United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 19

SEQ ID NO: 720322 - RNA, 16 nt, Haemophilus influenzae Rd
gcaacuucagcagcaa

SEQ ID NO: 720323 - RNA, 17 nt, Haemophilus influenzae Rd
gcaaggucaagaucgga

SEQ ID NO: 720324 - RNA, 19 nt, Haemophilus influenzae Rd
gcaaggauauuuccauagu

SEQ ID NO: 720325 - RNA, 14 nt, Haemophilus influenzae Rd
gcaagcguuaaugu

SEQ ID NO: 720326 - RNA, 14 nt, Haemophilus influenzae Rd
gcaagcuaccuugu

SEQ ID NO: 720327 - RNA, 18 nt, Haemophilus influenzae Rd
gcaagcgcguuuaucauc

SEQ ID NO: 720328 - RNA, 19 nt, Haemophilus influenzae Rd
gcaagcgcguuuaucaucu

SEQ ID NO: 720329 - RNA, 20 nt, Haemophilus influenzae Rd
gcaagaacuugauaaucauu

SEQ ID NO: 720330 - RNA, 23 nt, Haemophilus influenzae Rd
gcaagagaggcaccugaauaacg

SEQ ID NO: 720331 - RNA, 14 nt, Haemophilus influenzae Rd
gcaagauacuuuua

SEQ ID NO: 720332 - RNA, 19 nt, Haemophilus influenzae Rd
gcaagcaaacagcaauaaa

SEQ ID NO: 720333 - RNA, 15 nt, Haemophilus influenzae Rd
gcaagguuuccaaga

SEQ ID NO: 720334 - RNA, 16 nt, Haemophilus influenzae Rd
gcaaguaauuuaaaaa

SEQ ID NO: 720335 - RNA, 17 nt, Haemophilus influenzae Rd
gcaaguacucuugucaa

SEQ ID NO: 720336 - RNA, 16 nt, Haemophilus influenzae Rd
gcaagucuuaaucuua

SEQ ID NO: 720337 - RNA, 13 nt, Haemophilus influenzae Rd
gcaaguuguaaau

SEQ ID NO: 720338 - RNA, 22 nt, Haemophilus influenzae Rd
gcaauaaacagaaauauugucu

SEQ ID NO: 720339 - RNA, 17 nt, Haemophilus influenzae Rd
gcaauaaagcuugaaaa

SEQ ID NO: 720340 - RNA, 13 nt, Haemophilus influenzae Rd
gcaauaaauaaua

SEQ ID NO: 720341 - RNA, 15 nt, Haemophilus influenzae Rd
gcaauaaauaauagg

SEQ ID NO: 720342 - RNA, 20 nt, Haemophilus influenzae Rd
gcaauauaaucauugcuaag

SEQ ID NO: 720343 - RNA, 20 nt, Haemophilus influenzae Rd
gcaauauaaucuuuuacacc

SEQ ID NO: 720344 - RNA, 18 nt, Haemophilus influenzae Rd
gcaauauagucaaauaac

SEQ ID NO: 720345 - RNA, 14 nt, Haemophilus influenzae Rd
gcaauaucaauccc

SEQ ID NO: 720346 - RNA, 22 nt, Haemophilus influenzae Rd
gcaauaguuggguaaucaaauu

SEQ ID NO: 720347 - RNA, 22 nt, Haemophilus influenzae Rd
gcaauauggguucaauauaacu

SEQ ID NO: 720348 - RNA, 17 nt, Haemophilus influenzae Rd
gcaauaugauuagucua

SEQ ID NO: 720349 - RNA, 10 nt, Haemophilus influenzae Rd
gcaauaaucc

SEQ ID NO: 720350 - RNA, 13 nt, Haemophilus influenzae Rd
gcaauaauuaaga

SEQ ID NO: 720351 - RNA, 11 nt, Haemophilus influenzae Rd
gcaauaauauc

SEQ ID NO: 720352 - RNA, 13 nt, Haemophilus influenzae Rd
gcaauaccacagc

SEQ ID NO: 720353 - RNA, 13 nt, Haemophilus influenzae Rd
gcaaucguucuaa

SEQ ID NO: 720354 - RNA, 20 nt, Haemophilus influenzae Rd
gcaaugccagcgcuugcacc

SEQ ID NO: 720355 - RNA, 22 nt, Haemophilus influenzae Rd
gcaaugcaaaaguaaauaaucc

SEQ ID NO: 720356 - RNA, 15 nt, Haemophilus influenzae Rd
gcaaugccaaucuaa

SEQ ID NO: 720357 - RNA, 16 nt, Haemophilus influenzae Rd
gcaaucccaagcagcc

SEQ ID NO: 720358 - RNA, 14 nt, Haemophilus influenzae Rd
gcaaucagcaacau

SEQ ID NO: 720359 - RNA, 12 nt, Haemophilus influenzae Rd
gcaaucaacaca

SEQ ID NO: 720360 - RNA, 16 nt, Haemophilus influenzae Rd
gcaaucaacacaccua

SEQ ID NO: 720361 - RNA, 15 nt, Haemophilus influenzae Rd
gcaauucaaauuuuu

SEQ ID NO: 720362 - RNA, 15 nt, Haemophilus influenzae Rd
gcaauuaucaagcug

SEQ ID NO: 720363 - RNA, 14 nt, Haemophilus influenzae Rd
gcaauuaauggcaa

SEQ ID NO: 720364 - RNA, 22 nt, Haemophilus influenzae Rd
gcaauuaauucguccauucugu

SEQ ID NO: 720365 - RNA, 20 nt, Haemophilus influenzae Rd
gcaauuaaacuaauuccgac

SEQ ID NO: 720366 - RNA, 20 nt, Haemophilus influenzae Rd
gcaaugguucgagaaacuuu

SEQ ID NO: 720367 - RNA, 20 nt, Haemophilus influenzae Rd
gcaauguaguuggcauauca

SEQ ID NO: 720368 - RNA, 23 nt, Haemophilus influenzae Rd
gcaaugcuuuaaucauuuucacu

SEQ ID NO: 720369 - RNA, 23 nt, Haemophilus influenzae Rd
gcaauuguugcaccaauaauuga

SEQ ID NO: 720370 - RNA, 12 nt, Haemophilus influenzae Rd
gcaauugcuaaa

SEQ ID NO: 720371 - RNA, 21 nt, Haemophilus influenzae Rd
gcaauucgcccgaaacucacc

SEQ ID NO: 720372 - RNA, 15 nt, Haemophilus influenzae Rd
gcaauugaaacuaaa

SEQ ID NO: 720373 - RNA, 13 nt, Haemophilus influenzae Rd
gcaauuuuucuaa

SEQ ID NO: 720374 - RNA, 18 nt, Haemophilus influenzae Rd
gcaauuucaucacaucaa

SEQ ID NO: 720375 - RNA, 14 nt, Haemophilus influenzae Rd
gcaauuugaaaaga

SEQ ID NO: 720376 - RNA, 17 nt, Haemophilus influenzae Rd
gcaauuugaaaagaauu

SEQ ID NO: 720377 - RNA, 14 nt, Haemophilus influenzae Rd
gcaauuucugccau

SEQ ID NO: 720378 - RNA, 18 nt, Haemophilus influenzae Rd
gcacagggcugauaaauu

SEQ ID NO: 720379 - RNA, 16 nt, Haemophilus influenzae Rd
gcacaguuuccgcaaa

SEQ ID NO: 720380 - RNA, 19 nt, Haemophilus influenzae Rd
gcacauuaaucauuucaau

SEQ ID NO: 720381 - RNA, 19 nt, Haemophilus influenzae Rd
gcacauucugagcuuuucu

SEQ ID NO: 720382 - RNA, 14 nt, Haemophilus influenzae Rd
gcaccaaagcaaaa

SEQ ID NO: 720383 - RNA, 18 nt, Haemophilus influenzae Rd
gcacaucaaauucuaaaa

SEQ ID NO: 720384 - RNA, 17 nt, Haemophilus influenzae Rd
gcacaaagaaaaacuaa

SEQ ID NO: 720385 - RNA, 23 nt, Haemophilus influenzae Rd
gcacaagauuugccaaaaucacg

SEQ ID NO: 720386 - RNA, 21 nt, Haemophilus influenzae Rd
gcacaccaccugaugcuuuaa

SEQ ID NO: 720387 - RNA, 19 nt, Haemophilus influenzae Rd
gcacagaaaagauugcggc

SEQ ID NO: 720388 - RNA, 13 nt, Haemophilus influenzae Rd
gcaccgaaugugg

SEQ ID NO: 720389 - RNA, 16 nt, Haemophilus influenzae Rd
gcaccuaagucaggaa

SEQ ID NO: 720390 - RNA, 17 nt, Haemophilus influenzae Rd
gcaccagaaauagaagc

SEQ ID NO: 720391 - RNA, 17 nt, Haemophilus influenzae Rd
gcaccaaauuaaaaaua

SEQ ID NO: 720392 - RNA, 18 nt, Haemophilus influenzae Rd
gcaccacgaccuaagaaa

SEQ ID NO: 720393 - RNA, 16 nt, Haemophilus influenzae Rd
gcacccgcuguaauug

SEQ ID NO: 720394 - RNA, 13 nt, Haemophilus influenzae Rd
gcaccauuuaaac

SEQ ID NO: 720395 - RNA, 17 nt, Haemophilus influenzae Rd
gcaccauccaucaaauc

SEQ ID NO: 720396 - RNA, 12 nt, Haemophilus influenzae Rd
gcaccaucauag

SEQ ID NO: 720397 - RNA, 21 nt, Haemophilus influenzae Rd
gcaccaucguuaaaccaaaua

SEQ ID NO: 720398 - RNA, 22 nt, Haemophilus influenzae Rd
gcaccauaacuuaugaauaaua

SEQ ID NO: 720399 - RNA, 23 nt, Haemophilus influenzae Rd
gcaccagugguugcgauuuuugc

SEQ ID NO: 720400 - RNA, 22 nt, Haemophilus influenzae Rd
gcacgaucuaauugcggaaaaa

SEQ ID NO: 720401 - RNA, 22 nt, Haemophilus influenzae Rd
gcacgagcaggaaaaccacaag

SEQ ID NO: 720402 - RNA, 15 nt, Haemophilus influenzae Rd
gcaccuugagaaaua

SEQ ID NO: 720403 - RNA, 19 nt, Haemophilus influenzae Rd
gcaccuuuugaaaaacucg

SEQ ID NO: 720404 - RNA, 15 nt, Haemophilus influenzae Rd
gcaccuuaauuagau

SEQ ID NO: 720405 - RNA, 17 nt, Haemophilus influenzae Rd
gcaccuucaacauuuuu

SEQ ID NO: 720406 - RNA, 14 nt, Haemophilus influenzae Rd
gcacguaaugcaag

SEQ ID NO: 720407 - RNA, 12 nt, Haemophilus influenzae Rd
gcacucacaaua

SEQ ID NO: 720408 - RNA, 13 nt, Haemophilus influenzae Rd
gcacugaaauauc

SEQ ID NO: 720409 - RNA, 13 nt, Haemophilus influenzae Rd
gcacugaaauuca

SEQ ID NO: 720410 - RNA, 20 nt, Haemophilus influenzae Rd
gcacucuuucaaaaaucaaa

SEQ ID NO: 720411 - RNA, 19 nt, Haemophilus influenzae Rd
gcacugauuuuuuuauaau

SEQ ID NO: 720412 - RNA, 20 nt, Haemophilus influenzae Rd
gcacuaguucagcgauuuua

SEQ ID NO: 720413 - RNA, 17 nt, Haemophilus influenzae Rd
gcacugcggguucgguu

SEQ ID NO: 720414 - RNA, 21 nt, Haemophilus influenzae Rd
gcacuguugugaaguuuuuua

SEQ ID NO: 720415 - RNA, 14 nt, Haemophilus influenzae Rd
gcacuuaauaaaua

SEQ ID NO: 720416 - RNA, 17 nt, Haemophilus influenzae Rd
gcacuuaauaaauauug

SEQ ID NO: 720417 - RNA, 22 nt, Haemophilus influenzae Rd
gcacuuaaucacugaauuucau

SEQ ID NO: 720418 - RNA, 22 nt, Haemophilus influenzae Rd
gcacuucaauagauaaaucaaa

SEQ ID NO: 720419 - RNA, 12 nt, Haemophilus influenzae Rd
gcacuucaauuu

SEQ ID NO: 720420 - RNA, 16 nt, Haemophilus influenzae Rd
gcacuuagauuugaac

SEQ ID NO: 720421 - RNA, 15 nt, Haemophilus influenzae Rd
gcacuguaauaaagu

SEQ ID NO: 720422 - RNA, 15 nt, Haemophilus influenzae Rd
gcacugguucugggu

SEQ ID NO: 720423 - RNA, 19 nt, Haemophilus influenzae Rd
gcacuguuauauaaacaau

SEQ ID NO: 720424 - RNA, 20 nt, Haemophilus influenzae Rd
gcacuucagcauaauguuug

SEQ ID NO: 720425 - RNA, 14 nt, Haemophilus influenzae Rd
gcacuuccucaaug

SEQ ID NO: 720426 - RNA, 20 nt, Haemophilus influenzae Rd
gcacuugccacaacugaagc

SEQ ID NO: 720427 - RNA, 20 nt, Haemophilus influenzae Rd
gcacuuggguaaauauaaau

SEQ ID NO: 720428 - RNA, 21 nt, Haemophilus influenzae Rd
gcacuuuggaauauucuuuuu

SEQ ID NO: 720429 - RNA, 18 nt, Haemophilus influenzae Rd
gcacuuuguggcuuuuca

SEQ ID NO: 720430 - RNA, 17 nt, Haemophilus influenzae Rd
gcacuuuuaaaauuagu

SEQ ID NO: 720431 - RNA, 13 nt, Haemophilus influenzae Rd
gcacuuuuaacca

SEQ ID NO: 720432 - RNA, 16 nt, Haemophilus influenzae Rd
gcacuucuaugaagaa

SEQ ID NO: 720433 - RNA, 19 nt, Haemophilus influenzae Rd
gcacuuuccauaccauuua

SEQ ID NO: 720434 - RNA, 23 nt, Haemophilus influenzae Rd
gcacuuucgcggaauuucagaaa

SEQ ID NO: 720435 - RNA, 23 nt, Haemophilus influenzae Rd
gcacuuucuauacuaucugaucc

SEQ ID NO: 720436 - RNA, 23 nt, Haemophilus influenzae Rd
gcacuuuaaagaaauaaauuuau

SEQ ID NO: 720437 - RNA, 15 nt, Haemophilus influenzae Rd
gcacuuuagaaaaua

SEQ ID NO: 720438 - RNA, 19 nt, Haemophilus influenzae Rd
gcacuuuaucuagacaaaa

SEQ ID NO: 720439 - RNA, 15 nt, Haemophilus influenzae Rd
gcacuuuauuagaaa

SEQ ID NO: 720440 - RNA, 16 nt, Haemophilus influenzae Rd
gcacuuuauucaacgg

SEQ ID NO: 720441 - RNA, 14 nt, Haemophilus influenzae Rd
gcacuuucaucuac

SEQ ID NO: 720442 - RNA, 22 nt, Haemophilus influenzae Rd
gcacuuuuuaucuaaaaaagag

SEQ ID NO: 720443 - RNA, 15 nt, Haemophilus influenzae Rd
gcacuuuuuauucaa

SEQ ID NO: 720444 - RNA, 17 nt, Haemophilus influenzae Rd
gcacuuuuucuugaucu

SEQ ID NO: 720445 - RNA, 21 nt, Haemophilus influenzae Rd
gcacuuuuuucagucuauuau

SEQ ID NO: 720446 - RNA, 13 nt, Haemophilus influenzae Rd
gcacuuuuuucua

SEQ ID NO: 720447 - RNA, 14 nt, Haemophilus influenzae Rd
gcacuuuuuuucuu

SEQ ID NO: 720448 - RNA, 21 nt, Haemophilus influenzae Rd
gcacuuuuuuucuuauuucuu

SEQ ID NO: 720449 - RNA, 14 nt, Haemophilus influenzae Rd
gcacuuuuauauuu

SEQ ID NO: 720450 - RNA, 14 nt, Haemophilus influenzae Rd
gcacuuuuauccac

SEQ ID NO: 720451 - RNA, 13 nt, Haemophilus influenzae Rd
gcacuuuuccuuu

SEQ ID NO: 720452 - RNA, 13 nt, Haemophilus influenzae Rd
gcacuuuucuuua

SEQ ID NO: 720453 - RNA, 17 nt, Haemophilus influenzae Rd
gcacuuuugaucugcac

SEQ ID NO: 720454 - RNA, 18 nt, Haemophilus influenzae Rd
gcagaaaacucgacuuuu

SEQ ID NO: 720455 - RNA, 20 nt, Haemophilus influenzae Rd
gcagauuauugcacuaauaa

SEQ ID NO: 720456 - RNA, 22 nt, Haemophilus influenzae Rd
gcagauuauugcacuaauaaau

SEQ ID NO: 720457 - RNA, 21 nt, Haemophilus influenzae Rd
gcagaauuucgucaaaaaugu

SEQ ID NO: 720458 - RNA, 14 nt, Haemophilus influenzae Rd
gcagaaucagaaua

SEQ ID NO: 720459 - RNA, 22 nt, Haemophilus influenzae Rd
gcagauuuuuuauuaauaaacu

SEQ ID NO: 720460 - RNA, 20 nt, Haemophilus influenzae Rd
gcagauuuuuauaucuaaau

SEQ ID NO: 720461 - RNA, 19 nt, Haemophilus influenzae Rd
gcagcagcuucuucuuccu

SEQ ID NO: 720462 - RNA, 16 nt, Haemophilus influenzae Rd
gcagccauaaaugcua

SEQ ID NO: 720463 - RNA, 14 nt, Haemophilus influenzae Rd
gcagcccaaauaaa

SEQ ID NO: 720464 - RNA, 12 nt, Haemophilus influenzae Rd
gcagcauuuaaa

SEQ ID NO: 720465 - RNA, 19 nt, Haemophilus influenzae Rd
gcagguaauacacuuucac

SEQ ID NO: 720466 - RNA, 22 nt, Haemophilus influenzae Rd
gcagggauauugccuaauagaa

SEQ ID NO: 720467 - RNA, 20 nt, Haemophilus influenzae Rd
gcagggaaagucgcaguauu

SEQ ID NO: 720468 - RNA, 19 nt, Haemophilus influenzae Rd
gcaggugucacagcaagaa

SEQ ID NO: 720469 - RNA, 19 nt, Haemophilus influenzae Rd
gcaggugagccauuaagaa

SEQ ID NO: 720470 - RNA, 22 nt, Haemophilus influenzae Rd
gcaggcacaacgguugaaauug

SEQ ID NO: 720471 - RNA, 16 nt, Haemophilus influenzae Rd
gcagccgcaacggcag

SEQ ID NO: 720472 - RNA, 14 nt, Haemophilus influenzae Rd
gcagccuuguucug

SEQ ID NO: 720473 - RNA, 20 nt, Haemophilus influenzae Rd
gcaugcggaauaauuuuccu

SEQ ID NO: 720474 - RNA, 17 nt, Haemophilus influenzae Rd
gcaucguagucuuucaa

SEQ ID NO: 720475 - RNA, 22 nt, Haemophilus influenzae Rd
gcaucuuuuucuguaauauaug

SEQ ID NO: 720476 - RNA, 15 nt, Haemophilus influenzae Rd
gcauuaucaaaugcc

SEQ ID NO: 720477 - RNA, 15 nt, Haemophilus influenzae Rd
gcauuauguaauaua

SEQ ID NO: 720478 - RNA, 23 nt, Haemophilus influenzae Rd
gcauucucaauugcaaaaucaca

SEQ ID NO: 720479 - RNA, 19 nt, Haemophilus influenzae Rd
gcauucacuucuaaaacca

SEQ ID NO: 720480 - RNA, 13 nt, Haemophilus influenzae Rd
gcauuaaagcgag

SEQ ID NO: 720481 - RNA, 12 nt, Haemophilus influenzae Rd
gcauuaaaucaa

SEQ ID NO: 720482 - RNA, 22 nt, Haemophilus influenzae Rd
gcauuaaaagucuguuuaaaaa

SEQ ID NO: 720483 - RNA, 22 nt, Haemophilus influenzae Rd
gcauugaaaccuuguaaauacu

SEQ ID NO: 720484 - RNA, 15 nt, Haemophilus influenzae Rd
gcauuguaaaccaaa

SEQ ID NO: 720485 - RNA, 20 nt, Haemophilus influenzae Rd
gcauuguaaaccaaauuucu

SEQ ID NO: 720486 - RNA, 23 nt, Haemophilus influenzae Rd
gcauuguccacagcaaaagaaau

SEQ ID NO: 720487 - RNA, 16 nt, Haemophilus influenzae Rd
gcauuuuguaagcaac

SEQ ID NO: 720488 - RNA, 17 nt, Haemophilus influenzae Rd
gcauuuuuaauggauuc

SEQ ID NO: 720489 - RNA, 15 nt, Haemophilus influenzae Rd
gcauuuuuaauuuuu

SEQ ID NO: 720490 - RNA, 14 nt, Haemophilus influenzae Rd
gcauuuuuuauaaa

SEQ ID NO: 720491 - RNA, 15 nt, Haemophilus influenzae Rd
gcauuuuuuauaaau

SEQ ID NO: 720492 - RNA, 14 nt, Haemophilus influenzae Rd
gcauuuuuuauaag

SEQ ID NO: 720493 - RNA, 20 nt, Haemophilus influenzae Rd
gcauuuuugcaauuuaacau

SEQ ID NO: 720494 - RNA, 14 nt, Haemophilus influenzae Rd
gcauuuaaauaaaa

SEQ ID NO: 720495 - RNA, 21 nt, Haemophilus influenzae Rd
gcauuguuugcuaauguaguu

SEQ ID NO: 720496 - RNA, 13 nt, Haemophilus influenzae Rd
gccaaaaaagccc

SEQ ID NO: 720497 - RNA, 16 nt, Haemophilus influenzae Rd
gccaaaaaagcccaag

SEQ ID NO: 720498 - RNA, 15 nt, Haemophilus influenzae Rd
gcauuuuucauacaa

SEQ ID NO: 720499 - RNA, 18 nt, Haemophilus influenzae Rd
gcauccaucgacauacaa

SEQ ID NO: 720500 - RNA, 22 nt, Haemophilus influenzae Rd
gcaucagauuuuucgcauuuua

SEQ ID NO: 720501 - RNA, 13 nt, Haemophilus influenzae Rd
gcaucagccaccu

SEQ ID NO: 720502 - RNA, 18 nt, Haemophilus influenzae Rd
gcauaggugucaauccac

SEQ ID NO: 720503 - RNA, 22 nt, Haemophilus influenzae Rd
gcauaucaauuuggcucacaag

SEQ ID NO: 720504 - RNA, 13 nt, Haemophilus influenzae Rd
gcauauagacaac

SEQ ID NO: 720505 - RNA, 16 nt, Haemophilus influenzae Rd
gcauauaaaauaaaga

SEQ ID NO: 720506 - RNA, 18 nt, Haemophilus influenzae Rd
gcauauaaaauaaagaaa

SEQ ID NO: 720507 - RNA, 16 nt, Haemophilus influenzae Rd
gcaguauaaaccgcau

SEQ ID NO: 720508 - RNA, 18 nt, Haemophilus influenzae Rd
gcauacgugccgccacag

SEQ ID NO: 720509 - RNA, 17 nt, Haemophilus influenzae Rd
gcauacccgcuucuaag

SEQ ID NO: 720510 - RNA, 17 nt, Haemophilus influenzae Rd
gcauacgacggcuaaau

SEQ ID NO: 720511 - RNA, 19 nt, Haemophilus influenzae Rd
gccaccgguacagaugcca

SEQ ID NO: 720512 - RNA, 14 nt, Haemophilus influenzae Rd
gccacaggauaaaa

SEQ ID NO: 720513 - RNA, 12 nt, Haemophilus influenzae Rd
gccacgguaaau

SEQ ID NO: 720514 - RNA, 18 nt, Haemophilus influenzae Rd
gccaccuuuuguagaaaa

SEQ ID NO: 720515 - RNA, 20 nt, Haemophilus influenzae Rd
gccacugauuauauuguugc

SEQ ID NO: 720516 - RNA, 19 nt, Haemophilus influenzae Rd
gccaacuuagauuuucuua

SEQ ID NO: 720517 - RNA, 12 nt, Haemophilus influenzae Rd
gccaagacagua

SEQ ID NO: 720518 - RNA, 20 nt, Haemophilus influenzae Rd
gccaacguaagcaccaaugu

SEQ ID NO: 720519 - RNA, 16 nt, Haemophilus influenzae Rd
gccaacuucuacaccu

SEQ ID NO: 720520 - RNA, 16 nt, Haemophilus influenzae Rd
gccaaaccaucucgaa

SEQ ID NO: 720521 - RNA, 15 nt, Haemophilus influenzae Rd
gccaaaaucaucaca

SEQ ID NO: 720522 - RNA, 20 nt, Haemophilus influenzae Rd
gccaaugccaaauuucuccg

SEQ ID NO: 720523 - RNA, 20 nt, Haemophilus influenzae Rd
gccaaucuaagccuaagcca

SEQ ID NO: 720524 - RNA, 20 nt, Haemophilus influenzae Rd
gccaauuugcauauguuggu

SEQ ID NO: 720525 - RNA, 13 nt, Haemophilus influenzae Rd
gccaaucacaaug

SEQ ID NO: 720526 - RNA, 14 nt, Haemophilus influenzae Rd
gccaauagguugca

SEQ ID NO: 720527 - RNA, 22 nt, Haemophilus influenzae Rd
gccaauauggaacaguugaaaa

SEQ ID NO: 720528 - RNA, 15 nt, Haemophilus influenzae Rd
gccaauaaaauguua

SEQ ID NO: 720529 - RNA, 16 nt, Haemophilus influenzae Rd
gccaaguacaauuaaa

SEQ ID NO: 720530 - RNA, 15 nt, Haemophilus influenzae Rd
gccagucaucuaauu

SEQ ID NO: 720531 - RNA, 21 nt, Haemophilus influenzae Rd
gccagucauuuuuuacauuaa

SEQ ID NO: 720532 - RNA, 17 nt, Haemophilus influenzae Rd
gccaguaauuuuacagu

SEQ ID NO: 720533 - RNA, 18 nt, Haemophilus influenzae Rd
gccaguaagaucuucuac

SEQ ID NO: 720534 - RNA, 14 nt, Haemophilus influenzae Rd
gccacuggugcuga

SEQ ID NO: 720535 - RNA, 15 nt, Haemophilus influenzae Rd
gccauucguucccaa

SEQ ID NO: 720536 - RNA, 14 nt, Haemophilus influenzae Rd
gccauuuuuaaaaa

SEQ ID NO: 720537 - RNA, 15 nt, Haemophilus influenzae Rd
gccauuuuuaaaacg

SEQ ID NO: 720538 - RNA, 15 nt, Haemophilus influenzae Rd
gccauuuuucaaaau

SEQ ID NO: 720539 - RNA, 21 nt, Haemophilus influenzae Rd
gccauuuucgguuaaguaauc

SEQ ID NO: 720540 - RNA, 19 nt, Haemophilus influenzae Rd
gccaguuuagaaagcacuu

SEQ ID NO: 720541 - RNA, 15 nt, Haemophilus influenzae Rd
gccauaaaaaauuaa

SEQ ID NO: 720542 - RNA, 16 nt, Haemophilus influenzae Rd
gccauaaauaaaucaa

SEQ ID NO: 720543 - RNA, 17 nt, Haemophilus influenzae Rd
gccauaaauaaaucaau

SEQ ID NO: 720544 - RNA, 18 nt, Haemophilus influenzae Rd
gccauaggauuauucacc

SEQ ID NO: 720545 - RNA, 13 nt, Haemophilus influenzae Rd
gccauaauaauca

SEQ ID NO: 720546 - RNA, 18 nt, Haemophilus influenzae Rd
gccauaauaaucacaaca

SEQ ID NO: 720547 - RNA, 21 nt, Haemophilus influenzae Rd
gccauccaaaacuaauaaaag

SEQ ID NO: 720548 - RNA, 23 nt, Haemophilus influenzae Rd
gccaucacuauauaaugcacuau

SEQ ID NO: 720549 - RNA, 23 nt, Haemophilus influenzae Rd
gcccgaauucugagcaaauuacc

SEQ ID NO: 720550 - RNA, 18 nt, Haemophilus influenzae Rd
gccccuacuuuaaagaau

SEQ ID NO: 720551 - RNA, 14 nt, Haemophilus influenzae Rd
gccccugaagccaa

SEQ ID NO: 720552 - RNA, 18 nt, Haemophilus influenzae Rd
gcccagagcaccaaauua

SEQ ID NO: 720553 - RNA, 23 nt, Haemophilus influenzae Rd
gcccaagcgaacaaucgcuuggc

SEQ ID NO: 720554 - RNA, 14 nt, Haemophilus influenzae Rd
gcccaucuugccaa

SEQ ID NO: 720555 - RNA, 15 nt, Haemophilus influenzae Rd
gccccaauauuuuuc

SEQ ID NO: 720556 - RNA, 12 nt, Haemophilus influenzae Rd
gccccaaaagcu

SEQ ID NO: 720557 - RNA, 16 nt, Haemophilus influenzae Rd
gcccguguuucaauuc

SEQ ID NO: 720558 - RNA, 22 nt, Haemophilus influenzae Rd
gcccucaguauuguuuuaugaa

SEQ ID NO: 720559 - RNA, 15 nt, Haemophilus influenzae Rd
gcccuagugcaacca

SEQ ID NO: 720560 - RNA, 14 nt, Haemophilus influenzae Rd
gcccuauaccacca

SEQ ID NO: 720561 - RNA, 21 nt, Haemophilus influenzae Rd
gcccuacgccuaauucaucuu

SEQ ID NO: 720562 - RNA, 13 nt, Haemophilus influenzae Rd
gcccuuaauacug

SEQ ID NO: 720563 - RNA, 21 nt, Haemophilus influenzae Rd
aaagcuagaacaccgagaugc

SEQ ID NO: 720564 - RNA, 18 nt, Haemophilus influenzae Rd
gccgaauagauuuaaaca

SEQ ID NO: 720565 - RNA, 20 nt, Haemophilus influenzae Rd
aaagcuacaucaacaaaugu

SEQ ID NO: 720566 - RNA, 16 nt, Haemophilus influenzae Rd
aaagcgugagccaaug

SEQ ID NO: 720567 - RNA, 22 nt, Haemophilus influenzae Rd
aaagcgugugcuugcauuuaca

SEQ ID NO: 720568 - RNA, 19 nt, Haemophilus influenzae Rd
aaagcguugaaaauaaauu

SEQ ID NO: 720569 - RNA, 15 nt, Haemophilus influenzae Rd
aaagcguaaauuaug

SEQ ID NO: 720570 - RNA, 11 nt, Haemophilus influenzae Rd
gccgaagccau

SEQ ID NO: 720571 - RNA, 11 nt, Haemophilus influenzae Rd
gccgaaaaugg

SEQ ID NO: 720572 - RNA, 23 nt, Haemophilus influenzae Rd
gccgaaaaugguuacguuuuucc

SEQ ID NO: 720573 - RNA, 15 nt, Haemophilus influenzae Rd
gcccuuuuuaucuau

SEQ ID NO: 720574 - RNA, 17 nt, Haemophilus influenzae Rd
gcccuuuuuaucuauuu

SEQ ID NO: 720575 - RNA, 12 nt, Haemophilus influenzae Rd
gccgauuacuug

SEQ ID NO: 720576 - RNA, 19 nt, Haemophilus influenzae Rd
gccgaguaaauucaccaau

SEQ ID NO: 720577 - RNA, 16 nt, Haemophilus influenzae Rd
aaagcuauaaguaacu

SEQ ID NO: 720578 - RNA, 19 nt, Haemophilus influenzae Rd
aaagcuauaaguaacuuua

SEQ ID NO: 720579 - RNA, 17 nt, Haemophilus influenzae Rd
gccguaaguuaaaccaa

SEQ ID NO: 720580 - RNA, 16 nt, Haemophilus influenzae Rd
gccguacuguucuguu

SEQ ID NO: 720581 - RNA, 23 nt, Haemophilus influenzae Rd
gccuaaaacaagcgguuuuaauc

SEQ ID NO: 720582 - RNA, 14 nt, Haemophilus influenzae Rd
gccuaaacacauaa

SEQ ID NO: 720583 - RNA, 15 nt, Haemophilus influenzae Rd
gccuaaacacauaau

SEQ ID NO: 720584 - RNA, 18 nt, Haemophilus influenzae Rd
gccuaaacacauaauauu

SEQ ID NO: 720585 - RNA, 18 nt, Haemophilus influenzae Rd
gccuaaacgcucuuuaau

SEQ ID NO: 720586 - RNA, 16 nt, Haemophilus influenzae Rd
gccuaagauuuuaucu

SEQ ID NO: 720587 - RNA, 13 nt, Haemophilus influenzae Rd
gcgaguaaaauaa

SEQ ID NO: 720588 - RNA, 16 nt, Haemophilus influenzae Rd
gcgauagaaauaaaga

SEQ ID NO: 720589 - RNA, 19 nt, Haemophilus influenzae Rd
gcgaggcauucauucauuu

SEQ ID NO: 720590 - RNA, 20 nt, Haemophilus influenzae Rd
gcgaauagcuucugccagca

SEQ ID NO: 720591 - RNA, 22 nt, Haemophilus influenzae Rd
gcgaauagcuucugccagcaug

SEQ ID NO: 720592 - RNA, 11 nt, Haemophilus influenzae Rd
gcgaauuucuu

SEQ ID NO: 720593 - RNA, 21 nt, Haemophilus influenzae Rd
gcgaauuaaacggcucacauc

SEQ ID NO: 720594 - RNA, 18 nt, Haemophilus influenzae Rd
gcgacagaggggauaaaa

SEQ ID NO: 720595 - RNA, 21 nt, Haemophilus influenzae Rd
gcgacagaggggauaaaauaa

SEQ ID NO: 720596 - RNA, 18 nt, Haemophilus influenzae Rd
gcgaauuugguuuugcuc

SEQ ID NO: 720597 - RNA, 23 nt, Haemophilus influenzae Rd
gccugcgaugccgaaugaagaaa

SEQ ID NO: 720598 - RNA, 15 nt, Haemophilus influenzae Rd
gccugcgagcaguuu

SEQ ID NO: 720599 - RNA, 14 nt, Haemophilus influenzae Rd
gccugcauagaaug

SEQ ID NO: 720600 - RNA, 19 nt, Haemophilus influenzae Rd
gccugcauuaauaaucuaa

SEQ ID NO: 720601 - RNA, 20 nt, Haemophilus influenzae Rd
gccugcccaaguugugccaa

SEQ ID NO: 720602 - RNA, 14 nt, Haemophilus influenzae Rd
gccugagcguuaaa

SEQ ID NO: 720603 - RNA, 15 nt, Haemophilus influenzae Rd
gccugauccacuuac

SEQ ID NO: 720604 - RNA, 13 nt, Haemophilus influenzae Rd
gccugcaaauaag

SEQ ID NO: 720605 - RNA, 14 nt, Haemophilus influenzae Rd
gccugauucgccaa

SEQ ID NO: 720606 - RNA, 15 nt, Haemophilus influenzae Rd
gccuauuuuuagaaa

SEQ ID NO: 720607 - RNA, 14 nt, Haemophilus influenzae Rd
gccucuuuaucuau

SEQ ID NO: 720608 - RNA, 21 nt, Haemophilus influenzae Rd
gccucuuuaucuauugauucu

SEQ ID NO: 720609 - RNA, 21 nt, Haemophilus influenzae Rd
gccugaaaaagcuaaaaaaac

SEQ ID NO: 720610 - RNA, 14 nt, Haemophilus influenzae Rd
gccugaagccucug

SEQ ID NO: 720611 - RNA, 18 nt, Haemophilus influenzae Rd
gccuucauaaguccaagu

SEQ ID NO: 720612 - RNA, 17 nt, Haemophilus influenzae Rd
gccuuagccuguucuuc

SEQ ID NO: 720613 - RNA, 19 nt, Haemophilus influenzae Rd
gccuuagccuguucuucca

SEQ ID NO: 720614 - RNA, 11 nt, Haemophilus influenzae Rd
gccuucuucac

SEQ ID NO: 720615 - RNA, 14 nt, Haemophilus influenzae Rd
gccuugcauaaugc

SEQ ID NO: 720616 - RNA, 18 nt, Haemophilus influenzae Rd
gccuugugcauaaacaaa

SEQ ID NO: 720617 - RNA, 15 nt, Haemophilus influenzae Rd
gccuuguucugcagc

SEQ ID NO: 720618 - RNA, 19 nt, Haemophilus influenzae Rd
gccuuguucugcagcaaga

SEQ ID NO: 720619 - RNA, 18 nt, Haemophilus influenzae Rd
gcgcgugugaaauuccuu

SEQ ID NO: 720620 - RNA, 22 nt, Haemophilus influenzae Rd
gcggacuuuuucauuaucuuua

SEQ ID NO: 720621 - RNA, 15 nt, Haemophilus influenzae Rd
gcggauauggauauu

SEQ ID NO: 720622 - RNA, 12 nt, Haemophilus influenzae Rd
gcggauaaaaua

SEQ ID NO: 720623 - RNA, 18 nt, Haemophilus influenzae Rd
gcggauucgccaaagcua

SEQ ID NO: 720624 - RNA, 18 nt, Haemophilus influenzae Rd
gcggauuaagauggcuau

SEQ ID NO: 720625 - RNA, 23 nt, Haemophilus influenzae Rd
gcguacuuuuuuaccuucagcac

SEQ ID NO: 720626 - RNA, 18 nt, Haemophilus influenzae Rd
gcguagaaugcaaacauu

SEQ ID NO: 720627 - RNA, 14 nt, Haemophilus influenzae Rd
gcguagcugcaggg

SEQ ID NO: 720628 - RNA, 21 nt, Haemophilus influenzae Rd
gcguauuuuacggauuuauau

SEQ ID NO: 720629 - RNA, 19 nt, Haemophilus influenzae Rd
gcguaucacuuaaaccaaa

SEQ ID NO: 720630 - RNA, 23 nt, Haemophilus influenzae Rd
gcgugagcuugauuuucagcacu

SEQ ID NO: 720631 - RNA, 16 nt, Haemophilus influenzae Rd
gcgugaauauaagaaa

SEQ ID NO: 720632 - RNA, 20 nt, Haemophilus influenzae Rd
gcgugaauauaagaaaucuc

SEQ ID NO: 720633 - RNA, 14 nt, Haemophilus influenzae Rd
gcgugaaaagcugc

SEQ ID NO: 720634 - RNA, 14 nt, Haemophilus influenzae Rd
gcggugaaauuuua

SEQ ID NO: 720635 - RNA, 12 nt, Haemophilus influenzae Rd
gcguaauguuua

SEQ ID NO: 720636 - RNA, 16 nt, Haemophilus influenzae Rd
gcguaaaguuuuaaac

SEQ ID NO: 720637 - RNA, 20 nt, Haemophilus influenzae Rd
gcguaaaguuuuaaaccaag

SEQ ID NO: 720638 - RNA, 17 nt, Haemophilus influenzae Rd
gcguaaaacuauuaucu

SEQ ID NO: 720639 - RNA, 14 nt, Haemophilus influenzae Rd
gcgguuaaaauuuc

SEQ ID NO: 720640 - RNA, 21 nt, Haemophilus influenzae Rd
gcgguuaaauauuucaguauu

SEQ ID NO: 720641 - RNA, 18 nt, Haemophilus influenzae Rd
gcggucaucuacccacac

SEQ ID NO: 720642 - RNA, 16 nt, Haemophilus influenzae Rd
gcggucagcauaaaga

SEQ ID NO: 720643 - RNA, 22 nt, Haemophilus influenzae Rd
gcuaaucgcccuauuaaaacag

SEQ ID NO: 720644 - RNA, 14 nt, Haemophilus influenzae Rd
gcuaaguuugcuau

SEQ ID NO: 720645 - RNA, 15 nt, Haemophilus influenzae Rd
gcuaauccaauuuca

SEQ ID NO: 720646 - RNA, 19 nt, Haemophilus influenzae Rd
gcuaauccaauuucacaac

SEQ ID NO: 720647 - RNA, 12 nt, Haemophilus influenzae Rd
gcuaauaaaguu

SEQ ID NO: 720648 - RNA, 19 nt, Haemophilus influenzae Rd
gcuaacucugguucaaaau

SEQ ID NO: 720649 - RNA, 15 nt, Haemophilus influenzae Rd
gcuaacuggcaauac

SEQ ID NO: 720650 - RNA, 15 nt, Haemophilus influenzae Rd
gcuaacucaucaaca

SEQ ID NO: 720651 - RNA, 14 nt, Haemophilus influenzae Rd
gcuaagacauucau

SEQ ID NO: 720652 - RNA, 14 nt, Haemophilus influenzae Rd
gcuaacuucuucca

SEQ ID NO: 720653 - RNA, 20 nt, Haemophilus influenzae Rd
gcuaacauaucaauuacgua

SEQ ID NO: 720654 - RNA, 19 nt, Haemophilus influenzae Rd
gcuaaauuccccaagguau

SEQ ID NO: 720655 - RNA, 16 nt, Haemophilus influenzae Rd
gcuaacaaauaaugcc

SEQ ID NO: 720656 - RNA, 22 nt, Haemophilus influenzae Rd
gcuaacaaauuuaauauuucuu

SEQ ID NO: 720657 - RNA, 18 nt, Haemophilus influenzae Rd
gcuaaauuuuuggcugcu

SEQ ID NO: 720658 - RNA, 17 nt, Haemophilus influenzae Rd
gcuaaauuuuuuugcau

SEQ ID NO: 720659 - RNA, 12 nt, Haemophilus influenzae Rd
gcuaaauccaga

SEQ ID NO: 720660 - RNA, 18 nt, Haemophilus influenzae Rd
gcuaaaucuuauuaauaa

SEQ ID NO: 720661 - RNA, 18 nt, Haemophilus influenzae Rd
gcuaaaucaccuaaaucu

SEQ ID NO: 720662 - RNA, 21 nt, Haemophilus influenzae Rd
gcuaaaucaccuaaaucuuua

SEQ ID NO: 720663 - RNA, 20 nt, Haemophilus influenzae Rd
gcuaaaguucucaaaaaguu

SEQ ID NO: 720664 - RNA, 21 nt, Haemophilus influenzae Rd
gcuaaaguucucaaaaaguua

SEQ ID NO: 720665 - RNA, 23 nt, Haemophilus influenzae Rd
gcuaaaacagaaguugaaaauaa

SEQ ID NO: 720666 - RNA, 20 nt, Haemophilus influenzae Rd
gcuaaaggaauggcaaagaa

SEQ ID NO: 720667 - RNA, 22 nt, Haemophilus influenzae Rd
gcuaaaggaauggcaaagaaua

SEQ ID NO: 720668 - RNA, 19 nt, Haemophilus influenzae Rd
gcuacaucaacaaauguca

SEQ ID NO: 720669 - RNA, 16 nt, Haemophilus influenzae Rd
gcuacagcaaauccuu

SEQ ID NO: 720670 - RNA, 16 nt, Haemophilus influenzae Rd
gcuaauuuuuuuccaa

SEQ ID NO: 720671 - RNA, 17 nt, Haemophilus influenzae Rd
gcuacaaauaagccaau

SEQ ID NO: 720672 - RNA, 17 nt, Haemophilus influenzae Rd
gcuaauuuaagaaaaac

SEQ ID NO: 720673 - RNA, 21 nt, Haemophilus influenzae Rd
gcuaaugguugcauuugcuca

SEQ ID NO: 720674 - RNA, 22 nt, Haemophilus influenzae Rd
gcuaaugguugcauuugcucaa

SEQ ID NO: 720675 - RNA, 15 nt, Haemophilus influenzae Rd
gcuaauucugcuaaa

SEQ ID NO: 720676 - RNA, 13 nt, Haemophilus influenzae Rd
gcuacgccuugga

SEQ ID NO: 720677 - RNA, 16 nt, Haemophilus influenzae Rd
gcuacgguuauuuuuu

SEQ ID NO: 720678 - RNA, 14 nt, Haemophilus influenzae Rd
gcuacguuugcacg

SEQ ID NO: 720679 - RNA, 22 nt, Haemophilus influenzae Rd
gcuacuaucauccgcuuguaau

SEQ ID NO: 720680 - RNA, 20 nt, Haemophilus influenzae Rd
gcguuuaaagucaauggcug

SEQ ID NO: 720681 - RNA, 14 nt, Haemophilus influenzae Rd
gcguuuuucugggu

SEQ ID NO: 720682 - RNA, 14 nt, Haemophilus influenzae Rd
gcguuuuuuauaaa

SEQ ID NO: 720683 - RNA, 23 nt, Haemophilus influenzae Rd
gcguuuuuuauaaacuucugcaa

SEQ ID NO: 720684 - RNA, 12 nt, Haemophilus influenzae Rd
gcguuuuuucuu

SEQ ID NO: 720685 - RNA, 12 nt, Haemophilus influenzae Rd
gcguuuuaaaau

SEQ ID NO: 720686 - RNA, 20 nt, Haemophilus influenzae Rd
gcguuuuacaccaacacuug

SEQ ID NO: 720687 - RNA, 23 nt, Haemophilus influenzae Rd
gcguuugguucaucauuugcucu

SEQ ID NO: 720688 - RNA, 14 nt, Haemophilus influenzae Rd
gcguuggcagcuuu

SEQ ID NO: 720689 - RNA, 12 nt, Haemophilus influenzae Rd
gcguuaaaucaa

SEQ ID NO: 720690 - RNA, 23 nt, Haemophilus influenzae Rd
gcguguuucgcgugauuuaggga

SEQ ID NO: 720691 - RNA, 16 nt, Haemophilus influenzae Rd
gcguguguuuguaaac

SEQ ID NO: 720692 - RNA, 15 nt, Haemophilus influenzae Rd
gcguucauaucuuua

SEQ ID NO: 720693 - RNA, 22 nt, Haemophilus influenzae Rd
gcguucauaucuuuaccuguuu

SEQ ID NO: 720694 - RNA, 13 nt, Haemophilus influenzae Rd
gcguucaaaaaga

SEQ ID NO: 720695 - RNA, 19 nt, Haemophilus influenzae Rd
gcguucgauaacaauuuuu

SEQ ID NO: 720696 - RNA, 20 nt, Haemophilus influenzae Rd
gcguucgauaacaauuuuug

SEQ ID NO: 720697 - RNA, 19 nt, Haemophilus influenzae Rd
gcuauccaaccuaauaacg

SEQ ID NO: 720698 - RNA, 13 nt, Haemophilus influenzae Rd
gcuaguucuuccu

SEQ ID NO: 720699 - RNA, 14 nt, Haemophilus influenzae Rd
gcuaguucuuccuu

SEQ ID NO: 720700 - RNA, 12 nt, Haemophilus influenzae Rd
gcuauauuuucc

SEQ ID NO: 720701 - RNA, 16 nt, Haemophilus influenzae Rd
gcuauacaaaauuuug

SEQ ID NO: 720702 - RNA, 16 nt, Haemophilus influenzae Rd
gcuagggauuaagaau

SEQ ID NO: 720703 - RNA, 22 nt, Haemophilus influenzae Rd
gcuagucgucaucauuggggaa

SEQ ID NO: 720704 - RNA, 14 nt, Haemophilus influenzae Rd
gcuagaggcugaag

SEQ ID NO: 720705 - RNA, 20 nt, Haemophilus influenzae Rd
gcuacuuuuagcuaaaacua

SEQ ID NO: 720706 - RNA, 23 nt, Haemophilus influenzae Rd
gcuacuucuuugaauugagugaa

SEQ ID NO: 720707 - RNA, 19 nt, Haemophilus influenzae Rd
gcuauuacuuacuacuuug

SEQ ID NO: 720708 - RNA, 20 nt, Haemophilus influenzae Rd
gcuaucuuuugguaaauacu

SEQ ID NO: 720709 - RNA, 21 nt, Haemophilus influenzae Rd
gcuauuaguaauaaauucaaa

SEQ ID NO: 720710 - RNA, 20 nt, Haemophilus influenzae Rd
gcuauuaucauaaacaauuu

SEQ ID NO: 720711 - RNA, 21 nt, Haemophilus influenzae Rd
gcuauuaauuaacgcucaaaa

SEQ ID NO: 720712 - RNA, 15 nt, Haemophilus influenzae Rd
gcuaucugcuuuucu

SEQ ID NO: 720713 - RNA, 16 nt, Haemophilus influenzae Rd
gcuaucugcuuuucuu

SEQ ID NO: 720714 - RNA, 18 nt, Haemophilus influenzae Rd
gcuauggcaaugaauaaa

SEQ ID NO: 720715 - RNA, 13 nt, Haemophilus influenzae Rd
gcucaaaaucaag

SEQ ID NO: 720716 - RNA, 12 nt, Haemophilus influenzae Rd
gcucaaauaaau

SEQ ID NO: 720717 - RNA, 18 nt, Haemophilus influenzae Rd
gcuauuuucuaaugaaau

SEQ ID NO: 720718 - RNA, 19 nt, Haemophilus influenzae Rd
gcuauuuucuaaugaaauu

SEQ ID NO: 720719 - RNA, 21 nt, Haemophilus influenzae Rd
gcuauuuuauaauuaauaaaa

SEQ ID NO: 720720 - RNA, 16 nt, Haemophilus influenzae Rd
gcuauuuuauuuagaa

SEQ ID NO: 720721 - RNA, 22 nt, Haemophilus influenzae Rd
gcuauuuuucgcuacgccuugg

SEQ ID NO: 720722 - RNA, 15 nt, Haemophilus influenzae Rd
gcucaugauuauaaa

SEQ ID NO: 720723 - RNA, 18 nt, Haemophilus influenzae Rd
gcucagucgguagagcag

SEQ ID NO: 720724 - RNA, 19 nt, Haemophilus influenzae Rd
gcucagucgguuagagcag

SEQ ID NO: 720725 - RNA, 19 nt, Haemophilus influenzae Rd
gcucaguugguagagcacg

SEQ ID NO: 720726 - RNA, 20 nt, Haemophilus influenzae Rd
gcucagccaguuuucuagcu

SEQ ID NO: 720727 - RNA, 21 nt, Haemophilus influenzae Rd
gcucacggguuggaagaaugu

SEQ ID NO: 720728 - RNA, 24 nt, Haemophilus influenzae Rd
gcucaauaccuagcgggauaagau

SEQ ID NO: 720729 - RNA, 12 nt, Haemophilus influenzae Rd
gcucaauuucug

SEQ ID NO: 720730 - RNA, 22 nt, Haemophilus influenzae Rd
gcucacacugauuguggugaga

SEQ ID NO: 720731 - RNA, 13 nt, Haemophilus influenzae Rd
gcucacaagacgg

SEQ ID NO: 720732 - RNA, 19 nt, Haemophilus influenzae Rd
gcuccccuucauaagcccc

SEQ ID NO: 720733 - RNA, 21 nt, Haemophilus influenzae Rd
gcucgcuuuuguauuggguaa

SEQ ID NO: 720734 - RNA, 17 nt, Haemophilus influenzae Rd
gcucguuguagcccaau

SEQ ID NO: 720735 - RNA, 22 nt, Haemophilus influenzae Rd
gcucguauaauauuuucuuuua

SEQ ID NO: 720736 - RNA, 14 nt, Haemophilus influenzae Rd
gcucuguaaaacau

SEQ ID NO: 720737 - RNA, 23 nt, Haemophilus influenzae Rd
gcucuguaaaacauuucaucgca

SEQ ID NO: 720738 - RNA, 18 nt, Haemophilus influenzae Rd
gcucuucagcuucuucau

SEQ ID NO: 720739 - RNA, 19 nt, Haemophilus influenzae Rd
gcucuucaucaaaaugaaa

SEQ ID NO: 720740 - RNA, 15 nt, Haemophilus influenzae Rd
gcucugccacggcuu

SEQ ID NO: 720741 - RNA, 14 nt, Haemophilus influenzae Rd
gcucugaucacaau

SEQ ID NO: 720742 - RNA, 16 nt, Haemophilus influenzae Rd
gcucugaucacaauga

SEQ ID NO: 720743 - RNA, 17 nt, Haemophilus influenzae Rd
gcucugaucacaaugag

SEQ ID NO: 720744 - RNA, 16 nt, Haemophilus influenzae Rd
gcucuuucaaauaauu

SEQ ID NO: 720745 - RNA, 15 nt, Haemophilus influenzae Rd
gcucuuuaauuguuu

SEQ ID NO: 720746 - RNA, 14 nt, Haemophilus influenzae Rd
gcugaaaaauaaaa

SEQ ID NO: 720747 - RNA, 17 nt, Haemophilus influenzae Rd
gcugaaaaauaaaaaau

SEQ ID NO: 720748 - RNA, 18 nt, Haemophilus influenzae Rd
gcucuuuucggugcuuga

SEQ ID NO: 720749 - RNA, 18 nt, Haemophilus influenzae Rd
gcugaguaccaaaaggug

SEQ ID NO: 720750 - RNA, 19 nt, Haemophilus influenzae Rd
gcugauaaauuccuuccaa

SEQ ID NO: 720751 - RNA, 17 nt, Haemophilus influenzae Rd
gcugacguacaauuuca

SEQ ID NO: 720752 - RNA, 22 nt, Haemophilus influenzae Rd
gcugacguguaaaucuaaaaua

SEQ ID NO: 720753 - RNA, 19 nt, Haemophilus influenzae Rd
gcugcauaaagcucagcca

SEQ ID NO: 720754 - RNA, 21 nt, Haemophilus influenzae Rd
gcugcaguacuuucacaccca

SEQ ID NO: 720755 - RNA, 22 nt, Haemophilus influenzae Rd
gcugaucuugguagaaaauuug

SEQ ID NO: 720756 - RNA, 16 nt, Haemophilus influenzae Rd
gcugcaauucaacaac

SEQ ID NO: 720757 - RNA, 17 nt, Haemophilus influenzae Rd
gcuggcuuucuuuuuca

SEQ ID NO: 720758 - RNA, 22 nt, Haemophilus influenzae Rd
gcuggcuuucuuuuucaaguuc

SEQ ID NO: 720759 - RNA, 22 nt, Haemophilus influenzae Rd
gcugggaauacgcgucuuucug

SEQ ID NO: 720760 - RNA, 13 nt, Haemophilus influenzae Rd
gcuggguaagaag

SEQ ID NO: 720761 - RNA, 23 nt, Haemophilus influenzae Rd
aaagcuggauuaaauaaccaacu

SEQ ID NO: 720762 - RNA, 22 nt, Haemophilus influenzae Rd
gcuguaaugaucacuucauaaa

SEQ ID NO: 720763 - RNA, 12 nt, Haemophilus influenzae Rd
gcuguaaaucgc

SEQ ID NO: 720764 - RNA, 17 nt, Haemophilus influenzae Rd
gcugguuuuagcggcgc

SEQ ID NO: 720765 - RNA, 14 nt, Haemophilus influenzae Rd
gcugguuaaauuaa

SEQ ID NO: 720766 - RNA, 17 nt, Haemophilus influenzae Rd
gcugucgcuucuaauuc

SEQ ID NO: 720767 - RNA, 14 nt, Haemophilus influenzae Rd
gcugucuaauuuuu

SEQ ID NO: 720768 - RNA, 16 nt, Haemophilus influenzae Rd
gcugucuaauuuuuua

SEQ ID NO: 720769 - RNA, 15 nt, Haemophilus influenzae Rd
gcuguacaaagcacg

SEQ ID NO: 720770 - RNA, 14 nt, Haemophilus influenzae Rd
gcuguaccagcgau

SEQ ID NO: 720771 - RNA, 15 nt, Haemophilus influenzae Rd
gcugcugaauuuguu

SEQ ID NO: 720772 - RNA, 22 nt, Haemophilus influenzae Rd
gcugcuuuaauuucauucaaca

SEQ ID NO: 720773 - RNA, 21 nt, Haemophilus influenzae Rd
gcugcuuugagguaaaagugc

SEQ ID NO: 720774 - RNA, 18 nt, Haemophilus influenzae Rd
gcugcuugauauaauauu

SEQ ID NO: 720775 - RNA, 16 nt, Haemophilus influenzae Rd
gcuuuucccucuuuuu

SEQ ID NO: 720776 - RNA, 19 nt, Haemophilus influenzae Rd
gcuuuucccuuuucuuauu

SEQ ID NO: 720777 - RNA, 22 nt, Haemophilus influenzae Rd
gcuuuucgcgccaccuccaauu

SEQ ID NO: 720778 - RNA, 15 nt, Haemophilus influenzae Rd
gcuuuuggucuucuu

SEQ ID NO: 720779 - RNA, 13 nt, Haemophilus influenzae Rd
gcuuuucuuguaa

SEQ ID NO: 720780 - RNA, 15 nt, Haemophilus influenzae Rd
gcuuuuuacaacauu

SEQ ID NO: 720781 - RNA, 23 nt, Haemophilus influenzae Rd
gcuuuuuacaacauuaccuucug

SEQ ID NO: 720782 - RNA, 22 nt, Haemophilus influenzae Rd
gcuuuuugcacgguguuuucuu

SEQ ID NO: 720783 - RNA, 14 nt, Haemophilus influenzae Rd
gcuuuuuucuuaca

SEQ ID NO: 720784 - RNA, 16 nt, Haemophilus influenzae Rd
gcuuuuuucgcaccaa

SEQ ID NO: 720785 - RNA, 15 nt, Haemophilus influenzae Rd
gcuuuuuucaaugcu

SEQ ID NO: 720786 - RNA, 20 nt, Haemophilus influenzae Rd
gcuuuuuuauuuuauauauu

SEQ ID NO: 720787 - RNA, 21 nt, Haemophilus influenzae Rd
gcuuuuuuaucgaaacauaaa

SEQ ID NO: 720788 - RNA, 21 nt, Haemophilus influenzae Rd
gcuuuuuuacugcuugguucu

SEQ ID NO: 720789 - RNA, 11 nt, Haemophilus influenzae Rd
ggaaaaauuuu

SEQ ID NO: 720790 - RNA, 13 nt, Haemophilus influenzae Rd
gcuuuuuuuaauc

SEQ ID NO: 720791 - RNA, 21 nt, Haemophilus influenzae Rd
gcuuucuaacgcaaacuacaa

SEQ ID NO: 720792 - RNA, 14 nt, Haemophilus influenzae Rd
gcuuucuucagcca

SEQ ID NO: 720793 - RNA, 22 nt, Haemophilus influenzae Rd
gcuuucuuuuucaaguucagcu

SEQ ID NO: 720794 - RNA, 20 nt, Haemophilus influenzae Rd
gcuuugcugccacuucagcu

SEQ ID NO: 720795 - RNA, 18 nt, Haemophilus influenzae Rd
gcuuugauaaaugguuuc

SEQ ID NO: 720796 - RNA, 22 nt, Haemophilus influenzae Rd
gcuuugagccguuauauuuccu

SEQ ID NO: 720797 - RNA, 18 nt, Haemophilus influenzae Rd
gcuuuggcauaaccugcg

SEQ ID NO: 720798 - RNA, 14 nt, Haemophilus influenzae Rd
gcuuuuaaauuuuu

SEQ ID NO: 720799 - RNA, 15 nt, Haemophilus influenzae Rd
gcuuuuaaauuuuua

SEQ ID NO: 720800 - RNA, 16 nt, Haemophilus influenzae Rd
gcuuuuaacaaauaca

SEQ ID NO: 720801 - RNA, 15 nt, Haemophilus influenzae Rd
ggaaauauuuuaaua

SEQ ID NO: 720802 - RNA, 19 nt, Haemophilus influenzae Rd
ggaaauguuugaaggcaaa

SEQ ID NO: 720803 - RNA, 19 nt, Haemophilus influenzae Rd
ggaaaggcauuagauuuga

SEQ ID NO: 720804 - RNA, 20 nt, Haemophilus influenzae Rd
ggaaauaacaaaaacaauca

SEQ ID NO: 720805 - RNA, 11 nt, Haemophilus influenzae Rd
ggaaaguguag

SEQ ID NO: 720806 - RNA, 18 nt, Haemophilus influenzae Rd
ggaaagugcagcccaaau

SEQ ID NO: 720807 - RNA, 21 nt, Haemophilus influenzae Rd
ggaaagugcgguaauuauaga

SEQ ID NO: 720808 - RNA, 10 nt, Haemophilus influenzae Rd
ggaaaccagc

SEQ ID NO: 720809 - RNA, 16 nt, Haemophilus influenzae Rd
ggaaaaugcuuauaaa

SEQ ID NO: 720810 - RNA, 20 nt, Haemophilus influenzae Rd
ggaaaauuuggaauaaacuc

SEQ ID NO: 720811 - RNA, 16 nt, Haemophilus influenzae Rd
ggaaaaguaagaaacu

SEQ ID NO: 720812 - RNA, 18 nt, Haemophilus influenzae Rd
ggaaaagccuuaaccugc

SEQ ID NO: 720813 - RNA, 14 nt, Haemophilus influenzae Rd
ggaagaugaaagug

SEQ ID NO: 720814 - RNA, 18 nt, Haemophilus influenzae Rd
ggaagcauuucuaaagga

SEQ ID NO: 720815 - RNA, 15 nt, Haemophilus influenzae Rd
ggaauaucauuagca

SEQ ID NO: 720816 - RNA, 23 nt, Haemophilus influenzae Rd
ggaaggcuaccugauaccaccac

SEQ ID NO: 720817 - RNA, 21 nt, Haemophilus influenzae Rd
ggaauccagcguuaaguaauu

SEQ ID NO: 720818 - RNA, 14 nt, Haemophilus influenzae Rd
ggacauaagagaac

SEQ ID NO: 720819 - RNA, 14 nt, Haemophilus influenzae Rd
aaagggauuuuaau

SEQ ID NO: 720820 - RNA, 15 nt, Haemophilus influenzae Rd
aaaguaaaugauaaa

SEQ ID NO: 720821 - RNA, 12 nt, Haemophilus influenzae Rd
aaaguaaaauau

SEQ ID NO: 720822 - RNA, 14 nt, Haemophilus influenzae Rd
aaaguaaaaauaaa

SEQ ID NO: 720823 - RNA, 13 nt, Haemophilus influenzae Rd
ggacuaaaccuau

SEQ ID NO: 720824 - RNA, 15 nt, Haemophilus influenzae Rd
ggacuaaacuuuuaa

SEQ ID NO: 720825 - RNA, 16 nt, Haemophilus influenzae Rd
ggacguuuuaauaguu

SEQ ID NO: 720826 - RNA, 17 nt, Haemophilus influenzae Rd
ggagauacgaaauagcg

SEQ ID NO: 720827 - RNA, 18 nt, Haemophilus influenzae Rd
ggaggaucgauuaaaauu

SEQ ID NO: 720828 - RNA, 20 nt, Haemophilus influenzae Rd
ggaucacccauuaaauaaaa

SEQ ID NO: 720829 - RNA, 16 nt, Haemophilus influenzae Rd
ggauaucuuguugaua

SEQ ID NO: 720830 - RNA, 16 nt, Haemophilus influenzae Rd
ggaguggacauaagag

SEQ ID NO: 720831 - RNA, 17 nt, Haemophilus influenzae Rd
ggcaaacgcucuuuaau

SEQ ID NO: 720832 - RNA, 14 nt, Haemophilus influenzae Rd
ggcaaacaaaauaa

SEQ ID NO: 720833 - RNA, 17 nt, Haemophilus influenzae Rd
ggauuuauuauuuaaua

SEQ ID NO: 720834 - RNA, 17 nt, Haemophilus influenzae Rd
ggauuuaaaaucccucg

SEQ ID NO: 720835 - RNA, 18 nt, Haemophilus influenzae Rd
ggauuggaccguuuggua

SEQ ID NO: 720836 - RNA, 20 nt, Haemophilus influenzae Rd
ggauuggaccguuugguaaa

SEQ ID NO: 720837 - RNA, 12 nt, Haemophilus influenzae Rd
ggcaaagguuuu

SEQ ID NO: 720838 - RNA, 20 nt, Haemophilus influenzae Rd
ggcaaauaaaauagacaaua

SEQ ID NO: 720839 - RNA, 12 nt, Haemophilus influenzae Rd
ggcaaauagcaa

SEQ ID NO: 720840 - RNA, 17 nt, Haemophilus influenzae Rd
ggcacaacgguugaaau

SEQ ID NO: 720841 - RNA, 14 nt, Haemophilus influenzae Rd
ggcaauuggauaaa

SEQ ID NO: 720842 - RNA, 21 nt, Haemophilus influenzae Rd
ggcaauucgugaagugauucg

SEQ ID NO: 720843 - RNA, 13 nt, Haemophilus influenzae Rd
ggcacaucaaauu

SEQ ID NO: 720844 - RNA, 18 nt, Haemophilus influenzae Rd
ggcaauaauguugcugau

SEQ ID NO: 720845 - RNA, 17 nt, Haemophilus influenzae Rd
ggcaaugaauaaacaga

SEQ ID NO: 720846 - RNA, 13 nt, Haemophilus influenzae Rd
ggcaauccugcuu

SEQ ID NO: 720847 - RNA, 16 nt, Haemophilus influenzae Rd
ggcaccuuuuugcucu

SEQ ID NO: 720848 - RNA, 23 nt, Haemophilus influenzae Rd
ggcaccguuccuggauaaagugu

SEQ ID NO: 720849 - RNA, 11 nt, Haemophilus influenzae Rd
ggcacuuugca

SEQ ID NO: 720850 - RNA, 12 nt, Haemophilus influenzae Rd
ggcauagaaaag

SEQ ID NO: 720851 - RNA, 15 nt, Haemophilus influenzae Rd
ggcauaauuugguua

SEQ ID NO: 720852 - RNA, 16 nt, Haemophilus influenzae Rd
ggcaugaauaucuucc

SEQ ID NO: 720853 - RNA, 18 nt, Haemophilus influenzae Rd
ggcaguuuggaaagagua

SEQ ID NO: 720854 - RNA, 21 nt, Haemophilus influenzae Rd
ggcauuuuguaagcaacacag

SEQ ID NO: 720855 - RNA, 15 nt, Haemophilus influenzae Rd
aaagugcggaaaauu

SEQ ID NO: 720856 - RNA, 16 nt, Haemophilus influenzae Rd
aaagugcggaaaauuu

SEQ ID NO: 720857 - RNA, 22 nt, Haemophilus influenzae Rd
aaagugcggaaaauuuuccgca

SEQ ID NO: 720858 - RNA, 17 nt, Haemophilus influenzae Rd
aaagugcgguaaaaaaa

SEQ ID NO: 720859 - RNA, 18 nt, Haemophilus influenzae Rd
aaagugcgguaaaaauua

SEQ ID NO: 720860 - RNA, 20 nt, Haemophilus influenzae Rd
aaagugcgguaaaaauuaac

SEQ ID NO: 720861 - RNA, 17 nt, Haemophilus influenzae Rd
aaagugcgguaaaauca

SEQ ID NO: 720862 - RNA, 16 nt, Haemophilus influenzae Rd
aaagugcgguaaaauu

SEQ ID NO: 720863 - RNA, 17 nt, Haemophilus influenzae Rd
aaagugcgguaaauuuu

SEQ ID NO: 720864 - RNA, 20 nt, Haemophilus influenzae Rd
aaagugcgguaaauuuuaaa

SEQ ID NO: 720865 - RNA, 21 nt, Haemophilus influenzae Rd
aaagugcgguaaauuuuaaaa

SEQ ID NO: 720866 - RNA, 20 nt, Haemophilus influenzae Rd
aaagugcgguaagaaaauca

SEQ ID NO: 720867 - RNA, 22 nt, Haemophilus influenzae Rd
aaagugcgguaagaaaaucaac

SEQ ID NO: 720868 - RNA, 16 nt, Haemophilus influenzae Rd
aaagugcgguaauuuu

SEQ ID NO: 720869 - RNA, 19 nt, Haemophilus influenzae Rd
aaagugcggucaacauaaa

SEQ ID NO: 720870 - RNA, 20 nt, Haemophilus influenzae Rd
aaagugcggucaauaaaaau

SEQ ID NO: 720871 - RNA, 21 nt, Haemophilus influenzae Rd
aaagugcggucaauaaaaaua

SEQ ID NO: 720872 - RNA, 14 nt, Haemophilus influenzae Rd
aaagugcggucauu

SEQ ID NO: 720873 - RNA, 22 nt, Haemophilus influenzae Rd
aaagugcggucugaaaaucaaa

SEQ ID NO: 720874 - RNA, 19 nt, Haemophilus influenzae Rd
aaagugcggugaaauuuca

SEQ ID NO: 720875 - RNA, 18 nt, Haemophilus influenzae Rd
aaagugcggugagauuuc

SEQ ID NO: 720876 - RNA, 22 nt, Haemophilus influenzae Rd
aaagugcgguuaaaauuuaaua

SEQ ID NO: 720877 - RNA, 16 nt, Haemophilus influenzae Rd
aaagugcgguuaauuu

SEQ ID NO: 720878 - RNA, 20 nt, Haemophilus influenzae Rd
aaagugcgguuaauuuuuac

SEQ ID NO: 720879 - RNA, 23 nt, Haemophilus influenzae Rd
aaagugcgguuaauuuuuuguuc

SEQ ID NO: 720880 - RNA, 19 nt, Haemophilus influenzae Rd
aaagugcgguugaaauuuc

SEQ ID NO: 720881 - RNA, 20 nt, Haemophilus influenzae Rd
aaagugcgguugauuuuccu

SEQ ID NO: 720882 - RNA, 21 nt, Haemophilus influenzae Rd
aaagugcgguuguuuuugcca

SEQ ID NO: 720883 - RNA, 22 nt, Haemophilus influenzae Rd
aaaguggagaaacauuuuuccc

SEQ ID NO: 720884 - RNA, 20 nt, Haemophilus influenzae Rd
aaaguguagcaaguccaagu

SEQ ID NO: 720885 - RNA, 16 nt, Haemophilus influenzae Rd
aaagugcagauuuuuu

SEQ ID NO: 720886 - RNA, 13 nt, Haemophilus influenzae Rd
ggcccaacagaaa

SEQ ID NO: 720887 - RNA, 14 nt, Haemophilus influenzae Rd
aaaguguucaaugu

SEQ ID NO: 720888 - RNA, 23 nt, Haemophilus influenzae Rd
aaaguuaggcuaagguuuaacug

SEQ ID NO: 720889 - RNA, 20 nt, Haemophilus influenzae Rd
aaaguuaaucaaacuuuuag

SEQ ID NO: 720890 - RNA, 15 nt, Haemophilus influenzae Rd
aaaguuacucuugga

SEQ ID NO: 720891 - RNA, 19 nt, Haemophilus influenzae Rd
aaaguuccuagaauuaaaa

SEQ ID NO: 720892 - RNA, 20 nt, Haemophilus influenzae Rd
aaaguugauccguugucaca

SEQ ID NO: 720893 - RNA, 18 nt, Haemophilus influenzae Rd
aaaguugaauauuuuguu

SEQ ID NO: 720894 - RNA, 23 nt, Haemophilus influenzae Rd
aaaguugagacaaauuuuauaua

SEQ ID NO: 720895 - RNA, 14 nt, Haemophilus influenzae Rd
aaaguuuaacuuuc

SEQ ID NO: 720896 - RNA, 18 nt, Haemophilus influenzae Rd
aaaguuguuucauaagau

SEQ ID NO: 720897 - RNA, 20 nt, Haemophilus influenzae Rd
aaaguuguuuugcuuuugca

SEQ ID NO: 720898 - RNA, 20 nt, Haemophilus influenzae Rd
aaaguuggcuuacagcaaaa

SEQ ID NO: 720899 - RNA, 19 nt, Haemophilus influenzae Rd
aaaguuggacuaaacaacu

SEQ ID NO: 720900 - RNA, 13 nt, Haemophilus influenzae Rd
aaaguuggauuaa

SEQ ID NO: 720901 - RNA, 15 nt, Haemophilus influenzae Rd
aaaguuuuuucaaua

SEQ ID NO: 720902 - RNA, 19 nt, Haemophilus influenzae Rd
aaaguuuuccgacaacacu

SEQ ID NO: 720903 - RNA, 16 nt, Haemophilus influenzae Rd
aaaguuuuaaaccaag

SEQ ID NO: 720904 - RNA, 23 nt, Haemophilus influenzae Rd
aaaguuuccuucgccauuuuuaa

SEQ ID NO: 720905 - RNA, 23 nt, Haemophilus influenzae Rd
aaaguuucuguugauuuaucaua

SEQ ID NO: 720906 - RNA, 18 nt, Haemophilus influenzae Rd
aaaguuugauuaacuuuc

SEQ ID NO: 720907 - RNA, 21 nt, Haemophilus influenzae Rd
aaaguuugcaacauauggaua

SEQ ID NO: 720908 - RNA, 13 nt, Haemophilus influenzae Rd
ggcgaaggcaaau

SEQ ID NO: 720909 - RNA, 22 nt, Haemophilus influenzae Rd
ggcgaaccuuucauauaaauaa

SEQ ID NO: 720910 - RNA, 13 nt, Haemophilus influenzae Rd
aaauaaagcccug

SEQ ID NO: 720911 - RNA, 14 nt, Haemophilus influenzae Rd
aaauaaaggauuaa

SEQ ID NO: 720912 - RNA, 13 nt, Haemophilus influenzae Rd
aaauaaauaaaau

SEQ ID NO: 720913 - RNA, 15 nt, Haemophilus influenzae Rd
aaauaaauaaaauau

SEQ ID NO: 720914 - RNA, 17 nt, Haemophilus influenzae Rd
aaauaaacuacuucuaa

SEQ ID NO: 720915 - RNA, 15 nt, Haemophilus influenzae Rd
aaauaaacucauuga

SEQ ID NO: 720916 - RNA, 22 nt, Haemophilus influenzae Rd
aaauaaagauagguacaaguaa

SEQ ID NO: 720917 - RNA, 21 nt, Haemophilus influenzae Rd
aaauaaagaagaaaaucuuua

SEQ ID NO: 720918 - RNA, 18 nt, Haemophilus influenzae Rd
aaauaaaucacacaguua

SEQ ID NO: 720919 - RNA, 12 nt, Haemophilus influenzae Rd
aaauaaauaaua

SEQ ID NO: 720920 - RNA, 13 nt, Haemophilus influenzae Rd
aaauaaauaauag

SEQ ID NO: 720921 - RNA, 21 nt, Haemophilus influenzae Rd
aaauaaauggucaaugccaaa

SEQ ID NO: 720922 - RNA, 21 nt, Haemophilus influenzae Rd
aaauaaauuaacuuaucuaaa

SEQ ID NO: 720923 - RNA, 13 nt, Haemophilus influenzae Rd
aaauaaaauuaca

SEQ ID NO: 720924 - RNA, 20 nt, Haemophilus influenzae Rd
aaauaaaauucgcacacuuu

SEQ ID NO: 720925 - RNA, 17 nt, Haemophilus influenzae Rd
aaauaaacaaacuuuca

SEQ ID NO: 720926 - RNA, 20 nt, Haemophilus influenzae Rd
aaauaaacauuuuucauuuu

SEQ ID NO: 720927 - RNA, 20 nt, Haemophilus influenzae Rd
aaauaaaccgcaucaaaauu

SEQ ID NO: 720928 - RNA, 18 nt, Haemophilus influenzae Rd
aaauaaaauagacaauau

SEQ ID NO: 720929 - RNA, 13 nt, Haemophilus influenzae Rd
aaauaaaaugccg

SEQ ID NO: 720930 - RNA, 14 nt, Haemophilus influenzae Rd
aaauaaaauauuug

SEQ ID NO: 720931 - RNA, 12 nt, Haemophilus influenzae Rd
aaauaaaacaag

SEQ ID NO: 720932 - RNA, 15 nt, Haemophilus influenzae Rd
aaauaaaaagugggu

SEQ ID NO: 720933 - RNA, 12 nt, Haemophilus influenzae Rd
aaauaaaaacau

SEQ ID NO: 720934 - RNA, 16 nt, Haemophilus influenzae Rd
aaauaaaaaugaugau

SEQ ID NO: 720935 - RNA, 14 nt, Haemophilus influenzae Rd
aaauaaaaaauaaa

SEQ ID NO: 720936 - RNA, 14 nt, Haemophilus influenzae Rd
aaauaaaaaauauu

SEQ ID NO: 720937 - RNA, 19 nt, Haemophilus influenzae Rd
aaauacggugaaauuucac

SEQ ID NO: 720938 - RNA, 20 nt, Haemophilus influenzae Rd
aaauacggugaaauuucacc

SEQ ID NO: 720939 - RNA, 18 nt, Haemophilus influenzae Rd
aaauacuaauaggaguaa

SEQ ID NO: 720940 - RNA, 21 nt, Haemophilus influenzae Rd
aaauacuaauaggaguaaaaa

SEQ ID NO: 720941 - RNA, 14 nt, Haemophilus influenzae Rd
aaauacaauuuuuu

SEQ ID NO: 720942 - RNA, 21 nt, Haemophilus influenzae Rd
aaauacaauuuuuuucaagca

SEQ ID NO: 720943 - RNA, 15 nt, Haemophilus influenzae Rd
aaauacacaaaucac

SEQ ID NO: 720944 - RNA, 13 nt, Haemophilus influenzae Rd
aaauacacuucua

SEQ ID NO: 720945 - RNA, 15 nt, Haemophilus influenzae Rd
ggcgagggauuuuaa

SEQ ID NO: 720946 - RNA, 16 nt, Haemophilus influenzae Rd
ggcgugaaaaauauca

SEQ ID NO: 720947 - RNA, 17 nt, Haemophilus influenzae Rd
ggcgugaaaaauaucac

SEQ ID NO: 720948 - RNA, 21 nt, Haemophilus influenzae Rd
ggcuaaaccgauuuugacuuu

SEQ ID NO: 720949 - RNA, 15 nt, Haemophilus influenzae Rd
ggcuaaauucacuga

SEQ ID NO: 720950 - RNA, 16 nt, Haemophilus influenzae Rd
ggcuaacaaauaaugc

SEQ ID NO: 720951 - RNA, 19 nt, Haemophilus influenzae Rd
ggcuacgaaccgagcgguc

SEQ ID NO: 720952 - RNA, 21 nt, Haemophilus influenzae Rd
ggcucaaaucuacuaaaauaa

SEQ ID NO: 720953 - RNA, 13 nt, Haemophilus influenzae Rd
ggcuaucugcuuu

SEQ ID NO: 720954 - RNA, 14 nt, Haemophilus influenzae Rd
ggcuauuuaagccu

SEQ ID NO: 720955 - RNA, 23 nt, Haemophilus influenzae Rd
ggcuauuugaaacugguuuauca

SEQ ID NO: 720956 - RNA, 14 nt, Haemophilus influenzae Rd
ggcuaguucuuccu

SEQ ID NO: 720957 - RNA, 17 nt, Haemophilus influenzae Rd
ggcuaguuuguuuauga

SEQ ID NO: 720958 - RNA, 13 nt, Haemophilus influenzae Rd
ggcguaaauccug

SEQ ID NO: 720959 - RNA, 20 nt, Haemophilus influenzae Rd
ggcguaaaccguggcauaau

SEQ ID NO: 720960 - RNA, 19 nt, Haemophilus influenzae Rd
ggcgguuugaaauuuaugu

SEQ ID NO: 720961 - RNA, 23 nt, Haemophilus influenzae Rd
gaagaauuaguuuuuuauuucua

SEQ ID NO: 720962 - RNA, 12 nt, Haemophilus influenzae Rd
gaagaaguaaaa

SEQ ID NO: 720963 - RNA, 18 nt, Haemophilus influenzae Rd
gaagaaguaaaaagaaaa

SEQ ID NO: 720964 - RNA, 16 nt, Haemophilus influenzae Rd
gaacaugcguuuucgc

SEQ ID NO: 720965 - RNA, 16 nt, Haemophilus influenzae Rd
gaagcuaauucuucua

SEQ ID NO: 720966 - RNA, 21 nt, Haemophilus influenzae Rd
gaagcagcuggcgguuugaaa

SEQ ID NO: 720967 - RNA, 18 nt, Haemophilus influenzae Rd
gaaguuuaagaaaagugc

SEQ ID NO: 720968 - RNA, 21 nt, Haemophilus influenzae Rd
gaaguuggagauuuuuuagga

SEQ ID NO: 720969 - RNA, 18 nt, Haemophilus influenzae Rd
gaaguuguaauaaagcug

SEQ ID NO: 720970 - RNA, 20 nt, Haemophilus influenzae Rd
gaaguuaauggguuaaaagc

SEQ ID NO: 720971 - RNA, 21 nt, Haemophilus influenzae Rd
gaaguuaaaacuugaauggcu

SEQ ID NO: 720972 - RNA, 17 nt, Haemophilus influenzae Rd
aaagauacacucacuuu

SEQ ID NO: 720973 - RNA, 22 nt, Haemophilus influenzae Rd
aaagauacacucacuuuuccuu

SEQ ID NO: 720974 - RNA, 17 nt, Haemophilus influenzae Rd
aaagauaguaauguucu

SEQ ID NO: 720975 - RNA, 18 nt, Haemophilus influenzae Rd
aaagauaguaauguucua

SEQ ID NO: 720976 - RNA, 19 nt, Haemophilus influenzae Rd
gaauaaugugcaaaaauau

SEQ ID NO: 720977 - RNA, 16 nt, Haemophilus influenzae Rd
gaauaacccuuguaac

SEQ ID NO: 720978 - RNA, 15 nt, Haemophilus influenzae Rd
gaauaauccuucuuc

SEQ ID NO: 720979 - RNA, 13 nt, Haemophilus influenzae Rd
gaauaacaacaaa

SEQ ID NO: 720980 - RNA, 18 nt, Haemophilus influenzae Rd
gaauaacacaccaacaac

SEQ ID NO: 720981 - RNA, 21 nt, Haemophilus influenzae Rd
gaauaaaugaccgcucuuuaa

SEQ ID NO: 720982 - RNA, 21 nt, Haemophilus influenzae Rd
gaauaaaugcaucauuaauac

SEQ ID NO: 720983 - RNA, 17 nt, Haemophilus influenzae Rd
gaauaaauugaauaucu

SEQ ID NO: 720984 - RNA, 13 nt, Haemophilus influenzae Rd
gaauaauuuugga

SEQ ID NO: 720985 - RNA, 16 nt, Haemophilus influenzae Rd
gaauaauuuuuauaau

SEQ ID NO: 720986 - RNA, 15 nt, Haemophilus influenzae Rd
gaauaauuaaaucuu

SEQ ID NO: 720987 - RNA, 24 nt, Haemophilus influenzae Rd
gaauaauuuccaacacauuaucau

SEQ ID NO: 720988 - RNA, 15 nt, Haemophilus influenzae Rd
gaauacgaucugcau

SEQ ID NO: 720989 - RNA, 16 nt, Haemophilus influenzae Rd
gaauacgaucugcauc

SEQ ID NO: 720990 - RNA, 21 nt, Haemophilus influenzae Rd
gaauacgcccauugaaauaac

SEQ ID NO: 720991 - RNA, 16 nt, Haemophilus influenzae Rd
gaagcugaauaaaaga

SEQ ID NO: 720992 - RNA, 21 nt, Haemophilus influenzae Rd
gaaggcuaccugauaccacca

SEQ ID NO: 720993 - RNA, 20 nt, Haemophilus influenzae Rd
gaagugcggaugaaauuuuu

SEQ ID NO: 720994 - RNA, 23 nt, Haemophilus influenzae Rd
gaagugcggucauuuuucaccgc

SEQ ID NO: 720995 - RNA, 18 nt, Haemophilus influenzae Rd
gaagugcguucauauuug

SEQ ID NO: 720996 - RNA, 21 nt, Haemophilus influenzae Rd
gaauauuaucuccaagaauau

SEQ ID NO: 720997 - RNA, 19 nt, Haemophilus influenzae Rd
gaauauugaucaucucgac

SEQ ID NO: 720998 - RNA, 21 nt, Haemophilus influenzae Rd
gaauauugguagcuaaaaaua

SEQ ID NO: 720999 - RNA, 18 nt, Haemophilus influenzae Rd
gaauaucuggauguugua

SEQ ID NO: 721000 - RNA, 20 nt, Haemophilus influenzae Rd
gaauaucuggauguuguaaa

SEQ ID NO: 721001 - RNA, 18 nt, Haemophilus influenzae Rd
gaauaucugucauuguaa

SEQ ID NO: 721002 - RNA, 21 nt, Haemophilus influenzae Rd
gaauaucuuguuuuacuucau

SEQ ID NO: 721003 - RNA, 16 nt, Haemophilus influenzae Rd
gaauaucgacuaauau

SEQ ID NO: 721004 - RNA, 18 nt, Haemophilus influenzae Rd
gaauauccaaacuuucug

SEQ ID NO: 721005 - RNA, 14 nt, Haemophilus influenzae Rd
gaauaucagaagaa

SEQ ID NO: 721006 - RNA, 14 nt, Haemophilus influenzae Rd
gaauaucaucagaa

SEQ ID NO: 721007 - RNA, 17 nt, Haemophilus influenzae Rd
gaauaucaucuagauuu

SEQ ID NO: 721008 - RNA, 17 nt, Haemophilus influenzae Rd
aaagaugaaugaacgag

SEQ ID NO: 721009 - RNA, 23 nt, Haemophilus influenzae Rd
gaauagcucaguugguagagcac

SEQ ID NO: 721010 - RNA, 18 nt, Haemophilus influenzae Rd
gaauacucgcggaucacu

SEQ ID NO: 721011 - RNA, 16 nt, Haemophilus influenzae Rd
gaauacugagaucucu

SEQ ID NO: 721012 - RNA, 18 nt, Haemophilus influenzae Rd
gaauacugagaucucuau

SEQ ID NO: 721013 - RNA, 16 nt, Haemophilus influenzae Rd
gaaugauucaauuuga

SEQ ID NO: 721014 - RNA, 17 nt, Haemophilus influenzae Rd
gaaugcauauuaaugcg

SEQ ID NO: 721015 - RNA, 23 nt, Haemophilus influenzae Rd
gaaugcaucacugcccaaccaaa

SEQ ID NO: 721016 - RNA, 14 nt, Haemophilus influenzae Rd
gaaugaucugcacc

SEQ ID NO: 721017 - RNA, 22 nt, Haemophilus influenzae Rd
gaaugaucugcaccccaaaagc

SEQ ID NO: 721018 - RNA, 14 nt, Haemophilus influenzae Rd
gaauccgaaauuaa

SEQ ID NO: 721019 - RNA, 18 nt, Haemophilus influenzae Rd
gacacaagggauuuaaaa

SEQ ID NO: 721020 - RNA, 20 nt, Haemophilus influenzae Rd
gacacaagggauuuaaaauc

SEQ ID NO: 721021 - RNA, 17 nt, Haemophilus influenzae Rd
gacaauauuuacucuuu

SEQ ID NO: 721022 - RNA, 20 nt, Haemophilus influenzae Rd
gacacacuauuaauuacuuu

SEQ ID NO: 721023 - RNA, 23 nt, Haemophilus influenzae Rd
gacaaucacuggcauaucagcau

SEQ ID NO: 721024 - RNA, 14 nt, Haemophilus influenzae Rd
gacaagaaauaaua

SEQ ID NO: 721025 - RNA, 18 nt, Haemophilus influenzae Rd
gacaagauaagagcuuac

SEQ ID NO: 721026 - RNA, 23 nt, Haemophilus influenzae Rd
gacaagauaagagcuuacuucua

SEQ ID NO: 721027 - RNA, 15 nt, Haemophilus influenzae Rd
gaauuuucaaugguu

SEQ ID NO: 721028 - RNA, 16 nt, Haemophilus influenzae Rd
gaauuuucacauuagu

SEQ ID NO: 721029 - RNA, 23 nt, Haemophilus influenzae Rd
gaauuuucaccguuuuuccuuug

SEQ ID NO: 721030 - RNA, 16 nt, Haemophilus influenzae Rd
gacaacaacuuuucua

SEQ ID NO: 721031 - RNA, 21 nt, Haemophilus influenzae Rd
gacaacacuugcuguuuuucc

SEQ ID NO: 721032 - RNA, 17 nt, Haemophilus influenzae Rd
gacaaauuuguugcauu

SEQ ID NO: 721033 - RNA, 14 nt, Haemophilus influenzae Rd
gacaaauuuugcau

SEQ ID NO: 721034 - RNA, 11 nt, Haemophilus influenzae Rd
gacaaauuaau

SEQ ID NO: 721035 - RNA, 23 nt, Haemophilus influenzae Rd
gacaaauuaauaagaaaaucaaa

SEQ ID NO: 721036 - RNA, 13 nt, Haemophilus influenzae Rd
gaauugaagaguu

SEQ ID NO: 721037 - RNA, 19 nt, Haemophilus influenzae Rd
gaauucugagcaaauuacc

SEQ ID NO: 721038 - RNA, 22 nt, Haemophilus influenzae Rd
gaauuugagcggugaauucuuu

SEQ ID NO: 721039 - RNA, 16 nt, Haemophilus influenzae Rd
gaauuuguuguuugcu

SEQ ID NO: 721040 - RNA, 23 nt, Haemophilus influenzae Rd
gaauuuuaaucgcacuuaaaaga

SEQ ID NO: 721041 - RNA, 15 nt, Haemophilus influenzae Rd
gaauuuuacuucuuc

SEQ ID NO: 721042 - RNA, 16 nt, Haemophilus influenzae Rd
gaauuuuacuucuuca

SEQ ID NO: 721043 - RNA, 23 nt, Haemophilus influenzae Rd
gaaugguauugcguaaaucgaca

SEQ ID NO: 721044 - RNA, 22 nt, Haemophilus influenzae Rd
gaauucccaaacgguauuucaa

SEQ ID NO: 721045 - RNA, 20 nt, Haemophilus influenzae Rd
gaauggguuaguaaguggua

SEQ ID NO: 721046 - RNA, 17 nt, Haemophilus influenzae Rd
gaauggcuaaagaaaua

SEQ ID NO: 721047 - RNA, 21 nt, Haemophilus influenzae Rd
gaauggcgucugcaauuagaa

SEQ ID NO: 721048 - RNA, 19 nt, Haemophilus influenzae Rd
gaauggcacgcgcuguauu

SEQ ID NO: 721049 - RNA, 16 nt, Haemophilus influenzae Rd
gaauggauuauaaaua

SEQ ID NO: 721050 - RNA, 20 nt, Haemophilus influenzae Rd
gaauggauuauaaauagaau

SEQ ID NO: 721051 - RNA, 21 nt, Haemophilus influenzae Rd
gacacgcucaggaaaacguuc

SEQ ID NO: 721052 - RNA, 22 nt, Haemophilus influenzae Rd
gacacuaaaaagcccaaaugca

SEQ ID NO: 721053 - RNA, 15 nt, Haemophilus influenzae Rd
gacaccuuuaaaaau

SEQ ID NO: 721054 - RNA, 17 nt, Haemophilus influenzae Rd
gacagaaacaaauccug

SEQ ID NO: 721055 - RNA, 14 nt, Haemophilus influenzae Rd
gacagcuauuaaaa

SEQ ID NO: 721056 - RNA, 20 nt, Haemophilus influenzae Rd
gacagcuauuaaaaaaagca

SEQ ID NO: 721057 - RNA, 18 nt, Haemophilus influenzae Rd
gacaguuuaucucuuucu

SEQ ID NO: 721058 - RNA, 18 nt, Haemophilus influenzae Rd
gacauaauuaaggcugcu

SEQ ID NO: 721059 - RNA, 15 nt, Haemophilus influenzae Rd
gacauaaauacacca

SEQ ID NO: 721060 - RNA, 17 nt, Haemophilus influenzae Rd
gacauauccucaacauc

SEQ ID NO: 721061 - RNA, 23 nt, Haemophilus influenzae Rd
gacauagaaaguuuaacuuucaa

SEQ ID NO: 721062 - RNA, 23 nt, Haemophilus influenzae Rd
gacauucaucuuagcuuuuuucu

SEQ ID NO: 721063 - RNA, 12 nt, Haemophilus influenzae Rd
gacauuccuauu

SEQ ID NO: 721064 - RNA, 14 nt, Haemophilus influenzae Rd
gacauuccuauucu

SEQ ID NO: 721065 - RNA, 15 nt, Haemophilus influenzae Rd
gacauuccuauucua

SEQ ID NO: 721066 - RNA, 20 nt, Haemophilus influenzae Rd
gacauuaaagcaauugcuaa

SEQ ID NO: 721067 - RNA, 15 nt, Haemophilus influenzae Rd
gacauuaagugcauc

SEQ ID NO: 721068 - RNA, 16 nt, Haemophilus influenzae Rd
gaccaacggauuaaaa

SEQ ID NO: 721069 - RNA, 15 nt, Haemophilus influenzae Rd
gacauucuuuagaau

SEQ ID NO: 721070 - RNA, 21 nt, Haemophilus influenzae Rd
gacccaauuagaugauuuuaa

SEQ ID NO: 721071 - RNA, 23 nt, Haemophilus influenzae Rd
gacccaauuagaugauuuuaaaa

SEQ ID NO: 721072 - RNA, 15 nt, Haemophilus influenzae Rd
gaccguuaauacuug

SEQ ID NO: 721073 - RNA, 22 nt, Haemophilus influenzae Rd
gaccguuuuuucuuuuuccuga

SEQ ID NO: 721074 - RNA, 20 nt, Haemophilus influenzae Rd
gaccguuuaacgcagccgcu

SEQ ID NO: 721075 - RNA, 13 nt, Haemophilus influenzae Rd
gacgagcuguugc

SEQ ID NO: 721076 - RNA, 22 nt, Haemophilus influenzae Rd
gacgauuaauaccaauaauaau

SEQ ID NO: 721077 - RNA, 17 nt, Haemophilus influenzae Rd
gacgauuuuagagguga

SEQ ID NO: 721078 - RNA, 21 nt, Haemophilus influenzae Rd
gacgcugcccaaauaaccacu

SEQ ID NO: 721079 - RNA, 12 nt, Haemophilus influenzae Rd
gacguaaugcuc

SEQ ID NO: 721080 - RNA, 16 nt, Haemophilus influenzae Rd
gacguaaaaguuuucc

SEQ ID NO: 721081 - RNA, 17 nt, Haemophilus influenzae Rd
gacguaaaaguuuuccg

SEQ ID NO: 721082 - RNA, 16 nt, Haemophilus influenzae Rd
gacgguucaguuucaa

SEQ ID NO: 721083 - RNA, 20 nt, Haemophilus influenzae Rd
gacgguucaguuucaagcac

SEQ ID NO: 721084 - RNA, 20 nt, Haemophilus influenzae Rd
gacucuguuccacagguuuc

SEQ ID NO: 721085 - RNA, 20 nt, Haemophilus influenzae Rd
gacucguccaucaaaaaaau

SEQ ID NO: 721086 - RNA, 19 nt, Haemophilus influenzae Rd
gacguugucacguaauaca

SEQ ID NO: 721087 - RNA, 17 nt, Haemophilus influenzae Rd
gacguuugauuguaaaa

SEQ ID NO: 721088 - RNA, 11 nt, Haemophilus influenzae Rd
gacguuuuaag

SEQ ID NO: 721089 - RNA, 12 nt, Haemophilus influenzae Rd
gacguuguucuu

SEQ ID NO: 721090 - RNA, 15 nt, Haemophilus influenzae Rd
gacguuucaaaaaua

SEQ ID NO: 721091 - RNA, 15 nt, Haemophilus influenzae Rd
gacuggcaaaaaugu

SEQ ID NO: 721092 - RNA, 20 nt, Haemophilus influenzae Rd
gacuuuauuugauuguugcu

SEQ ID NO: 721093 - RNA, 15 nt, Haemophilus influenzae Rd
gacuuguuuuaaaac

SEQ ID NO: 721094 - RNA, 16 nt, Haemophilus influenzae Rd
gacuugugcaagaaau

SEQ ID NO: 721095 - RNA, 23 nt, Haemophilus influenzae Rd
gacuucuguaugacuauuuagaa

SEQ ID NO: 721096 - RNA, 16 nt, Haemophilus influenzae Rd
gacuugcacaauuacu

SEQ ID NO: 721097 - RNA, 24 nt, Haemophilus influenzae Rd
gacuugcacaauuacuucuuacaa

SEQ ID NO: 721098 - RNA, 17 nt, Haemophilus influenzae Rd
gacuugguggauugugc

SEQ ID NO: 721099 - RNA, 16 nt, Haemophilus influenzae Rd
gacuucgcuaauuuuu

SEQ ID NO: 721100 - RNA, 13 nt, Haemophilus influenzae Rd
gacuuaaauuugg

SEQ ID NO: 721101 - RNA, 18 nt, Haemophilus influenzae Rd
gacuuaaccaaauaggca

SEQ ID NO: 721102 - RNA, 13 nt, Haemophilus influenzae Rd
gagaaaaauccug

SEQ ID NO: 721103 - RNA, 23 nt, Haemophilus influenzae Rd
aaagcaauugccgacacuaaaaa

SEQ ID NO: 721104 - RNA, 14 nt, Haemophilus influenzae Rd
gagaacguaaauuc

SEQ ID NO: 721105 - RNA, 21 nt, Haemophilus influenzae Rd
gagaacgagccucaucuaagg

SEQ ID NO: 721106 - RNA, 15 nt, Haemophilus influenzae Rd
aaagcaauauuuaga

SEQ ID NO: 721107 - RNA, 14 nt, Haemophilus influenzae Rd
aaagcaaucccaag

SEQ ID NO: 721108 - RNA, 20 nt, Haemophilus influenzae Rd
aaagcaauguaguuggcaua

SEQ ID NO: 721109 - RNA, 23 nt, Haemophilus influenzae Rd
aaagcaaaacugaaagaaaaaga

SEQ ID NO: 721110 - RNA, 16 nt, Haemophilus influenzae Rd
gagaauaaguaguuac

SEQ ID NO: 721111 - RNA, 14 nt, Haemophilus influenzae Rd
gagaauauuuccac

SEQ ID NO: 721112 - RNA, 16 nt, Haemophilus influenzae Rd
gagaagcugaauaaaa

SEQ ID NO: 721113 - RNA, 19 nt, Haemophilus influenzae Rd
gagaacuuuuaaaacacgc

SEQ ID NO: 721114 - RNA, 22 nt, Haemophilus influenzae Rd
gagauauaauacguaaauucaa

SEQ ID NO: 721115 - RNA, 14 nt, Haemophilus influenzae Rd
gagauaaaacuugc

SEQ ID NO: 721116 - RNA, 16 nt, Haemophilus influenzae Rd
gagauaaauuuuuagc

SEQ ID NO: 721117 - RNA, 13 nt, Haemophilus influenzae Rd
gagcaccaaauua

SEQ ID NO: 721118 - RNA, 16 nt, Haemophilus influenzae Rd
gagcacaguauuuaua

SEQ ID NO: 721119 - RNA, 18 nt, Haemophilus influenzae Rd
gagcaggcugaaggcgcu

SEQ ID NO: 721120 - RNA, 12 nt, Haemophilus influenzae Rd
gagcccacaacu

SEQ ID NO: 721121 - RNA, 17 nt, Haemophilus influenzae Rd
gagcauaaacuaaaaua

SEQ ID NO: 721122 - RNA, 18 nt, Haemophilus influenzae Rd
gagcauaacguauuuucu

SEQ ID NO: 721123 - RNA, 19 nt, Haemophilus influenzae Rd
gagcuuucaugauuaacaa

SEQ ID NO: 721124 - RNA, 17 nt, Haemophilus influenzae Rd
gagcuuuccaaacaagg

SEQ ID NO: 721125 - RNA, 23 nt, Haemophilus influenzae Rd
gagcuugauuuucagcacugguu

SEQ ID NO: 721126 - RNA, 15 nt, Haemophilus influenzae Rd
gaggaauauacgcca

SEQ ID NO: 721127 - RNA, 13 nt, Haemophilus influenzae Rd
gaggaauaaugaa

SEQ ID NO: 721128 - RNA, 19 nt, Haemophilus influenzae Rd
gagcuuagauaagaaaauc

SEQ ID NO: 721129 - RNA, 15 nt, Haemophilus influenzae Rd
gagcugggcaaacaa

SEQ ID NO: 721130 - RNA, 20 nt, Haemophilus influenzae Rd
gagcuuguuggaaaaaugcu

SEQ ID NO: 721131 - RNA, 23 nt, Haemophilus influenzae Rd
gaggucugcaauaauaucugcuu

SEQ ID NO: 721132 - RNA, 21 nt, Haemophilus influenzae Rd
gagggaucgcauuaucaaaug

SEQ ID NO: 721133 - RNA, 13 nt, Haemophilus influenzae Rd
gagguguuuaugc

SEQ ID NO: 721134 - RNA, 19 nt, Haemophilus influenzae Rd
gagguuccccuaaaaaaua

SEQ ID NO: 721135 - RNA, 20 nt, Haemophilus influenzae Rd
gagguuccccuaaaaaauaa

SEQ ID NO: 721136 - RNA, 17 nt, Haemophilus influenzae Rd
gagguucgaauccucuc

SEQ ID NO: 721137 - RNA, 12 nt, Haemophilus influenzae Rd
gaguauaaauuu

SEQ ID NO: 721138 - RNA, 18 nt, Haemophilus influenzae Rd
gaguauaaauuugugugg

SEQ ID NO: 721139 - RNA, 16 nt, Haemophilus influenzae Rd
gaguauagucauucaa

SEQ ID NO: 721140 - RNA, 23 nt, Haemophilus influenzae Rd
gaguauagucauucaaugcagaa

SEQ ID NO: 721141 - RNA, 23 nt, Haemophilus influenzae Rd
gagguuugccaucugaaaguuug

SEQ ID NO: 721142 - RNA, 23 nt, Haemophilus influenzae Rd
gaguaaaaaaucuagagauugua

SEQ ID NO: 721143 - RNA, 14 nt, Haemophilus influenzae Rd
gaguaaaaauauua

SEQ ID NO: 721144 - RNA, 16 nt, Haemophilus influenzae Rd
gagugcuguacacaca

SEQ ID NO: 721145 - RNA, 19 nt, Haemophilus influenzae Rd
gaguuauuucuuuaaaugg

SEQ ID NO: 721146 - RNA, 12 nt, Haemophilus influenzae Rd
gaguuauuuuua

SEQ ID NO: 721147 - RNA, 22 nt, Haemophilus influenzae Rd
gaguucaacgacaauuaaagua

SEQ ID NO: 721148 - RNA, 20 nt, Haemophilus influenzae Rd
gauaaagguuacucauucua

SEQ ID NO: 721149 - RNA, 17 nt, Haemophilus influenzae Rd
gauaaaguauucauaua

SEQ ID NO: 721150 - RNA, 15 nt, Haemophilus influenzae Rd
gauaaaguccauaau

SEQ ID NO: 721151 - RNA, 18 nt, Haemophilus influenzae Rd
gauaaauaucaaaauuau

SEQ ID NO: 721152 - RNA, 12 nt, Haemophilus influenzae Rd
gauaaauauuac

SEQ ID NO: 721153 - RNA, 14 nt, Haemophilus influenzae Rd
gauaacaauuuuug

SEQ ID NO: 721154 - RNA, 19 nt, Haemophilus influenzae Rd
gauaacaauuuuugcauuu

SEQ ID NO: 721155 - RNA, 19 nt, Haemophilus influenzae Rd
gauaaauuuuuagcugauu

SEQ ID NO: 721156 - RNA, 18 nt, Haemophilus influenzae Rd
gauaaauuacauaaaagc

SEQ ID NO: 721157 - RNA, 13 nt, Haemophilus influenzae Rd
gauaaaaaucauc

SEQ ID NO: 721158 - RNA, 22 nt, Haemophilus influenzae Rd
gauaaaaaccuaaaggcaaggu

SEQ ID NO: 721159 - RNA, 18 nt, Haemophilus influenzae Rd
gauaaaaaaucugcaacu

SEQ ID NO: 721160 - RNA, 14 nt, Haemophilus influenzae Rd
gaguuuuucaaaaa

SEQ ID NO: 721161 - RNA, 14 nt, Haemophilus influenzae Rd
gauaauaaaaaaac

SEQ ID NO: 721162 - RNA, 18 nt, Haemophilus influenzae Rd
gauaaguggggaaaaaua

SEQ ID NO: 721163 - RNA, 14 nt, Haemophilus influenzae Rd
gauaauaaaaugga

SEQ ID NO: 721164 - RNA, 13 nt, Haemophilus influenzae Rd
gauaauaugcauc

SEQ ID NO: 721165 - RNA, 15 nt, Haemophilus influenzae Rd
gauaauaugcaucac

SEQ ID NO: 721166 - RNA, 17 nt, Haemophilus influenzae Rd
gauaauauguuuugcca

SEQ ID NO: 721167 - RNA, 15 nt, Haemophilus influenzae Rd
gauaauaucgcccgc

SEQ ID NO: 721168 - RNA, 14 nt, Haemophilus influenzae Rd
gauaauacacguua

SEQ ID NO: 721169 - RNA, 16 nt, Haemophilus influenzae Rd
gauaauacagaaauau

SEQ ID NO: 721170 - RNA, 19 nt, Haemophilus influenzae Rd
gauaacacccucaaccacu

SEQ ID NO: 721171 - RNA, 22 nt, Haemophilus influenzae Rd
gauaacacgccauuaccacugc

SEQ ID NO: 721172 - RNA, 23 nt, Haemophilus influenzae Rd
gauaaccaaaauauuucauuugc

SEQ ID NO: 721173 - RNA, 17 nt, Haemophilus influenzae Rd
gauaaggcagaaaugaa

SEQ ID NO: 721174 - RNA, 15 nt, Haemophilus influenzae Rd
gauaaguaaugaaaa

SEQ ID NO: 721175 - RNA, 16 nt, Haemophilus influenzae Rd
gauaaguagaaaaauu

SEQ ID NO: 721176 - RNA, 18 nt, Haemophilus influenzae Rd
gauaaguauaacuuaaau

SEQ ID NO: 721177 - RNA, 15 nt, Haemophilus influenzae Rd
gauaauauuuuugcc

SEQ ID NO: 721178 - RNA, 15 nt, Haemophilus influenzae Rd
gauaaucuucccauu

SEQ ID NO: 721179 - RNA, 20 nt, Haemophilus influenzae Rd
gauaaucugauugagaaaau

SEQ ID NO: 721180 - RNA, 19 nt, Haemophilus influenzae Rd
gauaaucuaaaaaaccuug

SEQ ID NO: 721181 - RNA, 20 nt, Haemophilus influenzae Rd
gauaaucgaucuuuuuuuug

SEQ ID NO: 721182 - RNA, 22 nt, Haemophilus influenzae Rd
gauaaugccucuuuaacauugu

SEQ ID NO: 721183 - RNA, 16 nt, Haemophilus influenzae Rd
gauaaugauagaugaa

SEQ ID NO: 721184 - RNA, 21 nt, Haemophilus influenzae Rd
gauaauuggauacauuccauc

SEQ ID NO: 721185 - RNA, 16 nt, Haemophilus influenzae Rd
gauaauuggcaauaau

SEQ ID NO: 721186 - RNA, 18 nt, Haemophilus influenzae Rd
gauaauuggcaauaaugu

SEQ ID NO: 721187 - RNA, 15 nt, Haemophilus influenzae Rd
gauaauuuaacugaa

SEQ ID NO: 721188 - RNA, 17 nt, Haemophilus influenzae Rd
gauaauguucuuuuaaa

SEQ ID NO: 721189 - RNA, 16 nt, Haemophilus influenzae Rd
gauaauuaaggucuua

SEQ ID NO: 721190 - RNA, 16 nt, Haemophilus influenzae Rd
gauaauuuuucacugu

SEQ ID NO: 721191 - RNA, 16 nt, Haemophilus influenzae Rd
aaagcagguuuuucuu

SEQ ID NO: 721192 - RNA, 17 nt, Haemophilus influenzae Rd
gauacaagcggcugaca

SEQ ID NO: 721193 - RNA, 14 nt, Haemophilus influenzae Rd
aaagccaaugccaa

SEQ ID NO: 721194 - RNA, 22 nt, Haemophilus influenzae Rd
aaagcauuuagagcaagcaaua

SEQ ID NO: 721195 - RNA, 14 nt, Haemophilus influenzae Rd
aaagcauuaaguuu

SEQ ID NO: 721196 - RNA, 17 nt, Haemophilus influenzae Rd
aaagcauuaaguuuuua

SEQ ID NO: 721197 - RNA, 18 nt, Haemophilus influenzae Rd
aaagcaugaauaaaaaug

SEQ ID NO: 721198 - RNA, 21 nt, Haemophilus influenzae Rd
gauaccaccacagaaccagca

SEQ ID NO: 721199 - RNA, 14 nt, Haemophilus influenzae Rd
gauaccaauaauca

SEQ ID NO: 721200 - RNA, 16 nt, Haemophilus influenzae Rd
gauaccaauaaucaau

SEQ ID NO: 721201 - RNA, 15 nt, Haemophilus influenzae Rd
gauaccaagauaaua

SEQ ID NO: 721202 - RNA, 20 nt, Haemophilus influenzae Rd
gauaccaagauaauaaaguu

SEQ ID NO: 721203 - RNA, 11 nt, Haemophilus influenzae Rd
gauacagaagg

SEQ ID NO: 721204 - RNA, 15 nt, Haemophilus influenzae Rd
gauagccucuucuuu

SEQ ID NO: 721205 - RNA, 16 nt, Haemophilus influenzae Rd
gauaguuaauggcaau

SEQ ID NO: 721206 - RNA, 17 nt, Haemophilus influenzae Rd
gauauaagaaauaaucg

SEQ ID NO: 721207 - RNA, 15 nt, Haemophilus influenzae Rd
gauauaaguucuaaa

SEQ ID NO: 721208 - RNA, 23 nt, Haemophilus influenzae Rd
gauauaaguucuaaauaaacuac

SEQ ID NO: 721209 - RNA, 12 nt, Haemophilus influenzae Rd
gauauaaacuga

SEQ ID NO: 721210 - RNA, 13 nt, Haemophilus influenzae Rd
gauauaaaaaugg

SEQ ID NO: 721211 - RNA, 14 nt, Haemophilus influenzae Rd
gauauaaaaacuau

SEQ ID NO: 721212 - RNA, 14 nt, Haemophilus influenzae Rd
gauaccuaaaccuu

SEQ ID NO: 721213 - RNA, 20 nt, Haemophilus influenzae Rd
gauacuauauuuucuucugc

SEQ ID NO: 721214 - RNA, 13 nt, Haemophilus influenzae Rd
gauacguuucaua

SEQ ID NO: 721215 - RNA, 23 nt, Haemophilus influenzae Rd
gauagcacuuguuuuuagugguu

SEQ ID NO: 721216 - RNA, 22 nt, Haemophilus influenzae Rd
gauauuucaauuuaagcccugc

SEQ ID NO: 721217 - RNA, 23 nt, Haemophilus influenzae Rd
gauauuuauaaguaaucacagau

SEQ ID NO: 721218 - RNA, 13 nt, Haemophilus influenzae Rd
gauauuuaaaauc

SEQ ID NO: 721219 - RNA, 15 nt, Haemophilus influenzae Rd
gauauuggauuuacu

SEQ ID NO: 721220 - RNA, 23 nt, Haemophilus influenzae Rd
gauauugccuaauagaaaaaugc

SEQ ID NO: 721221 - RNA, 21 nt, Haemophilus influenzae Rd
gauauuuuuaucaauaacuga

SEQ ID NO: 721222 - RNA, 13 nt, Haemophilus influenzae Rd
gaucaaaaauauc

SEQ ID NO: 721223 - RNA, 17 nt, Haemophilus influenzae Rd
gaucaauggguuuaaaa

SEQ ID NO: 721224 - RNA, 19 nt, Haemophilus influenzae Rd
gauauuauuauuaaaucca

SEQ ID NO: 721225 - RNA, 13 nt, Haemophilus influenzae Rd
gauauuccaaggu

SEQ ID NO: 721226 - RNA, 16 nt, Haemophilus influenzae Rd
gauauuccaagguuuu

SEQ ID NO: 721227 - RNA, 19 nt, Haemophilus influenzae Rd
gaaaucucuuucaauuuca

SEQ ID NO: 721228 - RNA, 15 nt, Haemophilus influenzae Rd
gaaaucuaauuugcu

SEQ ID NO: 721229 - RNA, 19 nt, Haemophilus influenzae Rd
gaaaucuaauuugcuuaca

SEQ ID NO: 721230 - RNA, 18 nt, Haemophilus influenzae Rd
gaaauggcuagggauuaa

SEQ ID NO: 721231 - RNA, 20 nt, Haemophilus influenzae Rd
gaaauguaaagauuuuucuu

SEQ ID NO: 721232 - RNA, 16 nt, Haemophilus influenzae Rd
gaaaugucguaagaac

SEQ ID NO: 721233 - RNA, 17 nt, Haemophilus influenzae Rd
gaaaugcuuacaggaaa

SEQ ID NO: 721234 - RNA, 18 nt, Haemophilus influenzae Rd
gaaaugcuuacaggaaag

SEQ ID NO: 721235 - RNA, 19 nt, Haemophilus influenzae Rd
gaaaugcuuacaggaaagu

SEQ ID NO: 721236 - RNA, 19 nt, Haemophilus influenzae Rd
aaagagcgguuaaaaauag

SEQ ID NO: 721237 - RNA, 16 nt, Haemophilus influenzae Rd
gaaauuaaaauaauau

SEQ ID NO: 721238 - RNA, 21 nt, Haemophilus influenzae Rd
gaaauguuguccaucaaucau

SEQ ID NO: 721239 - RNA, 18 nt, Haemophilus influenzae Rd
gaaauguuugaaggcaaa

SEQ ID NO: 721240 - RNA, 19 nt, Haemophilus influenzae Rd
gaaauuuaucuaaaaguaa

SEQ ID NO: 721241 - RNA, 15 nt, Haemophilus influenzae Rd
gaaauuuauuauaaa

SEQ ID NO: 721242 - RNA, 20 nt, Haemophilus influenzae Rd
gaaauuuauuauaaaaauau

SEQ ID NO: 721243 - RNA, 13 nt, Haemophilus influenzae Rd
gaaauuuauuaua

SEQ ID NO: 721244 - RNA, 13 nt, Haemophilus influenzae Rd
gaaauuucauagu

SEQ ID NO: 721245 - RNA, 16 nt, Haemophilus influenzae Rd
gaaauuucauauuucu

SEQ ID NO: 721246 - RNA, 21 nt, Haemophilus influenzae Rd
gaaauuuccugagaauuuuca

SEQ ID NO: 721247 - RNA, 18 nt, Haemophilus influenzae Rd
gaacagccaguaaauugg

SEQ ID NO: 721248 - RNA, 20 nt, Haemophilus influenzae Rd
gaacagguugcugauaaaga

SEQ ID NO: 721249 - RNA, 15 nt, Haemophilus influenzae Rd
gaacaguaaauuuaa

SEQ ID NO: 721250 - RNA, 17 nt, Haemophilus influenzae Rd
gaacaguaaauuuaagg

SEQ ID NO: 721251 - RNA, 15 nt, Haemophilus influenzae Rd
gaacaccgagaugca

SEQ ID NO: 721252 - RNA, 21 nt, Haemophilus influenzae Rd
gaacaagcgcaaguucuucau

SEQ ID NO: 721253 - RNA, 17 nt, Haemophilus influenzae Rd
gaacaauuucuuuaccu

SEQ ID NO: 721254 - RNA, 18 nt, Haemophilus influenzae Rd
gaaauccacaaaaucuga

SEQ ID NO: 721255 - RNA, 13 nt, Haemophilus influenzae Rd
gaaaucauuucaa

SEQ ID NO: 721256 - RNA, 19 nt, Haemophilus influenzae Rd
gaaaucccgcagggaugcg

SEQ ID NO: 721257 - RNA, 22 nt, Haemophilus influenzae Rd
gaaauauuauuaaguaauacau

SEQ ID NO: 721258 - RNA, 20 nt, Haemophilus influenzae Rd
gaaauaucagcuacuuguaa

SEQ ID NO: 721259 - RNA, 22 nt, Haemophilus influenzae Rd
gaaauaucagcuacuuguaaga

SEQ ID NO: 721260 - RNA, 22 nt, Haemophilus influenzae Rd
gaaauauauuauugugauaauu

SEQ ID NO: 721261 - RNA, 14 nt, Haemophilus influenzae Rd
gaaauauaauaaau

SEQ ID NO: 721262 - RNA, 15 nt, Haemophilus influenzae Rd
gaaauaaaauauaug

SEQ ID NO: 721263 - RNA, 15 nt, Haemophilus influenzae Rd
gaaauaggcaaguuc

SEQ ID NO: 721264 - RNA, 14 nt, Haemophilus influenzae Rd
gaaaguuuuaagug

SEQ ID NO: 721265 - RNA, 19 nt, Haemophilus influenzae Rd
gaaagugcggucauuuuug

SEQ ID NO: 721266 - RNA, 19 nt, Haemophilus influenzae Rd
gaaagucccgugagcauuu

SEQ ID NO: 721267 - RNA, 16 nt, Haemophilus influenzae Rd
gaaagucgauucaaau

SEQ ID NO: 721268 - RNA, 18 nt, Haemophilus influenzae Rd
gaaaguuggcuacuauca

SEQ ID NO: 721269 - RNA, 15 nt, Haemophilus influenzae Rd
gaaaguucuuuuuug

SEQ ID NO: 721270 - RNA, 19 nt, Haemophilus influenzae Rd
gaaaguuggccaauuugca

SEQ ID NO: 721271 - RNA, 20 nt, Haemophilus influenzae Rd
gaaaguuaagccugauagca

SEQ ID NO: 721272 - RNA, 22 nt, Haemophilus influenzae Rd
gaaaguuaccgcucgccaauaa

SEQ ID NO: 721273 - RNA, 18 nt, Haemophilus influenzae Rd
gaaagggcgugauaccaa

SEQ ID NO: 721274 - RNA, 15 nt, Haemophilus influenzae Rd
gaaaggguugcagaa

SEQ ID NO: 721275 - RNA, 16 nt, Haemophilus influenzae Rd
gaaaggaauagauuua

SEQ ID NO: 721276 - RNA, 14 nt, Haemophilus influenzae Rd
gaaacgagcauauu

SEQ ID NO: 721277 - RNA, 16 nt, Haemophilus influenzae Rd
gaaacgagcauauuuu

SEQ ID NO: 721278 - RNA, 20 nt, Haemophilus influenzae Rd
gaaacguaaaauaucuuucu

SEQ ID NO: 721279 - RNA, 17 nt, Haemophilus influenzae Rd
gaaacguaaacaaaaua

SEQ ID NO: 721280 - RNA, 22 nt, Haemophilus influenzae Rd
gaaagagacucuguuccacagg

SEQ ID NO: 721281 - RNA, 15 nt, Haemophilus influenzae Rd
gaaagacuuuauccg

SEQ ID NO: 721282 - RNA, 16 nt, Haemophilus influenzae Rd
gaaagaguaagcaagu

SEQ ID NO: 721283 - RNA, 22 nt, Haemophilus influenzae Rd
gaaagcgaaaucgcacucacaa

SEQ ID NO: 721284 - RNA, 15 nt, Haemophilus influenzae Rd
gaaaaguugaaacug

SEQ ID NO: 721285 - RNA, 16 nt, Haemophilus influenzae Rd
gaaaauuaagaaaaua

SEQ ID NO: 721286 - RNA, 13 nt, Haemophilus influenzae Rd
gaaaauuaucugc

SEQ ID NO: 721287 - RNA, 22 nt, Haemophilus influenzae Rd
gaaaauuauugugagauaugaa

SEQ ID NO: 721288 - RNA, 14 nt, Haemophilus influenzae Rd
gaaaaucaaaagaa

SEQ ID NO: 721289 - RNA, 12 nt, Haemophilus influenzae Rd
gaaaauuaaaaa

SEQ ID NO: 721290 - RNA, 21 nt, Haemophilus influenzae Rd
gaaaauuaaaaauuuaauacu

SEQ ID NO: 721291 - RNA, 12 nt, Haemophilus influenzae Rd
gaaaauucuucu

SEQ ID NO: 721292 - RNA, 17 nt, Haemophilus influenzae Rd
gaaaauugcaccuucuu

SEQ ID NO: 721293 - RNA, 22 nt, Haemophilus influenzae Rd
gaaaauugcaccuucuuuugga

SEQ ID NO: 721294 - RNA, 23 nt, Haemophilus influenzae Rd
gaaaauugcaccuucuuuuggau

SEQ ID NO: 721295 - RNA, 18 nt, Haemophilus influenzae Rd
gaaaaaucgaagaaauau

SEQ ID NO: 721296 - RNA, 17 nt, Haemophilus influenzae Rd
gaaaaauuaucaaaaga

SEQ ID NO: 721297 - RNA, 20 nt, Haemophilus influenzae Rd
gaaaaauuaucaaaagaaaa

SEQ ID NO: 721298 - RNA, 18 nt, Haemophilus influenzae Rd
gaaaaaugcuuguucuga

SEQ ID NO: 721299 - RNA, 24 nt, Haemophilus influenzae Rd
gaaaaauuuaaucguuuaggaauu

SEQ ID NO: 721300 - RNA, 13 nt, Haemophilus influenzae Rd
gaaaaguaaauga

SEQ ID NO: 721301 - RNA, 15 nt, Haemophilus influenzae Rd
gaaacauaucaaaaa

SEQ ID NO: 721302 - RNA, 23 nt, Haemophilus influenzae Rd
gaaacauaaaagaggaaaaucga

SEQ ID NO: 721303 - RNA, 19 nt, Haemophilus influenzae Rd
gaaacagguaauuucucug

SEQ ID NO: 721304 - RNA, 12 nt, Haemophilus influenzae Rd
gaaacagcuaaa

SEQ ID NO: 721305 - RNA, 19 nt, Haemophilus influenzae Rd
gaaacagaaauaacacuac

SEQ ID NO: 721306 - RNA, 14 nt, Haemophilus influenzae Rd
gaaacaauaaaacu

SEQ ID NO: 721307 - RNA, 21 nt, Haemophilus influenzae Rd
gaaacaacgcguacuuuuuua

SEQ ID NO: 721308 - RNA, 21 nt, Haemophilus influenzae Rd
gaaacaauauguauaauuccu

SEQ ID NO: 721309 - RNA, 16 nt, Haemophilus influenzae Rd
gaaaccauugaugaaa

SEQ ID NO: 721310 - RNA, 17 nt, Haemophilus influenzae Rd
gaaaccauugaugaaau

SEQ ID NO: 721311 - RNA, 15 nt, Haemophilus influenzae Rd
gaaaccagcuuucca

SEQ ID NO: 721312 - RNA, 16 nt, Haemophilus influenzae Rd
gaaaccaaauccuuuu

SEQ ID NO: 721313 - RNA, 21 nt, Haemophilus influenzae Rd
gaaaccaacuuugaccauuuc

SEQ ID NO: 721314 - RNA, 17 nt, Haemophilus influenzae Rd
gaaacauuuuucccugu

SEQ ID NO: 721315 - RNA, 13 nt, Haemophilus influenzae Rd
gaaaccgcauauu

SEQ ID NO: 721316 - RNA, 14 nt, Haemophilus influenzae Rd
gaaaccuuguaaau

SEQ ID NO: 721317 - RNA, 21 nt, Haemophilus influenzae Rd
cuuuuucaucuuuacccacac

SEQ ID NO: 721318 - RNA, 19 nt, Haemophilus influenzae Rd
cuuuuucauguacaaguga

SEQ ID NO: 721319 - RNA, 12 nt, Haemophilus influenzae Rd
cuuuuuccugaa

SEQ ID NO: 721320 - RNA, 23 nt, Haemophilus influenzae Rd
cuuuuuccugaauaacuacauaa

SEQ ID NO: 721321 - RNA, 19 nt, Haemophilus influenzae Rd
cuuuuugaucucuuucuau

SEQ ID NO: 721322 - RNA, 18 nt, Haemophilus influenzae Rd
cuuuuugugccaauccau

SEQ ID NO: 721323 - RNA, 22 nt, Haemophilus influenzae Rd
cuuuuuugauacuaacucaaaa

SEQ ID NO: 721324 - RNA, 16 nt, Haemophilus influenzae Rd
cuuuuuucuuucuagu

SEQ ID NO: 721325 - RNA, 11 nt, Haemophilus influenzae Rd
cuuuuuuucau

SEQ ID NO: 721326 - RNA, 18 nt, Haemophilus influenzae Rd
cuuuuuuuauauuuuuua

SEQ ID NO: 721327 - RNA, 22 nt, Haemophilus influenzae Rd
cuuuuuuuaaucacaaagcuua

SEQ ID NO: 721328 - RNA, 16 nt, Haemophilus influenzae Rd
gaaaaagaaaaccugc

SEQ ID NO: 721329 - RNA, 19 nt, Haemophilus influenzae Rd
cuuuuagugcuguauauuu

SEQ ID NO: 721330 - RNA, 16 nt, Haemophilus influenzae Rd
cuuuuauagacuucaa

SEQ ID NO: 721331 - RNA, 18 nt, Haemophilus influenzae Rd
cuuuuauagacuucaagu

SEQ ID NO: 721332 - RNA, 18 nt, Haemophilus influenzae Rd
cuuuuaguucguuuuuua

SEQ ID NO: 721333 - RNA, 16 nt, Haemophilus influenzae Rd
cuuuuaguuuccccug

SEQ ID NO: 721334 - RNA, 13 nt, Haemophilus influenzae Rd
cuuuuauaaagau

SEQ ID NO: 721335 - RNA, 14 nt, Haemophilus influenzae Rd
cuuuuauaaagauc

SEQ ID NO: 721336 - RNA, 12 nt, Haemophilus influenzae Rd
cuuuuauccacc

SEQ ID NO: 721337 - RNA, 15 nt, Haemophilus influenzae Rd
cuuuuggcauuagcg

SEQ ID NO: 721338 - RNA, 21 nt, Haemophilus influenzae Rd
cuuuuggauaaaguauucaua

SEQ ID NO: 721339 - RNA, 20 nt, Haemophilus influenzae Rd
cuuuuggauacacaaauuga

SEQ ID NO: 721340 - RNA, 13 nt, Haemophilus influenzae Rd
cuuuugcaaucac

SEQ ID NO: 721341 - RNA, 17 nt, Haemophilus influenzae Rd
cuuuugaaugugagcca

SEQ ID NO: 721342 - RNA, 20 nt, Haemophilus influenzae Rd
cuuuugagugcuguacacac

SEQ ID NO: 721343 - RNA, 13 nt, Haemophilus influenzae Rd
cuuuugauaucca

SEQ ID NO: 721344 - RNA, 12 nt, Haemophilus influenzae Rd
cuuuuuauaaaa

SEQ ID NO: 721345 - RNA, 15 nt, Haemophilus influenzae Rd
cuuuuuauaaaaaaa

SEQ ID NO: 721346 - RNA, 16 nt, Haemophilus influenzae Rd
cuuuuuauaaaaaaac

SEQ ID NO: 721347 - RNA, 13 nt, Haemophilus influenzae Rd
cuuuuuauuuuug

SEQ ID NO: 721348 - RNA, 20 nt, Haemophilus influenzae Rd
cuuuuuauuuuacuaauuaa

SEQ ID NO: 721349 - RNA, 16 nt, Haemophilus influenzae Rd
cuuuuuaucuaaauuu

SEQ ID NO: 721350 - RNA, 22 nt, Haemophilus influenzae Rd
cuuuuuauguuucgauaaaaaa

SEQ ID NO: 721351 - RNA, 16 nt, Haemophilus influenzae Rd
cuuuuuauguuuuguu

SEQ ID NO: 721352 - RNA, 16 nt, Haemophilus influenzae Rd
cuuuugguaaauacug

SEQ ID NO: 721353 - RNA, 19 nt, Haemophilus influenzae Rd
cuuuuguauuacgugauuu

SEQ ID NO: 721354 - RNA, 17 nt, Haemophilus influenzae Rd
cuuuuguauuggguaaa

SEQ ID NO: 721355 - RNA, 15 nt, Haemophilus influenzae Rd
cuuuugguuuucugg

SEQ ID NO: 721356 - RNA, 12 nt, Haemophilus influenzae Rd
cuuuuguagaaa

SEQ ID NO: 721357 - RNA, 21 nt, Haemophilus influenzae Rd
cuuuuuacaacauuaccuucu

SEQ ID NO: 721358 - RNA, 11 nt, Haemophilus influenzae Rd
aaagaaauuuu

SEQ ID NO: 721359 - RNA, 22 nt, Haemophilus influenzae Rd
aaagaaaucaccgcacuuugug

SEQ ID NO: 721360 - RNA, 23 nt, Haemophilus influenzae Rd
aaagaaauauauuauugugauaa

SEQ ID NO: 721361 - RNA, 12 nt, Haemophilus influenzae Rd
aaagaacaucuu

SEQ ID NO: 721362 - RNA, 16 nt, Haemophilus influenzae Rd
aaagaaauuuuaauca

SEQ ID NO: 721363 - RNA, 18 nt, Haemophilus influenzae Rd
aaagaaauuuuauccauc

SEQ ID NO: 721364 - RNA, 17 nt, Haemophilus influenzae Rd
cuuguucuucauagaag

SEQ ID NO: 721365 - RNA, 12 nt, Haemophilus influenzae Rd
cuuguucuaaag

SEQ ID NO: 721366 - RNA, 18 nt, Haemophilus influenzae Rd
cuuguucuccauuaagca

SEQ ID NO: 721367 - RNA, 19 nt, Haemophilus influenzae Rd
cuuguugaaauuccucacu

SEQ ID NO: 721368 - RNA, 15 nt, Haemophilus influenzae Rd
aaagaacuauuauuc

SEQ ID NO: 721369 - RNA, 23 nt, Haemophilus influenzae Rd
aaagaaccuaucucauccacuaa

SEQ ID NO: 721370 - RNA, 21 nt, Haemophilus influenzae Rd
aaagaacggucaaaaugcagu

SEQ ID NO: 721371 - RNA, 13 nt, Haemophilus influenzae Rd
aaagaagaaaaag

SEQ ID NO: 721372 - RNA, 12 nt, Haemophilus influenzae Rd
cuuguuuaauau

SEQ ID NO: 721373 - RNA, 13 nt, Haemophilus influenzae Rd
cuuguuuaaucac

SEQ ID NO: 721374 - RNA, 18 nt, Haemophilus influenzae Rd
cuuguuguucaaaauugc

SEQ ID NO: 721375 - RNA, 18 nt, Haemophilus influenzae Rd
cuuguuguaaauugguuu

SEQ ID NO: 721376 - RNA, 15 nt, Haemophilus influenzae Rd
cuuguuuauuauuuc

SEQ ID NO: 721377 - RNA, 17 nt, Haemophilus influenzae Rd
cuuguuuacugaauaaa

SEQ ID NO: 721378 - RNA, 15 nt, Haemophilus influenzae Rd
cuuuaaaaaauaaca

SEQ ID NO: 721379 - RNA, 18 nt, Haemophilus influenzae Rd
cuuguuuuaaaucuucua

SEQ ID NO: 721380 - RNA, 12 nt, Haemophilus influenzae Rd
cuuguuuuaaaa

SEQ ID NO: 721381 - RNA, 17 nt, Haemophilus influenzae Rd
cuuuaaagaaauaaauu

SEQ ID NO: 721382 - RNA, 16 nt, Haemophilus influenzae Rd
cuuuaaagaauauucu

SEQ ID NO: 721383 - RNA, 18 nt, Haemophilus influenzae Rd
cuuuaaagagcaaauuua

SEQ ID NO: 721384 - RNA, 14 nt, Haemophilus influenzae Rd
cuuuaaauauucaa

SEQ ID NO: 721385 - RNA, 22 nt, Haemophilus influenzae Rd
cuuuaaauauuuaaaaagaaua

SEQ ID NO: 721386 - RNA, 18 nt, Haemophilus influenzae Rd
cuuuaaagguuuaaaccu

SEQ ID NO: 721387 - RNA, 18 nt, Haemophilus influenzae Rd
cuuguuccacauuauuug

SEQ ID NO: 721388 - RNA, 16 nt, Haemophilus influenzae Rd
cuugugucuaccgauu

SEQ ID NO: 721389 - RNA, 14 nt, Haemophilus influenzae Rd
cuuguuaauacacu

SEQ ID NO: 721390 - RNA, 14 nt, Haemophilus influenzae Rd
cuugugcauaaaca

SEQ ID NO: 721391 - RNA, 17 nt, Haemophilus influenzae Rd
cuugugcauaaacaaau

SEQ ID NO: 721392 - RNA, 14 nt, Haemophilus influenzae Rd
cuugugaaauaaaa

SEQ ID NO: 721393 - RNA, 18 nt, Haemophilus influenzae Rd
cuugugaaauaaaauaua

SEQ ID NO: 721394 - RNA, 17 nt, Haemophilus influenzae Rd
cuugugcuauacaaaau

SEQ ID NO: 721395 - RNA, 22 nt, Haemophilus influenzae Rd
cuugugcucgauuuuuaaaagc

SEQ ID NO: 721396 - RNA, 23 nt, Haemophilus influenzae Rd
cuugugcgauuaacaauaaugug

SEQ ID NO: 721397 - RNA, 22 nt, Haemophilus influenzae Rd
cuugugcuggaguugcagauuu

SEQ ID NO: 721398 - RNA, 12 nt, Haemophilus influenzae Rd
cuuguggaauaa

SEQ ID NO: 721399 - RNA, 16 nt, Haemophilus influenzae Rd
cuuguggaucuaaauc

SEQ ID NO: 721400 - RNA, 16 nt, Haemophilus influenzae Rd
aaagaaacguaaacaa

SEQ ID NO: 721401 - RNA, 19 nt, Haemophilus influenzae Rd
aaagaaacguaaacaaaau

SEQ ID NO: 721402 - RNA, 16 nt, Haemophilus influenzae Rd
aaagaaaagaugaaug

SEQ ID NO: 721403 - RNA, 13 nt, Haemophilus influenzae Rd
aaagaaacaccac

SEQ ID NO: 721404 - RNA, 13 nt, Haemophilus influenzae Rd
aaagaaacaggac

SEQ ID NO: 721405 - RNA, 14 nt, Haemophilus influenzae Rd
aaagaaaauauuua

SEQ ID NO: 721406 - RNA, 13 nt, Haemophilus influenzae Rd
aaagaaaaccaaa

SEQ ID NO: 721407 - RNA, 22 nt, Haemophilus influenzae Rd
aaagaaaacuuauaaagauauu

SEQ ID NO: 721408 - RNA, 20 nt, Haemophilus influenzae Rd
cuuguaaaauugguggggca

SEQ ID NO: 721409 - RNA, 23 nt, Haemophilus influenzae Rd
cuuguaaagauuguccuuuugcc

SEQ ID NO: 721410 - RNA, 21 nt, Haemophilus influenzae Rd
cuugguuuaaauuuuaaaaaa

SEQ ID NO: 721411 - RNA, 18 nt, Haemophilus influenzae Rd
cuugguguuguggugcaa

SEQ ID NO: 721412 - RNA, 20 nt, Haemophilus influenzae Rd
cuugguagccuuuaugacua

SEQ ID NO: 721413 - RNA, 17 nt, Haemophilus influenzae Rd
cuuggucacgauuuuuu

SEQ ID NO: 721414 - RNA, 18 nt, Haemophilus influenzae Rd
cuuggucacgauuuuuuu

SEQ ID NO: 721415 - RNA, 16 nt, Haemophilus influenzae Rd
cuuggucacugguuca

SEQ ID NO: 721416 - RNA, 19 nt, Haemophilus influenzae Rd
cuuggucacugguucaagu

SEQ ID NO: 721417 - RNA, 15 nt, Haemophilus influenzae Rd
cuugggcuaaaagcu

SEQ ID NO: 721418 - RNA, 21 nt, Haemophilus influenzae Rd
cuuggguaaauauaaaugccg

SEQ ID NO: 721419 - RNA, 18 nt, Haemophilus influenzae Rd
cuugguaaacuucuucug

SEQ ID NO: 721420 - RNA, 15 nt, Haemophilus influenzae Rd
cuugguaagaaagau

SEQ ID NO: 721421 - RNA, 20 nt, Haemophilus influenzae Rd
aaacuuuucuuauaauuaca

SEQ ID NO: 721422 - RNA, 23 nt, Haemophilus influenzae Rd
cuugucauugccauuucugcauu

SEQ ID NO: 721423 - RNA, 16 nt, Haemophilus influenzae Rd
cuugucaauaaauccc

SEQ ID NO: 721424 - RNA, 24 nt, Haemophilus influenzae Rd
cuuguacaguaauuguugguuacu

SEQ ID NO: 721425 - RNA, 18 nt, Haemophilus influenzae Rd
cuuguaagcguaaugcac

SEQ ID NO: 721426 - RNA, 21 nt, Haemophilus influenzae Rd
cuuguaauugauuuucagaaa

SEQ ID NO: 721427 - RNA, 21 nt, Haemophilus influenzae Rd
cuuguacaacagcaauaagca

SEQ ID NO: 721428 - RNA, 20 nt, Haemophilus influenzae Rd
cuugguguaauuugaugcuc

SEQ ID NO: 721429 - RNA, 22 nt, Haemophilus influenzae Rd
cuuguaaugguucuaacacgcc

SEQ ID NO: 721430 - RNA, 16 nt, Haemophilus influenzae Rd
cuugggaaucuggcuu

SEQ ID NO: 721431 - RNA, 18 nt, Haemophilus influenzae Rd
cuuggcuuauuuacuuua

SEQ ID NO: 721432 - RNA, 23 nt, Haemophilus influenzae Rd
cuuggcgugguucaaaaccaaau

SEQ ID NO: 721433 - RNA, 18 nt, Haemophilus influenzae Rd
cuuggcguucauaucuuu

SEQ ID NO: 721434 - RNA, 16 nt, Haemophilus influenzae Rd
cuuggcuaacuucuuc

SEQ ID NO: 721435 - RNA, 19 nt, Haemophilus influenzae Rd
cuuggcauuucaagcuggu

SEQ ID NO: 721436 - RNA, 19 nt, Haemophilus influenzae Rd
cuuggaagaauaaaagaua

SEQ ID NO: 721437 - RNA, 16 nt, Haemophilus influenzae Rd
cuuggaauaucaucua

SEQ ID NO: 721438 - RNA, 23 nt, Haemophilus influenzae Rd
cuuggaaugcaccagaugcaaua

SEQ ID NO: 721439 - RNA, 20 nt, Haemophilus influenzae Rd
cuuggcaacccacuucugca

SEQ ID NO: 721440 - RNA, 22 nt, Haemophilus influenzae Rd
cuuggauuuucuuagcuucauc

SEQ ID NO: 721441 - RNA, 15 nt, Haemophilus influenzae Rd
cuuggaucguuuucu

SEQ ID NO: 721442 - RNA, 19 nt, Haemophilus influenzae Rd
cuuggaucauacauaucca

SEQ ID NO: 721443 - RNA, 17 nt, Haemophilus influenzae Rd
cuuucugucaucacauc

SEQ ID NO: 721444 - RNA, 13 nt, Haemophilus influenzae Rd
cuuucuuaaaaua

SEQ ID NO: 721445 - RNA, 23 nt, Haemophilus influenzae Rd
cuuucuucagccauuccaaugau

SEQ ID NO: 721446 - RNA, 23 nt, Haemophilus influenzae Rd
cuuucgguacgaucacugccacu

SEQ ID NO: 721447 - RNA, 13 nt, Haemophilus influenzae Rd
cuuucggugcauu

SEQ ID NO: 721448 - RNA, 22 nt, Haemophilus influenzae Rd
cuuucggacuuugauaauacac

SEQ ID NO: 721449 - RNA, 15 nt, Haemophilus influenzae Rd
cuuuccucuccauca

SEQ ID NO: 721450 - RNA, 17 nt, Haemophilus influenzae Rd
cuuuccuucuaacauuu

SEQ ID NO: 721451 - RNA, 20 nt, Haemophilus influenzae Rd
cuuucgccgaguaaauucac

SEQ ID NO: 721452 - RNA, 19 nt, Haemophilus influenzae Rd
cuuucgaguaguaauaagc

SEQ ID NO: 721453 - RNA, 14 nt, Haemophilus influenzae Rd
cuuucgcagccacu

SEQ ID NO: 721454 - RNA, 15 nt, Haemophilus influenzae Rd
cuuugagccuucaaa

SEQ ID NO: 721455 - RNA, 18 nt, Haemophilus influenzae Rd
cuuugagccguuauauuu

SEQ ID NO: 721456 - RNA, 23 nt, Haemophilus influenzae Rd
cuuugagccguuauauuuccuuc

SEQ ID NO: 721457 - RNA, 17 nt, Haemophilus influenzae Rd
cuuugaauguaaaaaau

SEQ ID NO: 721458 - RNA, 22 nt, Haemophilus influenzae Rd
cuuugaauguaaaaaauaauuu

SEQ ID NO: 721459 - RNA, 14 nt, Haemophilus influenzae Rd
cuuugaguaaaaaa

SEQ ID NO: 721460 - RNA, 16 nt, Haemophilus influenzae Rd
cuuugaguaaaaaauc

SEQ ID NO: 721461 - RNA, 22 nt, Haemophilus influenzae Rd
cuuuggaauauucuuuuuaaau

SEQ ID NO: 721462 - RNA, 13 nt, Haemophilus influenzae Rd
cuuuggaaugaag

SEQ ID NO: 721463 - RNA, 19 nt, Haemophilus influenzae Rd
cuuuuaaugaacgauagcc

SEQ ID NO: 721464 - RNA, 17 nt, Haemophilus influenzae Rd
cuuuuaauucuugucuu

SEQ ID NO: 721465 - RNA, 12 nt, Haemophilus influenzae Rd
cuuuuaauaaau

SEQ ID NO: 721466 - RNA, 23 nt, Haemophilus influenzae Rd
cuuuuaauucagggauuaagaaa

SEQ ID NO: 721467 - RNA, 12 nt, Haemophilus influenzae Rd
cuuuuaauuaaa

SEQ ID NO: 721468 - RNA, 17 nt, Haemophilus influenzae Rd
cuuuuaauuaaauacaa

SEQ ID NO: 721469 - RNA, 17 nt, Haemophilus influenzae Rd
cuuuuaacugcuuuaau

SEQ ID NO: 721470 - RNA, 22 nt, Haemophilus influenzae Rd
cuuuuaacuuaaucauuuuuua

SEQ ID NO: 721471 - RNA, 20 nt, Haemophilus influenzae Rd
cuuuggauuggauuuugaaa

SEQ ID NO: 721472 - RNA, 15 nt, Haemophilus influenzae Rd
aaagaaucuuaaauu

SEQ ID NO: 721473 - RNA, 12 nt, Haemophilus influenzae Rd
aaagaauguuug

SEQ ID NO: 721474 - RNA, 18 nt, Haemophilus influenzae Rd
aaagaauuucaucgcauu

SEQ ID NO: 721475 - RNA, 22 nt, Haemophilus influenzae Rd
aaagaauuucaucgcauuuuua

SEQ ID NO: 721476 - RNA, 23 nt, Haemophilus influenzae Rd
aaagaauuggcgaaccuucacuu

SEQ ID NO: 721477 - RNA, 16 nt, Haemophilus influenzae Rd
aaagaauuugccugcc

SEQ ID NO: 721478 - RNA, 17 nt, Haemophilus influenzae Rd
aaagacagaagaaguaa

SEQ ID NO: 721479 - RNA, 17 nt, Haemophilus influenzae Rd
aaagacagcuauuaaaa

SEQ ID NO: 721480 - RNA, 21 nt, Haemophilus influenzae Rd
aaagacagcuauuaaaaaaag

SEQ ID NO: 721481 - RNA, 17 nt, Haemophilus influenzae Rd
aaagaagcguucaaaaa

SEQ ID NO: 721482 - RNA, 24 nt, Haemophilus influenzae Rd
aaagaagggaugauugacgaaaaa

SEQ ID NO: 721483 - RNA, 14 nt, Haemophilus influenzae Rd
aaagaauauaaaua

SEQ ID NO: 721484 - RNA, 23 nt, Haemophilus influenzae Rd
aaagaauaucgccuuaucccaua

SEQ ID NO: 721485 - RNA, 12 nt, Haemophilus influenzae Rd
aaagaauauuua

SEQ ID NO: 721486 - RNA, 13 nt, Haemophilus influenzae Rd
aaagaauauuuua

SEQ ID NO: 721487 - RNA, 14 nt, Haemophilus influenzae Rd
aaagaauauuuuaa

SEQ ID NO: 721488 - RNA, 21 nt, Haemophilus influenzae Rd
aaagaauauuuuaaugaaagu

SEQ ID NO: 721489 - RNA, 23 nt, Haemophilus influenzae Rd
aaagaauaauuuucaaacacaac

SEQ ID NO: 721490 - RNA, 12 nt, Haemophilus influenzae Rd
aaagaauaauaa

SEQ ID NO: 721491 - RNA, 22 nt, Haemophilus influenzae Rd
aaagaauaauauuaaagaaaau

SEQ ID NO: 721492 - RNA, 16 nt, Haemophilus influenzae Rd
cuuuacgggauuuuuu

SEQ ID NO: 721493 - RNA, 15 nt, Haemophilus influenzae Rd
cuuuacaaugagugu

SEQ ID NO: 721494 - RNA, 23 nt, Haemophilus influenzae Rd
cuuuacaaugaguguuauugaug

SEQ ID NO: 721495 - RNA, 21 nt, Haemophilus influenzae Rd
cuuuacauuuggcaaaauaau

SEQ ID NO: 721496 - RNA, 20 nt, Haemophilus influenzae Rd
cuuuaacuugcucugguuga

SEQ ID NO: 721497 - RNA, 17 nt, Haemophilus influenzae Rd
cuuuaacuucuaaagua

SEQ ID NO: 721498 - RNA, 20 nt, Haemophilus influenzae Rd
cuuuaacccauuuauuuaaa

SEQ ID NO: 721499 - RNA, 20 nt, Haemophilus influenzae Rd
cuuuaacugaagcaaucgca

SEQ ID NO: 721500 - RNA, 18 nt, Haemophilus influenzae Rd
cuuuaauuucuucaacua

SEQ ID NO: 721501 - RNA, 18 nt, Haemophilus influenzae Rd
cuuuaauuuuaucuaauc

SEQ ID NO: 721502 - RNA, 16 nt, Haemophilus influenzae Rd
cuuuaaggcacagauu

SEQ ID NO: 721503 - RNA, 20 nt, Haemophilus influenzae Rd
cuuuaauucgugcaaauuuu

SEQ ID NO: 721504 - RNA, 17 nt, Haemophilus influenzae Rd
cuuuaauugauuaaaaa

SEQ ID NO: 721505 - RNA, 15 nt, Haemophilus influenzae Rd
cuuuaagcuuuucua

SEQ ID NO: 721506 - RNA, 14 nt, Haemophilus influenzae Rd
cuuuaucuauugau

SEQ ID NO: 721507 - RNA, 23 nt, Haemophilus influenzae Rd
cuuuaucuauugauucuaaaaac

SEQ ID NO: 721508 - RNA, 21 nt, Haemophilus influenzae Rd
cuuuauuugagccaauaacuu

SEQ ID NO: 721509 - RNA, 22 nt, Haemophilus influenzae Rd
cuuuauuugcaccuuguaacca

SEQ ID NO: 721510 - RNA, 12 nt, Haemophilus influenzae Rd
cuuuauaaauga

SEQ ID NO: 721511 - RNA, 15 nt, Haemophilus influenzae Rd
cuuuauaaauaacau

SEQ ID NO: 721512 - RNA, 17 nt, Haemophilus influenzae Rd
cuuuacuuuuuaauaaa

SEQ ID NO: 721513 - RNA, 21 nt, Haemophilus influenzae Rd
cuuuacuuuuuaauaaaucaa

SEQ ID NO: 721514 - RNA, 12 nt, Haemophilus influenzae Rd
cuuuccaaucau

SEQ ID NO: 721515 - RNA, 20 nt, Haemophilus influenzae Rd
cuuucacuauuucaucuuua

SEQ ID NO: 721516 - RNA, 14 nt, Haemophilus influenzae Rd
cuuuauuuugcaac

SEQ ID NO: 721517 - RNA, 18 nt, Haemophilus influenzae Rd
cuucugcggaaaugaaac

SEQ ID NO: 721518 - RNA, 20 nt, Haemophilus influenzae Rd
cuucugcggucaucucuugu

SEQ ID NO: 721519 - RNA, 19 nt, Haemophilus influenzae Rd
cuucugcagaaaaauguuc

SEQ ID NO: 721520 - RNA, 21 nt, Haemophilus influenzae Rd
cuucugaacgcgcgccaauaa

SEQ ID NO: 721521 - RNA, 19 nt, Haemophilus influenzae Rd
cuucugaauccaaugcacu

SEQ ID NO: 721522 - RNA, 19 nt, Haemophilus influenzae Rd
cuucucuuuuuauuuuacu

SEQ ID NO: 721523 - RNA, 22 nt, Haemophilus influenzae Rd
cuucucgcccaacagauuuaau

SEQ ID NO: 721524 - RNA, 20 nt, Haemophilus influenzae Rd
cuucuacggucgcaccaccu

SEQ ID NO: 721525 - RNA, 17 nt, Haemophilus influenzae Rd
cuucuacgccuaaugca

SEQ ID NO: 721526 - RNA, 21 nt, Haemophilus influenzae Rd
cuucuagauaguuuucgcaau

SEQ ID NO: 721527 - RNA, 16 nt, Haemophilus influenzae Rd
cuucuaauuuuaaaac

SEQ ID NO: 721528 - RNA, 18 nt, Haemophilus influenzae Rd
cuucuaacgccauuggau

SEQ ID NO: 721529 - RNA, 12 nt, Haemophilus influenzae Rd
cuucuaauucug

SEQ ID NO: 721530 - RNA, 20 nt, Haemophilus influenzae Rd
cuucuaauucugcacgacgu

SEQ ID NO: 721531 - RNA, 14 nt, Haemophilus influenzae Rd
cuucuaauucuucc

SEQ ID NO: 721532 - RNA, 15 nt, Haemophilus influenzae Rd
cuucuaauucuuccc

SEQ ID NO: 721533 - RNA, 14 nt, Haemophilus influenzae Rd
cuucgucaucauca

SEQ ID NO: 721534 - RNA, 23 nt, Haemophilus influenzae Rd
cuucgugaauacgaucugcaucu

SEQ ID NO: 721535 - RNA, 14 nt, Haemophilus influenzae Rd
cuucgugcugaaga

SEQ ID NO: 721536 - RNA, 23 nt, Haemophilus influenzae Rd
cuucguuuucugcuucagauucu

SEQ ID NO: 721537 - RNA, 20 nt, Haemophilus influenzae Rd
cuucuaaaauacguuuuuuc

SEQ ID NO: 721538 - RNA, 17 nt, Haemophilus influenzae Rd
cuucuaaaggcuaaaua

SEQ ID NO: 721539 - RNA, 18 nt, Haemophilus influenzae Rd
cuucuaaaaccaauaauc

SEQ ID NO: 721540 - RNA, 12 nt, Haemophilus influenzae Rd
cuucuaaaagag

SEQ ID NO: 721541 - RNA, 15 nt, Haemophilus influenzae Rd
cuucugggucuuuuu

SEQ ID NO: 721542 - RNA, 16 nt, Haemophilus influenzae Rd
cuucugggucuuuuug

SEQ ID NO: 721543 - RNA, 18 nt, Haemophilus influenzae Rd
cuucugggucuuuuugug

SEQ ID NO: 721544 - RNA, 16 nt, Haemophilus influenzae Rd
cuucuggguaaaauaa

SEQ ID NO: 721545 - RNA, 20 nt, Haemophilus influenzae Rd
cuucuguaagcagcuaacaa

SEQ ID NO: 721546 - RNA, 15 nt, Haemophilus influenzae Rd
cuucuguuuucaaua

SEQ ID NO: 721547 - RNA, 18 nt, Haemophilus influenzae Rd
cuucuguuuugccugcuu

SEQ ID NO: 721548 - RNA, 19 nt, Haemophilus influenzae Rd
cuucuguuuugccugcuuc

SEQ ID NO: 721549 - RNA, 23 nt, Haemophilus influenzae Rd
cuucuguuaaacgcauauuuugu

SEQ ID NO: 721550 - RNA, 16 nt, Haemophilus influenzae Rd
cuucuguugcuucaau

SEQ ID NO: 721551 - RNA, 22 nt, Haemophilus influenzae Rd
cuucuguugcuucaauuguugu

SEQ ID NO: 721552 - RNA, 17 nt, Haemophilus influenzae Rd
cuucuucaaagauugca

SEQ ID NO: 721553 - RNA, 18 nt, Haemophilus influenzae Rd
cuucuucaggugcaacuu

SEQ ID NO: 721554 - RNA, 14 nt, Haemophilus influenzae Rd
cuucuuguggagau

SEQ ID NO: 721555 - RNA, 17 nt, Haemophilus influenzae Rd
cuucuucgcuccaauca

SEQ ID NO: 721556 - RNA, 19 nt, Haemophilus influenzae Rd
cuucuucgcuuaaacgaau

SEQ ID NO: 721557 - RNA, 10 nt, Haemophilus influenzae Rd
cuucuuccca

SEQ ID NO: 721558 - RNA, 11 nt, Haemophilus influenzae Rd
cuucuucccaa

SEQ ID NO: 721559 - RNA, 16 nt, Haemophilus influenzae Rd
cuucuuccacuuuuug

SEQ ID NO: 721560 - RNA, 15 nt, Haemophilus influenzae Rd
cuucuucaucgcuca

SEQ ID NO: 721561 - RNA, 19 nt, Haemophilus influenzae Rd
cuugaaauaguuaaagaaa

SEQ ID NO: 721562 - RNA, 19 nt, Haemophilus influenzae Rd
cuucuuuuggauacacaaa

SEQ ID NO: 721563 - RNA, 23 nt, Haemophilus influenzae Rd
cuugaaauugucguccuucaaau

SEQ ID NO: 721564 - RNA, 15 nt, Haemophilus influenzae Rd
cuucuuucauuugaa

SEQ ID NO: 721565 - RNA, 15 nt, Haemophilus influenzae Rd
cuugaauugauaaag

SEQ ID NO: 721566 - RNA, 18 nt, Haemophilus influenzae Rd
cuugaauugcauuuucuu

SEQ ID NO: 721567 - RNA, 20 nt, Haemophilus influenzae Rd
cuugaauugcauuuucuucc

SEQ ID NO: 721568 - RNA, 18 nt, Haemophilus influenzae Rd
cuugaauugcuccuccua

SEQ ID NO: 721569 - RNA, 21 nt, Haemophilus influenzae Rd
cuugaaugucuuaaagauaaa

SEQ ID NO: 721570 - RNA, 11 nt, Haemophilus influenzae Rd
cuugaauaaua

SEQ ID NO: 721571 - RNA, 22 nt, Haemophilus influenzae Rd
cuugaauaucagcuacuuccca

SEQ ID NO: 721572 - RNA, 13 nt, Haemophilus influenzae Rd
cuugaauaugaug

SEQ ID NO: 721573 - RNA, 20 nt, Haemophilus influenzae Rd
cuugacaacgcucacuuaau

SEQ ID NO: 721574 - RNA, 15 nt, Haemophilus influenzae Rd
cuugacauaauuuca

SEQ ID NO: 721575 - RNA, 19 nt, Haemophilus influenzae Rd
cuugaagucuauaaaagaa

SEQ ID NO: 721576 - RNA, 20 nt, Haemophilus influenzae Rd
cuugaagucuauaaaagaag

SEQ ID NO: 721577 - RNA, 23 nt, Haemophilus influenzae Rd
cuugaagucuauaaaagaaggga

SEQ ID NO: 721578 - RNA, 16 nt, Haemophilus influenzae Rd
cuugaagaucuucaua

SEQ ID NO: 721579 - RNA, 12 nt, Haemophilus influenzae Rd
cuugaacuugac

SEQ ID NO: 721580 - RNA, 23 nt, Haemophilus influenzae Rd
cuugaacagcuuugcugucuuug

SEQ ID NO: 721581 - RNA, 23 nt, Haemophilus influenzae Rd
cuugaaccagugaccaagcgauu

SEQ ID NO: 721582 - RNA, 15 nt, Haemophilus influenzae Rd
cuugacuaucuguuu

SEQ ID NO: 721583 - RNA, 14 nt, Haemophilus influenzae Rd
cuugacgcauuaau

SEQ ID NO: 721584 - RNA, 17 nt, Haemophilus influenzae Rd
cuugacgguuuuuauua

SEQ ID NO: 721585 - RNA, 23 nt, Haemophilus influenzae Rd
cuugaccugcagccauaauauuu

SEQ ID NO: 721586 - RNA, 13 nt, Haemophilus influenzae Rd
cuugaccuguuaa

SEQ ID NO: 721587 - RNA, 13 nt, Haemophilus influenzae Rd
cuugaccuucaau

SEQ ID NO: 721588 - RNA, 15 nt, Haemophilus influenzae Rd
cuugaccuucaauug

SEQ ID NO: 721589 - RNA, 21 nt, Haemophilus influenzae Rd
cuugaguuucgccagcaccac

SEQ ID NO: 721590 - RNA, 18 nt, Haemophilus influenzae Rd
cuugaguugucacaacag

SEQ ID NO: 721591 - RNA, 21 nt, Haemophilus influenzae Rd
cuugauauucaaggagcuuua

SEQ ID NO: 721592 - RNA, 21 nt, Haemophilus influenzae Rd
cuugauauaaguucuaaauaa

SEQ ID NO: 721593 - RNA, 24 nt, Haemophilus influenzae Rd
cuugauauaaguucuaaauaaacu

SEQ ID NO: 721594 - RNA, 18 nt, Haemophilus influenzae Rd
cuugauauaauauuuugg

SEQ ID NO: 721595 - RNA, 21 nt, Haemophilus influenzae Rd
cuugauacauuucuaaaauaa

SEQ ID NO: 721596 - RNA, 18 nt, Haemophilus influenzae Rd
cuugaucacauauuuuug

SEQ ID NO: 721597 - RNA, 16 nt, Haemophilus influenzae Rd
cuugauccauauauug

SEQ ID NO: 721598 - RNA, 20 nt, Haemophilus influenzae Rd
cuugcaaucacgcucaaucu

SEQ ID NO: 721599 - RNA, 17 nt, Haemophilus influenzae Rd
cuugcacaauuacuucu

SEQ ID NO: 721600 - RNA, 13 nt, Haemophilus influenzae Rd
cuugcacaauuug

SEQ ID NO: 721601 - RNA, 19 nt, Haemophilus influenzae Rd
cuugauuucaguagaauca

SEQ ID NO: 721602 - RNA, 20 nt, Haemophilus influenzae Rd
cuugauuucaguagaaucaa

SEQ ID NO: 721603 - RNA, 23 nt, Haemophilus influenzae Rd
cuugauuucaguagaaucaaggc

SEQ ID NO: 721604 - RNA, 12 nt, Haemophilus influenzae Rd
cuugauuauuuu

SEQ ID NO: 721605 - RNA, 18 nt, Haemophilus influenzae Rd
cuugauguuuuugaagua

SEQ ID NO: 721606 - RNA, 20 nt, Haemophilus influenzae Rd
cuugauuauuuaauuucaaa

SEQ ID NO: 721607 - RNA, 19 nt, Haemophilus influenzae Rd
cuugaugauaaucuuccca

SEQ ID NO: 721608 - RNA, 19 nt, Haemophilus influenzae Rd
cuugcagauugcugacaaa

SEQ ID NO: 721609 - RNA, 16 nt, Haemophilus influenzae Rd
cuugcaccaccaauua

SEQ ID NO: 721610 - RNA, 20 nt, Haemophilus influenzae Rd
cuugcacggcaguaucuugg

SEQ ID NO: 721611 - RNA, 17 nt, Haemophilus influenzae Rd
cuugcacugcuaauucc

SEQ ID NO: 721612 - RNA, 19 nt, Haemophilus influenzae Rd
cuugcauucgguuuuaagu

SEQ ID NO: 721613 - RNA, 22 nt, Haemophilus influenzae Rd
cuugcauauuugcgauugcugu

SEQ ID NO: 721614 - RNA, 16 nt, Haemophilus influenzae Rd
cuugcauaaaccaacu

SEQ ID NO: 721615 - RNA, 13 nt, Haemophilus influenzae Rd
cuugccagauuuu

SEQ ID NO: 721616 - RNA, 15 nt, Haemophilus influenzae Rd
cuugccaauucagcu

SEQ ID NO: 721617 - RNA, 23 nt, Haemophilus influenzae Rd
cuugccaauugaauuaaaaguag

SEQ ID NO: 721618 - RNA, 15 nt, Haemophilus influenzae Rd
cuugccacagguaaa

SEQ ID NO: 721619 - RNA, 16 nt, Haemophilus influenzae Rd
cuugccgcuuccacac

SEQ ID NO: 721620 - RNA, 16 nt, Haemophilus influenzae Rd
aaacuugcaaaccaac

SEQ ID NO: 721621 - RNA, 22 nt, Haemophilus influenzae Rd
aaacuugacguuguucuucugu

SEQ ID NO: 721622 - RNA, 14 nt, Haemophilus influenzae Rd
aaacuuguuaaaua

SEQ ID NO: 721623 - RNA, 20 nt, Haemophilus influenzae Rd
aaacuuuagagauuuuauuc

SEQ ID NO: 721624 - RNA, 16 nt, Haemophilus influenzae Rd
aaacuuuuaauagcgc

SEQ ID NO: 721625 - RNA, 16 nt, Haemophilus influenzae Rd
cuugccgaaaauuuac

SEQ ID NO: 721626 - RNA, 13 nt, Haemophilus influenzae Rd
cuugcugauaaau

SEQ ID NO: 721627 - RNA, 21 nt, Haemophilus influenzae Rd
cuugcugauaaauuccuucca

SEQ ID NO: 721628 - RNA, 19 nt, Haemophilus influenzae Rd
cuugcugaaguuguaauaa

SEQ ID NO: 721629 - RNA, 17 nt, Haemophilus influenzae Rd
cuugcucacgggcagaa

SEQ ID NO: 721630 - RNA, 13 nt, Haemophilus influenzae Rd
cuugcuauuuucu

SEQ ID NO: 721631 - RNA, 18 nt, Haemophilus influenzae Rd
cuugcuauuuucuaauuu

SEQ ID NO: 721632 - RNA, 18 nt, Haemophilus influenzae Rd
cuugcugggcaagggauu

SEQ ID NO: 721633 - RNA, 18 nt, Haemophilus influenzae Rd
cuugcuguugguuaaaaa

SEQ ID NO: 721634 - RNA, 20 nt, Haemophilus influenzae Rd
cuugcuguugguuaaaaaua

SEQ ID NO: 721635 - RNA, 21 nt, Haemophilus influenzae Rd
cuugcuguugguuaaaaauag

SEQ ID NO: 721636 - RNA, 16 nt, Haemophilus influenzae Rd
cuugcugccacaagau

SEQ ID NO: 721637 - RNA, 19 nt, Haemophilus influenzae Rd
cuugcuuuuuaauugauuc

SEQ ID NO: 721638 - RNA, 15 nt, Haemophilus influenzae Rd
cuugcuguuuuuccg

SEQ ID NO: 721639 - RNA, 18 nt, Haemophilus influenzae Rd
cuugcuguuuuuccgcua

SEQ ID NO: 721640 - RNA, 12 nt, Haemophilus influenzae Rd
cuugcuuaaauu

SEQ ID NO: 721641 - RNA, 13 nt, Haemophilus influenzae Rd
cuugcuuuaauug

SEQ ID NO: 721642 - RNA, 20 nt, Haemophilus influenzae Rd
cuugcgcaauggcuuguucc

SEQ ID NO: 721643 - RNA, 21 nt, Haemophilus influenzae Rd
cuugcggauuacuuucauuua

SEQ ID NO: 721644 - RNA, 18 nt, Haemophilus influenzae Rd
cuugcguuugguucauca

SEQ ID NO: 721645 - RNA, 20 nt, Haemophilus influenzae Rd
cuugcguuugguucaucauu

SEQ ID NO: 721646 - RNA, 13 nt, Haemophilus influenzae Rd
cuugcuaaaaaga

SEQ ID NO: 721647 - RNA, 20 nt, Haemophilus influenzae Rd
cuugcuaaaaagaaauaaaa

SEQ ID NO: 721648 - RNA, 14 nt, Haemophilus influenzae Rd
cuuaaaaagagcgg

SEQ ID NO: 721649 - RNA, 17 nt, Haemophilus influenzae Rd
cuguuuuuccauucacu

SEQ ID NO: 721650 - RNA, 15 nt, Haemophilus influenzae Rd
cuguuucuucuacuu

SEQ ID NO: 721651 - RNA, 13 nt, Haemophilus influenzae Rd
cuuaaauaguuaa

SEQ ID NO: 721652 - RNA, 23 nt, Haemophilus influenzae Rd
cuuaaauaguuaauugauuuaaa

SEQ ID NO: 721653 - RNA, 20 nt, Haemophilus influenzae Rd
cuuaaagcaaucaaaaauga

SEQ ID NO: 721654 - RNA, 18 nt, Haemophilus influenzae Rd
cuuaaagcugaauaaaua

SEQ ID NO: 721655 - RNA, 23 nt, Haemophilus influenzae Rd
cuuaaagaauuucuuucgcuuuu

SEQ ID NO: 721656 - RNA, 22 nt, Haemophilus influenzae Rd
cuuaaacuaaaugaaguucacu

SEQ ID NO: 721657 - RNA, 18 nt, Haemophilus influenzae Rd
cuuaaccaucacaaagga

SEQ ID NO: 721658 - RNA, 18 nt, Haemophilus influenzae Rd
cuuaaauuagcguaaaca

SEQ ID NO: 721659 - RNA, 13 nt, Haemophilus influenzae Rd
cuuaaucauugca

SEQ ID NO: 721660 - RNA, 20 nt, Haemophilus influenzae Rd
cuuaaucacugaauuucauu

SEQ ID NO: 721661 - RNA, 14 nt, Haemophilus influenzae Rd
cuuaauauguucuu

SEQ ID NO: 721662 - RNA, 21 nt, Haemophilus influenzae Rd
cuuaauauugccauaauaauc

SEQ ID NO: 721663 - RNA, 13 nt, Haemophilus influenzae Rd
cuguucaaauaag

SEQ ID NO: 721664 - RNA, 19 nt, Haemophilus influenzae Rd
cuguuauuaagcgugcuuu

SEQ ID NO: 721665 - RNA, 14 nt, Haemophilus influenzae Rd
cuguuacuucuuuc

SEQ ID NO: 721666 - RNA, 23 nt, Haemophilus influenzae Rd
cuguuauauaaacaauuccccuu

SEQ ID NO: 721667 - RNA, 21 nt, Haemophilus influenzae Rd
cuguuucaaugucuuuuucuu

SEQ ID NO: 721668 - RNA, 18 nt, Haemophilus influenzae Rd
cuguuucacgaucauaaa

SEQ ID NO: 721669 - RNA, 21 nt, Haemophilus influenzae Rd
cuguuucgcaguguuaaaugc

SEQ ID NO: 721670 - RNA, 20 nt, Haemophilus influenzae Rd
cuguuuaguguguccccccg

SEQ ID NO: 721671 - RNA, 22 nt, Haemophilus influenzae Rd
cuguuuauagcgucuuuuugca

SEQ ID NO: 721672 - RNA, 13 nt, Haemophilus influenzae Rd
cuguuuaucaaua

SEQ ID NO: 721673 - RNA, 20 nt, Haemophilus influenzae Rd
cuguuuaaaucuaagccuug

SEQ ID NO: 721674 - RNA, 13 nt, Haemophilus influenzae Rd
cuguuccugcauu

SEQ ID NO: 721675 - RNA, 20 nt, Haemophilus influenzae Rd
cuguucgcaaacaugcuccc

SEQ ID NO: 721676 - RNA, 14 nt, Haemophilus influenzae Rd
cuuauauauaaaau

SEQ ID NO: 721677 - RNA, 18 nt, Haemophilus influenzae Rd
cuuauauauaaaauauau

SEQ ID NO: 721678 - RNA, 13 nt, Haemophilus influenzae Rd
cuuauauuuuuga

SEQ ID NO: 721679 - RNA, 16 nt, Haemophilus influenzae Rd
cuuauauuauuuagau

SEQ ID NO: 721680 - RNA, 21 nt, Haemophilus influenzae Rd
cuuaucaaucaagaauuccau

SEQ ID NO: 721681 - RNA, 12 nt, Haemophilus influenzae Rd
cuuaucaaacac

SEQ ID NO: 721682 - RNA, 17 nt, Haemophilus influenzae Rd
cuuaggaugauacaauc

SEQ ID NO: 721683 - RNA, 21 nt, Haemophilus influenzae Rd
cuuagcgcauuuuucuuuaaa

SEQ ID NO: 721684 - RNA, 17 nt, Haemophilus influenzae Rd
cuuagcgugcuaauucc

SEQ ID NO: 721685 - RNA, 16 nt, Haemophilus influenzae Rd
cuuagcuuuuuucuua

SEQ ID NO: 721686 - RNA, 14 nt, Haemophilus influenzae Rd
cuuauuuacuuuau

SEQ ID NO: 721687 - RNA, 15 nt, Haemophilus influenzae Rd
cuuaugugcaccuuc

SEQ ID NO: 721688 - RNA, 16 nt, Haemophilus influenzae Rd
cuuaugugcaccuuca

SEQ ID NO: 721689 - RNA, 15 nt, Haemophilus influenzae Rd
cuuauuucuguuacu

SEQ ID NO: 721690 - RNA, 13 nt, Haemophilus influenzae Rd
cuuauuugauuaa

SEQ ID NO: 721691 - RNA, 12 nt, Haemophilus influenzae Rd
cuuauuuuaaau

SEQ ID NO: 721692 - RNA, 15 nt, Haemophilus influenzae Rd
cuuauuuuaaauaaa

SEQ ID NO: 721693 - RNA, 16 nt, Haemophilus influenzae Rd
cuuauuuuaaauaaaa

SEQ ID NO: 721694 - RNA, 14 nt, Haemophilus influenzae Rd
cuuaucuaaaaaga

SEQ ID NO: 721695 - RNA, 15 nt, Haemophilus influenzae Rd
cuuaugcaaaguauu

SEQ ID NO: 721696 - RNA, 17 nt, Haemophilus influenzae Rd
cuuauccuauaaaacaa

SEQ ID NO: 721697 - RNA, 23 nt, Haemophilus influenzae Rd
cuuacgaagaauccacauuuuuu

SEQ ID NO: 721698 - RNA, 21 nt, Haemophilus influenzae Rd
cuuaccuaaaaauuuaaauau

SEQ ID NO: 721699 - RNA, 15 nt, Haemophilus influenzae Rd
cuuacucauuuauca

SEQ ID NO: 721700 - RNA, 18 nt, Haemophilus influenzae Rd
cuuacuacguguucauca

SEQ ID NO: 721701 - RNA, 16 nt, Haemophilus influenzae Rd
cuuacugccuuuuucu

SEQ ID NO: 721702 - RNA, 13 nt, Haemophilus influenzae Rd
cuuagauuuucuu

SEQ ID NO: 721703 - RNA, 21 nt, Haemophilus influenzae Rd
cuuagauuuucuuauuauaca

SEQ ID NO: 721704 - RNA, 15 nt, Haemophilus influenzae Rd
cuuacccaguaaaac

SEQ ID NO: 721705 - RNA, 14 nt, Haemophilus influenzae Rd
cuuaccgaucauuu

SEQ ID NO: 721706 - RNA, 16 nt, Haemophilus influenzae Rd
cuuaauguuaauaauu

SEQ ID NO: 721707 - RNA, 16 nt, Haemophilus influenzae Rd
cuuaauucuaagguua

SEQ ID NO: 721708 - RNA, 16 nt, Haemophilus influenzae Rd
cuuaaucggcacaaga

SEQ ID NO: 721709 - RNA, 21 nt, Haemophilus influenzae Rd
cuuaauggcuugcucuguauu

SEQ ID NO: 721710 - RNA, 15 nt, Haemophilus influenzae Rd
cuuaauuaaagauag

SEQ ID NO: 721711 - RNA, 13 nt, Haemophilus influenzae Rd
cuuaauuaagaua

SEQ ID NO: 721712 - RNA, 14 nt, Haemophilus influenzae Rd
cuuaauuaaucuuu

SEQ ID NO: 721713 - RNA, 16 nt, Haemophilus influenzae Rd
cuuaauuagauuuauu

SEQ ID NO: 721714 - RNA, 18 nt, Haemophilus influenzae Rd
cuuaauuaguuauacuua

SEQ ID NO: 721715 - RNA, 12 nt, Haemophilus influenzae Rd
cuuccacuuuug

SEQ ID NO: 721716 - RNA, 21 nt, Haemophilus influenzae Rd
cuuccgcuggugggaauaauu

SEQ ID NO: 721717 - RNA, 12 nt, Haemophilus influenzae Rd
aaacuuccaaaa

SEQ ID NO: 721718 - RNA, 16 nt, Haemophilus influenzae Rd
cuucauuugcuucuau

SEQ ID NO: 721719 - RNA, 21 nt, Haemophilus influenzae Rd
cuucauuuugagauaaauuuu

SEQ ID NO: 721720 - RNA, 21 nt, Haemophilus influenzae Rd
aaacuucucuuauuugugugg

SEQ ID NO: 721721 - RNA, 18 nt, Haemophilus influenzae Rd
cuuccaaauccaucauuu

SEQ ID NO: 721722 - RNA, 20 nt, Haemophilus influenzae Rd
cuuccuuauugccuaauuca

SEQ ID NO: 721723 - RNA, 23 nt, Haemophilus influenzae Rd
cuucgaccaacggauuaaaaguc

SEQ ID NO: 721724 - RNA, 22 nt, Haemophilus influenzae Rd
cuuccugcuggguuugcacuuu

SEQ ID NO: 721725 - RNA, 23 nt, Haemophilus influenzae Rd
cuuccgucaauaucccaacuuua

SEQ ID NO: 721726 - RNA, 12 nt, Haemophilus influenzae Rd
cuuccuaugaau

SEQ ID NO: 721727 - RNA, 16 nt, Haemophilus influenzae Rd
cuuccguuccccaaug

SEQ ID NO: 721728 - RNA, 13 nt, Haemophilus influenzae Rd
cuucgggcaccau

SEQ ID NO: 721729 - RNA, 22 nt, Haemophilus influenzae Rd
cuucgggcgaaaccuuuuucuu

SEQ ID NO: 721730 - RNA, 20 nt, Haemophilus influenzae Rd
cuucgcgagaauuaccacaa

SEQ ID NO: 721731 - RNA, 22 nt, Haemophilus influenzae Rd
cuucgcgagaauuaccacaaga

SEQ ID NO: 721732 - RNA, 18 nt, Haemophilus influenzae Rd
cuucagcuugaguuguca

SEQ ID NO: 721733 - RNA, 23 nt, Haemophilus influenzae Rd
cuucacuacuugaacuaauauca

SEQ ID NO: 721734 - RNA, 11 nt, Haemophilus influenzae Rd
cuucagauuuu

SEQ ID NO: 721735 - RNA, 16 nt, Haemophilus influenzae Rd
cuucagcauaauguuu

SEQ ID NO: 721736 - RNA, 22 nt, Haemophilus influenzae Rd
cuucagcagauacaucuucugg

SEQ ID NO: 721737 - RNA, 23 nt, Haemophilus influenzae Rd
cuucauccaauacuguuuggcaa

SEQ ID NO: 721738 - RNA, 16 nt, Haemophilus influenzae Rd
cuucauuauauuccuu

SEQ ID NO: 721739 - RNA, 16 nt, Haemophilus influenzae Rd
cuucauuccauuuugc

SEQ ID NO: 721740 - RNA, 23 nt, Haemophilus influenzae Rd
cuucauuguggaaacgugcaauu

SEQ ID NO: 721741 - RNA, 23 nt, Haemophilus influenzae Rd
cuucauuuagugaccacauuucg

SEQ ID NO: 721742 - RNA, 12 nt, Haemophilus influenzae Rd
cuucauucucuu

SEQ ID NO: 721743 - RNA, 15 nt, Haemophilus influenzae Rd
cuucauucucuucug

SEQ ID NO: 721744 - RNA, 19 nt, Haemophilus influenzae Rd
cuucauugauggaauaaau

SEQ ID NO: 721745 - RNA, 17 nt, Haemophilus influenzae Rd
cuucaucagccgcuuuu

SEQ ID NO: 721746 - RNA, 14 nt, Haemophilus influenzae Rd
cuucaucaccugcu

SEQ ID NO: 721747 - RNA, 22 nt, Haemophilus influenzae Rd
cuucaguccgccuuuuugcuua

SEQ ID NO: 721748 - RNA, 16 nt, Haemophilus influenzae Rd
cuucaccagugaauuu

SEQ ID NO: 721749 - RNA, 12 nt, Haemophilus influenzae Rd
cuucaaugguuu

SEQ ID NO: 721750 - RNA, 15 nt, Haemophilus influenzae Rd
cuucaaugguuuuac

SEQ ID NO: 721751 - RNA, 18 nt, Haemophilus influenzae Rd
cuucaaucaucauuuauu

SEQ ID NO: 721752 - RNA, 21 nt, Haemophilus influenzae Rd
cuucaaucaucauuuauuaaa

SEQ ID NO: 721753 - RNA, 17 nt, Haemophilus influenzae Rd
cuucaaucgcaacacgu

SEQ ID NO: 721754 - RNA, 19 nt, Haemophilus influenzae Rd
cuucaacuugccacaguag

SEQ ID NO: 721755 - RNA, 14 nt, Haemophilus influenzae Rd
cuucaaaauuuggc

SEQ ID NO: 721756 - RNA, 16 nt, Haemophilus influenzae Rd
cuucaaaauuuggccc

SEQ ID NO: 721757 - RNA, 20 nt, Haemophilus influenzae Rd
cuuauuuuuuggaauauuau

SEQ ID NO: 721758 - RNA, 14 nt, Haemophilus influenzae Rd
cuuauuuugggauu

SEQ ID NO: 721759 - RNA, 15 nt, Haemophilus influenzae Rd
cuuauuuuacuucaa

SEQ ID NO: 721760 - RNA, 11 nt, Haemophilus influenzae Rd
cuuauuuuguu

SEQ ID NO: 721761 - RNA, 17 nt, Haemophilus influenzae Rd
cuuauuuuguugcagcu

SEQ ID NO: 721762 - RNA, 18 nt, Haemophilus influenzae Rd
cuuauuuuguugcagcuu

SEQ ID NO: 721763 - RNA, 22 nt, Haemophilus influenzae Rd
cuuauuuuguugcagcuuucau

SEQ ID NO: 721764 - RNA, 13 nt, Haemophilus influenzae Rd
cggcuaaaacaga

SEQ ID NO: 721765 - RNA, 19 nt, Haemophilus influenzae Rd
cggcuuuuucaauacuuuu

SEQ ID NO: 721766 - RNA, 15 nt, Haemophilus influenzae Rd
cgggaaaauuuggaa

SEQ ID NO: 721767 - RNA, 18 nt, Haemophilus influenzae Rd
cgggaaaauuuggaauaa

SEQ ID NO: 721768 - RNA, 15 nt, Haemophilus influenzae Rd
cggcuucauuuugag

SEQ ID NO: 721769 - RNA, 14 nt, Haemophilus influenzae Rd
cgggcgauaaaauc

SEQ ID NO: 721770 - RNA, 22 nt, Haemophilus influenzae Rd
cgguaauuugaucuaauuugcc

SEQ ID NO: 721771 - RNA, 23 nt, Haemophilus influenzae Rd
cgguagacacaagggauuuaaaa

SEQ ID NO: 721772 - RNA, 18 nt, Haemophilus influenzae Rd
cgguauuuuuauuuauag

SEQ ID NO: 721773 - RNA, 16 nt, Haemophilus influenzae Rd
aaacuaaaucuugcuu

SEQ ID NO: 721774 - RNA, 23 nt, Haemophilus influenzae Rd
aaacuaaaucuugcuuuugguuu

SEQ ID NO: 721775 - RNA, 14 nt, Haemophilus influenzae Rd
aaacuaauaaaagc

SEQ ID NO: 721776 - RNA, 16 nt, Haemophilus influenzae Rd
aaacuaauuucauuuu

SEQ ID NO: 721777 - RNA, 21 nt, Haemophilus influenzae Rd
aaacuacuuucuauuaaaaaa

SEQ ID NO: 721778 - RNA, 22 nt, Haemophilus influenzae Rd
aaacuacuuucuauuaaaaaau

SEQ ID NO: 721779 - RNA, 14 nt, Haemophilus influenzae Rd
cggucgcaccaccu

SEQ ID NO: 721780 - RNA, 16 nt, Haemophilus influenzae Rd
cggucgcaccaccuuu

SEQ ID NO: 721781 - RNA, 20 nt, Haemophilus influenzae Rd
cggucaucuacccacacacc

SEQ ID NO: 721782 - RNA, 19 nt, Haemophilus influenzae Rd
cggucauugugugcagaau

SEQ ID NO: 721783 - RNA, 19 nt, Haemophilus influenzae Rd
cggucuuuuuuuauauuuu

SEQ ID NO: 721784 - RNA, 20 nt, Haemophilus influenzae Rd
cggucuuuuuuuauauuuuu

SEQ ID NO: 721785 - RNA, 20 nt, Haemophilus influenzae Rd
cggucugaaaaucaaaagaa

SEQ ID NO: 721786 - RNA, 14 nt, Haemophilus influenzae Rd
cggugaauuuauca

SEQ ID NO: 721787 - RNA, 15 nt, Haemophilus influenzae Rd
cggugaaauuucacc

SEQ ID NO: 721788 - RNA, 18 nt, Haemophilus influenzae Rd
cgggugcgccauuuuuaa

SEQ ID NO: 721789 - RNA, 16 nt, Haemophilus influenzae Rd
cgggugucgugaaaau

SEQ ID NO: 721790 - RNA, 18 nt, Haemophilus influenzae Rd
cggguuuauguaaauaag

SEQ ID NO: 721791 - RNA, 17 nt, Haemophilus influenzae Rd
cgguaaaauucuauuaa

SEQ ID NO: 721792 - RNA, 21 nt, Haemophilus influenzae Rd
cggguuuugcuaauggagaaa

SEQ ID NO: 721793 - RNA, 14 nt, Haemophilus influenzae Rd
cgguaaaaaaguaa

SEQ ID NO: 721794 - RNA, 17 nt, Haemophilus influenzae Rd
cgguaaaaaucauuaaa

SEQ ID NO: 721795 - RNA, 17 nt, Haemophilus influenzae Rd
cgguaaaaauuucucuc

SEQ ID NO: 721796 - RNA, 14 nt, Haemophilus influenzae Rd
cgguaaauuuuaaa

SEQ ID NO: 721797 - RNA, 14 nt, Haemophilus influenzae Rd
cgguaaauuuuuac

SEQ ID NO: 721798 - RNA, 15 nt, Haemophilus influenzae Rd
cgucaaaggaacaga

SEQ ID NO: 721799 - RNA, 12 nt, Haemophilus influenzae Rd
cguauuaaauac

SEQ ID NO: 721800 - RNA, 17 nt, Haemophilus influenzae Rd
cguauaagcuaaagcaa

SEQ ID NO: 721801 - RNA, 14 nt, Haemophilus influenzae Rd
cguaguuauuuauu

SEQ ID NO: 721802 - RNA, 18 nt, Haemophilus influenzae Rd
cguagucggcgauuuauu

SEQ ID NO: 721803 - RNA, 22 nt, Haemophilus influenzae Rd
cguaugcgaaugguaacauuca

SEQ ID NO: 721804 - RNA, 23 nt, Haemophilus influenzae Rd
cguagcguaaucacauagauuua

SEQ ID NO: 721805 - RNA, 14 nt, Haemophilus influenzae Rd
cguaguauggcaag

SEQ ID NO: 721806 - RNA, 15 nt, Haemophilus influenzae Rd
cguagucacaacaau

SEQ ID NO: 721807 - RNA, 22 nt, Haemophilus influenzae Rd
cguaaucgugccugccaccaug

SEQ ID NO: 721808 - RNA, 15 nt, Haemophilus influenzae Rd
cguaaucugauggga

SEQ ID NO: 721809 - RNA, 22 nt, Haemophilus influenzae Rd
cguagccuagugcuaaaauaaa

SEQ ID NO: 721810 - RNA, 21 nt, Haemophilus influenzae Rd
cguagccuggcacuaagaaag

SEQ ID NO: 721811 - RNA, 19 nt, Haemophilus influenzae Rd
cguaauaauuguaguuaga

SEQ ID NO: 721812 - RNA, 13 nt, Haemophilus influenzae Rd
cguaauacaaaau

SEQ ID NO: 721813 - RNA, 20 nt, Haemophilus influenzae Rd
cguaaguuugcuaauuuauc

SEQ ID NO: 721814 - RNA, 21 nt, Haemophilus influenzae Rd
cguaauaacaagcgaaaaacg

SEQ ID NO: 721815 - RNA, 21 nt, Haemophilus influenzae Rd
cguaauaaguauuuugcagaa

SEQ ID NO: 721816 - RNA, 18 nt, Haemophilus influenzae Rd
cguaaggaucuuuuucuu

SEQ ID NO: 721817 - RNA, 23 nt, Haemophilus influenzae Rd
cguaaucccauuucaucuucagu

SEQ ID NO: 721818 - RNA, 15 nt, Haemophilus influenzae Rd
cguaauacuuuugcu

SEQ ID NO: 721819 - RNA, 12 nt, Haemophilus influenzae Rd
cgucaauauccc

SEQ ID NO: 721820 - RNA, 21 nt, Haemophilus influenzae Rd
cgucaauaucccaacuuuaug

SEQ ID NO: 721821 - RNA, 16 nt, Haemophilus influenzae Rd
cggugcaauuugaaaa

SEQ ID NO: 721822 - RNA, 17 nt, Haemophilus influenzae Rd
cgguguuuucuuuugcc

SEQ ID NO: 721823 - RNA, 18 nt, Haemophilus influenzae Rd
cggugcuuacuuuauuuu

SEQ ID NO: 721824 - RNA, 14 nt, Haemophilus influenzae Rd
cggugcuuuaagua

SEQ ID NO: 721825 - RNA, 9 nt, Haemophilus influenzae Rd
cggugggcu

SEQ ID NO: 721826 - RNA, 18 nt, Haemophilus influenzae Rd
cggugggcugaagcccac

SEQ ID NO: 721827 - RNA, 17 nt, Haemophilus influenzae Rd
cgguuggauuuuaacca

SEQ ID NO: 721828 - RNA, 13 nt, Haemophilus influenzae Rd
cgguuuauuuuca

SEQ ID NO: 721829 - RNA, 20 nt, Haemophilus influenzae Rd
cgguuuauuuuuauuauuua

SEQ ID NO: 721830 - RNA, 22 nt, Haemophilus influenzae Rd
cgguuguuuuugccaaaauucu

SEQ ID NO: 721831 - RNA, 18 nt, Haemophilus influenzae Rd
cgguucuucuuuuaauaa

SEQ ID NO: 721832 - RNA, 17 nt, Haemophilus influenzae Rd
cgguuacagcuuaauga

SEQ ID NO: 721833 - RNA, 20 nt, Haemophilus influenzae Rd
cgguuaugcaacgagcaaua

SEQ ID NO: 721834 - RNA, 20 nt, Haemophilus influenzae Rd
cguaaagugcggaaauauuu

SEQ ID NO: 721835 - RNA, 23 nt, Haemophilus influenzae Rd
cguaaaguuggcaacauauuuuc

SEQ ID NO: 721836 - RNA, 23 nt, Haemophilus influenzae Rd
cguaaaguuuguagcgauauucu

SEQ ID NO: 721837 - RNA, 17 nt, Haemophilus influenzae Rd
cguaaagggaagugaua

SEQ ID NO: 721838 - RNA, 17 nt, Haemophilus influenzae Rd
cguaaauuauuuauuua

SEQ ID NO: 721839 - RNA, 22 nt, Haemophilus influenzae Rd
cguaacgaauuaguauaaacau

SEQ ID NO: 721840 - RNA, 14 nt, Haemophilus influenzae Rd
cguaacccaaagca

SEQ ID NO: 721841 - RNA, 18 nt, Haemophilus influenzae Rd
cguaacuaaaaaaguuua

SEQ ID NO: 721842 - RNA, 24 nt, Haemophilus influenzae Rd
cguaacuuaaugcaguaauaaauc

SEQ ID NO: 721843 - RNA, 17 nt, Haemophilus influenzae Rd
cguaaaaguaaauaagc

SEQ ID NO: 721844 - RNA, 18 nt, Haemophilus influenzae Rd
cguaaaaguaaauaagcc

SEQ ID NO: 721845 - RNA, 12 nt, Haemophilus influenzae Rd
cguaaaaguuuu

SEQ ID NO: 721846 - RNA, 23 nt, Haemophilus influenzae Rd
cguaaaaucgccugacauuuuug

SEQ ID NO: 721847 - RNA, 22 nt, Haemophilus influenzae Rd
cguaaaccguggcauaauuugg

SEQ ID NO: 721848 - RNA, 23 nt, Haemophilus influenzae Rd
cgguuuuucgaccguuuuuucuu

SEQ ID NO: 721849 - RNA, 16 nt, Haemophilus influenzae Rd
cgugcaauaacaagca

SEQ ID NO: 721850 - RNA, 21 nt, Haemophilus influenzae Rd
cgugcaauuaauucuuuugcu

SEQ ID NO: 721851 - RNA, 19 nt, Haemophilus influenzae Rd
cgugauauuuuucacgccu

SEQ ID NO: 721852 - RNA, 22 nt, Haemophilus influenzae Rd
cgugcaaauaaauuugguacau

SEQ ID NO: 721853 - RNA, 15 nt, Haemophilus influenzae Rd
cgugaggucugcaau

SEQ ID NO: 721854 - RNA, 18 nt, Haemophilus influenzae Rd
cgugaggucugcaauaau

SEQ ID NO: 721855 - RNA, 21 nt, Haemophilus influenzae Rd
cgugauaauaucgcccgcuuu

SEQ ID NO: 721856 - RNA, 20 nt, Haemophilus influenzae Rd
cgugccaucacauccacaaa

SEQ ID NO: 721857 - RNA, 20 nt, Haemophilus influenzae Rd
cgugaccuaauaugauuucu

SEQ ID NO: 721858 - RNA, 14 nt, Haemophilus influenzae Rd
cgucuuuuaacauu

SEQ ID NO: 721859 - RNA, 19 nt, Haemophilus influenzae Rd
cgugaaauuagacaaaaau

SEQ ID NO: 721860 - RNA, 22 nt, Haemophilus influenzae Rd
cgugguuugcaccugcaucaau

SEQ ID NO: 721861 - RNA, 21 nt, Haemophilus influenzae Rd
cguguaaaucuaaaauaaucg

SEQ ID NO: 721862 - RNA, 17 nt, Haemophilus influenzae Rd
cguguagaucagccccu

SEQ ID NO: 721863 - RNA, 21 nt, Haemophilus influenzae Rd
cguguaguuggaucauuaucc

SEQ ID NO: 721864 - RNA, 16 nt, Haemophilus influenzae Rd
cguguauauauuuucc

SEQ ID NO: 721865 - RNA, 23 nt, Haemophilus influenzae Rd
cguguauuuuuaucuaaauuccu

SEQ ID NO: 721866 - RNA, 21 nt, Haemophilus influenzae Rd
cguguucaaccacuucagcag

SEQ ID NO: 721867 - RNA, 16 nt, Haemophilus influenzae Rd
cguuaaaaguuuuuua

SEQ ID NO: 721868 - RNA, 23 nt, Haemophilus influenzae Rd
cgugucccggagucgaaccgagc

SEQ ID NO: 721869 - RNA, 19 nt, Haemophilus influenzae Rd
cguugccgaaccugaaauu

SEQ ID NO: 721870 - RNA, 14 nt, Haemophilus influenzae Rd
cguugaaaauaaau

SEQ ID NO: 721871 - RNA, 16 nt, Haemophilus influenzae Rd
cguucuugaugauaau

SEQ ID NO: 721872 - RNA, 13 nt, Haemophilus influenzae Rd
cguguuuuuucac

SEQ ID NO: 721873 - RNA, 19 nt, Haemophilus influenzae Rd
cguuaaacccuguuuuaag

SEQ ID NO: 721874 - RNA, 16 nt, Haemophilus influenzae Rd
cguucaugguuguaau

SEQ ID NO: 721875 - RNA, 17 nt, Haemophilus influenzae Rd
cguuaagaaagaaacug

SEQ ID NO: 721876 - RNA, 15 nt, Haemophilus influenzae Rd
cguuaaguucagaaa

SEQ ID NO: 721877 - RNA, 13 nt, Haemophilus influenzae Rd
cguucauuuugau

SEQ ID NO: 721878 - RNA, 13 nt, Haemophilus influenzae Rd
cguucgauaacaa

SEQ ID NO: 721879 - RNA, 20 nt, Haemophilus influenzae Rd
cguucgauaacaauuuuugc

SEQ ID NO: 721880 - RNA, 17 nt, Haemophilus influenzae Rd
cguucgauacaagguac

SEQ ID NO: 721881 - RNA, 15 nt, Haemophilus influenzae Rd
cguucgcaaugaaau

SEQ ID NO: 721882 - RNA, 21 nt, Haemophilus influenzae Rd
cguuggucgaagguucgaauc

SEQ ID NO: 721883 - RNA, 19 nt, Haemophilus influenzae Rd
cguuggucugcccaugcuu

SEQ ID NO: 721884 - RNA, 19 nt, Haemophilus influenzae Rd
cguuuaaccacguauuuuu

SEQ ID NO: 721885 - RNA, 22 nt, Haemophilus influenzae Rd
cguuuaaccacguauuuuuuaa

SEQ ID NO: 721886 - RNA, 16 nt, Haemophilus influenzae Rd
cguuuacuuaaaaucu

SEQ ID NO: 721887 - RNA, 17 nt, Haemophilus influenzae Rd
cguuuacuuaaaaucuu

SEQ ID NO: 721888 - RNA, 13 nt, Haemophilus influenzae Rd
cguuucaaaugcu

SEQ ID NO: 721889 - RNA, 16 nt, Haemophilus influenzae Rd
cguuucaaaugcuuug

SEQ ID NO: 721890 - RNA, 17 nt, Haemophilus influenzae Rd
cguuuauggcuuucaau

SEQ ID NO: 721891 - RNA, 15 nt, Haemophilus influenzae Rd
cguuuauuuaacaau

SEQ ID NO: 721892 - RNA, 17 nt, Haemophilus influenzae Rd
cguuuaucuaauagauu

SEQ ID NO: 721893 - RNA, 20 nt, Haemophilus influenzae Rd
cuaaauaaggcguaaaacua

SEQ ID NO: 721894 - RNA, 24 nt, Haemophilus influenzae Rd
cuaaauaauccaacuaugaagacu

SEQ ID NO: 721895 - RNA, 17 nt, Haemophilus influenzae Rd
cuaaauaaagauuauuu

SEQ ID NO: 721896 - RNA, 22 nt, Haemophilus influenzae Rd
cuaaagugcgguuaauuuuuag

SEQ ID NO: 721897 - RNA, 15 nt, Haemophilus influenzae Rd
cuaaauacauuuuua

SEQ ID NO: 721898 - RNA, 15 nt, Haemophilus influenzae Rd
cuaaauauauaucau

SEQ ID NO: 721899 - RNA, 15 nt, Haemophilus influenzae Rd
cuaaauauauuuuua

SEQ ID NO: 721900 - RNA, 16 nt, Haemophilus influenzae Rd
cuaaauauauuuuuau

SEQ ID NO: 721901 - RNA, 15 nt, Haemophilus influenzae Rd
cuaaauaauuacgca

SEQ ID NO: 721902 - RNA, 17 nt, Haemophilus influenzae Rd
cuaaaggcaauucccag

SEQ ID NO: 721903 - RNA, 17 nt, Haemophilus influenzae Rd
cuaaaggcuaaauaacc

SEQ ID NO: 721904 - RNA, 21 nt, Haemophilus influenzae Rd
cuaaaggaguaaguuuuacac

SEQ ID NO: 721905 - RNA, 21 nt, Haemophilus influenzae Rd
cuaaaggaauggcaaagaaua

SEQ ID NO: 721906 - RNA, 18 nt, Haemophilus influenzae Rd
cuaaauuaucguuuacuu

SEQ ID NO: 721907 - RNA, 16 nt, Haemophilus influenzae Rd
cuaaauuagaauuuag

SEQ ID NO: 721908 - RNA, 18 nt, Haemophilus influenzae Rd
cuaaauuacauuuuuucu

SEQ ID NO: 721909 - RNA, 21 nt, Haemophilus influenzae Rd
cuaaaugcuguagaaauuaau

SEQ ID NO: 721910 - RNA, 21 nt, Haemophilus influenzae Rd
cuaaaugugacauuguaaagu

SEQ ID NO: 721911 - RNA, 21 nt, Haemophilus influenzae Rd
cuaaauuaguuuaaagagauc

SEQ ID NO: 721912 - RNA, 17 nt, Haemophilus influenzae Rd
cuaaauucaguaagaaa

SEQ ID NO: 721913 - RNA, 15 nt, Haemophilus influenzae Rd
cuaaauucaauuuuc

SEQ ID NO: 721914 - RNA, 13 nt, Haemophilus influenzae Rd
cuaaauucuaaac

SEQ ID NO: 721915 - RNA, 20 nt, Haemophilus influenzae Rd
cuaaauuuaguugguaaaga

SEQ ID NO: 721916 - RNA, 13 nt, Haemophilus influenzae Rd
cuaaauuuauaua

SEQ ID NO: 721917 - RNA, 17 nt, Haemophilus influenzae Rd
cuaaaugacgugcuaau

SEQ ID NO: 721918 - RNA, 15 nt, Haemophilus influenzae Rd
cuaaaugagaaaaau

SEQ ID NO: 721919 - RNA, 16 nt, Haemophilus influenzae Rd
cuaaaugagaaaaauc

SEQ ID NO: 721920 - RNA, 22 nt, Haemophilus influenzae Rd
cuaaaucuucuuuaccaacuaa

SEQ ID NO: 721921 - RNA, 12 nt, Haemophilus influenzae Rd
cuaaaucuuucc

SEQ ID NO: 721922 - RNA, 15 nt, Haemophilus influenzae Rd
cuaaaucuuuccaga

SEQ ID NO: 721923 - RNA, 21 nt, Haemophilus influenzae Rd
cuaaaugaaguucacuucauc

SEQ ID NO: 721924 - RNA, 16 nt, Haemophilus influenzae Rd
cuaaaugaauaaaacu

SEQ ID NO: 721925 - RNA, 16 nt, Haemophilus influenzae Rd
cuaaaucugccaaugc

SEQ ID NO: 721926 - RNA, 14 nt, Haemophilus influenzae Rd
cuaaaucauauuuc

SEQ ID NO: 721927 - RNA, 22 nt, Haemophilus influenzae Rd
cuaaauccccugucaauuuuuc

SEQ ID NO: 721928 - RNA, 15 nt, Haemophilus influenzae Rd
cuaaacguucuugga

SEQ ID NO: 721929 - RNA, 21 nt, Haemophilus influenzae Rd
cuaaacguuuuugaauagcuc

SEQ ID NO: 721930 - RNA, 12 nt, Haemophilus influenzae Rd
cuaaacuaagcu

SEQ ID NO: 721931 - RNA, 16 nt, Haemophilus influenzae Rd
cuaaacgcucaaauaa

SEQ ID NO: 721932 - RNA, 17 nt, Haemophilus influenzae Rd
cuaaacgcucaaauaaa

SEQ ID NO: 721933 - RNA, 17 nt, Haemophilus influenzae Rd
cuaaacgcucuuuaaua

SEQ ID NO: 721934 - RNA, 14 nt, Haemophilus influenzae Rd
cuaaacgcacuuuu

SEQ ID NO: 721935 - RNA, 17 nt, Haemophilus influenzae Rd
cuaaaaucgcacuuugu

SEQ ID NO: 721936 - RNA, 15 nt, Haemophilus influenzae Rd
cuaaaauaaauuuug

SEQ ID NO: 721937 - RNA, 14 nt, Haemophilus influenzae Rd
cuaaaauacaaaua

SEQ ID NO: 721938 - RNA, 15 nt, Haemophilus influenzae Rd
cuaaaauacaaauac

SEQ ID NO: 721939 - RNA, 22 nt, Haemophilus influenzae Rd
cuaaaauacaaauacauuuugu

SEQ ID NO: 721940 - RNA, 19 nt, Haemophilus influenzae Rd
cuaaaauaguugaaauuug

SEQ ID NO: 721941 - RNA, 19 nt, Haemophilus influenzae Rd
cuaaaauauaacauuuauu

SEQ ID NO: 721942 - RNA, 16 nt, Haemophilus influenzae Rd
cuaaagaaaauacaau

SEQ ID NO: 721943 - RNA, 13 nt, Haemophilus influenzae Rd
cuaaagaaagcaa

SEQ ID NO: 721944 - RNA, 16 nt, Haemophilus influenzae Rd
cuaaagaaagcaaugu

SEQ ID NO: 721945 - RNA, 19 nt, Haemophilus influenzae Rd
cuaaacuuaccuaaaaauu

SEQ ID NO: 721946 - RNA, 14 nt, Haemophilus influenzae Rd
cuaaacuucaauuu

SEQ ID NO: 721947 - RNA, 14 nt, Haemophilus influenzae Rd
cuaaacuugauaua

SEQ ID NO: 721948 - RNA, 17 nt, Haemophilus influenzae Rd
cuaaacuuguuaaauaa

SEQ ID NO: 721949 - RNA, 21 nt, Haemophilus influenzae Rd
cuaaacuuuagagauuuuauu

SEQ ID NO: 721950 - RNA, 14 nt, Haemophilus influenzae Rd
cuaaacuuuuaauu

SEQ ID NO: 721951 - RNA, 21 nt, Haemophilus influenzae Rd
cuaaacuuuucgcaaaauauc

SEQ ID NO: 721952 - RNA, 16 nt, Haemophilus influenzae Rd
cuaaagagaaacauug

SEQ ID NO: 721953 - RNA, 18 nt, Haemophilus influenzae Rd
cuaaagcaauauuuagau

SEQ ID NO: 721954 - RNA, 12 nt, Haemophilus influenzae Rd
cuaaagagauuu

SEQ ID NO: 721955 - RNA, 13 nt, Haemophilus influenzae Rd
cuaaaaagaaaua

SEQ ID NO: 721956 - RNA, 21 nt, Haemophilus influenzae Rd
cuaaaaauaauuuuacuugug

SEQ ID NO: 721957 - RNA, 22 nt, Haemophilus influenzae Rd
cguuucacccaagauucuaaau

SEQ ID NO: 721958 - RNA, 11 nt, Haemophilus influenzae Rd
cguuucaucac

SEQ ID NO: 721959 - RNA, 11 nt, Haemophilus influenzae Rd
cguuucauuuu

SEQ ID NO: 721960 - RNA, 13 nt, Haemophilus influenzae Rd
cguuucauuuuug

SEQ ID NO: 721961 - RNA, 14 nt, Haemophilus influenzae Rd
cguuucauuuuugc

SEQ ID NO: 721962 - RNA, 17 nt, Haemophilus influenzae Rd
cguuugacguauccaua

SEQ ID NO: 721963 - RNA, 20 nt, Haemophilus influenzae Rd
cuacugcgugacaacggggc

SEQ ID NO: 721964 - RNA, 19 nt, Haemophilus influenzae Rd
cuacugcuucauaaaaacc

SEQ ID NO: 721965 - RNA, 18 nt, Haemophilus influenzae Rd
cuacugcaucugcauuuc

SEQ ID NO: 721966 - RNA, 14 nt, Haemophilus influenzae Rd
cuacuguuaauuug

SEQ ID NO: 721967 - RNA, 21 nt, Haemophilus influenzae Rd
cuacuggugaaauuaauuuag

SEQ ID NO: 721968 - RNA, 19 nt, Haemophilus influenzae Rd
cuacucguagaguuuuuuc

SEQ ID NO: 721969 - RNA, 22 nt, Haemophilus influenzae Rd
cuacucguagaguuuuuucacu

SEQ ID NO: 721970 - RNA, 17 nt, Haemophilus influenzae Rd
cuacuagccaaucauaa

SEQ ID NO: 721971 - RNA, 21 nt, Haemophilus influenzae Rd
cuaaauuucagcuuaaauacu

SEQ ID NO: 721972 - RNA, 22 nt, Haemophilus influenzae Rd
cuaaauuugacuucuuguacaa

SEQ ID NO: 721973 - RNA, 21 nt, Haemophilus influenzae Rd
cuaaauuugcugcgugagcuu

SEQ ID NO: 721974 - RNA, 22 nt, Haemophilus influenzae Rd
cuaacauugcaucagccaccuu

SEQ ID NO: 721975 - RNA, 17 nt, Haemophilus influenzae Rd
cuaacauuuccugugca

SEQ ID NO: 721976 - RNA, 14 nt, Haemophilus influenzae Rd
cuacgccauuuucu

SEQ ID NO: 721977 - RNA, 19 nt, Haemophilus influenzae Rd
cuaccuucaaccacccaua

SEQ ID NO: 721978 - RNA, 16 nt, Haemophilus influenzae Rd
cuacgaaccgagcggu

SEQ ID NO: 721979 - RNA, 15 nt, Haemophilus influenzae Rd
cuagauuuuuuacuc

SEQ ID NO: 721980 - RNA, 18 nt, Haemophilus influenzae Rd
cuagcucucguuguucuu

SEQ ID NO: 721981 - RNA, 18 nt, Haemophilus influenzae Rd
cuagcguaagcaccuuca

SEQ ID NO: 721982 - RNA, 15 nt, Haemophilus influenzae Rd
cuaggcaucaaaauu

SEQ ID NO: 721983 - RNA, 14 nt, Haemophilus influenzae Rd
cuagauaacuagac

SEQ ID NO: 721984 - RNA, 19 nt, Haemophilus influenzae Rd
cuagauaaugaugaaugcu

SEQ ID NO: 721985 - RNA, 15 nt, Haemophilus influenzae Rd
cuagauauaaaaacu

SEQ ID NO: 721986 - RNA, 17 nt, Haemophilus influenzae Rd
cuagauauaaaaacuau

SEQ ID NO: 721987 - RNA, 19 nt, Haemophilus influenzae Rd
cuagauauuucuaggcuau

SEQ ID NO: 721988 - RNA, 21 nt, Haemophilus influenzae Rd
cuagaggcugaagccauuuua

SEQ ID NO: 721989 - RNA, 23 nt, Haemophilus influenzae Rd
cuagauaaacgcuguuuugcuuc

SEQ ID NO: 721990 - RNA, 22 nt, Haemophilus influenzae Rd
cuagaucacaguugugaaaaaa

SEQ ID NO: 721991 - RNA, 15 nt, Haemophilus influenzae Rd
cuagaugaugaaauu

SEQ ID NO: 721992 - RNA, 16 nt, Haemophilus influenzae Rd
cuacuuuggauuggau

SEQ ID NO: 721993 - RNA, 21 nt, Haemophilus influenzae Rd
cuacuuuugacgcagcaucug

SEQ ID NO: 721994 - RNA, 18 nt, Haemophilus influenzae Rd
cuacuuuugugccagcug

SEQ ID NO: 721995 - RNA, 23 nt, Haemophilus influenzae Rd
cuacuuuugugccagcuggaaau

SEQ ID NO: 721996 - RNA, 12 nt, Haemophilus influenzae Rd
cuacuuucuauu

SEQ ID NO: 721997 - RNA, 13 nt, Haemophilus influenzae Rd
cuacuuucuauua

SEQ ID NO: 721998 - RNA, 16 nt, Haemophilus influenzae Rd
cuacuuguguuuuaga

SEQ ID NO: 721999 - RNA, 12 nt, Haemophilus influenzae Rd
cuacuuucagga

SEQ ID NO: 722000 - RNA, 14 nt, Haemophilus influenzae Rd
cuacuugagcuuca

SEQ ID NO: 722001 - RNA, 22 nt, Haemophilus influenzae Rd
cuaucauccgcuuguaauuuca

SEQ ID NO: 722002 - RNA, 17 nt, Haemophilus influenzae Rd
cuaugccuucuucacua

SEQ ID NO: 722003 - RNA, 13 nt, Haemophilus influenzae Rd
cuaugucaauuac

SEQ ID NO: 722004 - RNA, 17 nt, Haemophilus influenzae Rd
cuauguuauuaaaauua

SEQ ID NO: 722005 - RNA, 15 nt, Haemophilus influenzae Rd
cuauuaaaaaaucau

SEQ ID NO: 722006 - RNA, 13 nt, Haemophilus influenzae Rd
cuauacaaaauug

SEQ ID NO: 722007 - RNA, 12 nt, Haemophilus influenzae Rd
cuauaauuaaac

SEQ ID NO: 722008 - RNA, 22 nt, Haemophilus influenzae Rd
cuauaauuagaucauaaaaaaa

SEQ ID NO: 722009 - RNA, 12 nt, Haemophilus influenzae Rd
cuaguaaaacua

SEQ ID NO: 722010 - RNA, 14 nt, Haemophilus influenzae Rd
cuaguaaaacuaau

SEQ ID NO: 722011 - RNA, 21 nt, Haemophilus influenzae Rd
cuauaauagcuuccauuuuuu

SEQ ID NO: 722012 - RNA, 14 nt, Haemophilus influenzae Rd
cuagggauuaagaa

SEQ ID NO: 722013 - RNA, 19 nt, Haemophilus influenzae Rd
cuagguacguuuuguuuua

SEQ ID NO: 722014 - RNA, 17 nt, Haemophilus influenzae Rd
cuauauucguuaaauaa

SEQ ID NO: 722015 - RNA, 20 nt, Haemophilus influenzae Rd
cuauauucguuaaauaaugc

SEQ ID NO: 722016 - RNA, 21 nt, Haemophilus influenzae Rd
cuauauuugaguuauuuuuaa

SEQ ID NO: 722017 - RNA, 19 nt, Haemophilus influenzae Rd
cuauauuuuccacauuuug

SEQ ID NO: 722018 - RNA, 23 nt, Haemophilus influenzae Rd
cuauauuuugaauaauaaauugg

SEQ ID NO: 722019 - RNA, 17 nt, Haemophilus influenzae Rd
cuaucaaugaauauaaa

SEQ ID NO: 722020 - RNA, 18 nt, Haemophilus influenzae Rd
cuaucaaaaucaaagugc

SEQ ID NO: 722021 - RNA, 13 nt, Haemophilus influenzae Rd
cuauauauuucuc

SEQ ID NO: 722022 - RNA, 18 nt, Haemophilus influenzae Rd
cuauaucuuuaaauucua

SEQ ID NO: 722023 - RNA, 22 nt, Haemophilus influenzae Rd
cuauaugauauauaaaaccccg

SEQ ID NO: 722024 - RNA, 15 nt, Haemophilus influenzae Rd
cuauauacauuaaca

SEQ ID NO: 722025 - RNA, 12 nt, Haemophilus influenzae Rd
cuauauacuuuu

SEQ ID NO: 722026 - RNA, 15 nt, Haemophilus influenzae Rd
cucacuaacuuuccu

SEQ ID NO: 722027 - RNA, 23 nt, Haemophilus influenzae Rd
cucacuacggcuggugcuacuug

SEQ ID NO: 722028 - RNA, 16 nt, Haemophilus influenzae Rd
cucacuauaacuuuuc

SEQ ID NO: 722029 - RNA, 22 nt, Haemophilus influenzae Rd
cucacgagcauagaucgcaagg

SEQ ID NO: 722030 - RNA, 17 nt, Haemophilus influenzae Rd
cucaauagauuuaauau

SEQ ID NO: 722031 - RNA, 18 nt, Haemophilus influenzae Rd
cucaauagauuuaauauc

SEQ ID NO: 722032 - RNA, 18 nt, Haemophilus influenzae Rd
cucaauaauuucaauaua

SEQ ID NO: 722033 - RNA, 23 nt, Haemophilus influenzae Rd
cucaaguuuuauuugagaaaaau

SEQ ID NO: 722034 - RNA, 16 nt, Haemophilus influenzae Rd
cucaauaaauaucuaa

SEQ ID NO: 722035 - RNA, 16 nt, Haemophilus influenzae Rd
cucacauccauuccug

SEQ ID NO: 722036 - RNA, 18 nt, Haemophilus influenzae Rd
cucacauccauuccugca

SEQ ID NO: 722037 - RNA, 14 nt, Haemophilus influenzae Rd
cucacauugccauu

SEQ ID NO: 722038 - RNA, 16 nt, Haemophilus influenzae Rd
cucaagacaaauuugu

SEQ ID NO: 722039 - RNA, 11 nt, Haemophilus influenzae Rd
cucaagaaacu

SEQ ID NO: 722040 - RNA, 14 nt, Haemophilus influenzae Rd
cuauuaauuuaauu

SEQ ID NO: 722041 - RNA, 22 nt, Haemophilus influenzae Rd
cuauuaauuuaauucuaaauuc

SEQ ID NO: 722042 - RNA, 17 nt, Haemophilus influenzae Rd
cuauuaauuacuuuuau

SEQ ID NO: 722043 - RNA, 17 nt, Haemophilus influenzae Rd
  misc_feature (8)..(8): n is a, c, g or u
cuauuaanacaauaaau

SEQ ID NO: 722044 - RNA, 20 nt, Haemophilus influenzae Rd
cuauuaagcucaacugccac

SEQ ID NO: 722045 - RNA, 20 nt, Haemophilus influenzae Rd
cuauuacgcuguccaauaau

SEQ ID NO: 722046 - RNA, 22 nt, Haemophilus influenzae Rd
cuauuacgcuguccaauaauua

SEQ ID NO: 722047 - RNA, 15 nt, Haemophilus influenzae Rd
cuauuacucuuaauu

SEQ ID NO: 722048 - RNA, 22 nt, Haemophilus influenzae Rd
cuauuacuuacuacuuuggauu

SEQ ID NO: 722049 - RNA, 17 nt, Haemophilus influenzae Rd
cuauuacuuuccauaau

SEQ ID NO: 722050 - RNA, 12 nt, Haemophilus influenzae Rd
cuauuagaauuu

SEQ ID NO: 722051 - RNA, 17 nt, Haemophilus influenzae Rd
cuauuagacuuaauuuc

SEQ ID NO: 722052 - RNA, 18 nt, Haemophilus influenzae Rd
cuauuagacuuaauuuca

SEQ ID NO: 722053 - RNA, 20 nt, Haemophilus influenzae Rd
cuauuagacuuaauuucaca

SEQ ID NO: 722054 - RNA, 17 nt, Haemophilus influenzae Rd
cucaaaucuacuaaaau

SEQ ID NO: 722055 - RNA, 21 nt, Haemophilus influenzae Rd
cucaaauuuucuguugggaua

SEQ ID NO: 722056 - RNA, 14 nt, Haemophilus influenzae Rd
cucaaauuuuucac

SEQ ID NO: 722057 - RNA, 16 nt, Haemophilus influenzae Rd
cucaaauuuuucacag

SEQ ID NO: 722058 - RNA, 19 nt, Haemophilus influenzae Rd
cucaacaccgcaaaaauac

SEQ ID NO: 722059 - RNA, 18 nt, Haemophilus influenzae Rd
cucaucauuaugaaaaaa

SEQ ID NO: 722060 - RNA, 19 nt, Haemophilus influenzae Rd
cucaucauuaugaaaaaaa

SEQ ID NO: 722061 - RNA, 15 nt, Haemophilus influenzae Rd
cucaucauuauuuuu

SEQ ID NO: 722062 - RNA, 17 nt, Haemophilus influenzae Rd
cucauccaaucaucaga

SEQ ID NO: 722063 - RNA, 23 nt, Haemophilus influenzae Rd
cucaucaaaauaaggucagcaaa

SEQ ID NO: 722064 - RNA, 21 nt, Haemophilus influenzae Rd
cucaucguaucaauuuuauug

SEQ ID NO: 722065 - RNA, 22 nt, Haemophilus influenzae Rd
cucaucguaucaauuuuauuga

SEQ ID NO: 722066 - RNA, 23 nt, Haemophilus influenzae Rd
cucaucugaauuuaaacuuagga

SEQ ID NO: 722067 - RNA, 20 nt, Haemophilus influenzae Rd
cucagauaaugauagaugaa

SEQ ID NO: 722068 - RNA, 16 nt, Haemophilus influenzae Rd
cucagcaagcuggcuu

SEQ ID NO: 722069 - RNA, 22 nt, Haemophilus influenzae Rd
cucagcaaaagacgaagaaaca

SEQ ID NO: 722070 - RNA, 19 nt, Haemophilus influenzae Rd
cucagagauaaucgcaagg

SEQ ID NO: 722071 - RNA, 18 nt, Haemophilus influenzae Rd
cucagguauuucuucaau

SEQ ID NO: 722072 - RNA, 17 nt, Haemophilus influenzae Rd
cucaguugguagagcac

SEQ ID NO: 722073 - RNA, 22 nt, Haemophilus influenzae Rd
cucaguugguagagcacgaccu

SEQ ID NO: 722074 - RNA, 21 nt, Haemophilus influenzae Rd
cucaguuuauuagaauauaac

SEQ ID NO: 722075 - RNA, 20 nt, Haemophilus influenzae Rd
cucauaccaaggcauuuuuu

SEQ ID NO: 722076 - RNA, 22 nt, Haemophilus influenzae Rd
cucauaccaaggcauuuuuucu

SEQ ID NO: 722077 - RNA, 15 nt, Haemophilus influenzae Rd
cuccauaauauugug

SEQ ID NO: 722078 - RNA, 14 nt, Haemophilus influenzae Rd
cuccgccaagugcg

SEQ ID NO: 722079 - RNA, 14 nt, Haemophilus influenzae Rd
cuccgcauuuuuuu

SEQ ID NO: 722080 - RNA, 20 nt, Haemophilus influenzae Rd
cuccgcaaccguggcaaccg

SEQ ID NO: 722081 - RNA, 14 nt, Haemophilus influenzae Rd
cuccccuuaacuaa

SEQ ID NO: 722082 - RNA, 18 nt, Haemophilus influenzae Rd
cuccucugcauucugaau

SEQ ID NO: 722083 - RNA, 13 nt, Haemophilus influenzae Rd
cucgacuuuugca

SEQ ID NO: 722084 - RNA, 15 nt, Haemophilus influenzae Rd
cucgaauauaaggua

SEQ ID NO: 722085 - RNA, 19 nt, Haemophilus influenzae Rd
cucgaauaucgacuaauau

SEQ ID NO: 722086 - RNA, 15 nt, Haemophilus influenzae Rd
cucgaaguuuugcua

SEQ ID NO: 722087 - RNA, 16 nt, Haemophilus influenzae Rd
cucgaaaguuaccgcu

SEQ ID NO: 722088 - RNA, 19 nt, Haemophilus influenzae Rd
cuccuuaauuucauuaaua

SEQ ID NO: 722089 - RNA, 14 nt, Haemophilus influenzae Rd
cucguaugcugaga

SEQ ID NO: 722090 - RNA, 19 nt, Haemophilus influenzae Rd
cucguaaagaucauucaca

SEQ ID NO: 722091 - RNA, 21 nt, Haemophilus influenzae Rd
cucgcucgccaagaauaaaau

SEQ ID NO: 722092 - RNA, 17 nt, Haemophilus influenzae Rd
cucggaaagcaaaauag

SEQ ID NO: 722093 - RNA, 18 nt, Haemophilus influenzae Rd
cucggaaagcaaaauaga

SEQ ID NO: 722094 - RNA, 22 nt, Haemophilus influenzae Rd
cucuauuugucggaaaauaaua

SEQ ID NO: 722095 - RNA, 13 nt, Haemophilus influenzae Rd
cucucaaaaauca

SEQ ID NO: 722096 - RNA, 15 nt, Haemophilus influenzae Rd
cucuauuaauuuuaa

SEQ ID NO: 722097 - RNA, 22 nt, Haemophilus influenzae Rd
cucucacgugaaucacaacaua

SEQ ID NO: 722098 - RNA, 20 nt, Haemophilus influenzae Rd
cucucccgaaaauuguucag

SEQ ID NO: 722099 - RNA, 23 nt, Haemophilus influenzae Rd
cucucgccaaaucucaaaaucag

SEQ ID NO: 722100 - RNA, 23 nt, Haemophilus influenzae Rd
cucucgggugcgccauuuuuaaa

SEQ ID NO: 722101 - RNA, 19 nt, Haemophilus influenzae Rd
cucucggcgguucuuguuu

SEQ ID NO: 722102 - RNA, 21 nt, Haemophilus influenzae Rd
cucucgucaauacaacaagaa

SEQ ID NO: 722103 - RNA, 23 nt, Haemophilus influenzae Rd
cucugacuaaucguccaauuuca

SEQ ID NO: 722104 - RNA, 17 nt, Haemophilus influenzae Rd
cucugccacggcuugug

SEQ ID NO: 722105 - RNA, 19 nt, Haemophilus influenzae Rd
cucugcauaaaagccuuca

SEQ ID NO: 722106 - RNA, 17 nt, Haemophilus influenzae Rd
cucugcuagucguucuu

SEQ ID NO: 722107 - RNA, 14 nt, Haemophilus influenzae Rd
cucuucagcuucuu

SEQ ID NO: 722108 - RNA, 15 nt, Haemophilus influenzae Rd
cucuucagcuucuuc

SEQ ID NO: 722109 - RNA, 12 nt, Haemophilus influenzae Rd
cucuucaucaaa

SEQ ID NO: 722110 - RNA, 12 nt, Haemophilus influenzae Rd
cucugcuugagu

SEQ ID NO: 722111 - RNA, 22 nt, Haemophilus influenzae Rd
cucuggagaaaauugcuggcuu

SEQ ID NO: 722112 - RNA, 18 nt, Haemophilus influenzae Rd
cucuucugggucuuuuug

SEQ ID NO: 722113 - RNA, 22 nt, Haemophilus influenzae Rd
cucuugcguuugguucaucauu

SEQ ID NO: 722114 - RNA, 16 nt, Haemophilus influenzae Rd
cucuuggauuuucuua

SEQ ID NO: 722115 - RNA, 20 nt, Haemophilus influenzae Rd
cucuuggauuuucuuagcuu

SEQ ID NO: 722116 - RNA, 15 nt, Haemophilus influenzae Rd
cucuuggauuuuuuc

SEQ ID NO: 722117 - RNA, 19 nt, Haemophilus influenzae Rd
cucuuggcuaacuucuucc

SEQ ID NO: 722118 - RNA, 18 nt, Haemophilus influenzae Rd
cucuugucaauaaauccc

SEQ ID NO: 722119 - RNA, 22 nt, Haemophilus influenzae Rd
cucuugugccaaauucauucuu

SEQ ID NO: 722120 - RNA, 21 nt, Haemophilus influenzae Rd
cucuugcgccccuuuuuuagu

SEQ ID NO: 722121 - RNA, 15 nt, Haemophilus influenzae Rd
cucuuuaauuguuug

SEQ ID NO: 722122 - RNA, 21 nt, Haemophilus influenzae Rd
cucuuuuuauuuuacuaauua

SEQ ID NO: 722123 - RNA, 23 nt, Haemophilus influenzae Rd
cucuuuuucagaagucacauauu

SEQ ID NO: 722124 - RNA, 22 nt, Haemophilus influenzae Rd
cucuuuuaucucggcuaaaauc

SEQ ID NO: 722125 - RNA, 19 nt, Haemophilus influenzae Rd
cucuuugggaaugccauua

SEQ ID NO: 722126 - RNA, 14 nt, Haemophilus influenzae Rd
cucuuucaccauua

SEQ ID NO: 722127 - RNA, 21 nt, Haemophilus influenzae Rd
cucuuuacgacuaaaacgaac

SEQ ID NO: 722128 - RNA, 19 nt, Haemophilus influenzae Rd
cucuuuacuguucaaauaa

SEQ ID NO: 722129 - RNA, 12 nt, Haemophilus influenzae Rd
cucuuucaaaua

SEQ ID NO: 722130 - RNA, 18 nt, Haemophilus influenzae Rd
cugaaaccacuaaaaaca

SEQ ID NO: 722131 - RNA, 20 nt, Haemophilus influenzae Rd
cugaaaauauucuucauaaa

SEQ ID NO: 722132 - RNA, 12 nt, Haemophilus influenzae Rd
cugaaaaauaaa

SEQ ID NO: 722133 - RNA, 21 nt, Haemophilus influenzae Rd
cugaaaaagcuaaaaaaacag

SEQ ID NO: 722134 - RNA, 23 nt, Haemophilus influenzae Rd
cugaacggucauccaauguugca

SEQ ID NO: 722135 - RNA, 15 nt, Haemophilus influenzae Rd
cugaacuaaaauaac

SEQ ID NO: 722136 - RNA, 19 nt, Haemophilus influenzae Rd
cugaacgcgcgccaauaaa

SEQ ID NO: 722137 - RNA, 17 nt, Haemophilus influenzae Rd
cugaaauaccuucuuga

SEQ ID NO: 722138 - RNA, 19 nt, Haemophilus influenzae Rd
cugaaaguagauauuucuc

SEQ ID NO: 722139 - RNA, 13 nt, Haemophilus influenzae Rd
cugaaauacaaag

SEQ ID NO: 722140 - RNA, 15 nt, Haemophilus influenzae Rd
cugaaauauagcuua

SEQ ID NO: 722141 - RNA, 17 nt, Haemophilus influenzae Rd
cugaaauaucagcuacu

SEQ ID NO: 722142 - RNA, 17 nt, Haemophilus influenzae Rd
cugaaauuaauaagaaa

SEQ ID NO: 722143 - RNA, 17 nt, Haemophilus influenzae Rd
cugaaaucccuuagaaa

SEQ ID NO: 722144 - RNA, 22 nt, Haemophilus influenzae Rd
cugaaaucccuuagaaaaucac

SEQ ID NO: 722145 - RNA, 19 nt, Haemophilus influenzae Rd
cugaaauucauucaacaaa

SEQ ID NO: 722146 - RNA, 13 nt, Haemophilus influenzae Rd
cugaaauuuugau

SEQ ID NO: 722147 - RNA, 13 nt, Haemophilus influenzae Rd
cugaaauuuuuau

SEQ ID NO: 722148 - RNA, 17 nt, Haemophilus influenzae Rd
cugacccacaucaucaa

SEQ ID NO: 722149 - RNA, 22 nt, Haemophilus influenzae Rd
cugaagcuucuucaccugcguu

SEQ ID NO: 722150 - RNA, 17 nt, Haemophilus influenzae Rd
cugaaggcgcuccccug

SEQ ID NO: 722151 - RNA, 20 nt, Haemophilus influenzae Rd
cugacacgguaguaaauaac

SEQ ID NO: 722152 - RNA, 13 nt, Haemophilus influenzae Rd
cugacaaauuugu

SEQ ID NO: 722153 - RNA, 14 nt, Haemophilus influenzae Rd
cugacaaauuuguu

SEQ ID NO: 722154 - RNA, 17 nt, Haemophilus influenzae Rd
cugacacccaaauuaaa

SEQ ID NO: 722155 - RNA, 20 nt, Haemophilus influenzae Rd
cugacacccaaauuaaaaaa

SEQ ID NO: 722156 - RNA, 21 nt, Haemophilus influenzae Rd
cugagaaagggauuuuaauua

SEQ ID NO: 722157 - RNA, 21 nt, Haemophilus influenzae Rd
cugagcaaauuacccaaauga

SEQ ID NO: 722158 - RNA, 19 nt, Haemophilus influenzae Rd
cugauuuaaucauuacuua

SEQ ID NO: 722159 - RNA, 15 nt, Haemophilus influenzae Rd
cugauucuaaugcca

SEQ ID NO: 722160 - RNA, 18 nt, Haemophilus influenzae Rd
cugauucuaaugccauug

SEQ ID NO: 722161 - RNA, 14 nt, Haemophilus influenzae Rd
cugauugagaaaau

SEQ ID NO: 722162 - RNA, 14 nt, Haemophilus influenzae Rd
cugauucuucauaa

SEQ ID NO: 722163 - RNA, 20 nt, Haemophilus influenzae Rd
cugauucuucgccauuuucu

SEQ ID NO: 722164 - RNA, 20 nt, Haemophilus influenzae Rd
cugcaaggauauuuccauag

SEQ ID NO: 722165 - RNA, 19 nt, Haemophilus influenzae Rd
cugcaagugcgguaaaauu

SEQ ID NO: 722166 - RNA, 23 nt, Haemophilus influenzae Rd
cugcaagugcgguaaaauuuuuc

SEQ ID NO: 722167 - RNA, 17 nt, Haemophilus influenzae Rd
cugcaaagucuuuaccu

SEQ ID NO: 722168 - RNA, 20 nt, Haemophilus influenzae Rd
cugcaaauaaagaagaaaau

SEQ ID NO: 722169 - RNA, 22 nt, Haemophilus influenzae Rd
cugcaaauaaagaagaaaaucu

SEQ ID NO: 722170 - RNA, 21 nt, Haemophilus influenzae Rd
cugauccacgguauuuucuua

SEQ ID NO: 722171 - RNA, 17 nt, Haemophilus influenzae Rd
cugauaugccaaggcuc

SEQ ID NO: 722172 - RNA, 17 nt, Haemophilus influenzae Rd
cugauaaguagaaaaau

SEQ ID NO: 722173 - RNA, 19 nt, Haemophilus influenzae Rd
cugauaaguagaaaaauug

SEQ ID NO: 722174 - RNA, 13 nt, Haemophilus influenzae Rd
cugauaauuucug

SEQ ID NO: 722175 - RNA, 15 nt, Haemophilus influenzae Rd
cugauaauuuuucac

SEQ ID NO: 722176 - RNA, 14 nt, Haemophilus influenzae Rd
cugcuuuauuuucu

SEQ ID NO: 722177 - RNA, 16 nt, Haemophilus influenzae Rd
cugcuuucuagaugau

SEQ ID NO: 722178 - RNA, 11 nt, Haemophilus influenzae Rd
cugcuucauaa

SEQ ID NO: 722179 - RNA, 13 nt, Haemophilus influenzae Rd
cugcuuuucuuca

SEQ ID NO: 722180 - RNA, 14 nt, Haemophilus influenzae Rd
cugcuuuuuuacug

SEQ ID NO: 722181 - RNA, 12 nt, Haemophilus influenzae Rd
cugcuuuuuuca

SEQ ID NO: 722182 - RNA, 19 nt, Haemophilus influenzae Rd
cuggaaauuccacuuuuuc

SEQ ID NO: 722183 - RNA, 16 nt, Haemophilus influenzae Rd
cuggaaauucuucaau

SEQ ID NO: 722184 - RNA, 17 nt, Haemophilus influenzae Rd
cuggaucggcuauuuca

SEQ ID NO: 722185 - RNA, 22 nt, Haemophilus influenzae Rd
cuggauuucccgugcagacuag

SEQ ID NO: 722186 - RNA, 19 nt, Haemophilus influenzae Rd
cuggacgcucuacauuuac

SEQ ID NO: 722187 - RNA, 15 nt, Haemophilus influenzae Rd
cuggaccuaauccca

SEQ ID NO: 722188 - RNA, 20 nt, Haemophilus influenzae Rd
cugcucuaccgacugagcua

SEQ ID NO: 722189 - RNA, 13 nt, Haemophilus influenzae Rd
aaacuauuuuuaa

SEQ ID NO: 722190 - RNA, 22 nt, Haemophilus influenzae Rd
aaacuauuuuuaauuuugaagu

SEQ ID NO: 722191 - RNA, 16 nt, Haemophilus influenzae Rd
cugcugcaguuacugc

SEQ ID NO: 722192 - RNA, 15 nt, Haemophilus influenzae Rd
cugcugcaguuucug

SEQ ID NO: 722193 - RNA, 19 nt, Haemophilus influenzae Rd
cugcucuuuaggaucacua

SEQ ID NO: 722194 - RNA, 19 nt, Haemophilus influenzae Rd
aaacucaaugaauuaaaag

SEQ ID NO: 722195 - RNA, 16 nt, Haemophilus influenzae Rd
cugcuaaaucuguuuc

SEQ ID NO: 722196 - RNA, 22 nt, Haemophilus influenzae Rd
cugcguuuggcacaacaucaga

SEQ ID NO: 722197 - RNA, 16 nt, Haemophilus influenzae Rd
cugccaaaccaucucg

SEQ ID NO: 722198 - RNA, 12 nt, Haemophilus influenzae Rd
cugcauuuaaug

SEQ ID NO: 722199 - RNA, 15 nt, Haemophilus influenzae Rd
cugcauuucaauuuc

SEQ ID NO: 722200 - RNA, 23 nt, Haemophilus influenzae Rd
cugcauuucaauuucacugccaa

SEQ ID NO: 722201 - RNA, 14 nt, Haemophilus influenzae Rd
cugcauuugauuuc

SEQ ID NO: 722202 - RNA, 21 nt, Haemophilus influenzae Rd
cugcauuugauuucagaacau

SEQ ID NO: 722203 - RNA, 16 nt, Haemophilus influenzae Rd
cugcaucgcuaagaca

SEQ ID NO: 722204 - RNA, 15 nt, Haemophilus influenzae Rd
cugcaucugcauuuc

SEQ ID NO: 722205 - RNA, 14 nt, Haemophilus influenzae Rd
cugcaucuuguuua

SEQ ID NO: 722206 - RNA, 23 nt, Haemophilus influenzae Rd
cugcaucguugcuaccacuugau

SEQ ID NO: 722207 - RNA, 23 nt, Haemophilus influenzae Rd
cugcaauuguugcaccaauaauu

SEQ ID NO: 722208 - RNA, 19 nt, Haemophilus influenzae Rd
cugcacaaaguugauaauc

SEQ ID NO: 722209 - RNA, 15 nt, Haemophilus influenzae Rd
cugcacaagcaccac

SEQ ID NO: 722210 - RNA, 16 nt, Haemophilus influenzae Rd
cugcacaagcaccacu

SEQ ID NO: 722211 - RNA, 14 nt, Haemophilus influenzae Rd
cugcagguaauaca

SEQ ID NO: 722212 - RNA, 23 nt, Haemophilus influenzae Rd
cugcaguuacugccucugccaca

SEQ ID NO: 722213 - RNA, 14 nt, Haemophilus influenzae Rd
cugccaaugcuucu

SEQ ID NO: 722214 - RNA, 14 nt, Haemophilus influenzae Rd
cugccauccgcaau

SEQ ID NO: 722215 - RNA, 20 nt, Haemophilus influenzae Rd
cugccauccgcaauuaaucc

SEQ ID NO: 722216 - RNA, 14 nt, Haemophilus influenzae Rd
cugcccauaagaaa

SEQ ID NO: 722217 - RNA, 15 nt, Haemophilus influenzae Rd
cugccucuguauuuu

SEQ ID NO: 722218 - RNA, 18 nt, Haemophilus influenzae Rd
cugcgccuaauuggaaaa

SEQ ID NO: 722219 - RNA, 12 nt, Haemophilus influenzae Rd
aaaaaaaugaaa

SEQ ID NO: 722220 - RNA, 12 nt, Haemophilus influenzae Rd
aaaaaacaccua

SEQ ID NO: 722221 - RNA, 14 nt, Haemophilus influenzae Rd
aaaaaaagaaaacc

SEQ ID NO: 722222 - RNA, 21 nt, Haemophilus influenzae Rd
aaaaaaacaggguguuuauaa

SEQ ID NO: 722223 - RNA, 14 nt, Haemophilus influenzae Rd
aaaaaagccuugaa

SEQ ID NO: 722224 - RNA, 21 nt, Haemophilus influenzae Rd
aaaaaagcguugaaaauaaau

SEQ ID NO: 722225 - RNA, 21 nt, Haemophilus influenzae Rd
aaaaaagcaaaacugaaagaa

SEQ ID NO: 722226 - RNA, 13 nt, Haemophilus influenzae Rd
aaaaaaguaacaa

SEQ ID NO: 722227 - RNA, 18 nt, Haemophilus influenzae Rd
aaaaaaaugaaauauuuu

SEQ ID NO: 722228 - RNA, 13 nt, Haemophilus influenzae Rd
aaaaaaauguaga

SEQ ID NO: 722229 - RNA, 20 nt, Haemophilus influenzae Rd
aaaaaagugcgguaaaaauu

SEQ ID NO: 722230 - RNA, 19 nt, Haemophilus influenzae Rd
aaaaaaguuaaacuaaaua

SEQ ID NO: 722231 - RNA, 11 nt, Haemophilus influenzae Rd
aaaaaauaguu

SEQ ID NO: 722232 - RNA, 18 nt, Haemophilus influenzae Rd
aaaaaauaguuaauaauc

SEQ ID NO: 722233 - RNA, 14 nt, Haemophilus influenzae Rd
aaaaaauaauuuag

SEQ ID NO: 722234 - RNA, 18 nt, Haemophilus influenzae Rd
aaaaaauaaaaaauauuu

SEQ ID NO: 722235 - RNA, 13 nt, Haemophilus influenzae Rd
aaaaaaucuccaa

SEQ ID NO: 722236 - RNA, 16 nt, Haemophilus influenzae Rd
aaaaaaugaaauauuu

SEQ ID NO: 722237 - RNA, 17 nt, Haemophilus influenzae Rd
aaaaaaugcgcugauuu

SEQ ID NO: 722238 - RNA, 16 nt, Haemophilus influenzae Rd
aaaaaccagauaaaaa

SEQ ID NO: 722239 - RNA, 18 nt, Haemophilus influenzae Rd
aaaaaccagauaaaaacu

SEQ ID NO: 722240 - RNA, 17 nt, Haemophilus influenzae Rd
aaaaaccagauaaggca

SEQ ID NO: 722241 - RNA, 18 nt, Haemophilus influenzae Rd
aaaaaauggcuuuaauuu

SEQ ID NO: 722242 - RNA, 16 nt, Haemophilus influenzae Rd
aaaaaauuaaaagauu

SEQ ID NO: 722243 - RNA, 13 nt, Haemophilus influenzae Rd
aaaaaauuuauag

SEQ ID NO: 722244 - RNA, 13 nt, Haemophilus influenzae Rd
aaaaaauccuaaa

SEQ ID NO: 722245 - RNA, 21 nt, Haemophilus influenzae Rd
aaaaaauccuaaauaaagauu

SEQ ID NO: 722246 - RNA, 13 nt, Haemophilus influenzae Rd
aaaaaaucaauca

SEQ ID NO: 722247 - RNA, 12 nt, Haemophilus influenzae Rd
aaaaaaucauca

SEQ ID NO: 722248 - RNA, 11 nt, Haemophilus influenzae Rd
aaaaaauaagg

SEQ ID NO: 722249 - RNA, 12 nt, Haemophilus influenzae Rd
aaaaaauaguuu

SEQ ID NO: 722250 - RNA, 19 nt, Haemophilus influenzae Rd
aaaaaagugcggaaaauuu

SEQ ID NO: 722251 - RNA, 21 nt, Haemophilus influenzae Rd
aaaaaagugcgguuaaaauuu

SEQ ID NO: 722252 - RNA, 21 nt, Haemophilus influenzae Rd
aaaaaagugcgguugaaauuu

SEQ ID NO: 722253 - RNA, 13 nt, Haemophilus influenzae Rd
aaaaacauaauug

SEQ ID NO: 722254 - RNA, 11 nt, Haemophilus influenzae Rd
aaaaaaucaau

SEQ ID NO: 722255 - RNA, 17 nt, Haemophilus influenzae Rd
aaaaaauauccaaauca

SEQ ID NO: 722256 - RNA, 21 nt, Haemophilus influenzae Rd
aaaaaaucggugcaacaauau

SEQ ID NO: 722257 - RNA, 22 nt, Haemophilus influenzae Rd
aaaauuuuuaggugcuuuuugc

SEQ ID NO: 722258 - RNA, 11 nt, Haemophilus influenzae Rd
aaaauuuuucu

SEQ ID NO: 722259 - RNA, 14 nt, Haemophilus influenzae Rd
aaaauuuugccaau

SEQ ID NO: 722260 - RNA, 17 nt, Haemophilus influenzae Rd
aaaauuuugccaauuac

SEQ ID NO: 722261 - RNA, 11 nt, Haemophilus influenzae Rd
aaaauuuuuaa

SEQ ID NO: 722262 - RNA, 11 nt, Haemophilus influenzae Rd
aaacaaaaggc

SEQ ID NO: 722263 - RNA, 18 nt, Haemophilus influenzae Rd
aaacaaaagccaccauuu

SEQ ID NO: 722264 - RNA, 13 nt, Haemophilus influenzae Rd
aaacaaaauaaau

SEQ ID NO: 722265 - RNA, 14 nt, Haemophilus influenzae Rd
aaacaaaauaaaug

SEQ ID NO: 722266 - RNA, 11 nt, Haemophilus influenzae Rd
aaacaaaaacc

SEQ ID NO: 722267 - RNA, 18 nt, Haemophilus influenzae Rd
aaacaaaagaaauuuuaa

SEQ ID NO: 722268 - RNA, 15 nt, Haemophilus influenzae Rd
aaacaaacccuccca

SEQ ID NO: 722269 - RNA, 13 nt, Haemophilus influenzae Rd
aaacaaauaaaaa

SEQ ID NO: 722270 - RNA, 15 nt, Haemophilus influenzae Rd
aaacaaauaaaaagu

SEQ ID NO: 722271 - RNA, 22 nt, Haemophilus influenzae Rd
aaacaaagggcugauauuuaaa

SEQ ID NO: 722272 - RNA, 19 nt, Haemophilus influenzae Rd
aaacaaccagcgcaccaca

SEQ ID NO: 722273 - RNA, 13 nt, Haemophilus influenzae Rd
aaacaaauuuuua

SEQ ID NO: 722274 - RNA, 15 nt, Haemophilus influenzae Rd
aaacaaauuuuuaca

SEQ ID NO: 722275 - RNA, 13 nt, Haemophilus influenzae Rd
aaaauucaaagau

SEQ ID NO: 722276 - RNA, 15 nt, Haemophilus influenzae Rd
aaaauucaaagauua

SEQ ID NO: 722277 - RNA, 14 nt, Haemophilus influenzae Rd
aaaauucaaugaaa

SEQ ID NO: 722278 - RNA, 19 nt, Haemophilus influenzae Rd
aaaauuguucagccaauuu

SEQ ID NO: 722279 - RNA, 13 nt, Haemophilus influenzae Rd
aaaauuucgcuau

SEQ ID NO: 722280 - RNA, 21 nt, Haemophilus influenzae Rd
aaaauuucuuuuguuuuaacc

SEQ ID NO: 722281 - RNA, 12 nt, Haemophilus influenzae Rd
aaaauuucugaa

SEQ ID NO: 722282 - RNA, 18 nt, Haemophilus influenzae Rd
aaaauuucuucuacaccu

SEQ ID NO: 722283 - RNA, 16 nt, Haemophilus influenzae Rd
aaaauuucagacaaaa

SEQ ID NO: 722284 - RNA, 11 nt, Haemophilus influenzae Rd
aaaauuuaauc

SEQ ID NO: 722285 - RNA, 19 nt, Haemophilus influenzae Rd
aaaauuuacucacaacaaa

SEQ ID NO: 722286 - RNA, 16 nt, Haemophilus influenzae Rd
aaaauuuuaaauaaaa

SEQ ID NO: 722287 - RNA, 23 nt, Haemophilus influenzae Rd
aaaauuuguaccauugugccaaa

SEQ ID NO: 722288 - RNA, 18 nt, Haemophilus influenzae Rd
aaaauuuguuaagugauc

SEQ ID NO: 722289 - RNA, 21 nt, Haemophilus influenzae Rd
aaaaucgaucuaaucuuaaaa

SEQ ID NO: 722290 - RNA, 23 nt, Haemophilus influenzae Rd
aaaaucgaucuaaucuuaaaaaa

SEQ ID NO: 722291 - RNA, 17 nt, Haemophilus influenzae Rd
aaaaucguaauuuuaaa

SEQ ID NO: 722292 - RNA, 19 nt, Haemophilus influenzae Rd
aaaaucguaauuuuaaaac

SEQ ID NO: 722293 - RNA, 22 nt, Haemophilus influenzae Rd
aaaaucguaauuuuaaaaccac

SEQ ID NO: 722294 - RNA, 15 nt, Haemophilus influenzae Rd
aaaaucgcaauaaau

SEQ ID NO: 722295 - RNA, 17 nt, Haemophilus influenzae Rd
aaaaucgcaauauuaaa

SEQ ID NO: 722296 - RNA, 16 nt, Haemophilus influenzae Rd
aaaaugaugauaauuu

SEQ ID NO: 722297 - RNA, 17 nt, Haemophilus influenzae Rd
aaaaugccccagcaaga

SEQ ID NO: 722298 - RNA, 15 nt, Haemophilus influenzae Rd
aaaaugcuuauaaaa

SEQ ID NO: 722299 - RNA, 15 nt, Haemophilus influenzae Rd
aaaaugcggcaaugg

SEQ ID NO: 722300 - RNA, 23 nt, Haemophilus influenzae Rd
aaaaugcggcaaugguuaauaca

SEQ ID NO: 722301 - RNA, 16 nt, Haemophilus influenzae Rd
aaaauggaaauuugag

SEQ ID NO: 722302 - RNA, 16 nt, Haemophilus influenzae Rd
aaaauggaauaaaaac

SEQ ID NO: 722303 - RNA, 13 nt, Haemophilus influenzae Rd
aaaauggaaugag

SEQ ID NO: 722304 - RNA, 15 nt, Haemophilus influenzae Rd
aaaauuauagaacuu

SEQ ID NO: 722305 - RNA, 22 nt, Haemophilus influenzae Rd
aaaauuaucaaaagaaaagaug

SEQ ID NO: 722306 - RNA, 22 nt, Haemophilus influenzae Rd
aaaauuaucuggcaaucgccaa

SEQ ID NO: 722307 - RNA, 15 nt, Haemophilus influenzae Rd
aaaauuauugcauuu

SEQ ID NO: 722308 - RNA, 22 nt, Haemophilus influenzae Rd
aaaauagcugugcaaaaucuaa

SEQ ID NO: 722309 - RNA, 17 nt, Haemophilus influenzae Rd
aaaauagccuaaauauu

SEQ ID NO: 722310 - RNA, 17 nt, Haemophilus influenzae Rd
aaaauaguaaaaauugu

SEQ ID NO: 722311 - RNA, 18 nt, Haemophilus influenzae Rd
aaaauagaugucggcuau

SEQ ID NO: 722312 - RNA, 21 nt, Haemophilus influenzae Rd
aaaauagacaauauugaaaua

SEQ ID NO: 722313 - RNA, 16 nt, Haemophilus influenzae Rd
aaaauacccauaaaau

SEQ ID NO: 722314 - RNA, 22 nt, Haemophilus influenzae Rd
aaaauaauuuaguuauaugccu

SEQ ID NO: 722315 - RNA, 15 nt, Haemophilus influenzae Rd
aaaauacggugaaau

SEQ ID NO: 722316 - RNA, 13 nt, Haemophilus influenzae Rd
aaaauacguuguu

SEQ ID NO: 722317 - RNA, 15 nt, Haemophilus influenzae Rd
aaaauacuuucagaa

SEQ ID NO: 722318 - RNA, 11 nt, Haemophilus influenzae Rd
aaaaucaccau

SEQ ID NO: 722319 - RNA, 16 nt, Haemophilus influenzae Rd
aaaaucacauaaaaaa

SEQ ID NO: 722320 - RNA, 23 nt, Haemophilus influenzae Rd
aaaaucacaucgccaacuugaau

SEQ ID NO: 722321 - RNA, 15 nt, Haemophilus influenzae Rd
aaaaucaaguuaaaa

SEQ ID NO: 722322 - RNA, 17 nt, Haemophilus influenzae Rd
aaaaucaaguuaaaaaa

SEQ ID NO: 722323 - RNA, 13 nt, Haemophilus influenzae Rd
aaaauauauuaau

SEQ ID NO: 722324 - RNA, 13 nt, Haemophilus influenzae Rd
aaaauauauaauc

SEQ ID NO: 722325 - RNA, 16 nt, Haemophilus influenzae Rd
aaaauaguugaaauuu

SEQ ID NO: 722326 - RNA, 15 nt, Haemophilus influenzae Rd
aaaauaguuuucaca

SEQ ID NO: 722327 - RNA, 16 nt, Haemophilus influenzae Rd
aaaauauaaaaaaaga

SEQ ID NO: 722328 - RNA, 21 nt, Haemophilus influenzae Rd
aaaauauaagauauaaaaaaa

SEQ ID NO: 722329 - RNA, 23 nt, Haemophilus influenzae Rd
aaaauauaauuaaucugcaccuu

SEQ ID NO: 722330 - RNA, 14 nt, Haemophilus influenzae Rd
aaaauauacagcac

SEQ ID NO: 722331 - RNA, 14 nt, Haemophilus influenzae Rd
aaaauccauuuaac

SEQ ID NO: 722332 - RNA, 20 nt, Haemophilus influenzae Rd
aaaauccccguuaaauuuau

SEQ ID NO: 722333 - RNA, 18 nt, Haemophilus influenzae Rd
aaaauccacacuuuaaaa

SEQ ID NO: 722334 - RNA, 15 nt, Haemophilus influenzae Rd
aaaauccaaguuugu

SEQ ID NO: 722335 - RNA, 14 nt, Haemophilus influenzae Rd
aaaauccauaauuu

SEQ ID NO: 722336 - RNA, 16 nt, Haemophilus influenzae Rd
aaaauccauaauuuca

SEQ ID NO: 722337 - RNA, 13 nt, Haemophilus influenzae Rd
aaaaguaaaaaua

SEQ ID NO: 722338 - RNA, 17 nt, Haemophilus influenzae Rd
aaaaguaaaaauaaaaa

SEQ ID NO: 722339 - RNA, 20 nt, Haemophilus influenzae Rd
aaaaguaaaaauaaaaacau

SEQ ID NO: 722340 - RNA, 21 nt, Haemophilus influenzae Rd
aaaaguaaaaauaaaaacauu

SEQ ID NO: 722341 - RNA, 16 nt, Haemophilus influenzae Rd
aaaaguaaaugauaaa

SEQ ID NO: 722342 - RNA, 20 nt, Haemophilus influenzae Rd
aaaaguacagcaaaccaagg

SEQ ID NO: 722343 - RNA, 14 nt, Haemophilus influenzae Rd
aaaaguagcacuuu

SEQ ID NO: 722344 - RNA, 21 nt, Haemophilus influenzae Rd
aaaagugcgaugacaaaaaau

SEQ ID NO: 722345 - RNA, 18 nt, Haemophilus influenzae Rd
aaaagugcgguaaaaauu

SEQ ID NO: 722346 - RNA, 19 nt, Haemophilus influenzae Rd
aaaagugcgguaaaaauuu

SEQ ID NO: 722347 - RNA, 17 nt, Haemophilus influenzae Rd
aaaagugcgguaaauuu

SEQ ID NO: 722348 - RNA, 20 nt, Haemophilus influenzae Rd
aaaagugcgguaaauuuuua

SEQ ID NO: 722349 - RNA, 21 nt, Haemophilus influenzae Rd
aaaagugcggucaauaaaaau

SEQ ID NO: 722350 - RNA, 21 nt, Haemophilus influenzae Rd
aaaagugcggugcaauuugaa

SEQ ID NO: 722351 - RNA, 19 nt, Haemophilus influenzae Rd
aaaagugcgguuaaaaauu

SEQ ID NO: 722352 - RNA, 18 nt, Haemophilus influenzae Rd
aaaagugcgguugauuuu

SEQ ID NO: 722353 - RNA, 14 nt, Haemophilus influenzae Rd
aaaaguauaaacuu

SEQ ID NO: 722354 - RNA, 15 nt, Haemophilus influenzae Rd
aaaagccacuuucaa

SEQ ID NO: 722355 - RNA, 14 nt, Haemophilus influenzae Rd
aaaagcauuacaaa

SEQ ID NO: 722356 - RNA, 22 nt, Haemophilus influenzae Rd
aaaagcauggauuuuucuucua

SEQ ID NO: 722357 - RNA, 20 nt, Haemophilus influenzae Rd
aaaagccgcuaaagagauuu

SEQ ID NO: 722358 - RNA, 17 nt, Haemophilus influenzae Rd
aaaagcgaaucuuucga

SEQ ID NO: 722359 - RNA, 19 nt, Haemophilus influenzae Rd
aaaagcgaaucuuucgauu

SEQ ID NO: 722360 - RNA, 21 nt, Haemophilus influenzae Rd
aaaauaaggucagcaaauuau

SEQ ID NO: 722361 - RNA, 13 nt, Haemophilus influenzae Rd
aaaauaagcauaa

SEQ ID NO: 722362 - RNA, 14 nt, Haemophilus influenzae Rd
aaaauaaacucauu

SEQ ID NO: 722363 - RNA, 12 nt, Haemophilus influenzae Rd
aaaauaaaauga

SEQ ID NO: 722364 - RNA, 13 nt, Haemophilus influenzae Rd
aaaauaaucuggc

SEQ ID NO: 722365 - RNA, 13 nt, Haemophilus influenzae Rd
aaaauaauauaag

SEQ ID NO: 722366 - RNA, 18 nt, Haemophilus influenzae Rd
aaaauaaugcaaaaacaa

SEQ ID NO: 722367 - RNA, 13 nt, Haemophilus influenzae Rd
aaaauaauaucca

SEQ ID NO: 722368 - RNA, 15 nt, Haemophilus influenzae Rd
aaaauaauauccaaa

SEQ ID NO: 722369 - RNA, 13 nt, Haemophilus influenzae Rd
aaaauaaaaccau

SEQ ID NO: 722370 - RNA, 12 nt, Haemophilus influenzae Rd
aaaauaaaaaau

SEQ ID NO: 722371 - RNA, 14 nt, Haemophilus influenzae Rd
aaaauaaaaacauu

SEQ ID NO: 722372 - RNA, 13 nt, Haemophilus influenzae Rd
aaaaguuaaacua

SEQ ID NO: 722373 - RNA, 16 nt, Haemophilus influenzae Rd
aaaaguguauaaauau

SEQ ID NO: 722374 - RNA, 18 nt, Haemophilus influenzae Rd
aaaaguguauaaauauuu

SEQ ID NO: 722375 - RNA, 16 nt, Haemophilus influenzae Rd
aaaaccaaacugccaa

SEQ ID NO: 722376 - RNA, 13 nt, Haemophilus influenzae Rd
aaaaccaauaauc

SEQ ID NO: 722377 - RNA, 18 nt, Haemophilus influenzae Rd
aaaaccaaucauuggaua

SEQ ID NO: 722378 - RNA, 14 nt, Haemophilus influenzae Rd
aaaaccaauuuuuu

SEQ ID NO: 722379 - RNA, 20 nt, Haemophilus influenzae Rd
aaaacggcgugaguugcaua

SEQ ID NO: 722380 - RNA, 23 nt, Haemophilus influenzae Rd
aaaacggugggcugaagcccacc

SEQ ID NO: 722381 - RNA, 18 nt, Haemophilus influenzae Rd
aaaacuaaaaacaaauau

SEQ ID NO: 722382 - RNA, 19 nt, Haemophilus influenzae Rd
aaaacuaucuuacuugccu

SEQ ID NO: 722383 - RNA, 14 nt, Haemophilus influenzae Rd
aaaacuaauugacu

SEQ ID NO: 722384 - RNA, 13 nt, Haemophilus influenzae Rd
aaaacuaauuuga

SEQ ID NO: 722385 - RNA, 15 nt, Haemophilus influenzae Rd
aaaacucgaauagaa

SEQ ID NO: 722386 - RNA, 14 nt, Haemophilus influenzae Rd
aaaacucauccaau

SEQ ID NO: 722387 - RNA, 17 nt, Haemophilus influenzae Rd
aaaacuauuuuuaauuu

SEQ ID NO: 722388 - RNA, 21 nt, Haemophilus influenzae Rd
aaaacuauuuuuaauuuugaa

SEQ ID NO: 722389 - RNA, 11 nt, Haemophilus influenzae Rd
aaaacuuaaag

SEQ ID NO: 722390 - RNA, 16 nt, Haemophilus influenzae Rd
aaaacuuaucauuaau

SEQ ID NO: 722391 - RNA, 17 nt, Haemophilus influenzae Rd
aaaacuugcaaaccaac

SEQ ID NO: 722392 - RNA, 20 nt, Haemophilus influenzae Rd
aaaacuucucuuauuugugu

SEQ ID NO: 722393 - RNA, 22 nt, Haemophilus influenzae Rd
aaaacuucucuuauuugugugg

SEQ ID NO: 722394 - RNA, 17 nt, Haemophilus influenzae Rd
aaaacuuccuaaugcca

SEQ ID NO: 722395 - RNA, 23 nt, Haemophilus influenzae Rd
aaaacuuuucuuauaauuacaga

SEQ ID NO: 722396 - RNA, 18 nt, Haemophilus influenzae Rd
aaaacuuuuguucuugcu

SEQ ID NO: 722397 - RNA, 16 nt, Haemophilus influenzae Rd
aaaacuugcuacacga

SEQ ID NO: 722398 - RNA, 16 nt, Haemophilus influenzae Rd
aaaacuuggcaauuca

SEQ ID NO: 722399 - RNA, 13 nt, Haemophilus influenzae Rd
aaaagaaauuaag

SEQ ID NO: 722400 - RNA, 14 nt, Haemophilus influenzae Rd
aaaagaaauucgcu

SEQ ID NO: 722401 - RNA, 16 nt, Haemophilus influenzae Rd
aaaagaaauaaaagau

SEQ ID NO: 722402 - RNA, 17 nt, Haemophilus influenzae Rd
aaaagaauauuccaaag

SEQ ID NO: 722403 - RNA, 12 nt, Haemophilus influenzae Rd
aaaagacaaaac

SEQ ID NO: 722404 - RNA, 13 nt, Haemophilus influenzae Rd
aaaagaauuaaaa

SEQ ID NO: 722405 - RNA, 13 nt, Haemophilus influenzae Rd
aaaagaccacauu

SEQ ID NO: 722406 - RNA, 19 nt, Haemophilus influenzae Rd
aaaagaccaugccuguucu

SEQ ID NO: 722407 - RNA, 19 nt, Haemophilus influenzae Rd
aaaagacgaagaaacaacc

SEQ ID NO: 722408 - RNA, 18 nt, Haemophilus influenzae Rd
aaaagcaccuaaaaauuu

SEQ ID NO: 722409 - RNA, 19 nt, Haemophilus influenzae Rd
aaaagauugcggcagaauu

SEQ ID NO: 722410 - RNA, 16 nt, Haemophilus influenzae Rd
aaaagcaauaauccaa

SEQ ID NO: 722411 - RNA, 13 nt, Haemophilus influenzae Rd
aaaagcaauaaug

SEQ ID NO: 722412 - RNA, 13 nt, Haemophilus influenzae Rd
aaaagcaagauac

SEQ ID NO: 722413 - RNA, 16 nt, Haemophilus influenzae Rd
aaaagcaagaucuaaa

SEQ ID NO: 722414 - RNA, 19 nt, Haemophilus influenzae Rd
aaaagcaagaucuaaaaac

SEQ ID NO: 722415 - RNA, 22 nt, Haemophilus influenzae Rd
aaaagauucaacaauaauuuuu

SEQ ID NO: 722416 - RNA, 13 nt, Haemophilus influenzae Rd
aaaagaugaauga

SEQ ID NO: 722417 - RNA, 19 nt, Haemophilus influenzae Rd
aaaagaucauuuuuuuaaa

SEQ ID NO: 722418 - RNA, 20 nt, Haemophilus influenzae Rd
aaaagaucaggaucaaaaau

SEQ ID NO: 722419 - RNA, 22 nt, Haemophilus influenzae Rd
aaaagaucaggaucaaaaauau

SEQ ID NO: 722420 - RNA, 19 nt, Haemophilus influenzae Rd
aaaagauaacuuagaaaau

SEQ ID NO: 722421 - RNA, 14 nt, Haemophilus influenzae Rd
aaaagauaaacaaa

SEQ ID NO: 722422 - RNA, 18 nt, Haemophilus influenzae Rd
aaaagauaaacaaaccua

SEQ ID NO: 722423 - RNA, 18 nt, Haemophilus influenzae Rd
aaaaauaaccuaauuuca

SEQ ID NO: 722424 - RNA, 13 nt, Haemophilus influenzae Rd
aaaaauaaauaga

SEQ ID NO: 722425 - RNA, 17 nt, Haemophilus influenzae Rd
aaaaacccucaagaaac

SEQ ID NO: 722426 - RNA, 22 nt, Haemophilus influenzae Rd
aaaaaccgaccgcacuuuuuag

SEQ ID NO: 722427 - RNA, 13 nt, Haemophilus influenzae Rd
aaaaauaaaaaau

SEQ ID NO: 722428 - RNA, 14 nt, Haemophilus influenzae Rd
aaaaauaaaaaaua

SEQ ID NO: 722429 - RNA, 15 nt, Haemophilus influenzae Rd
aaaaauaaaaaauau

SEQ ID NO: 722430 - RNA, 17 nt, Haemophilus influenzae Rd
aaaaauaaaaaauauuu

SEQ ID NO: 722431 - RNA, 15 nt, Haemophilus influenzae Rd
aaaaauaaaaacauu

SEQ ID NO: 722432 - RNA, 13 nt, Haemophilus influenzae Rd
aaaaacauaguaa

SEQ ID NO: 722433 - RNA, 22 nt, Haemophilus influenzae Rd
aaaaacauauuccaagcacuga

SEQ ID NO: 722434 - RNA, 12 nt, Haemophilus influenzae Rd
aaaaacauucaa

SEQ ID NO: 722435 - RNA, 19 nt, Haemophilus influenzae Rd
aaaaacauucaaucuuuuu

SEQ ID NO: 722436 - RNA, 15 nt, Haemophilus influenzae Rd
aaaaacccgcuuauu

SEQ ID NO: 722437 - RNA, 22 nt, Haemophilus influenzae Rd
aaaaacccgcuuuuaacaaaua

SEQ ID NO: 722438 - RNA, 17 nt, Haemophilus influenzae Rd
aaaaaccccgcuaauuu

SEQ ID NO: 722439 - RNA, 20 nt, Haemophilus influenzae Rd
aaaaaccccgcuaauuugcg

SEQ ID NO: 722440 - RNA, 20 nt, Haemophilus influenzae Rd
aaaaacccguaauuaaaaau

SEQ ID NO: 722441 - RNA, 22 nt, Haemophilus influenzae Rd
aaaaacccguaauuaaaaauaa

SEQ ID NO: 722442 - RNA, 14 nt, Haemophilus influenzae Rd
aaaaaccagauaag

SEQ ID NO: 722443 - RNA, 14 nt, Haemophilus influenzae Rd
aaaaauacuaacug

SEQ ID NO: 722444 - RNA, 22 nt, Haemophilus influenzae Rd
aaaaauagccucagguauuucu

SEQ ID NO: 722445 - RNA, 20 nt, Haemophilus influenzae Rd
aaaaauaggcugaaaaaaua

SEQ ID NO: 722446 - RNA, 21 nt, Haemophilus influenzae Rd
aaaaauaggcugaaaaaauau

SEQ ID NO: 722447 - RNA, 23 nt, Haemophilus influenzae Rd
aaaaauaauuuucauugaaaaag

SEQ ID NO: 722448 - RNA, 16 nt, Haemophilus influenzae Rd
aaaaaucauuaaauaa

SEQ ID NO: 722449 - RNA, 18 nt, Haemophilus influenzae Rd
aaaaaucauuaaauaacu

SEQ ID NO: 722450 - RNA, 19 nt, Haemophilus influenzae Rd
aaaaaucaucguauuaaaa

SEQ ID NO: 722451 - RNA, 21 nt, Haemophilus influenzae Rd
aaaaaucaucguauuaaaagu

SEQ ID NO: 722452 - RNA, 13 nt, Haemophilus influenzae Rd
aaaaaucaucaau

SEQ ID NO: 722453 - RNA, 23 nt, Haemophilus influenzae Rd
aaaaauaguuaaucgaaaauuua

SEQ ID NO: 722454 - RNA, 16 nt, Haemophilus influenzae Rd
aaaaauauaaaacuuu

SEQ ID NO: 722455 - RNA, 12 nt, Haemophilus influenzae Rd
aaaaauauauuu

SEQ ID NO: 722456 - RNA, 15 nt, Haemophilus influenzae Rd
aaaaauauauuuaga

SEQ ID NO: 722457 - RNA, 19 nt, Haemophilus influenzae Rd
aaaaauauauuuagauaca

SEQ ID NO: 722458 - RNA, 17 nt, Haemophilus influenzae Rd
aaaaauuuuacauauaa

SEQ ID NO: 722459 - RNA, 23 nt, Haemophilus influenzae Rd
aaaacaagcuuauguaaauuuau

SEQ ID NO: 722460 - RNA, 13 nt, Haemophilus influenzae Rd
aaaacaauaaaaa

SEQ ID NO: 722461 - RNA, 21 nt, Haemophilus influenzae Rd
aaaaauuugaauguaaaaaua

SEQ ID NO: 722462 - RNA, 16 nt, Haemophilus influenzae Rd
aaaaauucaaugaaau

SEQ ID NO: 722463 - RNA, 16 nt, Haemophilus influenzae Rd
aaaaauccgccacuuu

SEQ ID NO: 722464 - RNA, 18 nt, Haemophilus influenzae Rd
aaaaauccuaaauaaaga

SEQ ID NO: 722465 - RNA, 15 nt, Haemophilus influenzae Rd
aaaaauccucaucug

SEQ ID NO: 722466 - RNA, 17 nt, Haemophilus influenzae Rd
aaaaauccucaucugaa

SEQ ID NO: 722467 - RNA, 17 nt, Haemophilus influenzae Rd
aaaaauccugaagauuu

SEQ ID NO: 722468 - RNA, 19 nt, Haemophilus influenzae Rd
aaaaauuaaccgcacuuuu

SEQ ID NO: 722469 - RNA, 14 nt, Haemophilus influenzae Rd
aaaaauuauuuucu

SEQ ID NO: 722470 - RNA, 22 nt, Haemophilus influenzae Rd
aaaaauuaauacugaaaugauu

SEQ ID NO: 722471 - RNA, 15 nt, Haemophilus influenzae Rd
aaaaauuaucaucau

SEQ ID NO: 722472 - RNA, 20 nt, Haemophilus influenzae Rd
aaaaauuagguaacuaaagc

SEQ ID NO: 722473 - RNA, 15 nt, Haemophilus influenzae Rd
aaaaauuaucaaaag

SEQ ID NO: 722474 - RNA, 21 nt, Haemophilus influenzae Rd
aaaaauuaucaaaagaaaaga

SEQ ID NO: 722475 - RNA, 15 nt, Haemophilus influenzae Rd
aaaacaauaaaaaaa

SEQ ID NO: 722476 - RNA, 12 nt, Haemophilus influenzae Rd
aaaacaccuaaa

SEQ ID NO: 722477 - RNA, 18 nt, Haemophilus influenzae Rd
aaaacaccuccagcaaaa

SEQ ID NO: 722478 - RNA, 21 nt, Haemophilus influenzae Rd
aaaacauuaauugacaauuaa

SEQ ID NO: 722479 - RNA, 22 nt, Haemophilus influenzae Rd
aaaacauuucaucgcaucuaaa

SEQ ID NO: 722480 - RNA, 20 nt, Haemophilus influenzae Rd
aaaacauugccaaagcauuu

SEQ ID NO: 722481 - RNA, 14 nt, Haemophilus influenzae Rd
aaaacagacugaaa

SEQ ID NO: 722482 - RNA, 15 nt, Haemophilus influenzae Rd
aaaacagagaaaaaa

SEQ ID NO: 722483 - RNA, 17 nt, Haemophilus influenzae Rd
aaaacagagaaaaaaau

SEQ ID NO: 722484 - RNA, 14 nt, Haemophilus influenzae Rd
aaaacauauuccaa

SEQ ID NO: 722485 - RNA, 13 nt, Haemophilus influenzae Rd
aaacgugauuuac

SEQ ID NO: 722486 - RNA, 20 nt, Haemophilus influenzae Rd
aaacuaaaaacaaauauauu

SEQ ID NO: 722487 - RNA, 12 nt, Haemophilus influenzae Rd
aaacuaaaucuu

SEQ ID NO: 722488 - RNA, 18 nt, Haemophilus influenzae Rd
aaacuaaagaaucaaauu

SEQ ID NO: 722489 - RNA, 22 nt, Haemophilus influenzae Rd
aaacuaaagacggcgcguucuu

SEQ ID NO: 722490 - RNA, 18 nt, Haemophilus influenzae Rd
aaacuaacguuaucaucu

SEQ ID NO: 722491 - RNA, 20 nt, Haemophilus influenzae Rd
aaacguaacuaaaaaaguuu

SEQ ID NO: 722492 - RNA, 20 nt, Haemophilus influenzae Rd
aaacggucgaguuuuucaaa

SEQ ID NO: 722493 - RNA, 14 nt, Haemophilus influenzae Rd
aaacgguuaauaaa

SEQ ID NO: 722494 - RNA, 18 nt, Haemophilus influenzae Rd
aaacguaaacaaaauacc

SEQ ID NO: 722495 - RNA, 19 nt, Haemophilus influenzae Rd
aaacgcuguuuugcuuccu

SEQ ID NO: 722496 - RNA, 14 nt, Haemophilus influenzae Rd
aaacggauuaacac

SEQ ID NO: 722497 - RNA, 23 nt, Haemophilus influenzae Rd
aaacggcuuaguuaaauauaaac

SEQ ID NO: 722498 - RNA, 22 nt, Haemophilus influenzae Rd
aaacgcguggaaagaauaccac

SEQ ID NO: 722499 - RNA, 22 nt, Haemophilus influenzae Rd
aaacgcucuuuaauuguuuggu

SEQ ID NO: 722500 - RNA, 20 nt, Haemophilus influenzae Rd
aaacgcuggaauauuuuucu

SEQ ID NO: 722501 - RNA, 21 nt, Haemophilus influenzae Rd
aaacgccuugggcuaacauug

SEQ ID NO: 722502 - RNA, 22 nt, Haemophilus influenzae Rd
aaacaaggaaucgaaauuaaaa

SEQ ID NO: 722503 - RNA, 23 nt, Haemophilus influenzae Rd
aaaccugaguaaauaaacggaac

SEQ ID NO: 722504 - RNA, 21 nt, Haemophilus influenzae Rd
aaaccugcaaggauauuucca

SEQ ID NO: 722505 - RNA, 16 nt, Haemophilus influenzae Rd
aaaccugcugauuagc

SEQ ID NO: 722506 - RNA, 13 nt, Haemophilus influenzae Rd
aaaccugcuugaa

SEQ ID NO: 722507 - RNA, 17 nt, Haemophilus influenzae Rd
aaacaagauucugaaag

SEQ ID NO: 722508 - RNA, 18 nt, Haemophilus influenzae Rd
aaacaagcucuagaaaau

SEQ ID NO: 722509 - RNA, 23 nt, Haemophilus influenzae Rd
aaacaagcuuauguaaauuuauc

SEQ ID NO: 722510 - RNA, 13 nt, Haemophilus influenzae Rd
aaacaacguaaaa

SEQ ID NO: 722511 - RNA, 17 nt, Haemophilus influenzae Rd
aaaccuguugguuguuc

SEQ ID NO: 722512 - RNA, 15 nt, Haemophilus influenzae Rd
aaaccuuauuuuaaa

SEQ ID NO: 722513 - RNA, 16 nt, Haemophilus influenzae Rd
aaaccuuauuuuaaau

SEQ ID NO: 722514 - RNA, 13 nt, Haemophilus influenzae Rd
aaaccuuggaaua

SEQ ID NO: 722515 - RNA, 13 nt, Haemophilus influenzae Rd
aaaccuuguaaau

SEQ ID NO: 722516 - RNA, 13 nt, Haemophilus influenzae Rd
aaacgaaaaaaau

SEQ ID NO: 722517 - RNA, 19 nt, Haemophilus influenzae Rd
aaacgaaucgguaacauau

SEQ ID NO: 722518 - RNA, 21 nt, Haemophilus influenzae Rd
aaacgaaucgguaacauauga

SEQ ID NO: 722519 - RNA, 13 nt, Haemophilus influenzae Rd
aaacgaagaaaaa

SEQ ID NO: 722520 - RNA, 12 nt, Haemophilus influenzae Rd
aaacgagaaaau

SEQ ID NO: 722521 - RNA, 16 nt, Haemophilus influenzae Rd
aaacgagaaaauuucu

SEQ ID NO: 722522 - RNA, 14 nt, Haemophilus influenzae Rd
aaacgauucacgaa

SEQ ID NO: 722523 - RNA, 13 nt, Haemophilus influenzae Rd
aaacgaugaagaa

SEQ ID NO: 722524 - RNA, 16 nt, Haemophilus influenzae Rd
aaacgaugaagaaaau

SEQ ID NO: 722525 - RNA, 17 nt, Haemophilus influenzae Rd
aaacgaggcucgaacuc

SEQ ID NO: 722526 - RNA, 13 nt, Haemophilus influenzae Rd
aaacgcaacaucg

SEQ ID NO: 722527 - RNA, 23 nt, Haemophilus influenzae Rd
aaacgcaccacgaccuaagaaaa

SEQ ID NO: 722528 - RNA, 23 nt, Haemophilus influenzae Rd
aaacgccucaucuuuuuuaagau

SEQ ID NO: 722529 - RNA, 21 nt, Haemophilus influenzae Rd
aaacuccccuuaacuaauugu

SEQ ID NO: 722530 - RNA, 23 nt, Haemophilus influenzae Rd
aaacuccguccaaucuaauucuu

SEQ ID NO: 722531 - RNA, 21 nt, Haemophilus influenzae Rd
aaacucuaagcuuaauauguu

SEQ ID NO: 722532 - RNA, 14 nt, Haemophilus influenzae Rd
aaacucuaauucca

SEQ ID NO: 722533 - RNA, 21 nt, Haemophilus influenzae Rd
aaacuaauuaguuuuuaauuu

SEQ ID NO: 722534 - RNA, 15 nt, Haemophilus influenzae Rd
aaacuaauuucauuu

SEQ ID NO: 722535 - RNA, 19 nt, Haemophilus influenzae Rd
aaacuaauuucauuuugca

SEQ ID NO: 722536 - RNA, 22 nt, Haemophilus influenzae Rd
aaacuaauuugacgauaauauu

SEQ ID NO: 722537 - RNA, 15 nt, Haemophilus influenzae Rd
aaacuagguaauaau

SEQ ID NO: 722538 - RNA, 20 nt, Haemophilus influenzae Rd
aaacuacuucuaaaggcuaa

SEQ ID NO: 722539 - RNA, 22 nt, Haemophilus influenzae Rd
aaacuacuucuaaaggcuaaau

SEQ ID NO: 722540 - RNA, 15 nt, Haemophilus influenzae Rd
aaacuacuuucuauu

SEQ ID NO: 722541 - RNA, 15 nt, Haemophilus influenzae Rd
aaacuaugcagaauc

SEQ ID NO: 722542 - RNA, 20 nt, Haemophilus influenzae Rd
aaacuaugcagaaucagaau

SEQ ID NO: 722543 - RNA, 18 nt, Haemophilus influenzae Rd
aaacucaaugaauuaaaa

SEQ ID NO: 722544 - RNA, 15 nt, Haemophilus influenzae Rd
aaacuauuaucuacu

SEQ ID NO: 722545 - RNA, 20 nt, Haemophilus influenzae Rd
aaacuauuaucuacuagcca

SEQ ID NO: 722546 - RNA, 19 nt, Haemophilus influenzae Rd
aaacuauuuuuaauuuuga

SEQ ID NO: 722547 - RNA, 23 nt, Haemophilus influenzae Rd
aaacuggguuuuuuuauuuuuau

SEQ ID NO: 722548 - RNA, 16 nt, Haemophilus influenzae Rd
aaacuggaugaaauca

SEQ ID NO: 722549 - RNA, 21 nt, Haemophilus influenzae Rd
aaacuguuuuggcauuuucaa

SEQ ID NO: 722550 - RNA, 13 nt, Haemophilus influenzae Rd
aaacuuaaagaau

SEQ ID NO: 722551 - RNA, 14 nt, Haemophilus influenzae Rd
aaacuuaaagaaua

SEQ ID NO: 722552 - RNA, 15 nt, Haemophilus influenzae Rd
aaacuguugccauaa

SEQ ID NO: 722553 - RNA, 16 nt, Haemophilus influenzae Rd
aaacugccaaacaaau

SEQ ID NO: 722554 - RNA, 15 nt, Haemophilus influenzae Rd
aaacugcuuucaaaa

SEQ ID NO: 722555 - RNA, 18 nt, Haemophilus influenzae Rd
aaacugcuuucaaaagga

SEQ ID NO: 722556 - RNA, 24 nt, Haemophilus influenzae Rd
aaacugaugauggccaugacaagc

SEQ ID NO: 722557 - RNA, 15 nt, Haemophilus influenzae Rd
aaacugauuuugauu

SEQ ID NO: 722558 - RNA, 19 nt, Haemophilus influenzae Rd
aaacugccgccuucuucca

SEQ ID NO: 722559 - RNA, 20 nt, Haemophilus influenzae Rd
aaacuugggugauccauuaa

SEQ ID NO: 722560 - RNA, 17 nt, Haemophilus influenzae Rd
aaacuugaauaauaacg

SEQ ID NO: 722561 - RNA, 18 nt, Haemophilus influenzae Rd
aaacuugacguuguucuu

SEQ ID NO: 722562 - RNA, 13 nt, Haemophilus influenzae Rd
aaacuugagauuu

SEQ ID NO: 722563 - RNA, 16 nt, Haemophilus influenzae Rd
aaacuuuauuuuauuc

SEQ ID NO: 722564 - RNA, 21 nt, Haemophilus influenzae Rd
aaacuuucaauuuuuccaccg

SEQ ID NO: 722565 - RNA, 15 nt, Haemophilus influenzae Rd
aaacuuguuaaauaa

SEQ ID NO: 722566 - RNA, 20 nt, Haemophilus influenzae Rd
aaacuuguuaaauaaacaca

SEQ ID NO: 722567 - RNA, 23 nt, Haemophilus influenzae Rd
aaacuuacuacguguucaucauc

SEQ ID NO: 722568 - RNA, 19 nt, Haemophilus influenzae Rd
aaacuuaggaugauacaau

SEQ ID NO: 722569 - RNA, 20 nt, Haemophilus influenzae Rd
aaacuuauaaagauauuacu

SEQ ID NO: 722570 - RNA, 21 nt, Haemophilus influenzae Rd
aaacuuaccuaaaaauuuaaa

SEQ ID NO: 722571 - RNA, 14 nt, Haemophilus influenzae Rd
aaagagcaaauuua

SEQ ID NO: 722572 - RNA, 18 nt, Haemophilus influenzae Rd
aaagagcaaauuuaaaua

SEQ ID NO: 722573 - RNA, 18 nt, Haemophilus influenzae Rd
aaagagcgguugaaaauu

SEQ ID NO: 722574 - RNA, 16 nt, Haemophilus influenzae Rd
aaagauaacuaagaug

SEQ ID NO: 722575 - RNA, 18 nt, Haemophilus influenzae Rd
aaagauaacuaagaugau

SEQ ID NO: 722576 - RNA, 19 nt, Haemophilus influenzae Rd
aaagacuaaacucaaugaa

SEQ ID NO: 722577 - RNA, 23 nt, Haemophilus influenzae Rd
aaagacuaaacucaaugaauuaa

SEQ ID NO: 722578 - RNA, 23 nt, Haemophilus influenzae Rd
aaagagaucacuguaaauaauag

SEQ ID NO: 722579 - RNA, 16 nt, Haemophilus influenzae Rd
aaagagagcuucucuu

SEQ ID NO: 722580 - RNA, 21 nt, Haemophilus influenzae Rd
aaagagacucuguuccacagg

SEQ ID NO: 722581 - RNA, 15 nt, Haemophilus influenzae Rd
aaagaaguuuuccau

SEQ ID NO: 722582 - RNA, 22 nt, Haemophilus influenzae Rd
aaacuuuuguucuugcuuaaau

SEQ ID NO: 722583 - RNA, 14 nt, Haemophilus influenzae Rd
aaagaagcuuucca

SEQ ID NO: 722584 - RNA, 13 nt, Haemophilus influenzae Rd
aaacuuuggaaua

SEQ ID NO: 722585 - RNA, 13 nt, Haemophilus influenzae Rd
aaagaauaucaau

SEQ ID NO: 722586 - RNA, 14 nt, Haemophilus influenzae Rd
aaagaauaauaagu

SEQ ID NO: 722587 - RNA, 20 nt, Haemophilus influenzae Rd
aaagaauacaccccaaaauc

SEQ ID NO: 722588 - RNA, 23 nt, Haemophilus influenzae Rd
aaagaauauaaauaaaacaagga

SEQ ID NO: 722589 - RNA, 21 nt, Haemophilus influenzae Rd
aaagaauaucgccuuauccca

SEQ ID NO: 722590 - RNA, 20 nt, Haemophilus influenzae Rd
aaagaauauucuuuucucca

SEQ ID NO: 722591 - RNA, 15 nt, Haemophilus influenzae Rd
aaagaauauuuuaau

SEQ ID NO: 722592 - RNA, 16 nt, Haemophilus influenzae Rd
aaagaauauuuuaaug

SEQ ID NO: 722593 - RNA, 17 nt, Haemophilus influenzae Rd
aaagacgauauuuuccu

SEQ ID NO: 722594 - RNA, 18 nt, Haemophilus influenzae Rd
aaagacgauauuuuccuu

SEQ ID NO: 722595 - RNA, 20 nt, Haemophilus influenzae Rd
aaagacgcuguuucuuuuca

SEQ ID NO: 722596 - RNA, 21 nt, Haemophilus influenzae Rd
aaagacggcgcguucuucugc

SEQ ID NO: 722597 - RNA, 22 nt, Haemophilus influenzae Rd
aaagacguuugauuguaaaagu

SEQ ID NO: 722598 - RNA, 19 nt, Haemophilus influenzae Rd
aaagcaaaugaggaaaaua

SEQ ID NO: 722599 - RNA, 21 nt, Haemophilus influenzae Rd
aaagcaaaugaggaaaauaaa

SEQ ID NO: 722600 - RNA, 23 nt, Haemophilus influenzae Rd
aaagcaaauggcaucaauauuau

SEQ ID NO: 722601 - RNA, 13 nt, Haemophilus influenzae Rd
aaagcaaaaccau

SEQ ID NO: 722602 - RNA, 16 nt, Haemophilus influenzae Rd
aaagcaaaaucaaagu

SEQ ID NO: 722603 - RNA, 15 nt, Haemophilus influenzae Rd
aaagauuuuucuugc

SEQ ID NO: 722604 - RNA, 15 nt, Haemophilus influenzae Rd
aaagauuuugcagau

SEQ ID NO: 722605 - RNA, 13 nt, Haemophilus influenzae Rd
aaagaucauuuuu

SEQ ID NO: 722606 - RNA, 18 nt, Haemophilus influenzae Rd
aaagaucauuuuuuuaaa

SEQ ID NO: 722607 - RNA, 22 nt, Haemophilus influenzae Rd
aaagauccaaagacuaaaacca

SEQ ID NO: 722608 - RNA, 14 nt, Haemophilus influenzae Rd
aaagauauuacuua

SEQ ID NO: 722609 - RNA, 23 nt, Haemophilus influenzae Rd
aaagauuguuuuuucauauuuua

SEQ ID NO: 722610 - RNA, 18 nt, Haemophilus influenzae Rd
aaagauuuauguugaauu

SEQ ID NO: 722611 - RNA, 13 nt, Haemophilus influenzae Rd
aaagauuuuaaaa

SEQ ID NO: 722612 - RNA, 16 nt, Haemophilus influenzae Rd
aaagauuuuaaaauuu

SEQ ID NO: 722613 - RNA, 16 nt, Haemophilus influenzae Rd
aaagaucaggaucaaa

SEQ ID NO: 722614 - RNA, 15 nt, Haemophilus influenzae Rd
aaagauauaaacuga

SEQ ID NO: 722615 - RNA, 21 nt, Haemophilus influenzae Rd
aaagauaauuacgccuaacca

SEQ ID NO: 722616 - RNA, 22 nt, Haemophilus influenzae Rd
aaagcacuaugguguuacuuaa

SEQ ID NO: 722617 - RNA, 18 nt, Haemophilus influenzae Rd
aaagcaccgcauuaauau

SEQ ID NO: 722618 - RNA, 19 nt, Haemophilus influenzae Rd
aaagcaccuaaaauuuuua

SEQ ID NO: 722619 - RNA, 23 nt, Haemophilus influenzae Rd
aaagcaccuuuaggaugugaaua

SEQ ID NO: 722620 - RNA, 18 nt, Haemophilus influenzae Rd
aaagcauggauuuuucuu

SEQ ID NO: 722621 - RNA, 16 nt, Haemophilus influenzae Rd
aaagcaugaauaaaaa

SEQ ID NO: 722622 - RNA, 16 nt, Haemophilus influenzae Rd
aaagccaacuuuuucu

SEQ ID NO: 722623 - RNA, 15 nt, Haemophilus influenzae Rd
aaagccauuuugcuc

SEQ ID NO: 722624 - RNA, 19 nt, Haemophilus influenzae Rd
aaagccauuuugcucaaaa

SEQ ID NO: 722625 - RNA, 16 nt, Haemophilus influenzae Rd
aaagcccaaaugcaac

SEQ ID NO: 722626 - RNA, 13 nt, Haemophilus influenzae Rd
aaagcccaaguaa

SEQ ID NO: 722627 - RNA, 20 nt, Haemophilus influenzae Rd
aaagccaaugccaaaaccau

SEQ ID NO: 722628 - RNA, 16 nt, Haemophilus influenzae Rd
aaagcuggcucuucuu

SEQ ID NO: 722629 - RNA, 21 nt, Haemophilus influenzae Rd
aaagcuguuuacuuuuauaaa

SEQ ID NO: 722630 - RNA, 22 nt, Haemophilus influenzae Rd
aaagcuguuugacaugacaguu

SEQ ID NO: 722631 - RNA, 21 nt, Haemophilus influenzae Rd
aaagcuuaauggcuugcucug

SEQ ID NO: 722632 - RNA, 23 nt, Haemophilus influenzae Rd
aaaggcacaggaugcaccaauac

SEQ ID NO: 722633 - RNA, 14 nt, Haemophilus influenzae Rd
aaaggaaucccaua

SEQ ID NO: 722634 - RNA, 21 nt, Haemophilus influenzae Rd
aaaggaaucccauauuuaaaa

SEQ ID NO: 722635 - RNA, 19 nt, Haemophilus influenzae Rd
aaagcgugagccaaugccu

SEQ ID NO: 722636 - RNA, 14 nt, Haemophilus influenzae Rd
aaagcgugauuuuu

SEQ ID NO: 722637 - RNA, 16 nt, Haemophilus influenzae Rd
aaagcguuguucaucu

SEQ ID NO: 722638 - RNA, 17 nt, Haemophilus influenzae Rd
aaagcguugaaaauaaa

SEQ ID NO: 722639 - RNA, 15 nt, Haemophilus influenzae Rd
aaagcuacuaaaaau

SEQ ID NO: 722640 - RNA, 16 nt, Haemophilus influenzae Rd
aaagcuacuaaaaauu

SEQ ID NO: 722641 - RNA, 14 nt, Haemophilus influenzae Rd
aaagcguuuuaaaa

SEQ ID NO: 722642 - RNA, 15 nt, Haemophilus influenzae Rd
aaagcuaaaaaaaca

SEQ ID NO: 722643 - RNA, 23 nt, Haemophilus influenzae Rd
aaagcccuucuaugccaaucaca

SEQ ID NO: 722644 - RNA, 16 nt, Haemophilus influenzae Rd
aaagggauuuuaauua

SEQ ID NO: 722645 - RNA, 16 nt, Haemophilus influenzae Rd
aaagggcgguuaaaaa

SEQ ID NO: 722646 - RNA, 13 nt, Haemophilus influenzae Rd
aaaggcauuuuuu

SEQ ID NO: 722647 - RNA, 17 nt, Haemophilus influenzae Rd
aaaggcauuuuuuauaa

SEQ ID NO: 722648 - RNA, 18 nt, Haemophilus influenzae Rd
aaagggaaauuuauuaua

SEQ ID NO: 722649 - RNA, 13 nt, Haemophilus influenzae Rd
aaagggaaauaac

SEQ ID NO: 722650 - RNA, 23 nt, Haemophilus influenzae Rd
aaagggcugauauuuaaaaucag

SEQ ID NO: 722651 - RNA, 14 nt, Haemophilus influenzae Rd
aaagguuacucauu

SEQ ID NO: 722652 - RNA, 13 nt, Haemophilus influenzae Rd
aaagguugguuga

SEQ ID NO: 722653 - RNA, 12 nt, Haemophilus influenzae Rd
aaagguugcggc

SEQ ID NO: 722654 - RNA, 14 nt, Haemophilus influenzae Rd
aaagucaaaauaag

SEQ ID NO: 722655 - RNA, 19 nt, Haemophilus influenzae Rd
aaaguauuuuucuaaaucg

SEQ ID NO: 722656 - RNA, 16 nt, Haemophilus influenzae Rd
aaaguauuaaauauaa

SEQ ID NO: 722657 - RNA, 14 nt, Haemophilus influenzae Rd
aaaguauuaaauuu

SEQ ID NO: 722658 - RNA, 21 nt, Haemophilus influenzae Rd
aaaguauucauauaauucauu

SEQ ID NO: 722659 - RNA, 17 nt, Haemophilus influenzae Rd
aaagucacgaggauuaa

SEQ ID NO: 722660 - RNA, 15 nt, Haemophilus influenzae Rd
aaaguacacaagaaa

SEQ ID NO: 722661 - RNA, 13 nt, Haemophilus influenzae Rd
aaaucaacaagac

SEQ ID NO: 722662 - RNA, 18 nt, Haemophilus influenzae Rd
aaaucaaauuuaggauuu

SEQ ID NO: 722663 - RNA, 20 nt, Haemophilus influenzae Rd
aaaucaaucaggcuuucauu

SEQ ID NO: 722664 - RNA, 15 nt, Haemophilus influenzae Rd
aaaucaaguuaaaaa

SEQ ID NO: 722665 - RNA, 22 nt, Haemophilus influenzae Rd
aaaucaagcccucgaauauuga

SEQ ID NO: 722666 - RNA, 16 nt, Haemophilus influenzae Rd
aaaucaagaugacgaa

SEQ ID NO: 722667 - RNA, 18 nt, Haemophilus influenzae Rd
aaaucaccuaaaucuuua

SEQ ID NO: 722668 - RNA, 16 nt, Haemophilus influenzae Rd
aaaucaauuaacuauu

SEQ ID NO: 722669 - RNA, 19 nt, Haemophilus influenzae Rd
aaaucaauuaacuauuuaa

SEQ ID NO: 722670 - RNA, 17 nt, Haemophilus influenzae Rd
aaaucagcgcauuuuuu

SEQ ID NO: 722671 - RNA, 18 nt, Haemophilus influenzae Rd
aaaucagcuaauaacaca

SEQ ID NO: 722672 - RNA, 14 nt, Haemophilus influenzae Rd
aaaucauaccaauu

SEQ ID NO: 722673 - RNA, 17 nt, Haemophilus influenzae Rd
aaaucacggaggaaugg

SEQ ID NO: 722674 - RNA, 19 nt, Haemophilus influenzae Rd
aaaucaccuucaaguaauu

SEQ ID NO: 722675 - RNA, 18 nt, Haemophilus influenzae Rd
aaauauugaguauucccc

SEQ ID NO: 722676 - RNA, 16 nt, Haemophilus influenzae Rd
aaauauucuucauaaa

SEQ ID NO: 722677 - RNA, 18 nt, Haemophilus influenzae Rd
aaauauuauuaaguaaua

SEQ ID NO: 722678 - RNA, 17 nt, Haemophilus influenzae Rd
aaauauuccaacgauuu

SEQ ID NO: 722679 - RNA, 13 nt, Haemophilus influenzae Rd
aaauauuucacuu

SEQ ID NO: 722680 - RNA, 13 nt, Haemophilus influenzae Rd
aaauauuucagua

SEQ ID NO: 722681 - RNA, 14 nt, Haemophilus influenzae Rd
aaauauuucaguau

SEQ ID NO: 722682 - RNA, 20 nt, Haemophilus influenzae Rd
aaauauuucaguauuuuaau

SEQ ID NO: 722683 - RNA, 20 nt, Haemophilus influenzae Rd
aaauauuuccgcacuuuacg

SEQ ID NO: 722684 - RNA, 16 nt, Haemophilus influenzae Rd
aaauauuuacgacuaa

SEQ ID NO: 722685 - RNA, 21 nt, Haemophilus influenzae Rd
aaauauuuauacacuuuuaac

SEQ ID NO: 722686 - RNA, 13 nt, Haemophilus influenzae Rd
aaauauugauuau

SEQ ID NO: 722687 - RNA, 16 nt, Haemophilus influenzae Rd
aaauauugguuauuua

SEQ ID NO: 722688 - RNA, 18 nt, Haemophilus influenzae Rd
aaauauugguuauuuaaa

SEQ ID NO: 722689 - RNA, 23 nt, Haemophilus influenzae Rd
aaauauugucuauuugcuuuccc

SEQ ID NO: 722690 - RNA, 19 nt, Haemophilus influenzae Rd
aaauauuuaaaaagaauau

SEQ ID NO: 722691 - RNA, 13 nt, Haemophilus influenzae Rd
aaaucaaaaauaa

SEQ ID NO: 722692 - RNA, 16 nt, Haemophilus influenzae Rd
aaaucaaaaauaaaaa

SEQ ID NO: 722693 - RNA, 15 nt, Haemophilus influenzae Rd
aaaucaaaaauuaag

SEQ ID NO: 722694 - RNA, 22 nt, Haemophilus influenzae Rd
aaaucaaaacgaucuaaaaaug

SEQ ID NO: 722695 - RNA, 20 nt, Haemophilus influenzae Rd
aaauauuuucauuuauguua

SEQ ID NO: 722696 - RNA, 23 nt, Haemophilus influenzae Rd
aaauauuuggcugauauauuaac

SEQ ID NO: 722697 - RNA, 23 nt, Haemophilus influenzae Rd
aaauaugcaucagauuuuucgca

SEQ ID NO: 722698 - RNA, 21 nt, Haemophilus influenzae Rd
aaauauuaucuucaugauuuu

SEQ ID NO: 722699 - RNA, 15 nt, Haemophilus influenzae Rd
aaauaugauuuagaa

SEQ ID NO: 722700 - RNA, 15 nt, Haemophilus influenzae Rd
aaauaugccuuauau

SEQ ID NO: 722701 - RNA, 20 nt, Haemophilus influenzae Rd
aaauaugccuuauauuucac

SEQ ID NO: 722702 - RNA, 12 nt, Haemophilus influenzae Rd
aaauaugauaaa

SEQ ID NO: 722703 - RNA, 22 nt, Haemophilus influenzae Rd
aaauagucacuugugguuauuu

SEQ ID NO: 722704 - RNA, 15 nt, Haemophilus influenzae Rd
aaauaguuaaagaaa

SEQ ID NO: 722705 - RNA, 21 nt, Haemophilus influenzae Rd
aaauaguuaaagaaaauauuu

SEQ ID NO: 722706 - RNA, 17 nt, Haemophilus influenzae Rd
aaauagguaucacuuaa

SEQ ID NO: 722707 - RNA, 17 nt, Haemophilus influenzae Rd
aaauaggcacauaagua

SEQ ID NO: 722708 - RNA, 20 nt, Haemophilus influenzae Rd
aaauaggcacauaaguaaaa

SEQ ID NO: 722709 - RNA, 19 nt, Haemophilus influenzae Rd
aaauaagggauauuuuuua

SEQ ID NO: 722710 - RNA, 17 nt, Haemophilus influenzae Rd
aaauaaggcguaaaacu

SEQ ID NO: 722711 - RNA, 16 nt, Haemophilus influenzae Rd
aaauaagguucgucau

SEQ ID NO: 722712 - RNA, 19 nt, Haemophilus influenzae Rd
aaauaauaauuagcuaaau

SEQ ID NO: 722713 - RNA, 14 nt, Haemophilus influenzae Rd
aaauaauaaaucca

SEQ ID NO: 722714 - RNA, 16 nt, Haemophilus influenzae Rd
aaauaacguaaccauu

SEQ ID NO: 722715 - RNA, 20 nt, Haemophilus influenzae Rd
aaauaacgucauuaauuuuu

SEQ ID NO: 722716 - RNA, 21 nt, Haemophilus influenzae Rd
aaauaacgucauuaauuuuuu

SEQ ID NO: 722717 - RNA, 19 nt, Haemophilus influenzae Rd
aaauaaccuaaaauauuua

SEQ ID NO: 722718 - RNA, 23 nt, Haemophilus influenzae Rd
aaauaaccuaauuucauaaaaau

SEQ ID NO: 722719 - RNA, 18 nt, Haemophilus influenzae Rd
aaauaaccuaucccaaaa

SEQ ID NO: 722720 - RNA, 16 nt, Haemophilus influenzae Rd
aaauaacuucauccau

SEQ ID NO: 722721 - RNA, 18 nt, Haemophilus influenzae Rd
aaauaacuucauccauuu

SEQ ID NO: 722722 - RNA, 18 nt, Haemophilus influenzae Rd
aaagucccgugagcauuu

SEQ ID NO: 722723 - RNA, 20 nt, Haemophilus influenzae Rd
aaauaaaacccaguuuaaaa

SEQ ID NO: 722724 - RNA, 15 nt, Haemophilus influenzae Rd
aaagucgcuuaaguc

SEQ ID NO: 722725 - RNA, 18 nt, Haemophilus influenzae Rd
aaagucgauucaaauaac

SEQ ID NO: 722726 - RNA, 11 nt, Haemophilus influenzae Rd
aaauaaaauau

SEQ ID NO: 722727 - RNA, 13 nt, Haemophilus influenzae Rd
aaauaaaauauuu

SEQ ID NO: 722728 - RNA, 17 nt, Haemophilus influenzae Rd
aaauaaaauauuuuuua

SEQ ID NO: 722729 - RNA, 16 nt, Haemophilus influenzae Rd
aaauaaaauuacaaaa

SEQ ID NO: 722730 - RNA, 14 nt, Haemophilus influenzae Rd
aaauaacaauccua

SEQ ID NO: 722731 - RNA, 15 nt, Haemophilus influenzae Rd
aaauaacacagaaac

SEQ ID NO: 722732 - RNA, 22 nt, Haemophilus influenzae Rd
aaauaacaugguuaaaauauuc

SEQ ID NO: 722733 - RNA, 20 nt, Haemophilus influenzae Rd
aaauaaaugaugacagcuga

SEQ ID NO: 722734 - RNA, 13 nt, Haemophilus influenzae Rd
aaauaaauuuauu

SEQ ID NO: 722735 - RNA, 14 nt, Haemophilus influenzae Rd
aaauaaauuuggua

SEQ ID NO: 722736 - RNA, 14 nt, Haemophilus influenzae Rd
aaauaaauuuuaaa

SEQ ID NO: 722737 - RNA, 23 nt, Haemophilus influenzae Rd
aaauaaauccuguuuauuuuuua

SEQ ID NO: 722738 - RNA, 23 nt, Haemophilus influenzae Rd
aaauaaacgcaucaacuuuauca

SEQ ID NO: 722739 - RNA, 12 nt, Haemophilus influenzae Rd
aaauaaaucaau

SEQ ID NO: 722740 - RNA, 17 nt, Haemophilus influenzae Rd
aaauaaaagaauuuuua

SEQ ID NO: 722741 - RNA, 14 nt, Haemophilus influenzae Rd
aaauaaacacaaac

SEQ ID NO: 722742 - RNA, 22 nt, Haemophilus influenzae Rd
aaauagcccuacuuaguaauau

SEQ ID NO: 722743 - RNA, 23 nt, Haemophilus influenzae Rd
aaauacugcacaaucaaaccaau

SEQ ID NO: 722744 - RNA, 14 nt, Haemophilus influenzae Rd
aaauacuguuuuau

SEQ ID NO: 722745 - RNA, 20 nt, Haemophilus influenzae Rd
aaauacuguuuuaugcuaaa

SEQ ID NO: 722746 - RNA, 21 nt, Haemophilus influenzae Rd
aaauacuugcuuaugcaaagu

SEQ ID NO: 722747 - RNA, 19 nt, Haemophilus influenzae Rd
aaauagccuaaauauuuau

SEQ ID NO: 722748 - RNA, 21 nt, Haemophilus influenzae Rd
aaauagcgaucugcacuuuaa

SEQ ID NO: 722749 - RNA, 22 nt, Haemophilus influenzae Rd
aaauagcgaucugcacuuuaac

SEQ ID NO: 722750 - RNA, 14 nt, Haemophilus influenzae Rd
aaauagcuaacaau

SEQ ID NO: 722751 - RNA, 18 nt, Haemophilus influenzae Rd
aaauagcuacgguuauuu

SEQ ID NO: 722752 - RNA, 18 nt, Haemophilus influenzae Rd
aaauagcugauaauaaag

SEQ ID NO: 722753 - RNA, 12 nt, Haemophilus influenzae Rd
aaauaggaaagg

SEQ ID NO: 722754 - RNA, 21 nt, Haemophilus influenzae Rd
aaauaggaaaggcauuuuuua

SEQ ID NO: 722755 - RNA, 20 nt, Haemophilus influenzae Rd
aaauaauccagauaacaaac

SEQ ID NO: 722756 - RNA, 17 nt, Haemophilus influenzae Rd
aaauaaucguuuuucca

SEQ ID NO: 722757 - RNA, 14 nt, Haemophilus influenzae Rd
aaauaaucucuucu

SEQ ID NO: 722758 - RNA, 15 nt, Haemophilus influenzae Rd
aaauaauauucaaaa

SEQ ID NO: 722759 - RNA, 17 nt, Haemophilus influenzae Rd
aaauaauauucaaaaca

SEQ ID NO: 722760 - RNA, 18 nt, Haemophilus influenzae Rd
aaauaauauucaaaacau

SEQ ID NO: 722761 - RNA, 21 nt, Haemophilus influenzae Rd
aaauaauauucaaaacauuaa

SEQ ID NO: 722762 - RNA, 17 nt, Haemophilus influenzae Rd
aaauaaucacuugaagu

SEQ ID NO: 722763 - RNA, 21 nt, Haemophilus influenzae Rd
aaauaaucacuugaagucuau

SEQ ID NO: 722764 - RNA, 24 nt, Haemophilus influenzae Rd
aaauaauaggauaaauaaacuauu

SEQ ID NO: 722765 - RNA, 14 nt, Haemophilus influenzae Rd
aaauaauauauuau

SEQ ID NO: 722766 - RNA, 16 nt, Haemophilus influenzae Rd
aaauacguuguuuuuc

SEQ ID NO: 722767 - RNA, 21 nt, Haemophilus influenzae Rd
aaauacguuguuuuucuaccg

SEQ ID NO: 722768 - RNA, 23 nt, Haemophilus influenzae Rd
aaauacuaauaggaguaaaaaua

SEQ ID NO: 722769 - RNA, 18 nt, Haemophilus influenzae Rd
aaauacguauaauugacc

SEQ ID NO: 722770 - RNA, 20 nt, Haemophilus influenzae Rd
aaaucugugcaaaguuacca

SEQ ID NO: 722771 - RNA, 19 nt, Haemophilus influenzae Rd
aaaucuguugaaucucagc

SEQ ID NO: 722772 - RNA, 16 nt, Haemophilus influenzae Rd
aaaucuguuucauuug

SEQ ID NO: 722773 - RNA, 18 nt, Haemophilus influenzae Rd
aaaucuauuccuuucuuu

SEQ ID NO: 722774 - RNA, 15 nt, Haemophilus influenzae Rd
aaaucucaaaaucag

SEQ ID NO: 722775 - RNA, 20 nt, Haemophilus influenzae Rd
aaaucuccaacuucauguuc

SEQ ID NO: 722776 - RNA, 19 nt, Haemophilus influenzae Rd
aaaucgcugggauuuuguc

SEQ ID NO: 722777 - RNA, 14 nt, Haemophilus influenzae Rd
aaaucuaaaaauau

SEQ ID NO: 722778 - RNA, 14 nt, Haemophilus influenzae Rd
aaaucguuugauau

SEQ ID NO: 722779 - RNA, 18 nt, Haemophilus influenzae Rd
aaaucuacucguuuacua

SEQ ID NO: 722780 - RNA, 11 nt, Haemophilus influenzae Rd
aaaucuacuuu

SEQ ID NO: 722781 - RNA, 22 nt, Haemophilus influenzae Rd
aaaucuagagauuguaugaaaa

SEQ ID NO: 722782 - RNA, 15 nt, Haemophilus influenzae Rd
aaaucuacauuuuua

SEQ ID NO: 722783 - RNA, 14 nt, Haemophilus influenzae Rd
aaaucuaaugccuu

SEQ ID NO: 722784 - RNA, 16 nt, Haemophilus influenzae Rd
aaaucuaauuuugcca

SEQ ID NO: 722785 - RNA, 16 nt, Haemophilus influenzae Rd
aaaucuauagauaaca

SEQ ID NO: 722786 - RNA, 21 nt, Haemophilus influenzae Rd
aaaucaucauauucacuuuca

SEQ ID NO: 722787 - RNA, 16 nt, Haemophilus influenzae Rd
aaaucauauugauuua

SEQ ID NO: 722788 - RNA, 17 nt, Haemophilus influenzae Rd
aaaucaucgaaaucuaa

SEQ ID NO: 722789 - RNA, 20 nt, Haemophilus influenzae Rd
aaaucaucggguaaauuuag

SEQ ID NO: 722790 - RNA, 14 nt, Haemophilus influenzae Rd
aaaucaucuagcau

SEQ ID NO: 722791 - RNA, 15 nt, Haemophilus influenzae Rd
aaaucaugaauaauu

SEQ ID NO: 722792 - RNA, 13 nt, Haemophilus influenzae Rd
aaaucauuaaaua

SEQ ID NO: 722793 - RNA, 15 nt, Haemophilus influenzae Rd
aaaucauuaaauaac

SEQ ID NO: 722794 - RNA, 22 nt, Haemophilus influenzae Rd
aaaucgaucacuuaauaaaaau

SEQ ID NO: 722795 - RNA, 17 nt, Haemophilus influenzae Rd
aaaucgcaauauuaaac

SEQ ID NO: 722796 - RNA, 15 nt, Haemophilus influenzae Rd
aaaucgcaauuuuuu

SEQ ID NO: 722797 - RNA, 22 nt, Haemophilus influenzae Rd
aaaucauuacacagaugccauu

SEQ ID NO: 722798 - RNA, 15 nt, Haemophilus influenzae Rd
aaaucuucauuuuca

SEQ ID NO: 722799 - RNA, 20 nt, Haemophilus influenzae Rd
aaaucuuauuaauaaaaaug

SEQ ID NO: 722800 - RNA, 21 nt, Haemophilus influenzae Rd
aaaucuuauuaauaaaaaugc

SEQ ID NO: 722801 - RNA, 20 nt, Haemophilus influenzae Rd
aaaucuuauuucaauauugu

SEQ ID NO: 722802 - RNA, 15 nt, Haemophilus influenzae Rd
aaaugaaaacuaugc

SEQ ID NO: 722803 - RNA, 24 nt, Haemophilus influenzae Rd
aaaugaaaacuaugcucuacuaaa

SEQ ID NO: 722804 - RNA, 22 nt, Haemophilus influenzae Rd
aaaugauguaggcaaaaacacu

SEQ ID NO: 722805 - RNA, 13 nt, Haemophilus influenzae Rd
aaaugaaaugcaa

SEQ ID NO: 722806 - RNA, 14 nt, Haemophilus influenzae Rd
aaaugaaaugcaag

SEQ ID NO: 722807 - RNA, 14 nt, Haemophilus influenzae Rd
aaaugaaauauuuu

SEQ ID NO: 722808 - RNA, 16 nt, Haemophilus influenzae Rd
aaaugaaauauuuuua

SEQ ID NO: 722809 - RNA, 13 nt, Haemophilus influenzae Rd
aaaugaaauguuu

SEQ ID NO: 722810 - RNA, 18 nt, Haemophilus influenzae Rd
aaaugccgauaauagaca

SEQ ID NO: 722811 - RNA, 18 nt, Haemophilus influenzae Rd
aaaugccgcuaaugguug

SEQ ID NO: 722812 - RNA, 22 nt, Haemophilus influenzae Rd
aaaugccgcuaaugguugcauu

SEQ ID NO: 722813 - RNA, 18 nt, Haemophilus influenzae Rd
aaaugcuugaauaaauga

SEQ ID NO: 722814 - RNA, 16 nt, Haemophilus influenzae Rd
aaaugcuguagaaauu

SEQ ID NO: 722815 - RNA, 19 nt, Haemophilus influenzae Rd
aaaugcuguagaaauuaau

SEQ ID NO: 722816 - RNA, 19 nt, Haemophilus influenzae Rd
aaaugcucgcuuuuguauu

SEQ ID NO: 722817 - RNA, 13 nt, Haemophilus influenzae Rd
aaauuacauaaaa

SEQ ID NO: 722818 - RNA, 13 nt, Haemophilus influenzae Rd
aaauuaccacguu

SEQ ID NO: 722819 - RNA, 22 nt, Haemophilus influenzae Rd
aaauuacccaaaugaugaaaca

SEQ ID NO: 722820 - RNA, 13 nt, Haemophilus influenzae Rd
aaauuaaugccaa

SEQ ID NO: 722821 - RNA, 19 nt, Haemophilus influenzae Rd
aaauuaauucucauacaaa

SEQ ID NO: 722822 - RNA, 13 nt, Haemophilus influenzae Rd
aaauuaauuuaac

SEQ ID NO: 722823 - RNA, 14 nt, Haemophilus influenzae Rd
aaauuaauuuaaca

SEQ ID NO: 722824 - RNA, 17 nt, Haemophilus influenzae Rd
aaaaagcuuaauggcuu

SEQ ID NO: 722825 - RNA, 23 nt, Haemophilus influenzae Rd
aaaaagcuuccuuuaaucuguca

SEQ ID NO: 722826 - RNA, 13 nt, Haemophilus influenzae Rd
aaaaagccacuuu

SEQ ID NO: 722827 - RNA, 23 nt, Haemophilus influenzae Rd
aaaaagcccaaaugcaacaauaa

SEQ ID NO: 722828 - RNA, 19 nt, Haemophilus influenzae Rd
aaaaagcccaaguaauaca

SEQ ID NO: 722829 - RNA, 20 nt, Haemophilus influenzae Rd
aaaaagcccaaguaauacac

SEQ ID NO: 722830 - RNA, 12 nt, Haemophilus influenzae Rd
aaaaagcuaaaa

SEQ ID NO: 722831 - RNA, 20 nt, Haemophilus influenzae Rd
aaaaagcgugauuuuuuuca

SEQ ID NO: 722832 - RNA, 15 nt, Haemophilus influenzae Rd
aaaaagcguugaaaa

SEQ ID NO: 722833 - RNA, 18 nt, Haemophilus influenzae Rd
aaauggacagaauaacua

SEQ ID NO: 722834 - RNA, 17 nt, Haemophilus influenzae Rd
aaauggauucaaguaag

SEQ ID NO: 722835 - RNA, 23 nt, Haemophilus influenzae Rd
aaaugcuugguuuuauauucauu

SEQ ID NO: 722836 - RNA, 20 nt, Haemophilus influenzae Rd
aaaugcuuuugccgaaaaug

SEQ ID NO: 722837 - RNA, 16 nt, Haemophilus influenzae Rd
aaauggaaauuugaga

SEQ ID NO: 722838 - RNA, 19 nt, Haemophilus influenzae Rd
aaauguuauaaauaaaaaa

SEQ ID NO: 722839 - RNA, 21 nt, Haemophilus influenzae Rd
aaauguugaauauaauaaaaa

SEQ ID NO: 722840 - RNA, 17 nt, Haemophilus influenzae Rd
aaauuaaauugaaaaaa

SEQ ID NO: 722841 - RNA, 18 nt, Haemophilus influenzae Rd
aaauuaaauugaaaaaau

SEQ ID NO: 722842 - RNA, 15 nt, Haemophilus influenzae Rd
aaauuaaauuguaac

SEQ ID NO: 722843 - RNA, 15 nt, Haemophilus influenzae Rd
aaauuaaacgauaaa

SEQ ID NO: 722844 - RNA, 20 nt, Haemophilus influenzae Rd
aaauuaaaucacccgcauaa

SEQ ID NO: 722845 - RNA, 18 nt, Haemophilus influenzae Rd
aaauuaaccgcacuuuaa

SEQ ID NO: 722846 - RNA, 23 nt, Haemophilus influenzae Rd
aaauuaaccgcacuuuagaaaau

SEQ ID NO: 722847 - RNA, 12 nt, Haemophilus influenzae Rd
aaauuaacaaua

SEQ ID NO: 722848 - RNA, 21 nt, Haemophilus influenzae Rd
aaauuaacgguuuucgauuua

SEQ ID NO: 722849 - RNA, 12 nt, Haemophilus influenzae Rd
aaauuaagaaaa

SEQ ID NO: 722850 - RNA, 16 nt, Haemophilus influenzae Rd
aaauuaagaaaauaau

SEQ ID NO: 722851 - RNA, 19 nt, Haemophilus influenzae Rd
aaauuaagaaaauaauaua

SEQ ID NO: 722852 - RNA, 13 nt, Haemophilus influenzae Rd
aaauuaagaaauu

SEQ ID NO: 722853 - RNA, 21 nt, Haemophilus influenzae Rd
aaauuaacuuaucuaaaaaga

SEQ ID NO: 722854 - RNA, 19 nt, Haemophilus influenzae Rd
aaauuccuuccaacaauuu

SEQ ID NO: 722855 - RNA, 20 nt, Haemophilus influenzae Rd
aaauucgauugcauuuuuua

SEQ ID NO: 722856 - RNA, 15 nt, Haemophilus influenzae Rd
aaauucguaaagcga

SEQ ID NO: 722857 - RNA, 18 nt, Haemophilus influenzae Rd
aaauucguacaaaugaaa

SEQ ID NO: 722858 - RNA, 21 nt, Haemophilus influenzae Rd
aaauucguacuuuugauuuau

SEQ ID NO: 722859 - RNA, 23 nt, Haemophilus influenzae Rd
aaauucgacgauaaccaucuguu

SEQ ID NO: 722860 - RNA, 20 nt, Haemophilus influenzae Rd
aaauucuacgccauuuucua

SEQ ID NO: 722861 - RNA, 23 nt, Haemophilus influenzae Rd
aaauucuacgccauuuucuaccg

SEQ ID NO: 722862 - RNA, 12 nt, Haemophilus influenzae Rd
aaauucuaaaac

SEQ ID NO: 722863 - RNA, 21 nt, Haemophilus influenzae Rd
aaauucaggcucuaacauacc

SEQ ID NO: 722864 - RNA, 17 nt, Haemophilus influenzae Rd
aaauuccauucacuuuc

SEQ ID NO: 722865 - RNA, 21 nt, Haemophilus influenzae Rd
aaauucaguaagaaaccaacu

SEQ ID NO: 722866 - RNA, 22 nt, Haemophilus influenzae Rd
aaauucccauuucuaaugcaau

SEQ ID NO: 722867 - RNA, 21 nt, Haemophilus influenzae Rd
aaauucacucaauucaaagaa

SEQ ID NO: 722868 - RNA, 14 nt, Haemophilus influenzae Rd
aaauucacugucuu

SEQ ID NO: 722869 - RNA, 20 nt, Haemophilus influenzae Rd
aaauucaccgcacuuuucuu

SEQ ID NO: 722870 - RNA, 23 nt, Haemophilus influenzae Rd
aaauucaccgcacuuuuuacuuu

SEQ ID NO: 722871 - RNA, 22 nt, Haemophilus influenzae Rd
aaauuaucaucauuuuuauuua

SEQ ID NO: 722872 - RNA, 20 nt, Haemophilus influenzae Rd
aaauuaucguuuacuuaaaa

SEQ ID NO: 722873 - RNA, 15 nt, Haemophilus influenzae Rd
aaauuauauuuuuaa

SEQ ID NO: 722874 - RNA, 17 nt, Haemophilus influenzae Rd
aaauuaucaaaagaaaa

SEQ ID NO: 722875 - RNA, 14 nt, Haemophilus influenzae Rd
aaauuaucaaagaa

SEQ ID NO: 722876 - RNA, 16 nt, Haemophilus influenzae Rd
aaauuaucaaagaauu

SEQ ID NO: 722877 - RNA, 19 nt, Haemophilus influenzae Rd
aaauuaccuuguuuugcaa

SEQ ID NO: 722878 - RNA, 18 nt, Haemophilus influenzae Rd
aaauuaccguguuuuuca

SEQ ID NO: 722879 - RNA, 19 nt, Haemophilus influenzae Rd
aaauuacgaccuuuacuuu

SEQ ID NO: 722880 - RNA, 21 nt, Haemophilus influenzae Rd
aaauuauguuaaauugcaaaa

SEQ ID NO: 722881 - RNA, 19 nt, Haemophilus influenzae Rd
aaauuaugcccaauuaccu

SEQ ID NO: 722882 - RNA, 17 nt, Haemophilus influenzae Rd
aaauuauugcauuuuua

SEQ ID NO: 722883 - RNA, 18 nt, Haemophilus influenzae Rd
aaauuauugcauuuuuaa

SEQ ID NO: 722884 - RNA, 15 nt, Haemophilus influenzae Rd
augcaauaaauaaga

SEQ ID NO: 722885 - RNA, 13 nt, Haemophilus influenzae Rd
augcaauauuauu

SEQ ID NO: 722886 - RNA, 16 nt, Haemophilus influenzae Rd
augcaauuggcaauau

SEQ ID NO: 722887 - RNA, 18 nt, Haemophilus influenzae Rd
augcaauuggcaauauua

SEQ ID NO: 722888 - RNA, 13 nt, Haemophilus influenzae Rd
augcaauuucaau

SEQ ID NO: 722889 - RNA, 14 nt, Haemophilus influenzae Rd
augcacaacaugcc

SEQ ID NO: 722890 - RNA, 21 nt, Haemophilus influenzae Rd
augcaaaguauuuuucuaaau

SEQ ID NO: 722891 - RNA, 13 nt, Haemophilus influenzae Rd
augcaaauacaag

SEQ ID NO: 722892 - RNA, 15 nt, Haemophilus influenzae Rd
augcaaauacauauu

SEQ ID NO: 722893 - RNA, 17 nt, Haemophilus influenzae Rd
augcaacaauaacugcc

SEQ ID NO: 722894 - RNA, 11 nt, Haemophilus influenzae Rd
augcaaaauua

SEQ ID NO: 722895 - RNA, 22 nt, Haemophilus influenzae Rd
augcaaacaagaugucaaaugu

SEQ ID NO: 722896 - RNA, 17 nt, Haemophilus influenzae Rd
augcaaaaguaaauaau

SEQ ID NO: 722897 - RNA, 13 nt, Haemophilus influenzae Rd
augauuuuuacaa

SEQ ID NO: 722898 - RNA, 21 nt, Haemophilus influenzae Rd
augauuuucauuccuucacuu

SEQ ID NO: 722899 - RNA, 15 nt, Haemophilus influenzae Rd
augauuugcauaaaa

SEQ ID NO: 722900 - RNA, 18 nt, Haemophilus influenzae Rd
augauuugcauaaaacca

SEQ ID NO: 722901 - RNA, 15 nt, Haemophilus influenzae Rd
augauuuuaaaauaa

SEQ ID NO: 722902 - RNA, 23 nt, Haemophilus influenzae Rd
augauuuuaaaauaaauuuuaaa

SEQ ID NO: 722903 - RNA, 18 nt, Haemophilus influenzae Rd
augauuucauuuucuaau

SEQ ID NO: 722904 - RNA, 19 nt, Haemophilus influenzae Rd
augauuuaugaauguuuca

SEQ ID NO: 722905 - RNA, 16 nt, Haemophilus influenzae Rd
augauuaauuaaauua

SEQ ID NO: 722906 - RNA, 23 nt, Haemophilus influenzae Rd
augauucguggcaauuuuucuaa

SEQ ID NO: 722907 - RNA, 21 nt, Haemophilus influenzae Rd
augauuuagaacaauauuuau

SEQ ID NO: 722908 - RNA, 21 nt, Haemophilus influenzae Rd
augauuauccacuaaaaaacu

SEQ ID NO: 722909 - RNA, 21 nt, Haemophilus influenzae Rd
augauuaucuagaaaacucau

SEQ ID NO: 722910 - RNA, 14 nt, Haemophilus influenzae Rd
augauuauaaauua

SEQ ID NO: 722911 - RNA, 18 nt, Haemophilus influenzae Rd
augauuaacuauucaaau

SEQ ID NO: 722912 - RNA, 22 nt, Haemophilus influenzae Rd
augauuacgcguacgcaauuua

SEQ ID NO: 722913 - RNA, 16 nt, Haemophilus influenzae Rd
augauuaaguuaaaag

SEQ ID NO: 722914 - RNA, 22 nt, Haemophilus influenzae Rd
augauuaaccauuaauaaauuu

SEQ ID NO: 722915 - RNA, 13 nt, Haemophilus influenzae Rd
augauuaaaaugg

SEQ ID NO: 722916 - RNA, 22 nt, Haemophilus influenzae Rd
augaugggaugaaaucaaaaug

SEQ ID NO: 722917 - RNA, 17 nt, Haemophilus influenzae Rd
augauguaggcaaaaac

SEQ ID NO: 722918 - RNA, 13 nt, Haemophilus influenzae Rd
augagcacgaaaa

SEQ ID NO: 722919 - RNA, 22 nt, Haemophilus influenzae Rd
augagccaacucgaacaugaag

SEQ ID NO: 722920 - RNA, 20 nt, Haemophilus influenzae Rd
augaucuucaaucaucauuu

SEQ ID NO: 722921 - RNA, 16 nt, Haemophilus influenzae Rd
augaucuuuaauuaaa

SEQ ID NO: 722922 - RNA, 20 nt, Haemophilus influenzae Rd
augaucuuuaauuaaaauau

SEQ ID NO: 722923 - RNA, 22 nt, Haemophilus influenzae Rd
augaugaaacaagcuguagcaa

SEQ ID NO: 722924 - RNA, 16 nt, Haemophilus influenzae Rd
augaugaaauuuuuca

SEQ ID NO: 722925 - RNA, 14 nt, Haemophilus influenzae Rd
augccuuauauuuc

SEQ ID NO: 722926 - RNA, 14 nt, Haemophilus influenzae Rd
augccuucuucacu

SEQ ID NO: 722927 - RNA, 20 nt, Haemophilus influenzae Rd
augccgccuuuuaauaaauu

SEQ ID NO: 722928 - RNA, 20 nt, Haemophilus influenzae Rd
augccgccucagcaauuuuc

SEQ ID NO: 722929 - RNA, 15 nt, Haemophilus influenzae Rd
augcgcccuuuaaau

SEQ ID NO: 722930 - RNA, 21 nt, Haemophilus influenzae Rd
augccgaagccuuguaaaauu

SEQ ID NO: 722931 - RNA, 18 nt, Haemophilus influenzae Rd
augccgauaauagacaua

SEQ ID NO: 722932 - RNA, 14 nt, Haemophilus influenzae Rd
augccauuaaacuu

SEQ ID NO: 722933 - RNA, 22 nt, Haemophilus influenzae Rd
augccauuaaacuucuguaaau

SEQ ID NO: 722934 - RNA, 14 nt, Haemophilus influenzae Rd
augccauucucccu

SEQ ID NO: 722935 - RNA, 22 nt, Haemophilus influenzae Rd
augccauuugcuucgccuucag

SEQ ID NO: 722936 - RNA, 16 nt, Haemophilus influenzae Rd
augcacauaacaaaau

SEQ ID NO: 722937 - RNA, 17 nt, Haemophilus influenzae Rd
augcacauaacaaaaug

SEQ ID NO: 722938 - RNA, 13 nt, Haemophilus influenzae Rd
augcacauuuuua

SEQ ID NO: 722939 - RNA, 19 nt, Haemophilus influenzae Rd
augcacauuuuuaccaauu

SEQ ID NO: 722940 - RNA, 14 nt, Haemophilus influenzae Rd
augcagaaucagaa

SEQ ID NO: 722941 - RNA, 16 nt, Haemophilus influenzae Rd
augcagauccuuucac

SEQ ID NO: 722942 - RNA, 13 nt, Haemophilus influenzae Rd
augccaaucuaaa

SEQ ID NO: 722943 - RNA, 14 nt, Haemophilus influenzae Rd
augccaauuuuucg

SEQ ID NO: 722944 - RNA, 15 nt, Haemophilus influenzae Rd
augccaagauaacca

SEQ ID NO: 722945 - RNA, 15 nt, Haemophilus influenzae Rd
augcagccaucaaua

SEQ ID NO: 722946 - RNA, 21 nt, Haemophilus influenzae Rd
augcagccaucaauaaaaagc

SEQ ID NO: 722947 - RNA, 23 nt, Haemophilus influenzae Rd
augcuugagcugucuaauuuuuu

SEQ ID NO: 722948 - RNA, 14 nt, Haemophilus influenzae Rd
augcuugguuuuau

SEQ ID NO: 722949 - RNA, 23 nt, Haemophilus influenzae Rd
augcuugguuuuauauucauuua

SEQ ID NO: 722950 - RNA, 21 nt, Haemophilus influenzae Rd
augcuuuaaucauuuucacuc

SEQ ID NO: 722951 - RNA, 16 nt, Haemophilus influenzae Rd
augcuuuauuuagaau

SEQ ID NO: 722952 - RNA, 21 nt, Haemophilus influenzae Rd
augcuuuauuuagaauuuuua

SEQ ID NO: 722953 - RNA, 16 nt, Haemophilus influenzae Rd
augcuuucagauaacg

SEQ ID NO: 722954 - RNA, 20 nt, Haemophilus influenzae Rd
augcuuaaucggcacaagac

SEQ ID NO: 722955 - RNA, 22 nt, Haemophilus influenzae Rd
augcuucagcguugucaucaga

SEQ ID NO: 722956 - RNA, 19 nt, Haemophilus influenzae Rd
augcuucuucugcaggaaa

SEQ ID NO: 722957 - RNA, 16 nt, Haemophilus influenzae Rd
augcucgcuuuuguau

SEQ ID NO: 722958 - RNA, 17 nt, Haemophilus influenzae Rd
augcucccaaauugugu

SEQ ID NO: 722959 - RNA, 14 nt, Haemophilus influenzae Rd
augcucucuuuuaa

SEQ ID NO: 722960 - RNA, 21 nt, Haemophilus influenzae Rd
augcugauuugacagaauuac

SEQ ID NO: 722961 - RNA, 23 nt, Haemophilus influenzae Rd
augcugauuugacagaauuacgu

SEQ ID NO: 722962 - RNA, 23 nt, Haemophilus influenzae Rd
augcucuaaauccccugucaauu

SEQ ID NO: 722963 - RNA, 14 nt, Haemophilus influenzae Rd
augcugcaaaagcu

SEQ ID NO: 722964 - RNA, 22 nt, Haemophilus influenzae Rd
auggaacaggcuacacccacuu

SEQ ID NO: 722965 - RNA, 15 nt, Haemophilus influenzae Rd
auggaacaguugaaa

SEQ ID NO: 722966 - RNA, 18 nt, Haemophilus influenzae Rd
augcuuuugaugccaaga

SEQ ID NO: 722967 - RNA, 21 nt, Haemophilus influenzae Rd
augcuuuugccgaaaaugguu

SEQ ID NO: 722968 - RNA, 18 nt, Haemophilus influenzae Rd
augcuuuuauaagugaaa

SEQ ID NO: 722969 - RNA, 22 nt, Haemophilus influenzae Rd
augcuuuuauaagugaaaugcu

SEQ ID NO: 722970 - RNA, 16 nt, Haemophilus influenzae Rd
auggaaaaagcaaaac

SEQ ID NO: 722971 - RNA, 13 nt, Haemophilus influenzae Rd
auggacguguugu

SEQ ID NO: 722972 - RNA, 21 nt, Haemophilus influenzae Rd
auggagagaauagcuauuuuu

SEQ ID NO: 722973 - RNA, 18 nt, Haemophilus influenzae Rd
auggaggauuagaaauga

SEQ ID NO: 722974 - RNA, 14 nt, Haemophilus influenzae Rd
auggaugaauacaa

SEQ ID NO: 722975 - RNA, 19 nt, Haemophilus influenzae Rd
auggauaaaccguacaaac

SEQ ID NO: 722976 - RNA, 14 nt, Haemophilus influenzae Rd
auggauauagaaau

SEQ ID NO: 722977 - RNA, 21 nt, Haemophilus influenzae Rd
auggcaguuuggaaagaguaa

SEQ ID NO: 722978 - RNA, 13 nt, Haemophilus influenzae Rd
auggcgugaaaua

SEQ ID NO: 722979 - RNA, 19 nt, Haemophilus influenzae Rd
auggcgugaaauauugauc

SEQ ID NO: 722980 - RNA, 14 nt, Haemophilus influenzae Rd
auggcuauuuaagc

SEQ ID NO: 722981 - RNA, 19 nt, Haemophilus influenzae Rd
auggcuauuuaagccuuga

SEQ ID NO: 722982 - RNA, 23 nt, Haemophilus influenzae Rd
auggcuauuuaagccuugacgaa

SEQ ID NO: 722983 - RNA, 22 nt, Haemophilus influenzae Rd
auggcguucacguaauggaaua

SEQ ID NO: 722984 - RNA, 16 nt, Haemophilus influenzae Rd
auggcucgaaaguuac

SEQ ID NO: 722985 - RNA, 19 nt, Haemophilus influenzae Rd
auggcucuaaauuaauuua

SEQ ID NO: 722986 - RNA, 15 nt, Haemophilus influenzae Rd
augggccuucaacua

SEQ ID NO: 722987 - RNA, 12 nt, Haemophilus influenzae Rd
augguaaauauu

SEQ ID NO: 722988 - RNA, 22 nt, Haemophilus influenzae Rd
auggugcacuuggccaguggga

SEQ ID NO: 722989 - RNA, 19 nt, Haemophilus influenzae Rd
auguaaauuauuuuaauaa

SEQ ID NO: 722990 - RNA, 16 nt, Haemophilus influenzae Rd
augguuggaagaaaag

SEQ ID NO: 722991 - RNA, 16 nt, Haemophilus influenzae Rd
augguugcaaaggcag

SEQ ID NO: 722992 - RNA, 19 nt, Haemophilus influenzae Rd
augguugcacccacuaaaa

SEQ ID NO: 722993 - RNA, 20 nt, Haemophilus influenzae Rd
augguucgagaaacuuucaa

SEQ ID NO: 722994 - RNA, 18 nt, Haemophilus influenzae Rd
augguucgauuucaucuu

SEQ ID NO: 722995 - RNA, 22 nt, Haemophilus influenzae Rd
auuauggguguuuaaauuuuua

SEQ ID NO: 722996 - RNA, 14 nt, Haemophilus influenzae Rd
auuauuaaauaaac

SEQ ID NO: 722997 - RNA, 14 nt, Haemophilus influenzae Rd
auuauuaaaagcaa

SEQ ID NO: 722998 - RNA, 14 nt, Haemophilus influenzae Rd
auuauguuuuguag

SEQ ID NO: 722999 - RNA, 11 nt, Haemophilus influenzae Rd
auuauguucau

SEQ ID NO: 723000 - RNA, 15 nt, Haemophilus influenzae Rd
auuauguucauuuuc

SEQ ID NO: 723001 - RNA, 20 nt, Haemophilus influenzae Rd
auuaugugcaauuugacaaa

SEQ ID NO: 723002 - RNA, 21 nt, Haemophilus influenzae Rd
auuaugugcuugggcaauuaa

SEQ ID NO: 723003 - RNA, 20 nt, Haemophilus influenzae Rd
auuauggaauggcauaagau

SEQ ID NO: 723004 - RNA, 22 nt, Haemophilus influenzae Rd
auuaugcuccauugcaauuuca

SEQ ID NO: 723005 - RNA, 16 nt, Haemophilus influenzae Rd
auuaugcugauuugac

SEQ ID NO: 723006 - RNA, 16 nt, Haemophilus influenzae Rd
auuaucuagaaaacuc

SEQ ID NO: 723007 - RNA, 18 nt, Haemophilus influenzae Rd
auuaugcgccuaaacgcu

SEQ ID NO: 723008 - RNA, 15 nt, Haemophilus influenzae Rd
auuaucuagcacaaa

SEQ ID NO: 723009 - RNA, 16 nt, Haemophilus influenzae Rd
auuaucuccaagaaua

SEQ ID NO: 723010 - RNA, 20 nt, Haemophilus influenzae Rd
auuaucuccaagaauauuuc

SEQ ID NO: 723011 - RNA, 21 nt, Haemophilus influenzae Rd
auuaucguuuacuuaaaaucu

SEQ ID NO: 723012 - RNA, 15 nt, Haemophilus influenzae Rd
auuaucuaaaucucu

SEQ ID NO: 723013 - RNA, 16 nt, Haemophilus influenzae Rd
auuaucuaaaucucug

SEQ ID NO: 723014 - RNA, 23 nt, Haemophilus influenzae Rd
auuaucuaaauuacauuuuuucu

SEQ ID NO: 723015 - RNA, 15 nt, Haemophilus influenzae Rd
auuaucuaaauuucg

SEQ ID NO: 723016 - RNA, 18 nt, Haemophilus influenzae Rd
auuaucguagguuuuuuu

SEQ ID NO: 723017 - RNA, 15 nt, Haemophilus influenzae Rd
auuaucgucuaucua

SEQ ID NO: 723018 - RNA, 19 nt, Haemophilus influenzae Rd
auuaucgaauagauuuuua

SEQ ID NO: 723019 - RNA, 19 nt, Haemophilus influenzae Rd
auuaucgccuaaaauugca

SEQ ID NO: 723020 - RNA, 13 nt, Haemophilus influenzae Rd
auuauauaaaaaa

SEQ ID NO: 723021 - RNA, 15 nt, Haemophilus influenzae Rd
auuauagauaaauau

SEQ ID NO: 723022 - RNA, 16 nt, Haemophilus influenzae Rd
auuauagauaaauauc

SEQ ID NO: 723023 - RNA, 17 nt, Haemophilus influenzae Rd
auuauagauaaauauca

SEQ ID NO: 723024 - RNA, 19 nt, Haemophilus influenzae Rd
auuaguugguacuaaagau

SEQ ID NO: 723025 - RNA, 14 nt, Haemophilus influenzae Rd
auuauagauuuagu

SEQ ID NO: 723026 - RNA, 17 nt, Haemophilus influenzae Rd
auuauaggcuauaaaga

SEQ ID NO: 723027 - RNA, 14 nt, Haemophilus influenzae Rd
auuagugauaaaug

SEQ ID NO: 723028 - RNA, 15 nt, Haemophilus influenzae Rd
auuagugaugauggu

SEQ ID NO: 723029 - RNA, 23 nt, Haemophilus influenzae Rd
aaaagcuacaccgauuucuuuac

SEQ ID NO: 723030 - RNA, 22 nt, Haemophilus influenzae Rd
aaaagcguugaaaauaaauuga

SEQ ID NO: 723031 - RNA, 14 nt, Haemophilus influenzae Rd
aaaagcuaaaaaaa

SEQ ID NO: 723032 - RNA, 13 nt, Haemophilus influenzae Rd
auuaguauuuaag

SEQ ID NO: 723033 - RNA, 21 nt, Haemophilus influenzae Rd
auuauuuagauauaaaaaucu

SEQ ID NO: 723034 - RNA, 16 nt, Haemophilus influenzae Rd
auuauugugauaauua

SEQ ID NO: 723035 - RNA, 12 nt, Haemophilus influenzae Rd
auuauuuaaaug

SEQ ID NO: 723036 - RNA, 19 nt, Haemophilus influenzae Rd
auuauuucguuguuuuaau

SEQ ID NO: 723037 - RNA, 16 nt, Haemophilus influenzae Rd
auuauuuauuuugaau

SEQ ID NO: 723038 - RNA, 16 nt, Haemophilus influenzae Rd
auuauuuccucuucuu

SEQ ID NO: 723039 - RNA, 14 nt, Haemophilus influenzae Rd
auuauuuuacuuuu

SEQ ID NO: 723040 - RNA, 16 nt, Haemophilus influenzae Rd
auuauuuuuacaaaua

SEQ ID NO: 723041 - RNA, 19 nt, Haemophilus influenzae Rd
auuauuuuuuauccuauua

SEQ ID NO: 723042 - RNA, 13 nt, Haemophilus influenzae Rd
auuauuuuuuaac

SEQ ID NO: 723043 - RNA, 20 nt, Haemophilus influenzae Rd
auucaaaaauaaagcccugu

SEQ ID NO: 723044 - RNA, 16 nt, Haemophilus influenzae Rd
auucaaaauaaaacca

SEQ ID NO: 723045 - RNA, 19 nt, Haemophilus influenzae Rd
auucaaaaaauguauccac

SEQ ID NO: 723046 - RNA, 14 nt, Haemophilus influenzae Rd
auucaaacugaauu

SEQ ID NO: 723047 - RNA, 15 nt, Haemophilus influenzae Rd
auucaaacugaauug

SEQ ID NO: 723048 - RNA, 13 nt, Haemophilus influenzae Rd
auucaaaauuugu

SEQ ID NO: 723049 - RNA, 23 nt, Haemophilus influenzae Rd
auucaagaugauauuuaauaaaa

SEQ ID NO: 723050 - RNA, 13 nt, Haemophilus influenzae Rd
aaaagcuguuguu

SEQ ID NO: 723051 - RNA, 14 nt, Haemophilus influenzae Rd
auucaaagauuauu

SEQ ID NO: 723052 - RNA, 17 nt, Haemophilus influenzae Rd
auucaaagauuuuaaaa

SEQ ID NO: 723053 - RNA, 18 nt, Haemophilus influenzae Rd
auucaaagauuuuaaaau

SEQ ID NO: 723054 - RNA, 19 nt, Haemophilus influenzae Rd
auucaaagauuuuaaaauu

SEQ ID NO: 723055 - RNA, 23 nt, Haemophilus influenzae Rd
auucaaagauuuuaaaauuuauu

SEQ ID NO: 723056 - RNA, 15 nt, Haemophilus influenzae Rd
auuaccgcucuuuuc

SEQ ID NO: 723057 - RNA, 23 nt, Haemophilus influenzae Rd
auuaccuuagccaaaucaucuag

SEQ ID NO: 723058 - RNA, 15 nt, Haemophilus influenzae Rd
auuacgugcaaauaa

SEQ ID NO: 723059 - RNA, 23 nt, Haemophilus influenzae Rd
auuacguguaguuggaucauuau

SEQ ID NO: 723060 - RNA, 21 nt, Haemophilus influenzae Rd
auuacguucauauaaauuuga

SEQ ID NO: 723061 - RNA, 21 nt, Haemophilus influenzae Rd
auuaccuuguuuugcaauaaa

SEQ ID NO: 723062 - RNA, 17 nt, Haemophilus influenzae Rd
auuacucugcuugaguu

SEQ ID NO: 723063 - RNA, 14 nt, Haemophilus influenzae Rd
auuacauccacuuu

SEQ ID NO: 723064 - RNA, 21 nt, Haemophilus influenzae Rd
auuacauagauugaaaaguaa

SEQ ID NO: 723065 - RNA, 17 nt, Haemophilus influenzae Rd
auuacaguacaauuaau

SEQ ID NO: 723066 - RNA, 20 nt, Haemophilus influenzae Rd
auuaauauaaaggauuuuau

SEQ ID NO: 723067 - RNA, 18 nt, Haemophilus influenzae Rd
auuaauaggaauaacaca

SEQ ID NO: 723068 - RNA, 17 nt, Haemophilus influenzae Rd
auuaauacgccaagaua

SEQ ID NO: 723069 - RNA, 16 nt, Haemophilus influenzae Rd
auuaauaccaauaaua

SEQ ID NO: 723070 - RNA, 22 nt, Haemophilus influenzae Rd
auuaauaccaauaauaauaucg

SEQ ID NO: 723071 - RNA, 17 nt, Haemophilus influenzae Rd
auuaauacgucaauugc

SEQ ID NO: 723072 - RNA, 14 nt, Haemophilus influenzae Rd
auuaauacugaaau

SEQ ID NO: 723073 - RNA, 19 nt, Haemophilus influenzae Rd
aaaagcccaaguaauacac

SEQ ID NO: 723074 - RNA, 15 nt, Haemophilus influenzae Rd
auuacuuaacaucau

SEQ ID NO: 723075 - RNA, 14 nt, Haemophilus influenzae Rd
auuacuuagauaua

SEQ ID NO: 723076 - RNA, 21 nt, Haemophilus influenzae Rd
auuacuuggggcuaauuuuua

SEQ ID NO: 723077 - RNA, 18 nt, Haemophilus influenzae Rd
auuagaaguaaauucagu

SEQ ID NO: 723078 - RNA, 23 nt, Haemophilus influenzae Rd
auuagaauuuaguccuuuagaaa

SEQ ID NO: 723079 - RNA, 19 nt, Haemophilus influenzae Rd
auuagaaauauauuuguuu

SEQ ID NO: 723080 - RNA, 15 nt, Haemophilus influenzae Rd
auuagaaaugaucaa

SEQ ID NO: 723081 - RNA, 20 nt, Haemophilus influenzae Rd
auuagaaaugaucaaaucaa

SEQ ID NO: 723082 - RNA, 20 nt, Haemophilus influenzae Rd
auuacuuuuauccacaugau

SEQ ID NO: 723083 - RNA, 21 nt, Haemophilus influenzae Rd
auuacuuuuagauaaauuuca

SEQ ID NO: 723084 - RNA, 23 nt, Haemophilus influenzae Rd
aaaagcggcgcaucaauauguuc

SEQ ID NO: 723085 - RNA, 15 nt, Haemophilus influenzae Rd
auuagaugauuuuaa

SEQ ID NO: 723086 - RNA, 16 nt, Haemophilus influenzae Rd
auuagaugauuuuaaa

SEQ ID NO: 723087 - RNA, 17 nt, Haemophilus influenzae Rd
auuagaugauuuuaaaa

SEQ ID NO: 723088 - RNA, 14 nt, Haemophilus influenzae Rd
auuagagccaucaa

SEQ ID NO: 723089 - RNA, 14 nt, Haemophilus influenzae Rd
auuagagacaaaca

SEQ ID NO: 723090 - RNA, 20 nt, Haemophilus influenzae Rd
auuagauaauacagaaauau

SEQ ID NO: 723091 - RNA, 18 nt, Haemophilus influenzae Rd
auuagaucauaaaaaaau

SEQ ID NO: 723092 - RNA, 13 nt, Haemophilus influenzae Rd
augugauauuaaa

SEQ ID NO: 723093 - RNA, 16 nt, Haemophilus influenzae Rd
augugacauuguaaag

SEQ ID NO: 723094 - RNA, 22 nt, Haemophilus influenzae Rd
augugauguaauauuacgcaua

SEQ ID NO: 723095 - RNA, 23 nt, Haemophilus influenzae Rd
augucuuuaggauuguugauuuu

SEQ ID NO: 723096 - RNA, 19 nt, Haemophilus influenzae Rd
auguaccgauugauggauc

SEQ ID NO: 723097 - RNA, 14 nt, Haemophilus influenzae Rd
augucgaaauuuuu

SEQ ID NO: 723098 - RNA, 18 nt, Haemophilus influenzae Rd
auguggucaaagauguuc

SEQ ID NO: 723099 - RNA, 20 nt, Haemophilus influenzae Rd
auguggcguacaacgugaag

SEQ ID NO: 723100 - RNA, 22 nt, Haemophilus influenzae Rd
auguggcguacaacgugaagua

SEQ ID NO: 723101 - RNA, 13 nt, Haemophilus influenzae Rd
auguguuccugua

SEQ ID NO: 723102 - RNA, 21 nt, Haemophilus influenzae Rd
auguguugauuucuacacuua

SEQ ID NO: 723103 - RNA, 16 nt, Haemophilus influenzae Rd
auguuaccgacaacca

SEQ ID NO: 723104 - RNA, 13 nt, Haemophilus influenzae Rd
auguuaauugugc

SEQ ID NO: 723105 - RNA, 16 nt, Haemophilus influenzae Rd
auguuaauuuuaaauu

SEQ ID NO: 723106 - RNA, 12 nt, Haemophilus influenzae Rd
auguuaauaauu

SEQ ID NO: 723107 - RNA, 13 nt, Haemophilus influenzae Rd
auguucauuuucu

SEQ ID NO: 723108 - RNA, 16 nt, Haemophilus influenzae Rd
auguucauuuuuauga

SEQ ID NO: 723109 - RNA, 15 nt, Haemophilus influenzae Rd
auguuauuaaauaua

SEQ ID NO: 723110 - RNA, 13 nt, Haemophilus influenzae Rd
auguuauuaaaua

SEQ ID NO: 723111 - RNA, 16 nt, Haemophilus influenzae Rd
auguugaauuuucacc

SEQ ID NO: 723112 - RNA, 18 nt, Haemophilus influenzae Rd
auguuugcaucaaucauu

SEQ ID NO: 723113 - RNA, 14 nt, Haemophilus influenzae Rd
auguuuucuugacc

SEQ ID NO: 723114 - RNA, 19 nt, Haemophilus influenzae Rd
auguuuuagagaaaugccu

SEQ ID NO: 723115 - RNA, 17 nt, Haemophilus influenzae Rd
auguucuaagguauaaa

SEQ ID NO: 723116 - RNA, 19 nt, Haemophilus influenzae Rd
auguucuaagguauaaaua

SEQ ID NO: 723117 - RNA, 14 nt, Haemophilus influenzae Rd
auguucgauuuuac

SEQ ID NO: 723118 - RNA, 18 nt, Haemophilus influenzae Rd
auguucuuuguugaugau

SEQ ID NO: 723119 - RNA, 12 nt, Haemophilus influenzae Rd
auguucucucac

SEQ ID NO: 723120 - RNA, 19 nt, Haemophilus influenzae Rd
auuaaagcguuguucaucu

SEQ ID NO: 723121 - RNA, 12 nt, Haemophilus influenzae Rd
auuaaagccaca

SEQ ID NO: 723122 - RNA, 13 nt, Haemophilus influenzae Rd
auuaaaaagacua

SEQ ID NO: 723123 - RNA, 20 nt, Haemophilus influenzae Rd
auuaaaaagacuaaacucaa

SEQ ID NO: 723124 - RNA, 13 nt, Haemophilus influenzae Rd
auuaaaaauuuaa

SEQ ID NO: 723125 - RNA, 14 nt, Haemophilus influenzae Rd
auuaaaaauuuaaa

SEQ ID NO: 723126 - RNA, 17 nt, Haemophilus influenzae Rd
auuaaaagauacacuca

SEQ ID NO: 723127 - RNA, 21 nt, Haemophilus influenzae Rd
auuaaagaguuauaaacccau

SEQ ID NO: 723128 - RNA, 17 nt, Haemophilus influenzae Rd
auuaaagauaguaaugu

SEQ ID NO: 723129 - RNA, 19 nt, Haemophilus influenzae Rd
auuaaaaccaauuuuuuca

SEQ ID NO: 723130 - RNA, 23 nt, Haemophilus influenzae Rd
auuaaaacuugggugauccauua

SEQ ID NO: 723131 - RNA, 23 nt, Haemophilus influenzae Rd
auuaacuugcuauuuucuaauuu

SEQ ID NO: 723132 - RNA, 18 nt, Haemophilus influenzae Rd
auuaacuuaucuaaaaag

SEQ ID NO: 723133 - RNA, 19 nt, Haemophilus influenzae Rd
auuaacuuaucuaaaaaga

SEQ ID NO: 723134 - RNA, 14 nt, Haemophilus influenzae Rd
auuaacguuauaaa

SEQ ID NO: 723135 - RNA, 13 nt, Haemophilus influenzae Rd
auuaacuaaacca

SEQ ID NO: 723136 - RNA, 16 nt, Haemophilus influenzae Rd
auuaacuaaaccauuu

SEQ ID NO: 723137 - RNA, 14 nt, Haemophilus influenzae Rd
auuaacgugcauuu

SEQ ID NO: 723138 - RNA, 13 nt, Haemophilus influenzae Rd
auuaacguaagaa

SEQ ID NO: 723139 - RNA, 17 nt, Haemophilus influenzae Rd
auuaaauguauuuucca

SEQ ID NO: 723140 - RNA, 22 nt, Haemophilus influenzae Rd
auuaaccguuuuuauuuguucu

SEQ ID NO: 723141 - RNA, 18 nt, Haemophilus influenzae Rd
auuaaccgcacuuuaaau

SEQ ID NO: 723142 - RNA, 17 nt, Haemophilus influenzae Rd
auuaaccgcacuuuaga

SEQ ID NO: 723143 - RNA, 18 nt, Haemophilus influenzae Rd
auuaaccgcacuuuagaa

SEQ ID NO: 723144 - RNA, 18 nt, Haemophilus influenzae Rd
auuaaccccagaaaugcu

SEQ ID NO: 723145 - RNA, 22 nt, Haemophilus influenzae Rd
auuaacgcucaaaaauuucaga

SEQ ID NO: 723146 - RNA, 19 nt, Haemophilus influenzae Rd
auuaacggcacgguuucug

SEQ ID NO: 723147 - RNA, 23 nt, Haemophilus influenzae Rd
auuaagauggcuauuuaagccuu

SEQ ID NO: 723148 - RNA, 11 nt, Haemophilus influenzae Rd
auuaagcaaua

SEQ ID NO: 723149 - RNA, 15 nt, Haemophilus influenzae Rd
auuaagcaauagaac

SEQ ID NO: 723150 - RNA, 19 nt, Haemophilus influenzae Rd
auuaagccaaaaccuagaa

SEQ ID NO: 723151 - RNA, 15 nt, Haemophilus influenzae Rd
auuaagccauuggaa

SEQ ID NO: 723152 - RNA, 19 nt, Haemophilus influenzae Rd
auuaagaaagguugguuga

SEQ ID NO: 723153 - RNA, 17 nt, Haemophilus influenzae Rd
auuaagaaauuuucuuu

SEQ ID NO: 723154 - RNA, 14 nt, Haemophilus influenzae Rd
auuaagaaaauaau

SEQ ID NO: 723155 - RNA, 14 nt, Haemophilus influenzae Rd
auuaagccugcaaa

SEQ ID NO: 723156 - RNA, 19 nt, Haemophilus influenzae Rd
auuaauaaaaaaucuguga

SEQ ID NO: 723157 - RNA, 17 nt, Haemophilus influenzae Rd
auuaaggcauuuuccca

SEQ ID NO: 723158 - RNA, 16 nt, Haemophilus influenzae Rd
auuaauaacugaauaa

SEQ ID NO: 723159 - RNA, 18 nt, Haemophilus influenzae Rd
auuaauaagaaaaucaaa

SEQ ID NO: 723160 - RNA, 16 nt, Haemophilus influenzae Rd
auuaauaagaaagaau

SEQ ID NO: 723161 - RNA, 13 nt, Haemophilus influenzae Rd
auuaauaaaccaa

SEQ ID NO: 723162 - RNA, 16 nt, Haemophilus influenzae Rd
auuaauaaauuuuucg

SEQ ID NO: 723163 - RNA, 14 nt, Haemophilus influenzae Rd
auucauuuaaaaua

SEQ ID NO: 723164 - RNA, 15 nt, Haemophilus influenzae Rd
auucauuuaaaauau

SEQ ID NO: 723165 - RNA, 20 nt, Haemophilus influenzae Rd
auucauuguuucucaauaaa

SEQ ID NO: 723166 - RNA, 21 nt, Haemophilus influenzae Rd
auucauuguuucucaauaaau

SEQ ID NO: 723167 - RNA, 22 nt, Haemophilus influenzae Rd
auucauugaugcccacuuuucc

SEQ ID NO: 723168 - RNA, 23 nt, Haemophilus influenzae Rd
auucauugaugcccacuuuuccu

SEQ ID NO: 723169 - RNA, 17 nt, Haemophilus influenzae Rd
auucauugcauuuuuau

SEQ ID NO: 723170 - RNA, 24 nt, Haemophilus influenzae Rd
auucauucuugcuugaucauccau

SEQ ID NO: 723171 - RNA, 12 nt, Haemophilus influenzae Rd
auucauuauuug

SEQ ID NO: 723172 - RNA, 16 nt, Haemophilus influenzae Rd
auucauucauuuuguc

SEQ ID NO: 723173 - RNA, 15 nt, Haemophilus influenzae Rd
auucauuaaguuuuc

SEQ ID NO: 723174 - RNA, 19 nt, Haemophilus influenzae Rd
auucauuaaguuuucuaca

SEQ ID NO: 723175 - RNA, 13 nt, Haemophilus influenzae Rd
auucauguuuuuu

SEQ ID NO: 723176 - RNA, 21 nt, Haemophilus influenzae Rd
auucauguuuuuuagauuuau

SEQ ID NO: 723177 - RNA, 19 nt, Haemophilus influenzae Rd
auucauuaaggcuuuucuu

SEQ ID NO: 723178 - RNA, 15 nt, Haemophilus influenzae Rd
auucaugaaucguuu

SEQ ID NO: 723179 - RNA, 16 nt, Haemophilus influenzae Rd
auucauauaauucauu

SEQ ID NO: 723180 - RNA, 19 nt, Haemophilus influenzae Rd
aaaagcuuccauaauacuc

SEQ ID NO: 723181 - RNA, 22 nt, Haemophilus influenzae Rd
auucaucuuagcuuuuuucuua

SEQ ID NO: 723182 - RNA, 20 nt, Haemophilus influenzae Rd
auucaugagcugggcaaaca

SEQ ID NO: 723183 - RNA, 22 nt, Haemophilus influenzae Rd
auucaugagcugggcaaacaau

SEQ ID NO: 723184 - RNA, 18 nt, Haemophilus influenzae Rd
auucaucacuucuugugg

SEQ ID NO: 723185 - RNA, 19 nt, Haemophilus influenzae Rd
auucaucacuucuugugga

SEQ ID NO: 723186 - RNA, 20 nt, Haemophilus influenzae Rd
auucaucaagcucaaaagua

SEQ ID NO: 723187 - RNA, 22 nt, Haemophilus influenzae Rd
auuccuccgccaucaauuuuua

SEQ ID NO: 723188 - RNA, 12 nt, Haemophilus influenzae Rd
auuccuacacca

SEQ ID NO: 723189 - RNA, 14 nt, Haemophilus influenzae Rd
auuccuauucuaaa

SEQ ID NO: 723190 - RNA, 23 nt, Haemophilus influenzae Rd
auuccuucaucgucuucuucgcu

SEQ ID NO: 723191 - RNA, 19 nt, Haemophilus influenzae Rd
auuccuuccaacaauuuca

SEQ ID NO: 723192 - RNA, 23 nt, Haemophilus influenzae Rd
auuccuuccaacaauuucacuga

SEQ ID NO: 723193 - RNA, 14 nt, Haemophilus influenzae Rd
auuccccuucaaau

SEQ ID NO: 723194 - RNA, 16 nt, Haemophilus influenzae Rd
auuccccuucaaauau

SEQ ID NO: 723195 - RNA, 15 nt, Haemophilus influenzae Rd
auucccaaauuuuuu

SEQ ID NO: 723196 - RNA, 23 nt, Haemophilus influenzae Rd
auucauuuugucagauuuauaaa

SEQ ID NO: 723197 - RNA, 14 nt, Haemophilus influenzae Rd
auucauuuuuuauu

SEQ ID NO: 723198 - RNA, 17 nt, Haemophilus influenzae Rd
auucauuuuuuauuuuu

SEQ ID NO: 723199 - RNA, 21 nt, Haemophilus influenzae Rd
auuccaaagcuggcucuucuu

SEQ ID NO: 723200 - RNA, 23 nt, Haemophilus influenzae Rd
auuccaaacuggaauaaagcaac

SEQ ID NO: 723201 - RNA, 16 nt, Haemophilus influenzae Rd
auuccaaaucauacca

SEQ ID NO: 723202 - RNA, 19 nt, Haemophilus influenzae Rd
auuccaacgauuuugcaag

SEQ ID NO: 723203 - RNA, 15 nt, Haemophilus influenzae Rd
auuccaagguuuuuu

SEQ ID NO: 723204 - RNA, 23 nt, Haemophilus influenzae Rd
auuccaccacagcccaaaauuca

SEQ ID NO: 723205 - RNA, 19 nt, Haemophilus influenzae Rd
auuccaccacucgggcaua

SEQ ID NO: 723206 - RNA, 14 nt, Haemophilus influenzae Rd
auuccacccauacc

SEQ ID NO: 723207 - RNA, 12 nt, Haemophilus influenzae Rd
auuccacuucag

SEQ ID NO: 723208 - RNA, 15 nt, Haemophilus influenzae Rd
auuccacuuuuucau

SEQ ID NO: 723209 - RNA, 18 nt, Haemophilus influenzae Rd
auuccacuuuuucaugua

SEQ ID NO: 723210 - RNA, 15 nt, Haemophilus influenzae Rd
auuccauauuggaag

SEQ ID NO: 723211 - RNA, 16 nt, Haemophilus influenzae Rd
auuccauauuguuuca

SEQ ID NO: 723212 - RNA, 22 nt, Haemophilus influenzae Rd
auuccauugcauccacuucauc

SEQ ID NO: 723213 - RNA, 14 nt, Haemophilus influenzae Rd
auuccauuuugcau

SEQ ID NO: 723214 - RNA, 17 nt, Haemophilus influenzae Rd
auuccauuuugcauauu

SEQ ID NO: 723215 - RNA, 21 nt, Haemophilus influenzae Rd
auucuaauccugcgugaauga

SEQ ID NO: 723216 - RNA, 17 nt, Haemophilus influenzae Rd
auucuaauuccccuuca

SEQ ID NO: 723217 - RNA, 21 nt, Haemophilus influenzae Rd
auucuacaccauuauuuuucu

SEQ ID NO: 723218 - RNA, 19 nt, Haemophilus influenzae Rd
auucuauuuauaauccauu

SEQ ID NO: 723219 - RNA, 14 nt, Haemophilus influenzae Rd
auucuauuuuaaaa

SEQ ID NO: 723220 - RNA, 15 nt, Haemophilus influenzae Rd
auucuauuuuaaaaa

SEQ ID NO: 723221 - RNA, 22 nt, Haemophilus influenzae Rd
auucuccgccugauucgccaaa

SEQ ID NO: 723222 - RNA, 19 nt, Haemophilus influenzae Rd
auucucaauugcaaaauca

SEQ ID NO: 723223 - RNA, 18 nt, Haemophilus influenzae Rd
auucucggcaaugguuca

SEQ ID NO: 723224 - RNA, 14 nt, Haemophilus influenzae Rd
auucgcugcaaaau

SEQ ID NO: 723225 - RNA, 16 nt, Haemophilus influenzae Rd
auucgcugcaaaauca

SEQ ID NO: 723226 - RNA, 16 nt, Haemophilus influenzae Rd
auucgcuuucauaaau

SEQ ID NO: 723227 - RNA, 23 nt, Haemophilus influenzae Rd
auucgcuuucauaaauucaucuu

SEQ ID NO: 723228 - RNA, 16 nt, Haemophilus influenzae Rd
auucgguguauuuuug

SEQ ID NO: 723229 - RNA, 19 nt, Haemophilus influenzae Rd
auucguacuuuugauuuau

SEQ ID NO: 723230 - RNA, 20 nt, Haemophilus influenzae Rd
auucguacuuuugauuuauu

SEQ ID NO: 723231 - RNA, 23 nt, Haemophilus influenzae Rd
auucguaaugccucgauauuuau

SEQ ID NO: 723232 - RNA, 14 nt, Haemophilus influenzae Rd
auuccuuuuucuac

SEQ ID NO: 723233 - RNA, 12 nt, Haemophilus influenzae Rd
auucgccuucac

SEQ ID NO: 723234 - RNA, 14 nt, Haemophilus influenzae Rd
auucgccuugcuuu

SEQ ID NO: 723235 - RNA, 17 nt, Haemophilus influenzae Rd
auuccuuauucaaauaa

SEQ ID NO: 723236 - RNA, 16 nt, Haemophilus influenzae Rd
auuccuuuguuagauu

SEQ ID NO: 723237 - RNA, 19 nt, Haemophilus influenzae Rd
auuccuuuugaacuuuuaa

SEQ ID NO: 723238 - RNA, 17 nt, Haemophilus influenzae Rd
auuccuucaaauucuac

SEQ ID NO: 723239 - RNA, 15 nt, Haemophilus influenzae Rd
auucugcaguuuuuu

SEQ ID NO: 723240 - RNA, 20 nt, Haemophilus influenzae Rd
auucugcaguuuuuuguuuu

SEQ ID NO: 723241 - RNA, 15 nt, Haemophilus influenzae Rd
auucugcaccuuaau

SEQ ID NO: 723242 - RNA, 19 nt, Haemophilus influenzae Rd
auucugcacgacgugcuuc

SEQ ID NO: 723243 - RNA, 16 nt, Haemophilus influenzae Rd
auucugaggauuuuau

SEQ ID NO: 723244 - RNA, 22 nt, Haemophilus influenzae Rd
auucugaggauuuuauggcugc

SEQ ID NO: 723245 - RNA, 14 nt, Haemophilus influenzae Rd
auucugaaaccacu

SEQ ID NO: 723246 - RNA, 13 nt, Haemophilus influenzae Rd
auucucuguuucu

SEQ ID NO: 723247 - RNA, 14 nt, Haemophilus influenzae Rd
auucucuguuucuu

SEQ ID NO: 723248 - RNA, 19 nt, Haemophilus influenzae Rd
auucucuguuucuuuaaau

SEQ ID NO: 723249 - RNA, 17 nt, Haemophilus influenzae Rd
auucucgccauaauaaa

SEQ ID NO: 723250 - RNA, 15 nt, Haemophilus influenzae Rd
auucucuaacgcauu

SEQ ID NO: 723251 - RNA, 21 nt, Haemophilus influenzae Rd
auucucuaacgcauucaaauc

SEQ ID NO: 723252 - RNA, 22 nt, Haemophilus influenzae Rd
auucuucccaaucuuguuuuaa

SEQ ID NO: 723253 - RNA, 24 nt, Haemophilus influenzae Rd
auucuucccagcguaaaaaugcug

SEQ ID NO: 723254 - RNA, 20 nt, Haemophilus influenzae Rd
auucuuccgcaauuucugcc

SEQ ID NO: 723255 - RNA, 18 nt, Haemophilus influenzae Rd
auucuggugcauuuaugc

SEQ ID NO: 723256 - RNA, 16 nt, Haemophilus influenzae Rd
auucugcuuuuuuacu

SEQ ID NO: 723257 - RNA, 15 nt, Haemophilus influenzae Rd
auucugcuuguucgc

SEQ ID NO: 723258 - RNA, 21 nt, Haemophilus influenzae Rd
auucugcuaaaucuguuucau

SEQ ID NO: 723259 - RNA, 17 nt, Haemophilus influenzae Rd
auucuugccagauuuuu

SEQ ID NO: 723260 - RNA, 18 nt, Haemophilus influenzae Rd
auucuugacguaauucuc

SEQ ID NO: 723261 - RNA, 16 nt, Haemophilus influenzae Rd
auucuugcguaaccaa

SEQ ID NO: 723262 - RNA, 18 nt, Haemophilus influenzae Rd
auucuugcguuucaaaug

SEQ ID NO: 723263 - RNA, 15 nt, Haemophilus influenzae Rd
auucuugaaugucuu

SEQ ID NO: 723264 - RNA, 17 nt, Haemophilus influenzae Rd
auucuucuauuuuauca

SEQ ID NO: 723265 - RNA, 15 nt, Haemophilus influenzae Rd
auucuucgccauuuu

SEQ ID NO: 723266 - RNA, 22 nt, Haemophilus influenzae Rd
auucuucgaaaauaacuucauc

SEQ ID NO: 723267 - RNA, 15 nt, Haemophilus influenzae Rd
auucuucuaaaagau

SEQ ID NO: 723268 - RNA, 22 nt, Haemophilus influenzae Rd
auugaaacuaaagaaucaaauu

SEQ ID NO: 723269 - RNA, 13 nt, Haemophilus influenzae Rd
auugaugaagaug

SEQ ID NO: 723270 - RNA, 23 nt, Haemophilus influenzae Rd
auugauuaaaaaagcaagauacu

SEQ ID NO: 723271 - RNA, 15 nt, Haemophilus influenzae Rd
auugaugcccacuuu

SEQ ID NO: 723272 - RNA, 20 nt, Haemophilus influenzae Rd
auugaugcccacuuuuccua

SEQ ID NO: 723273 - RNA, 18 nt, Haemophilus influenzae Rd
auucuuuagauugcucaa

SEQ ID NO: 723274 - RNA, 16 nt, Haemophilus influenzae Rd
auucuuuuuucuuccu

SEQ ID NO: 723275 - RNA, 22 nt, Haemophilus influenzae Rd
auucuuuuuucuuccuaugaau

SEQ ID NO: 723276 - RNA, 23 nt, Haemophilus influenzae Rd
auugaaaagaaaguauuaaauau

SEQ ID NO: 723277 - RNA, 14 nt, Haemophilus influenzae Rd
auugaaaauacagu

SEQ ID NO: 723278 - RNA, 16 nt, Haemophilus influenzae Rd
auucuuuaaauauuca

SEQ ID NO: 723279 - RNA, 14 nt, Haemophilus influenzae Rd
auucuuuuuguaau

SEQ ID NO: 723280 - RNA, 23 nt, Haemophilus influenzae Rd
auucuuuaguguauaacaaauag

SEQ ID NO: 723281 - RNA, 17 nt, Haemophilus influenzae Rd
auucuuuaucgaucacu

SEQ ID NO: 723282 - RNA, 21 nt, Haemophilus influenzae Rd
auugcacccgcagugcccaaa

SEQ ID NO: 723283 - RNA, 18 nt, Haemophilus influenzae Rd
auugcacuaauaaauaga

SEQ ID NO: 723284 - RNA, 22 nt, Haemophilus influenzae Rd
auugcacuaauaaauagaaauu

SEQ ID NO: 723285 - RNA, 23 nt, Haemophilus influenzae Rd
auugcacgagcaauaauaucaau

SEQ ID NO: 723286 - RNA, 21 nt, Haemophilus influenzae Rd
auugcaauuucagcugcgaug

SEQ ID NO: 723287 - RNA, 16 nt, Haemophilus influenzae Rd
auugcaccaaauuucg

SEQ ID NO: 723288 - RNA, 15 nt, Haemophilus influenzae Rd
auugcacaauagcuu

SEQ ID NO: 723289 - RNA, 23 nt, Haemophilus influenzae Rd
auugcaacacuugcugccacaag

SEQ ID NO: 723290 - RNA, 23 nt, Haemophilus influenzae Rd
auugcaaaggcagccauaaaugc

SEQ ID NO: 723291 - RNA, 18 nt, Haemophilus influenzae Rd
auugcaauaaccacgccu

SEQ ID NO: 723292 - RNA, 19 nt, Haemophilus influenzae Rd
auugcaggcuuagcaauaa

SEQ ID NO: 723293 - RNA, 21 nt, Haemophilus influenzae Rd
auugcauauagagucaaucca

SEQ ID NO: 723294 - RNA, 16 nt, Haemophilus influenzae Rd
auugcauuaagaaguu

SEQ ID NO: 723295 - RNA, 12 nt, Haemophilus influenzae Rd
auugcauuuucu

SEQ ID NO: 723296 - RNA, 16 nt, Haemophilus influenzae Rd
auugcauuuucuucca

SEQ ID NO: 723297 - RNA, 18 nt, Haemophilus influenzae Rd
auugcauuuucuuccaau

SEQ ID NO: 723298 - RNA, 16 nt, Haemophilus influenzae Rd
auugcauuuuuuauaa

SEQ ID NO: 723299 - RNA, 16 nt, Haemophilus influenzae Rd
auugccaaaaaagccc

SEQ ID NO: 723300 - RNA, 17 nt, Haemophilus influenzae Rd
auugcaucauaguccac

SEQ ID NO: 723301 - RNA, 20 nt, Haemophilus influenzae Rd
auugcauccacuucauccau

SEQ ID NO: 723302 - RNA, 17 nt, Haemophilus influenzae Rd
auugcauaguuuuaugc

SEQ ID NO: 723303 - RNA, 14 nt, Haemophilus influenzae Rd
auugcauaaucaua

SEQ ID NO: 723304 - RNA, 20 nt, Haemophilus influenzae Rd
auugccuaauaaaaaauaaa

SEQ ID NO: 723305 - RNA, 15 nt, Haemophilus influenzae Rd
auugccuaaauacau

SEQ ID NO: 723306 - RNA, 15 nt, Haemophilus influenzae Rd
auugccuucauauaa

SEQ ID NO: 723307 - RNA, 15 nt, Haemophilus influenzae Rd
auugcuaaauaaauu

SEQ ID NO: 723308 - RNA, 20 nt, Haemophilus influenzae Rd
auugccauauaccaauaauu

SEQ ID NO: 723309 - RNA, 14 nt, Haemophilus influenzae Rd
auugccauuuuuca

SEQ ID NO: 723310 - RNA, 21 nt, Haemophilus influenzae Rd
auugcccaauaaaaguaauuu

SEQ ID NO: 723311 - RNA, 21 nt, Haemophilus influenzae Rd
auugccgccaguaagaucuuc

SEQ ID NO: 723312 - RNA, 18 nt, Haemophilus influenzae Rd
auugccgaccguguuuuu

SEQ ID NO: 723313 - RNA, 13 nt, Haemophilus influenzae Rd
auugcccucugca

SEQ ID NO: 723314 - RNA, 18 nt, Haemophilus influenzae Rd
auugccgacacuaaaaag

SEQ ID NO: 723315 - RNA, 17 nt, Haemophilus influenzae Rd
auuggcugaauuuaauu

SEQ ID NO: 723316 - RNA, 17 nt, Haemophilus influenzae Rd
auuggcgguuuugccaa

SEQ ID NO: 723317 - RNA, 22 nt, Haemophilus influenzae Rd
auuggcuagagcuaauucugua

SEQ ID NO: 723318 - RNA, 21 nt, Haemophilus influenzae Rd
auuggcuauugaaaauuauug

SEQ ID NO: 723319 - RNA, 19 nt, Haemophilus influenzae Rd
auugcugggcaauauaaac

SEQ ID NO: 723320 - RNA, 17 nt, Haemophilus influenzae Rd
auugcugcuuuaauuuc

SEQ ID NO: 723321 - RNA, 18 nt, Haemophilus influenzae Rd
auugcugcuuuaauuuca

SEQ ID NO: 723322 - RNA, 17 nt, Haemophilus influenzae Rd
auugguggguucaucua

SEQ ID NO: 723323 - RNA, 18 nt, Haemophilus influenzae Rd
auugguuaauguaaacaa

SEQ ID NO: 723324 - RNA, 22 nt, Haemophilus influenzae Rd
auugguuaauguaaacaaaaau

SEQ ID NO: 723325 - RNA, 15 nt, Haemophilus influenzae Rd
auugguguuuaaaug

SEQ ID NO: 723326 - RNA, 20 nt, Haemophilus influenzae Rd
aaaaggcuuuuuacguucau

SEQ ID NO: 723327 - RNA, 14 nt, Haemophilus influenzae Rd
auuggugaaaggaa

SEQ ID NO: 723328 - RNA, 15 nt, Haemophilus influenzae Rd
auuggugaaaucaac

SEQ ID NO: 723329 - RNA, 17 nt, Haemophilus influenzae Rd
auuggugaaaucaacaa

SEQ ID NO: 723330 - RNA, 19 nt, Haemophilus influenzae Rd
auugggccacgagcgugaa

SEQ ID NO: 723331 - RNA, 23 nt, Haemophilus influenzae Rd
auuguagccuaguauuuuuguga

SEQ ID NO: 723332 - RNA, 15 nt, Haemophilus influenzae Rd
auuguaccuucugcu

SEQ ID NO: 723333 - RNA, 20 nt, Haemophilus influenzae Rd
auuguaaugucgugaaagaa

SEQ ID NO: 723334 - RNA, 23 nt, Haemophilus influenzae Rd
auuguccuuuugccauuuugcua

SEQ ID NO: 723335 - RNA, 22 nt, Haemophilus influenzae Rd
auuguccacagcaaaagaaaua

SEQ ID NO: 723336 - RNA, 13 nt, Haemophilus influenzae Rd
auugucauggcau

SEQ ID NO: 723337 - RNA, 23 nt, Haemophilus influenzae Rd
aaaaggguuauauucagcaaaau

SEQ ID NO: 723338 - RNA, 19 nt, Haemophilus influenzae Rd
auugguuugcuuaaaagcu

SEQ ID NO: 723339 - RNA, 12 nt, Haemophilus influenzae Rd
auugguuuugug

SEQ ID NO: 723340 - RNA, 23 nt, Haemophilus influenzae Rd
auuguaacuauaugauauauaaa

SEQ ID NO: 723341 - RNA, 21 nt, Haemophilus influenzae Rd
auuguaaaaccgcauccauuc

SEQ ID NO: 723342 - RNA, 13 nt, Haemophilus influenzae Rd
auuguaaaagucc

SEQ ID NO: 723343 - RNA, 17 nt, Haemophilus influenzae Rd
auuguuaucuaaauaau

SEQ ID NO: 723344 - RNA, 13 nt, Haemophilus influenzae Rd
auuguucuuguuc

SEQ ID NO: 723345 - RNA, 19 nt, Haemophilus influenzae Rd
auuguucuaggcuuucacc

SEQ ID NO: 723346 - RNA, 14 nt, Haemophilus influenzae Rd
auugugucacauaa

SEQ ID NO: 723347 - RNA, 17 nt, Haemophilus influenzae Rd
auugugucacauaauca

SEQ ID NO: 723348 - RNA, 20 nt, Haemophilus influenzae Rd
auugugucacuagauuuucu

SEQ ID NO: 723349 - RNA, 20 nt, Haemophilus influenzae Rd
auuguguuggaacguuuaaa

SEQ ID NO: 723350 - RNA, 14 nt, Haemophilus influenzae Rd
auugucuauuuuau

SEQ ID NO: 723351 - RNA, 14 nt, Haemophilus influenzae Rd
auugucgcuaacau

SEQ ID NO: 723352 - RNA, 20 nt, Haemophilus influenzae Rd
auuuaaacggauuaacacau

SEQ ID NO: 723353 - RNA, 22 nt, Haemophilus influenzae Rd
auuuaaacggauuaacacaucc

SEQ ID NO: 723354 - RNA, 13 nt, Haemophilus influenzae Rd
auuguuugaaauc

SEQ ID NO: 723355 - RNA, 12 nt, Haemophilus influenzae Rd
auuguuugcuuu

SEQ ID NO: 723356 - RNA, 17 nt, Haemophilus influenzae Rd
auuguuucucaauaaau

SEQ ID NO: 723357 - RNA, 18 nt, Haemophilus influenzae Rd
auuguuucucaauaaaua

SEQ ID NO: 723358 - RNA, 23 nt, Haemophilus influenzae Rd
auuguuucucaauaaauaucuaa

SEQ ID NO: 723359 - RNA, 19 nt, Haemophilus influenzae Rd
auuguuggcccaacagaaa

SEQ ID NO: 723360 - RNA, 12 nt, Haemophilus influenzae Rd
auuuaaauuagc

SEQ ID NO: 723361 - RNA, 21 nt, Haemophilus influenzae Rd
auuuaaauuuauuuuuuaaaa

SEQ ID NO: 723362 - RNA, 15 nt, Haemophilus influenzae Rd
auuuaacaauaacuu

SEQ ID NO: 723363 - RNA, 18 nt, Haemophilus influenzae Rd
auuuaacauaacuuucca

SEQ ID NO: 723364 - RNA, 13 nt, Haemophilus influenzae Rd
auuuaacauaauu

SEQ ID NO: 723365 - RNA, 19 nt, Haemophilus influenzae Rd
auuuaacauaauuuauauu

SEQ ID NO: 723366 - RNA, 21 nt, Haemophilus influenzae Rd
auuuaaauaaaacacaguuau

SEQ ID NO: 723367 - RNA, 19 nt, Haemophilus influenzae Rd
auuuaaauaaaauaacaaa

SEQ ID NO: 723368 - RNA, 21 nt, Haemophilus influenzae Rd
auuuaaagugguuuuagccau

SEQ ID NO: 723369 - RNA, 16 nt, Haemophilus influenzae Rd
auuuaaauaauaaauc

SEQ ID NO: 723370 - RNA, 21 nt, Haemophilus influenzae Rd
auuuaaauauaauuuagcauc

SEQ ID NO: 723371 - RNA, 19 nt, Haemophilus influenzae Rd
auuuaaaucuauagauaac

SEQ ID NO: 723372 - RNA, 19 nt, Haemophilus influenzae Rd
aaaaguauugagcgauaaa

SEQ ID NO: 723373 - RNA, 22 nt, Haemophilus influenzae Rd
aaaagucaguaaaccaagugaa

SEQ ID NO: 723374 - RNA, 16 nt, Haemophilus influenzae Rd
auuuaucgcacuguuu

SEQ ID NO: 723375 - RNA, 21 nt, Haemophilus influenzae Rd
auuuaucugcuuuaauucgug

SEQ ID NO: 723376 - RNA, 15 nt, Haemophilus influenzae Rd
aaaaguagaagguuu

SEQ ID NO: 723377 - RNA, 20 nt, Haemophilus influenzae Rd
aaaaguaggcauaaugccua

SEQ ID NO: 723378 - RNA, 22 nt, Haemophilus influenzae Rd
auuuaucgccauagaaaauaga

SEQ ID NO: 723379 - RNA, 23 nt, Haemophilus influenzae Rd
auuuaucgccauagaaaauagaa

SEQ ID NO: 723380 - RNA, 17 nt, Haemophilus influenzae Rd
auuuaucgggaauaaua

SEQ ID NO: 723381 - RNA, 14 nt, Haemophilus influenzae Rd
auuuaucuaaaagu

SEQ ID NO: 723382 - RNA, 11 nt, Haemophilus influenzae Rd
auuuaucauca

SEQ ID NO: 723383 - RNA, 16 nt, Haemophilus influenzae Rd
auuuauccaugacuaa

SEQ ID NO: 723384 - RNA, 17 nt, Haemophilus influenzae Rd
auuuaucauuccccagc

SEQ ID NO: 723385 - RNA, 16 nt, Haemophilus influenzae Rd
auuuaucauaaugaua

SEQ ID NO: 723386 - RNA, 16 nt, Haemophilus influenzae Rd
auuuauauaugauaaa

SEQ ID NO: 723387 - RNA, 22 nt, Haemophilus influenzae Rd
auuuaucaaacaagcccacauu

SEQ ID NO: 723388 - RNA, 21 nt, Haemophilus influenzae Rd
auuuaaccacuugucauuaaa

SEQ ID NO: 723389 - RNA, 17 nt, Haemophilus influenzae Rd
auuuaaccccugaauuu

SEQ ID NO: 723390 - RNA, 22 nt, Haemophilus influenzae Rd
auuuaaccccugaauuuuguac

SEQ ID NO: 723391 - RNA, 19 nt, Haemophilus influenzae Rd
auuuaaccguaauuucaaa

SEQ ID NO: 723392 - RNA, 16 nt, Haemophilus influenzae Rd
auuuaauaagaauuuu

SEQ ID NO: 723393 - RNA, 18 nt, Haemophilus influenzae Rd
auuuaauaagaauuuuaa

SEQ ID NO: 723394 - RNA, 19 nt, Haemophilus influenzae Rd
auuuaauaagaauuuuaau

SEQ ID NO: 723395 - RNA, 19 nt, Haemophilus influenzae Rd
auuuaauaagauuuuuaac

SEQ ID NO: 723396 - RNA, 14 nt, Haemophilus influenzae Rd
auuuaauaauuuaa

SEQ ID NO: 723397 - RNA, 14 nt, Haemophilus influenzae Rd
auuuaauaauuuag

SEQ ID NO: 723398 - RNA, 14 nt, Haemophilus influenzae Rd
auuuaauaaaacaa

SEQ ID NO: 723399 - RNA, 18 nt, Haemophilus influenzae Rd
auuuaauaccauacauaa

SEQ ID NO: 723400 - RNA, 15 nt, Haemophilus influenzae Rd
auuuaauaauaucaa

SEQ ID NO: 723401 - RNA, 14 nt, Haemophilus influenzae Rd
auuuaauagcacag

SEQ ID NO: 723402 - RNA, 14 nt, Haemophilus influenzae Rd
auuuauaaguaauc

SEQ ID NO: 723403 - RNA, 13 nt, Haemophilus influenzae Rd
auuuaauaucuuc

SEQ ID NO: 723404 - RNA, 18 nt, Haemophilus influenzae Rd
auuuauaccguuuuuuca

SEQ ID NO: 723405 - RNA, 19 nt, Haemophilus influenzae Rd
auuuauaccguuuuuucac

SEQ ID NO: 723406 - RNA, 16 nt, Haemophilus influenzae Rd
auuuauacuaaauuag

SEQ ID NO: 723407 - RNA, 19 nt, Haemophilus influenzae Rd
auuuauacaaaaaagccac

SEQ ID NO: 723408 - RNA, 18 nt, Haemophilus influenzae Rd
auuuauagcauuuaaaua

SEQ ID NO: 723409 - RNA, 21 nt, Haemophilus influenzae Rd
auuuauagcuaagcaguuuau

SEQ ID NO: 723410 - RNA, 14 nt, Haemophilus influenzae Rd
auuuauauaaagcu

SEQ ID NO: 723411 - RNA, 24 nt, Haemophilus influenzae Rd
auuuauauaaagcucuaauugaaa

SEQ ID NO: 723412 - RNA, 16 nt, Haemophilus influenzae Rd
auuuaugaauguuuca

SEQ ID NO: 723413 - RNA, 14 nt, Haemophilus influenzae Rd
auuuauuaaaaaua

SEQ ID NO: 723414 - RNA, 16 nt, Haemophilus influenzae Rd
aaaagucuguuuaaaa

SEQ ID NO: 723415 - RNA, 19 nt, Haemophilus influenzae Rd
aaaagucuguuuaaaaacg

SEQ ID NO: 723416 - RNA, 14 nt, Haemophilus influenzae Rd
auuuauuccaucaa

SEQ ID NO: 723417 - RNA, 18 nt, Haemophilus influenzae Rd
auuuauuccugcuuuuuu

SEQ ID NO: 723418 - RNA, 16 nt, Haemophilus influenzae Rd
auuuauuccuucaauc

SEQ ID NO: 723419 - RNA, 21 nt, Haemophilus influenzae Rd
auuuauuccuuuauuuugcaa

SEQ ID NO: 723420 - RNA, 21 nt, Haemophilus influenzae Rd
auuuauuguagccuaguauuu

SEQ ID NO: 723421 - RNA, 13 nt, Haemophilus influenzae Rd
auuuauuuaacaa

SEQ ID NO: 723422 - RNA, 14 nt, Haemophilus influenzae Rd
auuuauuuaacaau

SEQ ID NO: 723423 - RNA, 18 nt, Haemophilus influenzae Rd
auuuauuuaacaaugaaa

SEQ ID NO: 723424 - RNA, 19 nt, Haemophilus influenzae Rd
auuuauuuaacaaugaaau

SEQ ID NO: 723425 - RNA, 21 nt, Haemophilus influenzae Rd
auuuauuuaacaaugaaauua

SEQ ID NO: 723426 - RNA, 22 nt, Haemophilus influenzae Rd
auuuauuuacugauuuaaaaaa

SEQ ID NO: 723427 - RNA, 14 nt, Haemophilus influenzae Rd
auuuauuauucuug

SEQ ID NO: 723428 - RNA, 14 nt, Haemophilus influenzae Rd
auuuauuauauaaa

SEQ ID NO: 723429 - RNA, 16 nt, Haemophilus influenzae Rd
auuuauuauauaaaaa

SEQ ID NO: 723430 - RNA, 17 nt, Haemophilus influenzae Rd
auuuauuauauaaaaaa

SEQ ID NO: 723431 - RNA, 16 nt, Haemophilus influenzae Rd
auuuauuaaaaguaaa

SEQ ID NO: 723432 - RNA, 19 nt, Haemophilus influenzae Rd
auuuauuaagauauaaaag

SEQ ID NO: 723433 - RNA, 14 nt, Haemophilus influenzae Rd
auuuauuauaaaaa

SEQ ID NO: 723434 - RNA, 20 nt, Haemophilus influenzae Rd
auuuauuauaaaaauauuuu

SEQ ID NO: 723435 - RNA, 23 nt, Haemophilus influenzae Rd
auuuauuauaaaaauauuuuaau

SEQ ID NO: 723436 - RNA, 19 nt, Haemophilus influenzae Rd
auuucaauauaaucaauua

SEQ ID NO: 723437 - RNA, 23 nt, Haemophilus influenzae Rd
auuucaauaucuaagaaaauaga

SEQ ID NO: 723438 - RNA, 15 nt, Haemophilus influenzae Rd
auuucaaucacugaa

SEQ ID NO: 723439 - RNA, 20 nt, Haemophilus influenzae Rd
auuucaaucacugaauaaug

SEQ ID NO: 723440 - RNA, 17 nt, Haemophilus influenzae Rd
auuucaaaacaguuuuc

SEQ ID NO: 723441 - RNA, 18 nt, Haemophilus influenzae Rd
auuucaaaacaguuuuca

SEQ ID NO: 723442 - RNA, 12 nt, Haemophilus influenzae Rd
auuucaaucacu

SEQ ID NO: 723443 - RNA, 16 nt, Haemophilus influenzae Rd
auuuauuucaucaauc

SEQ ID NO: 723444 - RNA, 17 nt, Haemophilus influenzae Rd
auuuauuuuaaaaucau

SEQ ID NO: 723445 - RNA, 15 nt, Haemophilus influenzae Rd
auuuauuugcuaaaa

SEQ ID NO: 723446 - RNA, 22 nt, Haemophilus influenzae Rd
auuuauuuucaccugaagaaua

SEQ ID NO: 723447 - RNA, 12 nt, Haemophilus influenzae Rd
auuuauuuugaa

SEQ ID NO: 723448 - RNA, 15 nt, Haemophilus influenzae Rd
auuucuguugaaauc

SEQ ID NO: 723449 - RNA, 13 nt, Haemophilus influenzae Rd
auuucuguuugau

SEQ ID NO: 723450 - RNA, 17 nt, Haemophilus influenzae Rd
auuucuguauuaucuaa

SEQ ID NO: 723451 - RNA, 16 nt, Haemophilus influenzae Rd
auuucuguauuuuuua

SEQ ID NO: 723452 - RNA, 22 nt, Haemophilus influenzae Rd
auuucuguauuuuuuauuuaau

SEQ ID NO: 723453 - RNA, 22 nt, Haemophilus influenzae Rd
auuucuucgauuuuucuaaaau

SEQ ID NO: 723454 - RNA, 13 nt, Haemophilus influenzae Rd
auuucuucugaua

SEQ ID NO: 723455 - RNA, 16 nt, Haemophilus influenzae Rd
auuugaaaaucucuau

SEQ ID NO: 723456 - RNA, 14 nt, Haemophilus influenzae Rd
auuugaacaaacgc

SEQ ID NO: 723457 - RNA, 20 nt, Haemophilus influenzae Rd
auuugaacaaacgccauucu

SEQ ID NO: 723458 - RNA, 22 nt, Haemophilus influenzae Rd
auuugaacaauuaacgcauugu

SEQ ID NO: 723459 - RNA, 17 nt, Haemophilus influenzae Rd
auuugaaccuucacaga

SEQ ID NO: 723460 - RNA, 13 nt, Haemophilus influenzae Rd
auuucuuuuuuau

SEQ ID NO: 723461 - RNA, 22 nt, Haemophilus influenzae Rd
auuucuugaccuuucaauaauu

SEQ ID NO: 723462 - RNA, 23 nt, Haemophilus influenzae Rd
auuucuugaccuuucaauaauuu

SEQ ID NO: 723463 - RNA, 21 nt, Haemophilus influenzae Rd
auuucugcagcaaacgaacca

SEQ ID NO: 723464 - RNA, 15 nt, Haemophilus influenzae Rd
auuucugcauuuaau

SEQ ID NO: 723465 - RNA, 10 nt, Haemophilus influenzae Rd
auuucugcaa

SEQ ID NO: 723466 - RNA, 16 nt, Haemophilus influenzae Rd
auuucugcaaauaaag

SEQ ID NO: 723467 - RNA, 18 nt, Haemophilus influenzae Rd
auuucucgggcugaaaua

SEQ ID NO: 723468 - RNA, 18 nt, Haemophilus influenzae Rd
auuucucuggcucgcucu

SEQ ID NO: 723469 - RNA, 22 nt, Haemophilus influenzae Rd
auuucucugacguaauuguucc

SEQ ID NO: 723470 - RNA, 17 nt, Haemophilus influenzae Rd
auuucucucauuuuuua

SEQ ID NO: 723471 - RNA, 20 nt, Haemophilus influenzae Rd
auuucugcugccauaaugga

SEQ ID NO: 723472 - RNA, 21 nt, Haemophilus influenzae Rd
auuucggaugacggaauacau

SEQ ID NO: 723473 - RNA, 12 nt, Haemophilus influenzae Rd
auuucuaaaaua

SEQ ID NO: 723474 - RNA, 17 nt, Haemophilus influenzae Rd
auuucccuaaaaucuuc

SEQ ID NO: 723475 - RNA, 19 nt, Haemophilus influenzae Rd
auuucgccgccuuugauuu

SEQ ID NO: 723476 - RNA, 19 nt, Haemophilus influenzae Rd
auuucgcucaauaauuuuc

SEQ ID NO: 723477 - RNA, 20 nt, Haemophilus influenzae Rd
auuucgcucaauaauuuuca

SEQ ID NO: 723478 - RNA, 15 nt, Haemophilus influenzae Rd
auuucgcugcgaugu

SEQ ID NO: 723479 - RNA, 13 nt, Haemophilus influenzae Rd
auuucaguaucaa

SEQ ID NO: 723480 - RNA, 16 nt, Haemophilus influenzae Rd
auuucaguaucaauac

SEQ ID NO: 723481 - RNA, 13 nt, Haemophilus influenzae Rd
auuucaguauuuu

SEQ ID NO: 723482 - RNA, 21 nt, Haemophilus influenzae Rd
auuucaguuacguaauauuua

SEQ ID NO: 723483 - RNA, 21 nt, Haemophilus influenzae Rd
auuuccauaugaccauuaauc

SEQ ID NO: 723484 - RNA, 17 nt, Haemophilus influenzae Rd
auuucagcugcaauauc

SEQ ID NO: 723485 - RNA, 23 nt, Haemophilus influenzae Rd
auuucaggaucgucuugaccugc

SEQ ID NO: 723486 - RNA, 14 nt, Haemophilus influenzae Rd
auuucacaccauuu

SEQ ID NO: 723487 - RNA, 20 nt, Haemophilus influenzae Rd
auuucacaccauuuuuaauu

SEQ ID NO: 723488 - RNA, 18 nt, Haemophilus influenzae Rd
auuucaccgcagaaguaa

SEQ ID NO: 723489 - RNA, 22 nt, Haemophilus influenzae Rd
auuucaccguauuuuuuauuac

SEQ ID NO: 723490 - RNA, 19 nt, Haemophilus influenzae Rd
auuucacgcccaaauacuu

SEQ ID NO: 723491 - RNA, 15 nt, Haemophilus influenzae Rd
auuucacuaaauccu

SEQ ID NO: 723492 - RNA, 16 nt, Haemophilus influenzae Rd
auuucacguaguuaaa

SEQ ID NO: 723493 - RNA, 21 nt, Haemophilus influenzae Rd
auuucacguaguuaaaccaaa

SEQ ID NO: 723494 - RNA, 14 nt, Haemophilus influenzae Rd
auuuuagaaaaauc

SEQ ID NO: 723495 - RNA, 22 nt, Haemophilus influenzae Rd
auuuuagaaaaaucgaagaaau

SEQ ID NO: 723496 - RNA, 22 nt, Haemophilus influenzae Rd
auuuuacuuguuuaugucuaaa

SEQ ID NO: 723497 - RNA, 18 nt, Haemophilus influenzae Rd
auuuuacuuuagcaaugc

SEQ ID NO: 723498 - RNA, 15 nt, Haemophilus influenzae Rd
auuuuacuaauuaaa

SEQ ID NO: 723499 - RNA, 15 nt, Haemophilus influenzae Rd
auuuuacguuucauu

SEQ ID NO: 723500 - RNA, 21 nt, Haemophilus influenzae Rd
auuuuacguuucauuuuugca

SEQ ID NO: 723501 - RNA, 16 nt, Haemophilus influenzae Rd
auuuuacguuuuaaau

SEQ ID NO: 723502 - RNA, 17 nt, Haemophilus influenzae Rd
auuuuaccgcacuuuau

SEQ ID NO: 723503 - RNA, 23 nt, Haemophilus influenzae Rd
auuuuaccgcacuuuauuagaaa

SEQ ID NO: 723504 - RNA, 15 nt, Haemophilus influenzae Rd
auuuuacggauuuau

SEQ ID NO: 723505 - RNA, 23 nt, Haemophilus influenzae Rd
auuuuacgagaaagguguaauuc

SEQ ID NO: 723506 - RNA, 23 nt, Haemophilus influenzae Rd
auuuuaaguuggcugaaagcgaa

SEQ ID NO: 723507 - RNA, 15 nt, Haemophilus influenzae Rd
auuuuaauaaagaua

SEQ ID NO: 723508 - RNA, 14 nt, Haemophilus influenzae Rd
auuuuaauaaggca

SEQ ID NO: 723509 - RNA, 13 nt, Haemophilus influenzae Rd
auuuuaauguaau

SEQ ID NO: 723510 - RNA, 15 nt, Haemophilus influenzae Rd
auuuuacagauuuug

SEQ ID NO: 723511 - RNA, 15 nt, Haemophilus influenzae Rd
auuuuaccaagaaau

SEQ ID NO: 723512 - RNA, 17 nt, Haemophilus influenzae Rd
auuuuaccaagaaauaa

SEQ ID NO: 723513 - RNA, 14 nt, Haemophilus influenzae Rd
auuuuaaauuauuu

SEQ ID NO: 723514 - RNA, 17 nt, Haemophilus influenzae Rd
auuuuaacucagggaaa

SEQ ID NO: 723515 - RNA, 20 nt, Haemophilus influenzae Rd
auuuuaaccgcacuuuuaau

SEQ ID NO: 723516 - RNA, 17 nt, Haemophilus influenzae Rd
auuuuaaaaccacaaua

SEQ ID NO: 723517 - RNA, 14 nt, Haemophilus influenzae Rd
auuuuaaaaggcuu

SEQ ID NO: 723518 - RNA, 14 nt, Haemophilus influenzae Rd
auuuguuuuuuagg

SEQ ID NO: 723519 - RNA, 17 nt, Haemophilus influenzae Rd
auuuguuuuuaguuuuu

SEQ ID NO: 723520 - RNA, 11 nt, Haemophilus influenzae Rd
auuuguuuuau

SEQ ID NO: 723521 - RNA, 20 nt, Haemophilus influenzae Rd
auuuguuuuccguauuuuca

SEQ ID NO: 723522 - RNA, 17 nt, Haemophilus influenzae Rd
auuugaucguuaauauc

SEQ ID NO: 723523 - RNA, 23 nt, Haemophilus influenzae Rd
auuugagucucaaauuuuucaca

SEQ ID NO: 723524 - RNA, 15 nt, Haemophilus influenzae Rd
auuugauaaaaacac

SEQ ID NO: 723525 - RNA, 19 nt, Haemophilus influenzae Rd
auuugauacucuucaaguu

SEQ ID NO: 723526 - RNA, 17 nt, Haemophilus influenzae Rd
auuugagaaaaauguua

SEQ ID NO: 723527 - RNA, 13 nt, Haemophilus influenzae Rd
auuugagcauuua

SEQ ID NO: 723528 - RNA, 13 nt, Haemophilus influenzae Rd
auuugagauuuua

SEQ ID NO: 723529 - RNA, 17 nt, Haemophilus influenzae Rd
auuugagcaagaugaau

SEQ ID NO: 723530 - RNA, 16 nt, Haemophilus influenzae Rd
auuuuaguauuuuuga

SEQ ID NO: 723531 - RNA, 23 nt, Haemophilus influenzae Rd
auuuuaguauuuuugaaugauga

SEQ ID NO: 723532 - RNA, 22 nt, Haemophilus influenzae Rd
auuuuagaauccaaaauuacuu

SEQ ID NO: 723533 - RNA, 14 nt, Haemophilus influenzae Rd
auuuuaucuaauca

SEQ ID NO: 723534 - RNA, 16 nt, Haemophilus influenzae Rd
auuuuaucuaaucauu

SEQ ID NO: 723535 - RNA, 13 nt, Haemophilus influenzae Rd
auuuuauccaacc

SEQ ID NO: 723536 - RNA, 21 nt, Haemophilus influenzae Rd
auuuuauccaaccuacauuaa

SEQ ID NO: 723537 - RNA, 17 nt, Haemophilus influenzae Rd
auuuuaucaacuaaaaa

SEQ ID NO: 723538 - RNA, 18 nt, Haemophilus influenzae Rd
auuuuaucaacuaaaaaa

SEQ ID NO: 723539 - RNA, 13 nt, Haemophilus influenzae Rd
auuuuaucaagaa

SEQ ID NO: 723540 - RNA, 18 nt, Haemophilus influenzae Rd
auuuuaucacaaguuaaa

SEQ ID NO: 723541 - RNA, 12 nt, Haemophilus influenzae Rd
auuuuauauauu

SEQ ID NO: 723542 - RNA, 18 nt, Haemophilus influenzae Rd
auuuuauaaucuuuaaaa

SEQ ID NO: 723543 - RNA, 16 nt, Haemophilus influenzae Rd
auuuuauagcuuuagu

SEQ ID NO: 723544 - RNA, 17 nt, Haemophilus influenzae Rd
auuuuaguuucuaauuc

SEQ ID NO: 723545 - RNA, 18 nt, Haemophilus influenzae Rd
auuuuauaaacaucuucu

SEQ ID NO: 723546 - RNA, 17 nt, Haemophilus influenzae Rd
auuuucaauggcaucaa

SEQ ID NO: 723547 - RNA, 21 nt, Haemophilus influenzae Rd
auuuucaaugguuuauaacaa

SEQ ID NO: 723548 - RNA, 12 nt, Haemophilus influenzae Rd
auuuucaauauc

SEQ ID NO: 723549 - RNA, 19 nt, Haemophilus influenzae Rd
auuuucauaaccaaauaga

SEQ ID NO: 723550 - RNA, 22 nt, Haemophilus influenzae Rd
auuuucauaaccaaauagauga

SEQ ID NO: 723551 - RNA, 19 nt, Haemophilus influenzae Rd
auuuuauuugccuugugac

SEQ ID NO: 723552 - RNA, 19 nt, Haemophilus influenzae Rd
auuuuauuuuguauauugu

SEQ ID NO: 723553 - RNA, 12 nt, Haemophilus influenzae Rd
auuuucaacaaa

SEQ ID NO: 723554 - RNA, 12 nt, Haemophilus influenzae Rd
auuuucaaauaa

SEQ ID NO: 723555 - RNA, 23 nt, Haemophilus influenzae Rd
auuuucaagcccuuccaucuuuu

SEQ ID NO: 723556 - RNA, 18 nt, Haemophilus influenzae Rd
auuuucaaguaacuuuca

SEQ ID NO: 723557 - RNA, 17 nt, Haemophilus influenzae Rd
auuuuuucaucauuucu

SEQ ID NO: 723558 - RNA, 12 nt, Haemophilus influenzae Rd
auuuuuucaacu

SEQ ID NO: 723559 - RNA, 12 nt, Haemophilus influenzae Rd
auuuuuuauuaa

SEQ ID NO: 723560 - RNA, 19 nt, Haemophilus influenzae Rd
auuuuuuauuaauuauaaa

SEQ ID NO: 723561 - RNA, 15 nt, Haemophilus influenzae Rd
auuuuuuauuacauu

SEQ ID NO: 723562 - RNA, 22 nt, Haemophilus influenzae Rd
auuuuuuauuacauuaaaauca

SEQ ID NO: 723563 - RNA, 23 nt, Haemophilus influenzae Rd
auuuuuuauuacccuauucuaaa

SEQ ID NO: 723564 - RNA, 16 nt, Haemophilus influenzae Rd
auuuuuuuuauccaaa

SEQ ID NO: 723565 - RNA, 15 nt, Haemophilus influenzae Rd
auuuuuucugaauaa

SEQ ID NO: 723566 - RNA, 13 nt, Haemophilus influenzae Rd
auuuuuucugcaa

SEQ ID NO: 723567 - RNA, 16 nt, Haemophilus influenzae Rd
auuuuuuuugcauuua

SEQ ID NO: 723568 - RNA, 23 nt, Haemophilus influenzae Rd
caaaaaagugcgguaaaaauuca

SEQ ID NO: 723569 - RNA, 21 nt, Haemophilus influenzae Rd
caaaaaagugcgguuaaaauu

SEQ ID NO: 723570 - RNA, 17 nt, Haemophilus influenzae Rd
auuuuucggauuaagug

SEQ ID NO: 723571 - RNA, 20 nt, Haemophilus influenzae Rd
auuuuucgcuacgccuugga

SEQ ID NO: 723572 - RNA, 17 nt, Haemophilus influenzae Rd
auuuuucucguaugcug

SEQ ID NO: 723573 - RNA, 23 nt, Haemophilus influenzae Rd
auuuuucgcaaaaucuugcugaa

SEQ ID NO: 723574 - RNA, 21 nt, Haemophilus influenzae Rd
auuuuuccuuuucauaaaaau

SEQ ID NO: 723575 - RNA, 17 nt, Haemophilus influenzae Rd
auuuuuuaauuuuuucu

SEQ ID NO: 723576 - RNA, 17 nt, Haemophilus influenzae Rd
auuuuuuacgauauuuu

SEQ ID NO: 723577 - RNA, 18 nt, Haemophilus influenzae Rd
auuuuugcacgaauuuca

SEQ ID NO: 723578 - RNA, 19 nt, Haemophilus influenzae Rd
auuuuugagguguuuaugc

SEQ ID NO: 723579 - RNA, 23 nt, Haemophilus influenzae Rd
auuuuugauccugaucuuuugcc

SEQ ID NO: 723580 - RNA, 22 nt, Haemophilus influenzae Rd
auuuuugauuuaauugaaauuu

SEQ ID NO: 723581 - RNA, 15 nt, Haemophilus influenzae Rd
auuuuugauuuaguc

SEQ ID NO: 723582 - RNA, 22 nt, Haemophilus influenzae Rd
auuuuuuacugcuucauaaaug

SEQ ID NO: 723583 - RNA, 14 nt, Haemophilus influenzae Rd
auuuuuuauaaaau

SEQ ID NO: 723584 - RNA, 14 nt, Haemophilus influenzae Rd
auuuuuuauaaaug

SEQ ID NO: 723585 - RNA, 16 nt, Haemophilus influenzae Rd
auuuuucuuuucuucu

SEQ ID NO: 723586 - RNA, 17 nt, Haemophilus influenzae Rd
auuuuucuuuucuucua

SEQ ID NO: 723587 - RNA, 23 nt, Haemophilus influenzae Rd
auuuuucuuuucuucuaauucuu

SEQ ID NO: 723588 - RNA, 18 nt, Haemophilus influenzae Rd
auuuuugauaaaaaagaa

SEQ ID NO: 723589 - RNA, 19 nt, Haemophilus influenzae Rd
auuuuugauaaaaaagaaa

SEQ ID NO: 723590 - RNA, 20 nt, Haemophilus influenzae Rd
auuuuugauaaaaaagaaau

SEQ ID NO: 723591 - RNA, 12 nt, Haemophilus influenzae Rd
auuuuugaauga

SEQ ID NO: 723592 - RNA, 18 nt, Haemophilus influenzae Rd
auuuuugaaugaaauuca

SEQ ID NO: 723593 - RNA, 22 nt, Haemophilus influenzae Rd
auuuuugaaugaugaguagauu

SEQ ID NO: 723594 - RNA, 14 nt, Haemophilus influenzae Rd
auuuuugaauuuca

SEQ ID NO: 723595 - RNA, 16 nt, Haemophilus influenzae Rd
auuuugugaucuugau

SEQ ID NO: 723596 - RNA, 19 nt, Haemophilus influenzae Rd
auuuuguuacucgcaucaa

SEQ ID NO: 723597 - RNA, 11 nt, Haemophilus influenzae Rd
auuuuuaaaac

SEQ ID NO: 723598 - RNA, 21 nt, Haemophilus influenzae Rd
auuuuuaaaauagaaugaaaa

SEQ ID NO: 723599 - RNA, 11 nt, Haemophilus influenzae Rd
auuuuuaaaaa

SEQ ID NO: 723600 - RNA, 11 nt, Haemophilus influenzae Rd
auuuuuaaaug

SEQ ID NO: 723601 - RNA, 15 nt, Haemophilus influenzae Rd
auuuuuaaagaaauc

SEQ ID NO: 723602 - RNA, 22 nt, Haemophilus influenzae Rd
auuuuuaaucaaauaaaauauu

SEQ ID NO: 723603 - RNA, 23 nt, Haemophilus influenzae Rd
auuuuucaauaagcaaguaauuu

SEQ ID NO: 723604 - RNA, 17 nt, Haemophilus influenzae Rd
auuuuuaaugcguuuua

SEQ ID NO: 723605 - RNA, 15 nt, Haemophilus influenzae Rd
auuuuucaaaauuuu

SEQ ID NO: 723606 - RNA, 15 nt, Haemophilus influenzae Rd
auuuuucaguauuuu

SEQ ID NO: 723607 - RNA, 19 nt, Haemophilus influenzae Rd
auuuuucauaaauaucaac

SEQ ID NO: 723608 - RNA, 21 nt, Haemophilus influenzae Rd
auuuuucaaggccauauuuuc

SEQ ID NO: 723609 - RNA, 22 nt, Haemophilus influenzae Rd
auuuuucaccgcacuuucuucu

SEQ ID NO: 723610 - RNA, 23 nt, Haemophilus influenzae Rd
auuuuucaccgcacuuucuucuu

SEQ ID NO: 723611 - RNA, 23 nt, Haemophilus influenzae Rd
auuuuuccagcaaaaaaauuucu

SEQ ID NO: 723612 - RNA, 20 nt, Haemophilus influenzae Rd
auuuuucaucuuuuuauaaa

SEQ ID NO: 723613 - RNA, 12 nt, Haemophilus influenzae Rd
auuuuucauuuu

SEQ ID NO: 723614 - RNA, 12 nt, Haemophilus influenzae Rd
auuuuucauucu

SEQ ID NO: 723615 - RNA, 15 nt, Haemophilus influenzae Rd
auuuucgcaucaauc

SEQ ID NO: 723616 - RNA, 16 nt, Haemophilus influenzae Rd
auuuucgcaucaauca

SEQ ID NO: 723617 - RNA, 21 nt, Haemophilus influenzae Rd
auuuucgcaucaaucacagca

SEQ ID NO: 723618 - RNA, 23 nt, Haemophilus influenzae Rd
auuuucgacuugugcaagaaauu

SEQ ID NO: 723619 - RNA, 22 nt, Haemophilus influenzae Rd
auuuucgccugccgcauaagcg

SEQ ID NO: 723620 - RNA, 21 nt, Haemophilus influenzae Rd
auuuucuagagcaagcguuaa

SEQ ID NO: 723621 - RNA, 23 nt, Haemophilus influenzae Rd
auuuucuaaggcuuguuguucaa

SEQ ID NO: 723622 - RNA, 11 nt, Haemophilus influenzae Rd
auuuucuaagu

SEQ ID NO: 723623 - RNA, 13 nt, Haemophilus influenzae Rd
auuuucuaaugaa

SEQ ID NO: 723624 - RNA, 22 nt, Haemophilus influenzae Rd
auuuuggcgaaccuuucauaua

SEQ ID NO: 723625 - RNA, 22 nt, Haemophilus influenzae Rd
auuuuguccgugccaaagcauu

SEQ ID NO: 723626 - RNA, 21 nt, Haemophilus influenzae Rd
caauguuauugccuaauaaaa

SEQ ID NO: 723627 - RNA, 18 nt, Haemophilus influenzae Rd
caauucgcccgaaacuca

SEQ ID NO: 723628 - RNA, 13 nt, Haemophilus influenzae Rd
caauuucacugcc

SEQ ID NO: 723629 - RNA, 15 nt, Haemophilus influenzae Rd
caauuucaauugcca

SEQ ID NO: 723630 - RNA, 14 nt, Haemophilus influenzae Rd
caauuucacgauuu

SEQ ID NO: 723631 - RNA, 22 nt, Haemophilus influenzae Rd
caauuucaaaacaguuuucaaa

SEQ ID NO: 723632 - RNA, 16 nt, Haemophilus influenzae Rd
caauuucaucacauca

SEQ ID NO: 723633 - RNA, 20 nt, Haemophilus influenzae Rd
caauuucagcacccacauca

SEQ ID NO: 723634 - RNA, 21 nt, Haemophilus influenzae Rd
caauuucucgaguaggcaauu

SEQ ID NO: 723635 - RNA, 12 nt, Haemophilus influenzae Rd
caauuucucugg

SEQ ID NO: 723636 - RNA, 19 nt, Haemophilus influenzae Rd
caauuuccgcuuccugcug

SEQ ID NO: 723637 - RNA, 16 nt, Haemophilus influenzae Rd
caauuucccguuuaau

SEQ ID NO: 723638 - RNA, 18 nt, Haemophilus influenzae Rd
caauugcccagauugguu

SEQ ID NO: 723639 - RNA, 13 nt, Haemophilus influenzae Rd
caauucuucuaau

SEQ ID NO: 723640 - RNA, 15 nt, Haemophilus influenzae Rd
caauucuuguuuaau

SEQ ID NO: 723641 - RNA, 19 nt, Haemophilus influenzae Rd
caauugcagauuuuuuuau

SEQ ID NO: 723642 - RNA, 17 nt, Haemophilus influenzae Rd
caauugccgacacuaaa

SEQ ID NO: 723643 - RNA, 20 nt, Haemophilus influenzae Rd
caauugccgacacuaaaaag

SEQ ID NO: 723644 - RNA, 13 nt, Haemophilus influenzae Rd
caaucuucacaaa

SEQ ID NO: 723645 - RNA, 19 nt, Haemophilus influenzae Rd
caaucuucacaaauaauau

SEQ ID NO: 723646 - RNA, 18 nt, Haemophilus influenzae Rd
caaucuguccaucuuuua

SEQ ID NO: 723647 - RNA, 17 nt, Haemophilus influenzae Rd
caaucuggauuggauuc

SEQ ID NO: 723648 - RNA, 15 nt, Haemophilus influenzae Rd
caaugaauauaaaau

SEQ ID NO: 723649 - RNA, 13 nt, Haemophilus influenzae Rd
caaugcuuccuuc

SEQ ID NO: 723650 - RNA, 13 nt, Haemophilus influenzae Rd
caauggaauacca

SEQ ID NO: 723651 - RNA, 13 nt, Haemophilus influenzae Rd
caaugcuauaaaa

SEQ ID NO: 723652 - RNA, 17 nt, Haemophilus influenzae Rd
caaugcuaucaggcuua

SEQ ID NO: 723653 - RNA, 21 nt, Haemophilus influenzae Rd
caauggcaaucacaguuuuau

SEQ ID NO: 723654 - RNA, 16 nt, Haemophilus influenzae Rd
caauggcugaaaaauu

SEQ ID NO: 723655 - RNA, 20 nt, Haemophilus influenzae Rd
caauggcgguauauucugua

SEQ ID NO: 723656 - RNA, 17 nt, Haemophilus influenzae Rd
caaugucagaaaagauu

SEQ ID NO: 723657 - RNA, 23 nt, Haemophilus influenzae Rd
caaugguuuauaacaaguuagau

SEQ ID NO: 723658 - RNA, 15 nt, Haemophilus influenzae Rd
caaugguuaauacaa

SEQ ID NO: 723659 - RNA, 14 nt, Haemophilus influenzae Rd
cacagaaaccaaua

SEQ ID NO: 723660 - RNA, 17 nt, Haemophilus influenzae Rd
cacacuuuguauggcaa

SEQ ID NO: 723661 - RNA, 19 nt, Haemophilus influenzae Rd
cacacuuuguauggcaaau

SEQ ID NO: 723662 - RNA, 16 nt, Haemophilus influenzae Rd
cacacaguuauacaca

SEQ ID NO: 723663 - RNA, 19 nt, Haemophilus influenzae Rd
cacacaguuauacacaagu

SEQ ID NO: 723664 - RNA, 22 nt, Haemophilus influenzae Rd
cacaaugagacuuaaccaaaua

SEQ ID NO: 723665 - RNA, 16 nt, Haemophilus influenzae Rd
cacaaucgcaucgucu

SEQ ID NO: 723666 - RNA, 21 nt, Haemophilus influenzae Rd
cacaaucgcuagcgcaaucaa

SEQ ID NO: 723667 - RNA, 20 nt, Haemophilus influenzae Rd
cacaagauuugccaaaauca

SEQ ID NO: 723668 - RNA, 21 nt, Haemophilus influenzae Rd
cacaagcugaccacuuucaau

SEQ ID NO: 723669 - RNA, 15 nt, Haemophilus influenzae Rd
cacaagggauuuaaa

SEQ ID NO: 723670 - RNA, 17 nt, Haemophilus influenzae Rd
cacaaggcucaucauua

SEQ ID NO: 723671 - RNA, 19 nt, Haemophilus influenzae Rd
cacaagguuguaagcccau

SEQ ID NO: 723672 - RNA, 18 nt, Haemophilus influenzae Rd
cacaaguagauuacacau

SEQ ID NO: 723673 - RNA, 20 nt, Haemophilus influenzae Rd
cacaauccuucaugguuugu

SEQ ID NO: 723674 - RNA, 18 nt, Haemophilus influenzae Rd
cacaaucaaaccaauaaa

SEQ ID NO: 723675 - RNA, 22 nt, Haemophilus influenzae Rd
cacaauagcuuccgcuuuuuuc

SEQ ID NO: 723676 - RNA, 14 nt, Haemophilus influenzae Rd
cacaauauuuaaua

SEQ ID NO: 723677 - RNA, 16 nt, Haemophilus influenzae Rd
cacaauacuuaucacu

SEQ ID NO: 723678 - RNA, 14 nt, Haemophilus influenzae Rd
cacaauaaaauaau

SEQ ID NO: 723679 - RNA, 21 nt, Haemophilus influenzae Rd
cacaauaauaggcgaaucaaa

SEQ ID NO: 723680 - RNA, 17 nt, Haemophilus influenzae Rd
cacaaguucuugcgcau

SEQ ID NO: 723681 - RNA, 18 nt, Haemophilus influenzae Rd
cacaaguucuugcgcauu

SEQ ID NO: 723682 - RNA, 21 nt, Haemophilus influenzae Rd
cacaacuucggaagaaaaaga

SEQ ID NO: 723683 - RNA, 19 nt, Haemophilus influenzae Rd
cacaacuugaccauuaagc

SEQ ID NO: 723684 - RNA, 20 nt, Haemophilus influenzae Rd
cacaacgacgcacuguugug

SEQ ID NO: 723685 - RNA, 21 nt, Haemophilus influenzae Rd
cacaacgacgccacuguugug

SEQ ID NO: 723686 - RNA, 17 nt, Haemophilus influenzae Rd
caauuugagucucaaau

SEQ ID NO: 723687 - RNA, 15 nt, Haemophilus influenzae Rd
caauuugaaaagaau

SEQ ID NO: 723688 - RNA, 15 nt, Haemophilus influenzae Rd
caauuucuuuaccuu

SEQ ID NO: 723689 - RNA, 19 nt, Haemophilus influenzae Rd
caauuuggcaaaaguaagc

SEQ ID NO: 723690 - RNA, 19 nt, Haemophilus influenzae Rd
caauuuggucgccgacuuu

SEQ ID NO: 723691 - RNA, 20 nt, Haemophilus influenzae Rd
cacaacagcuaccaauucaa

SEQ ID NO: 723692 - RNA, 12 nt, Haemophilus influenzae Rd
cacaacauaauu

SEQ ID NO: 723693 - RNA, 14 nt, Haemophilus influenzae Rd
cacaacauauaaau

SEQ ID NO: 723694 - RNA, 15 nt, Haemophilus influenzae Rd
cacaacauauaaauc

SEQ ID NO: 723695 - RNA, 20 nt, Haemophilus influenzae Rd
cacauccauuccugcaagaa

SEQ ID NO: 723696 - RNA, 13 nt, Haemophilus influenzae Rd
cacauccacaaaa

SEQ ID NO: 723697 - RNA, 14 nt, Haemophilus influenzae Rd
cacaucaaagcguu

SEQ ID NO: 723698 - RNA, 22 nt, Haemophilus influenzae Rd
cacaucaaagcguuuuucuaca

SEQ ID NO: 723699 - RNA, 13 nt, Haemophilus influenzae Rd
cacauauuuuuga

SEQ ID NO: 723700 - RNA, 15 nt, Haemophilus influenzae Rd
cacagcccaaaauuc

SEQ ID NO: 723701 - RNA, 16 nt, Haemophilus influenzae Rd
cacagcccaaaauuca

SEQ ID NO: 723702 - RNA, 17 nt, Haemophilus influenzae Rd
cacagcccaaaauucag

SEQ ID NO: 723703 - RNA, 14 nt, Haemophilus influenzae Rd
cacauacuuauuca

SEQ ID NO: 723704 - RNA, 21 nt, Haemophilus influenzae Rd
cacauauggagaaucuuuauc

SEQ ID NO: 723705 - RNA, 13 nt, Haemophilus influenzae Rd
cacauacuucuuc

SEQ ID NO: 723706 - RNA, 18 nt, Haemophilus influenzae Rd
caccaacacuugcagccc

SEQ ID NO: 723707 - RNA, 11 nt, Haemophilus influenzae Rd
caccaaauaau

SEQ ID NO: 723708 - RNA, 20 nt, Haemophilus influenzae Rd
caccaaauaauguuaaaucu

SEQ ID NO: 723709 - RNA, 13 nt, Haemophilus influenzae Rd
caccaaauuacug

SEQ ID NO: 723710 - RNA, 19 nt, Haemophilus influenzae Rd
caccacagcccaaaauuca

SEQ ID NO: 723711 - RNA, 13 nt, Haemophilus influenzae Rd
caccacaaaauaa

SEQ ID NO: 723712 - RNA, 18 nt, Haemophilus influenzae Rd
caccacaaaauaaaugau

SEQ ID NO: 723713 - RNA, 13 nt, Haemophilus influenzae Rd
caccacaagcuga

SEQ ID NO: 723714 - RNA, 15 nt, Haemophilus influenzae Rd
cacauucaaauccaa

SEQ ID NO: 723715 - RNA, 12 nt, Haemophilus influenzae Rd
cacauuaaacug

SEQ ID NO: 723716 - RNA, 20 nt, Haemophilus influenzae Rd
caccaaaaauccucaucuga

SEQ ID NO: 723717 - RNA, 23 nt, Haemophilus influenzae Rd
caccaaaaaugccguuuccaaau

SEQ ID NO: 723718 - RNA, 18 nt, Haemophilus influenzae Rd
caccaaaaccaauaccau

SEQ ID NO: 723719 - RNA, 21 nt, Haemophilus influenzae Rd
cacauuccauaccguuacgaa

SEQ ID NO: 723720 - RNA, 20 nt, Haemophilus influenzae Rd
aaaauaaacauuuuucauuu

SEQ ID NO: 723721 - RNA, 14 nt, Haemophilus influenzae Rd
aaaauaaaaugaca

SEQ ID NO: 723722 - RNA, 15 nt, Haemophilus influenzae Rd
aaaauaaacacucca

SEQ ID NO: 723723 - RNA, 14 nt, Haemophilus influenzae Rd
aaaauaaaaaauau

SEQ ID NO: 723724 - RNA, 13 nt, Haemophilus influenzae Rd
aaaauaaaaacau

SEQ ID NO: 723725 - RNA, 15 nt, Haemophilus influenzae Rd
aaaauaaaaacauug

SEQ ID NO: 723726 - RNA, 14 nt, Haemophilus influenzae Rd
aaaagugcuuaaau

SEQ ID NO: 723727 - RNA, 17 nt, Haemophilus influenzae Rd
aaaagugcggaaaauuu

SEQ ID NO: 723728 - RNA, 20 nt, Haemophilus influenzae Rd
aaaagugcgguaaaaauuau

SEQ ID NO: 723729 - RNA, 20 nt, Haemophilus influenzae Rd
aaaagugcgguaaaauuuca

SEQ ID NO: 723730 - RNA, 22 nt, Haemophilus influenzae Rd
aaaagugcggucaauaaaaaua

SEQ ID NO: 723731 - RNA, 17 nt, Haemophilus influenzae Rd
aaaagugcggugauuuu

SEQ ID NO: 723732 - RNA, 18 nt, Haemophilus influenzae Rd
aaaagugcggugauuuuu

SEQ ID NO: 723733 - RNA, 17 nt, Haemophilus influenzae Rd
aaaagugcgguuaaaau

SEQ ID NO: 723734 - RNA, 18 nt, Haemophilus influenzae Rd
aaaagugcgguuaaaauu

SEQ ID NO: 723735 - RNA, 15 nt, Haemophilus influenzae Rd
caccacgauauuucg

SEQ ID NO: 723736 - RNA, 16 nt, Haemophilus influenzae Rd
caccacgaccuaagaa

SEQ ID NO: 723737 - RNA, 16 nt, Haemophilus influenzae Rd
caccacuaaaguugaa

SEQ ID NO: 723738 - RNA, 15 nt, Haemophilus influenzae Rd
caccacguucauaaa

SEQ ID NO: 723739 - RNA, 16 nt, Haemophilus influenzae Rd
caccacguucauaaac

SEQ ID NO: 723740 - RNA, 15 nt, Haemophilus influenzae Rd
caccacuuaaaaaua

SEQ ID NO: 723741 - RNA, 17 nt, Haemophilus influenzae Rd
caccacugguaaauauc

SEQ ID NO: 723742 - RNA, 17 nt, Haemophilus influenzae Rd
caccgcuuugcuugccc

SEQ ID NO: 723743 - RNA, 19 nt, Haemophilus influenzae Rd
caccgcuaauaaaaauccu

SEQ ID NO: 723744 - RNA, 18 nt, Haemophilus influenzae Rd
caccgcacuuuccuucua

SEQ ID NO: 723745 - RNA, 14 nt, Haemophilus influenzae Rd
caccgcacuuucuu

SEQ ID NO: 723746 - RNA, 22 nt, Haemophilus influenzae Rd
caccgcacuuuuaucuauaaaa

SEQ ID NO: 723747 - RNA, 15 nt, Haemophilus influenzae Rd
caccgcacuuuuuac

SEQ ID NO: 723748 - RNA, 12 nt, Haemophilus influenzae Rd
caccgcauucuu

SEQ ID NO: 723749 - RNA, 16 nt, Haemophilus influenzae Rd
caccgcauucuucuuu

SEQ ID NO: 723750 - RNA, 22 nt, Haemophilus influenzae Rd
caccgcauuguaaaccaaauuu

SEQ ID NO: 723751 - RNA, 16 nt, Haemophilus influenzae Rd
caccuauuuuuuccug

SEQ ID NO: 723752 - RNA, 16 nt, Haemophilus influenzae Rd
caccuaaaugagaaaa

SEQ ID NO: 723753 - RNA, 17 nt, Haemophilus influenzae Rd
caccuaacauaugacag

SEQ ID NO: 723754 - RNA, 19 nt, Haemophilus influenzae Rd
caccgucauuuucaagcca

SEQ ID NO: 723755 - RNA, 22 nt, Haemophilus influenzae Rd
caccguauuuuuuaguuaaaua

SEQ ID NO: 723756 - RNA, 23 nt, Haemophilus influenzae Rd
caccguauuuuuuaguuaaauaa

SEQ ID NO: 723757 - RNA, 14 nt, Haemophilus influenzae Rd
aaaauaaauuaacu

SEQ ID NO: 723758 - RNA, 23 nt, Haemophilus influenzae Rd
aaaauaaagggcgguuaaaaauc

SEQ ID NO: 723759 - RNA, 12 nt, Haemophilus influenzae Rd
aaaauaaagaaa

SEQ ID NO: 723760 - RNA, 15 nt, Haemophilus influenzae Rd
aaaauaacaaaaaag

SEQ ID NO: 723761 - RNA, 16 nt, Haemophilus influenzae Rd
aaaauaaauuuuaaaa

SEQ ID NO: 723762 - RNA, 23 nt, Haemophilus influenzae Rd
aaaauaaauuuuaaaaucuuuga

SEQ ID NO: 723763 - RNA, 23 nt, Haemophilus influenzae Rd
aaaauaaagaaacguaaacaaaa

SEQ ID NO: 723764 - RNA, 13 nt, Haemophilus influenzae Rd
aaaauaaccaaua

SEQ ID NO: 723765 - RNA, 13 nt, Haemophilus influenzae Rd
aaaauaaccacua

SEQ ID NO: 723766 - RNA, 19 nt, Haemophilus influenzae Rd
cacccauacuuuaacuucu

SEQ ID NO: 723767 - RNA, 14 nt, Haemophilus influenzae Rd
cacccacuaaugcg

SEQ ID NO: 723768 - RNA, 14 nt, Haemophilus influenzae Rd
aaaauacauugcua

SEQ ID NO: 723769 - RNA, 14 nt, Haemophilus influenzae Rd
aaaauacccauaaa

SEQ ID NO: 723770 - RNA, 20 nt, Haemophilus influenzae Rd
aaaauaccgcacuuuggcaa

SEQ ID NO: 723771 - RNA, 14 nt, Haemophilus influenzae Rd
caccuucaacauuu

SEQ ID NO: 723772 - RNA, 22 nt, Haemophilus influenzae Rd
caccugugauaaguugggauaa

SEQ ID NO: 723773 - RNA, 15 nt, Haemophilus influenzae Rd
aaaauaaucuggcaa

SEQ ID NO: 723774 - RNA, 14 nt, Haemophilus influenzae Rd
aaaauaauuuuacu

SEQ ID NO: 723775 - RNA, 13 nt, Haemophilus influenzae Rd
aaaauaauuuagu

SEQ ID NO: 723776 - RNA, 16 nt, Haemophilus influenzae Rd
aaaauaauuuaguuau

SEQ ID NO: 723777 - RNA, 12 nt, Haemophilus influenzae Rd
aaaauaauucca

SEQ ID NO: 723778 - RNA, 17 nt, Haemophilus influenzae Rd
caccuccagcaaaagca

SEQ ID NO: 723779 - RNA, 17 nt, Haemophilus influenzae Rd
cacgagcaggaaaacca

SEQ ID NO: 723780 - RNA, 19 nt, Haemophilus influenzae Rd
cacgaugaugcaggaaagg

SEQ ID NO: 723781 - RNA, 16 nt, Haemophilus influenzae Rd
cacgagcuaaaaaauc

SEQ ID NO: 723782 - RNA, 18 nt, Haemophilus influenzae Rd
cacgacccaccacuuaaa

SEQ ID NO: 723783 - RNA, 22 nt, Haemophilus influenzae Rd
cacgagaaaagucgcuacauuu

SEQ ID NO: 723784 - RNA, 22 nt, Haemophilus influenzae Rd
cacgagacacacuaaucaaucc

SEQ ID NO: 723785 - RNA, 21 nt, Haemophilus influenzae Rd
cacgaaaccaacgaaaauagc

SEQ ID NO: 723786 - RNA, 16 nt, Haemophilus influenzae Rd
aaaauagaaugaaaaa

SEQ ID NO: 723787 - RNA, 18 nt, Haemophilus influenzae Rd
aaaauagaaugaaaaaca

SEQ ID NO: 723788 - RNA, 19 nt, Haemophilus influenzae Rd
aaaauagaaugaaaaacau

SEQ ID NO: 723789 - RNA, 15 nt, Haemophilus influenzae Rd
aaaauagaaagaaua

SEQ ID NO: 723790 - RNA, 22 nt, Haemophilus influenzae Rd
aaaauagccuaaauauuuauac

SEQ ID NO: 723791 - RNA, 21 nt, Haemophilus influenzae Rd
aaaauagccucagguauuucu

SEQ ID NO: 723792 - RNA, 13 nt, Haemophilus influenzae Rd
cacgcgcugcucu

SEQ ID NO: 723793 - RNA, 20 nt, Haemophilus influenzae Rd
cacgccuucgcgagauaaaa

SEQ ID NO: 723794 - RNA, 19 nt, Haemophilus influenzae Rd
cacgcaagcgcguuuauca

SEQ ID NO: 723795 - RNA, 13 nt, Haemophilus influenzae Rd
cacgcccuuguga

SEQ ID NO: 723796 - RNA, 23 nt, Haemophilus influenzae Rd
cacgauuuucaauacaucaguaa

SEQ ID NO: 723797 - RNA, 21 nt, Haemophilus influenzae Rd
cacgauuuuuuuauaaaaaaa

SEQ ID NO: 723798 - RNA, 23 nt, Haemophilus influenzae Rd
cacgcuaaggcaaaaaaaucaua

SEQ ID NO: 723799 - RNA, 18 nt, Haemophilus influenzae Rd
cacgcguuucuaaaauaa

SEQ ID NO: 723800 - RNA, 18 nt, Haemophilus influenzae Rd
cacgcuaaaaucuugcac

SEQ ID NO: 723801 - RNA, 20 nt, Haemophilus influenzae Rd
cacgcgugguauucuuucca

SEQ ID NO: 723802 - RNA, 22 nt, Haemophilus influenzae Rd
cacgcucgaggguuaagauuau

SEQ ID NO: 723803 - RNA, 16 nt, Haemophilus influenzae Rd
cacggccguaaugaau

SEQ ID NO: 723804 - RNA, 15 nt, Haemophilus influenzae Rd
aaaauagcugauaau

SEQ ID NO: 723805 - RNA, 17 nt, Haemophilus influenzae Rd
aaaauaggcugaaaaaa

SEQ ID NO: 723806 - RNA, 20 nt, Haemophilus influenzae Rd
aaaauagucauaaaggcuac

SEQ ID NO: 723807 - RNA, 16 nt, Haemophilus influenzae Rd
caauaccuuugugaca

SEQ ID NO: 723808 - RNA, 16 nt, Haemophilus influenzae Rd
caauaauuuuuaauuc

SEQ ID NO: 723809 - RNA, 20 nt, Haemophilus influenzae Rd
caauaauuuuuaauucuuuu

SEQ ID NO: 723810 - RNA, 14 nt, Haemophilus influenzae Rd
caauacaaauacug

SEQ ID NO: 723811 - RNA, 21 nt, Haemophilus influenzae Rd
caauaauuucauuguuaaaua

SEQ ID NO: 723812 - RNA, 18 nt, Haemophilus influenzae Rd
caauacacauuucuucua

SEQ ID NO: 723813 - RNA, 14 nt, Haemophilus influenzae Rd
caauaauuugccaa

SEQ ID NO: 723814 - RNA, 21 nt, Haemophilus influenzae Rd
caauaauaggcgaaucaaaau

SEQ ID NO: 723815 - RNA, 20 nt, Haemophilus influenzae Rd
caauaagugcgguaaaaaaa

SEQ ID NO: 723816 - RNA, 22 nt, Haemophilus influenzae Rd
caauaagugcgguaaaaaaaug

SEQ ID NO: 723817 - RNA, 15 nt, Haemophilus influenzae Rd
caauaaggcuuuuuu

SEQ ID NO: 723818 - RNA, 23 nt, Haemophilus influenzae Rd
caauaaagagaaagugcaacuau

SEQ ID NO: 723819 - RNA, 23 nt, Haemophilus influenzae Rd
caauaagcucgccuuuuucaaag

SEQ ID NO: 723820 - RNA, 11 nt, Haemophilus influenzae Rd
caauaaaaagu

SEQ ID NO: 723821 - RNA, 16 nt, Haemophilus influenzae Rd
caauaaaaauauauuu

SEQ ID NO: 723822 - RNA, 23 nt, Haemophilus influenzae Rd
caauaaaacacaacauagcugaa

SEQ ID NO: 723823 - RNA, 13 nt, Haemophilus influenzae Rd
caauaaaagcaau

SEQ ID NO: 723824 - RNA, 13 nt, Haemophilus influenzae Rd
caauaaaauguua

SEQ ID NO: 723825 - RNA, 19 nt, Haemophilus influenzae Rd
caauaaacccgaaauauaa

SEQ ID NO: 723826 - RNA, 11 nt, Haemophilus influenzae Rd
caauaaacauu

SEQ ID NO: 723827 - RNA, 13 nt, Haemophilus influenzae Rd
caauaaacagaaa

SEQ ID NO: 723828 - RNA, 16 nt, Haemophilus influenzae Rd
caauaaacagaaauau

SEQ ID NO: 723829 - RNA, 19 nt, Haemophilus influenzae Rd
caauaaacagaaauauugu

SEQ ID NO: 723830 - RNA, 17 nt, Haemophilus influenzae Rd
caaguucauauaaauaa

SEQ ID NO: 723831 - RNA, 14 nt, Haemophilus influenzae Rd
caaguuaaaaaaug

SEQ ID NO: 723832 - RNA, 19 nt, Haemophilus influenzae Rd
caaguuaaaaaaugauuaa

SEQ ID NO: 723833 - RNA, 23 nt, Haemophilus influenzae Rd
caaguuaauccuaaauuaugcuc

SEQ ID NO: 723834 - RNA, 19 nt, Haemophilus influenzae Rd
caaguuugcaauaaagcuu

SEQ ID NO: 723835 - RNA, 19 nt, Haemophilus influenzae Rd
caaguuuuaccuucaguuu

SEQ ID NO: 723836 - RNA, 13 nt, Haemophilus influenzae Rd
caauaaaaaaaca

SEQ ID NO: 723837 - RNA, 13 nt, Haemophilus influenzae Rd
caauaaaaaaacu

SEQ ID NO: 723838 - RNA, 21 nt, Haemophilus influenzae Rd
caaguuuuauuugagaaaaau

SEQ ID NO: 723839 - RNA, 20 nt, Haemophilus influenzae Rd
caaggagcuaguuuaguuua

SEQ ID NO: 723840 - RNA, 16 nt, Haemophilus influenzae Rd
caagcuggcuaacaaa

SEQ ID NO: 723841 - RNA, 22 nt, Haemophilus influenzae Rd
caagcuuauguaaauuuaucug

SEQ ID NO: 723842 - RNA, 15 nt, Haemophilus influenzae Rd
caagucagcucaagc

SEQ ID NO: 723843 - RNA, 13 nt, Haemophilus influenzae Rd
caagucaaaaacc

SEQ ID NO: 723844 - RNA, 14 nt, Haemophilus influenzae Rd
caaguauaaaaaau

SEQ ID NO: 723845 - RNA, 15 nt, Haemophilus influenzae Rd
caaguauaaaaaauc

SEQ ID NO: 723846 - RNA, 23 nt, Haemophilus influenzae Rd
caagucuuuuuuuguugguugag

SEQ ID NO: 723847 - RNA, 12 nt, Haemophilus influenzae Rd
caagugaaauuc

SEQ ID NO: 723848 - RNA, 16 nt, Haemophilus influenzae Rd
caaguccccauuugua

SEQ ID NO: 723849 - RNA, 19 nt, Haemophilus influenzae Rd
caaguccccauuuguagaa

SEQ ID NO: 723850 - RNA, 20 nt, Haemophilus influenzae Rd
caagugcgaucgcuccacca

SEQ ID NO: 723851 - RNA, 20 nt, Haemophilus influenzae Rd
caagugcgccaccuuuugua

SEQ ID NO: 723852 - RNA, 23 nt, Haemophilus influenzae Rd
caagugcgccaccuuuuguagaa

SEQ ID NO: 723853 - RNA, 13 nt, Haemophilus influenzae Rd
caagugauuauuu

SEQ ID NO: 723854 - RNA, 23 nt, Haemophilus influenzae Rd
caagugcuagugguccugucagu

SEQ ID NO: 723855 - RNA, 18 nt, Haemophilus influenzae Rd
caaguggcgguaaaaaug

SEQ ID NO: 723856 - RNA, 13 nt, Haemophilus influenzae Rd
caagugguaaaau

SEQ ID NO: 723857 - RNA, 22 nt, Haemophilus influenzae Rd
caaucacaaaauggcaaacaaa

SEQ ID NO: 723858 - RNA, 15 nt, Haemophilus influenzae Rd
caaucacaacacaau

SEQ ID NO: 723859 - RNA, 20 nt, Haemophilus influenzae Rd
caaucaagaauuccauugca

SEQ ID NO: 723860 - RNA, 15 nt, Haemophilus influenzae Rd
caaucaauucuuuca

SEQ ID NO: 723861 - RNA, 12 nt, Haemophilus influenzae Rd
caaucacaauga

SEQ ID NO: 723862 - RNA, 21 nt, Haemophilus influenzae Rd
caaucacuagccauaaauaaa

SEQ ID NO: 723863 - RNA, 16 nt, Haemophilus influenzae Rd
caaucaacacaccuau

SEQ ID NO: 723864 - RNA, 15 nt, Haemophilus influenzae Rd
caaucaaauucaaca

SEQ ID NO: 723865 - RNA, 13 nt, Haemophilus influenzae Rd
caaucaaauaaag

SEQ ID NO: 723866 - RNA, 12 nt, Haemophilus influenzae Rd
caaucaaaaaau

SEQ ID NO: 723867 - RNA, 13 nt, Haemophilus influenzae Rd
caaucaaaaaauc

SEQ ID NO: 723868 - RNA, 22 nt, Haemophilus influenzae Rd
caaucaaaaaugaaagggaaau

SEQ ID NO: 723869 - RNA, 21 nt, Haemophilus influenzae Rd
caauauuugguugaacuucua

SEQ ID NO: 723870 - RNA, 23 nt, Haemophilus influenzae Rd
caauauauaaauccguaaaauac

SEQ ID NO: 723871 - RNA, 16 nt, Haemophilus influenzae Rd
caauauaucagacaau

SEQ ID NO: 723872 - RNA, 21 nt, Haemophilus influenzae Rd
caauauaucagacaaucugug

SEQ ID NO: 723873 - RNA, 15 nt, Haemophilus influenzae Rd
caauauauucggaaa

SEQ ID NO: 723874 - RNA, 18 nt, Haemophilus influenzae Rd
caauauauucggaaaaaa

SEQ ID NO: 723875 - RNA, 20 nt, Haemophilus influenzae Rd
caauauauucggaaaaaauu

SEQ ID NO: 723876 - RNA, 16 nt, Haemophilus influenzae Rd
caauaucuaagaaaau

SEQ ID NO: 723877 - RNA, 19 nt, Haemophilus influenzae Rd
caauaucuaagauuuuagu

SEQ ID NO: 723878 - RNA, 20 nt, Haemophilus influenzae Rd
caauaucucgugaugcagaa

SEQ ID NO: 723879 - RNA, 22 nt, Haemophilus influenzae Rd
caauaucugcacguaaaguugg

SEQ ID NO: 723880 - RNA, 19 nt, Haemophilus influenzae Rd
caauacgccaacgcuuaau

SEQ ID NO: 723881 - RNA, 16 nt, Haemophilus influenzae Rd
caauacguugaguaua

SEQ ID NO: 723882 - RNA, 15 nt, Haemophilus influenzae Rd
caauacgccuaaaac

SEQ ID NO: 723883 - RNA, 21 nt, Haemophilus influenzae Rd
caauauaggcuauauuuucca

SEQ ID NO: 723884 - RNA, 17 nt, Haemophilus influenzae Rd
caauauagucaaauaac

SEQ ID NO: 723885 - RNA, 13 nt, Haemophilus influenzae Rd
caaucuaaacaca

SEQ ID NO: 723886 - RNA, 17 nt, Haemophilus influenzae Rd
caauccuuuacgggauu

SEQ ID NO: 723887 - RNA, 15 nt, Haemophilus influenzae Rd
caaucgccaauguuu

SEQ ID NO: 723888 - RNA, 15 nt, Haemophilus influenzae Rd
caaucgcaucauuca

SEQ ID NO: 723889 - RNA, 13 nt, Haemophilus influenzae Rd
caaucagcaacau

SEQ ID NO: 723890 - RNA, 19 nt, Haemophilus influenzae Rd
caaucacuuuaucuaaagu

SEQ ID NO: 723891 - RNA, 20 nt, Haemophilus influenzae Rd
caaucacuguaucuuuuugu

SEQ ID NO: 723892 - RNA, 17 nt, Haemophilus influenzae Rd
caauccagauuaaaaau

SEQ ID NO: 723893 - RNA, 15 nt, Haemophilus influenzae Rd
caauccauaaaauac

SEQ ID NO: 723894 - RNA, 16 nt, Haemophilus influenzae Rd
caauccauaaaauaca

SEQ ID NO: 723895 - RNA, 16 nt, Haemophilus influenzae Rd
caaucauaaaaacaau

SEQ ID NO: 723896 - RNA, 18 nt, Haemophilus influenzae Rd
caaucauacuaaauacau

SEQ ID NO: 723897 - RNA, 13 nt, Haemophilus influenzae Rd
caaucaguuuuac

SEQ ID NO: 723898 - RNA, 16 nt, Haemophilus influenzae Rd
caaucaguuuuacgcu

SEQ ID NO: 723899 - RNA, 17 nt, Haemophilus influenzae Rd
caacuuccgcuaauacu

SEQ ID NO: 723900 - RNA, 18 nt, Haemophilus influenzae Rd
caacuuccgcuaauacua

SEQ ID NO: 723901 - RNA, 22 nt, Haemophilus influenzae Rd
caagaaugacuggcuugugaaa

SEQ ID NO: 723902 - RNA, 14 nt, Haemophilus influenzae Rd
caagauaauaaagu

SEQ ID NO: 723903 - RNA, 23 nt, Haemophilus influenzae Rd
caagauaacugauuguccaaaga

SEQ ID NO: 723904 - RNA, 15 nt, Haemophilus influenzae Rd
caagaucaagcacuu

SEQ ID NO: 723905 - RNA, 22 nt, Haemophilus influenzae Rd
caagaucaagcacuuuuccuuu

SEQ ID NO: 723906 - RNA, 18 nt, Haemophilus influenzae Rd
caagagaggcaccugaau

SEQ ID NO: 723907 - RNA, 17 nt, Haemophilus influenzae Rd
caagaugugauauuaaa

SEQ ID NO: 723908 - RNA, 16 nt, Haemophilus influenzae Rd
caagaugacugcaauu

SEQ ID NO: 723909 - RNA, 23 nt, Haemophilus influenzae Rd
caagcaguuuacgguuaagucau

SEQ ID NO: 723910 - RNA, 13 nt, Haemophilus influenzae Rd
caagcauuuugaa

SEQ ID NO: 723911 - RNA, 14 nt, Haemophilus influenzae Rd
caagcauuuuucau

SEQ ID NO: 723912 - RNA, 18 nt, Haemophilus influenzae Rd
caagcauuuuucauacaa

SEQ ID NO: 723913 - RNA, 21 nt, Haemophilus influenzae Rd
caagcauuuuucauacaaucu

SEQ ID NO: 723914 - RNA, 16 nt, Haemophilus influenzae Rd
caagccaaguuguaaa

SEQ ID NO: 723915 - RNA, 19 nt, Haemophilus influenzae Rd
caagcugaccacuuucaau

SEQ ID NO: 723916 - RNA, 22 nt, Haemophilus influenzae Rd
caagcuaccuuguggcaguaaa

SEQ ID NO: 723917 - RNA, 17 nt, Haemophilus influenzae Rd
caagccuucuaaaauaa

SEQ ID NO: 723918 - RNA, 14 nt, Haemophilus influenzae Rd
caagcgauuuuuau

SEQ ID NO: 723919 - RNA, 19 nt, Haemophilus influenzae Rd
caacuggagccuugggaau

SEQ ID NO: 723920 - RNA, 17 nt, Haemophilus influenzae Rd
caacucauuacacaaaa

SEQ ID NO: 723921 - RNA, 18 nt, Haemophilus influenzae Rd
caacucauuacacaaaau

SEQ ID NO: 723922 - RNA, 14 nt, Haemophilus influenzae Rd
caacguaaaaguaa

SEQ ID NO: 723923 - RNA, 15 nt, Haemophilus influenzae Rd
caaccguaauaauug

SEQ ID NO: 723924 - RNA, 21 nt, Haemophilus influenzae Rd
caaccguagucacaacaauua

SEQ ID NO: 723925 - RNA, 14 nt, Haemophilus influenzae Rd
caaccguugcauug

SEQ ID NO: 723926 - RNA, 16 nt, Haemophilus influenzae Rd
caaauucuaaaacaaa

SEQ ID NO: 723927 - RNA, 13 nt, Haemophilus influenzae Rd
caaauugcuaaug

SEQ ID NO: 723928 - RNA, 14 nt, Haemophilus influenzae Rd
caaauuuaaaaaag

SEQ ID NO: 723929 - RNA, 13 nt, Haemophilus influenzae Rd
caaauuuaaauaa

SEQ ID NO: 723930 - RNA, 18 nt, Haemophilus influenzae Rd
caaauuuaauauuucuuc

SEQ ID NO: 723931 - RNA, 12 nt, Haemophilus influenzae Rd
caaauuucuugc

SEQ ID NO: 723932 - RNA, 10 nt, Haemophilus influenzae Rd
caacaaaaau

SEQ ID NO: 723933 - RNA, 19 nt, Haemophilus influenzae Rd
caaauuucuccguuagcaa

SEQ ID NO: 723934 - RNA, 17 nt, Haemophilus influenzae Rd
caaauuuagauaacaau

SEQ ID NO: 723935 - RNA, 19 nt, Haemophilus influenzae Rd
caaauucgccauauauaaa

SEQ ID NO: 723936 - RNA, 12 nt, Haemophilus influenzae Rd
caaauuccauuc

SEQ ID NO: 723937 - RNA, 19 nt, Haemophilus influenzae Rd
caaauuccauucacuuuca

SEQ ID NO: 723938 - RNA, 15 nt, Haemophilus influenzae Rd
caaauucauucuugc

SEQ ID NO: 723939 - RNA, 17 nt, Haemophilus influenzae Rd
caaauucauucuugcuu

SEQ ID NO: 723940 - RNA, 14 nt, Haemophilus influenzae Rd
caaauuaaccgcac

SEQ ID NO: 723941 - RNA, 13 nt, Haemophilus influenzae Rd
caaauuaauaaga

SEQ ID NO: 723942 - RNA, 21 nt, Haemophilus influenzae Rd
caaauuaauaagaaaaucaaa

SEQ ID NO: 723943 - RNA, 17 nt, Haemophilus influenzae Rd
caaaucguaauuaaaau

SEQ ID NO: 723944 - RNA, 13 nt, Haemophilus influenzae Rd
caaaucuaaaaau

SEQ ID NO: 723945 - RNA, 18 nt, Haemophilus influenzae Rd
caaaucuaaaaauaugua

SEQ ID NO: 723946 - RNA, 14 nt, Haemophilus influenzae Rd
caaaucuaaugccu

SEQ ID NO: 723947 - RNA, 17 nt, Haemophilus influenzae Rd
caaaucuacuaaaauaa

SEQ ID NO: 723948 - RNA, 18 nt, Haemophilus influenzae Rd
caaaucuacuaaaauaag

SEQ ID NO: 723949 - RNA, 21 nt, Haemophilus influenzae Rd
caaaucuucauuuucaaccac

SEQ ID NO: 723950 - RNA, 14 nt, Haemophilus influenzae Rd
caaaugaaauguuu

SEQ ID NO: 723951 - RNA, 14 nt, Haemophilus influenzae Rd
caaaugguguuuua

SEQ ID NO: 723952 - RNA, 13 nt, Haemophilus influenzae Rd
caaaugcaacaau

SEQ ID NO: 723953 - RNA, 15 nt, Haemophilus influenzae Rd
caaaugcaacaauaa

SEQ ID NO: 723954 - RNA, 18 nt, Haemophilus influenzae Rd
caaaugcacauaacaaaa

SEQ ID NO: 723955 - RNA, 19 nt, Haemophilus influenzae Rd
caaaugcacauaacaaaau

SEQ ID NO: 723956 - RNA, 21 nt, Haemophilus influenzae Rd
caaaugaagugcgguugaaau

SEQ ID NO: 723957 - RNA, 14 nt, Haemophilus influenzae Rd
caaaugaggaaaau

SEQ ID NO: 723958 - RNA, 16 nt, Haemophilus influenzae Rd
caaaugaggaaaauaa

SEQ ID NO: 723959 - RNA, 20 nt, Haemophilus influenzae Rd
caaauccauaaggaaauugc

SEQ ID NO: 723960 - RNA, 17 nt, Haemophilus influenzae Rd
caaaucacacguucauu

SEQ ID NO: 723961 - RNA, 14 nt, Haemophilus influenzae Rd
caaauccuacaaca

SEQ ID NO: 723962 - RNA, 18 nt, Haemophilus influenzae Rd
caaaucgagguuuuccac

SEQ ID NO: 723963 - RNA, 23 nt, Haemophilus influenzae Rd
caaaucgaucacuuaauaaaaau

SEQ ID NO: 723964 - RNA, 14 nt, Haemophilus influenzae Rd
caaaucaaauuuuc

SEQ ID NO: 723965 - RNA, 15 nt, Haemophilus influenzae Rd
caaaucaaaaagcua

SEQ ID NO: 723966 - RNA, 19 nt, Haemophilus influenzae Rd
caaaucaaaaccuuucugu

SEQ ID NO: 723967 - RNA, 21 nt, Haemophilus influenzae Rd
caaauaugaacuuguucguca

SEQ ID NO: 723968 - RNA, 15 nt, Haemophilus influenzae Rd
caaauauucuucuaa

SEQ ID NO: 723969 - RNA, 15 nt, Haemophilus influenzae Rd
caaauaucaaaaaaa

SEQ ID NO: 723970 - RNA, 16 nt, Haemophilus influenzae Rd
caaauaucaaaaaaau

SEQ ID NO: 723971 - RNA, 15 nt, Haemophilus influenzae Rd
caaauauaaaauaaa

SEQ ID NO: 723972 - RNA, 19 nt, Haemophilus influenzae Rd
caaauauaaaauaaaauuc

SEQ ID NO: 723973 - RNA, 17 nt, Haemophilus influenzae Rd
caaagucuucaucuuua

SEQ ID NO: 723974 - RNA, 19 nt, Haemophilus influenzae Rd
caaagucgguuuuuaauuc

SEQ ID NO: 723975 - RNA, 21 nt, Haemophilus influenzae Rd
caaagucgguuuuuaauucag

SEQ ID NO: 723976 - RNA, 23 nt, Haemophilus influenzae Rd
caaccauauuaaucgcaauaaca

SEQ ID NO: 723977 - RNA, 15 nt, Haemophilus influenzae Rd
caaccauaacaagaa

SEQ ID NO: 723978 - RNA, 15 nt, Haemophilus influenzae Rd
caaccaucuucaacg

SEQ ID NO: 723979 - RNA, 15 nt, Haemophilus influenzae Rd
caaccauuacguaau

SEQ ID NO: 723980 - RNA, 14 nt, Haemophilus influenzae Rd
caaccauucgccua

SEQ ID NO: 723981 - RNA, 19 nt, Haemophilus influenzae Rd
caacauuucacuaaauaaa

SEQ ID NO: 723982 - RNA, 16 nt, Haemophilus influenzae Rd
caacaccgcaaaaaua

SEQ ID NO: 723983 - RNA, 20 nt, Haemophilus influenzae Rd
caacaccgcaaaaauacuaa

SEQ ID NO: 723984 - RNA, 18 nt, Haemophilus influenzae Rd
caacaaagucaauacaca

SEQ ID NO: 723985 - RNA, 20 nt, Haemophilus influenzae Rd
caacaaaauaaacacuccaa

SEQ ID NO: 723986 - RNA, 14 nt, Haemophilus influenzae Rd
caacaaauuuaaau

SEQ ID NO: 723987 - RNA, 19 nt, Haemophilus influenzae Rd
caacaacaaagucuucauc

SEQ ID NO: 723988 - RNA, 12 nt, Haemophilus influenzae Rd
caacaucuucua

SEQ ID NO: 723989 - RNA, 13 nt, Haemophilus influenzae Rd
caacaucaauaac

SEQ ID NO: 723990 - RNA, 20 nt, Haemophilus influenzae Rd
caacaucagauggaauauuu

SEQ ID NO: 723991 - RNA, 12 nt, Haemophilus influenzae Rd
caacagcgaaau

SEQ ID NO: 723992 - RNA, 17 nt, Haemophilus influenzae Rd
caacaguaaauuuuucc

SEQ ID NO: 723993 - RNA, 18 nt, Haemophilus influenzae Rd
caaaccaaaucacaauaa

SEQ ID NO: 723994 - RNA, 12 nt, Haemophilus influenzae Rd
caaaccaauaaa

SEQ ID NO: 723995 - RNA, 15 nt, Haemophilus influenzae Rd
caaacauuuuuauuu

SEQ ID NO: 723996 - RNA, 15 nt, Haemophilus influenzae Rd
caaacaaauuuuuac

SEQ ID NO: 723997 - RNA, 17 nt, Haemophilus influenzae Rd
caaacaaauuuuuacag

SEQ ID NO: 723998 - RNA, 13 nt, Haemophilus influenzae Rd
caaacaaaauaaa

SEQ ID NO: 723999 - RNA, 22 nt, Haemophilus influenzae Rd
caaaauucuacgccauuuucua

SEQ ID NO: 724000 - RNA, 16 nt, Haemophilus influenzae Rd
caaaccagccugaaaa

SEQ ID NO: 724001 - RNA, 13 nt, Haemophilus influenzae Rd
caaaccauuuauc

SEQ ID NO: 724002 - RNA, 13 nt, Haemophilus influenzae Rd
caaaccaucucga

SEQ ID NO: 724003 - RNA, 18 nt, Haemophilus influenzae Rd
caaaccgucagugcuuuc

SEQ ID NO: 724004 - RNA, 15 nt, Haemophilus influenzae Rd
caaacuuggaucaua

SEQ ID NO: 724005 - RNA, 17 nt, Haemophilus influenzae Rd
caaacugguuaaaaucc

SEQ ID NO: 724006 - RNA, 18 nt, Haemophilus influenzae Rd
caaacugguuaaaaucca

SEQ ID NO: 724007 - RNA, 20 nt, Haemophilus influenzae Rd
caaacggucgaguuuuucaa

SEQ ID NO: 724008 - RNA, 13 nt, Haemophilus influenzae Rd
caaacggaaaauu

SEQ ID NO: 724009 - RNA, 17 nt, Haemophilus influenzae Rd
caaacggaaaauuugau

SEQ ID NO: 724010 - RNA, 17 nt, Haemophilus influenzae Rd
caaacgaaaaaaauaaa

SEQ ID NO: 724011 - RNA, 21 nt, Haemophilus influenzae Rd
caaacgaaaaaaauaaaaaau

SEQ ID NO: 724012 - RNA, 14 nt, Haemophilus influenzae Rd
caaacuuucugcaa

SEQ ID NO: 724013 - RNA, 13 nt, Haemophilus influenzae Rd
caaagaaaaacua

SEQ ID NO: 724014 - RNA, 20 nt, Haemophilus influenzae Rd
caaagaauacaccccaaaau

SEQ ID NO: 724015 - RNA, 18 nt, Haemophilus influenzae Rd
caaagaauugaucaaaau

SEQ ID NO: 724016 - RNA, 21 nt, Haemophilus influenzae Rd
caaagacagcuauuaaaaaaa

SEQ ID NO: 724017 - RNA, 15 nt, Haemophilus influenzae Rd
caaagacuaaaacca

SEQ ID NO: 724018 - RNA, 18 nt, Haemophilus influenzae Rd
caaagacuaaaaccacau

SEQ ID NO: 724019 - RNA, 16 nt, Haemophilus influenzae Rd
caaagauggauauuuc

SEQ ID NO: 724020 - RNA, 21 nt, Haemophilus influenzae Rd
caaaggcucuaccuaaaauaa

SEQ ID NO: 724021 - RNA, 23 nt, Haemophilus influenzae Rd
caaaggcucuaccuaaaauaaau

SEQ ID NO: 724022 - RNA, 20 nt, Haemophilus influenzae Rd
caaaggcuuucgcaaguugu

SEQ ID NO: 724023 - RNA, 15 nt, Haemophilus influenzae Rd
caaagauugcauuga

SEQ ID NO: 724024 - RNA, 21 nt, Haemophilus influenzae Rd
caaagauuuuaaaauuuauuu

SEQ ID NO: 724025 - RNA, 14 nt, Haemophilus influenzae Rd
caaagccugcuaca

SEQ ID NO: 724026 - RNA, 17 nt, Haemophilus influenzae Rd
caaagccuucaccuaau

SEQ ID NO: 724027 - RNA, 15 nt, Haemophilus influenzae Rd
caaaagguaaaaauu

SEQ ID NO: 724028 - RNA, 16 nt, Haemophilus influenzae Rd
caaaaggcagcaagac

SEQ ID NO: 724029 - RNA, 21 nt, Haemophilus influenzae Rd
caaaagcuggauuaaauaacc

SEQ ID NO: 724030 - RNA, 13 nt, Haemophilus influenzae Rd
caaaagccaccau

SEQ ID NO: 724031 - RNA, 22 nt, Haemophilus influenzae Rd
caaaauaauauccaaaauguuc

SEQ ID NO: 724032 - RNA, 20 nt, Haemophilus influenzae Rd
caaaauaaucaggauauuuu

SEQ ID NO: 724033 - RNA, 13 nt, Haemophilus influenzae Rd
caaaauacaauca

SEQ ID NO: 724034 - RNA, 23 nt, Haemophilus influenzae Rd
caaaauacaaucacgaucugcaa

SEQ ID NO: 724035 - RNA, 14 nt, Haemophilus influenzae Rd
caaaaguauaaacu

SEQ ID NO: 724036 - RNA, 15 nt, Haemophilus influenzae Rd
caaaaguaagcaaau

SEQ ID NO: 724037 - RNA, 19 nt, Haemophilus influenzae Rd
caaaaggucuuaauagcau

SEQ ID NO: 724038 - RNA, 15 nt, Haemophilus influenzae Rd
caaaauaguaaaaau

SEQ ID NO: 724039 - RNA, 16 nt, Haemophilus influenzae Rd
caaaauaguaaaaauu

SEQ ID NO: 724040 - RNA, 21 nt, Haemophilus influenzae Rd
caaaauagaccgcuauuuuua

SEQ ID NO: 724041 - RNA, 23 nt, Haemophilus influenzae Rd
caaaaucguaauuuuaaaaccac

SEQ ID NO: 724042 - RNA, 14 nt, Haemophilus influenzae Rd
caaaaucuugcuga

SEQ ID NO: 724043 - RNA, 18 nt, Haemophilus influenzae Rd
caaaaucucuggagaaaa

SEQ ID NO: 724044 - RNA, 22 nt, Haemophilus influenzae Rd
caaaaugucgccauuuaagccu

SEQ ID NO: 724045 - RNA, 17 nt, Haemophilus influenzae Rd
caaaaugucgcuuucuu

SEQ ID NO: 724046 - RNA, 21 nt, Haemophilus influenzae Rd
caaaauuaaauugaaaaaauc

SEQ ID NO: 724047 - RNA, 17 nt, Haemophilus influenzae Rd
caaaauguucacugcgg

SEQ ID NO: 724048 - RNA, 18 nt, Haemophilus influenzae Rd
caaaaccuagaaauuuug

SEQ ID NO: 724049 - RNA, 19 nt, Haemophilus influenzae Rd
caaaaagcaccuaaaaauu

SEQ ID NO: 724050 - RNA, 22 nt, Haemophilus influenzae Rd
caaaaagaacggucaaaaugca

SEQ ID NO: 724051 - RNA, 13 nt, Haemophilus influenzae Rd
caaaacuaaaaaa

SEQ ID NO: 724052 - RNA, 20 nt, Haemophilus influenzae Rd
caaaacuagucauauugauu

SEQ ID NO: 724053 - RNA, 14 nt, Haemophilus influenzae Rd
caaaacuaucaaaa

SEQ ID NO: 724054 - RNA, 15 nt, Haemophilus influenzae Rd
caaaacuaucaaaau

SEQ ID NO: 724055 - RNA, 16 nt, Haemophilus influenzae Rd
caaaacuaucaaaauc

SEQ ID NO: 724056 - RNA, 21 nt, Haemophilus influenzae Rd
caaaacuuuuuccuucugcca

SEQ ID NO: 724057 - RNA, 13 nt, Haemophilus influenzae Rd
caaaagaaagacu

SEQ ID NO: 724058 - RNA, 15 nt, Haemophilus influenzae Rd
caaaagaaagacuuu

SEQ ID NO: 724059 - RNA, 11 nt, Haemophilus influenzae Rd
caaaagaaaag

SEQ ID NO: 724060 - RNA, 14 nt, Haemophilus influenzae Rd
caaaagaaaagaug

SEQ ID NO: 724061 - RNA, 15 nt, Haemophilus influenzae Rd
caaaagaaaagauga

SEQ ID NO: 724062 - RNA, 17 nt, Haemophilus influenzae Rd
caaaacuuaucauuaau

SEQ ID NO: 724063 - RNA, 20 nt, Haemophilus influenzae Rd
caaaagaucaggaucaaaaa

SEQ ID NO: 724064 - RNA, 22 nt, Haemophilus influenzae Rd
caaaagaucaggaucaaaaaua

SEQ ID NO: 724065 - RNA, 16 nt, Haemophilus influenzae Rd
caaaagacgaagaaac

SEQ ID NO: 724066 - RNA, 23 nt, Haemophilus influenzae Rd
caaaagcaaaugaggaaaauaaa

SEQ ID NO: 724067 - RNA, 17 nt, Haemophilus influenzae Rd
caaaagagcgguugaaa

SEQ ID NO: 724068 - RNA, 17 nt, Haemophilus influenzae Rd
caaaagaauuaaaaaug

SEQ ID NO: 724069 - RNA, 19 nt, Haemophilus influenzae Rd
caaaagaauuaaaaauggc

SEQ ID NO: 724070 - RNA, 13 nt, Haemophilus influenzae Rd
aucaugaaaugca

SEQ ID NO: 724071 - RNA, 17 nt, Haemophilus influenzae Rd
aucaugaaaugcagauc

SEQ ID NO: 724072 - RNA, 18 nt, Haemophilus influenzae Rd
aucaugagguuugccauc

SEQ ID NO: 724073 - RNA, 16 nt, Haemophilus influenzae Rd
aucaucuauaccaauu

SEQ ID NO: 724074 - RNA, 20 nt, Haemophilus influenzae Rd
aucaucucuaaccuaaaaua

SEQ ID NO: 724075 - RNA, 21 nt, Haemophilus influenzae Rd
aucaucuaguuuuaauacuaa

SEQ ID NO: 724076 - RNA, 15 nt, Haemophilus influenzae Rd
aucaucuguaaacca

SEQ ID NO: 724077 - RNA, 23 nt, Haemophilus influenzae Rd
aucaucuuaucuagacuuucuug

SEQ ID NO: 724078 - RNA, 22 nt, Haemophilus influenzae Rd
aucaucuggcauaucugcugcu

SEQ ID NO: 724079 - RNA, 19 nt, Haemophilus influenzae Rd
aucaucggcaguacgaauu

SEQ ID NO: 724080 - RNA, 17 nt, Haemophilus influenzae Rd
aucaucgcgaugacuaa

SEQ ID NO: 724081 - RNA, 13 nt, Haemophilus influenzae Rd
aaaacuauuuuua

SEQ ID NO: 724082 - RNA, 14 nt, Haemophilus influenzae Rd
aaaacuauuuuuaa

SEQ ID NO: 724083 - RNA, 20 nt, Haemophilus influenzae Rd
aaaacuauuaucuacuagcc

SEQ ID NO: 724084 - RNA, 12 nt, Haemophilus influenzae Rd
aaaacuaucaaa

SEQ ID NO: 724085 - RNA, 13 nt, Haemophilus influenzae Rd
aaaacuauaaaaa

SEQ ID NO: 724086 - RNA, 15 nt, Haemophilus influenzae Rd
aaaacuauaaaaauu

SEQ ID NO: 724087 - RNA, 18 nt, Haemophilus influenzae Rd
aucauaauccacuaaaaa

SEQ ID NO: 724088 - RNA, 18 nt, Haemophilus influenzae Rd
aucauaaucgccaaaauc

SEQ ID NO: 724089 - RNA, 19 nt, Haemophilus influenzae Rd
aucauaccaauugcaacuu

SEQ ID NO: 724090 - RNA, 20 nt, Haemophilus influenzae Rd
aucauaccaauugcaacuuc

SEQ ID NO: 724091 - RNA, 14 nt, Haemophilus influenzae Rd
aucauacuaaaaaa

SEQ ID NO: 724092 - RNA, 22 nt, Haemophilus influenzae Rd
aucauacuauuacccacuucac

SEQ ID NO: 724093 - RNA, 21 nt, Haemophilus influenzae Rd
aaaacguucuaagaauuuuuu

SEQ ID NO: 724094 - RNA, 15 nt, Haemophilus influenzae Rd
aucaugguaauuuaa

SEQ ID NO: 724095 - RNA, 24 nt, Haemophilus influenzae Rd
aaaacucuucguugguuuucgcca

SEQ ID NO: 724096 - RNA, 23 nt, Haemophilus influenzae Rd
aaaacucgacuuuugcauuugcu

SEQ ID NO: 724097 - RNA, 16 nt, Haemophilus influenzae Rd
aaaagaaccuaucuca

SEQ ID NO: 724098 - RNA, 17 nt, Haemophilus influenzae Rd
aaaagaacggucaaaau

SEQ ID NO: 724099 - RNA, 21 nt, Haemophilus influenzae Rd
aaaacuguauuucgucuuaau

SEQ ID NO: 724100 - RNA, 13 nt, Haemophilus influenzae Rd
aaaagaauaauau

SEQ ID NO: 724101 - RNA, 20 nt, Haemophilus influenzae Rd
aaaagaauaauauuaaagaa

SEQ ID NO: 724102 - RNA, 12 nt, Haemophilus influenzae Rd
aaaagaauauuc

SEQ ID NO: 724103 - RNA, 17 nt, Haemophilus influenzae Rd
aucauuccgcccauucc

SEQ ID NO: 724104 - RNA, 18 nt, Haemophilus influenzae Rd
aucauuccgcccauucca

SEQ ID NO: 724105 - RNA, 22 nt, Haemophilus influenzae Rd
aucauucugguaauuugcucaa

SEQ ID NO: 724106 - RNA, 17 nt, Haemophilus influenzae Rd
aucauugacuuuuggca

SEQ ID NO: 724107 - RNA, 15 nt, Haemophilus influenzae Rd
aucauugcaagugca

SEQ ID NO: 724108 - RNA, 15 nt, Haemophilus influenzae Rd
auccacuaaaaaacu

SEQ ID NO: 724109 - RNA, 21 nt, Haemophilus influenzae Rd
auccacuaauuccgcaccugc

SEQ ID NO: 724110 - RNA, 21 nt, Haemophilus influenzae Rd
auccacuacuaacguuucuaa

SEQ ID NO: 724111 - RNA, 17 nt, Haemophilus influenzae Rd
auccacgguauuuucuu

SEQ ID NO: 724112 - RNA, 16 nt, Haemophilus influenzae Rd
auccagauuaaaaauu

SEQ ID NO: 724113 - RNA, 14 nt, Haemophilus influenzae Rd
auccacaugauaua

SEQ ID NO: 724114 - RNA, 12 nt, Haemophilus influenzae Rd
auccacaaaaaa

SEQ ID NO: 724115 - RNA, 21 nt, Haemophilus influenzae Rd
auccacaaucaaucuuuaaaa

SEQ ID NO: 724116 - RNA, 13 nt, Haemophilus influenzae Rd
auccaauuucaca

SEQ ID NO: 724117 - RNA, 17 nt, Haemophilus influenzae Rd
auccacacuucaucacu

SEQ ID NO: 724118 - RNA, 15 nt, Haemophilus influenzae Rd
auccacacuuuaaaa

SEQ ID NO: 724119 - RNA, 17 nt, Haemophilus influenzae Rd
auccacacuuuaaaagu

SEQ ID NO: 724120 - RNA, 22 nt, Haemophilus influenzae Rd
auccacacuuuaauaguaaacu

SEQ ID NO: 724121 - RNA, 23 nt, Haemophilus influenzae Rd
auccacacuuuaauaguaaacuu

SEQ ID NO: 724122 - RNA, 21 nt, Haemophilus influenzae Rd
aucauugcuaagggcaacaau

SEQ ID NO: 724123 - RNA, 19 nt, Haemophilus influenzae Rd
auccaaccccauuugccaa

SEQ ID NO: 724124 - RNA, 18 nt, Haemophilus influenzae Rd
auccaaauugagaucuuu

SEQ ID NO: 724125 - RNA, 23 nt, Haemophilus influenzae Rd
auccaaauugagaucuuugccaa

SEQ ID NO: 724126 - RNA, 21 nt, Haemophilus influenzae Rd
auccaaauuguccgccaucag

SEQ ID NO: 724127 - RNA, 22 nt, Haemophilus influenzae Rd
auccaguuggcgugcuuccauu

SEQ ID NO: 724128 - RNA, 23 nt, Haemophilus influenzae Rd
auccaguuggcgugcuuccauuu

SEQ ID NO: 724129 - RNA, 12 nt, Haemophilus influenzae Rd
auccagugcaua

SEQ ID NO: 724130 - RNA, 15 nt, Haemophilus influenzae Rd
auccaucauuuuucg

SEQ ID NO: 724131 - RNA, 12 nt, Haemophilus influenzae Rd
auccaucaaauc

SEQ ID NO: 724132 - RNA, 22 nt, Haemophilus influenzae Rd
auccaucaaauccgccaaucau

SEQ ID NO: 724133 - RNA, 13 nt, Haemophilus influenzae Rd
auccaucaagaaa

SEQ ID NO: 724134 - RNA, 17 nt, Haemophilus influenzae Rd
auccaucaauucuuccc

SEQ ID NO: 724135 - RNA, 16 nt, Haemophilus influenzae Rd
auccauaucccauugu

SEQ ID NO: 724136 - RNA, 22 nt, Haemophilus influenzae Rd
auccauaacggcaagcaaacag

SEQ ID NO: 724137 - RNA, 12 nt, Haemophilus influenzae Rd
auccauaaaaua

SEQ ID NO: 724138 - RNA, 21 nt, Haemophilus influenzae Rd
auccauaacaaccauuguuca

SEQ ID NO: 724139 - RNA, 13 nt, Haemophilus influenzae Rd
auccauacaguaa

SEQ ID NO: 724140 - RNA, 16 nt, Haemophilus influenzae Rd
auccauacaguaaaaa

SEQ ID NO: 724141 - RNA, 16 nt, Haemophilus influenzae Rd
auccaucgacauacaa

SEQ ID NO: 724142 - RNA, 19 nt, Haemophilus influenzae Rd
auccaucgacauacaaagu

SEQ ID NO: 724143 - RNA, 15 nt, Haemophilus influenzae Rd
auccaucgcaagaua

SEQ ID NO: 724144 - RNA, 16 nt, Haemophilus influenzae Rd
auccaugaugaaauaa

SEQ ID NO: 724145 - RNA, 17 nt, Haemophilus influenzae Rd
auccaugaugaaauaau

SEQ ID NO: 724146 - RNA, 13 nt, Haemophilus influenzae Rd
aucccaacuuuau

SEQ ID NO: 724147 - RNA, 20 nt, Haemophilus influenzae Rd
aucccaaauuaaauccuuuu

SEQ ID NO: 724148 - RNA, 13 nt, Haemophilus influenzae Rd
aucccaauuauug

SEQ ID NO: 724149 - RNA, 16 nt, Haemophilus influenzae Rd
auccccauucuuuucg

SEQ ID NO: 724150 - RNA, 20 nt, Haemophilus influenzae Rd
auccguaaucgugccugcca

SEQ ID NO: 724151 - RNA, 17 nt, Haemophilus influenzae Rd
auccguuaagaaacgau

SEQ ID NO: 724152 - RNA, 21 nt, Haemophilus influenzae Rd
auccuaaauaaagauuauuua

SEQ ID NO: 724153 - RNA, 17 nt, Haemophilus influenzae Rd
auccguugucacagaaa

SEQ ID NO: 724154 - RNA, 15 nt, Haemophilus influenzae Rd
auccuaacuuuucuu

SEQ ID NO: 724155 - RNA, 22 nt, Haemophilus influenzae Rd
auccuagauguaacugaaacua

SEQ ID NO: 724156 - RNA, 16 nt, Haemophilus influenzae Rd
auccuaguuuuuuccc

SEQ ID NO: 724157 - RNA, 22 nt, Haemophilus influenzae Rd
auccuauuaauuuaauucuaaa

SEQ ID NO: 724158 - RNA, 17 nt, Haemophilus influenzae Rd
auccucagcaauuucuu

SEQ ID NO: 724159 - RNA, 19 nt, Haemophilus influenzae Rd
auccucagcaauuucuuca

SEQ ID NO: 724160 - RNA, 21 nt, Haemophilus influenzae Rd
auccugaaaguagauauuucu

SEQ ID NO: 724161 - RNA, 16 nt, Haemophilus influenzae Rd
auccucuuuaaaauua

SEQ ID NO: 724162 - RNA, 13 nt, Haemophilus influenzae Rd
auccugaagauuu

SEQ ID NO: 724163 - RNA, 19 nt, Haemophilus influenzae Rd
auccucucgccaaaucuca

SEQ ID NO: 724164 - RNA, 20 nt, Haemophilus influenzae Rd
auccuucaggauaaaacaau

SEQ ID NO: 724165 - RNA, 23 nt, Haemophilus influenzae Rd
auccuucaggauaaaacaaugca

SEQ ID NO: 724166 - RNA, 16 nt, Haemophilus influenzae Rd
auccuuccaaauccau

SEQ ID NO: 724167 - RNA, 18 nt, Haemophilus influenzae Rd
auccuuccaaauccauca

SEQ ID NO: 724168 - RNA, 17 nt, Haemophilus influenzae Rd
auccugaugcagaagua

SEQ ID NO: 724169 - RNA, 19 nt, Haemophilus influenzae Rd
auccuguuguuuuuuaccu

SEQ ID NO: 724170 - RNA, 18 nt, Haemophilus influenzae Rd
aucgagaaaauuaaaaau

SEQ ID NO: 724171 - RNA, 19 nt, Haemophilus influenzae Rd
aucgagaaaauuaaaaauu

SEQ ID NO: 724172 - RNA, 14 nt, Haemophilus influenzae Rd
aucgaaaaaguucu

SEQ ID NO: 724173 - RNA, 18 nt, Haemophilus influenzae Rd
aucgccauuaaaauucac

SEQ ID NO: 724174 - RNA, 20 nt, Haemophilus influenzae Rd
aucgccauucucacgagcau

SEQ ID NO: 724175 - RNA, 12 nt, Haemophilus influenzae Rd
aucgcaggauaa

SEQ ID NO: 724176 - RNA, 21 nt, Haemophilus influenzae Rd
aucgcaggauaagaugauaaa

SEQ ID NO: 724177 - RNA, 22 nt, Haemophilus influenzae Rd
aucgcaggauaagaugauaaau

SEQ ID NO: 724178 - RNA, 14 nt, Haemophilus influenzae Rd
aucgcaaucacgaa

SEQ ID NO: 724179 - RNA, 13 nt, Haemophilus influenzae Rd
aucgcaauauuaa

SEQ ID NO: 724180 - RNA, 16 nt, Haemophilus influenzae Rd
aucgcaaggucaagau

SEQ ID NO: 724181 - RNA, 14 nt, Haemophilus influenzae Rd
aucgcacucacaau

SEQ ID NO: 724182 - RNA, 21 nt, Haemophilus influenzae Rd
aucgcagaaauagauucuucg

SEQ ID NO: 724183 - RNA, 14 nt, Haemophilus influenzae Rd
aucgcgcaaaauaa

SEQ ID NO: 724184 - RNA, 19 nt, Haemophilus influenzae Rd
aucgcuggcuaaauuuuug

SEQ ID NO: 724185 - RNA, 20 nt, Haemophilus influenzae Rd
aucgcuggcuaaauuuuugg

SEQ ID NO: 724186 - RNA, 15 nt, Haemophilus influenzae Rd
aucgucuaucuaaga

SEQ ID NO: 724187 - RNA, 22 nt, Haemophilus influenzae Rd
aucgcuucauucucuucugggu

SEQ ID NO: 724188 - RNA, 18 nt, Haemophilus influenzae Rd
aucguguacuuuucgcuc

SEQ ID NO: 724189 - RNA, 21 nt, Haemophilus influenzae Rd
aucgugucaguaacuacaacu

SEQ ID NO: 724190 - RNA, 15 nt, Haemophilus influenzae Rd
aucgugauauuucac

SEQ ID NO: 724191 - RNA, 23 nt, Haemophilus influenzae Rd
aucguguaaaaguuguuuugcuu

SEQ ID NO: 724192 - RNA, 22 nt, Haemophilus influenzae Rd
aucuaaaauaaucgguuguuuu

SEQ ID NO: 724193 - RNA, 22 nt, Haemophilus influenzae Rd
aucuaaagcgaucaucauuaaa

SEQ ID NO: 724194 - RNA, 18 nt, Haemophilus influenzae Rd
aucuaaaccccguuuuuu

SEQ ID NO: 724195 - RNA, 15 nt, Haemophilus influenzae Rd
aucuaaaccuaagca

SEQ ID NO: 724196 - RNA, 14 nt, Haemophilus influenzae Rd
aucuaaacuuucau

SEQ ID NO: 724197 - RNA, 14 nt, Haemophilus influenzae Rd
aucuaaagaaaaua

SEQ ID NO: 724198 - RNA, 20 nt, Haemophilus influenzae Rd
aucuaaaggaaucccauauu

SEQ ID NO: 724199 - RNA, 12 nt, Haemophilus influenzae Rd
aucuaaaucucu

SEQ ID NO: 724200 - RNA, 16 nt, Haemophilus influenzae Rd
aucuaacguuuauauu

SEQ ID NO: 724201 - RNA, 16 nt, Haemophilus influenzae Rd
aucuaacuaaaauagu

SEQ ID NO: 724202 - RNA, 20 nt, Haemophilus influenzae Rd
aucuaacuaaaauaguugaa

SEQ ID NO: 724203 - RNA, 22 nt, Haemophilus influenzae Rd
aucuaagaaaauagaagccaaa

SEQ ID NO: 724204 - RNA, 18 nt, Haemophilus influenzae Rd
aucguucuaaaauggcuu

SEQ ID NO: 724205 - RNA, 19 nt, Haemophilus influenzae Rd
aucuaaaaacuuuuguucu

SEQ ID NO: 724206 - RNA, 11 nt, Haemophilus influenzae Rd
aucuaaaaaac

SEQ ID NO: 724207 - RNA, 12 nt, Haemophilus influenzae Rd
aucuaaaaaacc

SEQ ID NO: 724208 - RNA, 16 nt, Haemophilus influenzae Rd
aucuaaaaaaccuugg

SEQ ID NO: 724209 - RNA, 15 nt, Haemophilus influenzae Rd
aucuaaaaaaucaau

SEQ ID NO: 724210 - RNA, 13 nt, Haemophilus influenzae Rd
aucuaacaauaga

SEQ ID NO: 724211 - RNA, 19 nt, Haemophilus influenzae Rd
aucuaagguuuuauuuuca

SEQ ID NO: 724212 - RNA, 20 nt, Haemophilus influenzae Rd
aucuaagauuuuaguauuuu

SEQ ID NO: 724213 - RNA, 18 nt, Haemophilus influenzae Rd
aucuaagccuaagccaaa

SEQ ID NO: 724214 - RNA, 23 nt, Haemophilus influenzae Rd
aucuaagcgaccugaacggucau

SEQ ID NO: 724215 - RNA, 23 nt, Haemophilus influenzae Rd
aucuaagcucauauacaucucau

SEQ ID NO: 724216 - RNA, 14 nt, Haemophilus influenzae Rd
aucuaauaaaaagu

SEQ ID NO: 724217 - RNA, 16 nt, Haemophilus influenzae Rd
aucuaauaauaagauu

SEQ ID NO: 724218 - RNA, 20 nt, Haemophilus influenzae Rd
aucuaauacgucuaauuuag

SEQ ID NO: 724219 - RNA, 15 nt, Haemophilus influenzae Rd
aucuaaucauuaaca

SEQ ID NO: 724220 - RNA, 18 nt, Haemophilus influenzae Rd
aucuaauuggacaagaaa

SEQ ID NO: 724221 - RNA, 18 nt, Haemophilus influenzae Rd
aucuacaucaguaccuuu

SEQ ID NO: 724222 - RNA, 22 nt, Haemophilus influenzae Rd
aucuacgcggauacccauugag

SEQ ID NO: 724223 - RNA, 12 nt, Haemophilus influenzae Rd
aucuaauuauuu

SEQ ID NO: 724224 - RNA, 19 nt, Haemophilus influenzae Rd
aucuaaugccgcaaauacu

SEQ ID NO: 724225 - RNA, 15 nt, Haemophilus influenzae Rd
aucuaaugccuuucc

SEQ ID NO: 724226 - RNA, 13 nt, Haemophilus influenzae Rd
aucuacuaaaaua

SEQ ID NO: 724227 - RNA, 15 nt, Haemophilus influenzae Rd
aucuacuuaauugau

SEQ ID NO: 724228 - RNA, 16 nt, Haemophilus influenzae Rd
aucuacuguggcaagu

SEQ ID NO: 724229 - RNA, 21 nt, Haemophilus influenzae Rd
aucuacuuggacauuguuguu

SEQ ID NO: 724230 - RNA, 17 nt, Haemophilus influenzae Rd
aucuacuuguguuuuag

SEQ ID NO: 724231 - RNA, 22 nt, Haemophilus influenzae Rd
aucuauuggaauggcaaaauuu

SEQ ID NO: 724232 - RNA, 20 nt, Haemophilus influenzae Rd
aucucucaaaaaucaaccgc

SEQ ID NO: 724233 - RNA, 15 nt, Haemophilus influenzae Rd
aucucuauugcuuuu

SEQ ID NO: 724234 - RNA, 16 nt, Haemophilus influenzae Rd
aucucuauugcuuuua

SEQ ID NO: 724235 - RNA, 19 nt, Haemophilus influenzae Rd
aucucuaccacagucaaau

SEQ ID NO: 724236 - RNA, 17 nt, Haemophilus influenzae Rd
aucucuaaccuaaaaua

SEQ ID NO: 724237 - RNA, 23 nt, Haemophilus influenzae Rd
aucucaacaacaucuuguuuuaa

SEQ ID NO: 724238 - RNA, 14 nt, Haemophilus influenzae Rd
aucuauuguggcuu

SEQ ID NO: 724239 - RNA, 22 nt, Haemophilus influenzae Rd
aucuauuucuuugaguaaaaaa

SEQ ID NO: 724240 - RNA, 21 nt, Haemophilus influenzae Rd
aucucccaaagaagcuuucca

SEQ ID NO: 724241 - RNA, 12 nt, Haemophilus influenzae Rd
aucugcuuuaau

SEQ ID NO: 724242 - RNA, 18 nt, Haemophilus influenzae Rd
aucugcuuuuucuugcuc

SEQ ID NO: 724243 - RNA, 17 nt, Haemophilus influenzae Rd
aucugcauucuaaaagu

SEQ ID NO: 724244 - RNA, 14 nt, Haemophilus influenzae Rd
aucugcaucacaaa

SEQ ID NO: 724245 - RNA, 17 nt, Haemophilus influenzae Rd
aucugcauuucaaugac

SEQ ID NO: 724246 - RNA, 16 nt, Haemophilus influenzae Rd
aucugauugagaaaau

SEQ ID NO: 724247 - RNA, 17 nt, Haemophilus influenzae Rd
aucugauugagaaaaug

SEQ ID NO: 724248 - RNA, 20 nt, Haemophilus influenzae Rd
aucugcaaaugguguuuuau

SEQ ID NO: 724249 - RNA, 20 nt, Haemophilus influenzae Rd
aucugcaccuuaaaggcuga

SEQ ID NO: 724250 - RNA, 17 nt, Haemophilus influenzae Rd
aucugcacgauagcaau

SEQ ID NO: 724251 - RNA, 18 nt, Haemophilus influenzae Rd
aucugcacgauagcaaug

SEQ ID NO: 724252 - RNA, 16 nt, Haemophilus influenzae Rd
aucugcacguaaaguu

SEQ ID NO: 724253 - RNA, 17 nt, Haemophilus influenzae Rd
aucugcacguaaaguug

SEQ ID NO: 724254 - RNA, 16 nt, Haemophilus influenzae Rd
aucugaguauguuguu

SEQ ID NO: 724255 - RNA, 14 nt, Haemophilus influenzae Rd
aucucuugaauacc

SEQ ID NO: 724256 - RNA, 21 nt, Haemophilus influenzae Rd
aucugauccacgguauuuucu

SEQ ID NO: 724257 - RNA, 15 nt, Haemophilus influenzae Rd
aucuucugcugauaa

SEQ ID NO: 724258 - RNA, 13 nt, Haemophilus influenzae Rd
aucuucuucccaa

SEQ ID NO: 724259 - RNA, 22 nt, Haemophilus influenzae Rd
aucuucuuuaccaacuaacaua

SEQ ID NO: 724260 - RNA, 22 nt, Haemophilus influenzae Rd
aucuucuucuuggcaauauuua

SEQ ID NO: 724261 - RNA, 21 nt, Haemophilus influenzae Rd
aucuugaccaucuaauugugc

SEQ ID NO: 724262 - RNA, 22 nt, Haemophilus influenzae Rd
aucuugccaaugccaaauuucu

SEQ ID NO: 724263 - RNA, 15 nt, Haemophilus influenzae Rd
aucuugauccauaua

SEQ ID NO: 724264 - RNA, 23 nt, Haemophilus influenzae Rd
aucuugcguuaaaucaaaaccaa

SEQ ID NO: 724265 - RNA, 13 nt, Haemophilus influenzae Rd
aucugguuuugug

SEQ ID NO: 724266 - RNA, 15 nt, Haemophilus influenzae Rd
aucuguaaaccauuc

SEQ ID NO: 724267 - RNA, 19 nt, Haemophilus influenzae Rd
aucuguaaacgaccuugca

SEQ ID NO: 724268 - RNA, 19 nt, Haemophilus influenzae Rd
aucugugacgccauccaaa

SEQ ID NO: 724269 - RNA, 23 nt, Haemophilus influenzae Rd
aucugugauaacuaugccuucuu

SEQ ID NO: 724270 - RNA, 19 nt, Haemophilus influenzae Rd
aucuguugugaaugcaaua

SEQ ID NO: 724271 - RNA, 21 nt, Haemophilus influenzae Rd
aucuucuaauuugccaucacu

SEQ ID NO: 724272 - RNA, 19 nt, Haemophilus influenzae Rd
aucuucuacggucgcacca

SEQ ID NO: 724273 - RNA, 13 nt, Haemophilus influenzae Rd
aucuucuaucuac

SEQ ID NO: 724274 - RNA, 14 nt, Haemophilus influenzae Rd
aucuucuauucucu

SEQ ID NO: 724275 - RNA, 17 nt, Haemophilus influenzae Rd
aucuucugaucaauuua

SEQ ID NO: 724276 - RNA, 14 nt, Haemophilus influenzae Rd
aucuuuauaacaua

SEQ ID NO: 724277 - RNA, 17 nt, Haemophilus influenzae Rd
aucuuugacuaaaucau

SEQ ID NO: 724278 - RNA, 17 nt, Haemophilus influenzae Rd
aucuuuuuauaaaaaaa

SEQ ID NO: 724279 - RNA, 18 nt, Haemophilus influenzae Rd
aucuuuuguuacuuucca

SEQ ID NO: 724280 - RNA, 13 nt, Haemophilus influenzae Rd
aucuuuuuuaaga

SEQ ID NO: 724281 - RNA, 14 nt, Haemophilus influenzae Rd
aucuuuuuuaagau

SEQ ID NO: 724282 - RNA, 19 nt, Haemophilus influenzae Rd
aucuuuuuguaauuucuca

SEQ ID NO: 724283 - RNA, 14 nt, Haemophilus influenzae Rd
aucuuuuuguuaau

SEQ ID NO: 724284 - RNA, 22 nt, Haemophilus influenzae Rd
aucuuuuuguuaauaaaagaau

SEQ ID NO: 724285 - RNA, 20 nt, Haemophilus influenzae Rd
aucuuuuuucuugcuaaaaa

SEQ ID NO: 724286 - RNA, 22 nt, Haemophilus influenzae Rd
aucuuuuuucuugcuaaaaaga

SEQ ID NO: 724287 - RNA, 23 nt, Haemophilus influenzae Rd
aucuuuuuucuugcuaaaaagaa

SEQ ID NO: 724288 - RNA, 12 nt, Haemophilus influenzae Rd
aucuuuuucuuu

SEQ ID NO: 724289 - RNA, 13 nt, Haemophilus influenzae Rd
aucuuguuuuaau

SEQ ID NO: 724290 - RNA, 12 nt, Haemophilus influenzae Rd
aucuuuaaagug

SEQ ID NO: 724291 - RNA, 16 nt, Haemophilus influenzae Rd
aucuuuaauuaaaaua

SEQ ID NO: 724292 - RNA, 22 nt, Haemophilus influenzae Rd
aucuuuaauuaaaauauuuuua

SEQ ID NO: 724293 - RNA, 15 nt, Haemophilus influenzae Rd
aucuuuaccaaaaaa

SEQ ID NO: 724294 - RNA, 14 nt, Haemophilus influenzae Rd
aucuuuacccacac

SEQ ID NO: 724295 - RNA, 17 nt, Haemophilus influenzae Rd
aucuuuacccauugcuc

SEQ ID NO: 724296 - RNA, 14 nt, Haemophilus influenzae Rd
aucuuggcauuuuu

SEQ ID NO: 724297 - RNA, 21 nt, Haemophilus influenzae Rd
aucuuggugccaauccauuuu

SEQ ID NO: 724298 - RNA, 12 nt, Haemophilus influenzae Rd
aucuugguuuaa

SEQ ID NO: 724299 - RNA, 14 nt, Haemophilus influenzae Rd
augaauauaaaauu

SEQ ID NO: 724300 - RNA, 21 nt, Haemophilus influenzae Rd
augaauaucuuccacaacaac

SEQ ID NO: 724301 - RNA, 18 nt, Haemophilus influenzae Rd
augaauaagcgaaaaaca

SEQ ID NO: 724302 - RNA, 20 nt, Haemophilus influenzae Rd
augaauaagcgaaaaacaua

SEQ ID NO: 724303 - RNA, 21 nt, Haemophilus influenzae Rd
augaauaacuuuaauuuucca

SEQ ID NO: 724304 - RNA, 11 nt, Haemophilus influenzae Rd
augaauggguu

SEQ ID NO: 724305 - RNA, 21 nt, Haemophilus influenzae Rd
augaauuaccaauuccaaagc

SEQ ID NO: 724306 - RNA, 12 nt, Haemophilus influenzae Rd
augaauuagaaa

SEQ ID NO: 724307 - RNA, 11 nt, Haemophilus influenzae Rd
augaaagccaa

SEQ ID NO: 724308 - RNA, 16 nt, Haemophilus influenzae Rd
augaaagggaaauaac

SEQ ID NO: 724309 - RNA, 22 nt, Haemophilus influenzae Rd
augaacuuaugugcaccuucaa

SEQ ID NO: 724310 - RNA, 20 nt, Haemophilus influenzae Rd
augaacuuucuacgacauuu

SEQ ID NO: 724311 - RNA, 16 nt, Haemophilus influenzae Rd
augaacuuuuuuauaa

SEQ ID NO: 724312 - RNA, 17 nt, Haemophilus influenzae Rd
augaacuuuuuuauaau

SEQ ID NO: 724313 - RNA, 15 nt, Haemophilus influenzae Rd
augaagaugaagcua

SEQ ID NO: 724314 - RNA, 19 nt, Haemophilus influenzae Rd
augaagaaaauuucugcug

SEQ ID NO: 724315 - RNA, 22 nt, Haemophilus influenzae Rd
augaaacgcgaguaaaauaaaa

SEQ ID NO: 724316 - RNA, 19 nt, Haemophilus influenzae Rd
augaaaaacauucaaucuu

SEQ ID NO: 724317 - RNA, 18 nt, Haemophilus influenzae Rd
augaaacgagauuuauuu

SEQ ID NO: 724318 - RNA, 15 nt, Haemophilus influenzae Rd
augaaacagcuaaaa

SEQ ID NO: 724319 - RNA, 15 nt, Haemophilus influenzae Rd
augaaaauuaucugc

SEQ ID NO: 724320 - RNA, 18 nt, Haemophilus influenzae Rd
augaaaauuaucugcucu

SEQ ID NO: 724321 - RNA, 17 nt, Haemophilus influenzae Rd
augaccaaguaaaccaa

SEQ ID NO: 724322 - RNA, 20 nt, Haemophilus influenzae Rd
augacaccuuuaaaaauuac

SEQ ID NO: 724323 - RNA, 21 nt, Haemophilus influenzae Rd
augaccuuuuuuuagaauuaa

SEQ ID NO: 724324 - RNA, 19 nt, Haemophilus influenzae Rd
augacgcgccuaauauugc

SEQ ID NO: 724325 - RNA, 14 nt, Haemophilus influenzae Rd
augagaaaaagucg

SEQ ID NO: 724326 - RNA, 20 nt, Haemophilus influenzae Rd
augagaaaugcgauuuccaa

SEQ ID NO: 724327 - RNA, 14 nt, Haemophilus influenzae Rd
augagacuuaacca

SEQ ID NO: 724328 - RNA, 18 nt, Haemophilus influenzae Rd
auaugcauucaaauuuca

SEQ ID NO: 724329 - RNA, 19 nt, Haemophilus influenzae Rd
auaugcaucagauuuuucg

SEQ ID NO: 724330 - RNA, 14 nt, Haemophilus influenzae Rd
auaugccaaauaaa

SEQ ID NO: 724331 - RNA, 22 nt, Haemophilus influenzae Rd
auaugccaaauaaaauuacaaa

SEQ ID NO: 724332 - RNA, 16 nt, Haemophilus influenzae Rd
auaugccuuauauuuc

SEQ ID NO: 724333 - RNA, 18 nt, Haemophilus influenzae Rd
auaugcgaucacugcacc

SEQ ID NO: 724334 - RNA, 13 nt, Haemophilus influenzae Rd
auaugcucaauag

SEQ ID NO: 724335 - RNA, 16 nt, Haemophilus influenzae Rd
auaugcguugaugcaa

SEQ ID NO: 724336 - RNA, 17 nt, Haemophilus influenzae Rd
auaugguucauuauuaa

SEQ ID NO: 724337 - RNA, 14 nt, Haemophilus influenzae Rd
auauguaaaauuuu

SEQ ID NO: 724338 - RNA, 16 nt, Haemophilus influenzae Rd
auauguuaauaagccc

SEQ ID NO: 724339 - RNA, 14 nt, Haemophilus influenzae Rd
auauguucaacaag

SEQ ID NO: 724340 - RNA, 16 nt, Haemophilus influenzae Rd
auauuaaagaguuaua

SEQ ID NO: 724341 - RNA, 22 nt, Haemophilus influenzae Rd
auauuacccguaccuuuaaauu

SEQ ID NO: 724342 - RNA, 12 nt, Haemophilus influenzae Rd
auauuauuaaaa

SEQ ID NO: 724343 - RNA, 14 nt, Haemophilus influenzae Rd
auauuauucagcac

SEQ ID NO: 724344 - RNA, 17 nt, Haemophilus influenzae Rd
auauuauucagcacuuu

SEQ ID NO: 724345 - RNA, 20 nt, Haemophilus influenzae Rd
auauuacuuauaagaugacu

SEQ ID NO: 724346 - RNA, 18 nt, Haemophilus influenzae Rd
auauuaguuagcuaaaaa

SEQ ID NO: 724347 - RNA, 18 nt, Haemophilus influenzae Rd
auauuauacuuucaauua

SEQ ID NO: 724348 - RNA, 19 nt, Haemophilus influenzae Rd
auauucaaauuucauccua

SEQ ID NO: 724349 - RNA, 12 nt, Haemophilus influenzae Rd
auauucaaauuu

SEQ ID NO: 724350 - RNA, 23 nt, Haemophilus influenzae Rd
auauuccuuagaaaguaaacaau

SEQ ID NO: 724351 - RNA, 16 nt, Haemophilus influenzae Rd
auauuccuuauucaaa

SEQ ID NO: 724352 - RNA, 15 nt, Haemophilus influenzae Rd
auauucgcaccuuca

SEQ ID NO: 724353 - RNA, 16 nt, Haemophilus influenzae Rd
auauucgcaccuucag

SEQ ID NO: 724354 - RNA, 16 nt, Haemophilus influenzae Rd
auauucgcuucuuuua

SEQ ID NO: 724355 - RNA, 21 nt, Haemophilus influenzae Rd
auauucgcuucuuuuaauggg

SEQ ID NO: 724356 - RNA, 14 nt, Haemophilus influenzae Rd
aucaacuaaaaaau

SEQ ID NO: 724357 - RNA, 12 nt, Haemophilus influenzae Rd
aucaacuaaauc

SEQ ID NO: 724358 - RNA, 13 nt, Haemophilus influenzae Rd
aucaacuaaauca

SEQ ID NO: 724359 - RNA, 20 nt, Haemophilus influenzae Rd
aucaacuaauuuauuaaaaa

SEQ ID NO: 724360 - RNA, 15 nt, Haemophilus influenzae Rd
aucaacugcaacaau

SEQ ID NO: 724361 - RNA, 22 nt, Haemophilus influenzae Rd
aucaacugcaacaauuucauca

SEQ ID NO: 724362 - RNA, 19 nt, Haemophilus influenzae Rd
aucaacgcuguacaaagca

SEQ ID NO: 724363 - RNA, 13 nt, Haemophilus influenzae Rd
aucaaauuuuccu

SEQ ID NO: 724364 - RNA, 14 nt, Haemophilus influenzae Rd
aucaaauuuuccuu

SEQ ID NO: 724365 - RNA, 20 nt, Haemophilus influenzae Rd
aucaaauucucuguuucuuu

SEQ ID NO: 724366 - RNA, 18 nt, Haemophilus influenzae Rd
aucaaccaaaauacaauc

SEQ ID NO: 724367 - RNA, 21 nt, Haemophilus influenzae Rd
aucaaagugcgguuguuuuug

SEQ ID NO: 724368 - RNA, 17 nt, Haemophilus influenzae Rd
aucaaauccgccaauca

SEQ ID NO: 724369 - RNA, 21 nt, Haemophilus influenzae Rd
aucaaauccuuguuuuucaaa

SEQ ID NO: 724370 - RNA, 23 nt, Haemophilus influenzae Rd
aucaaaucuuuugcacuuugauu

SEQ ID NO: 724371 - RNA, 20 nt, Haemophilus influenzae Rd
aucaaaucauuuuuugcaaa

SEQ ID NO: 724372 - RNA, 13 nt, Haemophilus influenzae Rd
aucaaagaaacug

SEQ ID NO: 724373 - RNA, 22 nt, Haemophilus influenzae Rd
aucaaagcguucauuuugaucu

SEQ ID NO: 724374 - RNA, 19 nt, Haemophilus influenzae Rd
aucaaagcguuuuucuaca

SEQ ID NO: 724375 - RNA, 21 nt, Haemophilus influenzae Rd
aucaaaguagucuauuuacuu

SEQ ID NO: 724376 - RNA, 22 nt, Haemophilus influenzae Rd
aucaaaguagucuauuuacuug

SEQ ID NO: 724377 - RNA, 13 nt, Haemophilus influenzae Rd
auauucuguugaa

SEQ ID NO: 724378 - RNA, 22 nt, Haemophilus influenzae Rd
auauucuucgcuuaaugguaaa

SEQ ID NO: 724379 - RNA, 15 nt, Haemophilus influenzae Rd
auauucuucauaaaa

SEQ ID NO: 724380 - RNA, 18 nt, Haemophilus influenzae Rd
auauucuuggagauaaua

SEQ ID NO: 724381 - RNA, 19 nt, Haemophilus influenzae Rd
auauuuaaugauaaucuaa

SEQ ID NO: 724382 - RNA, 23 nt, Haemophilus influenzae Rd
auauuuaauguguagauaaaaua

SEQ ID NO: 724383 - RNA, 23 nt, Haemophilus influenzae Rd
auauuuacaacugcaaaugaaac

SEQ ID NO: 724384 - RNA, 20 nt, Haemophilus influenzae Rd
auauucuuuaaauauucaau

SEQ ID NO: 724385 - RNA, 11 nt, Haemophilus influenzae Rd
auauucuuuug

SEQ ID NO: 724386 - RNA, 21 nt, Haemophilus influenzae Rd
auauucugcuaacucaucaac

SEQ ID NO: 724387 - RNA, 22 nt, Haemophilus influenzae Rd
auauucugcuaacucaucaaca

SEQ ID NO: 724388 - RNA, 17 nt, Haemophilus influenzae Rd
auauucuggcaauauuu

SEQ ID NO: 724389 - RNA, 23 nt, Haemophilus influenzae Rd
auauucuggcaauauuucaauaa

SEQ ID NO: 724390 - RNA, 13 nt, Haemophilus influenzae Rd
auauucuccuugg

SEQ ID NO: 724391 - RNA, 21 nt, Haemophilus influenzae Rd
auauucuaccgcauuuuuaau

SEQ ID NO: 724392 - RNA, 23 nt, Haemophilus influenzae Rd
auauuuauaauguggugcuguuu

SEQ ID NO: 724393 - RNA, 21 nt, Haemophilus influenzae Rd
auauuuaggcuauuuuauaau

SEQ ID NO: 724394 - RNA, 20 nt, Haemophilus influenzae Rd
auauuuuuuacuauucuuca

SEQ ID NO: 724395 - RNA, 12 nt, Haemophilus influenzae Rd
auauuuuuuagu

SEQ ID NO: 724396 - RNA, 22 nt, Haemophilus influenzae Rd
auauuuuuucagccuauuuuua

SEQ ID NO: 724397 - RNA, 19 nt, Haemophilus influenzae Rd
auauuuuuucgugaaauua

SEQ ID NO: 724398 - RNA, 15 nt, Haemophilus influenzae Rd
aucaaaaaaauaagu

SEQ ID NO: 724399 - RNA, 21 nt, Haemophilus influenzae Rd
aucaaaaaugcucgcuggcua

SEQ ID NO: 724400 - RNA, 20 nt, Haemophilus influenzae Rd
aucaaaaaucuuauuucaau

SEQ ID NO: 724401 - RNA, 15 nt, Haemophilus influenzae Rd
aucaaaaauaaaaag

SEQ ID NO: 724402 - RNA, 17 nt, Haemophilus influenzae Rd
aucaaaaauaaaaagua

SEQ ID NO: 724403 - RNA, 12 nt, Haemophilus influenzae Rd
aucaaaaagaaa

SEQ ID NO: 724404 - RNA, 13 nt, Haemophilus influenzae Rd
aucaaaaagaaau

SEQ ID NO: 724405 - RNA, 14 nt, Haemophilus influenzae Rd
aucaaaaagaaaua

SEQ ID NO: 724406 - RNA, 15 nt, Haemophilus influenzae Rd
aucaaaaagaaauau

SEQ ID NO: 724407 - RNA, 13 nt, Haemophilus influenzae Rd
auauuuuugccaa

SEQ ID NO: 724408 - RNA, 24 nt, Haemophilus influenzae Rd
auauuuuuauuugguuaugauaua

SEQ ID NO: 724409 - RNA, 10 nt, Haemophilus influenzae Rd
auauuuuuca

SEQ ID NO: 724410 - RNA, 11 nt, Haemophilus influenzae Rd
auauuuuuaau

SEQ ID NO: 724411 - RNA, 21 nt, Haemophilus influenzae Rd
auauuugacgaaauaaaugau

SEQ ID NO: 724412 - RNA, 16 nt, Haemophilus influenzae Rd
auauuugaguuauuuu

SEQ ID NO: 724413 - RNA, 20 nt, Haemophilus influenzae Rd
auauuugaguuauuuuuaau

SEQ ID NO: 724414 - RNA, 16 nt, Haemophilus influenzae Rd
auauuucuucauuuua

SEQ ID NO: 724415 - RNA, 18 nt, Haemophilus influenzae Rd
auauuucuucauuuuaaa

SEQ ID NO: 724416 - RNA, 19 nt, Haemophilus influenzae Rd
auauuucuucauuuuaaau

SEQ ID NO: 724417 - RNA, 22 nt, Haemophilus influenzae Rd
auauuucuucgauuuuucuaaa

SEQ ID NO: 724418 - RNA, 21 nt, Haemophilus influenzae Rd
auauuucuuuucaaacacaaa

SEQ ID NO: 724419 - RNA, 22 nt, Haemophilus influenzae Rd
auauuucuuuucaaacacaaaa

SEQ ID NO: 724420 - RNA, 15 nt, Haemophilus influenzae Rd
auauuucuuuuugau

SEQ ID NO: 724421 - RNA, 16 nt, Haemophilus influenzae Rd
aucagaaugauuaucu

SEQ ID NO: 724422 - RNA, 14 nt, Haemophilus influenzae Rd
aucagaaggaauau

SEQ ID NO: 724423 - RNA, 15 nt, Haemophilus influenzae Rd
aucagaaauaucuuc

SEQ ID NO: 724424 - RNA, 17 nt, Haemophilus influenzae Rd
aucagaaauaucuucaa

SEQ ID NO: 724425 - RNA, 16 nt, Haemophilus influenzae Rd
aucagaacaagcauuu

SEQ ID NO: 724426 - RNA, 13 nt, Haemophilus influenzae Rd
aucacuuaaacca

SEQ ID NO: 724427 - RNA, 15 nt, Haemophilus influenzae Rd
aucacuuaaaccaaa

SEQ ID NO: 724428 - RNA, 16 nt, Haemophilus influenzae Rd
aucacuuaaaccaaau

SEQ ID NO: 724429 - RNA, 15 nt, Haemophilus influenzae Rd
aucagcuaaacgcac

SEQ ID NO: 724430 - RNA, 17 nt, Haemophilus influenzae Rd
aucagcuccuacauuaa

SEQ ID NO: 724431 - RNA, 21 nt, Haemophilus influenzae Rd
aucagcuccuacauuaaaaga

SEQ ID NO: 724432 - RNA, 23 nt, Haemophilus influenzae Rd
aucagcuccuacauuaaaagaua

SEQ ID NO: 724433 - RNA, 17 nt, Haemophilus influenzae Rd
aucagcccuuauuuuuu

SEQ ID NO: 724434 - RNA, 21 nt, Haemophilus influenzae Rd
aucagcgaauuaaagugcaga

SEQ ID NO: 724435 - RNA, 16 nt, Haemophilus influenzae Rd
aucagggccaguugaa

SEQ ID NO: 724436 - RNA, 20 nt, Haemophilus influenzae Rd
aucaggcuuaacuuucucuc

SEQ ID NO: 724437 - RNA, 17 nt, Haemophilus influenzae Rd
aucaggcuuucauuuuc

SEQ ID NO: 724438 - RNA, 21 nt, Haemophilus influenzae Rd
aucagguaauuggugugcaau

SEQ ID NO: 724439 - RNA, 15 nt, Haemophilus influenzae Rd
aaaacgaaauuuuuc

SEQ ID NO: 724440 - RNA, 13 nt, Haemophilus influenzae Rd
aaaacgaauagaa

SEQ ID NO: 724441 - RNA, 14 nt, Haemophilus influenzae Rd
aaaacggaaucagg

SEQ ID NO: 724442 - RNA, 15 nt, Haemophilus influenzae Rd
aaaacggaaucaggu

SEQ ID NO: 724443 - RNA, 14 nt, Haemophilus influenzae Rd
aucacccaucaaau

SEQ ID NO: 724444 - RNA, 17 nt, Haemophilus influenzae Rd
aucacccaucaaaucuu

SEQ ID NO: 724445 - RNA, 22 nt, Haemophilus influenzae Rd
aucaccccagccuuucgacaag

SEQ ID NO: 724446 - RNA, 21 nt, Haemophilus influenzae Rd
aucacccccacggcaaucaua

SEQ ID NO: 724447 - RNA, 19 nt, Haemophilus influenzae Rd
aucacucguugguauuuac

SEQ ID NO: 724448 - RNA, 16 nt, Haemophilus influenzae Rd
aucacugaauuucauu

SEQ ID NO: 724449 - RNA, 18 nt, Haemophilus influenzae Rd
aucacguuaucaaagaaa

SEQ ID NO: 724450 - RNA, 17 nt, Haemophilus influenzae Rd
aucaccuguaaacaaau

SEQ ID NO: 724451 - RNA, 11 nt, Haemophilus influenzae Rd
aucaccuucaa

SEQ ID NO: 724452 - RNA, 19 nt, Haemophilus influenzae Rd
aucacagccgcauuuuuac

SEQ ID NO: 724453 - RNA, 21 nt, Haemophilus influenzae Rd
aucacagauuuuuuauuaauu

SEQ ID NO: 724454 - RNA, 13 nt, Haemophilus influenzae Rd
aucacaguuuuau

SEQ ID NO: 724455 - RNA, 23 nt, Haemophilus influenzae Rd
aucacaguuuuauuuuccaucau

SEQ ID NO: 724456 - RNA, 13 nt, Haemophilus influenzae Rd
aucacauaaaaaa

SEQ ID NO: 724457 - RNA, 13 nt, Haemophilus influenzae Rd
aucacaucgccaa

SEQ ID NO: 724458 - RNA, 14 nt, Haemophilus influenzae Rd
aucacauuuuauug

SEQ ID NO: 724459 - RNA, 14 nt, Haemophilus influenzae Rd
aucacauuuucaaa

SEQ ID NO: 724460 - RNA, 11 nt, Haemophilus influenzae Rd
aucacauccac

SEQ ID NO: 724461 - RNA, 17 nt, Haemophilus influenzae Rd
aucacauccacaaaaaa

SEQ ID NO: 724462 - RNA, 14 nt, Haemophilus influenzae Rd
aucacaaagcacua

SEQ ID NO: 724463 - RNA, 19 nt, Haemophilus influenzae Rd
aucacaaaauggcaaacaa

SEQ ID NO: 724464 - RNA, 23 nt, Haemophilus influenzae Rd
aucacaaaauggcaaacaaaaua

SEQ ID NO: 724465 - RNA, 22 nt, Haemophilus influenzae Rd
aucacaaaacaacgaauauccg

SEQ ID NO: 724466 - RNA, 20 nt, Haemophilus influenzae Rd
aucaauuuuauugaauacua

SEQ ID NO: 724467 - RNA, 12 nt, Haemophilus influenzae Rd
aucacaaaucuu

SEQ ID NO: 724468 - RNA, 16 nt, Haemophilus influenzae Rd
aucacaacauauaaau

SEQ ID NO: 724469 - RNA, 21 nt, Haemophilus influenzae Rd
aucacaacuugcaaccauaaa

SEQ ID NO: 724470 - RNA, 21 nt, Haemophilus influenzae Rd
aucacaaggcucaucauuaug

SEQ ID NO: 724471 - RNA, 15 nt, Haemophilus influenzae Rd
aucacaauuuuuaac

SEQ ID NO: 724472 - RNA, 21 nt, Haemophilus influenzae Rd
aucaauuugcggagaaaacaa

SEQ ID NO: 724473 - RNA, 19 nt, Haemophilus influenzae Rd
aucaauuuggcucacaaga

SEQ ID NO: 724474 - RNA, 19 nt, Haemophilus influenzae Rd
aucaauuugugcauaaaca

SEQ ID NO: 724475 - RNA, 23 nt, Haemophilus influenzae Rd
aucaauuugacgcgcacauacuu

SEQ ID NO: 724476 - RNA, 14 nt, Haemophilus influenzae Rd
aucaauucuuucac

SEQ ID NO: 724477 - RNA, 20 nt, Haemophilus influenzae Rd
aucaauuuaaucaaaguagu

SEQ ID NO: 724478 - RNA, 22 nt, Haemophilus influenzae Rd
auaauucaaaacggucagucac

SEQ ID NO: 724479 - RNA, 13 nt, Haemophilus influenzae Rd
auaauucaucaaa

SEQ ID NO: 724480 - RNA, 15 nt, Haemophilus influenzae Rd
auaauucaucaaaau

SEQ ID NO: 724481 - RNA, 13 nt, Haemophilus influenzae Rd
auacaguaaaaau

SEQ ID NO: 724482 - RNA, 15 nt, Haemophilus influenzae Rd
auaauuccuaaaaua

SEQ ID NO: 724483 - RNA, 17 nt, Haemophilus influenzae Rd
auaauuccuaaaauaca

SEQ ID NO: 724484 - RNA, 19 nt, Haemophilus influenzae Rd
auaauuccuaaaauacaaa

SEQ ID NO: 724485 - RNA, 21 nt, Haemophilus influenzae Rd
auacauaacgccaagguuauu

SEQ ID NO: 724486 - RNA, 18 nt, Haemophilus influenzae Rd
auacauagaacguuuuuu

SEQ ID NO: 724487 - RNA, 14 nt, Haemophilus influenzae Rd
auacaguuagaaca

SEQ ID NO: 724488 - RNA, 21 nt, Haemophilus influenzae Rd
auacauaaagaauaauuuuca

SEQ ID NO: 724489 - RNA, 17 nt, Haemophilus influenzae Rd
auacauaaaaaacacag

SEQ ID NO: 724490 - RNA, 16 nt, Haemophilus influenzae Rd
auacaucuaauuuuag

SEQ ID NO: 724491 - RNA, 13 nt, Haemophilus influenzae Rd
auacaucuucaca

SEQ ID NO: 724492 - RNA, 15 nt, Haemophilus influenzae Rd
auacaucacuaauac

SEQ ID NO: 724493 - RNA, 17 nt, Haemophilus influenzae Rd
auacaucacuaauacgc

SEQ ID NO: 724494 - RNA, 14 nt, Haemophilus influenzae Rd
auacauuucuaaaa

SEQ ID NO: 724495 - RNA, 16 nt, Haemophilus influenzae Rd
auacauuucuaaaaua

SEQ ID NO: 724496 - RNA, 15 nt, Haemophilus influenzae Rd
auacauuaacaaugc

SEQ ID NO: 724497 - RNA, 14 nt, Haemophilus influenzae Rd
auacauuauuaaaa

SEQ ID NO: 724498 - RNA, 17 nt, Haemophilus influenzae Rd
auacauuauuaaaagca

SEQ ID NO: 724499 - RNA, 12 nt, Haemophilus influenzae Rd
auaccacauucc

SEQ ID NO: 724500 - RNA, 22 nt, Haemophilus influenzae Rd
auaccaccgccgauaguuaaug

SEQ ID NO: 724501 - RNA, 16 nt, Haemophilus influenzae Rd
auaccagccugaaugg

SEQ ID NO: 724502 - RNA, 22 nt, Haemophilus influenzae Rd
auaccagccugaauggcgaauu

SEQ ID NO: 724503 - RNA, 12 nt, Haemophilus influenzae Rd
auaccaaaauug

SEQ ID NO: 724504 - RNA, 14 nt, Haemophilus influenzae Rd
auaccaagauaaua

SEQ ID NO: 724505 - RNA, 21 nt, Haemophilus influenzae Rd
auaccaagauaauaaaguuac

SEQ ID NO: 724506 - RNA, 21 nt, Haemophilus influenzae Rd
auaccaagugcugguagcaau

SEQ ID NO: 724507 - RNA, 17 nt, Haemophilus influenzae Rd
auaccaauaauaauauc

SEQ ID NO: 724508 - RNA, 12 nt, Haemophilus influenzae Rd
auaccacacccu

SEQ ID NO: 724509 - RNA, 18 nt, Haemophilus influenzae Rd
auaccacacccuuuucaa

SEQ ID NO: 724510 - RNA, 19 nt, Haemophilus influenzae Rd
auaccacacccuuuucaaa

SEQ ID NO: 724511 - RNA, 23 nt, Haemophilus influenzae Rd
auacccgcuucuaaggcagcaag

SEQ ID NO: 724512 - RNA, 21 nt, Haemophilus influenzae Rd
auacccauuggaagauuucuu

SEQ ID NO: 724513 - RNA, 13 nt, Haemophilus influenzae Rd
auacccauuucga

SEQ ID NO: 724514 - RNA, 16 nt, Haemophilus influenzae Rd
auaccauuuaaaagua

SEQ ID NO: 724515 - RNA, 18 nt, Haemophilus influenzae Rd
auaccauuuaaaaguaaa

SEQ ID NO: 724516 - RNA, 13 nt, Haemophilus influenzae Rd
auaccauuugauu

SEQ ID NO: 724517 - RNA, 22 nt, Haemophilus influenzae Rd
auaccauuaauggguaaucaau

SEQ ID NO: 724518 - RNA, 20 nt, Haemophilus influenzae Rd
auaccauucuuucaauaauu

SEQ ID NO: 724519 - RNA, 15 nt, Haemophilus influenzae Rd
auagaaugaaaaaca

SEQ ID NO: 724520 - RNA, 21 nt, Haemophilus influenzae Rd
auagaaugaaaaacauucaau

SEQ ID NO: 724521 - RNA, 18 nt, Haemophilus influenzae Rd
auagaagugcgguugcuu

SEQ ID NO: 724522 - RNA, 21 nt, Haemophilus influenzae Rd
auagaagugcgguugcuuuua

SEQ ID NO: 724523 - RNA, 23 nt, Haemophilus influenzae Rd
auagaauuuugcaagccaauaga

SEQ ID NO: 724524 - RNA, 11 nt, Haemophilus influenzae Rd
auagaaauuca

SEQ ID NO: 724525 - RNA, 16 nt, Haemophilus influenzae Rd
auagaaauaaagauag

SEQ ID NO: 724526 - RNA, 21 nt, Haemophilus influenzae Rd
auagaaccgucuuuaaauaga

SEQ ID NO: 724527 - RNA, 17 nt, Haemophilus influenzae Rd
auagaaagaauauuuaa

SEQ ID NO: 724528 - RNA, 20 nt, Haemophilus influenzae Rd
auagaaagcauuguuugcua

SEQ ID NO: 724529 - RNA, 16 nt, Haemophilus influenzae Rd
auacugaauuaccagc

SEQ ID NO: 724530 - RNA, 22 nt, Haemophilus influenzae Rd
auacuguuaccaauaacuaaaa

SEQ ID NO: 724531 - RNA, 12 nt, Haemophilus influenzae Rd
auacuguuuuau

SEQ ID NO: 724532 - RNA, 14 nt, Haemophilus influenzae Rd
auacuguuuuaugc

SEQ ID NO: 724533 - RNA, 18 nt, Haemophilus influenzae Rd
auacuguuuuaugcuaaa

SEQ ID NO: 724534 - RNA, 12 nt, Haemophilus influenzae Rd
auaccguauuuu

SEQ ID NO: 724535 - RNA, 23 nt, Haemophilus influenzae Rd
auaccguauuuuuuuaauuuuuu

SEQ ID NO: 724536 - RNA, 18 nt, Haemophilus influenzae Rd
auaccgauaauauguuuu

SEQ ID NO: 724537 - RNA, 23 nt, Haemophilus influenzae Rd
auaccgauaauauguuuugccaa

SEQ ID NO: 724538 - RNA, 17 nt, Haemophilus influenzae Rd
auaccguuacgaacuuc

SEQ ID NO: 724539 - RNA, 14 nt, Haemophilus influenzae Rd
auacggugaaauuu

SEQ ID NO: 724540 - RNA, 19 nt, Haemophilus influenzae Rd
auacguaauacuuuugcuu

SEQ ID NO: 724541 - RNA, 14 nt, Haemophilus influenzae Rd
auacgucaauugcu

SEQ ID NO: 724542 - RNA, 16 nt, Haemophilus influenzae Rd
auaccuaucuuauuaa

SEQ ID NO: 724543 - RNA, 22 nt, Haemophilus influenzae Rd
auacggauauuaguaauauauu

SEQ ID NO: 724544 - RNA, 24 nt, Haemophilus influenzae Rd
auacucuucaaguuuaucguauuc

SEQ ID NO: 724545 - RNA, 19 nt, Haemophilus influenzae Rd
auacuacacccaaaugcca

SEQ ID NO: 724546 - RNA, 21 nt, Haemophilus influenzae Rd
auacuaauuuuaguauucuuu

SEQ ID NO: 724547 - RNA, 17 nt, Haemophilus influenzae Rd
auacucuuaacaaaaca

SEQ ID NO: 724548 - RNA, 16 nt, Haemophilus influenzae Rd
auacugagaucucuau

SEQ ID NO: 724549 - RNA, 13 nt, Haemophilus influenzae Rd
auacugaaaugau

SEQ ID NO: 724550 - RNA, 19 nt, Haemophilus influenzae Rd
auacugaaaugauuauaau

SEQ ID NO: 724551 - RNA, 22 nt, Haemophilus influenzae Rd
auacuacggcguagaaugcaaa

SEQ ID NO: 724552 - RNA, 16 nt, Haemophilus influenzae Rd
auacguuuaauauagu

SEQ ID NO: 724553 - RNA, 18 nt, Haemophilus influenzae Rd
auacuaaauacauuuuua

SEQ ID NO: 724554 - RNA, 18 nt, Haemophilus influenzae Rd
auauaggcuauauuuucc

SEQ ID NO: 724555 - RNA, 19 nt, Haemophilus influenzae Rd
auauaggguaaauaaaaau

SEQ ID NO: 724556 - RNA, 15 nt, Haemophilus influenzae Rd
auauagucaaauaac

SEQ ID NO: 724557 - RNA, 16 nt, Haemophilus influenzae Rd
auauagugaaaaaaua

SEQ ID NO: 724558 - RNA, 22 nt, Haemophilus influenzae Rd
auauacaucucauaaaguauac

SEQ ID NO: 724559 - RNA, 14 nt, Haemophilus influenzae Rd
auauacauuaacaa

SEQ ID NO: 724560 - RNA, 15 nt, Haemophilus influenzae Rd
auauacauuaacaau

SEQ ID NO: 724561 - RNA, 16 nt, Haemophilus influenzae Rd
auauagaugaagugaa

SEQ ID NO: 724562 - RNA, 22 nt, Haemophilus influenzae Rd
auauagaugaagugaacuucau

SEQ ID NO: 724563 - RNA, 15 nt, Haemophilus influenzae Rd
auauaauuuaacaua

SEQ ID NO: 724564 - RNA, 12 nt, Haemophilus influenzae Rd
auauaauuuacu

SEQ ID NO: 724565 - RNA, 15 nt, Haemophilus influenzae Rd
auaguggcuuuaaag

SEQ ID NO: 724566 - RNA, 18 nt, Haemophilus influenzae Rd
auaguuaaagaaaauauu

SEQ ID NO: 724567 - RNA, 14 nt, Haemophilus influenzae Rd
auauaaauuauguu

SEQ ID NO: 724568 - RNA, 13 nt, Haemophilus influenzae Rd
auauaacaacaac

SEQ ID NO: 724569 - RNA, 13 nt, Haemophilus influenzae Rd
auauaacaccaaa

SEQ ID NO: 724570 - RNA, 23 nt, Haemophilus influenzae Rd
auauaacauaccuagauugcuuu

SEQ ID NO: 724571 - RNA, 11 nt, Haemophilus influenzae Rd
auaucaauuac

SEQ ID NO: 724572 - RNA, 22 nt, Haemophilus influenzae Rd
auaucaauuuggcucacaagac

SEQ ID NO: 724573 - RNA, 17 nt, Haemophilus influenzae Rd
auaucaagcagauuauu

SEQ ID NO: 724574 - RNA, 13 nt, Haemophilus influenzae Rd
auaucaaaauuau

SEQ ID NO: 724575 - RNA, 15 nt, Haemophilus influenzae Rd
auaucaaagaaaaau

SEQ ID NO: 724576 - RNA, 21 nt, Haemophilus influenzae Rd
auaucaaaguuccuagaauua

SEQ ID NO: 724577 - RNA, 16 nt, Haemophilus influenzae Rd
auauauuaauuauuuu

SEQ ID NO: 724578 - RNA, 14 nt, Haemophilus influenzae Rd
auauauuaaaaaaa

SEQ ID NO: 724579 - RNA, 13 nt, Haemophilus influenzae Rd
auauauaaauuua

SEQ ID NO: 724580 - RNA, 14 nt, Haemophilus influenzae Rd
auauauaaauuuag

SEQ ID NO: 724581 - RNA, 16 nt, Haemophilus influenzae Rd
auauauaaauuuagaa

SEQ ID NO: 724582 - RNA, 12 nt, Haemophilus influenzae Rd
auauauaaaaua

SEQ ID NO: 724583 - RNA, 14 nt, Haemophilus influenzae Rd
auauaugauuauaa

SEQ ID NO: 724584 - RNA, 16 nt, Haemophilus influenzae Rd
auauccacauaaccaa

SEQ ID NO: 724585 - RNA, 17 nt, Haemophilus influenzae Rd
auauccaaagcaauuaa

SEQ ID NO: 724586 - RNA, 14 nt, Haemophilus influenzae Rd
auauccaaaugccu

SEQ ID NO: 724587 - RNA, 20 nt, Haemophilus influenzae Rd
auauccaaaugccuaacaca

SEQ ID NO: 724588 - RNA, 21 nt, Haemophilus influenzae Rd
auaucagcccuuuguuuuaau

SEQ ID NO: 724589 - RNA, 20 nt, Haemophilus influenzae Rd
auaucauggcacaaaauaau

SEQ ID NO: 724590 - RNA, 15 nt, Haemophilus influenzae Rd
auaucacgacaaagu

SEQ ID NO: 724591 - RNA, 14 nt, Haemophilus influenzae Rd
auaucacauuuuau

SEQ ID NO: 724592 - RNA, 14 nt, Haemophilus influenzae Rd
auaucacagauuuu

SEQ ID NO: 724593 - RNA, 17 nt, Haemophilus influenzae Rd
auaucacagauuuuuaa

SEQ ID NO: 724594 - RNA, 22 nt, Haemophilus influenzae Rd
auaggauuaacguaagaaauaa

SEQ ID NO: 724595 - RNA, 16 nt, Haemophilus influenzae Rd
auaggauaaauaaacu

SEQ ID NO: 724596 - RNA, 15 nt, Haemophilus influenzae Rd
auaggaguaaaaaua

SEQ ID NO: 724597 - RNA, 17 nt, Haemophilus influenzae Rd
auaggaagcauuucuaa

SEQ ID NO: 724598 - RNA, 16 nt, Haemophilus influenzae Rd
auagcuucuaauuuuu

SEQ ID NO: 724599 - RNA, 14 nt, Haemophilus influenzae Rd
auagcuucugccag

SEQ ID NO: 724600 - RNA, 19 nt, Haemophilus influenzae Rd
auagcugggcaaaaucauc

SEQ ID NO: 724601 - RNA, 23 nt, Haemophilus influenzae Rd
auagccgcgaugauagaaccaau

SEQ ID NO: 724602 - RNA, 22 nt, Haemophilus influenzae Rd
auagccgacaucuauuuugcuu

SEQ ID NO: 724603 - RNA, 16 nt, Haemophilus influenzae Rd
auagagcuucauagaa

SEQ ID NO: 724604 - RNA, 19 nt, Haemophilus influenzae Rd
auagaggaaccauguaauc

SEQ ID NO: 724605 - RNA, 23 nt, Haemophilus influenzae Rd
auaggcuucuuguuuacauucuu

SEQ ID NO: 724606 - RNA, 20 nt, Haemophilus influenzae Rd
auaggcgguaucaaugccau

SEQ ID NO: 724607 - RNA, 16 nt, Haemophilus influenzae Rd
auaggcgcguaauaaa

SEQ ID NO: 724608 - RNA, 14 nt, Haemophilus influenzae Rd
auagguuauaaguu

SEQ ID NO: 724609 - RNA, 21 nt, Haemophilus influenzae Rd
auaggugcuuaacugaaaauu

SEQ ID NO: 724610 - RNA, 17 nt, Haemophilus influenzae Rd
  misc_feature (5)..(5): n is a, c, g or u
auagnaaaaauuuaggg

SEQ ID NO: 724611 - RNA, 14 nt, Haemophilus influenzae Rd
auaggguaauaaaa

SEQ ID NO: 724612 - RNA, 15 nt, Haemophilus influenzae Rd
auaggguaauaaaaa

SEQ ID NO: 724613 - RNA, 23 nt, Haemophilus influenzae Rd
auagucauucaaugcagaaauac

SEQ ID NO: 724614 - RNA, 13 nt, Haemophilus influenzae Rd
auaguauauuuau

SEQ ID NO: 724615 - RNA, 21 nt, Haemophilus influenzae Rd
auaguagagucauuuacaggu

SEQ ID NO: 724616 - RNA, 15 nt, Haemophilus influenzae Rd
auaguaaacuuuuaa

SEQ ID NO: 724617 - RNA, 12 nt, Haemophilus influenzae Rd
auaguaauguuc

SEQ ID NO: 724618 - RNA, 22 nt, Haemophilus influenzae Rd
auaguaauguucuacguaauuu

SEQ ID NO: 724619 - RNA, 15 nt, Haemophilus influenzae Rd
aguacuuucacaccc

SEQ ID NO: 724620 - RNA, 19 nt, Haemophilus influenzae Rd
aguagaaaaucagauuaug

SEQ ID NO: 724621 - RNA, 21 nt, Haemophilus influenzae Rd
aguagaaaaucagauuauguu

SEQ ID NO: 724622 - RNA, 16 nt, Haemophilus influenzae Rd
agucaauccaguuacc

SEQ ID NO: 724623 - RNA, 22 nt, Haemophilus influenzae Rd
agucacuucaggguuuucauca

SEQ ID NO: 724624 - RNA, 20 nt, Haemophilus influenzae Rd
agucagcauaaacaaaauaa

SEQ ID NO: 724625 - RNA, 16 nt, Haemophilus influenzae Rd
agucagcgcagcaauu

SEQ ID NO: 724626 - RNA, 18 nt, Haemophilus influenzae Rd
agucagcgcagcaauuaa

SEQ ID NO: 724627 - RNA, 18 nt, Haemophilus influenzae Rd
agucauuaaugcauugau

SEQ ID NO: 724628 - RNA, 19 nt, Haemophilus influenzae Rd
agucauucaaugcagaaau

SEQ ID NO: 724629 - RNA, 20 nt, Haemophilus influenzae Rd
aguccaaguuuuuuaucuuu

SEQ ID NO: 724630 - RNA, 21 nt, Haemophilus influenzae Rd
aguccaaguuuuuuaucuuuu

SEQ ID NO: 724631 - RNA, 15 nt, Haemophilus influenzae Rd
agucccaaaagcaaa

SEQ ID NO: 724632 - RNA, 20 nt, Haemophilus influenzae Rd
aguccaugcguuuuauuugg

SEQ ID NO: 724633 - RNA, 23 nt, Haemophilus influenzae Rd
aguccacuguauauuguuugcuu

SEQ ID NO: 724634 - RNA, 19 nt, Haemophilus influenzae Rd
agucaucgaguuuuaucuu

SEQ ID NO: 724635 - RNA, 13 nt, Haemophilus influenzae Rd
agucauacagaaa

SEQ ID NO: 724636 - RNA, 19 nt, Haemophilus influenzae Rd
agucauauugauuucucug

SEQ ID NO: 724637 - RNA, 14 nt, Haemophilus influenzae Rd
agucaggaauaaaa

SEQ ID NO: 724638 - RNA, 20 nt, Haemophilus influenzae Rd
aguccccauaucucugccau

SEQ ID NO: 724639 - RNA, 21 nt, Haemophilus influenzae Rd
aguccgauccauacaguaaaa

SEQ ID NO: 724640 - RNA, 23 nt, Haemophilus influenzae Rd
aguccgauccauacaguaaaaau

SEQ ID NO: 724641 - RNA, 22 nt, Haemophilus influenzae Rd
agucgcacccgccuuaaucauu

SEQ ID NO: 724642 - RNA, 20 nt, Haemophilus influenzae Rd
aguccuuuuaguuuccccug

SEQ ID NO: 724643 - RNA, 14 nt, Haemophilus influenzae Rd
agucgaaaucauaa

SEQ ID NO: 724644 - RNA, 16 nt, Haemophilus influenzae Rd
agucuaauaugauuaa

SEQ ID NO: 724645 - RNA, 18 nt, Haemophilus influenzae Rd
agucuacaagaaaccaaa

SEQ ID NO: 724646 - RNA, 15 nt, Haemophilus influenzae Rd
agucuauuacuaaaa

SEQ ID NO: 724647 - RNA, 13 nt, Haemophilus influenzae Rd
agucuauuauaaa

SEQ ID NO: 724648 - RNA, 18 nt, Haemophilus influenzae Rd
agucucaaauuuuucaca

SEQ ID NO: 724649 - RNA, 20 nt, Haemophilus influenzae Rd
agucuaguaacuguucgguu

SEQ ID NO: 724650 - RNA, 17 nt, Haemophilus influenzae Rd
agugaaaccaaagaguu

SEQ ID NO: 724651 - RNA, 21 nt, Haemophilus influenzae Rd
agugaaaccaaagaguuugaa

SEQ ID NO: 724652 - RNA, 16 nt, Haemophilus influenzae Rd
agucuuguaacuauaa

SEQ ID NO: 724653 - RNA, 19 nt, Haemophilus influenzae Rd
agucuuaauuuguugaauu

SEQ ID NO: 724654 - RNA, 10 nt, Haemophilus influenzae Rd
agugacaauc

SEQ ID NO: 724655 - RNA, 22 nt, Haemophilus influenzae Rd
agugacguuuauuuuuauaugu

SEQ ID NO: 724656 - RNA, 23 nt, Haemophilus influenzae Rd
agugaauuuauauuaauuuugau

SEQ ID NO: 724657 - RNA, 16 nt, Haemophilus influenzae Rd
agugaaccaauauagc

SEQ ID NO: 724658 - RNA, 20 nt, Haemophilus influenzae Rd
agugaaaugcucuaaauccc

SEQ ID NO: 724659 - RNA, 14 nt, Haemophilus influenzae Rd
agugagauaaaugg

SEQ ID NO: 724660 - RNA, 13 nt, Haemophilus influenzae Rd
agugagcauuucg

SEQ ID NO: 724661 - RNA, 22 nt, Haemophilus influenzae Rd
agugaguacccgugccuaauuc

SEQ ID NO: 724662 - RNA, 17 nt, Haemophilus influenzae Rd
agugaguauguugcuuu

SEQ ID NO: 724663 - RNA, 17 nt, Haemophilus influenzae Rd
agugaguugauuuuaaa

SEQ ID NO: 724664 - RNA, 22 nt, Haemophilus influenzae Rd
agugcggugcaauuugaaaaga

SEQ ID NO: 724665 - RNA, 15 nt, Haemophilus influenzae Rd
agugcggucaacaua

SEQ ID NO: 724666 - RNA, 17 nt, Haemophilus influenzae Rd
agugcggucaauuuuuc

SEQ ID NO: 724667 - RNA, 19 nt, Haemophilus influenzae Rd
agugcggucagcauaaaga

SEQ ID NO: 724668 - RNA, 17 nt, Haemophilus influenzae Rd
agugcggucauuuuuca

SEQ ID NO: 724669 - RNA, 21 nt, Haemophilus influenzae Rd
agugcgguuaaaaaagaaaua

SEQ ID NO: 724670 - RNA, 21 nt, Haemophilus influenzae Rd
agugcgguuaaaauucaccgc

SEQ ID NO: 724671 - RNA, 16 nt, Haemophilus influenzae Rd
agugcgguuaauuuuu

SEQ ID NO: 724672 - RNA, 17 nt, Haemophilus influenzae Rd
agugcgguuaauuuuuu

SEQ ID NO: 724673 - RNA, 17 nt, Haemophilus influenzae Rd
agugcgguuaguuuuuu

SEQ ID NO: 724674 - RNA, 15 nt, Haemophilus influenzae Rd
agugcgguugaaaaa

SEQ ID NO: 724675 - RNA, 18 nt, Haemophilus influenzae Rd
agugcgguugaaauuuaa

SEQ ID NO: 724676 - RNA, 17 nt, Haemophilus influenzae Rd
agugcgguugauuuucc

SEQ ID NO: 724677 - RNA, 21 nt, Haemophilus influenzae Rd
agugcgguugauuuuccugau

SEQ ID NO: 724678 - RNA, 15 nt, Haemophilus influenzae Rd
agugcuaaaauaaaa

SEQ ID NO: 724679 - RNA, 21 nt, Haemophilus influenzae Rd
agugcuaaauggaauguagau

SEQ ID NO: 724680 - RNA, 15 nt, Haemophilus influenzae Rd
aguggauauuuuuga

SEQ ID NO: 724681 - RNA, 19 nt, Haemophilus influenzae Rd
aguggagaaacauuuuucc

SEQ ID NO: 724682 - RNA, 23 nt, Haemophilus influenzae Rd
aguggaauaaugaaauauuccaa

SEQ ID NO: 724683 - RNA, 15 nt, Haemophilus influenzae Rd
agugcuuucauagau

SEQ ID NO: 724684 - RNA, 15 nt, Haemophilus influenzae Rd
aguggauagaugauc

SEQ ID NO: 724685 - RNA, 19 nt, Haemophilus influenzae Rd
aguggcuugcgccauuucc

SEQ ID NO: 724686 - RNA, 14 nt, Haemophilus influenzae Rd
aguggcgguaaaaa

SEQ ID NO: 724687 - RNA, 13 nt, Haemophilus influenzae Rd
aguggcuuuaaag

SEQ ID NO: 724688 - RNA, 22 nt, Haemophilus influenzae Rd
aguggcuuuaaagguuuaaacc

SEQ ID NO: 724689 - RNA, 13 nt, Haemophilus influenzae Rd
aguggguaaacca

SEQ ID NO: 724690 - RNA, 16 nt, Haemophilus influenzae Rd
aguuaaacguugaauc

SEQ ID NO: 724691 - RNA, 18 nt, Haemophilus influenzae Rd
aguuaaacagcuuuccug

SEQ ID NO: 724692 - RNA, 14 nt, Haemophilus influenzae Rd
aguuaaacaucgca

SEQ ID NO: 724693 - RNA, 22 nt, Haemophilus influenzae Rd
aguuaaaccaaauuuugaugaa

SEQ ID NO: 724694 - RNA, 23 nt, Haemophilus influenzae Rd
aguuaaaccaaauuuugaugaaa

SEQ ID NO: 724695 - RNA, 12 nt, Haemophilus influenzae Rd
aguuaaauaauc

SEQ ID NO: 724696 - RNA, 16 nt, Haemophilus influenzae Rd
aguuaaauauaaacua

SEQ ID NO: 724697 - RNA, 23 nt, Haemophilus influenzae Rd
aguuaaauccucagcaauuucuu

SEQ ID NO: 724698 - RNA, 15 nt, Haemophilus influenzae Rd
aguguugcuuugcca

SEQ ID NO: 724699 - RNA, 18 nt, Haemophilus influenzae Rd
aguguuuacuauuaauuc

SEQ ID NO: 724700 - RNA, 21 nt, Haemophilus influenzae Rd
aguguaaucagcuguuuauca

SEQ ID NO: 724701 - RNA, 14 nt, Haemophilus influenzae Rd
aguguauaaauauu

SEQ ID NO: 724702 - RNA, 15 nt, Haemophilus influenzae Rd
aguguagucacuauu

SEQ ID NO: 724703 - RNA, 16 nt, Haemophilus influenzae Rd
aguguugcagggaaag

SEQ ID NO: 724704 - RNA, 18 nt, Haemophilus influenzae Rd
aguguugcagggaaaguc

SEQ ID NO: 724705 - RNA, 15 nt, Haemophilus influenzae Rd
aguguggugaacagc

SEQ ID NO: 724706 - RNA, 19 nt, Haemophilus influenzae Rd
aguguggcuuuuuuuccuu

SEQ ID NO: 724707 - RNA, 17 nt, Haemophilus influenzae Rd
agugugcgagaaagauu

SEQ ID NO: 724708 - RNA, 22 nt, Haemophilus influenzae Rd
aguucuuuugguaauaaaucaa

SEQ ID NO: 724709 - RNA, 22 nt, Haemophilus influenzae Rd
aguucuuucugucaucacaucu

SEQ ID NO: 724710 - RNA, 20 nt, Haemophilus influenzae Rd
aguuggccaauuugcauaug

SEQ ID NO: 724711 - RNA, 14 nt, Haemophilus influenzae Rd
aguuggcaacauau

SEQ ID NO: 724712 - RNA, 19 nt, Haemophilus influenzae Rd
aguuggauaacguuuaugg

SEQ ID NO: 724713 - RNA, 14 nt, Haemophilus influenzae Rd
aguuggauuaaaca

SEQ ID NO: 724714 - RNA, 19 nt, Haemophilus influenzae Rd
aguuggaaccaccccauuu

SEQ ID NO: 724715 - RNA, 15 nt, Haemophilus influenzae Rd
aguuggagauuuuuu

SEQ ID NO: 724716 - RNA, 13 nt, Haemophilus influenzae Rd
aguugcuucgcca

SEQ ID NO: 724717 - RNA, 19 nt, Haemophilus influenzae Rd
aguugcgguggugaaaauc

SEQ ID NO: 724718 - RNA, 20 nt, Haemophilus influenzae Rd
aguugcgguggugaaaaucu

SEQ ID NO: 724719 - RNA, 20 nt, Haemophilus influenzae Rd
aguugcuaaaucaccuaaau

SEQ ID NO: 724720 - RNA, 17 nt, Haemophilus influenzae Rd
aguugagcuaaagugcg

SEQ ID NO: 724721 - RNA, 15 nt, Haemophilus influenzae Rd
aguugagaauuuuuu

SEQ ID NO: 724722 - RNA, 13 nt, Haemophilus influenzae Rd
aguugaauauuuu

SEQ ID NO: 724723 - RNA, 22 nt, Haemophilus influenzae Rd
aguugaagagaauuuucaucaa

SEQ ID NO: 724724 - RNA, 19 nt, Haemophilus influenzae Rd
aguucauaagcucgaaguu

SEQ ID NO: 724725 - RNA, 12 nt, Haemophilus influenzae Rd
aguucauaaaag

SEQ ID NO: 724726 - RNA, 18 nt, Haemophilus influenzae Rd
aguucagcgauuuuaacu

SEQ ID NO: 724727 - RNA, 19 nt, Haemophilus influenzae Rd
aguucagcgauuuuaacug

SEQ ID NO: 724728 - RNA, 14 nt, Haemophilus influenzae Rd
aguuagcucucuuu

SEQ ID NO: 724729 - RNA, 19 nt, Haemophilus influenzae Rd
aguuaguacgcuuaacuaa

SEQ ID NO: 724730 - RNA, 22 nt, Haemophilus influenzae Rd
aguuaggcuaagguuuaacuga

SEQ ID NO: 724731 - RNA, 12 nt, Haemophilus influenzae Rd
aguuauaaaccc

SEQ ID NO: 724732 - RNA, 22 nt, Haemophilus influenzae Rd
aguuauaaacccaucauaaaua

SEQ ID NO: 724733 - RNA, 23 nt, Haemophilus influenzae Rd
aguuauaaacccaucauaaauau

SEQ ID NO: 724734 - RNA, 13 nt, Haemophilus influenzae Rd
aguuaguuuuuua

SEQ ID NO: 724735 - RNA, 20 nt, Haemophilus influenzae Rd
aguuauaauaaccauacaac

SEQ ID NO: 724736 - RNA, 14 nt, Haemophilus influenzae Rd
aguucaauaaaaau

SEQ ID NO: 724737 - RNA, 20 nt, Haemophilus influenzae Rd
aguucaauaaaaauauauuu

SEQ ID NO: 724738 - RNA, 22 nt, Haemophilus influenzae Rd
aguucaauaaaaauauauuuag

SEQ ID NO: 724739 - RNA, 19 nt, Haemophilus influenzae Rd
aguucacaaaucuaaaaau

SEQ ID NO: 724740 - RNA, 16 nt, Haemophilus influenzae Rd
aguuauaguauauuua

SEQ ID NO: 724741 - RNA, 16 nt, Haemophilus influenzae Rd
aguuauugauaaaaau

SEQ ID NO: 724742 - RNA, 15 nt, Haemophilus influenzae Rd
aguuauuuauuuaag

SEQ ID NO: 724743 - RNA, 14 nt, Haemophilus influenzae Rd
aguuauuucuuuaa

SEQ ID NO: 724744 - RNA, 19 nt, Haemophilus influenzae Rd
auaaaagugcgguaaauuu

SEQ ID NO: 724745 - RNA, 21 nt, Haemophilus influenzae Rd
auaaaagugcgguaaauuuuu

SEQ ID NO: 724746 - RNA, 21 nt, Haemophilus influenzae Rd
auaaacagggugucguagaaa

SEQ ID NO: 724747 - RNA, 23 nt, Haemophilus influenzae Rd
auaaacagggugucguagaaaua

SEQ ID NO: 724748 - RNA, 22 nt, Haemophilus influenzae Rd
auaaacagccauggcuuuuucc

SEQ ID NO: 724749 - RNA, 23 nt, Haemophilus influenzae Rd
auaaacagccauggcuuuuuccu

SEQ ID NO: 724750 - RNA, 17 nt, Haemophilus influenzae Rd
auaaacauacaucuaau

SEQ ID NO: 724751 - RNA, 19 nt, Haemophilus influenzae Rd
auaaacauacaucuaauuu

SEQ ID NO: 724752 - RNA, 21 nt, Haemophilus influenzae Rd
auaaacggagcgauguuuucc

SEQ ID NO: 724753 - RNA, 18 nt, Haemophilus influenzae Rd
auaaacggauugcauaua

SEQ ID NO: 724754 - RNA, 16 nt, Haemophilus influenzae Rd
auaaacgccuuuuaaa

SEQ ID NO: 724755 - RNA, 21 nt, Haemophilus influenzae Rd
auaaacgccuuuuaaacuauu

SEQ ID NO: 724756 - RNA, 13 nt, Haemophilus influenzae Rd
auaaacauuuuuc

SEQ ID NO: 724757 - RNA, 15 nt, Haemophilus influenzae Rd
auaaacauuuuucau

SEQ ID NO: 724758 - RNA, 20 nt, Haemophilus influenzae Rd
auaaacauuaggaauaucuu

SEQ ID NO: 724759 - RNA, 10 nt, Haemophilus influenzae Rd
auaaacauuu

SEQ ID NO: 724760 - RNA, 21 nt, Haemophilus influenzae Rd
auaaacgucauaguauggcuc

SEQ ID NO: 724761 - RNA, 18 nt, Haemophilus influenzae Rd
auaaacgcuguuuugcuu

SEQ ID NO: 724762 - RNA, 17 nt, Haemophilus influenzae Rd
auaaacguugugaacuu

SEQ ID NO: 724763 - RNA, 16 nt, Haemophilus influenzae Rd
auaaacuacuucuaaa

SEQ ID NO: 724764 - RNA, 16 nt, Haemophilus influenzae Rd
auaaacuuccuuuugc

SEQ ID NO: 724765 - RNA, 14 nt, Haemophilus influenzae Rd
auaaacugauuuug

SEQ ID NO: 724766 - RNA, 16 nt, Haemophilus influenzae Rd
auaaacugauuuugau

SEQ ID NO: 724767 - RNA, 20 nt, Haemophilus influenzae Rd
auaaacugcgaucuucugau

SEQ ID NO: 724768 - RNA, 16 nt, Haemophilus influenzae Rd
auaaagaagaaaaucu

SEQ ID NO: 724769 - RNA, 18 nt, Haemophilus influenzae Rd
auaaagaaaggaauagau

SEQ ID NO: 724770 - RNA, 14 nt, Haemophilus influenzae Rd
auaaagagaauauu

SEQ ID NO: 724771 - RNA, 14 nt, Haemophilus influenzae Rd
auaaagagauuauu

SEQ ID NO: 724772 - RNA, 20 nt, Haemophilus influenzae Rd
auaaagagauuauuucuccu

SEQ ID NO: 724773 - RNA, 13 nt, Haemophilus influenzae Rd
auaaagauaacua

SEQ ID NO: 724774 - RNA, 20 nt, Haemophilus influenzae Rd
auaaagauaacuaagaugau

SEQ ID NO: 724775 - RNA, 16 nt, Haemophilus influenzae Rd
auaaagcuacuaaaaa

SEQ ID NO: 724776 - RNA, 17 nt, Haemophilus influenzae Rd
auaaagcuacuaaaaau

SEQ ID NO: 724777 - RNA, 21 nt, Haemophilus influenzae Rd
auaaagcucuaauugaaauag

SEQ ID NO: 724778 - RNA, 19 nt, Haemophilus influenzae Rd
auaaagcucucgaacauuc

SEQ ID NO: 724779 - RNA, 14 nt, Haemophilus influenzae Rd
auaaaggauuaaau

SEQ ID NO: 724780 - RNA, 13 nt, Haemophilus influenzae Rd
auaaaggauuuua

SEQ ID NO: 724781 - RNA, 23 nt, Haemophilus influenzae Rd
auaaaggcacaggaugcaccaau

SEQ ID NO: 724782 - RNA, 22 nt, Haemophilus influenzae Rd
auaaaugcaucauuaauacaca

SEQ ID NO: 724783 - RNA, 21 nt, Haemophilus influenzae Rd
auaaaugauuauccacuaaaa

SEQ ID NO: 724784 - RNA, 22 nt, Haemophilus influenzae Rd
auaaaugcgucgcagccuuguu

SEQ ID NO: 724785 - RNA, 18 nt, Haemophilus influenzae Rd
auaaaugcgugaacugcu

SEQ ID NO: 724786 - RNA, 17 nt, Haemophilus influenzae Rd
auaaaugcuacuugaau

SEQ ID NO: 724787 - RNA, 15 nt, Haemophilus influenzae Rd
auaaauggcucaagu

SEQ ID NO: 724788 - RNA, 12 nt, Haemophilus influenzae Rd
auaaauggguuu

SEQ ID NO: 724789 - RNA, 19 nt, Haemophilus influenzae Rd
auaaauucguacaaaugaa

SEQ ID NO: 724790 - RNA, 14 nt, Haemophilus influenzae Rd
auaaauucuuacca

SEQ ID NO: 724791 - RNA, 16 nt, Haemophilus influenzae Rd
auaaauuacauaaaag

SEQ ID NO: 724792 - RNA, 20 nt, Haemophilus influenzae Rd
auaaauuaacuuaucuaaaa

SEQ ID NO: 724793 - RNA, 13 nt, Haemophilus influenzae Rd
auaaauuauauuu

SEQ ID NO: 724794 - RNA, 14 nt, Haemophilus influenzae Rd
auaaauuauauuuu

SEQ ID NO: 724795 - RNA, 10 nt, Haemophilus influenzae Rd
auaaauuagc

SEQ ID NO: 724796 - RNA, 20 nt, Haemophilus influenzae Rd
auaaauuagccccaaauuac

SEQ ID NO: 724797 - RNA, 17 nt, Haemophilus influenzae Rd
auaaauuagcuuaauaa

SEQ ID NO: 724798 - RNA, 18 nt, Haemophilus influenzae Rd
auaaaggcauuuauuuca

SEQ ID NO: 724799 - RNA, 23 nt, Haemophilus influenzae Rd
auaaaguggagcuggauguggcu

SEQ ID NO: 724800 - RNA, 23 nt, Haemophilus influenzae Rd
auaaagggaaagugcagcccaaa

SEQ ID NO: 724801 - RNA, 23 nt, Haemophilus influenzae Rd
auaaagugcggucaauuuucaaa

SEQ ID NO: 724802 - RNA, 20 nt, Haemophilus influenzae Rd
auaaagugcgguuauuuuuu

SEQ ID NO: 724803 - RNA, 23 nt, Haemophilus influenzae Rd
auaaauaaaaaaccgagucuuag

SEQ ID NO: 724804 - RNA, 13 nt, Haemophilus influenzae Rd
auaaauaaaacaa

SEQ ID NO: 724805 - RNA, 14 nt, Haemophilus influenzae Rd
auaaauaaaacaag

SEQ ID NO: 724806 - RNA, 16 nt, Haemophilus influenzae Rd
auaaauaaaacaagga

SEQ ID NO: 724807 - RNA, 12 nt, Haemophilus influenzae Rd
auaaauauuuag

SEQ ID NO: 724808 - RNA, 23 nt, Haemophilus influenzae Rd
auaaauauuacuuaacaucauca

SEQ ID NO: 724809 - RNA, 14 nt, Haemophilus influenzae Rd
auaaaucaaaagaa

SEQ ID NO: 724810 - RNA, 22 nt, Haemophilus influenzae Rd
auaaaucaaaagaauuaaaaau

SEQ ID NO: 724811 - RNA, 23 nt, Haemophilus influenzae Rd
auaaaucaauacgccuaaaacaa

SEQ ID NO: 724812 - RNA, 14 nt, Haemophilus influenzae Rd
auaaaucuuuaaau

SEQ ID NO: 724813 - RNA, 14 nt, Haemophilus influenzae Rd
auaaaucauaggcu

SEQ ID NO: 724814 - RNA, 18 nt, Haemophilus influenzae Rd
auaaaucacuuaauuucu

SEQ ID NO: 724815 - RNA, 24 nt, Haemophilus influenzae Rd
auaaaucaucccuguauaaagaua

SEQ ID NO: 724816 - RNA, 15 nt, Haemophilus influenzae Rd
aguuggguaaucaaa

SEQ ID NO: 724817 - RNA, 21 nt, Haemophilus influenzae Rd
aguugggauuuaucuuccccc

SEQ ID NO: 724818 - RNA, 16 nt, Haemophilus influenzae Rd
aguuuucuguauacca

SEQ ID NO: 724819 - RNA, 17 nt, Haemophilus influenzae Rd
aguuuugaaguuaucaa

SEQ ID NO: 724820 - RNA, 17 nt, Haemophilus influenzae Rd
aguuuuggcucuacuuu

SEQ ID NO: 724821 - RNA, 22 nt, Haemophilus influenzae Rd
aguuuugggauaaucugauuga

SEQ ID NO: 724822 - RNA, 10 nt, Haemophilus influenzae Rd
aguuuugcuu

SEQ ID NO: 724823 - RNA, 17 nt, Haemophilus influenzae Rd
aguuuugcuuuuuuaau

SEQ ID NO: 724824 - RNA, 14 nt, Haemophilus influenzae Rd
auaaaaaagaaauu

SEQ ID NO: 724825 - RNA, 11 nt, Haemophilus influenzae Rd
auaaaaaaauc

SEQ ID NO: 724826 - RNA, 12 nt, Haemophilus influenzae Rd
auaaaaaauaaa

SEQ ID NO: 724827 - RNA, 14 nt, Haemophilus influenzae Rd
aguuuuuuuauaaa

SEQ ID NO: 724828 - RNA, 17 nt, Haemophilus influenzae Rd
aguuuuuuuauaaaaaa

SEQ ID NO: 724829 - RNA, 13 nt, Haemophilus influenzae Rd
aguuuuuugccaa

SEQ ID NO: 724830 - RNA, 14 nt, Haemophilus influenzae Rd
aguuuuuugccaaa

SEQ ID NO: 724831 - RNA, 17 nt, Haemophilus influenzae Rd
aguuuuuugccaaaaaa

SEQ ID NO: 724832 - RNA, 13 nt, Haemophilus influenzae Rd
aguuuuuucacuu

SEQ ID NO: 724833 - RNA, 18 nt, Haemophilus influenzae Rd
aguuuuuuaccuugcaag

SEQ ID NO: 724834 - RNA, 15 nt, Haemophilus influenzae Rd
aguuuuucgcugcag

SEQ ID NO: 724835 - RNA, 21 nt, Haemophilus influenzae Rd
auaaaaccauccgaaauuaau

SEQ ID NO: 724836 - RNA, 23 nt, Haemophilus influenzae Rd
auaaaaccauccgaaauuaauuu

SEQ ID NO: 724837 - RNA, 17 nt, Haemophilus influenzae Rd
auaaaacagagaaaaaa

SEQ ID NO: 724838 - RNA, 18 nt, Haemophilus influenzae Rd
auaaaacacaguuauuuu

SEQ ID NO: 724839 - RNA, 15 nt, Haemophilus influenzae Rd
auaaaaauauuuuaa

SEQ ID NO: 724840 - RNA, 21 nt, Haemophilus influenzae Rd
auaaaaauugaucuaaauuau

SEQ ID NO: 724841 - RNA, 14 nt, Haemophilus influenzae Rd
auaaaaaucaucgu

SEQ ID NO: 724842 - RNA, 19 nt, Haemophilus influenzae Rd
auaaaaaguggguagcuuu

SEQ ID NO: 724843 - RNA, 22 nt, Haemophilus influenzae Rd
auaaaaaguggguagcuuucgc

SEQ ID NO: 724844 - RNA, 15 nt, Haemophilus influenzae Rd
auaaaaaguaggcau

SEQ ID NO: 724845 - RNA, 22 nt, Haemophilus influenzae Rd
auaaaaacgugcuuuuuuuguu

SEQ ID NO: 724846 - RNA, 23 nt, Haemophilus influenzae Rd
auaaaaaccagauaaaaacugug

SEQ ID NO: 724847 - RNA, 15 nt, Haemophilus influenzae Rd
auaaaaaauggaaua

SEQ ID NO: 724848 - RNA, 13 nt, Haemophilus influenzae Rd
auaaaaaauuaag

SEQ ID NO: 724849 - RNA, 19 nt, Haemophilus influenzae Rd
auaaaaggcaaagcaaaau

SEQ ID NO: 724850 - RNA, 15 nt, Haemophilus influenzae Rd
auaaaacaguauuuu

SEQ ID NO: 724851 - RNA, 14 nt, Haemophilus influenzae Rd
auaaaacccaguuu

SEQ ID NO: 724852 - RNA, 16 nt, Haemophilus influenzae Rd
auaaaacggcucaaau

SEQ ID NO: 724853 - RNA, 15 nt, Haemophilus influenzae Rd
auaaaaccuaaaauu

SEQ ID NO: 724854 - RNA, 17 nt, Haemophilus influenzae Rd
auaaaaccuaaaauuga

SEQ ID NO: 724855 - RNA, 19 nt, Haemophilus influenzae Rd
auaaaaccuaaaauugauu

SEQ ID NO: 724856 - RNA, 14 nt, Haemophilus influenzae Rd
auaaaaccucagaa

SEQ ID NO: 724857 - RNA, 19 nt, Haemophilus influenzae Rd
auaaaaccucagaagaaau

SEQ ID NO: 724858 - RNA, 19 nt, Haemophilus influenzae Rd
auaaaacuuuucuuauaau

SEQ ID NO: 724859 - RNA, 20 nt, Haemophilus influenzae Rd
auaaaagaaagggcaucaau

SEQ ID NO: 724860 - RNA, 20 nt, Haemophilus influenzae Rd
auaaaagaagcuauuacucu

SEQ ID NO: 724861 - RNA, 12 nt, Haemophilus influenzae Rd
auaaaagaauuu

SEQ ID NO: 724862 - RNA, 14 nt, Haemophilus influenzae Rd
auaaucuaauccaa

SEQ ID NO: 724863 - RNA, 14 nt, Haemophilus influenzae Rd
auaaucguuaaacu

SEQ ID NO: 724864 - RNA, 17 nt, Haemophilus influenzae Rd
auaaucuccauaauauu

SEQ ID NO: 724865 - RNA, 21 nt, Haemophilus influenzae Rd
auaaucgguuguuuuuuaaua

SEQ ID NO: 724866 - RNA, 20 nt, Haemophilus influenzae Rd
auaaucgcuuggucacuggu

SEQ ID NO: 724867 - RNA, 23 nt, Haemophilus influenzae Rd
auaaugcgaucuuuuguuacuuu

SEQ ID NO: 724868 - RNA, 21 nt, Haemophilus influenzae Rd
auaaugcccgcacuuuuaacc

SEQ ID NO: 724869 - RNA, 16 nt, Haemophilus influenzae Rd
auaaugcaaaaacaag

SEQ ID NO: 724870 - RNA, 17 nt, Haemophilus influenzae Rd
auaaugcaaccaaacaa

SEQ ID NO: 724871 - RNA, 14 nt, Haemophilus influenzae Rd
auaaugcauagcca

SEQ ID NO: 724872 - RNA, 15 nt, Haemophilus influenzae Rd
auaaugcauagccaa

SEQ ID NO: 724873 - RNA, 17 nt, Haemophilus influenzae Rd
auaaugcauagccaagu

SEQ ID NO: 724874 - RNA, 16 nt, Haemophilus influenzae Rd
auaauguggugcuguu

SEQ ID NO: 724875 - RNA, 20 nt, Haemophilus influenzae Rd
auaauguguugauuucuaca

SEQ ID NO: 724876 - RNA, 16 nt, Haemophilus influenzae Rd
auaauguucuuuuaaa

SEQ ID NO: 724877 - RNA, 17 nt, Haemophilus influenzae Rd
auaauguugcugauugc

SEQ ID NO: 724878 - RNA, 22 nt, Haemophilus influenzae Rd
auaauguugcugauugcacauu

SEQ ID NO: 724879 - RNA, 20 nt, Haemophilus influenzae Rd
auaauguucccuauaaauaa

SEQ ID NO: 724880 - RNA, 13 nt, Haemophilus influenzae Rd
auaauguuucacu

SEQ ID NO: 724881 - RNA, 14 nt, Haemophilus influenzae Rd
auaauguuuucauu

SEQ ID NO: 724882 - RNA, 21 nt, Haemophilus influenzae Rd
auaauguuuucauuaauuuca

SEQ ID NO: 724883 - RNA, 16 nt, Haemophilus influenzae Rd
auaauuaaaaauaaau

SEQ ID NO: 724884 - RNA, 17 nt, Haemophilus influenzae Rd
auaauuaaaaauaaaua

SEQ ID NO: 724885 - RNA, 15 nt, Haemophilus influenzae Rd
auaauuaaacagcca

SEQ ID NO: 724886 - RNA, 19 nt, Haemophilus influenzae Rd
auaauuaaacagccaaaca

SEQ ID NO: 724887 - RNA, 20 nt, Haemophilus influenzae Rd
auaauuaaacagccaaacaa

SEQ ID NO: 724888 - RNA, 14 nt, Haemophilus influenzae Rd
auaauuaaacauuu

SEQ ID NO: 724889 - RNA, 15 nt, Haemophilus influenzae Rd
auaauuaaaguuacu

SEQ ID NO: 724890 - RNA, 15 nt, Haemophilus influenzae Rd
auaauuaaagccgaa

SEQ ID NO: 724891 - RNA, 17 nt, Haemophilus influenzae Rd
auaauuaaaucuucgcc

SEQ ID NO: 724892 - RNA, 19 nt, Haemophilus influenzae Rd
auaauuaucaacaucaacu

SEQ ID NO: 724893 - RNA, 13 nt, Haemophilus influenzae Rd
auaauuagauaau

SEQ ID NO: 724894 - RNA, 16 nt, Haemophilus influenzae Rd
auaauuagaucauaaa

SEQ ID NO: 724895 - RNA, 19 nt, Haemophilus influenzae Rd
auaauuaccugugaaaaca

SEQ ID NO: 724896 - RNA, 18 nt, Haemophilus influenzae Rd
auaauuacgccuaaccaa

SEQ ID NO: 724897 - RNA, 14 nt, Haemophilus influenzae Rd
auaauuaauaaaaa

SEQ ID NO: 724898 - RNA, 22 nt, Haemophilus influenzae Rd
auaauuaauaaaaaaucuguga

SEQ ID NO: 724899 - RNA, 20 nt, Haemophilus influenzae Rd
auaauuaaucugcaccuuaa

SEQ ID NO: 724900 - RNA, 14 nt, Haemophilus influenzae Rd
auaauacguaaauu

SEQ ID NO: 724901 - RNA, 18 nt, Haemophilus influenzae Rd
auaauagaaacuaaacuu

SEQ ID NO: 724902 - RNA, 12 nt, Haemophilus influenzae Rd
auaauagacaua

SEQ ID NO: 724903 - RNA, 15 nt, Haemophilus influenzae Rd
auaauagacugaaaa

SEQ ID NO: 724904 - RNA, 18 nt, Haemophilus influenzae Rd
auaauaucagagaaaagu

SEQ ID NO: 724905 - RNA, 21 nt, Haemophilus influenzae Rd
auaauauauuauguauuacca

SEQ ID NO: 724906 - RNA, 23 nt, Haemophilus influenzae Rd
auaauaucaaucacuucucugac

SEQ ID NO: 724907 - RNA, 12 nt, Haemophilus influenzae Rd
auaauaucacaa

SEQ ID NO: 724908 - RNA, 18 nt, Haemophilus influenzae Rd
auaauagccauauuaucu

SEQ ID NO: 724909 - RNA, 12 nt, Haemophilus influenzae Rd
auaaguaacuuu

SEQ ID NO: 724910 - RNA, 15 nt, Haemophilus influenzae Rd
auaaguaacuuuaga

SEQ ID NO: 724911 - RNA, 14 nt, Haemophilus influenzae Rd
auaaguaaaaccau

SEQ ID NO: 724912 - RNA, 14 nt, Haemophilus influenzae Rd
auaaguaaaauagu

SEQ ID NO: 724913 - RNA, 13 nt, Haemophilus influenzae Rd
auaaguaggcaaa

SEQ ID NO: 724914 - RNA, 23 nt, Haemophilus influenzae Rd
auaaguauaacuuaaaucaacuu

SEQ ID NO: 724915 - RNA, 22 nt, Haemophilus influenzae Rd
auaaguauuuugcagaauacug

SEQ ID NO: 724916 - RNA, 21 nt, Haemophilus influenzae Rd
auaauccagcaugagcuucaa

SEQ ID NO: 724917 - RNA, 18 nt, Haemophilus influenzae Rd
auaauccagcuacauuca

SEQ ID NO: 724918 - RNA, 19 nt, Haemophilus influenzae Rd
auaauccagcuacauucau

SEQ ID NO: 724919 - RNA, 11 nt, Haemophilus influenzae Rd
auaauccaacg

SEQ ID NO: 724920 - RNA, 16 nt, Haemophilus influenzae Rd
auaauccaacuaugaa

SEQ ID NO: 724921 - RNA, 22 nt, Haemophilus influenzae Rd
auaauccaacuaugaagacuaa

SEQ ID NO: 724922 - RNA, 16 nt, Haemophilus influenzae Rd
auaaucauugaaaugu

SEQ ID NO: 724923 - RNA, 18 nt, Haemophilus influenzae Rd
auaaucauugaaauguug

SEQ ID NO: 724924 - RNA, 17 nt, Haemophilus influenzae Rd
auaauauuuuggcaauc

SEQ ID NO: 724925 - RNA, 14 nt, Haemophilus influenzae Rd
auaauauuuucuuu

SEQ ID NO: 724926 - RNA, 12 nt, Haemophilus influenzae Rd
auaauauuuaaa

SEQ ID NO: 724927 - RNA, 13 nt, Haemophilus influenzae Rd
auaauauuuaaaa

SEQ ID NO: 724928 - RNA, 16 nt, Haemophilus influenzae Rd
auaaucaaaaaugcuc

SEQ ID NO: 724929 - RNA, 22 nt, Haemophilus influenzae Rd
auaaucaaaauuacgccugcaa

SEQ ID NO: 724930 - RNA, 17 nt, Haemophilus influenzae Rd
auaauauuccuuagaaa

SEQ ID NO: 724931 - RNA, 14 nt, Haemophilus influenzae Rd
auaauauucaaaac

SEQ ID NO: 724932 - RNA, 17 nt, Haemophilus influenzae Rd
auaauauuccaaaaaau

SEQ ID NO: 724933 - RNA, 19 nt, Haemophilus influenzae Rd
auaauauuccaaaaaauaa

SEQ ID NO: 724934 - RNA, 11 nt, Haemophilus influenzae Rd
auaauauguuu

SEQ ID NO: 724935 - RNA, 19 nt, Haemophilus influenzae Rd
auaagcaaguaauuuaaaa

SEQ ID NO: 724936 - RNA, 23 nt, Haemophilus influenzae Rd
auaagcaaguaauuuaaaaagua

SEQ ID NO: 724937 - RNA, 16 nt, Haemophilus influenzae Rd
auaagauuugcuuuuu

SEQ ID NO: 724938 - RNA, 14 nt, Haemophilus influenzae Rd
auaagauagaaaug

SEQ ID NO: 724939 - RNA, 16 nt, Haemophilus influenzae Rd
auaagaucuucuuugc

SEQ ID NO: 724940 - RNA, 23 nt, Haemophilus influenzae Rd
auaagaugaacgaguaaauuaau

SEQ ID NO: 724941 - RNA, 22 nt, Haemophilus influenzae Rd
auaagauguuucacuaaaaaua

SEQ ID NO: 724942 - RNA, 23 nt, Haemophilus influenzae Rd
auaagauuaaugauaaguuuugu

SEQ ID NO: 724943 - RNA, 22 nt, Haemophilus influenzae Rd
auaagauuacccacuaaguauu

SEQ ID NO: 724944 - RNA, 20 nt, Haemophilus influenzae Rd
auaagccacugugcauuaaa

SEQ ID NO: 724945 - RNA, 21 nt, Haemophilus influenzae Rd
auaagccacugugcauuaaau

SEQ ID NO: 724946 - RNA, 13 nt, Haemophilus influenzae Rd
auaagcacaaucg

SEQ ID NO: 724947 - RNA, 17 nt, Haemophilus influenzae Rd
auaagcccgaacagaaa

SEQ ID NO: 724948 - RNA, 18 nt, Haemophilus influenzae Rd
auaagccauuaacauuua

SEQ ID NO: 724949 - RNA, 18 nt, Haemophilus influenzae Rd
auaagcccaacuuaaguu

SEQ ID NO: 724950 - RNA, 14 nt, Haemophilus influenzae Rd
auaagguacaacag

SEQ ID NO: 724951 - RNA, 20 nt, Haemophilus influenzae Rd
auaaggucagcaaauuaucu

SEQ ID NO: 724952 - RNA, 17 nt, Haemophilus influenzae Rd
auaagggcugauuuuaa

SEQ ID NO: 724953 - RNA, 21 nt, Haemophilus influenzae Rd
auaagggcugauuuuaaauau

SEQ ID NO: 724954 - RNA, 19 nt, Haemophilus influenzae Rd
auaaggcuugcacaauaau

SEQ ID NO: 724955 - RNA, 16 nt, Haemophilus influenzae Rd
auaaggcguaaaacua

SEQ ID NO: 724956 - RNA, 20 nt, Haemophilus influenzae Rd
auaaggcaccuuuuugcucu

SEQ ID NO: 724957 - RNA, 15 nt, Haemophilus influenzae Rd
auaaggcagaaauga

SEQ ID NO: 724958 - RNA, 14 nt, Haemophilus influenzae Rd
auaagcugcgccua

SEQ ID NO: 724959 - RNA, 15 nt, Haemophilus influenzae Rd
auaagcugcuuaauu

SEQ ID NO: 724960 - RNA, 20 nt, Haemophilus influenzae Rd
auaagcuaucgucaaauuua

SEQ ID NO: 724961 - RNA, 19 nt, Haemophilus influenzae Rd
auaagcucgaaguuuugcu

SEQ ID NO: 724962 - RNA, 16 nt, Haemophilus influenzae Rd
auaagcugcaucaaua

SEQ ID NO: 724963 - RNA, 14 nt, Haemophilus influenzae Rd
auaagcuuggcuua

SEQ ID NO: 724964 - RNA, 14 nt, Haemophilus influenzae Rd
auaaggaccaagca

SEQ ID NO: 724965 - RNA, 15 nt, Haemophilus influenzae Rd
auaaggaccaagcaa

SEQ ID NO: 724966 - RNA, 18 nt, Haemophilus influenzae Rd
auaaggauuaauguguuc

SEQ ID NO: 724967 - RNA, 17 nt, Haemophilus influenzae Rd
auaaggaaauugcaggc

SEQ ID NO: 724968 - RNA, 13 nt, Haemophilus influenzae Rd
auaacuagcaauc

SEQ ID NO: 724969 - RNA, 18 nt, Haemophilus influenzae Rd
auaacuaggcaucaaaau

SEQ ID NO: 724970 - RNA, 16 nt, Haemophilus influenzae Rd
auaacguuuaaaaauu

SEQ ID NO: 724971 - RNA, 18 nt, Haemophilus influenzae Rd
auaacguuuaaaaauuaa

SEQ ID NO: 724972 - RNA, 12 nt, Haemophilus influenzae Rd
auaacuaaaaau

SEQ ID NO: 724973 - RNA, 13 nt, Haemophilus influenzae Rd
auaacuaaaaaua

SEQ ID NO: 724974 - RNA, 19 nt, Haemophilus influenzae Rd
auaacgccaugaacguuug

SEQ ID NO: 724975 - RNA, 20 nt, Haemophilus influenzae Rd
auaacgagguuggcaauaaa

SEQ ID NO: 724976 - RNA, 19 nt, Haemophilus influenzae Rd
auaacgacgggaaacuguc

SEQ ID NO: 724977 - RNA, 14 nt, Haemophilus influenzae Rd
auaacgauauguua

SEQ ID NO: 724978 - RNA, 16 nt, Haemophilus influenzae Rd
auaacgauauucuugc

SEQ ID NO: 724979 - RNA, 15 nt, Haemophilus influenzae Rd
auaaauuuaaaggac

SEQ ID NO: 724980 - RNA, 15 nt, Haemophilus influenzae Rd
auaaauuuaaauuau

SEQ ID NO: 724981 - RNA, 17 nt, Haemophilus influenzae Rd
auaaauuuaaauuauua

SEQ ID NO: 724982 - RNA, 12 nt, Haemophilus influenzae Rd
auaaauuuagaa

SEQ ID NO: 724983 - RNA, 14 nt, Haemophilus influenzae Rd
auaaauuuagaaua

SEQ ID NO: 724984 - RNA, 18 nt, Haemophilus influenzae Rd
auaaauuuagaauagggu

SEQ ID NO: 724985 - RNA, 24 nt, Haemophilus influenzae Rd
auaaauuuauuuaauaauaucaau

SEQ ID NO: 724986 - RNA, 13 nt, Haemophilus influenzae Rd
auaaauugcccuc

SEQ ID NO: 724987 - RNA, 22 nt, Haemophilus influenzae Rd
auaaauuugaucguuaauauca

SEQ ID NO: 724988 - RNA, 23 nt, Haemophilus influenzae Rd
auaaauuugaucguuaauaucau

SEQ ID NO: 724989 - RNA, 23 nt, Haemophilus influenzae Rd
auaaauuuggguaguuuauaaaa

SEQ ID NO: 724990 - RNA, 14 nt, Haemophilus influenzae Rd
auaaauuugugugg

SEQ ID NO: 724991 - RNA, 20 nt, Haemophilus influenzae Rd
auaacuugcuugugggaauu

SEQ ID NO: 724992 - RNA, 23 nt, Haemophilus influenzae Rd
auaacuugauguuuuugaaguaa

SEQ ID NO: 724993 - RNA, 14 nt, Haemophilus influenzae Rd
auaacuuuuuggca

SEQ ID NO: 724994 - RNA, 13 nt, Haemophilus influenzae Rd
auaacuuucaguu

SEQ ID NO: 724995 - RNA, 20 nt, Haemophilus influenzae Rd
auaacuuucaguuaaauuuu

SEQ ID NO: 724996 - RNA, 19 nt, Haemophilus influenzae Rd
auaacuauuggcaucaaaa

SEQ ID NO: 724997 - RNA, 22 nt, Haemophilus influenzae Rd
auaacucaacaccgcaaaaaua

SEQ ID NO: 724998 - RNA, 21 nt, Haemophilus influenzae Rd
auaagaguuuccuuauauuca

SEQ ID NO: 724999 - RNA, 21 nt, Haemophilus influenzae Rd
auaagauaacaagaaaaauca

SEQ ID NO: 725000 - RNA, 13 nt, Haemophilus influenzae Rd
auaagaaaauuau

SEQ ID NO: 725001 - RNA, 16 nt, Haemophilus influenzae Rd
agcuccuacauuaaaa

SEQ ID NO: 725002 - RNA, 17 nt, Haemophilus influenzae Rd
agcuccuacauuaaaag

SEQ ID NO: 725003 - RNA, 18 nt, Haemophilus influenzae Rd
agcuccuacauuaaaaga

SEQ ID NO: 725004 - RNA, 15 nt, Haemophilus influenzae Rd
agcucggaauguuuu

SEQ ID NO: 725005 - RNA, 20 nt, Haemophilus influenzae Rd
agcucuguaaaacauuucau

SEQ ID NO: 725006 - RNA, 18 nt, Haemophilus influenzae Rd
agcucgguaaaaaucauu

SEQ ID NO: 725007 - RNA, 17 nt, Haemophilus influenzae Rd
agcucguaaagaucauu

SEQ ID NO: 725008 - RNA, 14 nt, Haemophilus influenzae Rd
agcucguugccaua

SEQ ID NO: 725009 - RNA, 20 nt, Haemophilus influenzae Rd
agcucguugccauaaaaaau

SEQ ID NO: 725010 - RNA, 21 nt, Haemophilus influenzae Rd
agcucguugccauaaaaaauu

SEQ ID NO: 725011 - RNA, 23 nt, Haemophilus influenzae Rd
agcugauaaguucauaaaagggg

SEQ ID NO: 725012 - RNA, 15 nt, Haemophilus influenzae Rd
agcugaauaaaagag

SEQ ID NO: 725013 - RNA, 15 nt, Haemophilus influenzae Rd
agcugaaaaauaaaa

SEQ ID NO: 725014 - RNA, 15 nt, Haemophilus influenzae Rd
agcugaaauuuagug

SEQ ID NO: 725015 - RNA, 20 nt, Haemophilus influenzae Rd
agcuggcgguuugaaauuua

SEQ ID NO: 725016 - RNA, 17 nt, Haemophilus influenzae Rd
agcuggcucuucuuguu

SEQ ID NO: 725017 - RNA, 22 nt, Haemophilus influenzae Rd
agcuggauucauuugcaaauca

SEQ ID NO: 725018 - RNA, 13 nt, Haemophilus influenzae Rd
agcuguuguugug

SEQ ID NO: 725019 - RNA, 15 nt, Haemophilus influenzae Rd
agcuguuuaucaaua

SEQ ID NO: 725020 - RNA, 16 nt, Haemophilus influenzae Rd
agcuguguaagcuggc

SEQ ID NO: 725021 - RNA, 23 nt, Haemophilus influenzae Rd
agcuggcuuucuuuuucaaguuc

SEQ ID NO: 725022 - RNA, 22 nt, Haemophilus influenzae Rd
agcuggaguucguuauaagccu

SEQ ID NO: 725023 - RNA, 17 nt, Haemophilus influenzae Rd
agcugauucuucauaaa

SEQ ID NO: 725024 - RNA, 16 nt, Haemophilus influenzae Rd
agcugcacaagcacca

SEQ ID NO: 725025 - RNA, 22 nt, Haemophilus influenzae Rd
agcugcacaagcaccacuucca

SEQ ID NO: 725026 - RNA, 11 nt, Haemophilus influenzae Rd
agcugcaauaa

SEQ ID NO: 725027 - RNA, 22 nt, Haemophilus influenzae Rd
agcuucuucaucgcucaucgua

SEQ ID NO: 725028 - RNA, 24 nt, Haemophilus influenzae Rd
agcuucagcuugaguugucacaac

SEQ ID NO: 725029 - RNA, 15 nt, Haemophilus influenzae Rd
agcuucaaaaucacc

SEQ ID NO: 725030 - RNA, 19 nt, Haemophilus influenzae Rd
agcuuaauauguucuuugu

SEQ ID NO: 725031 - RNA, 22 nt, Haemophilus influenzae Rd
agcuuuuugcacgguguuuucu

SEQ ID NO: 725032 - RNA, 14 nt, Haemophilus influenzae Rd
agcuuuccaaacaa

SEQ ID NO: 725033 - RNA, 16 nt, Haemophilus influenzae Rd
agcuuuccaaacaagg

SEQ ID NO: 725034 - RNA, 18 nt, Haemophilus influenzae Rd
agcuugcuccgcuaaaaa

SEQ ID NO: 725035 - RNA, 13 nt, Haemophilus influenzae Rd
aggaaaaaggcau

SEQ ID NO: 725036 - RNA, 13 nt, Haemophilus influenzae Rd
aggaaaaauaaau

SEQ ID NO: 725037 - RNA, 20 nt, Haemophilus influenzae Rd
aggaaacguaaaauaucuuu

SEQ ID NO: 725038 - RNA, 16 nt, Haemophilus influenzae Rd
aggaauauucuuuaaa

SEQ ID NO: 725039 - RNA, 16 nt, Haemophilus influenzae Rd
aggaauagauuuauac

SEQ ID NO: 725040 - RNA, 12 nt, Haemophilus influenzae Rd
aggaauaacaca

SEQ ID NO: 725041 - RNA, 22 nt, Haemophilus influenzae Rd
aggauaaaaauggaaaaagcaa

SEQ ID NO: 725042 - RNA, 13 nt, Haemophilus influenzae Rd
aggauaaaacaau

SEQ ID NO: 725043 - RNA, 13 nt, Haemophilus influenzae Rd
aggauaaauaaac

SEQ ID NO: 725044 - RNA, 15 nt, Haemophilus influenzae Rd
aggauagagaaacua

SEQ ID NO: 725045 - RNA, 17 nt, Haemophilus influenzae Rd
aggaguaaaaauauuau

SEQ ID NO: 725046 - RNA, 13 nt, Haemophilus influenzae Rd
aggacguuuuaau

SEQ ID NO: 725047 - RNA, 12 nt, Haemophilus influenzae Rd
aggacuaaauua

SEQ ID NO: 725048 - RNA, 16 nt, Haemophilus influenzae Rd
aggauccauuacaaau

SEQ ID NO: 725049 - RNA, 17 nt, Haemophilus influenzae Rd
aggaucacuaauugcau

SEQ ID NO: 725050 - RNA, 12 nt, Haemophilus influenzae Rd
aggaucauuaaa

SEQ ID NO: 725051 - RNA, 23 nt, Haemophilus influenzae Rd
aggccauauuuucccaguaaaua

SEQ ID NO: 725052 - RNA, 20 nt, Haemophilus influenzae Rd
aggccagcuugacgaaauaa

SEQ ID NO: 725053 - RNA, 17 nt, Haemophilus influenzae Rd
aggcaaguucguuuuuu

SEQ ID NO: 725054 - RNA, 20 nt, Haemophilus influenzae Rd
aggcaaguucguuuuuucca

SEQ ID NO: 725055 - RNA, 14 nt, Haemophilus influenzae Rd
aggcaaaucaccuu

SEQ ID NO: 725056 - RNA, 13 nt, Haemophilus influenzae Rd
aggauuaaauaac

SEQ ID NO: 725057 - RNA, 14 nt, Haemophilus influenzae Rd
aggcaaagcaaaau

SEQ ID NO: 725058 - RNA, 15 nt, Haemophilus influenzae Rd
aggauuaaagggcug

SEQ ID NO: 725059 - RNA, 23 nt, Haemophilus influenzae Rd
aggauuaaagggcugcuacaauu

SEQ ID NO: 725060 - RNA, 18 nt, Haemophilus influenzae Rd
aggcacaacgguugaaau

SEQ ID NO: 725061 - RNA, 14 nt, Haemophilus influenzae Rd
aggcacaaaaaauu

SEQ ID NO: 725062 - RNA, 23 nt, Haemophilus influenzae Rd
aggcucaucauuaugaaaaaaag

SEQ ID NO: 725063 - RNA, 21 nt, Haemophilus influenzae Rd
aggcucacaaaggugguuuca

SEQ ID NO: 725064 - RNA, 17 nt, Haemophilus influenzae Rd
aggcuaguucuuccuug

SEQ ID NO: 725065 - RNA, 23 nt, Haemophilus influenzae Rd
aggcucuguaauugggcgcauaa

SEQ ID NO: 725066 - RNA, 14 nt, Haemophilus influenzae Rd
aggcugaaaaaaua

SEQ ID NO: 725067 - RNA, 18 nt, Haemophilus influenzae Rd
aggcucggucgauggcug

SEQ ID NO: 725068 - RNA, 16 nt, Haemophilus influenzae Rd
aggcucuaccuaaaau

SEQ ID NO: 725069 - RNA, 16 nt, Haemophilus influenzae Rd
aggcgugccaguucaa

SEQ ID NO: 725070 - RNA, 14 nt, Haemophilus influenzae Rd
aggcuaauuauuua

SEQ ID NO: 725071 - RNA, 16 nt, Haemophilus influenzae Rd
aggcuaacuggcaaua

SEQ ID NO: 725072 - RNA, 17 nt, Haemophilus influenzae Rd
aggcuaaauaaccuaaa

SEQ ID NO: 725073 - RNA, 13 nt, Haemophilus influenzae Rd
aggcguaaaacua

SEQ ID NO: 725074 - RNA, 18 nt, Haemophilus influenzae Rd
agggaugguuaauuuuuc

SEQ ID NO: 725075 - RNA, 13 nt, Haemophilus influenzae Rd
agggcauucauug

SEQ ID NO: 725076 - RNA, 14 nt, Haemophilus influenzae Rd
aggcugugcauaau

SEQ ID NO: 725077 - RNA, 19 nt, Haemophilus influenzae Rd
aggcuuaauucuugccaua

SEQ ID NO: 725078 - RNA, 16 nt, Haemophilus influenzae Rd
aggcuuaucuacugcu

SEQ ID NO: 725079 - RNA, 20 nt, Haemophilus influenzae Rd
agggaucgcauuaucaaaug

SEQ ID NO: 725080 - RNA, 23 nt, Haemophilus influenzae Rd
aggcuucauuugcuucuaucaga

SEQ ID NO: 725081 - RNA, 17 nt, Haemophilus influenzae Rd
aggcuucgccauuuuua

SEQ ID NO: 725082 - RNA, 17 nt, Haemophilus influenzae Rd
aggcuucggccuauuaa

SEQ ID NO: 725083 - RNA, 13 nt, Haemophilus influenzae Rd
aggcuucuuguuu

SEQ ID NO: 725084 - RNA, 22 nt, Haemophilus influenzae Rd
agggcuuuuucugcuggcucua

SEQ ID NO: 725085 - RNA, 23 nt, Haemophilus influenzae Rd
aggggauucgauuucguucccaa

SEQ ID NO: 725086 - RNA, 18 nt, Haemophilus influenzae Rd
aggggauaaaauaaacau

SEQ ID NO: 725087 - RNA, 17 nt, Haemophilus influenzae Rd
aggguauuuauuauucu

SEQ ID NO: 725088 - RNA, 22 nt, Haemophilus influenzae Rd
aggguauuucgguuucaugauu

SEQ ID NO: 725089 - RNA, 16 nt, Haemophilus influenzae Rd
aggguuccugcaucag

SEQ ID NO: 725090 - RNA, 19 nt, Haemophilus influenzae Rd
aggucgagggucaaaagaa

SEQ ID NO: 725091 - RNA, 23 nt, Haemophilus influenzae Rd
aggucuuacaccuaacauaugac

SEQ ID NO: 725092 - RNA, 14 nt, Haemophilus influenzae Rd
aggucugcaauaau

SEQ ID NO: 725093 - RNA, 15 nt, Haemophilus influenzae Rd
aggucagcaaauuau

SEQ ID NO: 725094 - RNA, 13 nt, Haemophilus influenzae Rd
agguaacagguga

SEQ ID NO: 725095 - RNA, 18 nt, Haemophilus influenzae Rd
agguguuguuucugguau

SEQ ID NO: 725096 - RNA, 18 nt, Haemophilus influenzae Rd
agguuaaaccuaaauccc

SEQ ID NO: 725097 - RNA, 22 nt, Haemophilus influenzae Rd
agguguguuuuucaaaaaaugg

SEQ ID NO: 725098 - RNA, 22 nt, Haemophilus influenzae Rd
agguuauauaacauaccuagau

SEQ ID NO: 725099 - RNA, 23 nt, Haemophilus influenzae Rd
aggugcauuaggguuacguacaa

SEQ ID NO: 725100 - RNA, 15 nt, Haemophilus influenzae Rd
aggugguuucaagag

SEQ ID NO: 725101 - RNA, 19 nt, Haemophilus influenzae Rd
aggugggcuuuagcccacc

SEQ ID NO: 725102 - RNA, 19 nt, Haemophilus influenzae Rd
agguuuuuuauuucucauu

SEQ ID NO: 725103 - RNA, 21 nt, Haemophilus influenzae Rd
agguuuuucuuuuaauuuuua

SEQ ID NO: 725104 - RNA, 12 nt, Haemophilus influenzae Rd
aguaaaaaaauc

SEQ ID NO: 725105 - RNA, 22 nt, Haemophilus influenzae Rd
aguaaaaagucaaugaacuuau

SEQ ID NO: 725106 - RNA, 15 nt, Haemophilus influenzae Rd
aguaaaaauaaaaac

SEQ ID NO: 725107 - RNA, 19 nt, Haemophilus influenzae Rd
agguuuuacauauaaagau

SEQ ID NO: 725108 - RNA, 13 nt, Haemophilus influenzae Rd
agguugaauuuuu

SEQ ID NO: 725109 - RNA, 15 nt, Haemophilus influenzae Rd
agguugaauuuuugu

SEQ ID NO: 725110 - RNA, 10 nt, Haemophilus influenzae Rd
agguuuugug

SEQ ID NO: 725111 - RNA, 22 nt, Haemophilus influenzae Rd
agguuuugugaagauugaaaua

SEQ ID NO: 725112 - RNA, 19 nt, Haemophilus influenzae Rd
agguuuuauuuugaacaau

SEQ ID NO: 725113 - RNA, 19 nt, Haemophilus influenzae Rd
aguaagcaaguacaacuga

SEQ ID NO: 725114 - RNA, 14 nt, Haemophilus influenzae Rd
aguaacuuucacaa

SEQ ID NO: 725115 - RNA, 14 nt, Haemophilus influenzae Rd
aguaagaaaccaac

SEQ ID NO: 725116 - RNA, 12 nt, Haemophilus influenzae Rd
aguaacuuuaau

SEQ ID NO: 725117 - RNA, 12 nt, Haemophilus influenzae Rd
aguaacuacaac

SEQ ID NO: 725118 - RNA, 17 nt, Haemophilus influenzae Rd
aguaacuacaacuucau

SEQ ID NO: 725119 - RNA, 13 nt, Haemophilus influenzae Rd
aguaaauaagcca

SEQ ID NO: 725120 - RNA, 20 nt, Haemophilus influenzae Rd
aguaaauagcucaacgcuuu

SEQ ID NO: 725121 - RNA, 14 nt, Haemophilus influenzae Rd
aguaaauauuuuuu

SEQ ID NO: 725122 - RNA, 19 nt, Haemophilus influenzae Rd
aguaaauauuuuuuaguuu

SEQ ID NO: 725123 - RNA, 12 nt, Haemophilus influenzae Rd
aguaaaugcuga

SEQ ID NO: 725124 - RNA, 15 nt, Haemophilus influenzae Rd
aguacgauaaacacu

SEQ ID NO: 725125 - RNA, 17 nt, Haemophilus influenzae Rd
aguacgauugcaauaau

SEQ ID NO: 725126 - RNA, 15 nt, Haemophilus influenzae Rd
aguaaugaaagaaac

SEQ ID NO: 725127 - RNA, 11 nt, Haemophilus influenzae Rd
aguaaggcacu

SEQ ID NO: 725128 - RNA, 13 nt, Haemophilus influenzae Rd
aguaagcugauuc

SEQ ID NO: 725129 - RNA, 19 nt, Haemophilus influenzae Rd
aguaaugcuaaauauauau

SEQ ID NO: 725130 - RNA, 18 nt, Haemophilus influenzae Rd
aguaaugcuuuaaauugu

SEQ ID NO: 725131 - RNA, 22 nt, Haemophilus influenzae Rd
aguacaauuaaauccaucaauu

SEQ ID NO: 725132 - RNA, 12 nt, Haemophilus influenzae Rd
aguaauguucua

SEQ ID NO: 725133 - RNA, 21 nt, Haemophilus influenzae Rd
aguaauguucuacguaauuua

SEQ ID NO: 725134 - RNA, 22 nt, Haemophilus influenzae Rd
aguaauguucuacguaauuuaa

SEQ ID NO: 725135 - RNA, 19 nt, Haemophilus influenzae Rd
aguacaucauuugcaauau

SEQ ID NO: 725136 - RNA, 20 nt, Haemophilus influenzae Rd
aguacaucauuugcaauauc

SEQ ID NO: 725137 - RNA, 22 nt, Haemophilus influenzae Rd
aguacacgaugaugcaggaaag

SEQ ID NO: 725138 - RNA, 23 nt, Haemophilus influenzae Rd
aguacacgaugaugcaggaaagg

SEQ ID NO: 725139 - RNA, 16 nt, Haemophilus influenzae Rd
accagccugaaaaagc

SEQ ID NO: 725140 - RNA, 24 nt, Haemophilus influenzae Rd
accagccgacuauuacaagauaau

SEQ ID NO: 725141 - RNA, 18 nt, Haemophilus influenzae Rd
accagcacaguuuccgca

SEQ ID NO: 725142 - RNA, 15 nt, Haemophilus influenzae Rd
accaagcauauuugc

SEQ ID NO: 725143 - RNA, 11 nt, Haemophilus influenzae Rd
accaagcaaug

SEQ ID NO: 725144 - RNA, 15 nt, Haemophilus influenzae Rd
accaagcaauuucau

SEQ ID NO: 725145 - RNA, 21 nt, Haemophilus influenzae Rd
accaagagccuccacaagcaa

SEQ ID NO: 725146 - RNA, 17 nt, Haemophilus influenzae Rd
accagacaaaauuuuac

SEQ ID NO: 725147 - RNA, 17 nt, Haemophilus influenzae Rd
accaagccauuuaacua

SEQ ID NO: 725148 - RNA, 17 nt, Haemophilus influenzae Rd
accagaaguagcaacac

SEQ ID NO: 725149 - RNA, 13 nt, Haemophilus influenzae Rd
accaggcgaaacc

SEQ ID NO: 725150 - RNA, 19 nt, Haemophilus influenzae Rd
accauaucguaaccaucag

SEQ ID NO: 725151 - RNA, 19 nt, Haemophilus influenzae Rd
accaucguuaaaccaaaua

SEQ ID NO: 725152 - RNA, 21 nt, Haemophilus influenzae Rd
accaucguuaaaccaaauaau

SEQ ID NO: 725153 - RNA, 19 nt, Haemophilus influenzae Rd
accauaucuuccaaagcaa

SEQ ID NO: 725154 - RNA, 22 nt, Haemophilus influenzae Rd
accauaucuuccaaagcaaucc

SEQ ID NO: 725155 - RNA, 14 nt, Haemophilus influenzae Rd
accaguuauucuuc

SEQ ID NO: 725156 - RNA, 14 nt, Haemophilus influenzae Rd
accaguuaaauccu

SEQ ID NO: 725157 - RNA, 16 nt, Haemophilus influenzae Rd
accagugccaauauga

SEQ ID NO: 725158 - RNA, 17 nt, Haemophilus influenzae Rd
accgauaaggaaaauac

SEQ ID NO: 725159 - RNA, 18 nt, Haemophilus influenzae Rd
accgauaauaugcaucac

SEQ ID NO: 725160 - RNA, 18 nt, Haemophilus influenzae Rd
accgacucguccaucaaa

SEQ ID NO: 725161 - RNA, 14 nt, Haemophilus influenzae Rd
accgaaagcccaca

SEQ ID NO: 725162 - RNA, 19 nt, Haemophilus influenzae Rd
accgaaaaccgaaaaaaua

SEQ ID NO: 725163 - RNA, 16 nt, Haemophilus influenzae Rd
acccguaauuaaaaau

SEQ ID NO: 725164 - RNA, 24 nt, Haemophilus influenzae Rd
acccuaaucguucauaaaacgagc

SEQ ID NO: 725165 - RNA, 22 nt, Haemophilus influenzae Rd
acccuacaggcuuccaacaaaa

SEQ ID NO: 725166 - RNA, 16 nt, Haemophilus influenzae Rd
acccuauuacuuucca

SEQ ID NO: 725167 - RNA, 19 nt, Haemophilus influenzae Rd
acccuauucgcugauaaac

SEQ ID NO: 725168 - RNA, 17 nt, Haemophilus influenzae Rd
acccacuaaaauuugua

SEQ ID NO: 725169 - RNA, 14 nt, Haemophilus influenzae Rd
acccacugauuuuu

SEQ ID NO: 725170 - RNA, 16 nt, Haemophilus influenzae Rd
acccacugauuuuucu

SEQ ID NO: 725171 - RNA, 18 nt, Haemophilus influenzae Rd
acccacuucgauauuuuc

SEQ ID NO: 725172 - RNA, 12 nt, Haemophilus influenzae Rd
accaucuacacg

SEQ ID NO: 725173 - RNA, 14 nt, Haemophilus influenzae Rd
accaucuauauuug

SEQ ID NO: 725174 - RNA, 14 nt, Haemophilus influenzae Rd
accaucuuuuuuug

SEQ ID NO: 725175 - RNA, 18 nt, Haemophilus influenzae Rd
accaucuuuuuuugcaag

SEQ ID NO: 725176 - RNA, 19 nt, Haemophilus influenzae Rd
accaucuuuaauuccaacu

SEQ ID NO: 725177 - RNA, 21 nt, Haemophilus influenzae Rd
acccaggaguaaccacaaaau

SEQ ID NO: 725178 - RNA, 20 nt, Haemophilus influenzae Rd
accccaauuccuugugaacc

SEQ ID NO: 725179 - RNA, 16 nt, Haemophilus influenzae Rd
acccauuuugauugcu

SEQ ID NO: 725180 - RNA, 23 nt, Haemophilus influenzae Rd
acccgauaaaugcacauuuuuac

SEQ ID NO: 725181 - RNA, 17 nt, Haemophilus influenzae Rd
acccgaaccgauuuuaa

SEQ ID NO: 725182 - RNA, 21 nt, Haemophilus influenzae Rd
accguauuuuuuuaauuuuuu

SEQ ID NO: 725183 - RNA, 13 nt, Haemophilus influenzae Rd
accgucagccaaa

SEQ ID NO: 725184 - RNA, 13 nt, Haemophilus influenzae Rd
accgcuucuuccu

SEQ ID NO: 725185 - RNA, 24 nt, Haemophilus influenzae Rd
accgcguauuaucggaagaugaaa

SEQ ID NO: 725186 - RNA, 13 nt, Haemophilus influenzae Rd
accgcguaaaaau

SEQ ID NO: 725187 - RNA, 14 nt, Haemophilus influenzae Rd
accgauuuugacuu

SEQ ID NO: 725188 - RNA, 18 nt, Haemophilus influenzae Rd
accgcaaaaauacuaacu

SEQ ID NO: 725189 - RNA, 15 nt, Haemophilus influenzae Rd
accgauuaauucaac

SEQ ID NO: 725190 - RNA, 21 nt, Haemophilus influenzae Rd
accgcucauugcugcuuuaau

SEQ ID NO: 725191 - RNA, 23 nt, Haemophilus influenzae Rd
accguuuuuauuuguucuacuuu

SEQ ID NO: 725192 - RNA, 14 nt, Haemophilus influenzae Rd
accguuuuuucuuu

SEQ ID NO: 725193 - RNA, 18 nt, Haemophilus influenzae Rd
accguuuacguuaagugc

SEQ ID NO: 725194 - RNA, 16 nt, Haemophilus influenzae Rd
accuaaagagugacca

SEQ ID NO: 725195 - RNA, 13 nt, Haemophilus influenzae Rd
accuaaaucuuua

SEQ ID NO: 725196 - RNA, 14 nt, Haemophilus influenzae Rd
accuaaaauugauu

SEQ ID NO: 725197 - RNA, 16 nt, Haemophilus influenzae Rd
accuaacauaugacag

SEQ ID NO: 725198 - RNA, 14 nt, Haemophilus influenzae Rd
accuaagucaggaa

SEQ ID NO: 725199 - RNA, 16 nt, Haemophilus influenzae Rd
accuaagguuaauuuu

SEQ ID NO: 725200 - RNA, 23 nt, Haemophilus influenzae Rd
accuaauggauauagaaaucaua

SEQ ID NO: 725201 - RNA, 19 nt, Haemophilus influenzae Rd
accuacacccacugauuuu

SEQ ID NO: 725202 - RNA, 22 nt, Haemophilus influenzae Rd
accuacacccacugauuuuucu

SEQ ID NO: 725203 - RNA, 13 nt, Haemophilus influenzae Rd
accuauuuuuucc

SEQ ID NO: 725204 - RNA, 17 nt, Haemophilus influenzae Rd
accuacugguguagaug

SEQ ID NO: 725205 - RNA, 19 nt, Haemophilus influenzae Rd
accgucaugggauaaacau

SEQ ID NO: 725206 - RNA, 22 nt, Haemophilus influenzae Rd
accgucaugggauaaacauuuc

SEQ ID NO: 725207 - RNA, 21 nt, Haemophilus influenzae Rd
accgucuaaaaauccugaaga

SEQ ID NO: 725208 - RNA, 14 nt, Haemophilus influenzae Rd
accgucuuuaaaua

SEQ ID NO: 725209 - RNA, 21 nt, Haemophilus influenzae Rd
accgugcgugaauguccauuu

SEQ ID NO: 725210 - RNA, 21 nt, Haemophilus influenzae Rd
accguuaagcaaauuucuguu

SEQ ID NO: 725211 - RNA, 14 nt, Haemophilus influenzae Rd
accguucuauauuu

SEQ ID NO: 725212 - RNA, 19 nt, Haemophilus influenzae Rd
accguucuauauuuugaau

SEQ ID NO: 725213 - RNA, 13 nt, Haemophilus influenzae Rd
accuucagccacu

SEQ ID NO: 725214 - RNA, 18 nt, Haemophilus influenzae Rd
accuucaguuuucauuuu

SEQ ID NO: 725215 - RNA, 21 nt, Haemophilus influenzae Rd
accuucauaaacuucuauguu

SEQ ID NO: 725216 - RNA, 14 nt, Haemophilus influenzae Rd
accuuccacuuuug

SEQ ID NO: 725217 - RNA, 16 nt, Haemophilus influenzae Rd
accuuccacuuuuggu

SEQ ID NO: 725218 - RNA, 14 nt, Haemophilus influenzae Rd
accuucaccacuug

SEQ ID NO: 725219 - RNA, 23 nt, Haemophilus influenzae Rd
accuucaccacuuggugcaacca

SEQ ID NO: 725220 - RNA, 17 nt, Haemophilus influenzae Rd
accuucacagauuucaa

SEQ ID NO: 725221 - RNA, 14 nt, Haemophilus influenzae Rd
accugugaaaacac

SEQ ID NO: 725222 - RNA, 15 nt, Haemophilus influenzae Rd
accugugaaaacacg

SEQ ID NO: 725223 - RNA, 13 nt, Haemophilus influenzae Rd
accuguaaacaaa

SEQ ID NO: 725224 - RNA, 14 nt, Haemophilus influenzae Rd
accugguugcauaa

SEQ ID NO: 725225 - RNA, 22 nt, Haemophilus influenzae Rd
accuucuggguaaaauaaugca

SEQ ID NO: 725226 - RNA, 17 nt, Haemophilus influenzae Rd
accuucuugauuauuua

SEQ ID NO: 725227 - RNA, 16 nt, Haemophilus influenzae Rd
accuuggaauauccca

SEQ ID NO: 725228 - RNA, 21 nt, Haemophilus influenzae Rd
accuugagcaauauaaucuuu

SEQ ID NO: 725229 - RNA, 17 nt, Haemophilus influenzae Rd
accuugaauugcauuuu

SEQ ID NO: 725230 - RNA, 22 nt, Haemophilus influenzae Rd
accuuguuccaggaaaauuuua

SEQ ID NO: 725231 - RNA, 17 nt, Haemophilus influenzae Rd
accuugugguucacgau

SEQ ID NO: 725232 - RNA, 14 nt, Haemophilus influenzae Rd
accuugagaaauaa

SEQ ID NO: 725233 - RNA, 20 nt, Haemophilus influenzae Rd
accugcagccauaauauuua

SEQ ID NO: 725234 - RNA, 21 nt, Haemophilus influenzae Rd
accugcagccauaauauuuaa

SEQ ID NO: 725235 - RNA, 18 nt, Haemophilus influenzae Rd
accugcagagaagaaaua

SEQ ID NO: 725236 - RNA, 19 nt, Haemophilus influenzae Rd
accugcagagaagaaauac

SEQ ID NO: 725237 - RNA, 19 nt, Haemophilus influenzae Rd
accugcaaggauauuucca

SEQ ID NO: 725238 - RNA, 17 nt, Haemophilus influenzae Rd
accugcggauuucacua

SEQ ID NO: 725239 - RNA, 17 nt, Haemophilus influenzae Rd
acgaccguuaauacuug

SEQ ID NO: 725240 - RNA, 15 nt, Haemophilus influenzae Rd
acgaccuaagaaaag

SEQ ID NO: 725241 - RNA, 16 nt, Haemophilus influenzae Rd
acgaccuugcaaauuu

SEQ ID NO: 725242 - RNA, 13 nt, Haemophilus influenzae Rd
acgauaagaaugu

SEQ ID NO: 725243 - RNA, 21 nt, Haemophilus influenzae Rd
acgauagcggcgaauguggcu

SEQ ID NO: 725244 - RNA, 15 nt, Haemophilus influenzae Rd
acgauaguaaaaaau

SEQ ID NO: 725245 - RNA, 23 nt, Haemophilus influenzae Rd
acgaguggcggacgggugaguaa

SEQ ID NO: 725246 - RNA, 16 nt, Haemophilus influenzae Rd
acgaguuugauuacca

SEQ ID NO: 725247 - RNA, 17 nt, Haemophilus influenzae Rd
acgagcauauuuuccau

SEQ ID NO: 725248 - RNA, 17 nt, Haemophilus influenzae Rd
acgagcaauauucaaaa

SEQ ID NO: 725249 - RNA, 15 nt, Haemophilus influenzae Rd
acgagccaauacagc

SEQ ID NO: 725250 - RNA, 13 nt, Haemophilus influenzae Rd
acgaauaagcacu

SEQ ID NO: 725251 - RNA, 18 nt, Haemophilus influenzae Rd
acgaaagcuucauugcua

SEQ ID NO: 725252 - RNA, 20 nt, Haemophilus influenzae Rd
accuuuuguauuacgugauu

SEQ ID NO: 725253 - RNA, 14 nt, Haemophilus influenzae Rd
acgaaaaguugaaa

SEQ ID NO: 725254 - RNA, 13 nt, Haemophilus influenzae Rd
accuuuugaaaaa

SEQ ID NO: 725255 - RNA, 14 nt, Haemophilus influenzae Rd
acgaauuaaaucca

SEQ ID NO: 725256 - RNA, 17 nt, Haemophilus influenzae Rd
acgaauugacggugcau

SEQ ID NO: 725257 - RNA, 21 nt, Haemophilus influenzae Rd
acgaauggcgacggcaucaaa

SEQ ID NO: 725258 - RNA, 19 nt, Haemophilus influenzae Rd
acgaauuucagcgaaacuu

SEQ ID NO: 725259 - RNA, 22 nt, Haemophilus influenzae Rd
acgacaucaaucaaauucaaca

SEQ ID NO: 725260 - RNA, 16 nt, Haemophilus influenzae Rd
acgccgauaccacauu

SEQ ID NO: 725261 - RNA, 14 nt, Haemophilus influenzae Rd
acgcccuucaccuu

SEQ ID NO: 725262 - RNA, 19 nt, Haemophilus influenzae Rd
acgccauucacauucuuuu

SEQ ID NO: 725263 - RNA, 13 nt, Haemophilus influenzae Rd
acgcccaaauacu

SEQ ID NO: 725264 - RNA, 22 nt, Haemophilus influenzae Rd
acgccaucuuuaaaguguuuuu

SEQ ID NO: 725265 - RNA, 19 nt, Haemophilus influenzae Rd
acgccugcccaaguugugc

SEQ ID NO: 725266 - RNA, 17 nt, Haemophilus influenzae Rd
acgccuaauucuugcca

SEQ ID NO: 725267 - RNA, 22 nt, Haemophilus influenzae Rd
acgccuucagaaagauuacauu

SEQ ID NO: 725268 - RNA, 16 nt, Haemophilus influenzae Rd
acgccuguggcaaaau

SEQ ID NO: 725269 - RNA, 14 nt, Haemophilus influenzae Rd
acgccuuugucuua

SEQ ID NO: 725270 - RNA, 22 nt, Haemophilus influenzae Rd
acgccuuuaaaacgcgcauuaa

SEQ ID NO: 725271 - RNA, 13 nt, Haemophilus influenzae Rd
acgcguacuuuuu

SEQ ID NO: 725272 - RNA, 22 nt, Haemophilus influenzae Rd
acgcgucuuucugcaauuuuac

SEQ ID NO: 725273 - RNA, 20 nt, Haemophilus influenzae Rd
acgcgugaugaaacaaucug

SEQ ID NO: 725274 - RNA, 20 nt, Haemophilus influenzae Rd
acgcuccucugcauucugaa

SEQ ID NO: 725275 - RNA, 23 nt, Haemophilus influenzae Rd
acgcuccauuaccguaugcaaac

SEQ ID NO: 725276 - RNA, 14 nt, Haemophilus influenzae Rd
acgcuguacaaagc

SEQ ID NO: 725277 - RNA, 20 nt, Haemophilus influenzae Rd
acgcggcggaacaggucgag

SEQ ID NO: 725278 - RNA, 17 nt, Haemophilus influenzae Rd
acgcgcuacaauauuua

SEQ ID NO: 725279 - RNA, 17 nt, Haemophilus influenzae Rd
acgcgcugcucugugcc

SEQ ID NO: 725280 - RNA, 21 nt, Haemophilus influenzae Rd
acgcgcugauucuaaugccau

SEQ ID NO: 725281 - RNA, 18 nt, Haemophilus influenzae Rd
acgcgcaaauuuucguuu

SEQ ID NO: 725282 - RNA, 15 nt, Haemophilus influenzae Rd
acgcgaugaauuuaa

SEQ ID NO: 725283 - RNA, 18 nt, Haemophilus influenzae Rd
acgcgcacauacuucuuc

SEQ ID NO: 725284 - RNA, 23 nt, Haemophilus influenzae Rd
acguccgcaaccagcagaaaaua

SEQ ID NO: 725285 - RNA, 13 nt, Haemophilus influenzae Rd
acgucaccuacug

SEQ ID NO: 725286 - RNA, 14 nt, Haemophilus influenzae Rd
acgguguuuucuuu

SEQ ID NO: 725287 - RNA, 19 nt, Haemophilus influenzae Rd
acguauagcgugcuuuaau

SEQ ID NO: 725288 - RNA, 13 nt, Haemophilus influenzae Rd
acguauugaacua

SEQ ID NO: 725289 - RNA, 19 nt, Haemophilus influenzae Rd
acguauugaacuaaaauau

SEQ ID NO: 725290 - RNA, 17 nt, Haemophilus influenzae Rd
acguauuuaaaaucgcu

SEQ ID NO: 725291 - RNA, 14 nt, Haemophilus influenzae Rd
acguauuuuuuaau

SEQ ID NO: 725292 - RNA, 20 nt, Haemophilus influenzae Rd
acgucaauagcggauucugc

SEQ ID NO: 725293 - RNA, 18 nt, Haemophilus influenzae Rd
acgugugccaguuuugug

SEQ ID NO: 725294 - RNA, 21 nt, Haemophilus influenzae Rd
acgugugcgauucaucacuuc

SEQ ID NO: 725295 - RNA, 22 nt, Haemophilus influenzae Rd
acguggauuuguuugccuucau

SEQ ID NO: 725296 - RNA, 15 nt, Haemophilus influenzae Rd
acgucgucuuugaaa

SEQ ID NO: 725297 - RNA, 15 nt, Haemophilus influenzae Rd
acggucagucacuuc

SEQ ID NO: 725298 - RNA, 15 nt, Haemophilus influenzae Rd
acgggcagaaugaau

SEQ ID NO: 725299 - RNA, 17 nt, Haemophilus influenzae Rd
acggcguagaaugcaaa

SEQ ID NO: 725300 - RNA, 21 nt, Haemophilus influenzae Rd
acggcacaccuaacuguugga

SEQ ID NO: 725301 - RNA, 21 nt, Haemophilus influenzae Rd
acuacguaaagagagcauauu

SEQ ID NO: 725302 - RNA, 19 nt, Haemophilus influenzae Rd
acuacguguuaauaaccaa

SEQ ID NO: 725303 - RNA, 18 nt, Haemophilus influenzae Rd
acuacggcguagaaugca

SEQ ID NO: 725304 - RNA, 18 nt, Haemophilus influenzae Rd
acuacggacuaaauaaau

SEQ ID NO: 725305 - RNA, 21 nt, Haemophilus influenzae Rd
acguuaauuaccacaugcauu

SEQ ID NO: 725306 - RNA, 17 nt, Haemophilus influenzae Rd
acguucauauuguuuca

SEQ ID NO: 725307 - RNA, 18 nt, Haemophilus influenzae Rd
acguucauguaaauaguu

SEQ ID NO: 725308 - RNA, 13 nt, Haemophilus influenzae Rd
acuaccuaauaaa

SEQ ID NO: 725309 - RNA, 20 nt, Haemophilus influenzae Rd
acuacgauuuaauguauaaa

SEQ ID NO: 725310 - RNA, 23 nt, Haemophilus influenzae Rd
acuaucauaacgggcauuuuucu

SEQ ID NO: 725311 - RNA, 14 nt, Haemophilus influenzae Rd
acuaucuguuuuac

SEQ ID NO: 725312 - RNA, 21 nt, Haemophilus influenzae Rd
acuaucuguuuuaccugaaaa

SEQ ID NO: 725313 - RNA, 20 nt, Haemophilus influenzae Rd
acuaguucagcgauuuuaac

SEQ ID NO: 725314 - RNA, 19 nt, Haemophilus influenzae Rd
acuagcuccuugauauuca

SEQ ID NO: 725315 - RNA, 20 nt, Haemophilus influenzae Rd
acuagcuccuugauauucaa

SEQ ID NO: 725316 - RNA, 18 nt, Haemophilus influenzae Rd
acuacuuuccaauuccau

SEQ ID NO: 725317 - RNA, 20 nt, Haemophilus influenzae Rd
acuacuuuggauuggauuuu

SEQ ID NO: 725318 - RNA, 20 nt, Haemophilus influenzae Rd
acucaagguugcccacaaaa

SEQ ID NO: 725319 - RNA, 17 nt, Haemophilus influenzae Rd
acucaacaccgcaaaaa

SEQ ID NO: 725320 - RNA, 15 nt, Haemophilus influenzae Rd
acucacuggcucaag

SEQ ID NO: 725321 - RNA, 22 nt, Haemophilus influenzae Rd
acucacuggcucaaguaaugcu

SEQ ID NO: 725322 - RNA, 19 nt, Haemophilus influenzae Rd
acucaaugaauuaaaaguu

SEQ ID NO: 725323 - RNA, 22 nt, Haemophilus influenzae Rd
acucacaagucuguaauuuuac

SEQ ID NO: 725324 - RNA, 13 nt, Haemophilus influenzae Rd
acucacaauaaua

SEQ ID NO: 725325 - RNA, 13 nt, Haemophilus influenzae Rd
acucacaauacca

SEQ ID NO: 725326 - RNA, 15 nt, Haemophilus influenzae Rd
acucaauuuacacau

SEQ ID NO: 725327 - RNA, 15 nt, Haemophilus influenzae Rd
acucacauuguuucc

SEQ ID NO: 725328 - RNA, 22 nt, Haemophilus influenzae Rd
acucacagagccuuuuucuaau

SEQ ID NO: 725329 - RNA, 11 nt, Haemophilus influenzae Rd
acucauuacac

SEQ ID NO: 725330 - RNA, 21 nt, Haemophilus influenzae Rd
acucauccaaucaucagaaua

SEQ ID NO: 725331 - RNA, 17 nt, Haemophilus influenzae Rd
acucauuuaucaaacaa

SEQ ID NO: 725332 - RNA, 21 nt, Haemophilus influenzae Rd
acuccaacaccagucaauaaa

SEQ ID NO: 725333 - RNA, 15 nt, Haemophilus influenzae Rd
acucacgauucuucc

SEQ ID NO: 725334 - RNA, 13 nt, Haemophilus influenzae Rd
acucacuuuuccu

SEQ ID NO: 725335 - RNA, 15 nt, Haemophilus influenzae Rd
acucacuuuuccuug

SEQ ID NO: 725336 - RNA, 22 nt, Haemophilus influenzae Rd
acucagaauauaaguucuucca

SEQ ID NO: 725337 - RNA, 21 nt, Haemophilus influenzae Rd
acucaguuuuugaggaaaguu

SEQ ID NO: 725338 - RNA, 23 nt, Haemophilus influenzae Rd
acucgcgccgauuggaugcccaa

SEQ ID NO: 725339 - RNA, 23 nt, Haemophilus influenzae Rd
acugcucacgccgugauaacaac

SEQ ID NO: 725340 - RNA, 22 nt, Haemophilus influenzae Rd
acugccacugcgcccgcugcau

SEQ ID NO: 725341 - RNA, 15 nt, Haemophilus influenzae Rd
acugcagcauuuaaa

SEQ ID NO: 725342 - RNA, 14 nt, Haemophilus influenzae Rd
acugcaauuaucaa

SEQ ID NO: 725343 - RNA, 22 nt, Haemophilus influenzae Rd
acugcaaguccgccuugagaug

SEQ ID NO: 725344 - RNA, 12 nt, Haemophilus influenzae Rd
acugauuauauu

SEQ ID NO: 725345 - RNA, 16 nt, Haemophilus influenzae Rd
acugauuauauuguug

SEQ ID NO: 725346 - RNA, 20 nt, Haemophilus influenzae Rd
acugauuauauuguugcaca

SEQ ID NO: 725347 - RNA, 13 nt, Haemophilus influenzae Rd
acugacucagguu

SEQ ID NO: 725348 - RNA, 19 nt, Haemophilus influenzae Rd
acugaauuucauucaaaaa

SEQ ID NO: 725349 - RNA, 13 nt, Haemophilus influenzae Rd
acugacagaagac

SEQ ID NO: 725350 - RNA, 22 nt, Haemophilus influenzae Rd
acugaccuuuaggaucauuaaa

SEQ ID NO: 725351 - RNA, 15 nt, Haemophilus influenzae Rd
acucuaucuaaaaua

SEQ ID NO: 725352 - RNA, 15 nt, Haemophilus influenzae Rd
acucguggaauuuca

SEQ ID NO: 725353 - RNA, 20 nt, Haemophilus influenzae Rd
acucguauaagcgaauuaca

SEQ ID NO: 725354 - RNA, 23 nt, Haemophilus influenzae Rd
acucguccaaauucauuuuuuau

SEQ ID NO: 725355 - RNA, 21 nt, Haemophilus influenzae Rd
acugaauaauuuccaacacau

SEQ ID NO: 725356 - RNA, 14 nt, Haemophilus influenzae Rd
acugaauaaaaaaa

SEQ ID NO: 725357 - RNA, 15 nt, Haemophilus influenzae Rd
acugaauaaaaaaaa

SEQ ID NO: 725358 - RNA, 17 nt, Haemophilus influenzae Rd
acuggcuguguaaaaca

SEQ ID NO: 725359 - RNA, 20 nt, Haemophilus influenzae Rd
acuggguuucggauaauaau

SEQ ID NO: 725360 - RNA, 13 nt, Haemophilus influenzae Rd
acugguucaaguc

SEQ ID NO: 725361 - RNA, 18 nt, Haemophilus influenzae Rd
acuggcucuucuuucggu

SEQ ID NO: 725362 - RNA, 20 nt, Haemophilus influenzae Rd
acuggcuugugaaauaaaau

SEQ ID NO: 725363 - RNA, 15 nt, Haemophilus influenzae Rd
acuggcauuuucuuc

SEQ ID NO: 725364 - RNA, 21 nt, Haemophilus influenzae Rd
acugcuuguucagcaacauca

SEQ ID NO: 725365 - RNA, 17 nt, Haemophilus influenzae Rd
acugcuuucuagaugau

SEQ ID NO: 725366 - RNA, 22 nt, Haemophilus influenzae Rd
acugcuuucuagaugaugaaau

SEQ ID NO: 725367 - RNA, 17 nt, Haemophilus influenzae Rd
acugcuuuauuuucuuu

SEQ ID NO: 725368 - RNA, 22 nt, Haemophilus influenzae Rd
acugcuuuauuuucuuuugugc

SEQ ID NO: 725369 - RNA, 20 nt, Haemophilus influenzae Rd
acuguggauaauucaucaaa

SEQ ID NO: 725370 - RNA, 22 nt, Haemophilus influenzae Rd
acugucaccucguaaaauauua

SEQ ID NO: 725371 - RNA, 18 nt, Haemophilus influenzae Rd
acuguauauuguuugcuu

SEQ ID NO: 725372 - RNA, 14 nt, Haemophilus influenzae Rd
acuguaucuacuuu

SEQ ID NO: 725373 - RNA, 12 nt, Haemophilus influenzae Rd
acuguuauuaag

SEQ ID NO: 725374 - RNA, 14 nt, Haemophilus influenzae Rd
acuguucaaauaag

SEQ ID NO: 725375 - RNA, 13 nt, Haemophilus influenzae Rd
acuguuuggcaaa

SEQ ID NO: 725376 - RNA, 14 nt, Haemophilus influenzae Rd
acuguuuuggcauu

SEQ ID NO: 725377 - RNA, 19 nt, Haemophilus influenzae Rd
acuguuuuggcauuuucaa

SEQ ID NO: 725378 - RNA, 16 nt, Haemophilus influenzae Rd
acuuaauccuuucacu

SEQ ID NO: 725379 - RNA, 17 nt, Haemophilus influenzae Rd
acuuaaugcaaaaucuu

SEQ ID NO: 725380 - RNA, 20 nt, Haemophilus influenzae Rd
acuuaaugcuucggcugcuu

SEQ ID NO: 725381 - RNA, 16 nt, Haemophilus influenzae Rd
acuuaggaugauacaa

SEQ ID NO: 725382 - RNA, 13 nt, Haemophilus influenzae Rd
acuuaguaauaua

SEQ ID NO: 725383 - RNA, 13 nt, Haemophilus influenzae Rd
acuuaauaauaua

SEQ ID NO: 725384 - RNA, 16 nt, Haemophilus influenzae Rd
acuuaaguugggcuua

SEQ ID NO: 725385 - RNA, 22 nt, Haemophilus influenzae Rd
acuuaaguugggcuuauuuguu

SEQ ID NO: 725386 - RNA, 16 nt, Haemophilus influenzae Rd
agcaacgguguggaaa

SEQ ID NO: 725387 - RNA, 13 nt, Haemophilus influenzae Rd
agcaacuuccgcg

SEQ ID NO: 725388 - RNA, 16 nt, Haemophilus influenzae Rd
agauuauguucauuuu

SEQ ID NO: 725389 - RNA, 19 nt, Haemophilus influenzae Rd
agauuauggcugacuagau

SEQ ID NO: 725390 - RNA, 14 nt, Haemophilus influenzae Rd
agauuaucauuaaa

SEQ ID NO: 725391 - RNA, 13 nt, Haemophilus influenzae Rd
agauuauuuuuag

SEQ ID NO: 725392 - RNA, 16 nt, Haemophilus influenzae Rd
agauuauuucuacuug

SEQ ID NO: 725393 - RNA, 20 nt, Haemophilus influenzae Rd
agcaaguuugcgaucaucac

SEQ ID NO: 725394 - RNA, 17 nt, Haemophilus influenzae Rd
agcaaggcguucaauau

SEQ ID NO: 725395 - RNA, 14 nt, Haemophilus influenzae Rd
agcaaguaauuuaa

SEQ ID NO: 725396 - RNA, 22 nt, Haemophilus influenzae Rd
agcaagaccccaagcaaaugga

SEQ ID NO: 725397 - RNA, 16 nt, Haemophilus influenzae Rd
agcaagauaaucccuu

SEQ ID NO: 725398 - RNA, 15 nt, Haemophilus influenzae Rd
agcaagauacuuuua

SEQ ID NO: 725399 - RNA, 14 nt, Haemophilus influenzae Rd
agcaagaacuugau

SEQ ID NO: 725400 - RNA, 22 nt, Haemophilus influenzae Rd
agcaagaaagcguucaucaauu

SEQ ID NO: 725401 - RNA, 15 nt, Haemophilus influenzae Rd
agcaagcaaaauuaa

SEQ ID NO: 725402 - RNA, 18 nt, Haemophilus influenzae Rd
agcaagaugaauuaagac

SEQ ID NO: 725403 - RNA, 14 nt, Haemophilus influenzae Rd
agcaaucgcauugc

SEQ ID NO: 725404 - RNA, 20 nt, Haemophilus influenzae Rd
agcaaucuuuggcaaaaaau

SEQ ID NO: 725405 - RNA, 21 nt, Haemophilus influenzae Rd
agcaaucuuuuucuuucaguu

SEQ ID NO: 725406 - RNA, 13 nt, Haemophilus influenzae Rd
agcaauaauauca

SEQ ID NO: 725407 - RNA, 21 nt, Haemophilus influenzae Rd
agcaauaaugauguaccaaaa

SEQ ID NO: 725408 - RNA, 22 nt, Haemophilus influenzae Rd
agcaauaaacagaaauauuguc

SEQ ID NO: 725409 - RNA, 14 nt, Haemophilus influenzae Rd
agcaauaauuucau

SEQ ID NO: 725410 - RNA, 23 nt, Haemophilus influenzae Rd
agcaauacccgcuucaaucgcaa

SEQ ID NO: 725411 - RNA, 11 nt, Haemophilus influenzae Rd
agcaauauggg

SEQ ID NO: 725412 - RNA, 21 nt, Haemophilus influenzae Rd
agcaauauggguucaauauaa

SEQ ID NO: 725413 - RNA, 15 nt, Haemophilus influenzae Rd
agcaauauaaucauu

SEQ ID NO: 725414 - RNA, 17 nt, Haemophilus influenzae Rd
agcaaucauuugccgcc

SEQ ID NO: 725415 - RNA, 14 nt, Haemophilus influenzae Rd
agcaauuucucugg

SEQ ID NO: 725416 - RNA, 17 nt, Haemophilus influenzae Rd
agcaauuugaauuaaua

SEQ ID NO: 725417 - RNA, 20 nt, Haemophilus influenzae Rd
agcaauuaauucguccauuc

SEQ ID NO: 725418 - RNA, 20 nt, Haemophilus influenzae Rd
agcaaugccgaagccuugua

SEQ ID NO: 725419 - RNA, 21 nt, Haemophilus influenzae Rd
agcaaugccgaagccuuguaa

SEQ ID NO: 725420 - RNA, 14 nt, Haemophilus influenzae Rd
agcaauuuucugca

SEQ ID NO: 725421 - RNA, 20 nt, Haemophilus influenzae Rd
agcacaaucgcaucgucuuu

SEQ ID NO: 725422 - RNA, 19 nt, Haemophilus influenzae Rd
agcacacaagguuguaagc

SEQ ID NO: 725423 - RNA, 21 nt, Haemophilus influenzae Rd
agcacaagauuugccaaaauc

SEQ ID NO: 725424 - RNA, 22 nt, Haemophilus influenzae Rd
agcacaagauuugccaaaauca

SEQ ID NO: 725425 - RNA, 18 nt, Haemophilus influenzae Rd
agcacauuaaucauuuca

SEQ ID NO: 725426 - RNA, 15 nt, Haemophilus influenzae Rd
agcaccaaauaucgc

SEQ ID NO: 725427 - RNA, 18 nt, Haemophilus influenzae Rd
agcaccaaauuaaaaaua

SEQ ID NO: 725428 - RNA, 17 nt, Haemophilus influenzae Rd
agcacacuaauaagaau

SEQ ID NO: 725429 - RNA, 16 nt, Haemophilus influenzae Rd
agcaccagucaagguu

SEQ ID NO: 725430 - RNA, 15 nt, Haemophilus influenzae Rd
agcacgauaaccauc

SEQ ID NO: 725431 - RNA, 16 nt, Haemophilus influenzae Rd
agcacgccuaauacca

SEQ ID NO: 725432 - RNA, 14 nt, Haemophilus influenzae Rd
agcagacaaaauug

SEQ ID NO: 725433 - RNA, 19 nt, Haemophilus influenzae Rd
aaaaccgucacaaauugac

SEQ ID NO: 725434 - RNA, 20 nt, Haemophilus influenzae Rd
aaaaccgcuuuaucaaagaa

SEQ ID NO: 725435 - RNA, 19 nt, Haemophilus influenzae Rd
agcacugguuacgccugca

SEQ ID NO: 725436 - RNA, 21 nt, Haemophilus influenzae Rd
agcacuucagcauaauguuug

SEQ ID NO: 725437 - RNA, 19 nt, Haemophilus influenzae Rd
aaaaccuaacauaaugccu

SEQ ID NO: 725438 - RNA, 18 nt, Haemophilus influenzae Rd
aaaaccugcugauuagca

SEQ ID NO: 725439 - RNA, 23 nt, Haemophilus influenzae Rd
aaaaccuugggauauuccaaggu

SEQ ID NO: 725440 - RNA, 19 nt, Haemophilus influenzae Rd
aaaaccuuguaaacgauuu

SEQ ID NO: 725441 - RNA, 13 nt, Haemophilus influenzae Rd
agcaggaagaaca

SEQ ID NO: 725442 - RNA, 18 nt, Haemophilus influenzae Rd
agcaucaaaauaaauaaa

SEQ ID NO: 725443 - RNA, 13 nt, Haemophilus influenzae Rd
agcauauuuucca

SEQ ID NO: 725444 - RNA, 19 nt, Haemophilus influenzae Rd
agcauauuuuccaucaccu

SEQ ID NO: 725445 - RNA, 18 nt, Haemophilus influenzae Rd
agcauaaggaccaagcaa

SEQ ID NO: 725446 - RNA, 15 nt, Haemophilus influenzae Rd
agcauaacguauuuu

SEQ ID NO: 725447 - RNA, 17 nt, Haemophilus influenzae Rd
agcauaacguauuuucu

SEQ ID NO: 725448 - RNA, 13 nt, Haemophilus influenzae Rd
agcauaaagagaa

SEQ ID NO: 725449 - RNA, 14 nt, Haemophilus influenzae Rd
agcauaaagagaau

SEQ ID NO: 725450 - RNA, 15 nt, Haemophilus influenzae Rd
agcauaaagagaaua

SEQ ID NO: 725451 - RNA, 13 nt, Haemophilus influenzae Rd
agcauaaacaaaa

SEQ ID NO: 725452 - RNA, 14 nt, Haemophilus influenzae Rd
agcauaaacaaaau

SEQ ID NO: 725453 - RNA, 21 nt, Haemophilus influenzae Rd
agcauaaacaaaauaaacuca

SEQ ID NO: 725454 - RNA, 19 nt, Haemophilus influenzae Rd
agcaguuuucgugauuuug

SEQ ID NO: 725455 - RNA, 18 nt, Haemophilus influenzae Rd
agcauuucuaaaggagua

SEQ ID NO: 725456 - RNA, 20 nt, Haemophilus influenzae Rd
agcauuuugauaauuuuuca

SEQ ID NO: 725457 - RNA, 19 nt, Haemophilus influenzae Rd
agcauuuuucauacaaucu

SEQ ID NO: 725458 - RNA, 19 nt, Haemophilus influenzae Rd
agcauuuuuuauuaaaaaa

SEQ ID NO: 725459 - RNA, 21 nt, Haemophilus influenzae Rd
agcauuuuuuauuaaaaaagu

SEQ ID NO: 725460 - RNA, 20 nt, Haemophilus influenzae Rd
agccaaaacgaauagaaaua

SEQ ID NO: 725461 - RNA, 17 nt, Haemophilus influenzae Rd
agcauuuagagcaagca

SEQ ID NO: 725462 - RNA, 23 nt, Haemophilus influenzae Rd
agcauuguccacagcaaaagaaa

SEQ ID NO: 725463 - RNA, 14 nt, Haemophilus influenzae Rd
agcaucugauuuuc

SEQ ID NO: 725464 - RNA, 15 nt, Haemophilus influenzae Rd
agcaucugauuuuca

SEQ ID NO: 725465 - RNA, 13 nt, Haemophilus influenzae Rd
agcauuaaaaauu

SEQ ID NO: 725466 - RNA, 22 nt, Haemophilus influenzae Rd
agcauuaaaaauuuaaaagcac

SEQ ID NO: 725467 - RNA, 16 nt, Haemophilus influenzae Rd
agccaauaacuucuaa

SEQ ID NO: 725468 - RNA, 18 nt, Haemophilus influenzae Rd
agccaaauacaaucgcau

SEQ ID NO: 725469 - RNA, 14 nt, Haemophilus influenzae Rd
agccaaauuuaaaa

SEQ ID NO: 725470 - RNA, 19 nt, Haemophilus influenzae Rd
agccaaauuuaaaaaagcc

SEQ ID NO: 725471 - RNA, 12 nt, Haemophilus influenzae Rd
agccaaaucauc

SEQ ID NO: 725472 - RNA, 14 nt, Haemophilus influenzae Rd
agccaauuuuucaa

SEQ ID NO: 725473 - RNA, 15 nt, Haemophilus influenzae Rd
agccaauuuuucaaa

SEQ ID NO: 725474 - RNA, 15 nt, Haemophilus influenzae Rd
agccaaucauugcua

SEQ ID NO: 725475 - RNA, 14 nt, Haemophilus influenzae Rd
agccaaugcggcua

SEQ ID NO: 725476 - RNA, 17 nt, Haemophilus influenzae Rd
agccaauggaaauacca

SEQ ID NO: 725477 - RNA, 18 nt, Haemophilus influenzae Rd
agccacuucuucaaagau

SEQ ID NO: 725478 - RNA, 20 nt, Haemophilus influenzae Rd
agccacuugugcaucaaagc

SEQ ID NO: 725479 - RNA, 15 nt, Haemophilus influenzae Rd
agccacugugcauua

SEQ ID NO: 725480 - RNA, 21 nt, Haemophilus influenzae Rd
agccacugugcauuaaaucaa

SEQ ID NO: 725481 - RNA, 21 nt, Haemophilus influenzae Rd
agccagcagcuaauaggcuua

SEQ ID NO: 725482 - RNA, 14 nt, Haemophilus influenzae Rd
agccaccaaauggu

SEQ ID NO: 725483 - RNA, 18 nt, Haemophilus influenzae Rd
agccacauaauaagaaag

SEQ ID NO: 725484 - RNA, 19 nt, Haemophilus influenzae Rd
agccgcgaugauagaacca

SEQ ID NO: 725485 - RNA, 23 nt, Haemophilus influenzae Rd
agcccguuguguuucaacaaaaa

SEQ ID NO: 725486 - RNA, 13 nt, Haemophilus influenzae Rd
agccgaagaagau

SEQ ID NO: 725487 - RNA, 14 nt, Haemophilus influenzae Rd
agccgaagaagaua

SEQ ID NO: 725488 - RNA, 14 nt, Haemophilus influenzae Rd
agccuuauuuuguc

SEQ ID NO: 725489 - RNA, 17 nt, Haemophilus influenzae Rd
agccuucaaaauuuggc

SEQ ID NO: 725490 - RNA, 16 nt, Haemophilus influenzae Rd
agccuucaucacaaau

SEQ ID NO: 725491 - RNA, 13 nt, Haemophilus influenzae Rd
agccuucugccau

SEQ ID NO: 725492 - RNA, 15 nt, Haemophilus influenzae Rd
agccuugauuucagu

SEQ ID NO: 725493 - RNA, 16 nt, Haemophilus influenzae Rd
agccuugauuucagua

SEQ ID NO: 725494 - RNA, 23 nt, Haemophilus influenzae Rd
agccuugauuucaguagaaucaa

SEQ ID NO: 725495 - RNA, 20 nt, Haemophilus influenzae Rd
agccuuguucugcagcaaga

SEQ ID NO: 725496 - RNA, 24 nt, Haemophilus influenzae Rd
agcgaaccgcccgguaaaucuacu

SEQ ID NO: 725497 - RNA, 23 nt, Haemophilus influenzae Rd
agccuacaacuaaucccacuugu

SEQ ID NO: 725498 - RNA, 16 nt, Haemophilus influenzae Rd
agccuaguauuuuugu

SEQ ID NO: 725499 - RNA, 14 nt, Haemophilus influenzae Rd
agccuauaauuaaa

SEQ ID NO: 725500 - RNA, 15 nt, Haemophilus influenzae Rd
agccuauaauuaaag

SEQ ID NO: 725501 - RNA, 21 nt, Haemophilus influenzae Rd
agccuauaauuaaaguuacuu

SEQ ID NO: 725502 - RNA, 15 nt, Haemophilus influenzae Rd
agccguuuugcguug

SEQ ID NO: 725503 - RNA, 13 nt, Haemophilus influenzae Rd
agccuaagccaaa

SEQ ID NO: 725504 - RNA, 19 nt, Haemophilus influenzae Rd
agccuaagccaaauccaac

SEQ ID NO: 725505 - RNA, 16 nt, Haemophilus influenzae Rd
agccguucuuaucuac

SEQ ID NO: 725506 - RNA, 14 nt, Haemophilus influenzae Rd
agcggauaaaauaa

SEQ ID NO: 725507 - RNA, 21 nt, Haemophilus influenzae Rd
agcggaaacuacggacuaaau

SEQ ID NO: 725508 - RNA, 16 nt, Haemophilus influenzae Rd
agcguaccgccaguau

SEQ ID NO: 725509 - RNA, 21 nt, Haemophilus influenzae Rd
agcguaccgccaguaucaauc

SEQ ID NO: 725510 - RNA, 15 nt, Haemophilus influenzae Rd
agcggugaauucuuu

SEQ ID NO: 725511 - RNA, 15 nt, Haemophilus influenzae Rd
agcggucaauuuuuu

SEQ ID NO: 725512 - RNA, 20 nt, Haemophilus influenzae Rd
agcggcauuugcaucauuua

SEQ ID NO: 725513 - RNA, 23 nt, Haemophilus influenzae Rd
agcgaccugaacggucauccaau

SEQ ID NO: 725514 - RNA, 21 nt, Haemophilus influenzae Rd
agacucucugacuucuagcca

SEQ ID NO: 725515 - RNA, 16 nt, Haemophilus influenzae Rd
agacuuaauuucacau

SEQ ID NO: 725516 - RNA, 12 nt, Haemophilus influenzae Rd
agacuucaagug

SEQ ID NO: 725517 - RNA, 20 nt, Haemophilus influenzae Rd
agacuucaagugauuauuuc

SEQ ID NO: 725518 - RNA, 14 nt, Haemophilus influenzae Rd
agacuugaacuggc

SEQ ID NO: 725519 - RNA, 19 nt, Haemophilus influenzae Rd
agacuaugcguagaaagau

SEQ ID NO: 725520 - RNA, 14 nt, Haemophilus influenzae Rd
agacgggaaacaau

SEQ ID NO: 725521 - RNA, 15 nt, Haemophilus influenzae Rd
agacuaauuuuuuaa

SEQ ID NO: 725522 - RNA, 16 nt, Haemophilus influenzae Rd
agacuagugaaauauu

SEQ ID NO: 725523 - RNA, 18 nt, Haemophilus influenzae Rd
agacuagugaaauauuua

SEQ ID NO: 725524 - RNA, 19 nt, Haemophilus influenzae Rd
agacuagcaucaaaauaaa

SEQ ID NO: 725525 - RNA, 17 nt, Haemophilus influenzae Rd
agacuacuuaaaauuca

SEQ ID NO: 725526 - RNA, 18 nt, Haemophilus influenzae Rd
agacgaaguguuaagcac

SEQ ID NO: 725527 - RNA, 16 nt, Haemophilus influenzae Rd
agacgauauuuuccuu

SEQ ID NO: 725528 - RNA, 18 nt, Haemophilus influenzae Rd
agacgauauuuuccuugu

SEQ ID NO: 725529 - RNA, 16 nt, Haemophilus influenzae Rd
agacgcugcccaaaua

SEQ ID NO: 725530 - RNA, 17 nt, Haemophilus influenzae Rd
agacgcugcccaaauaa

SEQ ID NO: 725531 - RNA, 13 nt, Haemophilus influenzae Rd
agaauuuucaacc

SEQ ID NO: 725532 - RNA, 18 nt, Haemophilus influenzae Rd
agacccaccgcaaaagcc

SEQ ID NO: 725533 - RNA, 18 nt, Haemophilus influenzae Rd
agaauuuguuguuugcuu

SEQ ID NO: 725534 - RNA, 19 nt, Haemophilus influenzae Rd
agaauuuguuguuugcuuu

SEQ ID NO: 725535 - RNA, 13 nt, Haemophilus influenzae Rd
agagacaaacaac

SEQ ID NO: 725536 - RNA, 16 nt, Haemophilus influenzae Rd
agagaagcugaauaaa

SEQ ID NO: 725537 - RNA, 19 nt, Haemophilus influenzae Rd
agagaagcugaauaaaaga

SEQ ID NO: 725538 - RNA, 14 nt, Haemophilus influenzae Rd
agagaaaucaucaa

SEQ ID NO: 725539 - RNA, 17 nt, Haemophilus influenzae Rd
agagaacguauuauuca

SEQ ID NO: 725540 - RNA, 14 nt, Haemophilus influenzae Rd
agagaaaacucaca

SEQ ID NO: 725541 - RNA, 16 nt, Haemophilus influenzae Rd
agagaaacauaaaaga

SEQ ID NO: 725542 - RNA, 19 nt, Haemophilus influenzae Rd
agacuuucuuguauugcca

SEQ ID NO: 725543 - RNA, 12 nt, Haemophilus influenzae Rd
agagagaaaaau

SEQ ID NO: 725544 - RNA, 17 nt, Haemophilus influenzae Rd
agagauugauuuucuuu

SEQ ID NO: 725545 - RNA, 20 nt, Haemophilus influenzae Rd
agagauuuagauaauaaaaa

SEQ ID NO: 725546 - RNA, 21 nt, Haemophilus influenzae Rd
agagauuuagauaauaaaaaa

SEQ ID NO: 725547 - RNA, 23 nt, Haemophilus influenzae Rd
agagauuuagauaauaaaaaaac

SEQ ID NO: 725548 - RNA, 16 nt, Haemophilus influenzae Rd
agagauuguaugaaaa

SEQ ID NO: 725549 - RNA, 18 nt, Haemophilus influenzae Rd
agagauuguaugaaaaau

SEQ ID NO: 725550 - RNA, 22 nt, Haemophilus influenzae Rd
agagauauaauacguaaauuca

SEQ ID NO: 725551 - RNA, 18 nt, Haemophilus influenzae Rd
agagauaauaaauauaau

SEQ ID NO: 725552 - RNA, 14 nt, Haemophilus influenzae Rd
agagcaaauuuaaa

SEQ ID NO: 725553 - RNA, 19 nt, Haemophilus influenzae Rd
agagcaaauuuaaauaaua

SEQ ID NO: 725554 - RNA, 20 nt, Haemophilus influenzae Rd
agagccaguuggguuaaaua

SEQ ID NO: 725555 - RNA, 14 nt, Haemophilus influenzae Rd
agaucgauuuuccu

SEQ ID NO: 725556 - RNA, 18 nt, Haemophilus influenzae Rd
agauccuuucacaaaaua

SEQ ID NO: 725557 - RNA, 23 nt, Haemophilus influenzae Rd
agaucuucgaugugcauuuuuca

SEQ ID NO: 725558 - RNA, 12 nt, Haemophilus influenzae Rd
agaucuuugcca

SEQ ID NO: 725559 - RNA, 13 nt, Haemophilus influenzae Rd
agaucuucuuugc

SEQ ID NO: 725560 - RNA, 18 nt, Haemophilus influenzae Rd
agaugaagcuaagaaaau

SEQ ID NO: 725561 - RNA, 22 nt, Haemophilus influenzae Rd
agaugcacgagcaggaaaacca

SEQ ID NO: 725562 - RNA, 19 nt, Haemophilus influenzae Rd
agaugauuuuaaaauaaau

SEQ ID NO: 725563 - RNA, 20 nt, Haemophilus influenzae Rd
agauuaaauauuuucauuua

SEQ ID NO: 725564 - RNA, 21 nt, Haemophilus influenzae Rd
agauaagagcuuacuucuacu

SEQ ID NO: 725565 - RNA, 14 nt, Haemophilus influenzae Rd
agauaagaaaaucc

SEQ ID NO: 725566 - RNA, 15 nt, Haemophilus influenzae Rd
agauaacguaaguaa

SEQ ID NO: 725567 - RNA, 13 nt, Haemophilus influenzae Rd
agauaacaucacg

SEQ ID NO: 725568 - RNA, 19 nt, Haemophilus influenzae Rd
agauaacaaugaaaucgca

SEQ ID NO: 725569 - RNA, 21 nt, Haemophilus influenzae Rd
agauaaaauaaaacccaguuu

SEQ ID NO: 725570 - RNA, 15 nt, Haemophilus influenzae Rd
agauaaaauauucaa

SEQ ID NO: 725571 - RNA, 17 nt, Haemophilus influenzae Rd
agauaaaauauucaaac

SEQ ID NO: 725572 - RNA, 14 nt, Haemophilus influenzae Rd
agauaaauuauauu

SEQ ID NO: 725573 - RNA, 14 nt, Haemophilus influenzae Rd
agauaaauuuaaag

SEQ ID NO: 725574 - RNA, 16 nt, Haemophilus influenzae Rd
agauaaauuucaauua

SEQ ID NO: 725575 - RNA, 13 nt, Haemophilus influenzae Rd
agauaaauuuuua

SEQ ID NO: 725576 - RNA, 17 nt, Haemophilus influenzae Rd
agauaaaaauuucagac

SEQ ID NO: 725577 - RNA, 20 nt, Haemophilus influenzae Rd
agaguuuccuuauauucaga

SEQ ID NO: 725578 - RNA, 13 nt, Haemophilus influenzae Rd
aaaaccaccagaa

SEQ ID NO: 725579 - RNA, 12 nt, Haemophilus influenzae Rd
aaaaccacaaga

SEQ ID NO: 725580 - RNA, 16 nt, Haemophilus influenzae Rd
aaaaccagauaaaaac

SEQ ID NO: 725581 - RNA, 17 nt, Haemophilus influenzae Rd
agagugaguuuggaaua

SEQ ID NO: 725582 - RNA, 16 nt, Haemophilus influenzae Rd
agagugaccagucauu

SEQ ID NO: 725583 - RNA, 18 nt, Haemophilus influenzae Rd
agauaguuuucgcaauca

SEQ ID NO: 725584 - RNA, 22 nt, Haemophilus influenzae Rd
agauaguuuucgcaaucagcau

SEQ ID NO: 725585 - RNA, 15 nt, Haemophilus influenzae Rd
agauauaaaaaucug

SEQ ID NO: 725586 - RNA, 16 nt, Haemophilus influenzae Rd
agauauaaacugauuu

SEQ ID NO: 725587 - RNA, 14 nt, Haemophilus influenzae Rd
agauauaaggcaca

SEQ ID NO: 725588 - RNA, 13 nt, Haemophilus influenzae Rd
agauauuucuagg

SEQ ID NO: 725589 - RNA, 20 nt, Haemophilus influenzae Rd
agaucacaguugugaaaaaa

SEQ ID NO: 725590 - RNA, 22 nt, Haemophilus influenzae Rd
agaucacaguugugaaaaaacg

SEQ ID NO: 725591 - RNA, 19 nt, Haemophilus influenzae Rd
agaucaauggguuuaaaaa

SEQ ID NO: 725592 - RNA, 21 nt, Haemophilus influenzae Rd
agaucaauggguuuaaaaagu

SEQ ID NO: 725593 - RNA, 17 nt, Haemophilus influenzae Rd
agaucaagcacuuuucc

SEQ ID NO: 725594 - RNA, 19 nt, Haemophilus influenzae Rd
agaucaagcacuuuuccuu

SEQ ID NO: 725595 - RNA, 23 nt, Haemophilus influenzae Rd
agauacccauuucgaucauaucg

SEQ ID NO: 725596 - RNA, 19 nt, Haemophilus influenzae Rd
agauacacucacuuuuccu

SEQ ID NO: 725597 - RNA, 21 nt, Haemophilus influenzae Rd
agauacauuuaaugaugaaac

SEQ ID NO: 725598 - RNA, 19 nt, Haemophilus influenzae Rd
agauacauuuguuuaagga

SEQ ID NO: 725599 - RNA, 13 nt, Haemophilus influenzae Rd
agauaccaauaau

SEQ ID NO: 725600 - RNA, 20 nt, Haemophilus influenzae Rd
agauacaaauaacacagaaa

SEQ ID NO: 725601 - RNA, 13 nt, Haemophilus influenzae Rd
agauacaagaaag

SEQ ID NO: 725602 - RNA, 11 nt, Haemophilus influenzae Rd
agauaaugaua

SEQ ID NO: 725603 - RNA, 20 nt, Haemophilus influenzae Rd
agauaaugauagaugaauua

SEQ ID NO: 725604 - RNA, 13 nt, Haemophilus influenzae Rd
agauaaucaaaaa

SEQ ID NO: 725605 - RNA, 20 nt, Haemophilus influenzae Rd
agauaaugguuacagaaaua

SEQ ID NO: 725606 - RNA, 22 nt, Haemophilus influenzae Rd
agauaauuacgccuaaccaagc

SEQ ID NO: 725607 - RNA, 20 nt, Haemophilus influenzae Rd
agauaauuaaaaucccuuuc

SEQ ID NO: 725608 - RNA, 16 nt, Haemophilus influenzae Rd
agaaccugucgcaaug

SEQ ID NO: 725609 - RNA, 22 nt, Haemophilus influenzae Rd
agaaccauuuauaaugcaacca

SEQ ID NO: 725610 - RNA, 17 nt, Haemophilus influenzae Rd
agaaccacaaacagggc

SEQ ID NO: 725611 - RNA, 13 nt, Haemophilus influenzae Rd
agaacauugauaa

SEQ ID NO: 725612 - RNA, 15 nt, Haemophilus influenzae Rd
agaacauugugacau

SEQ ID NO: 725613 - RNA, 20 nt, Haemophilus influenzae Rd
agaacaaaugucgaaauuuu

SEQ ID NO: 725614 - RNA, 22 nt, Haemophilus influenzae Rd
agaacaaaugucgaaauuuuuc

SEQ ID NO: 725615 - RNA, 12 nt, Haemophilus influenzae Rd
agaacuugauaa

SEQ ID NO: 725616 - RNA, 13 nt, Haemophilus influenzae Rd
agaacuuuuaaaa

SEQ ID NO: 725617 - RNA, 23 nt, Haemophilus influenzae Rd
agaacuuuugaauuagguuuugu

SEQ ID NO: 725618 - RNA, 23 nt, Haemophilus influenzae Rd
agaagaaccacagccaagguuuu

SEQ ID NO: 725619 - RNA, 14 nt, Haemophilus influenzae Rd
agaaauggcgacca

SEQ ID NO: 725620 - RNA, 22 nt, Haemophilus influenzae Rd
agaaauggcgcacccgaaagga

SEQ ID NO: 725621 - RNA, 18 nt, Haemophilus influenzae Rd
agaaaugucguaagaacg

SEQ ID NO: 725622 - RNA, 17 nt, Haemophilus influenzae Rd
agaacaaaauaauuaug

SEQ ID NO: 725623 - RNA, 19 nt, Haemophilus influenzae Rd
agaaauuuuaaccgcacuu

SEQ ID NO: 725624 - RNA, 14 nt, Haemophilus influenzae Rd
agaaauuuuaauca

SEQ ID NO: 725625 - RNA, 22 nt, Haemophilus influenzae Rd
agaaauguuguccaucaaucau

SEQ ID NO: 725626 - RNA, 20 nt, Haemophilus influenzae Rd
agaaaugaucaaaucaaauu

SEQ ID NO: 725627 - RNA, 15 nt, Haemophilus influenzae Rd
agaaaugaccuucac

SEQ ID NO: 725628 - RNA, 17 nt, Haemophilus influenzae Rd
agaaaucucuuucaauu

SEQ ID NO: 725629 - RNA, 18 nt, Haemophilus influenzae Rd
agaaaucccgcagggaug

SEQ ID NO: 725630 - RNA, 16 nt, Haemophilus influenzae Rd
agaaaucccuugacca

SEQ ID NO: 725631 - RNA, 20 nt, Haemophilus influenzae Rd
agaaacuaauuaguuuuuaa

SEQ ID NO: 725632 - RNA, 23 nt, Haemophilus influenzae Rd
agaaaucaucucuaaccuaaaau

SEQ ID NO: 725633 - RNA, 9 nt, Haemophilus influenzae Rd
agaaaucau

SEQ ID NO: 725634 - RNA, 14 nt, Haemophilus influenzae Rd
agaaaucauaaacu

SEQ ID NO: 725635 - RNA, 17 nt, Haemophilus influenzae Rd
agaaaucauugcugcaa

SEQ ID NO: 725636 - RNA, 22 nt, Haemophilus influenzae Rd
agaaaucauuucaauguuugga

SEQ ID NO: 725637 - RNA, 17 nt, Haemophilus influenzae Rd
agaaauccacaaaaucu

SEQ ID NO: 725638 - RNA, 15 nt, Haemophilus influenzae Rd
agaaaucacaauaaa

SEQ ID NO: 725639 - RNA, 20 nt, Haemophilus influenzae Rd
aaaacagaucgugauauuuc

SEQ ID NO: 725640 - RNA, 16 nt, Haemophilus influenzae Rd
aaaacaccgucuaaau

SEQ ID NO: 725641 - RNA, 14 nt, Haemophilus influenzae Rd
aaaacacgaaaaaa

SEQ ID NO: 725642 - RNA, 15 nt, Haemophilus influenzae Rd
aaaacacgaaaaaaa

SEQ ID NO: 725643 - RNA, 17 nt, Haemophilus influenzae Rd
aaaacacgaaaaaaacc

SEQ ID NO: 725644 - RNA, 17 nt, Haemophilus influenzae Rd
aaaacacucucagaauu

SEQ ID NO: 725645 - RNA, 19 nt, Haemophilus influenzae Rd
aaaacacucucagaauuaa

SEQ ID NO: 725646 - RNA, 17 nt, Haemophilus influenzae Rd
agaaacguaaacaaaau

SEQ ID NO: 725647 - RNA, 18 nt, Haemophilus influenzae Rd
agaaaccgcauauucuug

SEQ ID NO: 725648 - RNA, 14 nt, Haemophilus influenzae Rd
agaauauauuuuau

SEQ ID NO: 725649 - RNA, 16 nt, Haemophilus influenzae Rd
agaauauauuuuauca

SEQ ID NO: 725650 - RNA, 20 nt, Haemophilus influenzae Rd
agaauauauuuuaucaacua

SEQ ID NO: 725651 - RNA, 14 nt, Haemophilus influenzae Rd
agaauauaaauaaa

SEQ ID NO: 725652 - RNA, 17 nt, Haemophilus influenzae Rd
agaauauaaauaaaaca

SEQ ID NO: 725653 - RNA, 16 nt, Haemophilus influenzae Rd
agaauauaacaccaaa

SEQ ID NO: 725654 - RNA, 12 nt, Haemophilus influenzae Rd
agaauauuucac

SEQ ID NO: 725655 - RNA, 15 nt, Haemophilus influenzae Rd
agaauauuucacacc

SEQ ID NO: 725656 - RNA, 22 nt, Haemophilus influenzae Rd
agaauauuuugcauguuauucu

SEQ ID NO: 725657 - RNA, 18 nt, Haemophilus influenzae Rd
agaaucagaguuaaaagu

SEQ ID NO: 725658 - RNA, 14 nt, Haemophilus influenzae Rd
agaaucuaaagaaa

SEQ ID NO: 725659 - RNA, 15 nt, Haemophilus influenzae Rd
agaauuauuuaaacu

SEQ ID NO: 725660 - RNA, 23 nt, Haemophilus influenzae Rd
agaauggugacgagaacuuuuga

SEQ ID NO: 725661 - RNA, 21 nt, Haemophilus influenzae Rd
agaaugcggugaaauuucacc

SEQ ID NO: 725662 - RNA, 19 nt, Haemophilus influenzae Rd
agaauagccgcaaucacaa

SEQ ID NO: 725663 - RNA, 16 nt, Haemophilus influenzae Rd
agaauacuuaauagcu

SEQ ID NO: 725664 - RNA, 14 nt, Haemophilus influenzae Rd
agaauagucacacc

SEQ ID NO: 725665 - RNA, 16 nt, Haemophilus influenzae Rd
agaaguuguuuuucuu

SEQ ID NO: 725666 - RNA, 14 nt, Haemophilus influenzae Rd
agaauaaacuaauu

SEQ ID NO: 725667 - RNA, 13 nt, Haemophilus influenzae Rd
agaauaaaucacc

SEQ ID NO: 725668 - RNA, 14 nt, Haemophilus influenzae Rd
agaauaaauuaaaa

SEQ ID NO: 725669 - RNA, 16 nt, Haemophilus influenzae Rd
agaauaacaacaaaag

SEQ ID NO: 725670 - RNA, 21 nt, Haemophilus influenzae Rd
agaauaacccuuguaacguau

SEQ ID NO: 725671 - RNA, 14 nt, Haemophilus influenzae Rd
agaaguuuuccauc

SEQ ID NO: 725672 - RNA, 15 nt, Haemophilus influenzae Rd
agaaguugaaaauaa

SEQ ID NO: 725673 - RNA, 21 nt, Haemophilus influenzae Rd
agaagugcggggacaauugca

SEQ ID NO: 725674 - RNA, 14 nt, Haemophilus influenzae Rd
agaagugaaauauu

SEQ ID NO: 725675 - RNA, 14 nt, Haemophilus influenzae Rd
agaagugagaaaua

SEQ ID NO: 725676 - RNA, 15 nt, Haemophilus influenzae Rd
agaagugagaaauau

SEQ ID NO: 725677 - RNA, 15 nt, Haemophilus influenzae Rd
agaagcccgaauacu

SEQ ID NO: 725678 - RNA, 24 nt, Haemophilus influenzae Rd
agaaaauuucugcggcagaauuuc

SEQ ID NO: 725679 - RNA, 11 nt, Haemophilus influenzae Rd
agaaaauuuga

SEQ ID NO: 725680 - RNA, 13 nt, Haemophilus influenzae Rd
agaaacaaauccu

SEQ ID NO: 725681 - RNA, 23 nt, Haemophilus influenzae Rd
agaaacaaauccugaaaguagau

SEQ ID NO: 725682 - RNA, 23 nt, Haemophilus influenzae Rd
agaaaauuaaaaauuuaauacuu

SEQ ID NO: 725683 - RNA, 12 nt, Haemophilus influenzae Rd
agaaaauuaucu

SEQ ID NO: 725684 - RNA, 23 nt, Haemophilus influenzae Rd
agaaaaucguauucucauuuuag

SEQ ID NO: 725685 - RNA, 21 nt, Haemophilus influenzae Rd
agaaaaucagauuauguucau

SEQ ID NO: 725686 - RNA, 16 nt, Haemophilus influenzae Rd
agaaaauagaaagaau

SEQ ID NO: 725687 - RNA, 23 nt, Haemophilus influenzae Rd
agaaaauagaaagaauauuuaau

SEQ ID NO: 725688 - RNA, 15 nt, Haemophilus influenzae Rd
acuuuuuuucaucuc

SEQ ID NO: 725689 - RNA, 21 nt, Haemophilus influenzae Rd
acuuuuuucagucuauuauaa

SEQ ID NO: 725690 - RNA, 15 nt, Haemophilus influenzae Rd
acuuuuuucuuaaau

SEQ ID NO: 725691 - RNA, 23 nt, Haemophilus influenzae Rd
acuuuugacgcagcaucugccac

SEQ ID NO: 725692 - RNA, 18 nt, Haemophilus influenzae Rd
acuuuuucauuaucuuua

SEQ ID NO: 725693 - RNA, 13 nt, Haemophilus influenzae Rd
acuuuuucaucug

SEQ ID NO: 725694 - RNA, 15 nt, Haemophilus influenzae Rd
acuuuuucaaugaaa

SEQ ID NO: 725695 - RNA, 13 nt, Haemophilus influenzae Rd
acuuuuuuauaau

SEQ ID NO: 725696 - RNA, 16 nt, Haemophilus influenzae Rd
acuuuuuuauaugcaa

SEQ ID NO: 725697 - RNA, 12 nt, Haemophilus influenzae Rd
acuuuuuguuuu

SEQ ID NO: 725698 - RNA, 16 nt, Haemophilus influenzae Rd
acuuuuuuaaguagua

SEQ ID NO: 725699 - RNA, 21 nt, Haemophilus influenzae Rd
acuuuuuuaaguaguauuuua

SEQ ID NO: 725700 - RNA, 19 nt, Haemophilus influenzae Rd
acuuuuuuaccuucagcac

SEQ ID NO: 725701 - RNA, 15 nt, Haemophilus influenzae Rd
acuuuuucaucuuua

SEQ ID NO: 725702 - RNA, 15 nt, Haemophilus influenzae Rd
acuuuuuggacuuua

SEQ ID NO: 725703 - RNA, 14 nt, Haemophilus influenzae Rd
acuuuucaacaaaa

SEQ ID NO: 725704 - RNA, 20 nt, Haemophilus influenzae Rd
acuuuucaacacuuuauuac

SEQ ID NO: 725705 - RNA, 18 nt, Haemophilus influenzae Rd
acuuuuagcuccuaaauu

SEQ ID NO: 725706 - RNA, 22 nt, Haemophilus influenzae Rd
acuuuuauaaagaucaaugggu

SEQ ID NO: 725707 - RNA, 20 nt, Haemophilus influenzae Rd
acuuuuauccacaugauaua

SEQ ID NO: 725708 - RNA, 23 nt, Haemophilus influenzae Rd
acuuuucccaaugcaccaaaaau

SEQ ID NO: 725709 - RNA, 19 nt, Haemophilus influenzae Rd
acuuuucgauagaacaaau

SEQ ID NO: 725710 - RNA, 18 nt, Haemophilus influenzae Rd
acuuuucgcaauuuuaac

SEQ ID NO: 725711 - RNA, 21 nt, Haemophilus influenzae Rd
acuuuucuuauaauuacagaa

SEQ ID NO: 725712 - RNA, 14 nt, Haemophilus influenzae Rd
acuuucuucguuaa

SEQ ID NO: 725713 - RNA, 13 nt, Haemophilus influenzae Rd
acuuucuugcugu

SEQ ID NO: 725714 - RNA, 23 nt, Haemophilus influenzae Rd
acuuucuuuuuguuuaaaagccc

SEQ ID NO: 725715 - RNA, 14 nt, Haemophilus influenzae Rd
acuuugauaauaca

SEQ ID NO: 725716 - RNA, 21 nt, Haemophilus influenzae Rd
acuuuccauacccuugcuucu

SEQ ID NO: 725717 - RNA, 23 nt, Haemophilus influenzae Rd
acuuuccaucauugcucgacaaa

SEQ ID NO: 725718 - RNA, 23 nt, Haemophilus influenzae Rd
acuuucgccgaguaaauucacca

SEQ ID NO: 725719 - RNA, 17 nt, Haemophilus influenzae Rd
acuuucuaacuuuuaau

SEQ ID NO: 725720 - RNA, 18 nt, Haemophilus influenzae Rd
acuuucuaacuuuuaauu

SEQ ID NO: 725721 - RNA, 18 nt, Haemophilus influenzae Rd
acuuuguacaccaaaaua

SEQ ID NO: 725722 - RNA, 15 nt, Haemophilus influenzae Rd
acuuugguuuguuaa

SEQ ID NO: 725723 - RNA, 22 nt, Haemophilus influenzae Rd
acuuugguuuguuaaaugaaaa

SEQ ID NO: 725724 - RNA, 14 nt, Haemophilus influenzae Rd
acuuugauuuugag

SEQ ID NO: 725725 - RNA, 22 nt, Haemophilus influenzae Rd
acuuugcgccuguacugcaagc

SEQ ID NO: 725726 - RNA, 14 nt, Haemophilus influenzae Rd
acuuuuaacacuuu

SEQ ID NO: 725727 - RNA, 17 nt, Haemophilus influenzae Rd
acuuuuaacuuaaucau

SEQ ID NO: 725728 - RNA, 18 nt, Haemophilus influenzae Rd
acuuuuaacuuaaucauu

SEQ ID NO: 725729 - RNA, 14 nt, Haemophilus influenzae Rd
acuuuuaauuaaau

SEQ ID NO: 725730 - RNA, 18 nt, Haemophilus influenzae Rd
acuuuuaauuaaauacaa

SEQ ID NO: 725731 - RNA, 15 nt, Haemophilus influenzae Rd
acuuuuaauucuugu

SEQ ID NO: 725732 - RNA, 20 nt, Haemophilus influenzae Rd
acuuuuacaucauuguaguu

SEQ ID NO: 725733 - RNA, 18 nt, Haemophilus influenzae Rd
acuuuguucauuuuuacu

SEQ ID NO: 725734 - RNA, 20 nt, Haemophilus influenzae Rd
acuuucacgguacgcugcau

SEQ ID NO: 725735 - RNA, 14 nt, Haemophilus influenzae Rd
acuuuauuuaauuc

SEQ ID NO: 725736 - RNA, 14 nt, Haemophilus influenzae Rd
acuuuauuugauug

SEQ ID NO: 725737 - RNA, 21 nt, Haemophilus influenzae Rd
acuuuauuugauuguugcuug

SEQ ID NO: 725738 - RNA, 14 nt, Haemophilus influenzae Rd
acuuucaauuuuuc

SEQ ID NO: 725739 - RNA, 22 nt, Haemophilus influenzae Rd
acuuucaacuguucuucuggga

SEQ ID NO: 725740 - RNA, 19 nt, Haemophilus influenzae Rd
acuuucacacccaugaauc

SEQ ID NO: 725741 - RNA, 21 nt, Haemophilus influenzae Rd
acuuucacacccaugaaucga

SEQ ID NO: 725742 - RNA, 18 nt, Haemophilus influenzae Rd
acuuucacauaaauuaca

SEQ ID NO: 725743 - RNA, 13 nt, Haemophilus influenzae Rd
acuuuauuuuuaa

SEQ ID NO: 725744 - RNA, 15 nt, Haemophilus influenzae Rd
acuuuauccccuaca

SEQ ID NO: 725745 - RNA, 16 nt, Haemophilus influenzae Rd
acuuuauuagaaauau

SEQ ID NO: 725746 - RNA, 17 nt, Haemophilus influenzae Rd
acuuuauuagaaauaua

SEQ ID NO: 725747 - RNA, 19 nt, Haemophilus influenzae Rd
acuuuauuagaaauauauu

SEQ ID NO: 725748 - RNA, 16 nt, Haemophilus influenzae Rd
acuuuauauugacaaa

SEQ ID NO: 725749 - RNA, 16 nt, Haemophilus influenzae Rd
acuuuagaacauugau

SEQ ID NO: 725750 - RNA, 15 nt, Haemophilus influenzae Rd
acuuuagagauuuua

SEQ ID NO: 725751 - RNA, 15 nt, Haemophilus influenzae Rd
acuuuacguaaagua

SEQ ID NO: 725752 - RNA, 14 nt, Haemophilus influenzae Rd
acuuuaccauuaca

SEQ ID NO: 725753 - RNA, 22 nt, Haemophilus influenzae Rd
acuuuaccauugcguucacuca

SEQ ID NO: 725754 - RNA, 18 nt, Haemophilus influenzae Rd
acuuuaaucgaaaucaca

SEQ ID NO: 725755 - RNA, 14 nt, Haemophilus influenzae Rd
acuuuaaguaauca

SEQ ID NO: 725756 - RNA, 14 nt, Haemophilus influenzae Rd
acuuuaauuuucca

SEQ ID NO: 725757 - RNA, 22 nt, Haemophilus influenzae Rd
acuuuaauuuuccaaauuccau

SEQ ID NO: 725758 - RNA, 14 nt, Haemophilus influenzae Rd
acuuuaaagaaaua

SEQ ID NO: 725759 - RNA, 15 nt, Haemophilus influenzae Rd
acuuuaaagaauauu

SEQ ID NO: 725760 - RNA, 21 nt, Haemophilus influenzae Rd
acuuuaaagaauauucuuuuc

SEQ ID NO: 725761 - RNA, 12 nt, Haemophilus influenzae Rd
acuuuaaauauu

SEQ ID NO: 725762 - RNA, 14 nt, Haemophilus influenzae Rd
acuuuaaauauuua

SEQ ID NO: 725763 - RNA, 15 nt, Haemophilus influenzae Rd
acuuuaaauauuuaa

SEQ ID NO: 725764 - RNA, 16 nt, Haemophilus influenzae Rd
acuuuaacccauuacu

SEQ ID NO: 725765 - RNA, 22 nt, Haemophilus influenzae Rd
acuuguuuuuucaaucauuucu

SEQ ID NO: 725766 - RNA, 20 nt, Haemophilus influenzae Rd
acuuguuggauaucuuguug

SEQ ID NO: 725767 - RNA, 18 nt, Haemophilus influenzae Rd
acuuguuguuguacgauu

SEQ ID NO: 725768 - RNA, 20 nt, Haemophilus influenzae Rd
acuuguuuacugaauaaaaa

SEQ ID NO: 725769 - RNA, 21 nt, Haemophilus influenzae Rd
acuuuaaaaguuuacuauuaa

SEQ ID NO: 725770 - RNA, 13 nt, Haemophilus influenzae Rd
acuuguuuuaaaa

SEQ ID NO: 725771 - RNA, 19 nt, Haemophilus influenzae Rd
acuuguuuuaaaacuauuu

SEQ ID NO: 725772 - RNA, 20 nt, Haemophilus influenzae Rd
acuuguuuuaaaacuauuuu

SEQ ID NO: 725773 - RNA, 19 nt, Haemophilus influenzae Rd
acuuguuuuccaaacauuu

SEQ ID NO: 725774 - RNA, 22 nt, Haemophilus influenzae Rd
acuugcuguuaagaccaauucu

SEQ ID NO: 725775 - RNA, 16 nt, Haemophilus influenzae Rd
acuugcuguuuuuccg

SEQ ID NO: 725776 - RNA, 14 nt, Haemophilus influenzae Rd
acuugcuucaagau

SEQ ID NO: 725777 - RNA, 18 nt, Haemophilus influenzae Rd
acuuggaauaucaucuag

SEQ ID NO: 725778 - RNA, 14 nt, Haemophilus influenzae Rd
acuugcuauuuucu

SEQ ID NO: 725779 - RNA, 17 nt, Haemophilus influenzae Rd
acuugcgacuuggugga

SEQ ID NO: 725780 - RNA, 15 nt, Haemophilus influenzae Rd
acuugcguugauuuc

SEQ ID NO: 725781 - RNA, 18 nt, Haemophilus influenzae Rd
acuugcacaauuacuucu

SEQ ID NO: 725782 - RNA, 21 nt, Haemophilus influenzae Rd
acuugcacaauuacuucuuac

SEQ ID NO: 725783 - RNA, 17 nt, Haemophilus influenzae Rd
acuugcagcccaacagc

SEQ ID NO: 725784 - RNA, 20 nt, Haemophilus influenzae Rd
acuugccaaacauuaccaag

SEQ ID NO: 725785 - RNA, 19 nt, Haemophilus influenzae Rd
acuugccacagguaaagaa

SEQ ID NO: 725786 - RNA, 14 nt, Haemophilus influenzae Rd
acuuauauuauuua

SEQ ID NO: 725787 - RNA, 15 nt, Haemophilus influenzae Rd
acuuaguuuuaauuc

SEQ ID NO: 725788 - RNA, 17 nt, Haemophilus influenzae Rd
acuuauaaauuuaaagg

SEQ ID NO: 725789 - RNA, 20 nt, Haemophilus influenzae Rd
acuugugcgauuaacaauaa

SEQ ID NO: 725790 - RNA, 23 nt, Haemophilus influenzae Rd
acuugugcuucauagaaaccaau

SEQ ID NO: 725791 - RNA, 19 nt, Haemophilus influenzae Rd
acuuguuaaauaaacacaa

SEQ ID NO: 725792 - RNA, 16 nt, Haemophilus influenzae Rd
acuuggugaucaccga

SEQ ID NO: 725793 - RNA, 21 nt, Haemophilus influenzae Rd
acuuggugcaauaaaaucauu

SEQ ID NO: 725794 - RNA, 17 nt, Haemophilus influenzae Rd
accaaaacgcaaugcaa

SEQ ID NO: 725795 - RNA, 22 nt, Haemophilus influenzae Rd
accaaaaaauucguaaagcgag

SEQ ID NO: 725796 - RNA, 16 nt, Haemophilus influenzae Rd
acauuuuuauuuuuac

SEQ ID NO: 725797 - RNA, 13 nt, Haemophilus influenzae Rd
acauuuuuucaac

SEQ ID NO: 725798 - RNA, 16 nt, Haemophilus influenzae Rd
accaaaauacaaucac

SEQ ID NO: 725799 - RNA, 12 nt, Haemophilus influenzae Rd
accaaaauuuaa

SEQ ID NO: 725800 - RNA, 12 nt, Haemophilus influenzae Rd
accaaagaaacg

SEQ ID NO: 725801 - RNA, 17 nt, Haemophilus influenzae Rd
accaaacugccaaacaa

SEQ ID NO: 725802 - RNA, 17 nt, Haemophilus influenzae Rd
accaaacgagaaaauuu

SEQ ID NO: 725803 - RNA, 19 nt, Haemophilus influenzae Rd
accaaacgagaaaauuucu

SEQ ID NO: 725804 - RNA, 14 nt, Haemophilus influenzae Rd
accaacaccauucc

SEQ ID NO: 725805 - RNA, 15 nt, Haemophilus influenzae Rd
accaacaccauucca

SEQ ID NO: 725806 - RNA, 15 nt, Haemophilus influenzae Rd
accaacaguuaagcu

SEQ ID NO: 725807 - RNA, 20 nt, Haemophilus influenzae Rd
accaaauugauucauuugau

SEQ ID NO: 725808 - RNA, 13 nt, Haemophilus influenzae Rd
accaaauuaaaaa

SEQ ID NO: 725809 - RNA, 14 nt, Haemophilus influenzae Rd
accaaauuaaaaau

SEQ ID NO: 725810 - RNA, 16 nt, Haemophilus influenzae Rd
accaaauuaaaaauau

SEQ ID NO: 725811 - RNA, 20 nt, Haemophilus influenzae Rd
accaaagcguccaagcaagc

SEQ ID NO: 725812 - RNA, 20 nt, Haemophilus influenzae Rd
accaaaguuuccuucgccau

SEQ ID NO: 725813 - RNA, 16 nt, Haemophilus influenzae Rd
accaaauaauguuaaa

SEQ ID NO: 725814 - RNA, 16 nt, Haemophilus influenzae Rd
accaaaucuaacauuu

SEQ ID NO: 725815 - RNA, 14 nt, Haemophilus influenzae Rd
accaaauccuuuug

SEQ ID NO: 725816 - RNA, 12 nt, Haemophilus influenzae Rd
accaaauacaau

SEQ ID NO: 725817 - RNA, 17 nt, Haemophilus influenzae Rd
accaaauacaauuuuuu

SEQ ID NO: 725818 - RNA, 12 nt, Haemophilus influenzae Rd
accaaauaccac

SEQ ID NO: 725819 - RNA, 20 nt, Haemophilus influenzae Rd
accaaauaccacacccuuuu

SEQ ID NO: 725820 - RNA, 19 nt, Haemophilus influenzae Rd
accaaauaugguaauuagc

SEQ ID NO: 725821 - RNA, 16 nt, Haemophilus influenzae Rd
acauuuggcaaaauaa

SEQ ID NO: 725822 - RNA, 17 nt, Haemophilus influenzae Rd
acauuuggcaaaauaau

SEQ ID NO: 725823 - RNA, 22 nt, Haemophilus influenzae Rd
acauuuuacuacguaaagagag

SEQ ID NO: 725824 - RNA, 17 nt, Haemophilus influenzae Rd
acauuuucaaauugucc

SEQ ID NO: 725825 - RNA, 13 nt, Haemophilus influenzae Rd
acauuuuucccug

SEQ ID NO: 725826 - RNA, 17 nt, Haemophilus influenzae Rd
acauuuuguaucuaaau

SEQ ID NO: 725827 - RNA, 13 nt, Haemophilus influenzae Rd
acauuuuguuucu

SEQ ID NO: 725828 - RNA, 12 nt, Haemophilus influenzae Rd
acauuuaaacuc

SEQ ID NO: 725829 - RNA, 13 nt, Haemophilus influenzae Rd
acauuuaaccaaa

SEQ ID NO: 725830 - RNA, 14 nt, Haemophilus influenzae Rd
acauuuaaccaaaa

SEQ ID NO: 725831 - RNA, 21 nt, Haemophilus influenzae Rd
acauuuaauggcugaaugcuu

SEQ ID NO: 725832 - RNA, 12 nt, Haemophilus influenzae Rd
acauuucuuuug

SEQ ID NO: 725833 - RNA, 16 nt, Haemophilus influenzae Rd
acauuucuuuuggcca

SEQ ID NO: 725834 - RNA, 12 nt, Haemophilus influenzae Rd
acauuugacgaa

SEQ ID NO: 725835 - RNA, 14 nt, Haemophilus influenzae Rd
acauuaauuuuucc

SEQ ID NO: 725836 - RNA, 14 nt, Haemophilus influenzae Rd
acauuacauaaauu

SEQ ID NO: 725837 - RNA, 14 nt, Haemophilus influenzae Rd
acauuaaucgauca

SEQ ID NO: 725838 - RNA, 15 nt, Haemophilus influenzae Rd
acauuagagacaaac

SEQ ID NO: 725839 - RNA, 17 nt, Haemophilus influenzae Rd
acauucuuuuaaauaca

SEQ ID NO: 725840 - RNA, 19 nt, Haemophilus influenzae Rd
acauugugacauuggauua

SEQ ID NO: 725841 - RNA, 17 nt, Haemophilus influenzae Rd
acauugcaucagccacc

SEQ ID NO: 725842 - RNA, 17 nt, Haemophilus influenzae Rd
acauuguuucaaucacu

SEQ ID NO: 725843 - RNA, 15 nt, Haemophilus influenzae Rd
acauuguuguuuaau

SEQ ID NO: 725844 - RNA, 17 nt, Haemophilus influenzae Rd
acauccacaaaauuccg

SEQ ID NO: 725845 - RNA, 13 nt, Haemophilus influenzae Rd
acaucauuuucaa

SEQ ID NO: 725846 - RNA, 15 nt, Haemophilus influenzae Rd
acaucauuuucaagu

SEQ ID NO: 725847 - RNA, 18 nt, Haemophilus influenzae Rd
acaucauuuucaaguaac

SEQ ID NO: 725848 - RNA, 16 nt, Haemophilus influenzae Rd
acaucauuauugccuu

SEQ ID NO: 725849 - RNA, 20 nt, Haemophilus influenzae Rd
acaucauuccgcccauucca

SEQ ID NO: 725850 - RNA, 23 nt, Haemophilus influenzae Rd
acaucgcuugcauuucuucaguc

SEQ ID NO: 725851 - RNA, 18 nt, Haemophilus influenzae Rd
acaucaucggacgaauca

SEQ ID NO: 725852 - RNA, 23 nt, Haemophilus influenzae Rd
acaucaucuggcauaucugcugc

SEQ ID NO: 725853 - RNA, 24 nt, Haemophilus influenzae Rd
acaucacgaggauuuuugccguuu

SEQ ID NO: 725854 - RNA, 19 nt, Haemophilus influenzae Rd
acaucaccgauaauaugca

SEQ ID NO: 725855 - RNA, 19 nt, Haemophilus influenzae Rd
acauaaucaggcugugcau

SEQ ID NO: 725856 - RNA, 21 nt, Haemophilus influenzae Rd
acauaauuaaauuaaggacua

SEQ ID NO: 725857 - RNA, 14 nt, Haemophilus influenzae Rd
acaucaacuaauuu

SEQ ID NO: 725858 - RNA, 17 nt, Haemophilus influenzae Rd
acaucaacuaauuuauu

SEQ ID NO: 725859 - RNA, 16 nt, Haemophilus influenzae Rd
acauaagcugcaucaa

SEQ ID NO: 725860 - RNA, 13 nt, Haemophilus influenzae Rd
acauaacuuucca

SEQ ID NO: 725861 - RNA, 16 nt, Haemophilus influenzae Rd
acauaauauuuucccc

SEQ ID NO: 725862 - RNA, 14 nt, Haemophilus influenzae Rd
acauaaguaaaaua

SEQ ID NO: 725863 - RNA, 16 nt, Haemophilus influenzae Rd
acauaaguaaaauagu

SEQ ID NO: 725864 - RNA, 20 nt, Haemophilus influenzae Rd
acauaaguuaccgcuucuuc

SEQ ID NO: 725865 - RNA, 22 nt, Haemophilus influenzae Rd
acauaaguuaccgcuucuuccu

SEQ ID NO: 725866 - RNA, 15 nt, Haemophilus influenzae Rd
acauaauaaaauuua

SEQ ID NO: 725867 - RNA, 14 nt, Haemophilus influenzae Rd
acauaauaaacaua

SEQ ID NO: 725868 - RNA, 22 nt, Haemophilus influenzae Rd
acaugcguuuucgcaauaucau

SEQ ID NO: 725869 - RNA, 14 nt, Haemophilus influenzae Rd
acaugguuaaaaua

SEQ ID NO: 725870 - RNA, 17 nt, Haemophilus influenzae Rd
acaugaauuucuaauuu

SEQ ID NO: 725871 - RNA, 15 nt, Haemophilus influenzae Rd
acaucuaaaauguca

SEQ ID NO: 725872 - RNA, 21 nt, Haemophilus influenzae Rd
acaggguguuuauaagugcca

SEQ ID NO: 725873 - RNA, 17 nt, Haemophilus influenzae Rd
acagggcagugauguaa

SEQ ID NO: 725874 - RNA, 15 nt, Haemophilus influenzae Rd
acagggcauaaauca

SEQ ID NO: 725875 - RNA, 15 nt, Haemophilus influenzae Rd
acagggcugauaaau

SEQ ID NO: 725876 - RNA, 22 nt, Haemophilus influenzae Rd
acagguguguuuuucaaaaaau

SEQ ID NO: 725877 - RNA, 15 nt, Haemophilus influenzae Rd
acagguaauuucucu

SEQ ID NO: 725878 - RNA, 23 nt, Haemophilus influenzae Rd
acaguccccauaucucugccauc

SEQ ID NO: 725879 - RNA, 16 nt, Haemophilus influenzae Rd
acaguauuuagcggaa

SEQ ID NO: 725880 - RNA, 14 nt, Haemophilus influenzae Rd
acaguauuuuccuu

SEQ ID NO: 725881 - RNA, 16 nt, Haemophilus influenzae Rd
acaguaauuguugguu

SEQ ID NO: 725882 - RNA, 21 nt, Haemophilus influenzae Rd
acaguaaugaaagaaacacca

SEQ ID NO: 725883 - RNA, 17 nt, Haemophilus influenzae Rd
acaguagaaaucacaau

SEQ ID NO: 725884 - RNA, 18 nt, Haemophilus influenzae Rd
acaguaguacgaccugaa

SEQ ID NO: 725885 - RNA, 15 nt, Haemophilus influenzae Rd
acaguaaauuuuucc

SEQ ID NO: 725886 - RNA, 16 nt, Haemophilus influenzae Rd
acaguaaauuuuucca

SEQ ID NO: 725887 - RNA, 17 nt, Haemophilus influenzae Rd
acaguaaauuuuuccac

SEQ ID NO: 725888 - RNA, 14 nt, Haemophilus influenzae Rd
acaguaaaaauaga

SEQ ID NO: 725889 - RNA, 13 nt, Haemophilus influenzae Rd
acagguuucucua

SEQ ID NO: 725890 - RNA, 18 nt, Haemophilus influenzae Rd
acauaacauuguuuuaau

SEQ ID NO: 725891 - RNA, 23 nt, Haemophilus influenzae Rd
acauaacaaaauggcuuuuuugc

SEQ ID NO: 725892 - RNA, 20 nt, Haemophilus influenzae Rd
acauaaauguggucaaagau

SEQ ID NO: 725893 - RNA, 23 nt, Haemophilus influenzae Rd
acauaaagacgcuguuucuuuuc

SEQ ID NO: 725894 - RNA, 14 nt, Haemophilus influenzae Rd
acauaaaaaacaca

SEQ ID NO: 725895 - RNA, 22 nt, Haemophilus influenzae Rd
acauaaaagcggagauaguuua

SEQ ID NO: 725896 - RNA, 22 nt, Haemophilus influenzae Rd
acauaaagaauaauuuucaaac

SEQ ID NO: 725897 - RNA, 16 nt, Haemophilus influenzae Rd
acaguuuuauuuucca

SEQ ID NO: 725898 - RNA, 19 nt, Haemophilus influenzae Rd
acaguuuuggcucuacuuu

SEQ ID NO: 725899 - RNA, 18 nt, Haemophilus influenzae Rd
acaguuuccgcaaaugcu

SEQ ID NO: 725900 - RNA, 14 nt, Haemophilus influenzae Rd
acaguuuaucucuu

SEQ ID NO: 725901 - RNA, 16 nt, Haemophilus influenzae Rd
acagugaaaccaaaga

SEQ ID NO: 725902 - RNA, 21 nt, Haemophilus influenzae Rd
acagugacuaaaacaacagua

SEQ ID NO: 725903 - RNA, 14 nt, Haemophilus influenzae Rd
acaguucaauaaaa

SEQ ID NO: 725904 - RNA, 16 nt, Haemophilus influenzae Rd
acaguugugaaaaaac

SEQ ID NO: 725905 - RNA, 19 nt, Haemophilus influenzae Rd
acaguuggggcuaaaaaua

SEQ ID NO: 725906 - RNA, 15 nt, Haemophilus influenzae Rd
acaguugaaaaccgc

SEQ ID NO: 725907 - RNA, 17 nt, Haemophilus influenzae Rd
acagcuaccaauucaaa

SEQ ID NO: 725908 - RNA, 15 nt, Haemophilus influenzae Rd
acagcuauuaaaaaa

SEQ ID NO: 725909 - RNA, 14 nt, Haemophilus influenzae Rd
acagcucaaaaugc

SEQ ID NO: 725910 - RNA, 18 nt, Haemophilus influenzae Rd
acagcuuugcugucuuug

SEQ ID NO: 725911 - RNA, 21 nt, Haemophilus influenzae Rd
acaggaauacucacagagccu

SEQ ID NO: 725912 - RNA, 18 nt, Haemophilus influenzae Rd
acagcacacuaauaagaa

SEQ ID NO: 725913 - RNA, 14 nt, Haemophilus influenzae Rd
acagcaauaaauaa

SEQ ID NO: 725914 - RNA, 16 nt, Haemophilus influenzae Rd
acagcaagaacagcca

SEQ ID NO: 725915 - RNA, 18 nt, Haemophilus influenzae Rd
acagcaauuugaauuaau

SEQ ID NO: 725916 - RNA, 18 nt, Haemophilus influenzae Rd
acagcaaacuuaaauaca

SEQ ID NO: 725917 - RNA, 12 nt, Haemophilus influenzae Rd
acagcaaauccu

SEQ ID NO: 725918 - RNA, 13 nt, Haemophilus influenzae Rd
acagcaaauccuu

SEQ ID NO: 725919 - RNA, 21 nt, Haemophilus influenzae Rd
acacguccuugacuaucuguu

SEQ ID NO: 725920 - RNA, 12 nt, Haemophilus influenzae Rd
acaaugauuaau

SEQ ID NO: 725921 - RNA, 18 nt, Haemophilus influenzae Rd
acaaugauuaauaucacu

SEQ ID NO: 725922 - RNA, 20 nt, Haemophilus influenzae Rd
acaaugagacuuaaccaaau

SEQ ID NO: 725923 - RNA, 21 nt, Haemophilus influenzae Rd
acaaugagacuuaaccaaaua

SEQ ID NO: 725924 - RNA, 22 nt, Haemophilus influenzae Rd
acaaucuaaagcgaucaucauu

SEQ ID NO: 725925 - RNA, 14 nt, Haemophilus influenzae Rd
acaauuuguccuuu

SEQ ID NO: 725926 - RNA, 22 nt, Haemophilus influenzae Rd
acaauuuguccuuuaucaagca

SEQ ID NO: 725927 - RNA, 23 nt, Haemophilus influenzae Rd
acaauuuguccuuuaucaagcac

SEQ ID NO: 725928 - RNA, 12 nt, Haemophilus influenzae Rd
acaauuuuccug

SEQ ID NO: 725929 - RNA, 14 nt, Haemophilus influenzae Rd
acaauucucaucag

SEQ ID NO: 725930 - RNA, 20 nt, Haemophilus influenzae Rd
acaaucgcuucauucucuuc

SEQ ID NO: 725931 - RNA, 21 nt, Haemophilus influenzae Rd
acaaucgcuucauucucuucu

SEQ ID NO: 725932 - RNA, 21 nt, Haemophilus influenzae Rd
acaaucgcuagcgcaaucaac

SEQ ID NO: 725933 - RNA, 24 nt, Haemophilus influenzae Rd
acaaucgguuaaaaguaagcaauu

SEQ ID NO: 725934 - RNA, 16 nt, Haemophilus influenzae Rd
acaaucccaggcuuaa

SEQ ID NO: 725935 - RNA, 17 nt, Haemophilus influenzae Rd
acaaucccaggcuuaau

SEQ ID NO: 725936 - RNA, 17 nt, Haemophilus influenzae Rd
acaauccuauagcccaa

SEQ ID NO: 725937 - RNA, 18 nt, Haemophilus influenzae Rd
acaauccuauagcccaac

SEQ ID NO: 725938 - RNA, 18 nt, Haemophilus influenzae Rd
acaaucacugaaaaaugg

SEQ ID NO: 725939 - RNA, 16 nt, Haemophilus influenzae Rd
acaaucauacacacca

SEQ ID NO: 725940 - RNA, 13 nt, Haemophilus influenzae Rd
acaaucaaaaaau

SEQ ID NO: 725941 - RNA, 12 nt, Haemophilus influenzae Rd
acaauauuuaau

SEQ ID NO: 725942 - RNA, 15 nt, Haemophilus influenzae Rd
acaauauuuauuucu

SEQ ID NO: 725943 - RNA, 13 nt, Haemophilus influenzae Rd
acaauauuucacu

SEQ ID NO: 725944 - RNA, 15 nt, Haemophilus influenzae Rd
acaauauugaaauaa

SEQ ID NO: 725945 - RNA, 15 nt, Haemophilus influenzae Rd
acaauacuuaucacu

SEQ ID NO: 725946 - RNA, 16 nt, Haemophilus influenzae Rd
acaauacguugaguau

SEQ ID NO: 725947 - RNA, 16 nt, Haemophilus influenzae Rd
acaauacucuuaacaa

SEQ ID NO: 725948 - RNA, 17 nt, Haemophilus influenzae Rd
acaaguuuuaccuucag

SEQ ID NO: 725949 - RNA, 13 nt, Haemophilus influenzae Rd
acaauaauuugcc

SEQ ID NO: 725950 - RNA, 16 nt, Haemophilus influenzae Rd
acaauaauuugccaaa

SEQ ID NO: 725951 - RNA, 14 nt, Haemophilus influenzae Rd
acaauaauuuucaa

SEQ ID NO: 725952 - RNA, 14 nt, Haemophilus influenzae Rd
acaaguuaaaacuu

SEQ ID NO: 725953 - RNA, 20 nt, Haemophilus influenzae Rd
acaagugcggguucuuuuuu

SEQ ID NO: 725954 - RNA, 22 nt, Haemophilus influenzae Rd
acaauaaugugagaauaaccac

SEQ ID NO: 725955 - RNA, 14 nt, Haemophilus influenzae Rd
acaaguuuagauua

SEQ ID NO: 725956 - RNA, 15 nt, Haemophilus influenzae Rd
acaaguuuaauacaa

SEQ ID NO: 725957 - RNA, 16 nt, Haemophilus influenzae Rd
acaagggauuuaaaau

SEQ ID NO: 725958 - RNA, 20 nt, Haemophilus influenzae Rd
acaaggcucaucauuaugaa

SEQ ID NO: 725959 - RNA, 22 nt, Haemophilus influenzae Rd
acaaggcucaucauuaugaaaa

SEQ ID NO: 725960 - RNA, 21 nt, Haemophilus influenzae Rd
acaaccuguuugggauaagca

SEQ ID NO: 725961 - RNA, 20 nt, Haemophilus influenzae Rd
acacauggccaauuucaucg

SEQ ID NO: 725962 - RNA, 13 nt, Haemophilus influenzae Rd
acacauugccaua

SEQ ID NO: 725963 - RNA, 12 nt, Haemophilus influenzae Rd
acaccaaaaaug

SEQ ID NO: 725964 - RNA, 14 nt, Haemophilus influenzae Rd
acaccaaaaccaau

SEQ ID NO: 725965 - RNA, 17 nt, Haemophilus influenzae Rd
acacaagggauuuaaaa

SEQ ID NO: 725966 - RNA, 22 nt, Haemophilus influenzae Rd
acacaagggauuuaaaaucccu

SEQ ID NO: 725967 - RNA, 21 nt, Haemophilus influenzae Rd
acacaaacugguuaaaaucca

SEQ ID NO: 725968 - RNA, 17 nt, Haemophilus influenzae Rd
acaauuuuuuucaagca

SEQ ID NO: 725969 - RNA, 21 nt, Haemophilus influenzae Rd
acaauuuuuuucaagcaacaa

SEQ ID NO: 725970 - RNA, 17 nt, Haemophilus influenzae Rd
acaauuuucuuuucaaa

SEQ ID NO: 725971 - RNA, 22 nt, Haemophilus influenzae Rd
acaauuuucuuuucaaacaaca

SEQ ID NO: 725972 - RNA, 13 nt, Haemophilus influenzae Rd
acaccccaaaauc

SEQ ID NO: 725973 - RNA, 17 nt, Haemophilus influenzae Rd
acacccaaauuaaaaaa

SEQ ID NO: 725974 - RNA, 14 nt, Haemophilus influenzae Rd
acaccacccgauaa

SEQ ID NO: 725975 - RNA, 20 nt, Haemophilus influenzae Rd
acaccacccgauaaaugcac

SEQ ID NO: 725976 - RNA, 15 nt, Haemophilus influenzae Rd
acaccaauaauuaaa

SEQ ID NO: 725977 - RNA, 21 nt, Haemophilus influenzae Rd
acaccaauaauuaaacagcca

SEQ ID NO: 725978 - RNA, 16 nt, Haemophilus influenzae Rd
acacggauuggguugu

SEQ ID NO: 725979 - RNA, 15 nt, Haemophilus influenzae Rd
acacgcucaacgccu

SEQ ID NO: 725980 - RNA, 18 nt, Haemophilus influenzae Rd
acacgagcaauggcaauu

SEQ ID NO: 725981 - RNA, 14 nt, Haemophilus influenzae Rd
acacgauaaacugu

SEQ ID NO: 725982 - RNA, 14 nt, Haemophilus influenzae Rd
acaccguccaaggu

SEQ ID NO: 725983 - RNA, 13 nt, Haemophilus influenzae Rd
acaccuauuauuc

SEQ ID NO: 725984 - RNA, 15 nt, Haemophilus influenzae Rd
acaacagcaauaagc

SEQ ID NO: 725985 - RNA, 19 nt, Haemophilus influenzae Rd
acaacaguagaaaucacaa

SEQ ID NO: 725986 - RNA, 20 nt, Haemophilus influenzae Rd
acaacaacgcaucuuuauaa

SEQ ID NO: 725987 - RNA, 14 nt, Haemophilus influenzae Rd
acaacaacgcccuc

SEQ ID NO: 725988 - RNA, 12 nt, Haemophilus influenzae Rd
acaacaagaaau

SEQ ID NO: 725989 - RNA, 24 nt, Haemophilus influenzae Rd
acaaauuuuuacagauaaaucagc

SEQ ID NO: 725990 - RNA, 18 nt, Haemophilus influenzae Rd
acaaauuuuauauaucca

SEQ ID NO: 725991 - RNA, 23 nt, Haemophilus influenzae Rd
acaacaaaagugcgguaaauuuu

SEQ ID NO: 725992 - RNA, 14 nt, Haemophilus influenzae Rd
acaacaaaccagcc

SEQ ID NO: 725993 - RNA, 15 nt, Haemophilus influenzae Rd
acaacaaaccagccu

SEQ ID NO: 725994 - RNA, 16 nt, Haemophilus influenzae Rd
acaacaaagucuucau

SEQ ID NO: 725995 - RNA, 12 nt, Haemophilus influenzae Rd
acaaauuucacg

SEQ ID NO: 725996 - RNA, 17 nt, Haemophilus influenzae Rd
acaaauuuaauauuucu

SEQ ID NO: 725997 - RNA, 12 nt, Haemophilus influenzae Rd
acaaauuuagau

SEQ ID NO: 725998 - RNA, 22 nt, Haemophilus influenzae Rd
acaaauuuagauaacaaugaaa

SEQ ID NO: 725999 - RNA, 23 nt, Haemophilus influenzae Rd
acaaauuuagauaacaaugaaau

SEQ ID NO: 726000 - RNA, 18 nt, Haemophilus influenzae Rd
acaaauuuccauaugacc

SEQ ID NO: 726001 - RNA, 19 nt, Haemophilus influenzae Rd
acaaauuuccauaugacca

SEQ ID NO: 726002 - RNA, 17 nt, Haemophilus influenzae Rd
acaacauuuugacuuuc

SEQ ID NO: 726003 - RNA, 17 nt, Haemophilus influenzae Rd
acaaccaccaauuaauu

SEQ ID NO: 726004 - RNA, 21 nt, Haemophilus influenzae Rd
acaaccaagcgcgugugaaau

SEQ ID NO: 726005 - RNA, 18 nt, Haemophilus influenzae Rd
acaacaucuuguuuuaau

SEQ ID NO: 726006 - RNA, 14 nt, Haemophilus influenzae Rd
acaacauaauuaaa

SEQ ID NO: 726007 - RNA, 23 nt, Haemophilus influenzae Rd
acaacauagcugaaaaauaaaaa

SEQ ID NO: 726008 - RNA, 22 nt, Haemophilus influenzae Rd
acaacauaguuaauguuuucuu

SEQ ID NO: 726009 - RNA, 12 nt, Haemophilus influenzae Rd
acaacaucagau

SEQ ID NO: 726010 - RNA, 18 nt, Haemophilus influenzae Rd
acaacaucagauggaaua

SEQ ID NO: 726011 - RNA, 15 nt, Haemophilus influenzae Rd
acaaccagcgcacca

SEQ ID NO: 726012 - RNA, 21 nt, Haemophilus influenzae Rd
acaaccagcgcaccacacaau

SEQ ID NO: 726013 - RNA, 20 nt, Haemophilus influenzae Rd
acaaaucugccugauuuuuu

SEQ ID NO: 726014 - RNA, 17 nt, Haemophilus influenzae Rd
acaaaucguaauuaaaa

SEQ ID NO: 726015 - RNA, 18 nt, Haemophilus influenzae Rd
acaaaucguaauuaaaau

SEQ ID NO: 726016 - RNA, 18 nt, Haemophilus influenzae Rd
acaaauuaauaagaaaau

SEQ ID NO: 726017 - RNA, 21 nt, Haemophilus influenzae Rd
acaaauuaauaagaaaaucaa

SEQ ID NO: 726018 - RNA, 14 nt, Haemophilus influenzae Rd
acaaaugauuagaa

SEQ ID NO: 726019 - RNA, 18 nt, Haemophilus influenzae Rd
acaaauuagcgauuaaag

SEQ ID NO: 726020 - RNA, 12 nt, Haemophilus influenzae Rd
acaaauucagcu

SEQ ID NO: 726021 - RNA, 19 nt, Haemophilus influenzae Rd
acaaauucagcuaauucag

SEQ ID NO: 726022 - RNA, 15 nt, Haemophilus influenzae Rd
acaaauaggauaaaa

SEQ ID NO: 726023 - RNA, 17 nt, Haemophilus influenzae Rd
acaaauaggauaaaaau

SEQ ID NO: 726024 - RNA, 20 nt, Haemophilus influenzae Rd
acaaauauugguuauuuaaa

SEQ ID NO: 726025 - RNA, 14 nt, Haemophilus influenzae Rd
acaaauauauuucu

SEQ ID NO: 726026 - RNA, 15 nt, Haemophilus influenzae Rd
acaaauauauuucua

SEQ ID NO: 726027 - RNA, 19 nt, Haemophilus influenzae Rd
acaaauauauuucuaauaa

SEQ ID NO: 726028 - RNA, 20 nt, Haemophilus influenzae Rd
acaaauaaccuaucccaaaa

SEQ ID NO: 726029 - RNA, 14 nt, Haemophilus influenzae Rd
acaaauaagccaau

SEQ ID NO: 726030 - RNA, 20 nt, Haemophilus influenzae Rd
acaaauaagcccaacuuaag

SEQ ID NO: 726031 - RNA, 12 nt, Haemophilus influenzae Rd
acaaauaauaug

SEQ ID NO: 726032 - RNA, 13 nt, Haemophilus influenzae Rd
acaaaggguaaau

SEQ ID NO: 726033 - RNA, 19 nt, Haemophilus influenzae Rd
acaaagggcugauauuuaa

SEQ ID NO: 726034 - RNA, 14 nt, Haemophilus influenzae Rd
acaaagucaauaca

SEQ ID NO: 726035 - RNA, 23 nt, Haemophilus influenzae Rd
acaaaguguuuuauuuaucagcc

SEQ ID NO: 726036 - RNA, 23 nt, Haemophilus influenzae Rd
acaaagucgguuuuuaauucagu

SEQ ID NO: 726037 - RNA, 19 nt, Haemophilus influenzae Rd
acaaaguggagaaacauuu

SEQ ID NO: 726038 - RNA, 20 nt, Haemophilus influenzae Rd
acaaauaaacaaacuuucau

SEQ ID NO: 726039 - RNA, 12 nt, Haemophilus influenzae Rd
acaaauaaauca

SEQ ID NO: 726040 - RNA, 14 nt, Haemophilus influenzae Rd
acaaauaaaucaua

SEQ ID NO: 726041 - RNA, 20 nt, Haemophilus influenzae Rd
acaaauaacacagaaaccaa

SEQ ID NO: 726042 - RNA, 22 nt, Haemophilus influenzae Rd
acaaauaacacagaaaccaaua

SEQ ID NO: 726043 - RNA, 15 nt, Haemophilus influenzae Rd
acaaacuaauuucau

SEQ ID NO: 726044 - RNA, 23 nt, Haemophilus influenzae Rd
acaaaccagccugaaaaagcuaa

SEQ ID NO: 726045 - RNA, 12 nt, Haemophilus influenzae Rd
acaaacccauuu

SEQ ID NO: 726046 - RNA, 23 nt, Haemophilus influenzae Rd
acaaaauuuuaaauaaaauauuu

SEQ ID NO: 726047 - RNA, 15 nt, Haemophilus influenzae Rd
acaaacaauaugcgu

SEQ ID NO: 726048 - RNA, 16 nt, Haemophilus influenzae Rd
acaaacaaucuuaacu

SEQ ID NO: 726049 - RNA, 23 nt, Haemophilus influenzae Rd
acaaagacagcuauuaaaaaaag

SEQ ID NO: 726050 - RNA, 14 nt, Haemophilus influenzae Rd
acaaagaaucuuaa

SEQ ID NO: 726051 - RNA, 18 nt, Haemophilus influenzae Rd
acaaagaaucuuaaauuc

SEQ ID NO: 726052 - RNA, 19 nt, Haemophilus influenzae Rd
acaaacugguuaaaaucca

SEQ ID NO: 726053 - RNA, 20 nt, Haemophilus influenzae Rd
acaaacugguuaaaauccaa

SEQ ID NO: 726054 - RNA, 13 nt, Haemophilus influenzae Rd
acaaagaaaaacu

SEQ ID NO: 726055 - RNA, 18 nt, Haemophilus influenzae Rd
acaaagauuucauagcca

SEQ ID NO: 726056 - RNA, 22 nt, Haemophilus influenzae Rd
acaaagcguaccgccaguauca

SEQ ID NO: 726057 - RNA, 16 nt, Haemophilus influenzae Rd
acaaagcuuaguccuu

SEQ ID NO: 726058 - RNA, 19 nt, Haemophilus influenzae Rd
acaaaaguuugcaacauau

SEQ ID NO: 726059 - RNA, 19 nt, Haemophilus influenzae Rd
acaaaagugcgguaaauuu

SEQ ID NO: 726060 - RNA, 19 nt, Haemophilus influenzae Rd
acaaaauaaacacuccaac

SEQ ID NO: 726061 - RNA, 22 nt, Haemophilus influenzae Rd
acaaaaggcuuuuuacguucau

SEQ ID NO: 726062 - RNA, 16 nt, Haemophilus influenzae Rd
acaaaagaaauuuuaa

SEQ ID NO: 726063 - RNA, 12 nt, Haemophilus influenzae Rd
acaaaaccugca

SEQ ID NO: 726064 - RNA, 13 nt, Haemophilus influenzae Rd
acaaaacuuauca

SEQ ID NO: 726065 - RNA, 18 nt, Haemophilus influenzae Rd
acaaaaugucgcuuucuu

SEQ ID NO: 726066 - RNA, 13 nt, Haemophilus influenzae Rd
acaaaauggcugu

SEQ ID NO: 726067 - RNA, 22 nt, Haemophilus influenzae Rd
acaaaauggcuguuguuuuggc

SEQ ID NO: 726068 - RNA, 24 nt, Haemophilus influenzae Rd
acaaaauggcuguuguuuuggcug

SEQ ID NO: 726069 - RNA, 23 nt, Haemophilus influenzae Rd
acaaaauuaaugccaaugcaauu

SEQ ID NO: 726070 - RNA, 16 nt, Haemophilus influenzae Rd
acaaaauggcaaacaa

SEQ ID NO: 726071 - RNA, 18 nt, Haemophilus influenzae Rd
acaaaauggcaaacaaaa

SEQ ID NO: 726072 - RNA, 19 nt, Haemophilus influenzae Rd
acaaaauggcaaacaaaau

SEQ ID NO: 726073 - RNA, 18 nt, Haemophilus influenzae Rd
acaaaaucugauacgaau

SEQ ID NO: 726074 - RNA, 20 nt, Haemophilus influenzae Rd
acaaaaucgccgauugguuu

SEQ ID NO: 726075 - RNA, 18 nt, Haemophilus influenzae Rd
acaaaaucgcuuuuuguu

SEQ ID NO: 726076 - RNA, 14 nt, Haemophilus influenzae Rd
acaaaaaugcaccc

SEQ ID NO: 726077 - RNA, 18 nt, Haemophilus influenzae Rd
acaaaaauacguuguuuu

SEQ ID NO: 726078 - RNA, 17 nt, Haemophilus influenzae Rd
acaaaaauacagccacu

SEQ ID NO: 726079 - RNA, 18 nt, Haemophilus influenzae Rd
acaaaaaggcuaaguucu

SEQ ID NO: 726080 - RNA, 16 nt, Haemophilus influenzae Rd
acaaaaaguacuugca

SEQ ID NO: 726081 - RNA, 18 nt, Haemophilus influenzae Rd
acaaaaaacggacuauca

SEQ ID NO: 726082 - RNA, 19 nt, Haemophilus influenzae Rd
acaaaaaacggacuaucau

SEQ ID NO: 726083 - RNA, 18 nt, Haemophilus influenzae Rd
aauuuuuuuucuaauaau

SEQ ID NO: 726084 - RNA, 21 nt, Haemophilus influenzae Rd
aauuuagucauacagaaacca

SEQ ID NO: 726085 - RNA, 15 nt, Haemophilus influenzae Rd
aauuuaguccuuuag

SEQ ID NO: 726086 - RNA, 13 nt, Haemophilus influenzae Rd
aauuuauacaaaa

SEQ ID NO: 726087 - RNA, 17 nt, Haemophilus influenzae Rd
aauuuauacgcuuuaac

SEQ ID NO: 726088 - RNA, 19 nt, Haemophilus influenzae Rd
aauuuauacuaaauuagua

SEQ ID NO: 726089 - RNA, 20 nt, Haemophilus influenzae Rd
aauuuauauaugauaaaaau

SEQ ID NO: 726090 - RNA, 21 nt, Haemophilus influenzae Rd
aauuuauauaugauaaaaaua

SEQ ID NO: 726091 - RNA, 22 nt, Haemophilus influenzae Rd
aauuuauauaugauaaaaauaa

SEQ ID NO: 726092 - RNA, 23 nt, Haemophilus influenzae Rd
aauuuauauaugauaaaaauaaa

SEQ ID NO: 726093 - RNA, 13 nt, Haemophilus influenzae Rd
aaugccauuugcu

SEQ ID NO: 726094 - RNA, 16 nt, Haemophilus influenzae Rd
aaugccauuaaacuuc

SEQ ID NO: 726095 - RNA, 20 nt, Haemophilus influenzae Rd
aaugccaucaccaagaauca

SEQ ID NO: 726096 - RNA, 22 nt, Haemophilus influenzae Rd
aaugccagaaagcagguuuuuc

SEQ ID NO: 726097 - RNA, 22 nt, Haemophilus influenzae Rd
aaugccaguuaaggauuuuuga

SEQ ID NO: 726098 - RNA, 20 nt, Haemophilus influenzae Rd
aaugccagcgcuugcaccaa

SEQ ID NO: 726099 - RNA, 13 nt, Haemophilus influenzae Rd
aaugccacugccc

SEQ ID NO: 726100 - RNA, 17 nt, Haemophilus influenzae Rd
aaugcagcagcuucuuc

SEQ ID NO: 726101 - RNA, 18 nt, Haemophilus influenzae Rd
aaugcagcagcuucuucu

SEQ ID NO: 726102 - RNA, 23 nt, Haemophilus influenzae Rd
aaugcaauauuauucagcacuuu

SEQ ID NO: 726103 - RNA, 14 nt, Haemophilus influenzae Rd
aaugcaaauacaag

SEQ ID NO: 726104 - RNA, 14 nt, Haemophilus influenzae Rd
aaugcaaguuugau

SEQ ID NO: 726105 - RNA, 22 nt, Haemophilus influenzae Rd
aaugauuuuuucagguugguuu

SEQ ID NO: 726106 - RNA, 18 nt, Haemophilus influenzae Rd
aaugcaaaaucuuuacga

SEQ ID NO: 726107 - RNA, 16 nt, Haemophilus influenzae Rd
aaugcaaccaaacaaa

SEQ ID NO: 726108 - RNA, 17 nt, Haemophilus influenzae Rd
aaugcaccgcacacaac

SEQ ID NO: 726109 - RNA, 22 nt, Haemophilus influenzae Rd
aaugcacauaacaaaauggcuu

SEQ ID NO: 726110 - RNA, 19 nt, Haemophilus influenzae Rd
aaugcaccaaaaauccuca

SEQ ID NO: 726111 - RNA, 12 nt, Haemophilus influenzae Rd
aaucuucuuccc

SEQ ID NO: 726112 - RNA, 19 nt, Haemophilus influenzae Rd
aaucuucuaauuugccauc

SEQ ID NO: 726113 - RNA, 17 nt, Haemophilus influenzae Rd
aaucuucuuuaccaacu

SEQ ID NO: 726114 - RNA, 21 nt, Haemophilus influenzae Rd
aaucuugaacagcuuugcugu

SEQ ID NO: 726115 - RNA, 20 nt, Haemophilus influenzae Rd
aaucuugcacggcaguaucu

SEQ ID NO: 726116 - RNA, 21 nt, Haemophilus influenzae Rd
aaucuugcccaucuugccaau

SEQ ID NO: 726117 - RNA, 20 nt, Haemophilus influenzae Rd
aaucuugcgcacauucuaua

SEQ ID NO: 726118 - RNA, 23 nt, Haemophilus influenzae Rd
aaucuugcugaaguuguaauaaa

SEQ ID NO: 726119 - RNA, 15 nt, Haemophilus influenzae Rd
aaugcuuuuugcguu

SEQ ID NO: 726120 - RNA, 16 nt, Haemophilus influenzae Rd
aaugcuugguuuuaua

SEQ ID NO: 726121 - RNA, 18 nt, Haemophilus influenzae Rd
aaugcuugguuuuauauu

SEQ ID NO: 726122 - RNA, 16 nt, Haemophilus influenzae Rd
aaugcuuguucugauu

SEQ ID NO: 726123 - RNA, 23 nt, Haemophilus influenzae Rd
aaugcuguuuaaaucuaagccuu

SEQ ID NO: 726124 - RNA, 17 nt, Haemophilus influenzae Rd
aaugcuucuaaucccau

SEQ ID NO: 726125 - RNA, 21 nt, Haemophilus influenzae Rd
aaugcuugaccuguuaaugaa

SEQ ID NO: 726126 - RNA, 17 nt, Haemophilus influenzae Rd
aaugcuuugacugaggu

SEQ ID NO: 726127 - RNA, 20 nt, Haemophilus influenzae Rd
aaugcuuuuauaagugaaau

SEQ ID NO: 726128 - RNA, 18 nt, Haemophilus influenzae Rd
aaugcuuuugccgaaaau

SEQ ID NO: 726129 - RNA, 13 nt, Haemophilus influenzae Rd
aaugcuuuugcuu

SEQ ID NO: 726130 - RNA, 14 nt, Haemophilus influenzae Rd
aaugcuuuaaucau

SEQ ID NO: 726131 - RNA, 17 nt, Haemophilus influenzae Rd
aaugcuuuaaucauuuu

SEQ ID NO: 726132 - RNA, 17 nt, Haemophilus influenzae Rd
aaugcuuuauuuaaauu

SEQ ID NO: 726133 - RNA, 17 nt, Haemophilus influenzae Rd
aaugcuuacaggaaagu

SEQ ID NO: 726134 - RNA, 13 nt, Haemophilus influenzae Rd
aaugcuguagaaa

SEQ ID NO: 726135 - RNA, 14 nt, Haemophilus influenzae Rd
aaugcuguagaaau

SEQ ID NO: 726136 - RNA, 15 nt, Haemophilus influenzae Rd
aaugcuguagaaauu

SEQ ID NO: 726137 - RNA, 23 nt, Haemophilus influenzae Rd
aaugcggcaaugguuaauacaaa

SEQ ID NO: 726138 - RNA, 15 nt, Haemophilus influenzae Rd
aaugcgcugauuuuu

SEQ ID NO: 726139 - RNA, 14 nt, Haemophilus influenzae Rd
aauggauauagaaa

SEQ ID NO: 726140 - RNA, 15 nt, Haemophilus influenzae Rd
aauggaauguagaua

SEQ ID NO: 726141 - RNA, 21 nt, Haemophilus influenzae Rd
aauggauaaaccguacaaacc

SEQ ID NO: 726142 - RNA, 20 nt, Haemophilus influenzae Rd
aauggagugagcgguuuuuc

SEQ ID NO: 726143 - RNA, 13 nt, Haemophilus influenzae Rd
aauguaauaaaaa

SEQ ID NO: 726144 - RNA, 16 nt, Haemophilus influenzae Rd
aauguaauaaaaaaua

SEQ ID NO: 726145 - RNA, 13 nt, Haemophilus influenzae Rd
aauguaaucaauu

SEQ ID NO: 726146 - RNA, 14 nt, Haemophilus influenzae Rd
aauguaaacaaaaa

SEQ ID NO: 726147 - RNA, 15 nt, Haemophilus influenzae Rd
aauguaaacaaaaau

SEQ ID NO: 726148 - RNA, 19 nt, Haemophilus influenzae Rd
aauguaaauuggcauuuuc

SEQ ID NO: 726149 - RNA, 21 nt, Haemophilus influenzae Rd
aauguaaaaauuggaaaauaa

SEQ ID NO: 726150 - RNA, 22 nt, Haemophilus influenzae Rd
aaugguuucgagcgugaagaua

SEQ ID NO: 726151 - RNA, 22 nt, Haemophilus influenzae Rd
aauggcgauaauuauugaguag

SEQ ID NO: 726152 - RNA, 17 nt, Haemophilus influenzae Rd
aaugguuacagaaauau

SEQ ID NO: 726153 - RNA, 23 nt, Haemophilus influenzae Rd
aaugguuuaaauaaccaauauuu

SEQ ID NO: 726154 - RNA, 20 nt, Haemophilus influenzae Rd
aauguguuucgauacuuucu

SEQ ID NO: 726155 - RNA, 13 nt, Haemophilus influenzae Rd
aauguucauuuuu

SEQ ID NO: 726156 - RNA, 19 nt, Haemophilus influenzae Rd
aauguucauuuuuaugauu

SEQ ID NO: 726157 - RNA, 15 nt, Haemophilus influenzae Rd
aauguuaauggcuua

SEQ ID NO: 726158 - RNA, 15 nt, Haemophilus influenzae Rd
aauguuaauaauuua

SEQ ID NO: 726159 - RNA, 15 nt, Haemophilus influenzae Rd
aauguguugauuucu

SEQ ID NO: 726160 - RNA, 21 nt, Haemophilus influenzae Rd
aaugugaucaugguuguaaua

SEQ ID NO: 726161 - RNA, 15 nt, Haemophilus influenzae Rd
aaugucgaaauuuuu

SEQ ID NO: 726162 - RNA, 17 nt, Haemophilus influenzae Rd
aaugucgccauuuaagc

SEQ ID NO: 726163 - RNA, 19 nt, Haemophilus influenzae Rd
aauuaaacagccaaacaaa

SEQ ID NO: 726164 - RNA, 13 nt, Haemophilus influenzae Rd
aauuaaacaaaau

SEQ ID NO: 726165 - RNA, 18 nt, Haemophilus influenzae Rd
aauuaaaacuugggugau

SEQ ID NO: 726166 - RNA, 13 nt, Haemophilus influenzae Rd
aauuaaacuuuca

SEQ ID NO: 726167 - RNA, 20 nt, Haemophilus influenzae Rd
aauuaaacuuucaauuuuuc

SEQ ID NO: 726168 - RNA, 19 nt, Haemophilus influenzae Rd
aauuaaagauaguaauguu

SEQ ID NO: 726169 - RNA, 13 nt, Haemophilus influenzae Rd
aauuaaagaaaaa

SEQ ID NO: 726170 - RNA, 21 nt, Haemophilus influenzae Rd
aauuaaagaaaaaccuugugg

SEQ ID NO: 726171 - RNA, 17 nt, Haemophilus influenzae Rd
aauuaaauucauuuaaa

SEQ ID NO: 726172 - RNA, 18 nt, Haemophilus influenzae Rd
aauuaaauucauuuaaaa

SEQ ID NO: 726173 - RNA, 13 nt, Haemophilus influenzae Rd
aauuaaauugaaa

SEQ ID NO: 726174 - RNA, 17 nt, Haemophilus influenzae Rd
aauuaaauuguaacuau

SEQ ID NO: 726175 - RNA, 14 nt, Haemophilus influenzae Rd
aauuaaaucaaaaa

SEQ ID NO: 726176 - RNA, 11 nt, Haemophilus influenzae Rd
aauuaaaucca

SEQ ID NO: 726177 - RNA, 15 nt, Haemophilus influenzae Rd
aauuaaagccacaua

SEQ ID NO: 726178 - RNA, 17 nt, Haemophilus influenzae Rd
aauuaaccauaaaaaau

SEQ ID NO: 726179 - RNA, 20 nt, Haemophilus influenzae Rd
aauuaaccccagaaaugcuu

SEQ ID NO: 726180 - RNA, 20 nt, Haemophilus influenzae Rd
aauuaaccgcacuuuaaaua

SEQ ID NO: 726181 - RNA, 21 nt, Haemophilus influenzae Rd
aauuaaccgcacuuuaaauau

SEQ ID NO: 726182 - RNA, 11 nt, Haemophilus influenzae Rd
aauuaacaaua

SEQ ID NO: 726183 - RNA, 13 nt, Haemophilus influenzae Rd
aauuaacaaauaa

SEQ ID NO: 726184 - RNA, 18 nt, Haemophilus influenzae Rd
aauguugcugauugcaca

SEQ ID NO: 726185 - RNA, 12 nt, Haemophilus influenzae Rd
aauguuucaaac

SEQ ID NO: 726186 - RNA, 19 nt, Haemophilus influenzae Rd
aauguuuaccucgccauuu

SEQ ID NO: 726187 - RNA, 21 nt, Haemophilus influenzae Rd
aauguuuacgcuaauuuaaga

SEQ ID NO: 726188 - RNA, 18 nt, Haemophilus influenzae Rd
aauguuuaaaguaagaau

SEQ ID NO: 726189 - RNA, 19 nt, Haemophilus influenzae Rd
aauguuuaaaguaagaauu

SEQ ID NO: 726190 - RNA, 13 nt, Haemophilus influenzae Rd
aauuaaaaauaaa

SEQ ID NO: 726191 - RNA, 14 nt, Haemophilus influenzae Rd
aauuaaaaauaaau

SEQ ID NO: 726192 - RNA, 13 nt, Haemophilus influenzae Rd
aauuaaaaauaac

SEQ ID NO: 726193 - RNA, 20 nt, Haemophilus influenzae Rd
aauguuuucuugaccuucaa

SEQ ID NO: 726194 - RNA, 23 nt, Haemophilus influenzae Rd
aauguuuucuugaccuucaauug

SEQ ID NO: 726195 - RNA, 12 nt, Haemophilus influenzae Rd
aauguuuucgcc

SEQ ID NO: 726196 - RNA, 16 nt, Haemophilus influenzae Rd
aauguuuggauaaugu

SEQ ID NO: 726197 - RNA, 23 nt, Haemophilus influenzae Rd
aauguuugugcguuuuuuaauuc

SEQ ID NO: 726198 - RNA, 17 nt, Haemophilus influenzae Rd
aauugccccuucaccuu

SEQ ID NO: 726199 - RNA, 15 nt, Haemophilus influenzae Rd
aauugcauuuucuuc

SEQ ID NO: 726200 - RNA, 17 nt, Haemophilus influenzae Rd
aauugcauuuucuucca

SEQ ID NO: 726201 - RNA, 20 nt, Haemophilus influenzae Rd
aauugcauuuucuuccaaug

SEQ ID NO: 726202 - RNA, 14 nt, Haemophilus influenzae Rd
aauugcuggauuca

SEQ ID NO: 726203 - RNA, 13 nt, Haemophilus influenzae Rd
aauuggaaaagua

SEQ ID NO: 726204 - RNA, 18 nt, Haemophilus influenzae Rd
aauuggaaaaguaagaaa

SEQ ID NO: 726205 - RNA, 14 nt, Haemophilus influenzae Rd
aauuggaaauaaua

SEQ ID NO: 726206 - RNA, 22 nt, Haemophilus influenzae Rd
aauuggcgcaggcaaaccaagc

SEQ ID NO: 726207 - RNA, 17 nt, Haemophilus influenzae Rd
aauugggcgcauaacca

SEQ ID NO: 726208 - RNA, 21 nt, Haemophilus influenzae Rd
aaaacaaggaaucgaaauuaa

SEQ ID NO: 726209 - RNA, 16 nt, Haemophilus influenzae Rd
aauugauggaauuuau

SEQ ID NO: 726210 - RNA, 18 nt, Haemophilus influenzae Rd
aauugauggcgugaaaua

SEQ ID NO: 726211 - RNA, 20 nt, Haemophilus influenzae Rd
aauugauggcgugaaauauu

SEQ ID NO: 726212 - RNA, 18 nt, Haemophilus influenzae Rd
aaaacaaacgaugaagaa

SEQ ID NO: 726213 - RNA, 19 nt, Haemophilus influenzae Rd
aaaacaaauguaaaacagu

SEQ ID NO: 726214 - RNA, 12 nt, Haemophilus influenzae Rd
aauugaaaaaau

SEQ ID NO: 726215 - RNA, 14 nt, Haemophilus influenzae Rd
aauucuuuuucacu

SEQ ID NO: 726216 - RNA, 22 nt, Haemophilus influenzae Rd
aauucuuuucuucuuugacuaa

SEQ ID NO: 726217 - RNA, 17 nt, Haemophilus influenzae Rd
aauucuuuugccauaua

SEQ ID NO: 726218 - RNA, 16 nt, Haemophilus influenzae Rd
aauucugcuaaaucug

SEQ ID NO: 726219 - RNA, 16 nt, Haemophilus influenzae Rd
aauucugcuuaguucc

SEQ ID NO: 726220 - RNA, 17 nt, Haemophilus influenzae Rd
aauucugcuuaguucca

SEQ ID NO: 726221 - RNA, 12 nt, Haemophilus influenzae Rd
aauugaaauuua

SEQ ID NO: 726222 - RNA, 19 nt, Haemophilus influenzae Rd
aauugaagaguuugaucau

SEQ ID NO: 726223 - RNA, 20 nt, Haemophilus influenzae Rd
aauugaagaguuugaucaug

SEQ ID NO: 726224 - RNA, 15 nt, Haemophilus influenzae Rd
aauugaacugaauua

SEQ ID NO: 726225 - RNA, 21 nt, Haemophilus influenzae Rd
aauuguagccguaaguuaaac

SEQ ID NO: 726226 - RNA, 15 nt, Haemophilus influenzae Rd
aauuguaauuuugug

SEQ ID NO: 726227 - RNA, 16 nt, Haemophilus influenzae Rd
aauugguucuaaauau

SEQ ID NO: 726228 - RNA, 17 nt, Haemophilus influenzae Rd
aauugguucuaaauauu

SEQ ID NO: 726229 - RNA, 19 nt, Haemophilus influenzae Rd
aauugguucuaaauauuuu

SEQ ID NO: 726230 - RNA, 24 nt, Haemophilus influenzae Rd
aauuguaacuauaugauauauaaa

SEQ ID NO: 726231 - RNA, 20 nt, Haemophilus influenzae Rd
aauugugccgcuuguugauu

SEQ ID NO: 726232 - RNA, 18 nt, Haemophilus influenzae Rd
aauugugcuaaauuuuuu

SEQ ID NO: 726233 - RNA, 16 nt, Haemophilus influenzae Rd
aauugucaaaauugau

SEQ ID NO: 726234 - RNA, 20 nt, Haemophilus influenzae Rd
aauugucaaaauugaugaaa

SEQ ID NO: 726235 - RNA, 20 nt, Haemophilus influenzae Rd
aauugucguugaacucacaa

SEQ ID NO: 726236 - RNA, 22 nt, Haemophilus influenzae Rd
aauugucguugaacucacaauu

SEQ ID NO: 726237 - RNA, 16 nt, Haemophilus influenzae Rd
aauuguuuuucccaca

SEQ ID NO: 726238 - RNA, 14 nt, Haemophilus influenzae Rd
aauuuaaaaaguag

SEQ ID NO: 726239 - RNA, 13 nt, Haemophilus influenzae Rd
aauuguugauucc

SEQ ID NO: 726240 - RNA, 22 nt, Haemophilus influenzae Rd
aauuguugguuacuaaauguga

SEQ ID NO: 726241 - RNA, 16 nt, Haemophilus influenzae Rd
aauuguuguaaaauag

SEQ ID NO: 726242 - RNA, 18 nt, Haemophilus influenzae Rd
aauuuacacauugccaua

SEQ ID NO: 726243 - RNA, 14 nt, Haemophilus influenzae Rd
aauuuaagcccugc

SEQ ID NO: 726244 - RNA, 15 nt, Haemophilus influenzae Rd
aauuuaauaagaauu

SEQ ID NO: 726245 - RNA, 18 nt, Haemophilus influenzae Rd
aauuuaauaagauuuuua

SEQ ID NO: 726246 - RNA, 22 nt, Haemophilus influenzae Rd
aauucauuauuuggugcaacga

SEQ ID NO: 726247 - RNA, 18 nt, Haemophilus influenzae Rd
aauucauucaacaaaaau

SEQ ID NO: 726248 - RNA, 12 nt, Haemophilus influenzae Rd
aauucauuuaaa

SEQ ID NO: 726249 - RNA, 17 nt, Haemophilus influenzae Rd
aauucauuuaaaauaua

SEQ ID NO: 726250 - RNA, 22 nt, Haemophilus influenzae Rd
aauucauuuaaaauauauauua

SEQ ID NO: 726251 - RNA, 14 nt, Haemophilus influenzae Rd
aauucaucuucugc

SEQ ID NO: 726252 - RNA, 13 nt, Haemophilus influenzae Rd
aauucaucuucuu

SEQ ID NO: 726253 - RNA, 16 nt, Haemophilus influenzae Rd
aauucaucuugaucca

SEQ ID NO: 726254 - RNA, 18 nt, Haemophilus influenzae Rd
aauucaggcauuucauca

SEQ ID NO: 726255 - RNA, 15 nt, Haemophilus influenzae Rd
aauuccccuucaaau

SEQ ID NO: 726256 - RNA, 12 nt, Haemophilus influenzae Rd
aauuccauugca

SEQ ID NO: 726257 - RNA, 13 nt, Haemophilus influenzae Rd
aauucauucuugc

SEQ ID NO: 726258 - RNA, 23 nt, Haemophilus influenzae Rd
aauucauuuuuuauuuuuucuaa

SEQ ID NO: 726259 - RNA, 18 nt, Haemophilus influenzae Rd
aauucgagcgguaauuug

SEQ ID NO: 726260 - RNA, 22 nt, Haemophilus influenzae Rd
aauucuauaauccgcagaauuu

SEQ ID NO: 726261 - RNA, 14 nt, Haemophilus influenzae Rd
aauuccuuuaacgc

SEQ ID NO: 726262 - RNA, 16 nt, Haemophilus influenzae Rd
aauuccuuuuucuacu

SEQ ID NO: 726263 - RNA, 23 nt, Haemophilus influenzae Rd
aauuccuuuuucuacuucuuccg

SEQ ID NO: 726264 - RNA, 16 nt, Haemophilus influenzae Rd
aauuccuuauuuuacu

SEQ ID NO: 726265 - RNA, 21 nt, Haemophilus influenzae Rd
aauuccuucaucgucuucuuc

SEQ ID NO: 726266 - RNA, 24 nt, Haemophilus influenzae Rd
aauuccuucaucgucuucuucgcu

SEQ ID NO: 726267 - RNA, 20 nt, Haemophilus influenzae Rd
aauucugagaucgaaauuag

SEQ ID NO: 726268 - RNA, 22 nt, Haemophilus influenzae Rd
aauucugagcaaauuacccaaa

SEQ ID NO: 726269 - RNA, 21 nt, Haemophilus influenzae Rd
aauucugcacgacgugcuuca

SEQ ID NO: 726270 - RNA, 18 nt, Haemophilus influenzae Rd
aauucucggcaaugguuc

SEQ ID NO: 726271 - RNA, 14 nt, Haemophilus influenzae Rd
aauucucuucaacu

SEQ ID NO: 726272 - RNA, 18 nt, Haemophilus influenzae Rd
aauucucgccauaauaaa

SEQ ID NO: 726273 - RNA, 22 nt, Haemophilus influenzae Rd
aauucuccccgaugauuuuuac

SEQ ID NO: 726274 - RNA, 19 nt, Haemophilus influenzae Rd
aauucucaagaauauauuu

SEQ ID NO: 726275 - RNA, 17 nt, Haemophilus influenzae Rd
aauucuauuaaaauauu

SEQ ID NO: 726276 - RNA, 19 nt, Haemophilus influenzae Rd
aauucuauuaaaauauuuc

SEQ ID NO: 726277 - RNA, 18 nt, Haemophilus influenzae Rd
aauucagcgagagaauau

SEQ ID NO: 726278 - RNA, 19 nt, Haemophilus influenzae Rd
aauucagcggcuuucuuca

SEQ ID NO: 726279 - RNA, 16 nt, Haemophilus influenzae Rd
aauucagcaaaaagug

SEQ ID NO: 726280 - RNA, 20 nt, Haemophilus influenzae Rd
aauucagggauuaagaaaau

SEQ ID NO: 726281 - RNA, 20 nt, Haemophilus influenzae Rd
aauucaggugggaaauaauu

SEQ ID NO: 726282 - RNA, 17 nt, Haemophilus influenzae Rd
aauucaguaagaaacca

SEQ ID NO: 726283 - RNA, 18 nt, Haemophilus influenzae Rd
aauucaguaagaaaccaa

SEQ ID NO: 726284 - RNA, 18 nt, Haemophilus influenzae Rd
aauucaguccaugcguuu

SEQ ID NO: 726285 - RNA, 14 nt, Haemophilus influenzae Rd
aauucagucuuaau

SEQ ID NO: 726286 - RNA, 16 nt, Haemophilus influenzae Rd
aauucaguuaagaaaa

SEQ ID NO: 726287 - RNA, 16 nt, Haemophilus influenzae Rd
aauucaguucaauuua

SEQ ID NO: 726288 - RNA, 14 nt, Haemophilus influenzae Rd
aauucauaaaaaug

SEQ ID NO: 726289 - RNA, 16 nt, Haemophilus influenzae Rd
aauucacgaauguuuu

SEQ ID NO: 726290 - RNA, 18 nt, Haemophilus influenzae Rd
aauucacuacgauuuaau

SEQ ID NO: 726291 - RNA, 16 nt, Haemophilus influenzae Rd
aauucacucaauucaa

SEQ ID NO: 726292 - RNA, 15 nt, Haemophilus influenzae Rd
aauuauucugcaaca

SEQ ID NO: 726293 - RNA, 12 nt, Haemophilus influenzae Rd
aauuauucuuca

SEQ ID NO: 726294 - RNA, 13 nt, Haemophilus influenzae Rd
aauuauuggauug

SEQ ID NO: 726295 - RNA, 15 nt, Haemophilus influenzae Rd
aauuauugcauuuuu

SEQ ID NO: 726296 - RNA, 17 nt, Haemophilus influenzae Rd
aauuauugcauuuuuaa

SEQ ID NO: 726297 - RNA, 21 nt, Haemophilus influenzae Rd
aauuauugugagauaugaaau

SEQ ID NO: 726298 - RNA, 23 nt, Haemophilus influenzae Rd
aauuauugugagauaugaaauaa

SEQ ID NO: 726299 - RNA, 22 nt, Haemophilus influenzae Rd
aauuauaaaauagccuaaauau

SEQ ID NO: 726300 - RNA, 18 nt, Haemophilus influenzae Rd
aauuauaaaccaguuaaa

SEQ ID NO: 726301 - RNA, 19 nt, Haemophilus influenzae Rd
aauuauaaaccaguuaaau

SEQ ID NO: 726302 - RNA, 12 nt, Haemophilus influenzae Rd
aauuauagaaaa

SEQ ID NO: 726303 - RNA, 13 nt, Haemophilus influenzae Rd
aauuauagaaaag

SEQ ID NO: 726304 - RNA, 15 nt, Haemophilus influenzae Rd
aauuauagagaaaua

SEQ ID NO: 726305 - RNA, 16 nt, Haemophilus influenzae Rd
aauuauagagaaauaa

SEQ ID NO: 726306 - RNA, 15 nt, Haemophilus influenzae Rd
aauuauagauaaaua

SEQ ID NO: 726307 - RNA, 18 nt, Haemophilus influenzae Rd
aauuauaggcuauaaaga

SEQ ID NO: 726308 - RNA, 18 nt, Haemophilus influenzae Rd
aauuaacgcucaaaaauu

SEQ ID NO: 726309 - RNA, 14 nt, Haemophilus influenzae Rd
aauuaacgggcuua

SEQ ID NO: 726310 - RNA, 18 nt, Haemophilus influenzae Rd
aauuaacgugcauuuuua

SEQ ID NO: 726311 - RNA, 22 nt, Haemophilus influenzae Rd
aauuaacguuauaaacaacaaa

SEQ ID NO: 726312 - RNA, 18 nt, Haemophilus influenzae Rd
aauuaagaguaauagcuu

SEQ ID NO: 726313 - RNA, 12 nt, Haemophilus influenzae Rd
aauuaagauaau

SEQ ID NO: 726314 - RNA, 13 nt, Haemophilus influenzae Rd
aauuaacuuaucu

SEQ ID NO: 726315 - RNA, 13 nt, Haemophilus influenzae Rd
aauuaagaaaaua

SEQ ID NO: 726316 - RNA, 15 nt, Haemophilus influenzae Rd
aauuaagaaaauaau

SEQ ID NO: 726317 - RNA, 16 nt, Haemophilus influenzae Rd
aauuauccgagagaaa

SEQ ID NO: 726318 - RNA, 17 nt, Haemophilus influenzae Rd
aauuauccgagagaaag

SEQ ID NO: 726319 - RNA, 20 nt, Haemophilus influenzae Rd
aauuaucguuuacuuaaaau

SEQ ID NO: 726320 - RNA, 21 nt, Haemophilus influenzae Rd
aauuaucguuuacuuaaaauc

SEQ ID NO: 726321 - RNA, 22 nt, Haemophilus influenzae Rd
aauuaucugauguagcuugaau

SEQ ID NO: 726322 - RNA, 20 nt, Haemophilus influenzae Rd
aauuaucuggcaaucgccaa

SEQ ID NO: 726323 - RNA, 23 nt, Haemophilus influenzae Rd
aauuaucaucgcguuuauuuuua

SEQ ID NO: 726324 - RNA, 15 nt, Haemophilus influenzae Rd
aauuaucaaaaagaa

SEQ ID NO: 726325 - RNA, 17 nt, Haemophilus influenzae Rd
aauuaucaaaaagaaau

SEQ ID NO: 726326 - RNA, 19 nt, Haemophilus influenzae Rd
aauuaucaaaaagaaauau

SEQ ID NO: 726327 - RNA, 14 nt, Haemophilus influenzae Rd
aauuaucaaaagaa

SEQ ID NO: 726328 - RNA, 15 nt, Haemophilus influenzae Rd
aauuaucaaagaauu

SEQ ID NO: 726329 - RNA, 19 nt, Haemophilus influenzae Rd
aauuaucaaagaauuuuuu

SEQ ID NO: 726330 - RNA, 17 nt, Haemophilus influenzae Rd
aauuaucaacaucaacu

SEQ ID NO: 726331 - RNA, 13 nt, Haemophilus influenzae Rd
aauuaucaauguu

SEQ ID NO: 726332 - RNA, 16 nt, Haemophilus influenzae Rd
aaucacuggcauauca

SEQ ID NO: 726333 - RNA, 17 nt, Haemophilus influenzae Rd
aaucacuugauaaaaau

SEQ ID NO: 726334 - RNA, 23 nt, Haemophilus influenzae Rd
aaucacuugugcgauuaacaaua

SEQ ID NO: 726335 - RNA, 22 nt, Haemophilus influenzae Rd
aaucagaauagccgcaaucaca

SEQ ID NO: 726336 - RNA, 20 nt, Haemophilus influenzae Rd
aaucacgcucaaucucuuua

SEQ ID NO: 726337 - RNA, 19 nt, Haemophilus influenzae Rd
aaucacucgcaggaagcuc

SEQ ID NO: 726338 - RNA, 14 nt, Haemophilus influenzae Rd
aaucacugaaaaau

SEQ ID NO: 726339 - RNA, 15 nt, Haemophilus influenzae Rd
aaucacugaaaaaug

SEQ ID NO: 726340 - RNA, 14 nt, Haemophilus influenzae Rd
aaucacugaauuuc

SEQ ID NO: 726341 - RNA, 21 nt, Haemophilus influenzae Rd
aaucaccuucaaguaauucga

SEQ ID NO: 726342 - RNA, 15 nt, Haemophilus influenzae Rd
aaucacgaucugcaa

SEQ ID NO: 726343 - RNA, 22 nt, Haemophilus influenzae Rd
aaucacgaucugcaacaucacc

SEQ ID NO: 726344 - RNA, 15 nt, Haemophilus influenzae Rd
aaucaccauaucaau

SEQ ID NO: 726345 - RNA, 16 nt, Haemophilus influenzae Rd
aaucacaacauauaaa

SEQ ID NO: 726346 - RNA, 15 nt, Haemophilus influenzae Rd
aaucacaacaaacca

SEQ ID NO: 726347 - RNA, 16 nt, Haemophilus influenzae Rd
aaucacaacacaaucg

SEQ ID NO: 726348 - RNA, 22 nt, Haemophilus influenzae Rd
aaucacaaugagacuuaaccaa

SEQ ID NO: 726349 - RNA, 16 nt, Haemophilus influenzae Rd
aaucacaauuuuuaac

SEQ ID NO: 726350 - RNA, 11 nt, Haemophilus influenzae Rd
aaucacagcac

SEQ ID NO: 726351 - RNA, 14 nt, Haemophilus influenzae Rd
aaucacaguuuuau

SEQ ID NO: 726352 - RNA, 15 nt, Haemophilus influenzae Rd
aaucacauaaaaaau

SEQ ID NO: 726353 - RNA, 20 nt, Haemophilus influenzae Rd
aaucaauacuccaacccaga

SEQ ID NO: 726354 - RNA, 19 nt, Haemophilus influenzae Rd
aaucaauccccgcaucuuu

SEQ ID NO: 726355 - RNA, 15 nt, Haemophilus influenzae Rd
aaucacaaagcuuag

SEQ ID NO: 726356 - RNA, 16 nt, Haemophilus influenzae Rd
aaucacaaauccauaa

SEQ ID NO: 726357 - RNA, 11 nt, Haemophilus influenzae Rd
aaucaauuuuu

SEQ ID NO: 726358 - RNA, 14 nt, Haemophilus influenzae Rd
aaucaauuugauca

SEQ ID NO: 726359 - RNA, 17 nt, Haemophilus influenzae Rd
aaucaauguuuucagcu

SEQ ID NO: 726360 - RNA, 20 nt, Haemophilus influenzae Rd
aaucaaugucguuauucauc

SEQ ID NO: 726361 - RNA, 12 nt, Haemophilus influenzae Rd
aaucaauuaaag

SEQ ID NO: 726362 - RNA, 15 nt, Haemophilus influenzae Rd
aaucaauuaacuauu

SEQ ID NO: 726363 - RNA, 15 nt, Haemophilus influenzae Rd
aaucaagcauaaauc

SEQ ID NO: 726364 - RNA, 19 nt, Haemophilus influenzae Rd
aaucaagcauaaaucuuua

SEQ ID NO: 726365 - RNA, 18 nt, Haemophilus influenzae Rd
aaucaaggacuaggcucu

SEQ ID NO: 726366 - RNA, 17 nt, Haemophilus influenzae Rd
aaucaaguuaaaaaaug

SEQ ID NO: 726367 - RNA, 14 nt, Haemophilus influenzae Rd
aaucaaauaaaaua

SEQ ID NO: 726368 - RNA, 13 nt, Haemophilus influenzae Rd
aaucaaagauauu

SEQ ID NO: 726369 - RNA, 15 nt, Haemophilus influenzae Rd
aaucaaaaaaucuac

SEQ ID NO: 726370 - RNA, 17 nt, Haemophilus influenzae Rd
aaucaaaaccaaucauu

SEQ ID NO: 726371 - RNA, 17 nt, Haemophilus influenzae Rd
aaucaaaagaauuaaaa

SEQ ID NO: 726372 - RNA, 19 nt, Haemophilus influenzae Rd
aaucaaaagaauuaaaaau

SEQ ID NO: 726373 - RNA, 15 nt, Haemophilus influenzae Rd
aaucaaaaagcuacu

SEQ ID NO: 726374 - RNA, 13 nt, Haemophilus influenzae Rd
aaucaacacaccu

SEQ ID NO: 726375 - RNA, 13 nt, Haemophilus influenzae Rd
aaucaaauuuucc

SEQ ID NO: 726376 - RNA, 17 nt, Haemophilus influenzae Rd
aaucaaauuuuccuucu

SEQ ID NO: 726377 - RNA, 22 nt, Haemophilus influenzae Rd
aaucaaaugggaaagcguugaa

SEQ ID NO: 726378 - RNA, 14 nt, Haemophilus influenzae Rd
aaucaaauucaauu

SEQ ID NO: 726379 - RNA, 17 nt, Haemophilus influenzae Rd
aaucaaauucucuguuu

SEQ ID NO: 726380 - RNA, 19 nt, Haemophilus influenzae Rd
aaucaaauugaucaagcca

SEQ ID NO: 726381 - RNA, 17 nt, Haemophilus influenzae Rd
aauagauaaaauaaaac

SEQ ID NO: 726382 - RNA, 19 nt, Haemophilus influenzae Rd
aauagccauauuaucugcu

SEQ ID NO: 726383 - RNA, 22 nt, Haemophilus influenzae Rd
aauagccaaaacgaauagaaau

SEQ ID NO: 726384 - RNA, 14 nt, Haemophilus influenzae Rd
aauaugauuaauca

SEQ ID NO: 726385 - RNA, 14 nt, Haemophilus influenzae Rd
aauaugauuuagaa

SEQ ID NO: 726386 - RNA, 18 nt, Haemophilus influenzae Rd
aauaugccaaauaaaauu

SEQ ID NO: 726387 - RNA, 17 nt, Haemophilus influenzae Rd
aauaugccuguggaaac

SEQ ID NO: 726388 - RNA, 18 nt, Haemophilus influenzae Rd
aauaugccuuauauuuca

SEQ ID NO: 726389 - RNA, 20 nt, Haemophilus influenzae Rd
aauauggguucaauauaacu

SEQ ID NO: 726390 - RNA, 23 nt, Haemophilus influenzae Rd
aauauguuuaccaccgauaaaca

SEQ ID NO: 726391 - RNA, 12 nt, Haemophilus influenzae Rd
aauauguucuuu

SEQ ID NO: 726392 - RNA, 14 nt, Haemophilus influenzae Rd
aauauguucuuugu

SEQ ID NO: 726393 - RNA, 15 nt, Haemophilus influenzae Rd
aauauguucuuuguu

SEQ ID NO: 726394 - RNA, 18 nt, Haemophilus influenzae Rd
aauauguucaacaaguaa

SEQ ID NO: 726395 - RNA, 13 nt, Haemophilus influenzae Rd
aauauuaaagaaa

SEQ ID NO: 726396 - RNA, 19 nt, Haemophilus influenzae Rd
aauauuaucgaauagauuu

SEQ ID NO: 726397 - RNA, 22 nt, Haemophilus influenzae Rd
aauauuauuaaguaauacauuu

SEQ ID NO: 726398 - RNA, 19 nt, Haemophilus influenzae Rd
aauauuaucuccaagaaua

SEQ ID NO: 726399 - RNA, 19 nt, Haemophilus influenzae Rd
aauauuaucuucaugauuu

SEQ ID NO: 726400 - RNA, 18 nt, Haemophilus influenzae Rd
aauauuaguuagcuaaaa

SEQ ID NO: 726401 - RNA, 20 nt, Haemophilus influenzae Rd
aauauuaguuagcuaaaaaa

SEQ ID NO: 726402 - RNA, 23 nt, Haemophilus influenzae Rd
aauauuaguuagcuaaaaaaacu

SEQ ID NO: 726403 - RNA, 12 nt, Haemophilus influenzae Rd
aauauuaggaau

SEQ ID NO: 726404 - RNA, 19 nt, Haemophilus influenzae Rd
aauauuaggaauagcaaga

SEQ ID NO: 726405 - RNA, 13 nt, Haemophilus influenzae Rd
aauauuucuuuuu

SEQ ID NO: 726406 - RNA, 18 nt, Haemophilus influenzae Rd
aauauuugacgaaauaaa

SEQ ID NO: 726407 - RNA, 18 nt, Haemophilus influenzae Rd
aauauuucuucauuuuaa

SEQ ID NO: 726408 - RNA, 20 nt, Haemophilus influenzae Rd
aauauuucuucauuuuaaau

SEQ ID NO: 726409 - RNA, 22 nt, Haemophilus influenzae Rd
aauauuucuucauuuuaaauua

SEQ ID NO: 726410 - RNA, 22 nt, Haemophilus influenzae Rd
aauauuuauuucuauagauuua

SEQ ID NO: 726411 - RNA, 22 nt, Haemophilus influenzae Rd
  misc_feature (7)..(7): n is a, c, g or u
  misc_feature (11)..(11): n is a, c, g or u
aauauunugancgguuaugcaa

SEQ ID NO: 726412 - RNA, 14 nt, Haemophilus influenzae Rd
aauauuuaaauaca

SEQ ID NO: 726413 - RNA, 20 nt, Haemophilus influenzae Rd
aauauuuagauuacuuuuag

SEQ ID NO: 726414 - RNA, 14 nt, Haemophilus influenzae Rd
aauauuuauaaugu

SEQ ID NO: 726415 - RNA, 15 nt, Haemophilus influenzae Rd
aauauuuuugccaau

SEQ ID NO: 726416 - RNA, 11 nt, Haemophilus influenzae Rd
aauauuuuuca

SEQ ID NO: 726417 - RNA, 12 nt, Haemophilus influenzae Rd
aauauuuucccc

SEQ ID NO: 726418 - RNA, 19 nt, Haemophilus influenzae Rd
aauauuuuccccuuguucu

SEQ ID NO: 726419 - RNA, 19 nt, Haemophilus influenzae Rd
aauauuuuguugaagaaag

SEQ ID NO: 726420 - RNA, 18 nt, Haemophilus influenzae Rd
aauauuuuaauagaauuu

SEQ ID NO: 726421 - RNA, 23 nt, Haemophilus influenzae Rd
aauauuuuaaugaaaguaacaau

SEQ ID NO: 726422 - RNA, 14 nt, Haemophilus influenzae Rd
aauauuugggaaau

SEQ ID NO: 726423 - RNA, 22 nt, Haemophilus influenzae Rd
aauauuuguugccauuguuaaa

SEQ ID NO: 726424 - RNA, 15 nt, Haemophilus influenzae Rd
aauauugcaccauaa

SEQ ID NO: 726425 - RNA, 17 nt, Haemophilus influenzae Rd
aauauugauuacccauu

SEQ ID NO: 726426 - RNA, 17 nt, Haemophilus influenzae Rd
aauauugguuauuuaaa

SEQ ID NO: 726427 - RNA, 18 nt, Haemophilus influenzae Rd
aauauugucuauuugcuu

SEQ ID NO: 726428 - RNA, 19 nt, Haemophilus influenzae Rd
aauauugucuauuugcuuu

SEQ ID NO: 726429 - RNA, 20 nt, Haemophilus influenzae Rd
aauauugaguauuccccgcu

SEQ ID NO: 726430 - RNA, 14 nt, Haemophilus influenzae Rd
aauauugaaaagua

SEQ ID NO: 726431 - RNA, 17 nt, Haemophilus influenzae Rd
aauauucuuuacgauuu

SEQ ID NO: 726432 - RNA, 15 nt, Haemophilus influenzae Rd
aauauucuuuuuaaa

SEQ ID NO: 726433 - RNA, 21 nt, Haemophilus influenzae Rd
aauauucuuuuuaaauauuua

SEQ ID NO: 726434 - RNA, 14 nt, Haemophilus influenzae Rd
aauauuccauuaac

SEQ ID NO: 726435 - RNA, 17 nt, Haemophilus influenzae Rd
aauauucagucgguuua

SEQ ID NO: 726436 - RNA, 19 nt, Haemophilus influenzae Rd
aauauucaccccuucuguu

SEQ ID NO: 726437 - RNA, 16 nt, Haemophilus influenzae Rd
aauauucugaggauuu

SEQ ID NO: 726438 - RNA, 15 nt, Haemophilus influenzae Rd
aauauucuauuuaua

SEQ ID NO: 726439 - RNA, 13 nt, Haemophilus influenzae Rd
aauauucaaaaca

SEQ ID NO: 726440 - RNA, 14 nt, Haemophilus influenzae Rd
aauauucaaaacau

SEQ ID NO: 726441 - RNA, 13 nt, Haemophilus influenzae Rd
aaucgcacucaca

SEQ ID NO: 726442 - RNA, 12 nt, Haemophilus influenzae Rd
aaucgcaauaaa

SEQ ID NO: 726443 - RNA, 18 nt, Haemophilus influenzae Rd
aaucgcaaagaauuugcc

SEQ ID NO: 726444 - RNA, 19 nt, Haemophilus influenzae Rd
aaucgcaucgucuuuaccu

SEQ ID NO: 726445 - RNA, 19 nt, Haemophilus influenzae Rd
aaucgccaaaaucaucaca

SEQ ID NO: 726446 - RNA, 13 nt, Haemophilus influenzae Rd
aaaaauucuuugc

SEQ ID NO: 726447 - RNA, 17 nt, Haemophilus influenzae Rd
aaaaauugaucuaaauu

SEQ ID NO: 726448 - RNA, 14 nt, Haemophilus influenzae Rd
aaucgucaaaauca

SEQ ID NO: 726449 - RNA, 19 nt, Haemophilus influenzae Rd
aaaaauuguugauuccucu

SEQ ID NO: 726450 - RNA, 13 nt, Haemophilus influenzae Rd
aaaaauuuaaaag

SEQ ID NO: 726451 - RNA, 15 nt, Haemophilus influenzae Rd
aaaaauuuaaauaua

SEQ ID NO: 726452 - RNA, 17 nt, Haemophilus influenzae Rd
aaaaauuuaaauauaau

SEQ ID NO: 726453 - RNA, 21 nt, Haemophilus influenzae Rd
aaaaauuuaaauauaauuuag

SEQ ID NO: 726454 - RNA, 21 nt, Haemophilus influenzae Rd
aaaaauuuaaaagcaccuaaa

SEQ ID NO: 726455 - RNA, 19 nt, Haemophilus influenzae Rd
aaaaauuggaaaauaaaau

SEQ ID NO: 726456 - RNA, 21 nt, Haemophilus influenzae Rd
aaucucacguacuuuuaacac

SEQ ID NO: 726457 - RNA, 21 nt, Haemophilus influenzae Rd
aaucuauuucuuugaguaaaa

SEQ ID NO: 726458 - RNA, 14 nt, Haemophilus influenzae Rd
aaucucuggagaaa

SEQ ID NO: 726459 - RNA, 15 nt, Haemophilus influenzae Rd
aaucucuggagaaaa

SEQ ID NO: 726460 - RNA, 15 nt, Haemophilus influenzae Rd
aaucuaccgcaucua

SEQ ID NO: 726461 - RNA, 14 nt, Haemophilus influenzae Rd
aaucuacaaaacau

SEQ ID NO: 726462 - RNA, 20 nt, Haemophilus influenzae Rd
aaucuacagggcuuaguccu

SEQ ID NO: 726463 - RNA, 20 nt, Haemophilus influenzae Rd
aaucuacauuuuuagucucu

SEQ ID NO: 726464 - RNA, 18 nt, Haemophilus influenzae Rd
aaucuacguggauuuguu

SEQ ID NO: 726465 - RNA, 14 nt, Haemophilus influenzae Rd
aaucuacuaaaaua

SEQ ID NO: 726466 - RNA, 14 nt, Haemophilus influenzae Rd
aaucuacucguuua

SEQ ID NO: 726467 - RNA, 16 nt, Haemophilus influenzae Rd
aaucuacucguuuacu

SEQ ID NO: 726468 - RNA, 19 nt, Haemophilus influenzae Rd
aaucuacuuggacauuguu

SEQ ID NO: 726469 - RNA, 22 nt, Haemophilus influenzae Rd
aaucgugucaguaacuacaacu

SEQ ID NO: 726470 - RNA, 14 nt, Haemophilus influenzae Rd
aaucuaagccuugu

SEQ ID NO: 726471 - RNA, 17 nt, Haemophilus influenzae Rd
aaucuaagcgaccugaa

SEQ ID NO: 726472 - RNA, 23 nt, Haemophilus influenzae Rd
aaucuaagcgaccugaacgguca

SEQ ID NO: 726473 - RNA, 19 nt, Haemophilus influenzae Rd
aaucuaauucuuccgcauc

SEQ ID NO: 726474 - RNA, 17 nt, Haemophilus influenzae Rd
aaucuaauuuugccauc

SEQ ID NO: 726475 - RNA, 12 nt, Haemophilus influenzae Rd
aaucuucccauu

SEQ ID NO: 726476 - RNA, 16 nt, Haemophilus influenzae Rd
aaucuuaucaaacacu

SEQ ID NO: 726477 - RNA, 23 nt, Haemophilus influenzae Rd
aaucuuaugaaacagcuaaaaau

SEQ ID NO: 726478 - RNA, 16 nt, Haemophilus influenzae Rd
aaucuuauacaacaaa

SEQ ID NO: 726479 - RNA, 17 nt, Haemophilus influenzae Rd
aaucuuauacaacaaaa

SEQ ID NO: 726480 - RNA, 23 nt, Haemophilus influenzae Rd
aaucuucagcaguuuggcaaguc

SEQ ID NO: 726481 - RNA, 15 nt, Haemophilus influenzae Rd
aaucuuacgaagaau

SEQ ID NO: 726482 - RNA, 18 nt, Haemophilus influenzae Rd
aaucuuacgaagaaucca

SEQ ID NO: 726483 - RNA, 22 nt, Haemophilus influenzae Rd
aaucuuacgaagaauccacauu

SEQ ID NO: 726484 - RNA, 14 nt, Haemophilus influenzae Rd
aaucuuaacugcaa

SEQ ID NO: 726485 - RNA, 17 nt, Haemophilus influenzae Rd
aaucuuaacugcaaguc

SEQ ID NO: 726486 - RNA, 13 nt, Haemophilus influenzae Rd
aaucugugauaua

SEQ ID NO: 726487 - RNA, 15 nt, Haemophilus influenzae Rd
aaucugugauauaua

SEQ ID NO: 726488 - RNA, 20 nt, Haemophilus influenzae Rd
aaucugugauauauaucaca

SEQ ID NO: 726489 - RNA, 19 nt, Haemophilus influenzae Rd
aaucuguggcguauuuaga

SEQ ID NO: 726490 - RNA, 22 nt, Haemophilus influenzae Rd
aaucuggugcuuguuuuaaaau

SEQ ID NO: 726491 - RNA, 20 nt, Haemophilus influenzae Rd
aaucugcucuugaaauaguu

SEQ ID NO: 726492 - RNA, 22 nt, Haemophilus influenzae Rd
aaucucuuuacuguucaaauaa

SEQ ID NO: 726493 - RNA, 23 nt, Haemophilus influenzae Rd
aaucucuuuacuguucaaauaag

SEQ ID NO: 726494 - RNA, 12 nt, Haemophilus influenzae Rd
aaucugaaagug

SEQ ID NO: 726495 - RNA, 15 nt, Haemophilus influenzae Rd
aaucucuuucaauuu

SEQ ID NO: 726496 - RNA, 15 nt, Haemophilus influenzae Rd
aaucccuuagaaaau

SEQ ID NO: 726497 - RNA, 14 nt, Haemophilus influenzae Rd
aaucccuauaaugc

SEQ ID NO: 726498 - RNA, 23 nt, Haemophilus influenzae Rd
aauccgcacgcgugaugaaacaa

SEQ ID NO: 726499 - RNA, 15 nt, Haemophilus influenzae Rd
aauccgaaauuaaau

SEQ ID NO: 726500 - RNA, 17 nt, Haemophilus influenzae Rd
aauccguuaaauuuaga

SEQ ID NO: 726501 - RNA, 15 nt, Haemophilus influenzae Rd
aauccuuccaaaucc

SEQ ID NO: 726502 - RNA, 13 nt, Haemophilus influenzae Rd
aauccuuaauugg

SEQ ID NO: 726503 - RNA, 22 nt, Haemophilus influenzae Rd
aauccuugcgauguuauuuguu

SEQ ID NO: 726504 - RNA, 22 nt, Haemophilus influenzae Rd
aauccuucgccgccauuuggca

SEQ ID NO: 726505 - RNA, 14 nt, Haemophilus influenzae Rd
aauccucaaaaaca

SEQ ID NO: 726506 - RNA, 18 nt, Haemophilus influenzae Rd
aauccguuggucgaaggu

SEQ ID NO: 726507 - RNA, 13 nt, Haemophilus influenzae Rd
aauccuagaguaa

SEQ ID NO: 726508 - RNA, 20 nt, Haemophilus influenzae Rd
aaucgaucacuuaauaaaaa

SEQ ID NO: 726509 - RNA, 21 nt, Haemophilus influenzae Rd
aauccuuuacgggauuuuuuc

SEQ ID NO: 726510 - RNA, 14 nt, Haemophilus influenzae Rd
aaucgacucaggug

SEQ ID NO: 726511 - RNA, 20 nt, Haemophilus influenzae Rd
aaucccacuuguuggauauc

SEQ ID NO: 726512 - RNA, 13 nt, Haemophilus influenzae Rd
aauccauuuugaa

SEQ ID NO: 726513 - RNA, 13 nt, Haemophilus influenzae Rd
aauccauuuuuaa

SEQ ID NO: 726514 - RNA, 15 nt, Haemophilus influenzae Rd
aauccauuuuuaaau

SEQ ID NO: 726515 - RNA, 13 nt, Haemophilus influenzae Rd
aauccaugccaua

SEQ ID NO: 726516 - RNA, 19 nt, Haemophilus influenzae Rd
aauccagcccguucuuugc

SEQ ID NO: 726517 - RNA, 22 nt, Haemophilus influenzae Rd
aauccaucauuuuucgcaaaau

SEQ ID NO: 726518 - RNA, 14 nt, Haemophilus influenzae Rd
aaucauuuuuuaac

SEQ ID NO: 726519 - RNA, 19 nt, Haemophilus influenzae Rd
aaucauuuuuuaacuugau

SEQ ID NO: 726520 - RNA, 20 nt, Haemophilus influenzae Rd
aaucauuuuuuaacuugauu

SEQ ID NO: 726521 - RNA, 17 nt, Haemophilus influenzae Rd
aaucauuucaauguuug

SEQ ID NO: 726522 - RNA, 16 nt, Haemophilus influenzae Rd
aaucauuucaucuaca

SEQ ID NO: 726523 - RNA, 13 nt, Haemophilus influenzae Rd
aaucauuuucacc

SEQ ID NO: 726524 - RNA, 18 nt, Haemophilus influenzae Rd
aaucauuuucaccaauuu

SEQ ID NO: 726525 - RNA, 22 nt, Haemophilus influenzae Rd
aaucauuuucaccaauuuaucu

SEQ ID NO: 726526 - RNA, 23 nt, Haemophilus influenzae Rd
aauccaaaacgugucacuuuacu

SEQ ID NO: 726527 - RNA, 17 nt, Haemophilus influenzae Rd
aaucagcauauugaaau

SEQ ID NO: 726528 - RNA, 16 nt, Haemophilus influenzae Rd
aaucagaguuaaaagu

SEQ ID NO: 726529 - RNA, 14 nt, Haemophilus influenzae Rd
aaucagcaaaacuu

SEQ ID NO: 726530 - RNA, 20 nt, Haemophilus influenzae Rd
aaucagauuauguucauuuu

SEQ ID NO: 726531 - RNA, 19 nt, Haemophilus influenzae Rd
aaucaugaauaauuuuguu

SEQ ID NO: 726532 - RNA, 18 nt, Haemophilus influenzae Rd
aaaaagugcggaaaauuu

SEQ ID NO: 726533 - RNA, 19 nt, Haemophilus influenzae Rd
aaaaagugcgguaaaauca

SEQ ID NO: 726534 - RNA, 20 nt, Haemophilus influenzae Rd
aaaaagugcgguaaaaucac

SEQ ID NO: 726535 - RNA, 18 nt, Haemophilus influenzae Rd
aaaaagugcgguaaauuu

SEQ ID NO: 726536 - RNA, 22 nt, Haemophilus influenzae Rd
aaaaagugcgguaaauuuuaaa

SEQ ID NO: 726537 - RNA, 20 nt, Haemophilus influenzae Rd
aaaaagugcggucaauaaaa

SEQ ID NO: 726538 - RNA, 21 nt, Haemophilus influenzae Rd
aaaaagugcggucaauuucaa

SEQ ID NO: 726539 - RNA, 18 nt, Haemophilus influenzae Rd
aaaaaguaguaucagauu

SEQ ID NO: 726540 - RNA, 18 nt, Haemophilus influenzae Rd
aacaccaaauauucuucu

SEQ ID NO: 726541 - RNA, 15 nt, Haemophilus influenzae Rd
aaaaaggcuaaguuc

SEQ ID NO: 726542 - RNA, 22 nt, Haemophilus influenzae Rd
aaaaagggaugguuaauuuuuc

SEQ ID NO: 726543 - RNA, 18 nt, Haemophilus influenzae Rd
aacacagacuaaauucag

SEQ ID NO: 726544 - RNA, 19 nt, Haemophilus influenzae Rd
aacacaucagaaaaucaaa

SEQ ID NO: 726545 - RNA, 20 nt, Haemophilus influenzae Rd
aacacaccuauuuuuuccug

SEQ ID NO: 726546 - RNA, 13 nt, Haemophilus influenzae Rd
aacacaccaacaa

SEQ ID NO: 726547 - RNA, 14 nt, Haemophilus influenzae Rd
aacacaccaacaac

SEQ ID NO: 726548 - RNA, 18 nt, Haemophilus influenzae Rd
aacacaacauaauuaaag

SEQ ID NO: 726549 - RNA, 14 nt, Haemophilus influenzae Rd
aacacaauuaauaa

SEQ ID NO: 726550 - RNA, 12 nt, Haemophilus influenzae Rd
aacaauuuuugc

SEQ ID NO: 726551 - RNA, 17 nt, Haemophilus influenzae Rd
aaauucucuguuucuuu

SEQ ID NO: 726552 - RNA, 20 nt, Haemophilus influenzae Rd
aaauucucgccauaauaaaa

SEQ ID NO: 726553 - RNA, 13 nt, Haemophilus influenzae Rd
aaauucuuguucu

SEQ ID NO: 726554 - RNA, 17 nt, Haemophilus influenzae Rd
aaauucuuuuauuuuaa

SEQ ID NO: 726555 - RNA, 15 nt, Haemophilus influenzae Rd
aacaaguaaaucaac

SEQ ID NO: 726556 - RNA, 11 nt, Haemophilus influenzae Rd
aaauucugcuu

SEQ ID NO: 726557 - RNA, 17 nt, Haemophilus influenzae Rd
aacaaguuucuaaaauc

SEQ ID NO: 726558 - RNA, 23 nt, Haemophilus influenzae Rd
aacaaguuucuaaaaucacuuuu

SEQ ID NO: 726559 - RNA, 19 nt, Haemophilus influenzae Rd
aacaagugguggaauaaaa

SEQ ID NO: 726560 - RNA, 21 nt, Haemophilus influenzae Rd
aacaagugguggaauaaaagu

SEQ ID NO: 726561 - RNA, 21 nt, Haemophilus influenzae Rd
aacaauacucuuaacaaaaca

SEQ ID NO: 726562 - RNA, 22 nt, Haemophilus influenzae Rd
aacaauaaugugagaauaacca

SEQ ID NO: 726563 - RNA, 16 nt, Haemophilus influenzae Rd
aacaauauaucagaca

SEQ ID NO: 726564 - RNA, 21 nt, Haemophilus influenzae Rd
aacaauauauucggaaaaaau

SEQ ID NO: 726565 - RNA, 17 nt, Haemophilus influenzae Rd
aacaaucacugaaaaau

SEQ ID NO: 726566 - RNA, 18 nt, Haemophilus influenzae Rd
aacaaucccaggcuuaau

SEQ ID NO: 726567 - RNA, 21 nt, Haemophilus influenzae Rd
aacaaucgcuucauucucuuc

SEQ ID NO: 726568 - RNA, 16 nt, Haemophilus influenzae Rd
aacaaugcaaauacaa

SEQ ID NO: 726569 - RNA, 19 nt, Haemophilus influenzae Rd
aacaaugcggagaaaagca

SEQ ID NO: 726570 - RNA, 21 nt, Haemophilus influenzae Rd
aacaauuucacugaaaguaag

SEQ ID NO: 726571 - RNA, 17 nt, Haemophilus influenzae Rd
aacaauuucuuuaccuu

SEQ ID NO: 726572 - RNA, 17 nt, Haemophilus influenzae Rd
aacaauucauaaauaau

SEQ ID NO: 726573 - RNA, 13 nt, Haemophilus influenzae Rd
aacaauguagaaa

SEQ ID NO: 726574 - RNA, 14 nt, Haemophilus influenzae Rd
aacaaugcuauaaa

SEQ ID NO: 726575 - RNA, 16 nt, Haemophilus influenzae Rd
aacaaugcuauaaaac

SEQ ID NO: 726576 - RNA, 16 nt, Haemophilus influenzae Rd
aacacuugcagcccaa

SEQ ID NO: 726577 - RNA, 17 nt, Haemophilus influenzae Rd
aacacuugcagcccaac

SEQ ID NO: 726578 - RNA, 13 nt, Haemophilus influenzae Rd
aacacuguaaaua

SEQ ID NO: 726579 - RNA, 14 nt, Haemophilus influenzae Rd
aacacuguaaauaa

SEQ ID NO: 726580 - RNA, 13 nt, Haemophilus influenzae Rd
aacacucuaucua

SEQ ID NO: 726581 - RNA, 19 nt, Haemophilus influenzae Rd
aacacucuaucuaaaauau

SEQ ID NO: 726582 - RNA, 17 nt, Haemophilus influenzae Rd
aacacgcccuugugaaa

SEQ ID NO: 726583 - RNA, 21 nt, Haemophilus influenzae Rd
aacacgcccuugugaaaggga

SEQ ID NO: 726584 - RNA, 14 nt, Haemophilus influenzae Rd
aacacgguuccauu

SEQ ID NO: 726585 - RNA, 15 nt, Haemophilus influenzae Rd
aacacgaccauugaa

SEQ ID NO: 726586 - RNA, 20 nt, Haemophilus influenzae Rd
aacaccuuucggugcuuacu

SEQ ID NO: 726587 - RNA, 14 nt, Haemophilus influenzae Rd
aacacgaaaccaac

SEQ ID NO: 726588 - RNA, 20 nt, Haemophilus influenzae Rd
aacacgaaaccaacgaaaau

SEQ ID NO: 726589 - RNA, 18 nt, Haemophilus influenzae Rd
aacaccuccagcaaaagc

SEQ ID NO: 726590 - RNA, 19 nt, Haemophilus influenzae Rd
aacaccgcuaauaaaaauc

SEQ ID NO: 726591 - RNA, 17 nt, Haemophilus influenzae Rd
aacaccgcaaaaauacu

SEQ ID NO: 726592 - RNA, 22 nt, Haemophilus influenzae Rd
aacaccgagaugcauuuuuuaa

SEQ ID NO: 726593 - RNA, 13 nt, Haemophilus influenzae Rd
aacagcagacauu

SEQ ID NO: 726594 - RNA, 16 nt, Haemophilus influenzae Rd
aacagcaauaaauaau

SEQ ID NO: 726595 - RNA, 21 nt, Haemophilus influenzae Rd
aacagcaauaaauaauaggau

SEQ ID NO: 726596 - RNA, 23 nt, Haemophilus influenzae Rd
aacagauuuaauaccauacauaa

SEQ ID NO: 726597 - RNA, 15 nt, Haemophilus influenzae Rd
aacacuuuuucacga

SEQ ID NO: 726598 - RNA, 14 nt, Haemophilus influenzae Rd
aacacuuuuucuau

SEQ ID NO: 726599 - RNA, 14 nt, Haemophilus influenzae Rd
aacagaaauaacac

SEQ ID NO: 726600 - RNA, 18 nt, Haemophilus influenzae Rd
aacagaaaucauuucaau

SEQ ID NO: 726601 - RNA, 21 nt, Haemophilus influenzae Rd
aacagaucgugauauuucacu

SEQ ID NO: 726602 - RNA, 18 nt, Haemophilus influenzae Rd
aacagagcgucaaaauua

SEQ ID NO: 726603 - RNA, 13 nt, Haemophilus influenzae Rd
aacagagaaaaaa

SEQ ID NO: 726604 - RNA, 17 nt, Haemophilus influenzae Rd
aacagagaaaaaaauag

SEQ ID NO: 726605 - RNA, 18 nt, Haemophilus influenzae Rd
aacagagaaaaaaauagu

SEQ ID NO: 726606 - RNA, 18 nt, Haemophilus influenzae Rd
aacauuaccaagcccauu

SEQ ID NO: 726607 - RNA, 12 nt, Haemophilus influenzae Rd
aacauugucaua

SEQ ID NO: 726608 - RNA, 21 nt, Haemophilus influenzae Rd
aacauuggcaccuucucgacc

SEQ ID NO: 726609 - RNA, 15 nt, Haemophilus influenzae Rd
aaccaacgaaaauag

SEQ ID NO: 726610 - RNA, 16 nt, Haemophilus influenzae Rd
aaccaaucauaaaauu

SEQ ID NO: 726611 - RNA, 16 nt, Haemophilus influenzae Rd
aaccaauauaauuuac

SEQ ID NO: 726612 - RNA, 17 nt, Haemophilus influenzae Rd
aaccaauauaauuuacu

SEQ ID NO: 726613 - RNA, 13 nt, Haemophilus influenzae Rd
aaccaaguuggaa

SEQ ID NO: 726614 - RNA, 13 nt, Haemophilus influenzae Rd
aaccaauaagaua

SEQ ID NO: 726615 - RNA, 12 nt, Haemophilus influenzae Rd
aaccaauaauuu

SEQ ID NO: 726616 - RNA, 12 nt, Haemophilus influenzae Rd
aacaucaucacc

SEQ ID NO: 726617 - RNA, 15 nt, Haemophilus influenzae Rd
aacaucaaaaccauu

SEQ ID NO: 726618 - RNA, 15 nt, Haemophilus influenzae Rd
aacaucuugccauuu

SEQ ID NO: 726619 - RNA, 19 nt, Haemophilus influenzae Rd
aacauccgaauaaaugcau

SEQ ID NO: 726620 - RNA, 14 nt, Haemophilus influenzae Rd
aacauaauauuuuc

SEQ ID NO: 726621 - RNA, 23 nt, Haemophilus influenzae Rd
aacauaauauuuuccccuuguuc

SEQ ID NO: 726622 - RNA, 15 nt, Haemophilus influenzae Rd
aacauaaugcgaugu

SEQ ID NO: 726623 - RNA, 17 nt, Haemophilus influenzae Rd
aacauaaugauuucuaa

SEQ ID NO: 726624 - RNA, 18 nt, Haemophilus influenzae Rd
aacauaauuguguuggaa

SEQ ID NO: 726625 - RNA, 14 nt, Haemophilus influenzae Rd
aacauaauuuauau

SEQ ID NO: 726626 - RNA, 21 nt, Haemophilus influenzae Rd
aacauaccccuguugcgacag

SEQ ID NO: 726627 - RNA, 21 nt, Haemophilus influenzae Rd
aacauaucguuaucuuuaaag

SEQ ID NO: 726628 - RNA, 21 nt, Haemophilus influenzae Rd
aacauaugacagauagcauaa

SEQ ID NO: 726629 - RNA, 20 nt, Haemophilus influenzae Rd
aacccuacaggcuuccaaca

SEQ ID NO: 726630 - RNA, 16 nt, Haemophilus influenzae Rd
aacccuccgcauuaau

SEQ ID NO: 726631 - RNA, 15 nt, Haemophilus influenzae Rd
aaccgaaaaaauagu

SEQ ID NO: 726632 - RNA, 22 nt, Haemophilus influenzae Rd
aaccgaauauaugguucauuau

SEQ ID NO: 726633 - RNA, 14 nt, Haemophilus influenzae Rd
aaccgccuuugaua

SEQ ID NO: 726634 - RNA, 21 nt, Haemophilus influenzae Rd
aaccgccuaaaguuacacaau

SEQ ID NO: 726635 - RNA, 18 nt, Haemophilus influenzae Rd
aaccgauuaauuccagug

SEQ ID NO: 726636 - RNA, 17 nt, Haemophilus influenzae Rd
aaccgauagcuuuuguu

SEQ ID NO: 726637 - RNA, 14 nt, Haemophilus influenzae Rd
aaccgauuuuaaau

SEQ ID NO: 726638 - RNA, 17 nt, Haemophilus influenzae Rd
aaccgauuuuaaauucu

SEQ ID NO: 726639 - RNA, 15 nt, Haemophilus influenzae Rd
aaccgcacuuuaaau

SEQ ID NO: 726640 - RNA, 16 nt, Haemophilus influenzae Rd
aaccgcacuuuaaaua

SEQ ID NO: 726641 - RNA, 18 nt, Haemophilus influenzae Rd
aaccgcacuuuaaauauu

SEQ ID NO: 726642 - RNA, 20 nt, Haemophilus influenzae Rd
aaccgcacuuuaaauauuua

SEQ ID NO: 726643 - RNA, 15 nt, Haemophilus influenzae Rd
aaccgcacuuuuuaa

SEQ ID NO: 726644 - RNA, 21 nt, Haemophilus influenzae Rd
aaccgcagcuaauccaaauca

SEQ ID NO: 726645 - RNA, 14 nt, Haemophilus influenzae Rd
aacccaguuuuaaa

SEQ ID NO: 726646 - RNA, 15 nt, Haemophilus influenzae Rd
aacccguaauuaaaa

SEQ ID NO: 726647 - RNA, 14 nt, Haemophilus influenzae Rd
aaccauuguuuaau

SEQ ID NO: 726648 - RNA, 21 nt, Haemophilus influenzae Rd
aacccaaaaaagcguugaaaa

SEQ ID NO: 726649 - RNA, 21 nt, Haemophilus influenzae Rd
aaccacaagaugguaauuuug

SEQ ID NO: 726650 - RNA, 15 nt, Haemophilus influenzae Rd
aaccacaauaaaaua

SEQ ID NO: 726651 - RNA, 17 nt, Haemophilus influenzae Rd
aaccacaauaaaauaau

SEQ ID NO: 726652 - RNA, 17 nt, Haemophilus influenzae Rd
aaccacuagccauugca

SEQ ID NO: 726653 - RNA, 17 nt, Haemophilus influenzae Rd
aaccacuaucggugaag

SEQ ID NO: 726654 - RNA, 14 nt, Haemophilus influenzae Rd
aaccacuaaaaaca

SEQ ID NO: 726655 - RNA, 13 nt, Haemophilus influenzae Rd
aaccacuaaaaca

SEQ ID NO: 726656 - RNA, 18 nt, Haemophilus influenzae Rd
aaccaucccagucaaaaa

SEQ ID NO: 726657 - RNA, 19 nt, Haemophilus influenzae Rd
aaccaucucgaauucguuu

SEQ ID NO: 726658 - RNA, 16 nt, Haemophilus influenzae Rd
aaccaucauaggcuuu

SEQ ID NO: 726659 - RNA, 17 nt, Haemophilus influenzae Rd
aaccauaucguaaccau

SEQ ID NO: 726660 - RNA, 18 nt, Haemophilus influenzae Rd
aaccauaucguaaccauc

SEQ ID NO: 726661 - RNA, 21 nt, Haemophilus influenzae Rd
aaccauaucguaaccaucaga

SEQ ID NO: 726662 - RNA, 14 nt, Haemophilus influenzae Rd
aaccauaucugaaa

SEQ ID NO: 726663 - RNA, 23 nt, Haemophilus influenzae Rd
aaccauauuaaucgcaauaacac

SEQ ID NO: 726664 - RNA, 16 nt, Haemophilus influenzae Rd
aaccaucacaaaggaa

SEQ ID NO: 726665 - RNA, 15 nt, Haemophilus influenzae Rd
aaccauugaugaaau

SEQ ID NO: 726666 - RNA, 20 nt, Haemophilus influenzae Rd
aacgaugggcaauggcaauc

SEQ ID NO: 726667 - RNA, 14 nt, Haemophilus influenzae Rd
aacgaugaagaaaa

SEQ ID NO: 726668 - RNA, 16 nt, Haemophilus influenzae Rd
aacgaugaagaaaauu

SEQ ID NO: 726669 - RNA, 17 nt, Haemophilus influenzae Rd
aacgcaaacuacaacuu

SEQ ID NO: 726670 - RNA, 20 nt, Haemophilus influenzae Rd
aacgauuucgugcaauaaca

SEQ ID NO: 726671 - RNA, 20 nt, Haemophilus influenzae Rd
aacgauguugcaaccuucag

SEQ ID NO: 726672 - RNA, 12 nt, Haemophilus influenzae Rd
aaccgcuuuuau

SEQ ID NO: 726673 - RNA, 14 nt, Haemophilus influenzae Rd
aaccgcuuuuaugc

SEQ ID NO: 726674 - RNA, 15 nt, Haemophilus influenzae Rd
aaccgcuuuaucaaa

SEQ ID NO: 726675 - RNA, 22 nt, Haemophilus influenzae Rd
aacgcaagcugugcaagcauuu

SEQ ID NO: 726676 - RNA, 21 nt, Haemophilus influenzae Rd
aacgcaccacgaccuaagaaa

SEQ ID NO: 726677 - RNA, 18 nt, Haemophilus influenzae Rd
aacgccacgcuuugucag

SEQ ID NO: 726678 - RNA, 20 nt, Haemophilus influenzae Rd
aacgccagaaguuguuuuuc

SEQ ID NO: 726679 - RNA, 18 nt, Haemophilus influenzae Rd
aacgccauucguucccaa

SEQ ID NO: 726680 - RNA, 18 nt, Haemophilus influenzae Rd
aacgcccuucuuugauau

SEQ ID NO: 726681 - RNA, 20 nt, Haemophilus influenzae Rd
aacgcccuucuuugauauaa

SEQ ID NO: 726682 - RNA, 20 nt, Haemophilus influenzae Rd
aacgccgauaaguccaucac

SEQ ID NO: 726683 - RNA, 22 nt, Haemophilus influenzae Rd
aacgccgcaacuaauaaaccaa

SEQ ID NO: 726684 - RNA, 23 nt, Haemophilus influenzae Rd
aacgccgcaacuaauaaaccaau

SEQ ID NO: 726685 - RNA, 18 nt, Haemophilus influenzae Rd
aacgcccccgccauuuug

SEQ ID NO: 726686 - RNA, 20 nt, Haemophilus influenzae Rd
aacgguaacugauuuugcua

SEQ ID NO: 726687 - RNA, 11 nt, Haemophilus influenzae Rd
aacguaaaaac

SEQ ID NO: 726688 - RNA, 14 nt, Haemophilus influenzae Rd
aacguaaaaguaaa

SEQ ID NO: 726689 - RNA, 22 nt, Haemophilus influenzae Rd
aacguaaaaguaaauaagccau

SEQ ID NO: 726690 - RNA, 22 nt, Haemophilus influenzae Rd
aacggugugggugcugcaacug

SEQ ID NO: 726691 - RNA, 20 nt, Haemophilus influenzae Rd
aacgguucacguaaaaucau

SEQ ID NO: 726692 - RNA, 21 nt, Haemophilus influenzae Rd
aacgguucacguaaaaucauu

SEQ ID NO: 726693 - RNA, 13 nt, Haemophilus influenzae Rd
aacggucaaaaug

SEQ ID NO: 726694 - RNA, 23 nt, Haemophilus influenzae Rd
aacggucgaguuuuucaaaaauu

SEQ ID NO: 726695 - RNA, 15 nt, Haemophilus influenzae Rd
aacgcuugaauaaau

SEQ ID NO: 726696 - RNA, 18 nt, Haemophilus influenzae Rd
aacgcuuucucaauuuuu

SEQ ID NO: 726697 - RNA, 14 nt, Haemophilus influenzae Rd
aacgcuuaaugaac

SEQ ID NO: 726698 - RNA, 17 nt, Haemophilus influenzae Rd
aacgcuguuuugcuucc

SEQ ID NO: 726699 - RNA, 13 nt, Haemophilus influenzae Rd
aacgccguucaaa

SEQ ID NO: 726700 - RNA, 16 nt, Haemophilus influenzae Rd
aacgccguucaaaauc

SEQ ID NO: 726701 - RNA, 19 nt, Haemophilus influenzae Rd
aacuaaccgcacuuuggaa

SEQ ID NO: 726702 - RNA, 23 nt, Haemophilus influenzae Rd
aacuaaccacgcuggaauuuuca

SEQ ID NO: 726703 - RNA, 15 nt, Haemophilus influenzae Rd
aacuaagaugaucaa

SEQ ID NO: 726704 - RNA, 21 nt, Haemophilus influenzae Rd
aacuaaggugcagauuuuuua

SEQ ID NO: 726705 - RNA, 15 nt, Haemophilus influenzae Rd
aacuaauaaaccaau

SEQ ID NO: 726706 - RNA, 17 nt, Haemophilus influenzae Rd
aacuaauaaaccaauaa

SEQ ID NO: 726707 - RNA, 19 nt, Haemophilus influenzae Rd
aacuaauacuucauaguga

SEQ ID NO: 726708 - RNA, 17 nt, Haemophilus influenzae Rd
aacuaauagcgugaaaa

SEQ ID NO: 726709 - RNA, 11 nt, Haemophilus influenzae Rd
aacuaaaauaa

SEQ ID NO: 726710 - RNA, 13 nt, Haemophilus influenzae Rd
aacuaaaauaguu

SEQ ID NO: 726711 - RNA, 17 nt, Haemophilus influenzae Rd
aacuaaaaaaguuuaag

SEQ ID NO: 726712 - RNA, 14 nt, Haemophilus influenzae Rd
aacuaaaaaauagu

SEQ ID NO: 726713 - RNA, 15 nt, Haemophilus influenzae Rd
aacuaaaaaauaguu

SEQ ID NO: 726714 - RNA, 21 nt, Haemophilus influenzae Rd
aacuaaaaacaaauauauuuc

SEQ ID NO: 726715 - RNA, 14 nt, Haemophilus influenzae Rd
aacguuuuugaaua

SEQ ID NO: 726716 - RNA, 15 nt, Haemophilus influenzae Rd
aacguuuuuuacuug

SEQ ID NO: 726717 - RNA, 14 nt, Haemophilus influenzae Rd
aacuaaaccauuua

SEQ ID NO: 726718 - RNA, 23 nt, Haemophilus influenzae Rd
aacuaaacuguaaucuaaauauu

SEQ ID NO: 726719 - RNA, 15 nt, Haemophilus influenzae Rd
aacuaaacuuaccua

SEQ ID NO: 726720 - RNA, 21 nt, Haemophilus influenzae Rd
aacuaaacuuaccuaaaaauu

SEQ ID NO: 726721 - RNA, 20 nt, Haemophilus influenzae Rd
aacuaaagaaucaaauucac

SEQ ID NO: 726722 - RNA, 11 nt, Haemophilus influenzae Rd
aacuaaauauu

SEQ ID NO: 726723 - RNA, 14 nt, Haemophilus influenzae Rd
aacuaaauauucaa

SEQ ID NO: 726724 - RNA, 12 nt, Haemophilus influenzae Rd
aacuaaauucaa

SEQ ID NO: 726725 - RNA, 14 nt, Haemophilus influenzae Rd
aacuaaauucaauu

SEQ ID NO: 726726 - RNA, 21 nt, Haemophilus influenzae Rd
aacuacaacuuuuuauuuucu

SEQ ID NO: 726727 - RNA, 20 nt, Haemophilus influenzae Rd
aacuaauuucgcauaauaua

SEQ ID NO: 726728 - RNA, 17 nt, Haemophilus influenzae Rd
aacuaauuugacgauaa

SEQ ID NO: 726729 - RNA, 21 nt, Haemophilus influenzae Rd
aacuaauuugggugcagauuu

SEQ ID NO: 726730 - RNA, 14 nt, Haemophilus influenzae Rd
aacuacauaaacuu

SEQ ID NO: 726731 - RNA, 18 nt, Haemophilus influenzae Rd
aacuacccaaauuuauaa

SEQ ID NO: 726732 - RNA, 23 nt, Haemophilus influenzae Rd
aacuaccgcacuuagauuugaac

SEQ ID NO: 726733 - RNA, 18 nt, Haemophilus influenzae Rd
aacuacggacuaaauaaa

SEQ ID NO: 726734 - RNA, 16 nt, Haemophilus influenzae Rd
aacuagaccaaacucc

SEQ ID NO: 726735 - RNA, 12 nt, Haemophilus influenzae Rd
aacuagcaaucu

SEQ ID NO: 726736 - RNA, 22 nt, Haemophilus influenzae Rd
aacuaggcaucaaaauucaaaa

SEQ ID NO: 726737 - RNA, 13 nt, Haemophilus influenzae Rd
aacguaagcacca

SEQ ID NO: 726738 - RNA, 17 nt, Haemophilus influenzae Rd
aacguaaucaaauccac

SEQ ID NO: 726739 - RNA, 19 nt, Haemophilus influenzae Rd
aacguaacuaaaaaaguuu

SEQ ID NO: 726740 - RNA, 15 nt, Haemophilus influenzae Rd
aacguauuuucucau

SEQ ID NO: 726741 - RNA, 12 nt, Haemophilus influenzae Rd
aacgugaaguaa

SEQ ID NO: 726742 - RNA, 17 nt, Haemophilus influenzae Rd
aacguuggguuugauuu

SEQ ID NO: 726743 - RNA, 23 nt, Haemophilus influenzae Rd
aacguucauauuguuucaacaua

SEQ ID NO: 726744 - RNA, 16 nt, Haemophilus influenzae Rd
aacguuauaaacaaca

SEQ ID NO: 726745 - RNA, 18 nt, Haemophilus influenzae Rd
aacguuuauauugaacaa

SEQ ID NO: 726746 - RNA, 21 nt, Haemophilus influenzae Rd
aacguuucaucacuucaaaaa

SEQ ID NO: 726747 - RNA, 21 nt, Haemophilus influenzae Rd
aacguuuauggcuuucaauuu

SEQ ID NO: 726748 - RNA, 19 nt, Haemophilus influenzae Rd
aacguuuauuuauuccauc

SEQ ID NO: 726749 - RNA, 22 nt, Haemophilus influenzae Rd
aacugcacucgcucuaacaaua

SEQ ID NO: 726750 - RNA, 12 nt, Haemophilus influenzae Rd
aacugcuuuaau

SEQ ID NO: 726751 - RNA, 12 nt, Haemophilus influenzae Rd
aacugaagcuuc

SEQ ID NO: 726752 - RNA, 18 nt, Haemophilus influenzae Rd
aacugaaaauucaucauu

SEQ ID NO: 726753 - RNA, 15 nt, Haemophilus influenzae Rd
aacugaugauggcca

SEQ ID NO: 726754 - RNA, 14 nt, Haemophilus influenzae Rd
aacugcaacaauuu

SEQ ID NO: 726755 - RNA, 15 nt, Haemophilus influenzae Rd
aacugauuuugaguu

SEQ ID NO: 726756 - RNA, 13 nt, Haemophilus influenzae Rd
aacugauuuugau

SEQ ID NO: 726757 - RNA, 23 nt, Haemophilus influenzae Rd
aacugauuuugauuuagccagua

SEQ ID NO: 726758 - RNA, 11 nt, Haemophilus influenzae Rd
aacucaaaaua

SEQ ID NO: 726759 - RNA, 23 nt, Haemophilus influenzae Rd
aacucuuggcuaacuucuuccac

SEQ ID NO: 726760 - RNA, 19 nt, Haemophilus influenzae Rd
aacucuugucauugccauu

SEQ ID NO: 726761 - RNA, 11 nt, Haemophilus influenzae Rd
aacuauuuuua

SEQ ID NO: 726762 - RNA, 18 nt, Haemophilus influenzae Rd
aacuauuuuuaauuuuga

SEQ ID NO: 726763 - RNA, 22 nt, Haemophilus influenzae Rd
aacuauuuaaguguuuacuauu

SEQ ID NO: 726764 - RNA, 20 nt, Haemophilus influenzae Rd
aacuuaaauuuuuauaaagu

SEQ ID NO: 726765 - RNA, 15 nt, Haemophilus influenzae Rd
aacuuagucucuuua

SEQ ID NO: 726766 - RNA, 14 nt, Haemophilus influenzae Rd
aacuuagaaaauau

SEQ ID NO: 726767 - RNA, 15 nt, Haemophilus influenzae Rd
aacuuagaaaauauc

SEQ ID NO: 726768 - RNA, 15 nt, Haemophilus influenzae Rd
aacuuagauuuucuu

SEQ ID NO: 726769 - RNA, 22 nt, Haemophilus influenzae Rd
aacuuagauuuucuuauuauac

SEQ ID NO: 726770 - RNA, 23 nt, Haemophilus influenzae Rd
aacuuacuacguguucaucaucg

SEQ ID NO: 726771 - RNA, 21 nt, Haemophilus influenzae Rd
aacuggcuguguaaaacauug

SEQ ID NO: 726772 - RNA, 23 nt, Haemophilus influenzae Rd
aacuggcuuaaaugaucuaaugg

SEQ ID NO: 726773 - RNA, 22 nt, Haemophilus influenzae Rd
aacuugaauggcuaaagaaaua

SEQ ID NO: 726774 - RNA, 22 nt, Haemophilus influenzae Rd
aacuugacguuguucuucuguu

SEQ ID NO: 726775 - RNA, 19 nt, Haemophilus influenzae Rd
aacuucaccagugaauuuc

SEQ ID NO: 726776 - RNA, 22 nt, Haemophilus influenzae Rd
aacuucuucauucccaucuuua

SEQ ID NO: 726777 - RNA, 15 nt, Haemophilus influenzae Rd
aacuuaucuaaaaag

SEQ ID NO: 726778 - RNA, 19 nt, Haemophilus influenzae Rd
aacuuaucuaaaaagauuu

SEQ ID NO: 726779 - RNA, 17 nt, Haemophilus influenzae Rd
aacuuaucauuaaucuu

SEQ ID NO: 726780 - RNA, 20 nt, Haemophilus influenzae Rd
aacuuaucauuaaucuuaua

SEQ ID NO: 726781 - RNA, 22 nt, Haemophilus influenzae Rd
aacuuaucauuaaucuuauaca

SEQ ID NO: 726782 - RNA, 16 nt, Haemophilus influenzae Rd
aacuuaugaauaauaa

SEQ ID NO: 726783 - RNA, 13 nt, Haemophilus influenzae Rd
aacuuauuuggaa

SEQ ID NO: 726784 - RNA, 15 nt, Haemophilus influenzae Rd
aacuuauuuggaaca

SEQ ID NO: 726785 - RNA, 17 nt, Haemophilus influenzae Rd
aacuuauuuggaacagu

SEQ ID NO: 726786 - RNA, 22 nt, Haemophilus influenzae Rd
aacuucaauuuuuuaucaaaua

SEQ ID NO: 726787 - RNA, 17 nt, Haemophilus influenzae Rd
aacuucaaccacuucaa

SEQ ID NO: 726788 - RNA, 15 nt, Haemophilus influenzae Rd
aacuugccagcagaa

SEQ ID NO: 726789 - RNA, 16 nt, Haemophilus influenzae Rd
aacuugcuauuuucua

SEQ ID NO: 726790 - RNA, 12 nt, Haemophilus influenzae Rd
aacuugcucugg

SEQ ID NO: 726791 - RNA, 22 nt, Haemophilus influenzae Rd
aagaaaaacgccucaucuuuuu

SEQ ID NO: 726792 - RNA, 12 nt, Haemophilus influenzae Rd
aagaaaaccaaa

SEQ ID NO: 726793 - RNA, 14 nt, Haemophilus influenzae Rd
aagaaaagcauuaa

SEQ ID NO: 726794 - RNA, 18 nt, Haemophilus influenzae Rd
aagaaaacuuauaaagau

SEQ ID NO: 726795 - RNA, 14 nt, Haemophilus influenzae Rd
aagaaacguaaaca

SEQ ID NO: 726796 - RNA, 16 nt, Haemophilus influenzae Rd
aagaaacguaaacaaa

SEQ ID NO: 726797 - RNA, 21 nt, Haemophilus influenzae Rd
aagaaacguaaacaaaauacc

SEQ ID NO: 726798 - RNA, 17 nt, Haemophilus influenzae Rd
aagaaagaaauauaaua

SEQ ID NO: 726799 - RNA, 20 nt, Haemophilus influenzae Rd
aagaaccacagccaagguuu

SEQ ID NO: 726800 - RNA, 11 nt, Haemophilus influenzae Rd
aagaacagaaa

SEQ ID NO: 726801 - RNA, 12 nt, Haemophilus influenzae Rd
aagaacaagggg

SEQ ID NO: 726802 - RNA, 19 nt, Haemophilus influenzae Rd
aagaacaaggggaaaauau

SEQ ID NO: 726803 - RNA, 22 nt, Haemophilus influenzae Rd
aagaacaaggggaaaauauuau

SEQ ID NO: 726804 - RNA, 15 nt, Haemophilus influenzae Rd
aagaaagcaugaaua

SEQ ID NO: 726805 - RNA, 18 nt, Haemophilus influenzae Rd
aagaaagcgacauuuugu

SEQ ID NO: 726806 - RNA, 13 nt, Haemophilus influenzae Rd
aagaaauggcuug

SEQ ID NO: 726807 - RNA, 13 nt, Haemophilus influenzae Rd
aagaaauuuuaau

SEQ ID NO: 726808 - RNA, 19 nt, Haemophilus influenzae Rd
aagaaauuuuauccaucaa

SEQ ID NO: 726809 - RNA, 13 nt, Haemophilus influenzae Rd
aagaaauuuucuu

SEQ ID NO: 726810 - RNA, 17 nt, Haemophilus influenzae Rd
aagaaauuaagaaauuu

SEQ ID NO: 726811 - RNA, 18 nt, Haemophilus influenzae Rd
aagaacguaaauuauguu

SEQ ID NO: 726812 - RNA, 16 nt, Haemophilus influenzae Rd
aagaagaaaguuaaaa

SEQ ID NO: 726813 - RNA, 18 nt, Haemophilus influenzae Rd
aagaagaaugcggugaaa

SEQ ID NO: 726814 - RNA, 12 nt, Haemophilus influenzae Rd
aagaauccacau

SEQ ID NO: 726815 - RNA, 23 nt, Haemophilus influenzae Rd
aagaaucccauagcggauaacca

SEQ ID NO: 726816 - RNA, 15 nt, Haemophilus influenzae Rd
aagaauauuccaaag

SEQ ID NO: 726817 - RNA, 16 nt, Haemophilus influenzae Rd
aagaauauucuuuucu

SEQ ID NO: 726818 - RNA, 20 nt, Haemophilus influenzae Rd
aagaauauucuuuucuccac

SEQ ID NO: 726819 - RNA, 11 nt, Haemophilus influenzae Rd
aagaauauauu

SEQ ID NO: 726820 - RNA, 16 nt, Haemophilus influenzae Rd
aagaauauaaauaaaa

SEQ ID NO: 726821 - RNA, 17 nt, Haemophilus influenzae Rd
aagaauacaccccaaaa

SEQ ID NO: 726822 - RNA, 12 nt, Haemophilus influenzae Rd
aagaauaaaaug

SEQ ID NO: 726823 - RNA, 21 nt, Haemophilus influenzae Rd
aagaaguuuuccagauuuuac

SEQ ID NO: 726824 - RNA, 23 nt, Haemophilus influenzae Rd
aagaagggaugauugacgaaaaa

SEQ ID NO: 726825 - RNA, 16 nt, Haemophilus influenzae Rd
aauaaaacaaauguaa

SEQ ID NO: 726826 - RNA, 14 nt, Haemophilus influenzae Rd
aauaaaaauuaaaa

SEQ ID NO: 726827 - RNA, 13 nt, Haemophilus influenzae Rd
aauaaaaauaaug

SEQ ID NO: 726828 - RNA, 15 nt, Haemophilus influenzae Rd
aauaaaaaauaaauu

SEQ ID NO: 726829 - RNA, 16 nt, Haemophilus influenzae Rd
aauaaaaaauaaauua

SEQ ID NO: 726830 - RNA, 18 nt, Haemophilus influenzae Rd
aauaaaaaauccacacuu

SEQ ID NO: 726831 - RNA, 18 nt, Haemophilus influenzae Rd
aauaaaaacauugccaaa

SEQ ID NO: 726832 - RNA, 21 nt, Haemophilus influenzae Rd
aauaaaaacauugccaaagca

SEQ ID NO: 726833 - RNA, 15 nt, Haemophilus influenzae Rd
aauaaaaacgcccuu

SEQ ID NO: 726834 - RNA, 15 nt, Haemophilus influenzae Rd
aaguuuuccagauuu

SEQ ID NO: 726835 - RNA, 16 nt, Haemophilus influenzae Rd
aaguuuguuugcugca

SEQ ID NO: 726836 - RNA, 22 nt, Haemophilus influenzae Rd
aaguuugagcaaaucaaaaccu

SEQ ID NO: 726837 - RNA, 15 nt, Haemophilus influenzae Rd
aaguuuucguaaauu

SEQ ID NO: 726838 - RNA, 13 nt, Haemophilus influenzae Rd
aauaaaauuuuua

SEQ ID NO: 726839 - RNA, 13 nt, Haemophilus influenzae Rd
aauaaacacaaac

SEQ ID NO: 726840 - RNA, 14 nt, Haemophilus influenzae Rd
aauaaaauuacaaa

SEQ ID NO: 726841 - RNA, 18 nt, Haemophilus influenzae Rd
aauaaaauuuauuacaaa

SEQ ID NO: 726842 - RNA, 22 nt, Haemophilus influenzae Rd
aauaaaaccauccgaaauuaau

SEQ ID NO: 726843 - RNA, 23 nt, Haemophilus influenzae Rd
aauaaaaccauccgaaauuaauu

SEQ ID NO: 726844 - RNA, 18 nt, Haemophilus influenzae Rd
aauaaaacccaguuuaaa

SEQ ID NO: 726845 - RNA, 22 nt, Haemophilus influenzae Rd
aauaaaagagagcuucucuuuu

SEQ ID NO: 726846 - RNA, 23 nt, Haemophilus influenzae Rd
aauaaaacgggaucuauuugauu

SEQ ID NO: 726847 - RNA, 22 nt, Haemophilus influenzae Rd
aauaaaauagacaauauugaaa

SEQ ID NO: 726848 - RNA, 16 nt, Haemophilus influenzae Rd
aauaaaauagcuaaca

SEQ ID NO: 726849 - RNA, 22 nt, Haemophilus influenzae Rd
aauaaaauauaugggaaacaau

SEQ ID NO: 726850 - RNA, 13 nt, Haemophilus influenzae Rd
aauaaaagucagu

SEQ ID NO: 726851 - RNA, 22 nt, Haemophilus influenzae Rd
aauaaaagugcgguauuuuuua

SEQ ID NO: 726852 - RNA, 18 nt, Haemophilus influenzae Rd
aauaaaauaacaaaaaag

SEQ ID NO: 726853 - RNA, 17 nt, Haemophilus influenzae Rd
aauaaacgucauaguau

SEQ ID NO: 726854 - RNA, 16 nt, Haemophilus influenzae Rd
aauaaaccgcaucaaa

SEQ ID NO: 726855 - RNA, 17 nt, Haemophilus influenzae Rd
aauaaaccgcaucaaaa

SEQ ID NO: 726856 - RNA, 13 nt, Haemophilus influenzae Rd
aauaaaccaacau

SEQ ID NO: 726857 - RNA, 21 nt, Haemophilus influenzae Rd
aauaaaccaacauacauuaau

SEQ ID NO: 726858 - RNA, 17 nt, Haemophilus influenzae Rd
aauaaaccaauaagaua

SEQ ID NO: 726859 - RNA, 21 nt, Haemophilus influenzae Rd
aauaaaccaauaagauagaaa

SEQ ID NO: 726860 - RNA, 13 nt, Haemophilus influenzae Rd
aauaaacauuuuu

SEQ ID NO: 726861 - RNA, 11 nt, Haemophilus influenzae Rd
aauaaagaaac

SEQ ID NO: 726862 - RNA, 12 nt, Haemophilus influenzae Rd
aauaaagaaacg

SEQ ID NO: 726863 - RNA, 14 nt, Haemophilus influenzae Rd
aauaaagaagaaaa

SEQ ID NO: 726864 - RNA, 20 nt, Haemophilus influenzae Rd
aauaaagagcggucaauuuu

SEQ ID NO: 726865 - RNA, 18 nt, Haemophilus influenzae Rd
aauaaagauagguacaag

SEQ ID NO: 726866 - RNA, 18 nt, Haemophilus influenzae Rd
aauaaagggcgguuaaaa

SEQ ID NO: 726867 - RNA, 14 nt, Haemophilus influenzae Rd
aauaaaggauuaaa

SEQ ID NO: 726868 - RNA, 21 nt, Haemophilus influenzae Rd
aauaaagcugaccgcacuuuu

SEQ ID NO: 726869 - RNA, 20 nt, Haemophilus influenzae Rd
aauaaaguugagaauuuuuu

SEQ ID NO: 726870 - RNA, 14 nt, Haemophilus influenzae Rd
aauaaauaaaauau

SEQ ID NO: 726871 - RNA, 11 nt, Haemophilus influenzae Rd
aauaaauaaca

SEQ ID NO: 726872 - RNA, 12 nt, Haemophilus influenzae Rd
aauaaauaacau

SEQ ID NO: 726873 - RNA, 15 nt, Haemophilus influenzae Rd
aauaaauaaggcaca

SEQ ID NO: 726874 - RNA, 14 nt, Haemophilus influenzae Rd
aauaaauagaaauu

SEQ ID NO: 726875 - RNA, 17 nt, Haemophilus influenzae Rd
aauaaccguacauucuu

SEQ ID NO: 726876 - RNA, 21 nt, Haemophilus influenzae Rd
aauaacauagaaaucacuaaa

SEQ ID NO: 726877 - RNA, 20 nt, Haemophilus influenzae Rd
aauaacaacuggaauuugua

SEQ ID NO: 726878 - RNA, 20 nt, Haemophilus influenzae Rd
aauaaauuuuauuauguuuu

SEQ ID NO: 726879 - RNA, 19 nt, Haemophilus influenzae Rd
aauaacaagcgaaaaacgu

SEQ ID NO: 726880 - RNA, 14 nt, Haemophilus influenzae Rd
aauaacaaaaacaa

SEQ ID NO: 726881 - RNA, 16 nt, Haemophilus influenzae Rd
aauaaauucaaaaaau

SEQ ID NO: 726882 - RNA, 17 nt, Haemophilus influenzae Rd
aauaaauucaaaaaaug

SEQ ID NO: 726883 - RNA, 15 nt, Haemophilus influenzae Rd
aauaaauucaccacu

SEQ ID NO: 726884 - RNA, 13 nt, Haemophilus influenzae Rd
aauaaauuaaaaa

SEQ ID NO: 726885 - RNA, 16 nt, Haemophilus influenzae Rd
aauaaauuaaaaaaau

SEQ ID NO: 726886 - RNA, 18 nt, Haemophilus influenzae Rd
aauaaauucguacaaaug

SEQ ID NO: 726887 - RNA, 19 nt, Haemophilus influenzae Rd
aauaaauuggggaaguaau

SEQ ID NO: 726888 - RNA, 20 nt, Haemophilus influenzae Rd
aauaaauuuaaauuauuaaa

SEQ ID NO: 726889 - RNA, 16 nt, Haemophilus influenzae Rd
aagugguggaauaaaa

SEQ ID NO: 726890 - RNA, 21 nt, Haemophilus influenzae Rd
aagugguggaauaaaagucag

SEQ ID NO: 726891 - RNA, 13 nt, Haemophilus influenzae Rd
aaguguauaaaua

SEQ ID NO: 726892 - RNA, 20 nt, Haemophilus influenzae Rd
aaguuagacuaugaaaucaa

SEQ ID NO: 726893 - RNA, 16 nt, Haemophilus influenzae Rd
aaguuccuagaauuaa

SEQ ID NO: 726894 - RNA, 19 nt, Haemophilus influenzae Rd
aaguuccuagaauuaaaag

SEQ ID NO: 726895 - RNA, 18 nt, Haemophilus influenzae Rd
aaguucucaaaaaguuaa

SEQ ID NO: 726896 - RNA, 23 nt, Haemophilus influenzae Rd
aaguucucaaaaaguuaaauaag

SEQ ID NO: 726897 - RNA, 20 nt, Haemophilus influenzae Rd
aaguucuaauucauuuugag

SEQ ID NO: 726898 - RNA, 16 nt, Haemophilus influenzae Rd
aaguucuacccauuca

SEQ ID NO: 726899 - RNA, 15 nt, Haemophilus influenzae Rd
aaguuaggauuaaua

SEQ ID NO: 726900 - RNA, 12 nt, Haemophilus influenzae Rd
aaguuauaaagc

SEQ ID NO: 726901 - RNA, 19 nt, Haemophilus influenzae Rd
aaguuaucaaacaguucaa

SEQ ID NO: 726902 - RNA, 19 nt, Haemophilus influenzae Rd
aaguugcauaacuucacca

SEQ ID NO: 726903 - RNA, 16 nt, Haemophilus influenzae Rd
aaguuggauucauuaa

SEQ ID NO: 726904 - RNA, 18 nt, Haemophilus influenzae Rd
aaguuggcacuucaauuu

SEQ ID NO: 726905 - RNA, 18 nt, Haemophilus influenzae Rd
aaguuggccaauuugcau

SEQ ID NO: 726906 - RNA, 12 nt, Haemophilus influenzae Rd
aaguuugauucc

SEQ ID NO: 726907 - RNA, 20 nt, Haemophilus influenzae Rd
aaguuugauuccguuuacaa

SEQ ID NO: 726908 - RNA, 19 nt, Haemophilus influenzae Rd
aaguuugcuaucuuaccuu

SEQ ID NO: 726909 - RNA, 20 nt, Haemophilus influenzae Rd
aaguuugcuuagugaaaaga

SEQ ID NO: 726910 - RNA, 22 nt, Haemophilus influenzae Rd
aaguuugcuuagugaaaagaaa

SEQ ID NO: 726911 - RNA, 22 nt, Haemophilus influenzae Rd
aaguuuccuucgccauuuuuaa

SEQ ID NO: 726912 - RNA, 14 nt, Haemophilus influenzae Rd
aaguuuaugacgaa

SEQ ID NO: 726913 - RNA, 18 nt, Haemophilus influenzae Rd
aaguugggauaagcuuuu

SEQ ID NO: 726914 - RNA, 17 nt, Haemophilus influenzae Rd
aaguugggauuuaucuu

SEQ ID NO: 726915 - RNA, 20 nt, Haemophilus influenzae Rd
aaguugggauuuaucuuccc

SEQ ID NO: 726916 - RNA, 14 nt, Haemophilus influenzae Rd
aaguggggaaaaau

SEQ ID NO: 726917 - RNA, 22 nt, Haemophilus influenzae Rd
aaguggagaaacauuuuucccu

SEQ ID NO: 726918 - RNA, 19 nt, Haemophilus influenzae Rd
aaguggcauaaagaaacag

SEQ ID NO: 726919 - RNA, 19 nt, Haemophilus influenzae Rd
aagugcagauuuuuuuaua

SEQ ID NO: 726920 - RNA, 22 nt, Haemophilus influenzae Rd
aagugcugguagcaauaaccaa

SEQ ID NO: 726921 - RNA, 20 nt, Haemophilus influenzae Rd
aagugagcuaagcauuucag

SEQ ID NO: 726922 - RNA, 14 nt, Haemophilus influenzae Rd
aagugauauccgcu

SEQ ID NO: 726923 - RNA, 15 nt, Haemophilus influenzae Rd
aaguaacaauguaga

SEQ ID NO: 726924 - RNA, 12 nt, Haemophilus influenzae Rd
aaguaaauucag

SEQ ID NO: 726925 - RNA, 13 nt, Haemophilus influenzae Rd
aaguaaauucagu

SEQ ID NO: 726926 - RNA, 15 nt, Haemophilus influenzae Rd
aaguaaauucaguua

SEQ ID NO: 726927 - RNA, 16 nt, Haemophilus influenzae Rd
aaguaaauauuuuuua

SEQ ID NO: 726928 - RNA, 15 nt, Haemophilus influenzae Rd
aaguaaaucaacaau

SEQ ID NO: 726929 - RNA, 15 nt, Haemophilus influenzae Rd
aaguaagcaauuuuc

SEQ ID NO: 726930 - RNA, 13 nt, Haemophilus influenzae Rd
aaguaagcaaaua

SEQ ID NO: 726931 - RNA, 12 nt, Haemophilus influenzae Rd
aaguaagucgca

SEQ ID NO: 726932 - RNA, 16 nt, Haemophilus influenzae Rd
aaguaaucuaaauauu

SEQ ID NO: 726933 - RNA, 12 nt, Haemophilus influenzae Rd
aaguaauauuuc

SEQ ID NO: 726934 - RNA, 17 nt, Haemophilus influenzae Rd
aaguaauauuucuuguu

SEQ ID NO: 726935 - RNA, 18 nt, Haemophilus influenzae Rd
aaguaauaaucuucuucc

SEQ ID NO: 726936 - RNA, 15 nt, Haemophilus influenzae Rd
aaguaauacuuuuua

SEQ ID NO: 726937 - RNA, 21 nt, Haemophilus influenzae Rd
aaguaaucgccccaaaagcug

SEQ ID NO: 726938 - RNA, 22 nt, Haemophilus influenzae Rd
aagucugcugaaauacaaagca

SEQ ID NO: 726939 - RNA, 14 nt, Haemophilus influenzae Rd
aagucuucaucuuu

SEQ ID NO: 726940 - RNA, 13 nt, Haemophilus influenzae Rd
aagucuuaaucuu

SEQ ID NO: 726941 - RNA, 17 nt, Haemophilus influenzae Rd
aauacguugaacuuaau

SEQ ID NO: 726942 - RNA, 18 nt, Haemophilus influenzae Rd
aauacguugcugugguuu

SEQ ID NO: 726943 - RNA, 19 nt, Haemophilus influenzae Rd
aauacguuguuuuucuacc

SEQ ID NO: 726944 - RNA, 21 nt, Haemophilus influenzae Rd
aauacgucuaauuuagucaua

SEQ ID NO: 726945 - RNA, 16 nt, Haemophilus influenzae Rd
aauacguauaauugac

SEQ ID NO: 726946 - RNA, 15 nt, Haemophilus influenzae Rd
aauacgucaauugcu

SEQ ID NO: 726947 - RNA, 15 nt, Haemophilus influenzae Rd
aauacgauucguuuc

SEQ ID NO: 726948 - RNA, 20 nt, Haemophilus influenzae Rd
aauacgauucguuucaguac

SEQ ID NO: 726949 - RNA, 18 nt, Haemophilus influenzae Rd
aauacgcgucuuucugca

SEQ ID NO: 726950 - RNA, 14 nt, Haemophilus influenzae Rd
aauacagugacaaa

SEQ ID NO: 726951 - RNA, 16 nt, Haemophilus influenzae Rd
aauacaguuucugguu

SEQ ID NO: 726952 - RNA, 17 nt, Haemophilus influenzae Rd
aauacaguuucugguuu

SEQ ID NO: 726953 - RNA, 19 nt, Haemophilus influenzae Rd
aauacaguuucugguuuau

SEQ ID NO: 726954 - RNA, 16 nt, Haemophilus influenzae Rd
aauacauaaagaauaa

SEQ ID NO: 726955 - RNA, 15 nt, Haemophilus influenzae Rd
aauacauaauuaaau

SEQ ID NO: 726956 - RNA, 17 nt, Haemophilus influenzae Rd
aauacaucacgaacuuc

SEQ ID NO: 726957 - RNA, 21 nt, Haemophilus influenzae Rd
aauacaucacgaacuucagcu

SEQ ID NO: 726958 - RNA, 16 nt, Haemophilus influenzae Rd
aauaccgcacuuuuau

SEQ ID NO: 726959 - RNA, 18 nt, Haemophilus influenzae Rd
aauaccgcacuuuuauug

SEQ ID NO: 726960 - RNA, 17 nt, Haemophilus influenzae Rd
aauaccgcuugaauauc

SEQ ID NO: 726961 - RNA, 17 nt, Haemophilus influenzae Rd
aauacucacagagccuu

SEQ ID NO: 726962 - RNA, 20 nt, Haemophilus influenzae Rd
aauacuaauaggaguaaaaa

SEQ ID NO: 726963 - RNA, 22 nt, Haemophilus influenzae Rd
aauacuuagcgugcuaauucca

SEQ ID NO: 726964 - RNA, 23 nt, Haemophilus influenzae Rd
aauacuuagcgugcuaauuccaa

SEQ ID NO: 726965 - RNA, 14 nt, Haemophilus influenzae Rd
aauacugucacaau

SEQ ID NO: 726966 - RNA, 22 nt, Haemophilus influenzae Rd
aauacugucacaauauuugguu

SEQ ID NO: 726967 - RNA, 21 nt, Haemophilus influenzae Rd
aauacuguuaccaauaacuaa

SEQ ID NO: 726968 - RNA, 17 nt, Haemophilus influenzae Rd
aauacuguugagcaucu

SEQ ID NO: 726969 - RNA, 19 nt, Haemophilus influenzae Rd
aauacugaaaugauuauaa

SEQ ID NO: 726970 - RNA, 22 nt, Haemophilus influenzae Rd
aauacuggcacuaaaccugcuu

SEQ ID NO: 726971 - RNA, 21 nt, Haemophilus influenzae Rd
aauacugcgacuuucccugca

SEQ ID NO: 726972 - RNA, 12 nt, Haemophilus influenzae Rd
aauacugcugaa

SEQ ID NO: 726973 - RNA, 18 nt, Haemophilus influenzae Rd
aauacugagaucucuaug

SEQ ID NO: 726974 - RNA, 16 nt, Haemophilus influenzae Rd
aauagaaaguggcuua

SEQ ID NO: 726975 - RNA, 15 nt, Haemophilus influenzae Rd
aauagagaauaauua

SEQ ID NO: 726976 - RNA, 19 nt, Haemophilus influenzae Rd
aauagagaauaauuaaguu

SEQ ID NO: 726977 - RNA, 15 nt, Haemophilus influenzae Rd
aauagaaaaaugcca

SEQ ID NO: 726978 - RNA, 15 nt, Haemophilus influenzae Rd
aauacuuuugcuuca

SEQ ID NO: 726979 - RNA, 17 nt, Haemophilus influenzae Rd
aauacuugaccaaaauu

SEQ ID NO: 726980 - RNA, 14 nt, Haemophilus influenzae Rd
aauacuuucagaau

SEQ ID NO: 726981 - RNA, 21 nt, Haemophilus influenzae Rd
aauacuuucagcuuccaucca

SEQ ID NO: 726982 - RNA, 23 nt, Haemophilus influenzae Rd
aauacagcgaacauuuuugguuu

SEQ ID NO: 726983 - RNA, 21 nt, Haemophilus influenzae Rd
aauacagccgcuggaaacaaa

SEQ ID NO: 726984 - RNA, 22 nt, Haemophilus influenzae Rd
aauacagccgcuggaaacaaac

SEQ ID NO: 726985 - RNA, 16 nt, Haemophilus influenzae Rd
aauacaaucagcugcu

SEQ ID NO: 726986 - RNA, 16 nt, Haemophilus influenzae Rd
aauacaacgguuggaa

SEQ ID NO: 726987 - RNA, 22 nt, Haemophilus influenzae Rd
aauacaagcgauuuuuauauaa

SEQ ID NO: 726988 - RNA, 23 nt, Haemophilus influenzae Rd
aauaauugguaaucaaauucugu

SEQ ID NO: 726989 - RNA, 16 nt, Haemophilus influenzae Rd
aauaauugaagcaauu

SEQ ID NO: 726990 - RNA, 23 nt, Haemophilus influenzae Rd
aauaauucagcgagagaauauuu

SEQ ID NO: 726991 - RNA, 16 nt, Haemophilus influenzae Rd
aauaauugaugcuaaa

SEQ ID NO: 726992 - RNA, 12 nt, Haemophilus influenzae Rd
aauaauucuuua

SEQ ID NO: 726993 - RNA, 12 nt, Haemophilus influenzae Rd
aauacaaaauau

SEQ ID NO: 726994 - RNA, 13 nt, Haemophilus influenzae Rd
aauaauuucaaua

SEQ ID NO: 726995 - RNA, 13 nt, Haemophilus influenzae Rd
aauacaaauacau

SEQ ID NO: 726996 - RNA, 14 nt, Haemophilus influenzae Rd
aauacaacaagaaa

SEQ ID NO: 726997 - RNA, 16 nt, Haemophilus influenzae Rd
aauacaacaagaaauu

SEQ ID NO: 726998 - RNA, 21 nt, Haemophilus influenzae Rd
aauaauucauugaugcccacu

SEQ ID NO: 726999 - RNA, 23 nt, Haemophilus influenzae Rd
aauaauucauugaugcccacuuu

SEQ ID NO: 727000 - RNA, 15 nt, Haemophilus influenzae Rd
aauaauuacuugcuc

SEQ ID NO: 727001 - RNA, 18 nt, Haemophilus influenzae Rd
aauaauuagcuaaauacu

SEQ ID NO: 727002 - RNA, 13 nt, Haemophilus influenzae Rd
aauaauguuuuca

SEQ ID NO: 727003 - RNA, 20 nt, Haemophilus influenzae Rd
aauaauguuaccgacaacca

SEQ ID NO: 727004 - RNA, 16 nt, Haemophilus influenzae Rd
aauaaucuaauccaaa

SEQ ID NO: 727005 - RNA, 15 nt, Haemophilus influenzae Rd
aauaauuaaaaauaa

SEQ ID NO: 727006 - RNA, 14 nt, Haemophilus influenzae Rd
aauaaucgaaaaag

SEQ ID NO: 727007 - RNA, 18 nt, Haemophilus influenzae Rd
aauaaucacuugauaaaa

SEQ ID NO: 727008 - RNA, 15 nt, Haemophilus influenzae Rd
aauaaucacaacaaa

SEQ ID NO: 727009 - RNA, 15 nt, Haemophilus influenzae Rd
aauaaucacaguacc

SEQ ID NO: 727010 - RNA, 20 nt, Haemophilus influenzae Rd
aauaauccugguauuuacaa

SEQ ID NO: 727011 - RNA, 15 nt, Haemophilus influenzae Rd
aauaauaucgcccga

SEQ ID NO: 727012 - RNA, 22 nt, Haemophilus influenzae Rd
aauaauaucgcccgauuuuaaa

SEQ ID NO: 727013 - RNA, 14 nt, Haemophilus influenzae Rd
aauaauauauuuaa

SEQ ID NO: 727014 - RNA, 12 nt, Haemophilus influenzae Rd
aauaauaucaau

SEQ ID NO: 727015 - RNA, 14 nt, Haemophilus influenzae Rd
aauaauaucaauca

SEQ ID NO: 727016 - RNA, 15 nt, Haemophilus influenzae Rd
aauaauaguaguaau

SEQ ID NO: 727017 - RNA, 20 nt, Haemophilus influenzae Rd
aauaauauaggcgaacaaaa

SEQ ID NO: 727018 - RNA, 17 nt, Haemophilus influenzae Rd
aauaauauucaaaacau

SEQ ID NO: 727019 - RNA, 22 nt, Haemophilus influenzae Rd
aauaauauucaaaacauuaauu

SEQ ID NO: 727020 - RNA, 15 nt, Haemophilus influenzae Rd
aaaaauauaaacuga

SEQ ID NO: 727021 - RNA, 14 nt, Haemophilus influenzae Rd
aauaauaucugcuu

SEQ ID NO: 727022 - RNA, 20 nt, Haemophilus influenzae Rd
aaaaauccacacuuuaauag

SEQ ID NO: 727023 - RNA, 21 nt, Haemophilus influenzae Rd
aaaaauccacacuuuaauagu

SEQ ID NO: 727024 - RNA, 15 nt, Haemophilus influenzae Rd
aaaaaucauuaaaua

SEQ ID NO: 727025 - RNA, 17 nt, Haemophilus influenzae Rd
aaaaauaucgcacuuuu

SEQ ID NO: 727026 - RNA, 21 nt, Haemophilus influenzae Rd
aaaaauaucgcacuuuuuuca

SEQ ID NO: 727027 - RNA, 18 nt, Haemophilus influenzae Rd
aaaaauaucguaaaaaau

SEQ ID NO: 727028 - RNA, 14 nt, Haemophilus influenzae Rd
aaaaauauguauuu

SEQ ID NO: 727029 - RNA, 21 nt, Haemophilus influenzae Rd
aauaacgcaucaccacaaaau

SEQ ID NO: 727030 - RNA, 15 nt, Haemophilus influenzae Rd
aauaaccuuaaauca

SEQ ID NO: 727031 - RNA, 19 nt, Haemophilus influenzae Rd
aauaacguguaaauugcuu

SEQ ID NO: 727032 - RNA, 16 nt, Haemophilus influenzae Rd
aauaacguuacuaaaa

SEQ ID NO: 727033 - RNA, 15 nt, Haemophilus influenzae Rd
aauaacguaaccauu

SEQ ID NO: 727034 - RNA, 13 nt, Haemophilus influenzae Rd
aauaacuaaaaau

SEQ ID NO: 727035 - RNA, 13 nt, Haemophilus influenzae Rd
aauaacuacauaa

SEQ ID NO: 727036 - RNA, 23 nt, Haemophilus influenzae Rd
aaaaauaaucacuugauaaaaau

SEQ ID NO: 727037 - RNA, 14 nt, Haemophilus influenzae Rd
aaaaauaaucaucu

SEQ ID NO: 727038 - RNA, 20 nt, Haemophilus influenzae Rd
aaaaauaccgcuaucgucau

SEQ ID NO: 727039 - RNA, 13 nt, Haemophilus influenzae Rd
aaaaauacuaacu

SEQ ID NO: 727040 - RNA, 18 nt, Haemophilus influenzae Rd
aaaaauaauuuuacuugu

SEQ ID NO: 727041 - RNA, 14 nt, Haemophilus influenzae Rd
aagauuaaucuuuu

SEQ ID NO: 727042 - RNA, 18 nt, Haemophilus influenzae Rd
aagauuaaugauaaguuu

SEQ ID NO: 727043 - RNA, 16 nt, Haemophilus influenzae Rd
aagauuacuuucauaa

SEQ ID NO: 727044 - RNA, 21 nt, Haemophilus influenzae Rd
aagauuauacgaucacgauuu

SEQ ID NO: 727045 - RNA, 23 nt, Haemophilus influenzae Rd
aagauguuguaaaaucucuauug

SEQ ID NO: 727046 - RNA, 19 nt, Haemophilus influenzae Rd
aagaugugauauuaaacag

SEQ ID NO: 727047 - RNA, 22 nt, Haemophilus influenzae Rd
aagaauuccauugcauccacuu

SEQ ID NO: 727048 - RNA, 18 nt, Haemophilus influenzae Rd
aagaauguuugaaaauuc

SEQ ID NO: 727049 - RNA, 11 nt, Haemophilus influenzae Rd
aagaauguuuu

SEQ ID NO: 727050 - RNA, 16 nt, Haemophilus influenzae Rd
aagaugacuuguuuca

SEQ ID NO: 727051 - RNA, 21 nt, Haemophilus influenzae Rd
aagaugacuuguuucauaaaa

SEQ ID NO: 727052 - RNA, 17 nt, Haemophilus influenzae Rd
aagaugacgaaaugaaa

SEQ ID NO: 727053 - RNA, 16 nt, Haemophilus influenzae Rd
aagaugauauuuaaua

SEQ ID NO: 727054 - RNA, 21 nt, Haemophilus influenzae Rd
aagaugaggcguuuuucuuaa

SEQ ID NO: 727055 - RNA, 18 nt, Haemophilus influenzae Rd
aagaucuucuuugcgauu

SEQ ID NO: 727056 - RNA, 14 nt, Haemophilus influenzae Rd
aagaugaagcuaag

SEQ ID NO: 727057 - RNA, 18 nt, Haemophilus influenzae Rd
aagaugaagcuaagaaaa

SEQ ID NO: 727058 - RNA, 21 nt, Haemophilus influenzae Rd
aagaugaagcuaagaaaaucc

SEQ ID NO: 727059 - RNA, 22 nt, Haemophilus influenzae Rd
aagaucuucgaugugcauuuuu

SEQ ID NO: 727060 - RNA, 13 nt, Haemophilus influenzae Rd
aagcaacacagau

SEQ ID NO: 727061 - RNA, 13 nt, Haemophilus influenzae Rd
aagcaaauauuua

SEQ ID NO: 727062 - RNA, 20 nt, Haemophilus influenzae Rd
aagcaaccuaaacccgcaau

SEQ ID NO: 727063 - RNA, 12 nt, Haemophilus influenzae Rd
aagcaaaaccau

SEQ ID NO: 727064 - RNA, 13 nt, Haemophilus influenzae Rd
aagauuguccuuu

SEQ ID NO: 727065 - RNA, 17 nt, Haemophilus influenzae Rd
aagauuuacagaacaaa

SEQ ID NO: 727066 - RNA, 17 nt, Haemophilus influenzae Rd
aagauuuauauuccauu

SEQ ID NO: 727067 - RNA, 20 nt, Haemophilus influenzae Rd
aagauuuauguugaauuuuc

SEQ ID NO: 727068 - RNA, 21 nt, Haemophilus influenzae Rd
aagauuguuuuuucauauuuu

SEQ ID NO: 727069 - RNA, 14 nt, Haemophilus influenzae Rd
aagauuuaaaacaa

SEQ ID NO: 727070 - RNA, 16 nt, Haemophilus influenzae Rd
aagauuuaaaacaaga

SEQ ID NO: 727071 - RNA, 19 nt, Haemophilus influenzae Rd
aagauuuuuugaaucucau

SEQ ID NO: 727072 - RNA, 14 nt, Haemophilus influenzae Rd
aagauuuuaugaaa

SEQ ID NO: 727073 - RNA, 22 nt, Haemophilus influenzae Rd
aagauuugccaaaaucacgcca

SEQ ID NO: 727074 - RNA, 18 nt, Haemophilus influenzae Rd
aagcaaucaaaaaugaaa

SEQ ID NO: 727075 - RNA, 22 nt, Haemophilus influenzae Rd
aagcaauagaacgcacacaaca

SEQ ID NO: 727076 - RNA, 13 nt, Haemophilus influenzae Rd
aagcaauauaauc

SEQ ID NO: 727077 - RNA, 16 nt, Haemophilus influenzae Rd
aagcaauccuaagaau

SEQ ID NO: 727078 - RNA, 23 nt, Haemophilus influenzae Rd
aagcaaggcgaaucgaaagauuc

SEQ ID NO: 727079 - RNA, 20 nt, Haemophilus influenzae Rd
aagcaaguaauuuaaaaagu

SEQ ID NO: 727080 - RNA, 20 nt, Haemophilus influenzae Rd
aagcaaguuugcgaucauca

SEQ ID NO: 727081 - RNA, 15 nt, Haemophilus influenzae Rd
aagcaauaaacaaag

SEQ ID NO: 727082 - RNA, 17 nt, Haemophilus influenzae Rd
aagcaauaaacaaagaa

SEQ ID NO: 727083 - RNA, 16 nt, Haemophilus influenzae Rd
aagcaagcaaaauuaa

SEQ ID NO: 727084 - RNA, 20 nt, Haemophilus influenzae Rd
aagcacauuaaucauuucaa

SEQ ID NO: 727085 - RNA, 21 nt, Haemophilus influenzae Rd
aagcacauuaaucauuucaau

SEQ ID NO: 727086 - RNA, 16 nt, Haemophilus influenzae Rd
aagcaccaaagcaaaa

SEQ ID NO: 727087 - RNA, 16 nt, Haemophilus influenzae Rd
aagcaccagucaaggu

SEQ ID NO: 727088 - RNA, 23 nt, Haemophilus influenzae Rd
aagcacaagggguuacagcugca

SEQ ID NO: 727089 - RNA, 19 nt, Haemophilus influenzae Rd
aagcacaagauuugccaaa

SEQ ID NO: 727090 - RNA, 23 nt, Haemophilus influenzae Rd
aagcacaagauuugccaaaauca

SEQ ID NO: 727091 - RNA, 18 nt, Haemophilus influenzae Rd
aagcaaugcuuuaaucau

SEQ ID NO: 727092 - RNA, 15 nt, Haemophilus influenzae Rd
aagcaauucuuccgu

SEQ ID NO: 727093 - RNA, 21 nt, Haemophilus influenzae Rd
aagcaauucuuccguugcauu

SEQ ID NO: 727094 - RNA, 14 nt, Haemophilus influenzae Rd
aagcaauugaauaa

SEQ ID NO: 727095 - RNA, 14 nt, Haemophilus influenzae Rd
aagcaauuucacga

SEQ ID NO: 727096 - RNA, 17 nt, Haemophilus influenzae Rd
aagcaauuucacgauuu

SEQ ID NO: 727097 - RNA, 14 nt, Haemophilus influenzae Rd
aagcaauuuucugc

SEQ ID NO: 727098 - RNA, 23 nt, Haemophilus influenzae Rd
aagcacuucaucacccaucaaau

SEQ ID NO: 727099 - RNA, 19 nt, Haemophilus influenzae Rd
aagcacugaaauucauuca

SEQ ID NO: 727100 - RNA, 21 nt, Haemophilus influenzae Rd
aagcacugaggcuaauaauaa

SEQ ID NO: 727101 - RNA, 19 nt, Haemophilus influenzae Rd
aagcacuuuauuuaauuca

SEQ ID NO: 727102 - RNA, 20 nt, Haemophilus influenzae Rd
aagcacuuuauuuaauucac

SEQ ID NO: 727103 - RNA, 14 nt, Haemophilus influenzae Rd
aagcacuuuuccuu

SEQ ID NO: 727104 - RNA, 17 nt, Haemophilus influenzae Rd
aagcaccuaaaaauuuu

SEQ ID NO: 727105 - RNA, 20 nt, Haemophilus influenzae Rd
aagcauccaucgacauacaa

SEQ ID NO: 727106 - RNA, 16 nt, Haemophilus influenzae Rd
aagcaugaauaaaaau

SEQ ID NO: 727107 - RNA, 14 nt, Haemophilus influenzae Rd
aagcauauuugcaa

SEQ ID NO: 727108 - RNA, 18 nt, Haemophilus influenzae Rd
aagcaucaaaccaaaauc

SEQ ID NO: 727109 - RNA, 20 nt, Haemophilus influenzae Rd
aagcccuaaucguugcccca

SEQ ID NO: 727110 - RNA, 17 nt, Haemophilus influenzae Rd
aagccgaagaagauaau

SEQ ID NO: 727111 - RNA, 20 nt, Haemophilus influenzae Rd
aagcccuguagauuacagag

SEQ ID NO: 727112 - RNA, 17 nt, Haemophilus influenzae Rd
aagccccugaagccaau

SEQ ID NO: 727113 - RNA, 20 nt, Haemophilus influenzae Rd
aagccauuuaauguucccac

SEQ ID NO: 727114 - RNA, 19 nt, Haemophilus influenzae Rd
aagccauguugauguaaaa

SEQ ID NO: 727115 - RNA, 19 nt, Haemophilus influenzae Rd
aagccauacgcgaugcauu

SEQ ID NO: 727116 - RNA, 16 nt, Haemophilus influenzae Rd
aagccaccagagaaau

SEQ ID NO: 727117 - RNA, 14 nt, Haemophilus influenzae Rd
aagccaaugccaaa

SEQ ID NO: 727118 - RNA, 22 nt, Haemophilus influenzae Rd
aagccaaugcggcuauggcagc

SEQ ID NO: 727119 - RNA, 14 nt, Haemophilus influenzae Rd
aagccaauaauuuc

SEQ ID NO: 727120 - RNA, 22 nt, Haemophilus influenzae Rd
aagccaauagauuacguagaaa

SEQ ID NO: 727121 - RNA, 18 nt, Haemophilus influenzae Rd
aagccaaaaccuagaaau

SEQ ID NO: 727122 - RNA, 18 nt, Haemophilus influenzae Rd
aagcauuuuaucacaagu

SEQ ID NO: 727123 - RNA, 13 nt, Haemophilus influenzae Rd
aagcauuaaaaau

SEQ ID NO: 727124 - RNA, 21 nt, Haemophilus influenzae Rd
aagcauuaaauaccgcuugaa

SEQ ID NO: 727125 - RNA, 14 nt, Haemophilus influenzae Rd
aagcauuaaguuuu

SEQ ID NO: 727126 - RNA, 23 nt, Haemophilus influenzae Rd
aagcauuacggcaggaaugaaag

SEQ ID NO: 727127 - RNA, 22 nt, Haemophilus influenzae Rd
aagguuuggacaccuuuuuccu

SEQ ID NO: 727128 - RNA, 21 nt, Haemophilus influenzae Rd
aagguuucuaaaugaauaaaa

SEQ ID NO: 727129 - RNA, 18 nt, Haemophilus influenzae Rd
aagguuuccauaauguuc

SEQ ID NO: 727130 - RNA, 20 nt, Haemophilus influenzae Rd
aagguuuaguggguaaacca

SEQ ID NO: 727131 - RNA, 21 nt, Haemophilus influenzae Rd
aagguuuaguggguaaaccaa

SEQ ID NO: 727132 - RNA, 22 nt, Haemophilus influenzae Rd
aagguuuauagaugaacucaau

SEQ ID NO: 727133 - RNA, 18 nt, Haemophilus influenzae Rd
aagguucgauaguauuuu

SEQ ID NO: 727134 - RNA, 14 nt, Haemophilus influenzae Rd
aagguguaauucca

SEQ ID NO: 727135 - RNA, 17 nt, Haemophilus influenzae Rd
aaggugcguucuacacg

SEQ ID NO: 727136 - RNA, 16 nt, Haemophilus influenzae Rd
aagguggauuggucac

SEQ ID NO: 727137 - RNA, 23 nt, Haemophilus influenzae Rd
aaggugcagauuaauuauauuuu

SEQ ID NO: 727138 - RNA, 14 nt, Haemophilus influenzae Rd
aaggucagcaaauu

SEQ ID NO: 727139 - RNA, 20 nt, Haemophilus influenzae Rd
aaggucauacgaucuacauu

SEQ ID NO: 727140 - RNA, 18 nt, Haemophilus influenzae Rd
aagggaugguuaauuuuu

SEQ ID NO: 727141 - RNA, 13 nt, Haemophilus influenzae Rd
aagggcaaaaaau

SEQ ID NO: 727142 - RNA, 23 nt, Haemophilus influenzae Rd
aagggcagauuuaauucugcccu

SEQ ID NO: 727143 - RNA, 16 nt, Haemophilus influenzae Rd
aaggguaucuaaauuu

SEQ ID NO: 727144 - RNA, 11 nt, Haemophilus influenzae Rd
aagguaaaaau

SEQ ID NO: 727145 - RNA, 20 nt, Haemophilus influenzae Rd
aaggcgauccugaugcagaa

SEQ ID NO: 727146 - RNA, 18 nt, Haemophilus influenzae Rd
aaggcgaacauaacuuuu

SEQ ID NO: 727147 - RNA, 23 nt, Haemophilus influenzae Rd
aaggauuucuuaugaaaaaaaau

SEQ ID NO: 727148 - RNA, 13 nt, Haemophilus influenzae Rd
aaggauuuuauca

SEQ ID NO: 727149 - RNA, 14 nt, Haemophilus influenzae Rd
aaggcaaaauugaa

SEQ ID NO: 727150 - RNA, 18 nt, Haemophilus influenzae Rd
aagcucgguaaaaaucau

SEQ ID NO: 727151 - RNA, 13 nt, Haemophilus influenzae Rd
aagcugaaauuua

SEQ ID NO: 727152 - RNA, 14 nt, Haemophilus influenzae Rd
aagcugaaauuuag

SEQ ID NO: 727153 - RNA, 13 nt, Haemophilus influenzae Rd
aagcucgucuaaa

SEQ ID NO: 727154 - RNA, 17 nt, Haemophilus influenzae Rd
aagcucgcuauuuugag

SEQ ID NO: 727155 - RNA, 16 nt, Haemophilus influenzae Rd
aagcucggaauguuuu

SEQ ID NO: 727156 - RNA, 22 nt, Haemophilus influenzae Rd
aagcucggaauguuuuaaagaa

SEQ ID NO: 727157 - RNA, 14 nt, Haemophilus influenzae Rd
aagcguucaucaau

SEQ ID NO: 727158 - RNA, 18 nt, Haemophilus influenzae Rd
aagcguugaguaaauagc

SEQ ID NO: 727159 - RNA, 14 nt, Haemophilus influenzae Rd
aagcuaaaaaaaca

SEQ ID NO: 727160 - RNA, 14 nt, Haemophilus influenzae Rd
aagcuaagauugac

SEQ ID NO: 727161 - RNA, 19 nt, Haemophilus influenzae Rd
aagcuaaguacaaaagagc

SEQ ID NO: 727162 - RNA, 13 nt, Haemophilus influenzae Rd
aagcguuuuaaaa

SEQ ID NO: 727163 - RNA, 19 nt, Haemophilus influenzae Rd
aagcguuuuucuacauaau

SEQ ID NO: 727164 - RNA, 19 nt, Haemophilus influenzae Rd
aagcgcgugugaaauuccu

SEQ ID NO: 727165 - RNA, 16 nt, Haemophilus influenzae Rd
aagcgcguuuaucauc

SEQ ID NO: 727166 - RNA, 13 nt, Haemophilus influenzae Rd
aaggaguaaguuu

SEQ ID NO: 727167 - RNA, 22 nt, Haemophilus influenzae Rd
aaggauugaccgcccaacauuu

SEQ ID NO: 727168 - RNA, 22 nt, Haemophilus influenzae Rd
aaggacugaguucuguaauuca

SEQ ID NO: 727169 - RNA, 21 nt, Haemophilus influenzae Rd
aagcuuuccaucgcacuguua

SEQ ID NO: 727170 - RNA, 13 nt, Haemophilus influenzae Rd
aagcuucauauaa

SEQ ID NO: 727171 - RNA, 14 nt, Haemophilus influenzae Rd
aagcuuauuucacu

SEQ ID NO: 727172 - RNA, 14 nt, Haemophilus influenzae Rd
aaggaaaaaggcau

SEQ ID NO: 727173 - RNA, 13 nt, Haemophilus influenzae Rd
aaggaaagcccca

SEQ ID NO: 727174 - RNA, 15 nt, Haemophilus influenzae Rd
aagcuuuuucuuguu

SEQ ID NO: 727175 - RNA, 20 nt, Haemophilus influenzae Rd
aagcuuuuucuuguucugcc

SEQ ID NO: 727176 - RNA, 17 nt, Haemophilus influenzae Rd
aagcugcgaauugcaau

SEQ ID NO: 727177 - RNA, 23 nt, Haemophilus influenzae Rd
aagcuuaauauguucuuuguuga

SEQ ID NO: 727178 - RNA, 16 nt, Haemophilus influenzae Rd
aagcuuauguaaauuu

SEQ ID NO: 727179 - RNA, 17 nt, Haemophilus influenzae Rd
aagcugugguaaaaaua

SEQ ID NO: 727180 - RNA, 13 nt, Haemophilus influenzae Rd
aagcugaauaaaa

SEQ ID NO: 727181 - RNA, 12 nt, Haemophilus influenzae Rd
aagcugauauaa

SEQ ID NO: 727182 - RNA, 14 nt, Haemophilus influenzae Rd
aagcugauauaaaa

SEQ ID NO: 727183 - RNA, 14 nt, Haemophilus influenzae Rd
cgcuuuaauagauu

SEQ ID NO: 727184 - RNA, 17 nt, Haemophilus influenzae Rd
cgcuuguuugacugaau

SEQ ID NO: 727185 - RNA, 18 nt, Haemophilus influenzae Rd
cgcuuguaauuucauuuu

SEQ ID NO: 727186 - RNA, 16 nt, Haemophilus influenzae Rd
cgcuaauuuuuuuucu

SEQ ID NO: 727187 - RNA, 21 nt, Haemophilus influenzae Rd
cgcuaaauaagcugaaccauu

SEQ ID NO: 727188 - RNA, 12 nt, Haemophilus influenzae Rd
cggaaaaauucg

SEQ ID NO: 727189 - RNA, 16 nt, Haemophilus influenzae Rd
cgcuuuuuccucagca

SEQ ID NO: 727190 - RNA, 15 nt, Haemophilus influenzae Rd
cgcuuugagaaagaa

SEQ ID NO: 727191 - RNA, 16 nt, Haemophilus influenzae Rd
cgcuuucaauuuucug

SEQ ID NO: 727192 - RNA, 17 nt, Haemophilus influenzae Rd
cgcuuuaucaaagaauu

SEQ ID NO: 727193 - RNA, 23 nt, Haemophilus influenzae Rd
cgcuuucauaaauucaucuucug

SEQ ID NO: 727194 - RNA, 22 nt, Haemophilus influenzae Rd
cggaaacuacggacuaaauaaa

SEQ ID NO: 727195 - RNA, 18 nt, Haemophilus influenzae Rd
cggaaauauuuuaauaga

SEQ ID NO: 727196 - RNA, 14 nt, Haemophilus influenzae Rd
cggaauguaaaauu

SEQ ID NO: 727197 - RNA, 21 nt, Haemophilus influenzae Rd
cggaaugaaagaagguuauac

SEQ ID NO: 727198 - RNA, 16 nt, Haemophilus influenzae Rd
cggagcauuuugguaa

SEQ ID NO: 727199 - RNA, 21 nt, Haemophilus influenzae Rd
cggauuauagaauuuaguccu

SEQ ID NO: 727200 - RNA, 14 nt, Haemophilus influenzae Rd
cggauuaacacauc

SEQ ID NO: 727201 - RNA, 19 nt, Haemophilus influenzae Rd
cggauauuaguaauauauu

SEQ ID NO: 727202 - RNA, 23 nt, Haemophilus influenzae Rd
cggauacccauugaggaaaguuc

SEQ ID NO: 727203 - RNA, 14 nt, Haemophilus influenzae Rd
cggcacauaaauca

SEQ ID NO: 727204 - RNA, 16 nt, Haemophilus influenzae Rd
cggcaaccaaguauca

SEQ ID NO: 727205 - RNA, 21 nt, Haemophilus influenzae Rd
cggcaagcaaacagcaauaaa

SEQ ID NO: 727206 - RNA, 19 nt, Haemophilus influenzae Rd
cggcaagccacauacgcaa

SEQ ID NO: 727207 - RNA, 15 nt, Haemophilus influenzae Rd
cggauuuauuauuua

SEQ ID NO: 727208 - RNA, 15 nt, Haemophilus influenzae Rd
cggauuuuucaauug

SEQ ID NO: 727209 - RNA, 12 nt, Haemophilus influenzae Rd
cgcgauaaagag

SEQ ID NO: 727210 - RNA, 17 nt, Haemophilus influenzae Rd
cgcgagcacguacaacg

SEQ ID NO: 727211 - RNA, 14 nt, Haemophilus influenzae Rd
cgcgagauaaaauu

SEQ ID NO: 727212 - RNA, 14 nt, Haemophilus influenzae Rd
cgccuuuuuggaaa

SEQ ID NO: 727213 - RNA, 22 nt, Haemophilus influenzae Rd
cgccuuuuuggaaacgguuaau

SEQ ID NO: 727214 - RNA, 21 nt, Haemophilus influenzae Rd
cgccuguuaagccaacuugua

SEQ ID NO: 727215 - RNA, 12 nt, Haemophilus influenzae Rd
cgccuucuucca

SEQ ID NO: 727216 - RNA, 20 nt, Haemophilus influenzae Rd
cgccuuggaucguuuucucg

SEQ ID NO: 727217 - RNA, 15 nt, Haemophilus influenzae Rd
cgccuuuuaauaaau

SEQ ID NO: 727218 - RNA, 16 nt, Haemophilus influenzae Rd
cgcgcccauucauuuu

SEQ ID NO: 727219 - RNA, 14 nt, Haemophilus influenzae Rd
cgcgaugcauugau

SEQ ID NO: 727220 - RNA, 19 nt, Haemophilus influenzae Rd
cgcgugguauucuuuccac

SEQ ID NO: 727221 - RNA, 15 nt, Haemophilus influenzae Rd
cgcguaauaaauaag

SEQ ID NO: 727222 - RNA, 15 nt, Haemophilus influenzae Rd
cgcguaaaguuuuaa

SEQ ID NO: 727223 - RNA, 13 nt, Haemophilus influenzae Rd
cgccaugccaagc

SEQ ID NO: 727224 - RNA, 16 nt, Haemophilus influenzae Rd
cgcccucgccuugcaa

SEQ ID NO: 727225 - RNA, 21 nt, Haemophilus influenzae Rd
cgccguauugaauaauuacuu

SEQ ID NO: 727226 - RNA, 20 nt, Haemophilus influenzae Rd
aaacguuggguuugauuuau

SEQ ID NO: 727227 - RNA, 18 nt, Haemophilus influenzae Rd
aaacguucuaagaauuuu

SEQ ID NO: 727228 - RNA, 15 nt, Haemophilus influenzae Rd
aaacgugauuuacca

SEQ ID NO: 727229 - RNA, 16 nt, Haemophilus influenzae Rd
aaacgucgauccauug

SEQ ID NO: 727230 - RNA, 14 nt, Haemophilus influenzae Rd
cgauugccuuuuuu

SEQ ID NO: 727231 - RNA, 15 nt, Haemophilus influenzae Rd
cgauugcucguuauu

SEQ ID NO: 727232 - RNA, 20 nt, Haemophilus influenzae Rd
cgauuuuuuuauaaaaaaac

SEQ ID NO: 727233 - RNA, 17 nt, Haemophilus influenzae Rd
cgauuuuaaauucuccc

SEQ ID NO: 727234 - RNA, 19 nt, Haemophilus influenzae Rd
cgauuuuaauugugcaauu

SEQ ID NO: 727235 - RNA, 17 nt, Haemophilus influenzae Rd
cgaugaugcaggaaagg

SEQ ID NO: 727236 - RNA, 12 nt, Haemophilus influenzae Rd
cgauauucuuuu

SEQ ID NO: 727237 - RNA, 14 nt, Haemophilus influenzae Rd
cgaucaaauuguca

SEQ ID NO: 727238 - RNA, 12 nt, Haemophilus influenzae Rd
cgauauuuuuuc

SEQ ID NO: 727239 - RNA, 19 nt, Haemophilus influenzae Rd
cgauauuuguguaacagcu

SEQ ID NO: 727240 - RNA, 19 nt, Haemophilus influenzae Rd
cgauauuuuuaucaauaac

SEQ ID NO: 727241 - RNA, 16 nt, Haemophilus influenzae Rd
cgauggaaaugaguaa

SEQ ID NO: 727242 - RNA, 21 nt, Haemophilus influenzae Rd
cgcacauucuauagaauuauu

SEQ ID NO: 727243 - RNA, 12 nt, Haemophilus influenzae Rd
cgcaccacacaa

SEQ ID NO: 727244 - RNA, 14 nt, Haemophilus influenzae Rd
cgcaccaauaacag

SEQ ID NO: 727245 - RNA, 23 nt, Haemophilus influenzae Rd
cgcacuuucauuccauucuaaaa

SEQ ID NO: 727246 - RNA, 14 nt, Haemophilus influenzae Rd
cgcacuuucgccuu

SEQ ID NO: 727247 - RNA, 16 nt, Haemophilus influenzae Rd
cgcacuuucuucuuuu

SEQ ID NO: 727248 - RNA, 23 nt, Haemophilus influenzae Rd
cgcacuuuggaauauucuuuuua

SEQ ID NO: 727249 - RNA, 14 nt, Haemophilus influenzae Rd
cgcacuuuuauugc

SEQ ID NO: 727250 - RNA, 17 nt, Haemophilus influenzae Rd
cgcacuuuuguauuuua

SEQ ID NO: 727251 - RNA, 14 nt, Haemophilus influenzae Rd
cgcacuuuuuacuu

SEQ ID NO: 727252 - RNA, 12 nt, Haemophilus influenzae Rd
cgcacuuuuuau

SEQ ID NO: 727253 - RNA, 22 nt, Haemophilus influenzae Rd
cgcacuuuuuuguuuucaggau

SEQ ID NO: 727254 - RNA, 23 nt, Haemophilus influenzae Rd
cgcacuuuuuuguuuucaggaua

SEQ ID NO: 727255 - RNA, 14 nt, Haemophilus influenzae Rd
cgcacuuuuuuucu

SEQ ID NO: 727256 - RNA, 12 nt, Haemophilus influenzae Rd
cgcaauuuagau

SEQ ID NO: 727257 - RNA, 18 nt, Haemophilus influenzae Rd
cgcaacuaaauuagcucu

SEQ ID NO: 727258 - RNA, 16 nt, Haemophilus influenzae Rd
cgcaaccguaauaauu

SEQ ID NO: 727259 - RNA, 14 nt, Haemophilus influenzae Rd
cgcaaauacuucac

SEQ ID NO: 727260 - RNA, 22 nt, Haemophilus influenzae Rd
aaacggcgugcaccgauauuuu

SEQ ID NO: 727261 - RNA, 16 nt, Haemophilus influenzae Rd
aaacggcgaagauuac

SEQ ID NO: 727262 - RNA, 22 nt, Haemophilus influenzae Rd
aaacggcguaucauacuaaaaa

SEQ ID NO: 727263 - RNA, 23 nt, Haemophilus influenzae Rd
aaacggcguaucauacuaaaaaa

SEQ ID NO: 727264 - RNA, 22 nt, Haemophilus influenzae Rd
cgcauauuuuugcaagauuuuu

SEQ ID NO: 727265 - RNA, 20 nt, Haemophilus influenzae Rd
cgcaucaacaacuaaauaag

SEQ ID NO: 727266 - RNA, 17 nt, Haemophilus influenzae Rd
cgcaucaaucacagcac

SEQ ID NO: 727267 - RNA, 15 nt, Haemophilus influenzae Rd
cgcaucaccacaaaa

SEQ ID NO: 727268 - RNA, 21 nt, Haemophilus influenzae Rd
cgcauaucacgauaagcaacc

SEQ ID NO: 727269 - RNA, 13 nt, Haemophilus influenzae Rd
cgcauaggccuca

SEQ ID NO: 727270 - RNA, 16 nt, Haemophilus influenzae Rd
cgcaucauucaaugca

SEQ ID NO: 727271 - RNA, 21 nt, Haemophilus influenzae Rd
cgcaucgcccaauuuggcaaa

SEQ ID NO: 727272 - RNA, 14 nt, Haemophilus influenzae Rd
cgcaucuuuuucug

SEQ ID NO: 727273 - RNA, 17 nt, Haemophilus influenzae Rd
cgccaagaauaaaaugu

SEQ ID NO: 727274 - RNA, 14 nt, Haemophilus influenzae Rd
cgcauuuuuauuag

SEQ ID NO: 727275 - RNA, 16 nt, Haemophilus influenzae Rd
cgcauuuuuuauuuuu

SEQ ID NO: 727276 - RNA, 20 nt, Haemophilus influenzae Rd
cgcaugcggaauaauuuucc

SEQ ID NO: 727277 - RNA, 15 nt, Haemophilus influenzae Rd
cgcauugcguaaaug

SEQ ID NO: 727278 - RNA, 22 nt, Haemophilus influenzae Rd
cgcauuguaaaccaaauuucuu

SEQ ID NO: 727279 - RNA, 15 nt, Haemophilus influenzae Rd
cgcauucuucuuuua

SEQ ID NO: 727280 - RNA, 22 nt, Haemophilus influenzae Rd
cgccaauguuugguauaaauaa

SEQ ID NO: 727281 - RNA, 19 nt, Haemophilus influenzae Rd
cgccaaucuaagccuaagc

SEQ ID NO: 727282 - RNA, 21 nt, Haemophilus influenzae Rd
cgccaaguccccauuuguaga

SEQ ID NO: 727283 - RNA, 14 nt, Haemophilus influenzae Rd
cgagacauuauuuu

SEQ ID NO: 727284 - RNA, 16 nt, Haemophilus influenzae Rd
cgagacauuauuuuua

SEQ ID NO: 727285 - RNA, 18 nt, Haemophilus influenzae Rd
cgagaauuaccacaagau

SEQ ID NO: 727286 - RNA, 17 nt, Haemophilus influenzae Rd
cgagaaacuuucaaaau

SEQ ID NO: 727287 - RNA, 23 nt, Haemophilus influenzae Rd
cgagaacgagccucaucuaaggu

SEQ ID NO: 727288 - RNA, 20 nt, Haemophilus influenzae Rd
cgacuuuguuucuaaaaaug

SEQ ID NO: 727289 - RNA, 19 nt, Haemophilus influenzae Rd
cgacucaccgcaauaauac

SEQ ID NO: 727290 - RNA, 15 nt, Haemophilus influenzae Rd
cgacugcucacgccg

SEQ ID NO: 727291 - RNA, 17 nt, Haemophilus influenzae Rd
cgaauagccaaaacgaa

SEQ ID NO: 727292 - RNA, 13 nt, Haemophilus influenzae Rd
cgacgugcuucaa

SEQ ID NO: 727293 - RNA, 20 nt, Haemophilus influenzae Rd
cgacguggacgaccuguuac

SEQ ID NO: 727294 - RNA, 23 nt, Haemophilus influenzae Rd
cgacuaauuuuuuaauuuuuucu

SEQ ID NO: 727295 - RNA, 17 nt, Haemophilus influenzae Rd
cgagcaacuuggaaugc

SEQ ID NO: 727296 - RNA, 18 nt, Haemophilus influenzae Rd
cgagcaacuuggaaugca

SEQ ID NO: 727297 - RNA, 18 nt, Haemophilus influenzae Rd
cgagauuucuuugaugaa

SEQ ID NO: 727298 - RNA, 19 nt, Haemophilus influenzae Rd
cgagaucuucuucauccac

SEQ ID NO: 727299 - RNA, 15 nt, Haemophilus influenzae Rd
cgagaugcauuuuuu

SEQ ID NO: 727300 - RNA, 12 nt, Haemophilus influenzae Rd
cgagauaaaauu

SEQ ID NO: 727301 - RNA, 20 nt, Haemophilus influenzae Rd
cgagcauagaucgcaagggc

SEQ ID NO: 727302 - RNA, 17 nt, Haemophilus influenzae Rd
cgagcgacugauucuuc

SEQ ID NO: 727303 - RNA, 20 nt, Haemophilus influenzae Rd
aaacgcgaugaaauuaucau

SEQ ID NO: 727304 - RNA, 23 nt, Haemophilus influenzae Rd
aaacgcggucuaaauagaccgca

SEQ ID NO: 727305 - RNA, 20 nt, Haemophilus influenzae Rd
aaacgcucaaauaaauugcc

SEQ ID NO: 727306 - RNA, 22 nt, Haemophilus influenzae Rd
aaacgcuccucugcauucugaa

SEQ ID NO: 727307 - RNA, 13 nt, Haemophilus influenzae Rd
cgaguuaaguaag

SEQ ID NO: 727308 - RNA, 21 nt, Haemophilus influenzae Rd
cgaguaaaaaaucuaucccaa

SEQ ID NO: 727309 - RNA, 19 nt, Haemophilus influenzae Rd
cgaguaaauuaauuuagag

SEQ ID NO: 727310 - RNA, 16 nt, Haemophilus influenzae Rd
cgaguaaucuaauucu

SEQ ID NO: 727311 - RNA, 22 nt, Haemophilus influenzae Rd
cgaguaagggcaaaaaaucuuu

SEQ ID NO: 727312 - RNA, 18 nt, Haemophilus influenzae Rd
cgaguagugauugcgccg

SEQ ID NO: 727313 - RNA, 14 nt, Haemophilus influenzae Rd
cgagguuuucguau

SEQ ID NO: 727314 - RNA, 20 nt, Haemophilus influenzae Rd
cgaggguucgaaucccucuc

SEQ ID NO: 727315 - RNA, 16 nt, Haemophilus influenzae Rd
cgagggucaaaagaaa

SEQ ID NO: 727316 - RNA, 18 nt, Haemophilus influenzae Rd
cgagggucaaaagaaaga

SEQ ID NO: 727317 - RNA, 14 nt, Haemophilus influenzae Rd
cgauaccacauucc

SEQ ID NO: 727318 - RNA, 15 nt, Haemophilus influenzae Rd
cgauaccacauucca

SEQ ID NO: 727319 - RNA, 19 nt, Haemophilus influenzae Rd
cgauagaggcgaaccacau

SEQ ID NO: 727320 - RNA, 19 nt, Haemophilus influenzae Rd
cgauagcggcgaauguggc

SEQ ID NO: 727321 - RNA, 17 nt, Haemophilus influenzae Rd
cgauaaaaaagccacca

SEQ ID NO: 727322 - RNA, 18 nt, Haemophilus influenzae Rd
cgaguuugucaugacuau

SEQ ID NO: 727323 - RNA, 11 nt, Haemophilus influenzae Rd
cgauaaaaucg

SEQ ID NO: 727324 - RNA, 17 nt, Haemophilus influenzae Rd
cgauaaaauauauuaau

SEQ ID NO: 727325 - RNA, 13 nt, Haemophilus influenzae Rd
cgauaaaaucaaa

SEQ ID NO: 727326 - RNA, 15 nt, Haemophilus influenzae Rd
cgauaaaaucuugcu

SEQ ID NO: 727327 - RNA, 17 nt, Haemophilus influenzae Rd
cgauaaacauuuuuuca

SEQ ID NO: 727328 - RNA, 20 nt, Haemophilus influenzae Rd
cgauaacacgaccauugaau

SEQ ID NO: 727329 - RNA, 20 nt, Haemophilus influenzae Rd
cgagcuuucaugauuaacaa

SEQ ID NO: 727330 - RNA, 20 nt, Haemophilus influenzae Rd
cgagcucuuucauuaaauua

SEQ ID NO: 727331 - RNA, 14 nt, Haemophilus influenzae Rd
aaacgcucuuuaau

SEQ ID NO: 727332 - RNA, 23 nt, Haemophilus influenzae Rd
cgaggcuuuuuuuauaguuuuau

SEQ ID NO: 727333 - RNA, 15 nt, Haemophilus influenzae Rd
cgagggauuuuaaau

SEQ ID NO: 727334 - RNA, 17 nt, Haemophilus influenzae Rd
cgaggacaaucugcugu

SEQ ID NO: 727335 - RNA, 18 nt, Haemophilus influenzae Rd
ccaggaguaaccacaaaa

SEQ ID NO: 727336 - RNA, 22 nt, Haemophilus influenzae Rd
ccaggagaaaguuguacuauuu

SEQ ID NO: 727337 - RNA, 15 nt, Haemophilus influenzae Rd
ccaggaaaauuuuau

SEQ ID NO: 727338 - RNA, 14 nt, Haemophilus influenzae Rd
ccagcuuuccaaug

SEQ ID NO: 727339 - RNA, 17 nt, Haemophilus influenzae Rd
ccagcgcuugcaccaau

SEQ ID NO: 727340 - RNA, 16 nt, Haemophilus influenzae Rd
ccagcguaaaaaugcu

SEQ ID NO: 727341 - RNA, 13 nt, Haemophilus influenzae Rd
ccagcgcaccaca

SEQ ID NO: 727342 - RNA, 18 nt, Haemophilus influenzae Rd
ccacucgggcauauagac

SEQ ID NO: 727343 - RNA, 21 nt, Haemophilus influenzae Rd
ccacucuuuuaauaaaaccau

SEQ ID NO: 727344 - RNA, 12 nt, Haemophilus influenzae Rd
ccauaauagaau

SEQ ID NO: 727345 - RNA, 13 nt, Haemophilus influenzae Rd
ccauaauaaucac

SEQ ID NO: 727346 - RNA, 14 nt, Haemophilus influenzae Rd
ccauaauacucacc

SEQ ID NO: 727347 - RNA, 14 nt, Haemophilus influenzae Rd
ccauaagugagaaa

SEQ ID NO: 727348 - RNA, 16 nt, Haemophilus influenzae Rd
ccauaacggcaagcaa

SEQ ID NO: 727349 - RNA, 19 nt, Haemophilus influenzae Rd
ccauaacggcaagcaaaca

SEQ ID NO: 727350 - RNA, 14 nt, Haemophilus influenzae Rd
ccauagaaagcauu

SEQ ID NO: 727351 - RNA, 15 nt, Haemophilus influenzae Rd
ccauacuugccacag

SEQ ID NO: 727352 - RNA, 22 nt, Haemophilus influenzae Rd
ccaucacagucuuuuaacacau

SEQ ID NO: 727353 - RNA, 17 nt, Haemophilus influenzae Rd
ccaucacaaaggaaagu

SEQ ID NO: 727354 - RNA, 12 nt, Haemophilus influenzae Rd
ccaucaaucaua

SEQ ID NO: 727355 - RNA, 17 nt, Haemophilus influenzae Rd
ccaucaaucauaaaaac

SEQ ID NO: 727356 - RNA, 21 nt, Haemophilus influenzae Rd
ccaucaaucauaaaaacaaua

SEQ ID NO: 727357 - RNA, 21 nt, Haemophilus influenzae Rd
ccauauaguaagcaccaaaau

SEQ ID NO: 727358 - RNA, 17 nt, Haemophilus influenzae Rd
ccaucaaccauaacaag

SEQ ID NO: 727359 - RNA, 22 nt, Haemophilus influenzae Rd
ccaucaaccauaacaagaauca

SEQ ID NO: 727360 - RNA, 13 nt, Haemophilus influenzae Rd
ccaucaaaucuuu

SEQ ID NO: 727361 - RNA, 20 nt, Haemophilus influenzae Rd
ccaucaaaagaucauuuuuu

SEQ ID NO: 727362 - RNA, 14 nt, Haemophilus influenzae Rd
ccauaucugaaaau

SEQ ID NO: 727363 - RNA, 20 nt, Haemophilus influenzae Rd
ccagugguugcgauuuuugc

SEQ ID NO: 727364 - RNA, 12 nt, Haemophilus influenzae Rd
ccauaaauuugg

SEQ ID NO: 727365 - RNA, 21 nt, Haemophilus influenzae Rd
ccauaaaccgccaaaaauuaa

SEQ ID NO: 727366 - RNA, 16 nt, Haemophilus influenzae Rd
ccaguuucuugggauu

SEQ ID NO: 727367 - RNA, 15 nt, Haemophilus influenzae Rd
ccaguucuccuucuc

SEQ ID NO: 727368 - RNA, 18 nt, Haemophilus influenzae Rd
ccaguucuccuucuccau

SEQ ID NO: 727369 - RNA, 15 nt, Haemophilus influenzae Rd
ccaguuuagaaagca

SEQ ID NO: 727370 - RNA, 22 nt, Haemophilus influenzae Rd
ccaucguuaaaccaaauaauga

SEQ ID NO: 727371 - RNA, 18 nt, Haemophilus influenzae Rd
ccaucuaauugugcuaaa

SEQ ID NO: 727372 - RNA, 16 nt, Haemophilus influenzae Rd
ccaucuaauacgucua

SEQ ID NO: 727373 - RNA, 13 nt, Haemophilus influenzae Rd
ccaucuaaaccug

SEQ ID NO: 727374 - RNA, 22 nt, Haemophilus influenzae Rd
ccaucuaaaguuggcacuucaa

SEQ ID NO: 727375 - RNA, 16 nt, Haemophilus influenzae Rd
aaacaauaaaaaaacu

SEQ ID NO: 727376 - RNA, 19 nt, Haemophilus influenzae Rd
aaacaauaaaaaaacuugc

SEQ ID NO: 727377 - RNA, 22 nt, Haemophilus influenzae Rd
aaacaauauauucggaaaaaau

SEQ ID NO: 727378 - RNA, 23 nt, Haemophilus influenzae Rd
aaacaauauauucggaaaaaauu

SEQ ID NO: 727379 - RNA, 20 nt, Haemophilus influenzae Rd
aaacaagugcuaucuuaaau

SEQ ID NO: 727380 - RNA, 16 nt, Haemophilus influenzae Rd
aaacaaguuucuaaaa

SEQ ID NO: 727381 - RNA, 13 nt, Haemophilus influenzae Rd
aaacaaguucuua

SEQ ID NO: 727382 - RNA, 19 nt, Haemophilus influenzae Rd
aaacaagcucuagaaaauc

SEQ ID NO: 727383 - RNA, 16 nt, Haemophilus influenzae Rd
ccaucagcuccuacau

SEQ ID NO: 727384 - RNA, 15 nt, Haemophilus influenzae Rd
ccaucaccuucaaca

SEQ ID NO: 727385 - RNA, 23 nt, Haemophilus influenzae Rd
ccaucacgccauaaacgcaccac

SEQ ID NO: 727386 - RNA, 19 nt, Haemophilus influenzae Rd
ccaucacgaccuuuuucag

SEQ ID NO: 727387 - RNA, 17 nt, Haemophilus influenzae Rd
ccaucacguaauacaaa

SEQ ID NO: 727388 - RNA, 20 nt, Haemophilus influenzae Rd
ccaucacuacguguuaauaa

SEQ ID NO: 727389 - RNA, 12 nt, Haemophilus influenzae Rd
ccaucacucaau

SEQ ID NO: 727390 - RNA, 15 nt, Haemophilus influenzae Rd
aaacaagacaaaaua

SEQ ID NO: 727391 - RNA, 17 nt, Haemophilus influenzae Rd
cccacaacccaagagcc

SEQ ID NO: 727392 - RNA, 18 nt, Haemophilus influenzae Rd
cccaauuugcgccacaau

SEQ ID NO: 727393 - RNA, 17 nt, Haemophilus influenzae Rd
cccaauuuggcaaaagu

SEQ ID NO: 727394 - RNA, 21 nt, Haemophilus influenzae Rd
cccaauuuggcaaaaguaagc

SEQ ID NO: 727395 - RNA, 20 nt, Haemophilus influenzae Rd
cccaauuagaugauuuuaaa

SEQ ID NO: 727396 - RNA, 23 nt, Haemophilus influenzae Rd
cccaauuagcugguuuauuuauu

SEQ ID NO: 727397 - RNA, 22 nt, Haemophilus influenzae Rd
cccaauucucugcaucguugcu

SEQ ID NO: 727398 - RNA, 19 nt, Haemophilus influenzae Rd
cccaaucuccguugggauu

SEQ ID NO: 727399 - RNA, 20 nt, Haemophilus influenzae Rd
cccaaucuucgucaucauca

SEQ ID NO: 727400 - RNA, 12 nt, Haemophilus influenzae Rd
cccaaucacuag

SEQ ID NO: 727401 - RNA, 12 nt, Haemophilus influenzae Rd
cccaaguugugc

SEQ ID NO: 727402 - RNA, 18 nt, Haemophilus influenzae Rd
ccauuucaucuucaguac

SEQ ID NO: 727403 - RNA, 21 nt, Haemophilus influenzae Rd
ccauuuaauguucccacaaag

SEQ ID NO: 727404 - RNA, 19 nt, Haemophilus influenzae Rd
ccauuuagguuagaauaaa

SEQ ID NO: 727405 - RNA, 15 nt, Haemophilus influenzae Rd
ccauuuaucuuccau

SEQ ID NO: 727406 - RNA, 23 nt, Haemophilus influenzae Rd
cccaaauuguugccgccaaucca

SEQ ID NO: 727407 - RNA, 20 nt, Haemophilus influenzae Rd
cccaacagaaaucauuucaa

SEQ ID NO: 727408 - RNA, 15 nt, Haemophilus influenzae Rd
ccaugcuuuggcaua

SEQ ID NO: 727409 - RNA, 23 nt, Haemophilus influenzae Rd
ccauggaacaggcuacacccacu

SEQ ID NO: 727410 - RNA, 20 nt, Haemophilus influenzae Rd
ccauucacauucuuuuaaau

SEQ ID NO: 727411 - RNA, 12 nt, Haemophilus influenzae Rd
ccauucacuuuc

SEQ ID NO: 727412 - RNA, 22 nt, Haemophilus influenzae Rd
ccauucaguaauaaggcuugca

SEQ ID NO: 727413 - RNA, 15 nt, Haemophilus influenzae Rd
ccauucuuucaauaa

SEQ ID NO: 727414 - RNA, 17 nt, Haemophilus influenzae Rd
ccauucuuucaauaauu

SEQ ID NO: 727415 - RNA, 23 nt, Haemophilus influenzae Rd
ccauugaaaccugaguaaauaaa

SEQ ID NO: 727416 - RNA, 12 nt, Haemophilus influenzae Rd
ccauugaugaaa

SEQ ID NO: 727417 - RNA, 17 nt, Haemophilus influenzae Rd
ccauugcauccacuuca

SEQ ID NO: 727418 - RNA, 20 nt, Haemophilus influenzae Rd
ccauugcauccacuucaucc

SEQ ID NO: 727419 - RNA, 22 nt, Haemophilus influenzae Rd
ccauugagcauuuuuuauuaaa

SEQ ID NO: 727420 - RNA, 22 nt, Haemophilus influenzae Rd
ccauuggaagauuucuucuacu

SEQ ID NO: 727421 - RNA, 19 nt, Haemophilus influenzae Rd
ccauuggacacaauaauau

SEQ ID NO: 727422 - RNA, 14 nt, Haemophilus influenzae Rd
ccauugucauggca

SEQ ID NO: 727423 - RNA, 19 nt, Haemophilus influenzae Rd
ccauuguuguuuauuggca

SEQ ID NO: 727424 - RNA, 12 nt, Haemophilus influenzae Rd
ccauuuaagccu

SEQ ID NO: 727425 - RNA, 15 nt, Haemophilus influenzae Rd
cccacguccacuuca

SEQ ID NO: 727426 - RNA, 22 nt, Haemophilus influenzae Rd
cccacugauuuuucuuuuucag

SEQ ID NO: 727427 - RNA, 19 nt, Haemophilus influenzae Rd
cccacuuaucuuaaaaaag

SEQ ID NO: 727428 - RNA, 13 nt, Haemophilus influenzae Rd
cccacaugggcau

SEQ ID NO: 727429 - RNA, 13 nt, Haemophilus influenzae Rd
cccacaugucaaa

SEQ ID NO: 727430 - RNA, 24 nt, Haemophilus influenzae Rd
cccaccgcuggcauagcuucuaau

SEQ ID NO: 727431 - RNA, 18 nt, Haemophilus influenzae Rd
cccaccauacgcaacuaa

SEQ ID NO: 727432 - RNA, 19 nt, Haemophilus influenzae Rd
cccauuaaugguauuguga

SEQ ID NO: 727433 - RNA, 23 nt, Haemophilus influenzae Rd
cccauugaaauaacacaaccauc

SEQ ID NO: 727434 - RNA, 15 nt, Haemophilus influenzae Rd
ccccaauuagauuac

SEQ ID NO: 727435 - RNA, 18 nt, Haemophilus influenzae Rd
cccauuuaugggugaggg

SEQ ID NO: 727436 - RNA, 15 nt, Haemophilus influenzae Rd
cccauuucaucuuca

SEQ ID NO: 727437 - RNA, 16 nt, Haemophilus influenzae Rd
cccgaucauugugauc

SEQ ID NO: 727438 - RNA, 19 nt, Haemophilus influenzae Rd
aaacacgcauaaaaauaac

SEQ ID NO: 727439 - RNA, 13 nt, Haemophilus influenzae Rd
aaacacuccaaca

SEQ ID NO: 727440 - RNA, 17 nt, Haemophilus influenzae Rd
aaacacuccaacaccag

SEQ ID NO: 727441 - RNA, 16 nt, Haemophilus influenzae Rd
cccguaauuaaaaaua

SEQ ID NO: 727442 - RNA, 13 nt, Haemophilus influenzae Rd
aaacaccuaauuc

SEQ ID NO: 727443 - RNA, 20 nt, Haemophilus influenzae Rd
aaacaccuccagcaaaagca

SEQ ID NO: 727444 - RNA, 15 nt, Haemophilus influenzae Rd
cccgcuucuaaggca

SEQ ID NO: 727445 - RNA, 20 nt, Haemophilus influenzae Rd
cccgcuguaauugcgccccc

SEQ ID NO: 727446 - RNA, 15 nt, Haemophilus influenzae Rd
aaacacuugguucgc

SEQ ID NO: 727447 - RNA, 17 nt, Haemophilus influenzae Rd
aaacacuugguucgcuu

SEQ ID NO: 727448 - RNA, 13 nt, Haemophilus influenzae Rd
cccuguucaaauu

SEQ ID NO: 727449 - RNA, 13 nt, Haemophilus influenzae Rd
cccuuguucuuca

SEQ ID NO: 727450 - RNA, 14 nt, Haemophilus influenzae Rd
ccgaaauucccauu

SEQ ID NO: 727451 - RNA, 13 nt, Haemophilus influenzae Rd
aaacagacugaaa

SEQ ID NO: 727452 - RNA, 17 nt, Haemophilus influenzae Rd
aaacagacugaaauucu

SEQ ID NO: 727453 - RNA, 17 nt, Haemophilus influenzae Rd
cccuuuucuuauuucug

SEQ ID NO: 727454 - RNA, 16 nt, Haemophilus influenzae Rd
cccuuuugccuaaaac

SEQ ID NO: 727455 - RNA, 20 nt, Haemophilus influenzae Rd
cccuuuguuuuaaugauaaa

SEQ ID NO: 727456 - RNA, 17 nt, Haemophilus influenzae Rd
cccuuuuaguuuccccu

SEQ ID NO: 727457 - RNA, 14 nt, Haemophilus influenzae Rd
cccuuuucaaacaa

SEQ ID NO: 727458 - RNA, 14 nt, Haemophilus influenzae Rd
aaacaugagguguu

SEQ ID NO: 727459 - RNA, 18 nt, Haemophilus influenzae Rd
aaacaucgcuucaucauc

SEQ ID NO: 727460 - RNA, 19 nt, Haemophilus influenzae Rd
aaacaguucaauaaaaaua

SEQ ID NO: 727461 - RNA, 22 nt, Haemophilus influenzae Rd
aaaccaaagaguuugaauaauu

SEQ ID NO: 727462 - RNA, 12 nt, Haemophilus influenzae Rd
aaaccaaauaau

SEQ ID NO: 727463 - RNA, 13 nt, Haemophilus influenzae Rd
aaaccaaauaaug

SEQ ID NO: 727464 - RNA, 23 nt, Haemophilus influenzae Rd
aaaccaaauaugguaauuagccu

SEQ ID NO: 727465 - RNA, 13 nt, Haemophilus influenzae Rd
aaaccaaaucaca

SEQ ID NO: 727466 - RNA, 13 nt, Haemophilus influenzae Rd
aaaccaaauugau

SEQ ID NO: 727467 - RNA, 14 nt, Haemophilus influenzae Rd
aaaccaaauuuuga

SEQ ID NO: 727468 - RNA, 14 nt, Haemophilus influenzae Rd
aaacauuuguaccu

SEQ ID NO: 727469 - RNA, 18 nt, Haemophilus influenzae Rd
aaacauuuuuauuuuuac

SEQ ID NO: 727470 - RNA, 14 nt, Haemophilus influenzae Rd
aaacauuuuucccu

SEQ ID NO: 727471 - RNA, 12 nt, Haemophilus influenzae Rd
aaacauuuuuau

SEQ ID NO: 727472 - RNA, 15 nt, Haemophilus influenzae Rd
aaacauuuuguaucu

SEQ ID NO: 727473 - RNA, 23 nt, Haemophilus influenzae Rd
aaacauuuuguaucuaaauauau

SEQ ID NO: 727474 - RNA, 24 nt, Haemophilus influenzae Rd
aaacauuuuguaucuaaauauauu

SEQ ID NO: 727475 - RNA, 17 nt, Haemophilus influenzae Rd
aaaccaauuucguuuuc

SEQ ID NO: 727476 - RNA, 18 nt, Haemophilus influenzae Rd
aaaccaaucauuggauaa

SEQ ID NO: 727477 - RNA, 13 nt, Haemophilus influenzae Rd
aaaccaagugaaa

SEQ ID NO: 727478 - RNA, 21 nt, Haemophilus influenzae Rd
aaaccaagugaaauucuaccu

SEQ ID NO: 727479 - RNA, 15 nt, Haemophilus influenzae Rd
aaaccaauaagauag

SEQ ID NO: 727480 - RNA, 14 nt, Haemophilus influenzae Rd
aaaccaacgaaaau

SEQ ID NO: 727481 - RNA, 15 nt, Haemophilus influenzae Rd
aaaccaacgaaaaua

SEQ ID NO: 727482 - RNA, 22 nt, Haemophilus influenzae Rd
aaaccaagagccuccacaagca

SEQ ID NO: 727483 - RNA, 16 nt, Haemophilus influenzae Rd
ccgaagugaauaaugu

SEQ ID NO: 727484 - RNA, 22 nt, Haemophilus influenzae Rd
aaacauuucuaucgcauuuuac

SEQ ID NO: 727485 - RNA, 23 nt, Haemophilus influenzae Rd
aaacauuucuaucgcauuuuaca

SEQ ID NO: 727486 - RNA, 15 nt, Haemophilus influenzae Rd
ccgaauguggcagca

SEQ ID NO: 727487 - RNA, 17 nt, Haemophilus influenzae Rd
ccgaauguggcagcaaa

SEQ ID NO: 727488 - RNA, 13 nt, Haemophilus influenzae Rd
aaacauuugaccu

SEQ ID NO: 727489 - RNA, 22 nt, Haemophilus influenzae Rd
ccgaguaaauucaccaauuccg

SEQ ID NO: 727490 - RNA, 19 nt, Haemophilus influenzae Rd
ccgauaaaaccuaaaauug

SEQ ID NO: 727491 - RNA, 19 nt, Haemophilus influenzae Rd
ccgauaaaugcacauuuuu

SEQ ID NO: 727492 - RNA, 22 nt, Haemophilus influenzae Rd
ccgcaagaggaauuucgacaua

SEQ ID NO: 727493 - RNA, 18 nt, Haemophilus influenzae Rd
ccgcaagugguaaaaucc

SEQ ID NO: 727494 - RNA, 16 nt, Haemophilus influenzae Rd
ccgcaacuaauaaacc

SEQ ID NO: 727495 - RNA, 12 nt, Haemophilus influenzae Rd
ccgauauuuucc

SEQ ID NO: 727496 - RNA, 21 nt, Haemophilus influenzae Rd
aaaccgcaucaaaauuauaaa

SEQ ID NO: 727497 - RNA, 14 nt, Haemophilus influenzae Rd
aaaccgauuuugac

SEQ ID NO: 727498 - RNA, 15 nt, Haemophilus influenzae Rd
aaacccuguuuuaag

SEQ ID NO: 727499 - RNA, 12 nt, Haemophilus influenzae Rd
ccgcagcaauua

SEQ ID NO: 727500 - RNA, 23 nt, Haemophilus influenzae Rd
ccgcgaaaugcggacuuuuucau

SEQ ID NO: 727501 - RNA, 13 nt, Haemophilus influenzae Rd
ccgccuuuguuuu

SEQ ID NO: 727502 - RNA, 12 nt, Haemophilus influenzae Rd
ccgccuucuucc

SEQ ID NO: 727503 - RNA, 13 nt, Haemophilus influenzae Rd
ccgccuucuucca

SEQ ID NO: 727504 - RNA, 20 nt, Haemophilus influenzae Rd
ccgcuaauaaucgcaaugcc

SEQ ID NO: 727505 - RNA, 22 nt, Haemophilus influenzae Rd
ccgcuuguaauuucauuuuaac

SEQ ID NO: 727506 - RNA, 23 nt, Haemophilus influenzae Rd
ccgcuugaacauaagcaacauau

SEQ ID NO: 727507 - RNA, 13 nt, Haemophilus influenzae Rd
ccgcuugcaacca

SEQ ID NO: 727508 - RNA, 17 nt, Haemophilus influenzae Rd
ccgcugcagcuucagca

SEQ ID NO: 727509 - RNA, 14 nt, Haemophilus influenzae Rd
ccgcucuuuucggu

SEQ ID NO: 727510 - RNA, 16 nt, Haemophilus influenzae Rd
ccgcugccuugauuug

SEQ ID NO: 727511 - RNA, 20 nt, Haemophilus influenzae Rd
aaaccgcugucauauucauu

SEQ ID NO: 727512 - RNA, 21 nt, Haemophilus influenzae Rd
aaaccgcugucauauucauuu

SEQ ID NO: 727513 - RNA, 23 nt, Haemophilus influenzae Rd
aaaccgcugucauauucauuuuc

SEQ ID NO: 727514 - RNA, 19 nt, Haemophilus influenzae Rd
aaaccugcaaggauauuuc

SEQ ID NO: 727515 - RNA, 22 nt, Haemophilus influenzae Rd
aaaccugcaaggauauuuccau

SEQ ID NO: 727516 - RNA, 16 nt, Haemophilus influenzae Rd
aaaccucgccuuguaa

SEQ ID NO: 727517 - RNA, 17 nt, Haemophilus influenzae Rd
aaaccugaguaaauaaa

SEQ ID NO: 727518 - RNA, 15 nt, Haemophilus influenzae Rd
ccguauuggcgaccg

SEQ ID NO: 727519 - RNA, 15 nt, Haemophilus influenzae Rd
ccguauugaauaauu

SEQ ID NO: 727520 - RNA, 14 nt, Haemophilus influenzae Rd
ccgucauuuauaaa

SEQ ID NO: 727521 - RNA, 18 nt, Haemophilus influenzae Rd
ccgucauuuucaagccac

SEQ ID NO: 727522 - RNA, 18 nt, Haemophilus influenzae Rd
ccgucaugggauaaacau

SEQ ID NO: 727523 - RNA, 13 nt, Haemophilus influenzae Rd
aaaccuuauugca

SEQ ID NO: 727524 - RNA, 19 nt, Haemophilus influenzae Rd
aaaccuuauuuuaaauaaa

SEQ ID NO: 727525 - RNA, 22 nt, Haemophilus influenzae Rd
aaaccuuauuuuaaauaaaaaa

SEQ ID NO: 727526 - RNA, 21 nt, Haemophilus influenzae Rd
aaaccuucuggguaaaauaau

SEQ ID NO: 727527 - RNA, 16 nt, Haemophilus influenzae Rd
aaacgaaaaaaauaaa

SEQ ID NO: 727528 - RNA, 20 nt, Haemophilus influenzae Rd
aaaccuuucuguaaauaugc

SEQ ID NO: 727529 - RNA, 14 nt, Haemophilus influenzae Rd
aaaccuuuuucuaa

SEQ ID NO: 727530 - RNA, 16 nt, Haemophilus influenzae Rd
aaaccuuuuucuucca

SEQ ID NO: 727531 - RNA, 18 nt, Haemophilus influenzae Rd
aaaccuuuuucuuccauu

SEQ ID NO: 727532 - RNA, 21 nt, Haemophilus influenzae Rd
aaaccuuuuucuuccauuuca

SEQ ID NO: 727533 - RNA, 21 nt, Haemophilus influenzae Rd
aaaccuuuuugcguauccgcu

SEQ ID NO: 727534 - RNA, 22 nt, Haemophilus influenzae Rd
aaacgaacuggcugagagaaga

SEQ ID NO: 727535 - RNA, 23 nt, Haemophilus influenzae Rd
ccgucagccaaauuuuucuuuuc

SEQ ID NO: 727536 - RNA, 16 nt, Haemophilus influenzae Rd
aaacgauucacgaaua

SEQ ID NO: 727537 - RNA, 19 nt, Haemophilus influenzae Rd
aaacgauucacgaauacau

SEQ ID NO: 727538 - RNA, 20 nt, Haemophilus influenzae Rd
aaacgauucacgaauacauc

SEQ ID NO: 727539 - RNA, 18 nt, Haemophilus influenzae Rd
aaaccuuguaaagcacca

SEQ ID NO: 727540 - RNA, 23 nt, Haemophilus influenzae Rd
ccgucgcccaaguaucuaccaug

SEQ ID NO: 727541 - RNA, 13 nt, Haemophilus influenzae Rd
ccgugagcauuua

SEQ ID NO: 727542 - RNA, 15 nt, Haemophilus influenzae Rd
ccuauuaauuuaauu

SEQ ID NO: 727543 - RNA, 22 nt, Haemophilus influenzae Rd
ccuauuaguauuuaagcugaaa

SEQ ID NO: 727544 - RNA, 22 nt, Haemophilus influenzae Rd
ccuaucucauccacuaaaccau

SEQ ID NO: 727545 - RNA, 15 nt, Haemophilus influenzae Rd
aaacgcauagaaauu

SEQ ID NO: 727546 - RNA, 18 nt, Haemophilus influenzae Rd
aaacgcacuugauuugcu

SEQ ID NO: 727547 - RNA, 23 nt, Haemophilus influenzae Rd
aaacgcacuugauuugcuuggaa

SEQ ID NO: 727548 - RNA, 19 nt, Haemophilus influenzae Rd
aaacgccaucaaccauaac

SEQ ID NO: 727549 - RNA, 13 nt, Haemophilus influenzae Rd
aaacgcccauuua

SEQ ID NO: 727550 - RNA, 12 nt, Haemophilus influenzae Rd
ccucaucuuuuu

SEQ ID NO: 727551 - RNA, 16 nt, Haemophilus influenzae Rd
aaacgccguucaaaau

SEQ ID NO: 727552 - RNA, 20 nt, Haemophilus influenzae Rd
ccucccuaaugauuaauuaa

SEQ ID NO: 727553 - RNA, 23 nt, Haemophilus influenzae Rd
ccuccuaaugcagcagcuucuuc

SEQ ID NO: 727554 - RNA, 21 nt, Haemophilus influenzae Rd
ccucgccauuuugaggaauaa

SEQ ID NO: 727555 - RNA, 20 nt, Haemophilus influenzae Rd
ccucuaaauaaaaacgcccu

SEQ ID NO: 727556 - RNA, 19 nt, Haemophilus influenzae Rd
ccucucgccaaaucucaaa

SEQ ID NO: 727557 - RNA, 23 nt, Haemophilus influenzae Rd
ccucucgggugcgccauuuuuaa

SEQ ID NO: 727558 - RNA, 18 nt, Haemophilus influenzae Rd
ccugaauuaccauaaaac

SEQ ID NO: 727559 - RNA, 17 nt, Haemophilus influenzae Rd
ccugauaaguagaaaaa

SEQ ID NO: 727560 - RNA, 21 nt, Haemophilus influenzae Rd
ccugauaaguagaaaaauugg

SEQ ID NO: 727561 - RNA, 15 nt, Haemophilus influenzae Rd
ccucuucauugugga

SEQ ID NO: 727562 - RNA, 13 nt, Haemophilus influenzae Rd
ccucuguauuuuu

SEQ ID NO: 727563 - RNA, 14 nt, Haemophilus influenzae Rd
ccucuguauuuuuc

SEQ ID NO: 727564 - RNA, 21 nt, Haemophilus influenzae Rd
ccucuucuuuugcaaaaauga

SEQ ID NO: 727565 - RNA, 18 nt, Haemophilus influenzae Rd
ccugcauuuucuuucguc

SEQ ID NO: 727566 - RNA, 13 nt, Haemophilus influenzae Rd
ccugauguuugag

SEQ ID NO: 727567 - RNA, 13 nt, Haemophilus influenzae Rd
ccugcagaaaggc

SEQ ID NO: 727568 - RNA, 23 nt, Haemophilus influenzae Rd
ccugcaauugugucauucgcauc

SEQ ID NO: 727569 - RNA, 15 nt, Haemophilus influenzae Rd
ccugcagagaagaaa

SEQ ID NO: 727570 - RNA, 22 nt, Haemophilus influenzae Rd
ccugcagagaagaaauacaauc

SEQ ID NO: 727571 - RNA, 20 nt, Haemophilus influenzae Rd
ccugauucauugcauuuuua

SEQ ID NO: 727572 - RNA, 15 nt, Haemophilus influenzae Rd
ccugauuuuuuuaga

SEQ ID NO: 727573 - RNA, 15 nt, Haemophilus influenzae Rd
ccugcaaagccuuca

SEQ ID NO: 727574 - RNA, 16 nt, Haemophilus influenzae Rd
ccugcuacauauucaa

SEQ ID NO: 727575 - RNA, 20 nt, Haemophilus influenzae Rd
ccugcuaauggcugaucuug

SEQ ID NO: 727576 - RNA, 22 nt, Haemophilus influenzae Rd
ccugucaguuugcuuugauaaa

SEQ ID NO: 727577 - RNA, 14 nt, Haemophilus influenzae Rd
ccugucauauaaag

SEQ ID NO: 727578 - RNA, 18 nt, Haemophilus influenzae Rd
ccugucaucgguucuuuu

SEQ ID NO: 727579 - RNA, 16 nt, Haemophilus influenzae Rd
ccugucaauuuuucua

SEQ ID NO: 727580 - RNA, 17 nt, Haemophilus influenzae Rd
ccugucaauuuuucuac

SEQ ID NO: 727581 - RNA, 14 nt, Haemophilus influenzae Rd
ccugugcauugcua

SEQ ID NO: 727582 - RNA, 18 nt, Haemophilus influenzae Rd
ccuguuugugcacagauu

SEQ ID NO: 727583 - RNA, 18 nt, Haemophilus influenzae Rd
ccuguuugagcaagaacu

SEQ ID NO: 727584 - RNA, 19 nt, Haemophilus influenzae Rd
ccuuaaacaaauguaucug

SEQ ID NO: 727585 - RNA, 17 nt, Haemophilus influenzae Rd
ccuguugcgacagauac

SEQ ID NO: 727586 - RNA, 17 nt, Haemophilus influenzae Rd
ccuguugauguuuuaac

SEQ ID NO: 727587 - RNA, 19 nt, Haemophilus influenzae Rd
ccuuagcgugaauauauua

SEQ ID NO: 727588 - RNA, 14 nt, Haemophilus influenzae Rd
ccuuagauuuaagc

SEQ ID NO: 727589 - RNA, 18 nt, Haemophilus influenzae Rd
ccuuaaaucaaacaaaau

SEQ ID NO: 727590 - RNA, 13 nt, Haemophilus influenzae Rd
ccuuaacauuuuc

SEQ ID NO: 727591 - RNA, 22 nt, Haemophilus influenzae Rd
ccuucauugauggaauaaauuu

SEQ ID NO: 727592 - RNA, 16 nt, Haemophilus influenzae Rd
ccuucaucgucuucuu

SEQ ID NO: 727593 - RNA, 15 nt, Haemophilus influenzae Rd
ccuuccaucuuuuug

SEQ ID NO: 727594 - RNA, 20 nt, Haemophilus influenzae Rd
ccuuccaaauccaucauuuc

SEQ ID NO: 727595 - RNA, 13 nt, Haemophilus influenzae Rd
ccuucuaacgcca

SEQ ID NO: 727596 - RNA, 14 nt, Haemophilus influenzae Rd
ccuucuaacgccau

SEQ ID NO: 727597 - RNA, 17 nt, Haemophilus influenzae Rd
ccuucuaugccaaucac

SEQ ID NO: 727598 - RNA, 13 nt, Haemophilus influenzae Rd
ccuugcgcugcuu

SEQ ID NO: 727599 - RNA, 15 nt, Haemophilus influenzae Rd
ccuugcgcugcuuua

SEQ ID NO: 727600 - RNA, 14 nt, Haemophilus influenzae Rd
ccuugagccaguuu

SEQ ID NO: 727601 - RNA, 21 nt, Haemophilus influenzae Rd
ccuugauaaguaggcaaaauc

SEQ ID NO: 727602 - RNA, 21 nt, Haemophilus influenzae Rd
ccuucugcggaaaugaaacca

SEQ ID NO: 727603 - RNA, 20 nt, Haemophilus influenzae Rd
ccuugcauaauuccuuuuuc

SEQ ID NO: 727604 - RNA, 18 nt, Haemophilus influenzae Rd
ccuugauuauuuuuuaac

SEQ ID NO: 727605 - RNA, 20 nt, Haemophilus influenzae Rd
ccuuuuuuauaggauuaacg

SEQ ID NO: 727606 - RNA, 17 nt, Haemophilus influenzae Rd
ccuuuuucuacuucuuc

SEQ ID NO: 727607 - RNA, 13 nt, Haemophilus influenzae Rd
cgaaaaaaauaaa

SEQ ID NO: 727608 - RNA, 17 nt, Haemophilus influenzae Rd
cgaaaaaaauaaaaaau

SEQ ID NO: 727609 - RNA, 20 nt, Haemophilus influenzae Rd
cgaaaaaagagguuauauua

SEQ ID NO: 727610 - RNA, 13 nt, Haemophilus influenzae Rd
cgaaaacuuucau

SEQ ID NO: 727611 - RNA, 16 nt, Haemophilus influenzae Rd
ccuuuucauaaaaauu

SEQ ID NO: 727612 - RNA, 16 nt, Haemophilus influenzae Rd
ccuuuuauuucuuaga

SEQ ID NO: 727613 - RNA, 22 nt, Haemophilus influenzae Rd
ccuuuuaguucguuuuuuagcu

SEQ ID NO: 727614 - RNA, 17 nt, Haemophilus influenzae Rd
ccuuuuaguuuccccug

SEQ ID NO: 727615 - RNA, 23 nt, Haemophilus influenzae Rd
ccuuuuaccaauugauuuuucaa

SEQ ID NO: 727616 - RNA, 21 nt, Haemophilus influenzae Rd
ccuuuguugucguuauuauga

SEQ ID NO: 727617 - RNA, 22 nt, Haemophilus influenzae Rd
ccuuuguugucguuauuaugaa

SEQ ID NO: 727618 - RNA, 18 nt, Haemophilus influenzae Rd
cgaaaauggcuaaauuca

SEQ ID NO: 727619 - RNA, 18 nt, Haemophilus influenzae Rd
cgaaaugcggacuuuuuc

SEQ ID NO: 727620 - RNA, 20 nt, Haemophilus influenzae Rd
cgaaaugcggacuuuuucau

SEQ ID NO: 727621 - RNA, 20 nt, Haemophilus influenzae Rd
cgaaauuaaaauaauaucca

SEQ ID NO: 727622 - RNA, 21 nt, Haemophilus influenzae Rd
cgaaauuaauuugggugguuu

SEQ ID NO: 727623 - RNA, 23 nt, Haemophilus influenzae Rd
cgaaagguguuuuuuuauuaucu

SEQ ID NO: 727624 - RNA, 20 nt, Haemophilus influenzae Rd
cgaaauaaccuagaacaaaa

SEQ ID NO: 727625 - RNA, 22 nt, Haemophilus influenzae Rd
cgaaaggcgagggauuuuaaau

SEQ ID NO: 727626 - RNA, 18 nt, Haemophilus influenzae Rd
cgaaaggcuacuuuauuu

SEQ ID NO: 727627 - RNA, 18 nt, Haemophilus influenzae Rd
cgaacagccgcaauggcg

SEQ ID NO: 727628 - RNA, 17 nt, Haemophilus influenzae Rd
cgaacacuguaaauaaa

SEQ ID NO: 727629 - RNA, 17 nt, Haemophilus influenzae Rd
cgaacaauuucuuuacc

SEQ ID NO: 727630 - RNA, 14 nt, Haemophilus influenzae Rd
cgaaccgagcuaca

SEQ ID NO: 727631 - RNA, 19 nt, Haemophilus influenzae Rd
cgaacaucguggucaccaa

SEQ ID NO: 727632 - RNA, 18 nt, Haemophilus influenzae Rd
cgaagcgcauuuaaauaa

SEQ ID NO: 727633 - RNA, 20 nt, Haemophilus influenzae Rd
cgaagccuaaaucuucuuua

SEQ ID NO: 727634 - RNA, 17 nt, Haemophilus influenzae Rd
caucuucauuaaacuga

SEQ ID NO: 727635 - RNA, 18 nt, Haemophilus influenzae Rd
caucuucagcauuuaaaa

SEQ ID NO: 727636 - RNA, 12 nt, Haemophilus influenzae Rd
caucuucaucaa

SEQ ID NO: 727637 - RNA, 12 nt, Haemophilus influenzae Rd
cauguacauuaa

SEQ ID NO: 727638 - RNA, 13 nt, Haemophilus influenzae Rd
cauguacauuaau

SEQ ID NO: 727639 - RNA, 18 nt, Haemophilus influenzae Rd
caugggugugaaaguacu

SEQ ID NO: 727640 - RNA, 23 nt, Haemophilus influenzae Rd
cauuaagccugcuacagaagcug

SEQ ID NO: 727641 - RNA, 15 nt, Haemophilus influenzae Rd
cauuaaggcuuuucu

SEQ ID NO: 727642 - RNA, 22 nt, Haemophilus influenzae Rd
cauuaagugcguguauauauuu

SEQ ID NO: 727643 - RNA, 15 nt, Haemophilus influenzae Rd
cauuaaguuuuuagc

SEQ ID NO: 727644 - RNA, 22 nt, Haemophilus influenzae Rd
cauuaauaaaccaacauacauu

SEQ ID NO: 727645 - RNA, 11 nt, Haemophilus influenzae Rd
cauuaauaacu

SEQ ID NO: 727646 - RNA, 17 nt, Haemophilus influenzae Rd
cauuaauaucuuuaaca

SEQ ID NO: 727647 - RNA, 13 nt, Haemophilus influenzae Rd
cauuaauacuuuu

SEQ ID NO: 727648 - RNA, 16 nt, Haemophilus influenzae Rd
cauuacauaaaaccaa

SEQ ID NO: 727649 - RNA, 16 nt, Haemophilus influenzae Rd
cauuacgugcaaauaa

SEQ ID NO: 727650 - RNA, 17 nt, Haemophilus influenzae Rd
cauuacgugcaaauaaa

SEQ ID NO: 727651 - RNA, 15 nt, Haemophilus influenzae Rd
cauuacguucauaua

SEQ ID NO: 727652 - RNA, 21 nt, Haemophilus influenzae Rd
cauuagcauccacaccaccag

SEQ ID NO: 727653 - RNA, 19 nt, Haemophilus influenzae Rd
cauuagaaaguuguuucau

SEQ ID NO: 727654 - RNA, 18 nt, Haemophilus influenzae Rd
cauuaccgccagugauuu

SEQ ID NO: 727655 - RNA, 15 nt, Haemophilus influenzae Rd
cauuacauccacuuu

SEQ ID NO: 727656 - RNA, 14 nt, Haemophilus influenzae Rd
cauucgcauauuuu

SEQ ID NO: 727657 - RNA, 15 nt, Haemophilus influenzae Rd
cauucgcauauuuuu

SEQ ID NO: 727658 - RNA, 23 nt, Haemophilus influenzae Rd
cauucgccguuaguuuguauuug

SEQ ID NO: 727659 - RNA, 14 nt, Haemophilus influenzae Rd
cauucgccuaaugc

SEQ ID NO: 727660 - RNA, 20 nt, Haemophilus influenzae Rd
cauuccugcaagaaaaaugu

SEQ ID NO: 727661 - RNA, 23 nt, Haemophilus influenzae Rd
cauucaagccuucuaaaauaaga

SEQ ID NO: 727662 - RNA, 13 nt, Haemophilus influenzae Rd
cauucaucaaaac

SEQ ID NO: 727663 - RNA, 20 nt, Haemophilus influenzae Rd
cauucaucaaaucauuuuuu

SEQ ID NO: 727664 - RNA, 21 nt, Haemophilus influenzae Rd
cauuaggguacauuugacgaa

SEQ ID NO: 727665 - RNA, 17 nt, Haemophilus influenzae Rd
cauuaggaauaucuuug

SEQ ID NO: 727666 - RNA, 19 nt, Haemophilus influenzae Rd
cauuaggaauaucuuugac

SEQ ID NO: 727667 - RNA, 17 nt, Haemophilus influenzae Rd
cauuagucgucuauuua

SEQ ID NO: 727668 - RNA, 18 nt, Haemophilus influenzae Rd
cauuagucgucuauuuau

SEQ ID NO: 727669 - RNA, 19 nt, Haemophilus influenzae Rd
cauuagucgucuauuuauu

SEQ ID NO: 727670 - RNA, 13 nt, Haemophilus influenzae Rd
cauuaguuguuuu

SEQ ID NO: 727671 - RNA, 14 nt, Haemophilus influenzae Rd
cauuaguuguuuua

SEQ ID NO: 727672 - RNA, 11 nt, Haemophilus influenzae Rd
cauucaaugca

SEQ ID NO: 727673 - RNA, 22 nt, Haemophilus influenzae Rd
cauucaaugcaacaauacguug

SEQ ID NO: 727674 - RNA, 18 nt, Haemophilus influenzae Rd
cauucaaugcagaaauac

SEQ ID NO: 727675 - RNA, 19 nt, Haemophilus influenzae Rd
cauucaaugcagaaauacu

SEQ ID NO: 727676 - RNA, 15 nt, Haemophilus influenzae Rd
cauuauugccaauua

SEQ ID NO: 727677 - RNA, 14 nt, Haemophilus influenzae Rd
cauuauugccuuuc

SEQ ID NO: 727678 - RNA, 18 nt, Haemophilus influenzae Rd
cauucaaaaauaaagccc

SEQ ID NO: 727679 - RNA, 16 nt, Haemophilus influenzae Rd
cauugcauuuuuauaa

SEQ ID NO: 727680 - RNA, 23 nt, Haemophilus influenzae Rd
cauugcccgcuucuucgauaaaa

SEQ ID NO: 727681 - RNA, 19 nt, Haemophilus influenzae Rd
cauugcaagugcaguuuca

SEQ ID NO: 727682 - RNA, 14 nt, Haemophilus influenzae Rd
cauugcaauuucag

SEQ ID NO: 727683 - RNA, 19 nt, Haemophilus influenzae Rd
cauugcauccacuucaucc

SEQ ID NO: 727684 - RNA, 20 nt, Haemophilus influenzae Rd
cauugauugcuuuaacugaa

SEQ ID NO: 727685 - RNA, 12 nt, Haemophilus influenzae Rd
cauucuaauccu

SEQ ID NO: 727686 - RNA, 16 nt, Haemophilus influenzae Rd
cauugccuaaauacau

SEQ ID NO: 727687 - RNA, 15 nt, Haemophilus influenzae Rd
cauugcgccuuuuug

SEQ ID NO: 727688 - RNA, 21 nt, Haemophilus influenzae Rd
cauugcgccuuuuuggaaacg

SEQ ID NO: 727689 - RNA, 17 nt, Haemophilus influenzae Rd
cauugcuccacuucuua

SEQ ID NO: 727690 - RNA, 23 nt, Haemophilus influenzae Rd
cauugcucgauaaguaaugaaaa

SEQ ID NO: 727691 - RNA, 13 nt, Haemophilus influenzae Rd
cauugcguuuuac

SEQ ID NO: 727692 - RNA, 15 nt, Haemophilus influenzae Rd
cauugcuaaauuuau

SEQ ID NO: 727693 - RNA, 15 nt, Haemophilus influenzae Rd
cauugcuauggcaau

SEQ ID NO: 727694 - RNA, 15 nt, Haemophilus influenzae Rd
cauugcguucacuca

SEQ ID NO: 727695 - RNA, 16 nt, Haemophilus influenzae Rd
cauugcguucacucac

SEQ ID NO: 727696 - RNA, 21 nt, Haemophilus influenzae Rd
cauuggaaaaugcuuauaaaa

SEQ ID NO: 727697 - RNA, 15 nt, Haemophilus influenzae Rd
cauugcuuaacauua

SEQ ID NO: 727698 - RNA, 20 nt, Haemophilus influenzae Rd
cauuguuacaaauuccucug

SEQ ID NO: 727699 - RNA, 13 nt, Haemophilus influenzae Rd
cauuguggaaacg

SEQ ID NO: 727700 - RNA, 18 nt, Haemophilus influenzae Rd
cauuguuugauccuuuau

SEQ ID NO: 727701 - RNA, 20 nt, Haemophilus influenzae Rd
cauuguuugcuaauguaguu

SEQ ID NO: 727702 - RNA, 16 nt, Haemophilus influenzae Rd
cauugugggcuuuaag

SEQ ID NO: 727703 - RNA, 14 nt, Haemophilus influenzae Rd
cauugucuuuuacg

SEQ ID NO: 727704 - RNA, 11 nt, Haemophilus influenzae Rd
cauuuaaauaa

SEQ ID NO: 727705 - RNA, 19 nt, Haemophilus influenzae Rd
cauuuaaaacaaaaggccu

SEQ ID NO: 727706 - RNA, 15 nt, Haemophilus influenzae Rd
cauuuaaaaguaaaa

SEQ ID NO: 727707 - RNA, 18 nt, Haemophilus influenzae Rd
cauuuaaaaguaaaaaua

SEQ ID NO: 727708 - RNA, 20 nt, Haemophilus influenzae Rd
cauuuaaaaguaaaaauaaa

SEQ ID NO: 727709 - RNA, 22 nt, Haemophilus influenzae Rd
cauuuaaaaguaaaaauaaaaa

SEQ ID NO: 727710 - RNA, 14 nt, Haemophilus influenzae Rd
cauuuaaaauauau

SEQ ID NO: 727711 - RNA, 16 nt, Haemophilus influenzae Rd
cauuuaauccugucau

SEQ ID NO: 727712 - RNA, 19 nt, Haemophilus influenzae Rd
cauuuaauccugucaucug

SEQ ID NO: 727713 - RNA, 16 nt, Haemophilus influenzae Rd
cauuuaauaaaacaaa

SEQ ID NO: 727714 - RNA, 14 nt, Haemophilus influenzae Rd
cauuuaauucugag

SEQ ID NO: 727715 - RNA, 19 nt, Haemophilus influenzae Rd
cauuuaacggggauuuuuu

SEQ ID NO: 727716 - RNA, 23 nt, Haemophilus influenzae Rd
cauuuaacggggauuuuuuauaa

SEQ ID NO: 727717 - RNA, 18 nt, Haemophilus influenzae Rd
cauuggauaauugccacu

SEQ ID NO: 727718 - RNA, 17 nt, Haemophilus influenzae Rd
cauuggauuaaucaauu

SEQ ID NO: 727719 - RNA, 18 nt, Haemophilus influenzae Rd
cauuggaaugguauaaaa

SEQ ID NO: 727720 - RNA, 17 nt, Haemophilus influenzae Rd
cauugggcguaauguug

SEQ ID NO: 727721 - RNA, 16 nt, Haemophilus influenzae Rd
cauuggggaacggaag

SEQ ID NO: 727722 - RNA, 19 nt, Haemophilus influenzae Rd
cauuggcugaauuuaauuc

SEQ ID NO: 727723 - RNA, 22 nt, Haemophilus influenzae Rd
cauuguccacagcaaaagaaau

SEQ ID NO: 727724 - RNA, 24 nt, Haemophilus influenzae Rd
cauuguaaaccaaauuucuugcua

SEQ ID NO: 727725 - RNA, 15 nt, Haemophilus influenzae Rd
cauuggugaaaucaa

SEQ ID NO: 727726 - RNA, 14 nt, Haemophilus influenzae Rd
cauuugaccugcgu

SEQ ID NO: 727727 - RNA, 15 nt, Haemophilus influenzae Rd
cauuugauacagcca

SEQ ID NO: 727728 - RNA, 14 nt, Haemophilus influenzae Rd
cauuugaagauuaa

SEQ ID NO: 727729 - RNA, 14 nt, Haemophilus influenzae Rd
cauuugaauuaaua

SEQ ID NO: 727730 - RNA, 23 nt, Haemophilus influenzae Rd
cauuugaauuuuacuucuucagg

SEQ ID NO: 727731 - RNA, 15 nt, Haemophilus influenzae Rd
cauuugagaugaaaa

SEQ ID NO: 727732 - RNA, 18 nt, Haemophilus influenzae Rd
cauuugcgccaauaauaa

SEQ ID NO: 727733 - RNA, 19 nt, Haemophilus influenzae Rd
cauuugccaaaacgcaauu

SEQ ID NO: 727734 - RNA, 13 nt, Haemophilus influenzae Rd
cauuugcauaaag

SEQ ID NO: 727735 - RNA, 15 nt, Haemophilus influenzae Rd
cauuugcaaaucaag

SEQ ID NO: 727736 - RNA, 14 nt, Haemophilus influenzae Rd
cauuugcacccgcu

SEQ ID NO: 727737 - RNA, 13 nt, Haemophilus influenzae Rd
cauuucuaaaaua

SEQ ID NO: 727738 - RNA, 21 nt, Haemophilus influenzae Rd
cauuucuaaaauaauaucaca

SEQ ID NO: 727739 - RNA, 13 nt, Haemophilus influenzae Rd
cauuucuaaagga

SEQ ID NO: 727740 - RNA, 21 nt, Haemophilus influenzae Rd
cauuucuaaaggcaauuccca

SEQ ID NO: 727741 - RNA, 12 nt, Haemophilus influenzae Rd
cauuucuaaaua

SEQ ID NO: 727742 - RNA, 17 nt, Haemophilus influenzae Rd
cauuucuaaugcaauuu

SEQ ID NO: 727743 - RNA, 18 nt, Haemophilus influenzae Rd
cauuuuacagauuuuggu

SEQ ID NO: 727744 - RNA, 17 nt, Haemophilus influenzae Rd
cauuuuaaucauaaaaa

SEQ ID NO: 727745 - RNA, 14 nt, Haemophilus influenzae Rd
cauuuuacaauacc

SEQ ID NO: 727746 - RNA, 16 nt, Haemophilus influenzae Rd
cauuuuacaauaccaa

SEQ ID NO: 727747 - RNA, 19 nt, Haemophilus influenzae Rd
cauuuuaacucagggaaau

SEQ ID NO: 727748 - RNA, 22 nt, Haemophilus influenzae Rd
cauuuuaacucagggaaaugua

SEQ ID NO: 727749 - RNA, 15 nt, Haemophilus influenzae Rd
cauuuuaaauuauuu

SEQ ID NO: 727750 - RNA, 17 nt, Haemophilus influenzae Rd
cauuuguugguaaaucu

SEQ ID NO: 727751 - RNA, 19 nt, Haemophilus influenzae Rd
cauuuguugguaaaucuaa

SEQ ID NO: 727752 - RNA, 21 nt, Haemophilus influenzae Rd
cauuuguugguaaaucuaaca

SEQ ID NO: 727753 - RNA, 10 nt, Haemophilus influenzae Rd
cauuuuaaaa

SEQ ID NO: 727754 - RNA, 21 nt, Haemophilus influenzae Rd
cauuugcuucuaauuuuaaaa

SEQ ID NO: 727755 - RNA, 17 nt, Haemophilus influenzae Rd
cauuugguggcuuuuuu

SEQ ID NO: 727756 - RNA, 15 nt, Haemophilus influenzae Rd
cauuugggaauacca

SEQ ID NO: 727757 - RNA, 12 nt, Haemophilus influenzae Rd
cauuuguagaaa

SEQ ID NO: 727758 - RNA, 21 nt, Haemophilus influenzae Rd
cauuuauuaaaaguaaacaau

SEQ ID NO: 727759 - RNA, 12 nt, Haemophilus influenzae Rd
cauuuaucuucc

SEQ ID NO: 727760 - RNA, 15 nt, Haemophilus influenzae Rd
cauuuaucuuccaua

SEQ ID NO: 727761 - RNA, 14 nt, Haemophilus influenzae Rd
cauuuaucaaacaa

SEQ ID NO: 727762 - RNA, 22 nt, Haemophilus influenzae Rd
cauuuagugaccacauuucgag

SEQ ID NO: 727763 - RNA, 20 nt, Haemophilus influenzae Rd
cauuuagagggauaaaaauc

SEQ ID NO: 727764 - RNA, 23 nt, Haemophilus influenzae Rd
cauuuagagggauaaaaaucauc

SEQ ID NO: 727765 - RNA, 19 nt, Haemophilus influenzae Rd
cauuuacggcuuagauaau

SEQ ID NO: 727766 - RNA, 16 nt, Haemophilus influenzae Rd
cauuucacuaaauaaa

SEQ ID NO: 727767 - RNA, 17 nt, Haemophilus influenzae Rd
cauuucacuaaauaaau

SEQ ID NO: 727768 - RNA, 15 nt, Haemophilus influenzae Rd
cauuucaauuucacu

SEQ ID NO: 727769 - RNA, 19 nt, Haemophilus influenzae Rd
cauuucaccacuucaucca

SEQ ID NO: 727770 - RNA, 13 nt, Haemophilus influenzae Rd
cauuuauuuaaau

SEQ ID NO: 727771 - RNA, 20 nt, Haemophilus influenzae Rd
cauuucaucaggcauugcgc

SEQ ID NO: 727772 - RNA, 15 nt, Haemophilus influenzae Rd
cauuucaucugcugg

SEQ ID NO: 727773 - RNA, 13 nt, Haemophilus influenzae Rd
cauuucaucuuca

SEQ ID NO: 727774 - RNA, 15 nt, Haemophilus influenzae Rd
cauuucaucuucagu

SEQ ID NO: 727775 - RNA, 21 nt, Haemophilus influenzae Rd
cauuucccucaagacaaauuu

SEQ ID NO: 727776 - RNA, 15 nt, Haemophilus influenzae Rd
cauuucccuuagauu

SEQ ID NO: 727777 - RNA, 17 nt, Haemophilus influenzae Rd
cauuucgggcaaacgcu

SEQ ID NO: 727778 - RNA, 23 nt, Haemophilus influenzae Rd
cauuuccuuuacauuuaaacuca

SEQ ID NO: 727779 - RNA, 22 nt, Haemophilus influenzae Rd
cauuuccuuugagccuucaaaa

SEQ ID NO: 727780 - RNA, 22 nt, Haemophilus influenzae Rd
cauuuucacugauauagcuaga

SEQ ID NO: 727781 - RNA, 19 nt, Haemophilus influenzae Rd
cauuuuccaaccaaucagu

SEQ ID NO: 727782 - RNA, 23 nt, Haemophilus influenzae Rd
cauuuuauugaagaguaaaacua

SEQ ID NO: 727783 - RNA, 22 nt, Haemophilus influenzae Rd
cauuuucaagcccuuccaucuu

SEQ ID NO: 727784 - RNA, 23 nt, Haemophilus influenzae Rd
ccaaagcuguuugacaugacagu

SEQ ID NO: 727785 - RNA, 13 nt, Haemophilus influenzae Rd
ccaaagcuauuca

SEQ ID NO: 727786 - RNA, 14 nt, Haemophilus influenzae Rd
ccaaagcuauucau

SEQ ID NO: 727787 - RNA, 14 nt, Haemophilus influenzae Rd
ccaacauacauuaa

SEQ ID NO: 727788 - RNA, 14 nt, Haemophilus influenzae Rd
ccaacaacugcaca

SEQ ID NO: 727789 - RNA, 12 nt, Haemophilus influenzae Rd
ccaaauuuuucu

SEQ ID NO: 727790 - RNA, 21 nt, Haemophilus influenzae Rd
ccaaauuuuccgcauaaauaa

SEQ ID NO: 727791 - RNA, 22 nt, Haemophilus influenzae Rd
ccaaauuuuccgcauaaauaau

SEQ ID NO: 727792 - RNA, 15 nt, Haemophilus influenzae Rd
ccaaaucucaaaauc

SEQ ID NO: 727793 - RNA, 14 nt, Haemophilus influenzae Rd
ccaaauuucuugcu

SEQ ID NO: 727794 - RNA, 17 nt, Haemophilus influenzae Rd
ccaaaucgccuuuuuga

SEQ ID NO: 727795 - RNA, 18 nt, Haemophilus influenzae Rd
ccaagauaauaaaguuac

SEQ ID NO: 727796 - RNA, 23 nt, Haemophilus influenzae Rd
ccaagaggcucugaucacaauga

SEQ ID NO: 727797 - RNA, 13 nt, Haemophilus influenzae Rd
ccaagauucuaaa

SEQ ID NO: 727798 - RNA, 23 nt, Haemophilus influenzae Rd
ccaagcagccaaugcaacuugca

SEQ ID NO: 727799 - RNA, 18 nt, Haemophilus influenzae Rd
ccaagcaaagaaauuuua

SEQ ID NO: 727800 - RNA, 22 nt, Haemophilus influenzae Rd
ccaagcaauuucaucacaucaa

SEQ ID NO: 727801 - RNA, 23 nt, Haemophilus influenzae Rd
ccaagcuuuuucuuguucugccg

SEQ ID NO: 727802 - RNA, 15 nt, Haemophilus influenzae Rd
ccaacgcaucuauug

SEQ ID NO: 727803 - RNA, 14 nt, Haemophilus influenzae Rd
ccaacgaagaaaca

SEQ ID NO: 727804 - RNA, 12 nt, Haemophilus influenzae Rd
ccaacugagcua

SEQ ID NO: 727805 - RNA, 14 nt, Haemophilus influenzae Rd
ccaacguaaaaucg

SEQ ID NO: 727806 - RNA, 17 nt, Haemophilus influenzae Rd
ccaacguauuuauacca

SEQ ID NO: 727807 - RNA, 16 nt, Haemophilus influenzae Rd
ccaauacgauaauuaa

SEQ ID NO: 727808 - RNA, 14 nt, Haemophilus influenzae Rd
ccaauacagccgcu

SEQ ID NO: 727809 - RNA, 19 nt, Haemophilus influenzae Rd
ccaaguuuguuuuuuacga

SEQ ID NO: 727810 - RNA, 19 nt, Haemophilus influenzae Rd
ccaaguccccauuuguaga

SEQ ID NO: 727811 - RNA, 17 nt, Haemophilus influenzae Rd
ccaaucaguuuuacgcu

SEQ ID NO: 727812 - RNA, 13 nt, Haemophilus influenzae Rd
ccaaucauaaaau

SEQ ID NO: 727813 - RNA, 15 nt, Haemophilus influenzae Rd
ccaaucauauuucug

SEQ ID NO: 727814 - RNA, 19 nt, Haemophilus influenzae Rd
ccaaucaucagaauaauua

SEQ ID NO: 727815 - RNA, 16 nt, Haemophilus influenzae Rd
ccaauccauaaaauac

SEQ ID NO: 727816 - RNA, 21 nt, Haemophilus influenzae Rd
ccaauccacucuuuuaauaaa

SEQ ID NO: 727817 - RNA, 17 nt, Haemophilus influenzae Rd
ccaauccagauuaaaaa

SEQ ID NO: 727818 - RNA, 16 nt, Haemophilus influenzae Rd
ccaauauugaaaagua

SEQ ID NO: 727819 - RNA, 15 nt, Haemophilus influenzae Rd
ccaauauguuuacca

SEQ ID NO: 727820 - RNA, 15 nt, Haemophilus influenzae Rd
ccaauaugaacauua

SEQ ID NO: 727821 - RNA, 21 nt, Haemophilus influenzae Rd
ccaaucacuagccauaaauaa

SEQ ID NO: 727822 - RNA, 16 nt, Haemophilus influenzae Rd
ccaaucagcaaaacuu

SEQ ID NO: 727823 - RNA, 15 nt, Haemophilus influenzae Rd
ccaaucaagauaacu

SEQ ID NO: 727824 - RNA, 21 nt, Haemophilus influenzae Rd
ccaaucacagccgcauuuuua

SEQ ID NO: 727825 - RNA, 18 nt, Haemophilus influenzae Rd
ccaauggcaaucacaaau

SEQ ID NO: 727826 - RNA, 16 nt, Haemophilus influenzae Rd
ccaauuugugcgcaug

SEQ ID NO: 727827 - RNA, 18 nt, Haemophilus influenzae Rd
ccaauuuuucaaaacguu

SEQ ID NO: 727828 - RNA, 18 nt, Haemophilus influenzae Rd
ccaauugguaaaauuucu

SEQ ID NO: 727829 - RNA, 15 nt, Haemophilus influenzae Rd
ccaauucuuuuaaau

SEQ ID NO: 727830 - RNA, 13 nt, Haemophilus influenzae Rd
ccaauugcaacuu

SEQ ID NO: 727831 - RNA, 13 nt, Haemophilus influenzae Rd
ccaauuuuuucau

SEQ ID NO: 727832 - RNA, 15 nt, Haemophilus influenzae Rd
ccacagcaaaagaaa

SEQ ID NO: 727833 - RNA, 15 nt, Haemophilus influenzae Rd
ccaccacccuucuuu

SEQ ID NO: 727834 - RNA, 15 nt, Haemophilus influenzae Rd
ccaccguauugucaa

SEQ ID NO: 727835 - RNA, 18 nt, Haemophilus influenzae Rd
ccacgaggucaaucuuua

SEQ ID NO: 727836 - RNA, 14 nt, Haemophilus influenzae Rd
ccacgauaaauccu

SEQ ID NO: 727837 - RNA, 21 nt, Haemophilus influenzae Rd
ccacgauacggcaaauuaaau

SEQ ID NO: 727838 - RNA, 15 nt, Haemophilus influenzae Rd
ccacggcuugugauu

SEQ ID NO: 727839 - RNA, 16 nt, Haemophilus influenzae Rd
ccacggcuugccaauu

SEQ ID NO: 727840 - RNA, 16 nt, Haemophilus influenzae Rd
ccacguccacuucauc

SEQ ID NO: 727841 - RNA, 16 nt, Haemophilus influenzae Rd
ccacguauuuuuuaau

SEQ ID NO: 727842 - RNA, 20 nt, Haemophilus influenzae Rd
ccacgucaagugguuuauuu

SEQ ID NO: 727843 - RNA, 19 nt, Haemophilus influenzae Rd
ccacgguaaaucugauuca

SEQ ID NO: 727844 - RNA, 21 nt, Haemophilus influenzae Rd
ccacuacuaacguuucuaaua

SEQ ID NO: 727845 - RNA, 17 nt, Haemophilus influenzae Rd
ccacuaguucaucauca

SEQ ID NO: 727846 - RNA, 23 nt, Haemophilus influenzae Rd
ccacgccuguggcaaaaucucug

SEQ ID NO: 727847 - RNA, 24 nt, Haemophilus influenzae Rd
ccacggauaaaugcgugaacugcu

SEQ ID NO: 727848 - RNA, 19 nt, Haemophilus influenzae Rd
cagugguugcgauuuuugc

SEQ ID NO: 727849 - RNA, 13 nt, Haemophilus influenzae Rd
cagugcuuuuuca

SEQ ID NO: 727850 - RNA, 22 nt, Haemophilus influenzae Rd
caguuaugcaaauacauauuuu

SEQ ID NO: 727851 - RNA, 16 nt, Haemophilus influenzae Rd
caguuaucgccaauaa

SEQ ID NO: 727852 - RNA, 18 nt, Haemophilus influenzae Rd
caguuaagaaaauaauga

SEQ ID NO: 727853 - RNA, 14 nt, Haemophilus influenzae Rd
caguuaaaacugug

SEQ ID NO: 727854 - RNA, 12 nt, Haemophilus influenzae Rd
caguuaccauac

SEQ ID NO: 727855 - RNA, 13 nt, Haemophilus influenzae Rd
caguuaccauaca

SEQ ID NO: 727856 - RNA, 20 nt, Haemophilus influenzae Rd
caguuacugccucugccaca

SEQ ID NO: 727857 - RNA, 23 nt, Haemophilus influenzae Rd
caguuacugccucugccacauca

SEQ ID NO: 727858 - RNA, 22 nt, Haemophilus influenzae Rd
caguuagaacaacaauacguug

SEQ ID NO: 727859 - RNA, 12 nt, Haemophilus influenzae Rd
cagugucuuaac

SEQ ID NO: 727860 - RNA, 17 nt, Haemophilus influenzae Rd
caguuucugguuuaucg

SEQ ID NO: 727861 - RNA, 17 nt, Haemophilus influenzae Rd
caguuugaauaucuacg

SEQ ID NO: 727862 - RNA, 18 nt, Haemophilus influenzae Rd
caguuuuacguugcaacg

SEQ ID NO: 727863 - RNA, 14 nt, Haemophilus influenzae Rd
caguuuucaaauua

SEQ ID NO: 727864 - RNA, 19 nt, Haemophilus influenzae Rd
caguuucacauccacaaaa

SEQ ID NO: 727865 - RNA, 22 nt, Haemophilus influenzae Rd
caguuuauucagugcuuuuuca

SEQ ID NO: 727866 - RNA, 19 nt, Haemophilus influenzae Rd
caguuuagaaagcacuuca

SEQ ID NO: 727867 - RNA, 22 nt, Haemophilus influenzae Rd
caguuuaaaacuggguuuuuuu

SEQ ID NO: 727868 - RNA, 19 nt, Haemophilus influenzae Rd
caguuuaagcuacagugag

SEQ ID NO: 727869 - RNA, 19 nt, Haemophilus influenzae Rd
caguugcuucgccagcagu

SEQ ID NO: 727870 - RNA, 19 nt, Haemophilus influenzae Rd
caguucuccuucuccauuu

SEQ ID NO: 727871 - RNA, 19 nt, Haemophilus influenzae Rd
caguuccugacccacauca

SEQ ID NO: 727872 - RNA, 16 nt, Haemophilus influenzae Rd
cauaaguaaaaccauu

SEQ ID NO: 727873 - RNA, 18 nt, Haemophilus influenzae Rd
cauaaggaccaagcaaug

SEQ ID NO: 727874 - RNA, 18 nt, Haemophilus influenzae Rd
cauaagcugcaucaauau

SEQ ID NO: 727875 - RNA, 13 nt, Haemophilus influenzae Rd
cauaagaucuucu

SEQ ID NO: 727876 - RNA, 21 nt, Haemophilus influenzae Rd
cauaagaucuucuuugcgauu

SEQ ID NO: 727877 - RNA, 17 nt, Haemophilus influenzae Rd
cauaagcaauaauuuca

SEQ ID NO: 727878 - RNA, 14 nt, Haemophilus influenzae Rd
cauaacguauuuuc

SEQ ID NO: 727879 - RNA, 19 nt, Haemophilus influenzae Rd
cauaacguuuacgauacau

SEQ ID NO: 727880 - RNA, 17 nt, Haemophilus influenzae Rd
cauaacuuaugaauaau

SEQ ID NO: 727881 - RNA, 13 nt, Haemophilus influenzae Rd
cauaacuucacca

SEQ ID NO: 727882 - RNA, 12 nt, Haemophilus influenzae Rd
cauaacuuucca

SEQ ID NO: 727883 - RNA, 13 nt, Haemophilus influenzae Rd
cauaacgauaacu

SEQ ID NO: 727884 - RNA, 16 nt, Haemophilus influenzae Rd
cauaacgccaagguua

SEQ ID NO: 727885 - RNA, 20 nt, Haemophilus influenzae Rd
cauaacgccaagguuauuua

SEQ ID NO: 727886 - RNA, 18 nt, Haemophilus influenzae Rd
cauaacgcugcuuaaagc

SEQ ID NO: 727887 - RNA, 16 nt, Haemophilus influenzae Rd
cauaaccaaagggcac

SEQ ID NO: 727888 - RNA, 17 nt, Haemophilus influenzae Rd
cauaaaaggcaaagcaa

SEQ ID NO: 727889 - RNA, 13 nt, Haemophilus influenzae Rd
cauaaaaaaugac

SEQ ID NO: 727890 - RNA, 19 nt, Haemophilus influenzae Rd
cauaaaaaauggaauaaaa

SEQ ID NO: 727891 - RNA, 13 nt, Haemophilus influenzae Rd
cauaaaaacaaua

SEQ ID NO: 727892 - RNA, 21 nt, Haemophilus influenzae Rd
cauaaacagggugucguagaa

SEQ ID NO: 727893 - RNA, 22 nt, Haemophilus influenzae Rd
cauaaacggcugccgcaucaac

SEQ ID NO: 727894 - RNA, 16 nt, Haemophilus influenzae Rd
cauaaacgguauuuuc

SEQ ID NO: 727895 - RNA, 17 nt, Haemophilus influenzae Rd
cauaaacgguauuuucu

SEQ ID NO: 727896 - RNA, 14 nt, Haemophilus influenzae Rd
cauaaaccaacuau

SEQ ID NO: 727897 - RNA, 16 nt, Haemophilus influenzae Rd
cauaaacuaaaauauc

SEQ ID NO: 727898 - RNA, 14 nt, Haemophilus influenzae Rd
cauaaagaauaauu

SEQ ID NO: 727899 - RNA, 17 nt, Haemophilus influenzae Rd
cauaaagcucagccaaa

SEQ ID NO: 727900 - RNA, 16 nt, Haemophilus influenzae Rd
cauaaauaauaaagug

SEQ ID NO: 727901 - RNA, 18 nt, Haemophilus influenzae Rd
cauaaauuacaauguaag

SEQ ID NO: 727902 - RNA, 19 nt, Haemophilus influenzae Rd
cauaaauuccuuuuuaaug

SEQ ID NO: 727903 - RNA, 20 nt, Haemophilus influenzae Rd
cauaaaucggcguauuuuac

SEQ ID NO: 727904 - RNA, 21 nt, Haemophilus influenzae Rd
cauaaaucaucccuguauaaa

SEQ ID NO: 727905 - RNA, 16 nt, Haemophilus influenzae Rd
cauaaauaucaacagc

SEQ ID NO: 727906 - RNA, 19 nt, Haemophilus influenzae Rd
cauaaauaucaacagcuuc

SEQ ID NO: 727907 - RNA, 14 nt, Haemophilus influenzae Rd
cauaauggcuuaau

SEQ ID NO: 727908 - RNA, 17 nt, Haemophilus influenzae Rd
cauaauggcuuaauaau

SEQ ID NO: 727909 - RNA, 17 nt, Haemophilus influenzae Rd
cauaauccgcugcagcu

SEQ ID NO: 727910 - RNA, 14 nt, Haemophilus influenzae Rd
cauaauguucccua

SEQ ID NO: 727911 - RNA, 20 nt, Haemophilus influenzae Rd
cauaauguucccuauaaaua

SEQ ID NO: 727912 - RNA, 22 nt, Haemophilus influenzae Rd
cauaauguucccuauaaauaaa

SEQ ID NO: 727913 - RNA, 17 nt, Haemophilus influenzae Rd
cauaauuaaacagcaca

SEQ ID NO: 727914 - RNA, 13 nt, Haemophilus influenzae Rd
cauaauuccuuuu

SEQ ID NO: 727915 - RNA, 23 nt, Haemophilus influenzae Rd
cauaauuccuuuuucuacuucuu

SEQ ID NO: 727916 - RNA, 17 nt, Haemophilus influenzae Rd
cauaauuuauucaaaau

SEQ ID NO: 727917 - RNA, 21 nt, Haemophilus influenzae Rd
cauaauuucacaauuuuugga

SEQ ID NO: 727918 - RNA, 23 nt, Haemophilus influenzae Rd
cauaauuucagcaucagaaauac

SEQ ID NO: 727919 - RNA, 14 nt, Haemophilus influenzae Rd
cauaauuugcugug

SEQ ID NO: 727920 - RNA, 14 nt, Haemophilus influenzae Rd
cauaauacuugaca

SEQ ID NO: 727921 - RNA, 17 nt, Haemophilus influenzae Rd
cauaauacuugacaacg

SEQ ID NO: 727922 - RNA, 16 nt, Haemophilus influenzae Rd
cauaauagaaaacauu

SEQ ID NO: 727923 - RNA, 19 nt, Haemophilus influenzae Rd
cauaauauaaauuauguua

SEQ ID NO: 727924 - RNA, 21 nt, Haemophilus influenzae Rd
cauaauaggcgcguaauaaau

SEQ ID NO: 727925 - RNA, 14 nt, Haemophilus influenzae Rd
cauaaguuaccgcu

SEQ ID NO: 727926 - RNA, 21 nt, Haemophilus influenzae Rd
cauaaguuaccgcuucuuccu

SEQ ID NO: 727927 - RNA, 14 nt, Haemophilus influenzae Rd
cauaauaaaaaaac

SEQ ID NO: 727928 - RNA, 13 nt, Haemophilus influenzae Rd
cauaauaaaaauu

SEQ ID NO: 727929 - RNA, 14 nt, Haemophilus influenzae Rd
cauaauaaaaauua

SEQ ID NO: 727930 - RNA, 14 nt, Haemophilus influenzae Rd
cauaauaaaauuua

SEQ ID NO: 727931 - RNA, 13 nt, Haemophilus influenzae Rd
cauaauaaacaua

SEQ ID NO: 727932 - RNA, 23 nt, Haemophilus influenzae Rd
cauaauccagcaugagcuucaaa

SEQ ID NO: 727933 - RNA, 15 nt, Haemophilus influenzae Rd
cauaauccacuaaaa

SEQ ID NO: 727934 - RNA, 18 nt, Haemophilus influenzae Rd
cauaauccacuaaaaacg

SEQ ID NO: 727935 - RNA, 18 nt, Haemophilus influenzae Rd
cauaaucaggcugugcau

SEQ ID NO: 727936 - RNA, 21 nt, Haemophilus influenzae Rd
cauaaucaggcugugcauaau

SEQ ID NO: 727937 - RNA, 21 nt, Haemophilus influenzae Rd
cauaauauugaaaacgucgau

SEQ ID NO: 727938 - RNA, 18 nt, Haemophilus influenzae Rd
cauaauauuuuccccuug

SEQ ID NO: 727939 - RNA, 13 nt, Haemophilus influenzae Rd
cauaauauuuaaa

SEQ ID NO: 727940 - RNA, 14 nt, Haemophilus influenzae Rd
cauaauauuuaaaa

SEQ ID NO: 727941 - RNA, 15 nt, Haemophilus influenzae Rd
cauaauaucuuucuu

SEQ ID NO: 727942 - RNA, 18 nt, Haemophilus influenzae Rd
cauaauaucuuucuucga

SEQ ID NO: 727943 - RNA, 22 nt, Haemophilus influenzae Rd
cauaccauuuaaaaguaaaaau

SEQ ID NO: 727944 - RNA, 16 nt, Haemophilus influenzae Rd
cauacgcaacuaaauu

SEQ ID NO: 727945 - RNA, 14 nt, Haemophilus influenzae Rd
cauacgaucuacau

SEQ ID NO: 727946 - RNA, 18 nt, Haemophilus influenzae Rd
cauacgaccuucaaccau

SEQ ID NO: 727947 - RNA, 19 nt, Haemophilus influenzae Rd
cauaccaaggcauuuuuuc

SEQ ID NO: 727948 - RNA, 18 nt, Haemophilus influenzae Rd
cauaccaauugcaacuuc

SEQ ID NO: 727949 - RNA, 14 nt, Haemophilus influenzae Rd
cauacaucuaauuu

SEQ ID NO: 727950 - RNA, 18 nt, Haemophilus influenzae Rd
cauacaguaaaaauagaa

SEQ ID NO: 727951 - RNA, 18 nt, Haemophilus influenzae Rd
cauacaaucgcucgaaau

SEQ ID NO: 727952 - RNA, 15 nt, Haemophilus influenzae Rd
cauacagaaaccaga

SEQ ID NO: 727953 - RNA, 17 nt, Haemophilus influenzae Rd
cauaguucacuaaaaau

SEQ ID NO: 727954 - RNA, 16 nt, Haemophilus influenzae Rd
cauauaccaauaauuc

SEQ ID NO: 727955 - RNA, 15 nt, Haemophilus influenzae Rd
cauaguuuggcucuu

SEQ ID NO: 727956 - RNA, 23 nt, Haemophilus influenzae Rd
cauaguuuggcucuucuuuaauu

SEQ ID NO: 727957 - RNA, 17 nt, Haemophilus influenzae Rd
cauauaaucuccauaau

SEQ ID NO: 727958 - RNA, 15 nt, Haemophilus influenzae Rd
cauagucaggugcac

SEQ ID NO: 727959 - RNA, 20 nt, Haemophilus influenzae Rd
cauacuaugacguuuauuua

SEQ ID NO: 727960 - RNA, 22 nt, Haemophilus influenzae Rd
cauacuaugacguuuauuuaca

SEQ ID NO: 727961 - RNA, 17 nt, Haemophilus influenzae Rd
cauacuauuacccacuu

SEQ ID NO: 727962 - RNA, 21 nt, Haemophilus influenzae Rd
cauacuaaaaaauuaaauugu

SEQ ID NO: 727963 - RNA, 17 nt, Haemophilus influenzae Rd
cauacuaaauacauuuu

SEQ ID NO: 727964 - RNA, 20 nt, Haemophilus influenzae Rd
cauacuaaauacauuuuuau

SEQ ID NO: 727965 - RNA, 14 nt, Haemophilus influenzae Rd
cauaucaauuucau

SEQ ID NO: 727966 - RNA, 19 nt, Haemophilus influenzae Rd
cauaucaauuucauuugca

SEQ ID NO: 727967 - RNA, 22 nt, Haemophilus influenzae Rd
cauaucaauuuggcucacaaga

SEQ ID NO: 727968 - RNA, 21 nt, Haemophilus influenzae Rd
cauauacucguucguuauuuu

SEQ ID NO: 727969 - RNA, 22 nt, Haemophilus influenzae Rd
cauaucaucaaccaaaauacaa

SEQ ID NO: 727970 - RNA, 23 nt, Haemophilus influenzae Rd
cauaucacgcaccacuucauaua

SEQ ID NO: 727971 - RNA, 11 nt, Haemophilus influenzae Rd
cauauccaaau

SEQ ID NO: 727972 - RNA, 15 nt, Haemophilus influenzae Rd
cauaucuauugagau

SEQ ID NO: 727973 - RNA, 20 nt, Haemophilus influenzae Rd
cauaucuauugagauuuaau

SEQ ID NO: 727974 - RNA, 14 nt, Haemophilus influenzae Rd
cauaucuuccaaag

SEQ ID NO: 727975 - RNA, 19 nt, Haemophilus influenzae Rd
cauaucugucauauaacca

SEQ ID NO: 727976 - RNA, 13 nt, Haemophilus influenzae Rd
cauaucuucuucu

SEQ ID NO: 727977 - RNA, 14 nt, Haemophilus influenzae Rd
cauaucuucuucuu

SEQ ID NO: 727978 - RNA, 15 nt, Haemophilus influenzae Rd
cauauuagaaucaau

SEQ ID NO: 727979 - RNA, 22 nt, Haemophilus influenzae Rd
cauauuggcggauaugcucaau

SEQ ID NO: 727980 - RNA, 22 nt, Haemophilus influenzae Rd
cauauugcuugcauucacaaaa

SEQ ID NO: 727981 - RNA, 20 nt, Haemophilus influenzae Rd
cauauuuagccgcaccuuga

SEQ ID NO: 727982 - RNA, 23 nt, Haemophilus influenzae Rd
cauauuaaugcggugcuuuaagu

SEQ ID NO: 727983 - RNA, 19 nt, Haemophilus influenzae Rd
caucaacuaauuuauuaaa

SEQ ID NO: 727984 - RNA, 12 nt, Haemophilus influenzae Rd
caucaagaaagu

SEQ ID NO: 727985 - RNA, 16 nt, Haemophilus influenzae Rd
caucaauauuaugugc

SEQ ID NO: 727986 - RNA, 18 nt, Haemophilus influenzae Rd
caucaauauuaugugcuu

SEQ ID NO: 727987 - RNA, 18 nt, Haemophilus influenzae Rd
caucaagcucaaaaguau

SEQ ID NO: 727988 - RNA, 18 nt, Haemophilus influenzae Rd
caucaaccauaacaagaa

SEQ ID NO: 727989 - RNA, 18 nt, Haemophilus influenzae Rd
cauauuguuucuucucuu

SEQ ID NO: 727990 - RNA, 12 nt, Haemophilus influenzae Rd
caucaaaaccau

SEQ ID NO: 727991 - RNA, 14 nt, Haemophilus influenzae Rd
caucaaaaugaaaa

SEQ ID NO: 727992 - RNA, 12 nt, Haemophilus influenzae Rd
caucaaaauuua

SEQ ID NO: 727993 - RNA, 17 nt, Haemophilus influenzae Rd
caucaaaauaaauaaaa

SEQ ID NO: 727994 - RNA, 20 nt, Haemophilus influenzae Rd
caucaaaagaucauuuuuuu

SEQ ID NO: 727995 - RNA, 18 nt, Haemophilus influenzae Rd
caucagauggaauauuug

SEQ ID NO: 727996 - RNA, 22 nt, Haemophilus influenzae Rd
caucagcuuaucaaucaagaau

SEQ ID NO: 727997 - RNA, 14 nt, Haemophilus influenzae Rd
caucagcuucaauu

SEQ ID NO: 727998 - RNA, 19 nt, Haemophilus influenzae Rd
caucagcuccuacauuaaa

SEQ ID NO: 727999 - RNA, 17 nt, Haemophilus influenzae Rd
caucacguuaucaaaga

SEQ ID NO: 728000 - RNA, 17 nt, Haemophilus influenzae Rd
caucagaaauaucuuca

SEQ ID NO: 728001 - RNA, 18 nt, Haemophilus influenzae Rd
caucagaaauaucuucaa

SEQ ID NO: 728002 - RNA, 19 nt, Haemophilus influenzae Rd
caucagaaauaucuucaau

SEQ ID NO: 728003 - RNA, 22 nt, Haemophilus influenzae Rd
caucacguaaguaagucaagcu

SEQ ID NO: 728004 - RNA, 14 nt, Haemophilus influenzae Rd
caucaaucacagca

SEQ ID NO: 728005 - RNA, 15 nt, Haemophilus influenzae Rd
caucacgacaucaau

SEQ ID NO: 728006 - RNA, 22 nt, Haemophilus influenzae Rd
caucacgccaucgccauucuca

SEQ ID NO: 728007 - RNA, 12 nt, Haemophilus influenzae Rd
caucauaacuac

SEQ ID NO: 728008 - RNA, 18 nt, Haemophilus influenzae Rd
caucaguauuaagaacuu

SEQ ID NO: 728009 - RNA, 14 nt, Haemophilus influenzae Rd
caucaguaccuuua

SEQ ID NO: 728010 - RNA, 12 nt, Haemophilus influenzae Rd
caucaucauuuu

SEQ ID NO: 728011 - RNA, 23 nt, Haemophilus influenzae Rd
caucaucaucgauaaauucaauc

SEQ ID NO: 728012 - RNA, 12 nt, Haemophilus influenzae Rd
caucaucaucgc

SEQ ID NO: 728013 - RNA, 23 nt, Haemophilus influenzae Rd
caucaucgauaaauucaaucgcu

SEQ ID NO: 728014 - RNA, 20 nt, Haemophilus influenzae Rd
caucaucgcccgcuucuuuc

SEQ ID NO: 728015 - RNA, 17 nt, Haemophilus influenzae Rd
caucauuacuuuuuuaa

SEQ ID NO: 728016 - RNA, 18 nt, Haemophilus influenzae Rd
cauccgcuguucgcaaac

SEQ ID NO: 728017 - RNA, 21 nt, Haemophilus influenzae Rd
cauccgcuguucgcaaacaug

SEQ ID NO: 728018 - RNA, 14 nt, Haemophilus influenzae Rd
caucccuucuuuua

SEQ ID NO: 728019 - RNA, 15 nt, Haemophilus influenzae Rd
caucauuaugaaaaa

SEQ ID NO: 728020 - RNA, 16 nt, Haemophilus influenzae Rd
caucauuaugaaaaaa

SEQ ID NO: 728021 - RNA, 23 nt, Haemophilus influenzae Rd
caucauuaugaaaaaaagaaaac

SEQ ID NO: 728022 - RNA, 15 nt, Haemophilus influenzae Rd
caucauuauugccuu

SEQ ID NO: 728023 - RNA, 20 nt, Haemophilus influenzae Rd
caucauucaauauaaaaaau

SEQ ID NO: 728024 - RNA, 19 nt, Haemophilus influenzae Rd
caucauucaaugcaacaau

SEQ ID NO: 728025 - RNA, 18 nt, Haemophilus influenzae Rd
caucuaaggucauuaacu

SEQ ID NO: 728026 - RNA, 22 nt, Haemophilus influenzae Rd
caucuaauaauaagauuuuugg

SEQ ID NO: 728027 - RNA, 19 nt, Haemophilus influenzae Rd
caucuagauuucuauccau

SEQ ID NO: 728028 - RNA, 23 nt, Haemophilus influenzae Rd
caucuagauuucuauccauuucu

SEQ ID NO: 728029 - RNA, 18 nt, Haemophilus influenzae Rd
caucuaguaccugauuug

SEQ ID NO: 728030 - RNA, 15 nt, Haemophilus influenzae Rd
caucuaguuuuaaua

SEQ ID NO: 728031 - RNA, 19 nt, Haemophilus influenzae Rd
caucuauauuauacuuuca

SEQ ID NO: 728032 - RNA, 21 nt, Haemophilus influenzae Rd
caucguaaccgacucguccau

SEQ ID NO: 728033 - RNA, 16 nt, Haemophilus influenzae Rd
caucgucaaaggaaca

SEQ ID NO: 728034 - RNA, 14 nt, Haemophilus influenzae Rd
caucuaaaccgaua

SEQ ID NO: 728035 - RNA, 19 nt, Haemophilus influenzae Rd
caucuaaaccgauagcuuu

SEQ ID NO: 728036 - RNA, 12 nt, Haemophilus influenzae Rd
caucuaaaaguu

SEQ ID NO: 728037 - RNA, 12 nt, Haemophilus influenzae Rd
caucuaacaaua

SEQ ID NO: 728038 - RNA, 14 nt, Haemophilus influenzae Rd
caucuguuggaaug

SEQ ID NO: 728039 - RNA, 14 nt, Haemophilus influenzae Rd
caucuuagcuuuuu

SEQ ID NO: 728040 - RNA, 21 nt, Haemophilus influenzae Rd
caucuuaucuagacuuucuug

SEQ ID NO: 728041 - RNA, 22 nt, Haemophilus influenzae Rd
caucugguuuugugaguaaaau

SEQ ID NO: 728042 - RNA, 23 nt, Haemophilus influenzae Rd
caucugguuuugugaguaaaaua

SEQ ID NO: 728043 - RNA, 21 nt, Haemophilus influenzae Rd
caucuguugugaaugcaauau

SEQ ID NO: 728044 - RNA, 20 nt, Haemophilus influenzae Rd
caucugcuggcgugagcgca

SEQ ID NO: 728045 - RNA, 21 nt, Haemophilus influenzae Rd
caucuggugagugagcauuuc

SEQ ID NO: 728046 - RNA, 23 nt, Haemophilus influenzae Rd
caucuguaaaccauuccacgcua

SEQ ID NO: 728047 - RNA, 17 nt, Haemophilus influenzae Rd
caucugaacguaagauc

SEQ ID NO: 728048 - RNA, 19 nt, Haemophilus influenzae Rd
caucugccacuucuugcgu

SEQ ID NO: 728049 - RNA, 17 nt, Haemophilus influenzae Rd
caucucuaaccuaaaau

SEQ ID NO: 728050 - RNA, 20 nt, Haemophilus influenzae Rd
cacugcuaauuccacuucag

SEQ ID NO: 728051 - RNA, 19 nt, Haemophilus influenzae Rd
cacugcccaaccaaaccug

SEQ ID NO: 728052 - RNA, 22 nt, Haemophilus influenzae Rd
cacugcaccguugaaugcuucu

SEQ ID NO: 728053 - RNA, 15 nt, Haemophilus influenzae Rd
cacugauuucacgcu

SEQ ID NO: 728054 - RNA, 11 nt, Haemophilus influenzae Rd
cacugcaauga

SEQ ID NO: 728055 - RNA, 16 nt, Haemophilus influenzae Rd
cacugcaaugauaaga

SEQ ID NO: 728056 - RNA, 21 nt, Haemophilus influenzae Rd
cacugauauagcuagaaagca

SEQ ID NO: 728057 - RNA, 13 nt, Haemophilus influenzae Rd
cacuccccaaaaa

SEQ ID NO: 728058 - RNA, 23 nt, Haemophilus influenzae Rd
cacucgcuguauuagaaguaaau

SEQ ID NO: 728059 - RNA, 13 nt, Haemophilus influenzae Rd
cacucggaaugcc

SEQ ID NO: 728060 - RNA, 22 nt, Haemophilus influenzae Rd
cacucgcaccaucacguaauac

SEQ ID NO: 728061 - RNA, 15 nt, Haemophilus influenzae Rd
cacucgcaggaagcu

SEQ ID NO: 728062 - RNA, 15 nt, Haemophilus influenzae Rd
cacugacaucaagca

SEQ ID NO: 728063 - RNA, 22 nt, Haemophilus influenzae Rd
cacugaauuucauucaaaaaua

SEQ ID NO: 728064 - RNA, 14 nt, Haemophilus influenzae Rd
cacugaauacacuu

SEQ ID NO: 728065 - RNA, 20 nt, Haemophilus influenzae Rd
cacucuuucaaaaaucaaau

SEQ ID NO: 728066 - RNA, 16 nt, Haemophilus influenzae Rd
cacucuaauaagugag

SEQ ID NO: 728067 - RNA, 16 nt, Haemophilus influenzae Rd
cacucuaucuaaaaua

SEQ ID NO: 728068 - RNA, 24 nt, Haemophilus influenzae Rd
cacucuaucuaaaauauaacauuu

SEQ ID NO: 728069 - RNA, 14 nt, Haemophilus influenzae Rd
cacuacacccucag

SEQ ID NO: 728070 - RNA, 20 nt, Haemophilus influenzae Rd
cacuaauugugguaaagcua

SEQ ID NO: 728071 - RNA, 22 nt, Haemophilus influenzae Rd
cacuacgauuuaauguauaaaa

SEQ ID NO: 728072 - RNA, 18 nt, Haemophilus influenzae Rd
cacuaaagagaaacauug

SEQ ID NO: 728073 - RNA, 18 nt, Haemophilus influenzae Rd
cacuaaaccugcuucuuu

SEQ ID NO: 728074 - RNA, 21 nt, Haemophilus influenzae Rd
cacuaaucuaaacuuguuaaa

SEQ ID NO: 728075 - RNA, 17 nt, Haemophilus influenzae Rd
cacuaauauaaagauaa

SEQ ID NO: 728076 - RNA, 13 nt, Haemophilus influenzae Rd
cacuaacuuuccu

SEQ ID NO: 728077 - RNA, 14 nt, Haemophilus influenzae Rd
cacuaaaaagccca

SEQ ID NO: 728078 - RNA, 21 nt, Haemophilus influenzae Rd
cacuaaaaagcccaaaugcaa

SEQ ID NO: 728079 - RNA, 21 nt, Haemophilus influenzae Rd
cacguucagcuuuacucauau

SEQ ID NO: 728080 - RNA, 15 nt, Haemophilus influenzae Rd
cacguucuaauguua

SEQ ID NO: 728081 - RNA, 23 nt, Haemophilus influenzae Rd
cacguucuuuuaaugcuucugcc

SEQ ID NO: 728082 - RNA, 22 nt, Haemophilus influenzae Rd
aaaauauaagauauaaaaaaag

SEQ ID NO: 728083 - RNA, 16 nt, Haemophilus influenzae Rd
aaaauaguuuucacaa

SEQ ID NO: 728084 - RNA, 23 nt, Haemophilus influenzae Rd
aaaauauaaccgcacuucaaaaa

SEQ ID NO: 728085 - RNA, 13 nt, Haemophilus influenzae Rd
aaaauaguugaaa

SEQ ID NO: 728086 - RNA, 14 nt, Haemophilus influenzae Rd
aaaauaguugaaau

SEQ ID NO: 728087 - RNA, 15 nt, Haemophilus influenzae Rd
aaaauaguuuaauac

SEQ ID NO: 728088 - RNA, 20 nt, Haemophilus influenzae Rd
cacguuaauuaccacaugca

SEQ ID NO: 728089 - RNA, 20 nt, Haemophilus influenzae Rd
cacguuacgcgcagcaccaa

SEQ ID NO: 728090 - RNA, 19 nt, Haemophilus influenzae Rd
cacguuagaugacauauca

SEQ ID NO: 728091 - RNA, 22 nt, Haemophilus influenzae Rd
cacucacuggcucaaguaaugc

SEQ ID NO: 728092 - RNA, 13 nt, Haemophilus influenzae Rd
cacucaauucaaa

SEQ ID NO: 728093 - RNA, 15 nt, Haemophilus influenzae Rd
cacuccaacaccagu

SEQ ID NO: 728094 - RNA, 22 nt, Haemophilus influenzae Rd
cacuagucugcacgggaaaucc

SEQ ID NO: 728095 - RNA, 18 nt, Haemophilus influenzae Rd
cacuagccauaaauaaau

SEQ ID NO: 728096 - RNA, 22 nt, Haemophilus influenzae Rd
cacuagccauaaauaaaucaau

SEQ ID NO: 728097 - RNA, 16 nt, Haemophilus influenzae Rd
cacuacuugaacuaau

SEQ ID NO: 728098 - RNA, 14 nt, Haemophilus influenzae Rd
cacuagauuuucuu

SEQ ID NO: 728099 - RNA, 19 nt, Haemophilus influenzae Rd
cacuagauuuucuucauca

SEQ ID NO: 728100 - RNA, 21 nt, Haemophilus influenzae Rd
cacuauuaccgcguaaaaauu

SEQ ID NO: 728101 - RNA, 15 nt, Haemophilus influenzae Rd
cacuggcucaaguaa

SEQ ID NO: 728102 - RNA, 23 nt, Haemophilus influenzae Rd
cacuggguuucggauaauaauuu

SEQ ID NO: 728103 - RNA, 13 nt, Haemophilus influenzae Rd
cacuguaaauaaa

SEQ ID NO: 728104 - RNA, 14 nt, Haemophilus influenzae Rd
cacuguaaauaaac

SEQ ID NO: 728105 - RNA, 21 nt, Haemophilus influenzae Rd
cacuuaauuucuuaauuaaga

SEQ ID NO: 728106 - RNA, 15 nt, Haemophilus influenzae Rd
cacuuaauaaaaauu

SEQ ID NO: 728107 - RNA, 14 nt, Haemophilus influenzae Rd
cacuuaauaaauau

SEQ ID NO: 728108 - RNA, 19 nt, Haemophilus influenzae Rd
cacuuaauguuaauaauuu

SEQ ID NO: 728109 - RNA, 21 nt, Haemophilus influenzae Rd
cacuuaaauuauauuuuccug

SEQ ID NO: 728110 - RNA, 14 nt, Haemophilus influenzae Rd
cacuuaaaaauaaa

SEQ ID NO: 728111 - RNA, 15 nt, Haemophilus influenzae Rd
cacuuaaaaauaaag

SEQ ID NO: 728112 - RNA, 13 nt, Haemophilus influenzae Rd
cacuuccccaagu

SEQ ID NO: 728113 - RNA, 22 nt, Haemophilus influenzae Rd
cacuucauuaaaaccaauuuuu

SEQ ID NO: 728114 - RNA, 13 nt, Haemophilus influenzae Rd
cacuucauauaaa

SEQ ID NO: 728115 - RNA, 15 nt, Haemophilus influenzae Rd
cacuucauauaaauu

SEQ ID NO: 728116 - RNA, 12 nt, Haemophilus influenzae Rd
cacuucaucacc

SEQ ID NO: 728117 - RNA, 20 nt, Haemophilus influenzae Rd
cacuucaucacuaaauucuu

SEQ ID NO: 728118 - RNA, 12 nt, Haemophilus influenzae Rd
cacuucagcaga

SEQ ID NO: 728119 - RNA, 23 nt, Haemophilus influenzae Rd
cacuucagcagauacaucuucug

SEQ ID NO: 728120 - RNA, 18 nt, Haemophilus influenzae Rd
cacuucaggguuuucauc

SEQ ID NO: 728121 - RNA, 20 nt, Haemophilus influenzae Rd
cacuucaggguuuucaucau

SEQ ID NO: 728122 - RNA, 16 nt, Haemophilus influenzae Rd
cacuucaauagauaaa

SEQ ID NO: 728123 - RNA, 16 nt, Haemophilus influenzae Rd
cacuucacaacuuuuu

SEQ ID NO: 728124 - RNA, 18 nt, Haemophilus influenzae Rd
cacuucacaacuuuuuaa

SEQ ID NO: 728125 - RNA, 14 nt, Haemophilus influenzae Rd
cacuugucauuaaa

SEQ ID NO: 728126 - RNA, 20 nt, Haemophilus influenzae Rd
cacuugucauuaaaaaauaa

SEQ ID NO: 728127 - RNA, 22 nt, Haemophilus influenzae Rd
cacuuggugaucaccgaaauaa

SEQ ID NO: 728128 - RNA, 23 nt, Haemophilus influenzae Rd
cacuuggugaucaccgaaauaac

SEQ ID NO: 728129 - RNA, 18 nt, Haemophilus influenzae Rd
cacuuggcgaaaaucauc

SEQ ID NO: 728130 - RNA, 22 nt, Haemophilus influenzae Rd
cacuugauuugcuuggaauaaa

SEQ ID NO: 728131 - RNA, 23 nt, Haemophilus influenzae Rd
cacuugauuugcuuggaauaaau

SEQ ID NO: 728132 - RNA, 22 nt, Haemophilus influenzae Rd
cacuucuaaaaccaauaauccu

SEQ ID NO: 728133 - RNA, 24 nt, Haemophilus influenzae Rd
cacuucuaacuaaaaaagcgaauu

SEQ ID NO: 728134 - RNA, 18 nt, Haemophilus influenzae Rd
cacuucucgcccaacaga

SEQ ID NO: 728135 - RNA, 14 nt, Haemophilus influenzae Rd
cacuucuucaaaga

SEQ ID NO: 728136 - RNA, 20 nt, Haemophilus influenzae Rd
cacuucuucaaagauugcau

SEQ ID NO: 728137 - RNA, 16 nt, Haemophilus influenzae Rd
cacuucuuguggagau

SEQ ID NO: 728138 - RNA, 18 nt, Haemophilus influenzae Rd
cacuugaagucuauaaaa

SEQ ID NO: 728139 - RNA, 20 nt, Haemophilus influenzae Rd
cacuugaagucuauaaaaga

SEQ ID NO: 728140 - RNA, 22 nt, Haemophilus influenzae Rd
cacuugaagucuauaaaagaag

SEQ ID NO: 728141 - RNA, 18 nt, Haemophilus influenzae Rd
cacuuugcacuuuaaaga

SEQ ID NO: 728142 - RNA, 23 nt, Haemophilus influenzae Rd
aaaauauuaguuagcuaaaaaaa

SEQ ID NO: 728143 - RNA, 18 nt, Haemophilus influenzae Rd
aaaauauucuucauaaaa

SEQ ID NO: 728144 - RNA, 22 nt, Haemophilus influenzae Rd
aaaauauucuucauaaaaaaag

SEQ ID NO: 728145 - RNA, 22 nt, Haemophilus influenzae Rd
aaaauauuaaagaguuauaaac

SEQ ID NO: 728146 - RNA, 22 nt, Haemophilus influenzae Rd
aaaauauucaaacagguguguu

SEQ ID NO: 728147 - RNA, 17 nt, Haemophilus influenzae Rd
aaaauaucguaaaaaau

SEQ ID NO: 728148 - RNA, 12 nt, Haemophilus influenzae Rd
aaaauaucugca

SEQ ID NO: 728149 - RNA, 18 nt, Haemophilus influenzae Rd
aaaauaucugcaaaacuu

SEQ ID NO: 728150 - RNA, 14 nt, Haemophilus influenzae Rd
aaaauaucuggcaa

SEQ ID NO: 728151 - RNA, 22 nt, Haemophilus influenzae Rd
aaaauauccguuacauauuuca

SEQ ID NO: 728152 - RNA, 13 nt, Haemophilus influenzae Rd
aaaauaucacuuu

SEQ ID NO: 728153 - RNA, 14 nt, Haemophilus influenzae Rd
aaaauauccacaua

SEQ ID NO: 728154 - RNA, 23 nt, Haemophilus influenzae Rd
cacuugugauugcgcauuuaaua

SEQ ID NO: 728155 - RNA, 16 nt, Haemophilus influenzae Rd
cacuugugcaucaaag

SEQ ID NO: 728156 - RNA, 22 nt, Haemophilus influenzae Rd
cacuugugcgauuaacaauaau

SEQ ID NO: 728157 - RNA, 23 nt, Haemophilus influenzae Rd
cacuuuaaaaauaaacauugcgc

SEQ ID NO: 728158 - RNA, 20 nt, Haemophilus influenzae Rd
cacuuuaaacuguugccaua

SEQ ID NO: 728159 - RNA, 17 nt, Haemophilus influenzae Rd
cacuuuaaagaaauaaa

SEQ ID NO: 728160 - RNA, 21 nt, Haemophilus influenzae Rd
cacuuuaaagaaauaaauuua

SEQ ID NO: 728161 - RNA, 12 nt, Haemophilus influenzae Rd
cacuuuaaauau

SEQ ID NO: 728162 - RNA, 18 nt, Haemophilus influenzae Rd
cacuuuaaauauuuaaaa

SEQ ID NO: 728163 - RNA, 18 nt, Haemophilus influenzae Rd
cacuuuaaucgaaaucac

SEQ ID NO: 728164 - RNA, 20 nt, Haemophilus influenzae Rd
cacuuguucaggugucauca

SEQ ID NO: 728165 - RNA, 13 nt, Haemophilus influenzae Rd
cacuuguuuuuuc

SEQ ID NO: 728166 - RNA, 22 nt, Haemophilus influenzae Rd
cagaaaacggcuuaguuaaaua

SEQ ID NO: 728167 - RNA, 21 nt, Haemophilus influenzae Rd
cagaaaagauugcggcagaau

SEQ ID NO: 728168 - RNA, 15 nt, Haemophilus influenzae Rd
cagaaaagauuuuuu

SEQ ID NO: 728169 - RNA, 12 nt, Haemophilus influenzae Rd
cagaaaauaacg

SEQ ID NO: 728170 - RNA, 11 nt, Haemophilus influenzae Rd
cagaaagagac

SEQ ID NO: 728171 - RNA, 14 nt, Haemophilus influenzae Rd
cagaaagauuacau

SEQ ID NO: 728172 - RNA, 16 nt, Haemophilus influenzae Rd
cagaaaggacagccag

SEQ ID NO: 728173 - RNA, 19 nt, Haemophilus influenzae Rd
cacuuugcucuaaaagcug

SEQ ID NO: 728174 - RNA, 23 nt, Haemophilus influenzae Rd
cacuuuggaauauucuuuuuaaa

SEQ ID NO: 728175 - RNA, 17 nt, Haemophilus influenzae Rd
cacuuuauuagaaauau

SEQ ID NO: 728176 - RNA, 15 nt, Haemophilus influenzae Rd
cacuuuuauuauuua

SEQ ID NO: 728177 - RNA, 18 nt, Haemophilus influenzae Rd
cacuuuuaauucuuuauc

SEQ ID NO: 728178 - RNA, 17 nt, Haemophilus influenzae Rd
cacuuuuaucuauaaaa

SEQ ID NO: 728179 - RNA, 12 nt, Haemophilus influenzae Rd
cacuuuuaacca

SEQ ID NO: 728180 - RNA, 12 nt, Haemophilus influenzae Rd
cacuuuuaaagu

SEQ ID NO: 728181 - RNA, 23 nt, Haemophilus influenzae Rd
cacuuuucaacaaaaaacaccua

SEQ ID NO: 728182 - RNA, 13 nt, Haemophilus influenzae Rd
cacuuuuccuuuu

SEQ ID NO: 728183 - RNA, 16 nt, Haemophilus influenzae Rd
cacuuuuccuuuuauu

SEQ ID NO: 728184 - RNA, 17 nt, Haemophilus influenzae Rd
cacuuuuggauaaagua

SEQ ID NO: 728185 - RNA, 19 nt, Haemophilus influenzae Rd
cacuuuuggauaaaguauu

SEQ ID NO: 728186 - RNA, 18 nt, Haemophilus influenzae Rd
cagaaccgccguauugaa

SEQ ID NO: 728187 - RNA, 20 nt, Haemophilus influenzae Rd
cagaaaguucuaauucauuu

SEQ ID NO: 728188 - RNA, 14 nt, Haemophilus influenzae Rd
cagaaguauuuacu

SEQ ID NO: 728189 - RNA, 15 nt, Haemophilus influenzae Rd
cagaaguaaaauagc

SEQ ID NO: 728190 - RNA, 22 nt, Haemophilus influenzae Rd
cagaaggaauauucuuuaaaua

SEQ ID NO: 728191 - RNA, 15 nt, Haemophilus influenzae Rd
cagaacugcuuucuu

SEQ ID NO: 728192 - RNA, 22 nt, Haemophilus influenzae Rd
cagaacuuuuuauaaucaggaa

SEQ ID NO: 728193 - RNA, 17 nt, Haemophilus influenzae Rd
cagaagaaucuucuaau

SEQ ID NO: 728194 - RNA, 14 nt, Haemophilus influenzae Rd
cagaaucauuuuca

SEQ ID NO: 728195 - RNA, 17 nt, Haemophilus influenzae Rd
cagaaucuaaagaaaau

SEQ ID NO: 728196 - RNA, 22 nt, Haemophilus influenzae Rd
cagaauagccgcaaucacaaaa

SEQ ID NO: 728197 - RNA, 13 nt, Haemophilus influenzae Rd
cagaauaaagaaa

SEQ ID NO: 728198 - RNA, 20 nt, Haemophilus influenzae Rd
cagaaguuaaaacuugaaug

SEQ ID NO: 728199 - RNA, 19 nt, Haemophilus influenzae Rd
cagaauaauuaacaaauaa

SEQ ID NO: 728200 - RNA, 23 nt, Haemophilus influenzae Rd
cagaauuugagcggugaauucuu

SEQ ID NO: 728201 - RNA, 21 nt, Haemophilus influenzae Rd
cagaaugaaucguuuguucug

SEQ ID NO: 728202 - RNA, 13 nt, Haemophilus influenzae Rd
cagacgcuuggug

SEQ ID NO: 728203 - RNA, 14 nt, Haemophilus influenzae Rd
cagaccaaaauucu

SEQ ID NO: 728204 - RNA, 21 nt, Haemophilus influenzae Rd
cagaccaacguaaaaucgccu

SEQ ID NO: 728205 - RNA, 18 nt, Haemophilus influenzae Rd
cagaggggauaaaauaaa

SEQ ID NO: 728206 - RNA, 22 nt, Haemophilus influenzae Rd
cagaguaguggugguggaauaa

SEQ ID NO: 728207 - RNA, 19 nt, Haemophilus influenzae Rd
aaaaucacacuaaucuaaa

SEQ ID NO: 728208 - RNA, 13 nt, Haemophilus influenzae Rd
aaaaucacauaaa

SEQ ID NO: 728209 - RNA, 14 nt, Haemophilus influenzae Rd
aaaaucacauaaaa

SEQ ID NO: 728210 - RNA, 18 nt, Haemophilus influenzae Rd
aaaaucacauaaaaaaug

SEQ ID NO: 728211 - RNA, 18 nt, Haemophilus influenzae Rd
aaaaucaaguuaaaaaau

SEQ ID NO: 728212 - RNA, 22 nt, Haemophilus influenzae Rd
aaaaucaaucaggcuuucauuu

SEQ ID NO: 728213 - RNA, 17 nt, Haemophilus influenzae Rd
aaaaucagauacauuug

SEQ ID NO: 728214 - RNA, 16 nt, Haemophilus influenzae Rd
aaaaucacgcucuuuu

SEQ ID NO: 728215 - RNA, 22 nt, Haemophilus influenzae Rd
aaaaucaccgcacuuuuuguuu

SEQ ID NO: 728216 - RNA, 20 nt, Haemophilus influenzae Rd
aaaaucacgccagauaaaau

SEQ ID NO: 728217 - RNA, 12 nt, Haemophilus influenzae Rd
cagagaaaaaaa

SEQ ID NO: 728218 - RNA, 18 nt, Haemophilus influenzae Rd
cagagccguuugcuguau

SEQ ID NO: 728219 - RNA, 19 nt, Haemophilus influenzae Rd
cagagauuuagauaauaaa

SEQ ID NO: 728220 - RNA, 17 nt, Haemophilus influenzae Rd
cagauaaucuacaaaac

SEQ ID NO: 728221 - RNA, 18 nt, Haemophilus influenzae Rd
cagauaaaucagcgaguu

SEQ ID NO: 728222 - RNA, 23 nt, Haemophilus influenzae Rd
aaaaucgccugacauuuuugcca

SEQ ID NO: 728223 - RNA, 15 nt, Haemophilus influenzae Rd
aaaauccuguucagc

SEQ ID NO: 728224 - RNA, 15 nt, Haemophilus influenzae Rd
aaaauccuugcacca

SEQ ID NO: 728225 - RNA, 14 nt, Haemophilus influenzae Rd
aaaauccuaaauaa

SEQ ID NO: 728226 - RNA, 14 nt, Haemophilus influenzae Rd
cagcacuaaaagca

SEQ ID NO: 728227 - RNA, 14 nt, Haemophilus influenzae Rd
aaaaugucgccauu

SEQ ID NO: 728228 - RNA, 18 nt, Haemophilus influenzae Rd
aaaauguaaauuggcauu

SEQ ID NO: 728229 - RNA, 13 nt, Haemophilus influenzae Rd
aaaauguaauucu

SEQ ID NO: 728230 - RNA, 20 nt, Haemophilus influenzae Rd
aaaauguagagauaauaaau

SEQ ID NO: 728231 - RNA, 16 nt, Haemophilus influenzae Rd
aaaauggugcaagcau

SEQ ID NO: 728232 - RNA, 19 nt, Haemophilus influenzae Rd
aaaauggugcaagcaucau

SEQ ID NO: 728233 - RNA, 21 nt, Haemophilus influenzae Rd
aaaauggcgguuuuuuaauuu

SEQ ID NO: 728234 - RNA, 14 nt, Haemophilus influenzae Rd
cagcaccaaagaaa

SEQ ID NO: 728235 - RNA, 14 nt, Haemophilus influenzae Rd
cagcaaucaacaca

SEQ ID NO: 728236 - RNA, 18 nt, Haemophilus influenzae Rd
cagcaauacccgcuucaa

SEQ ID NO: 728237 - RNA, 24 nt, Haemophilus influenzae Rd
aaaaucugugcaaaguuaccauuu

SEQ ID NO: 728238 - RNA, 15 nt, Haemophilus influenzae Rd
aaaaucuuccaauac

SEQ ID NO: 728239 - RNA, 15 nt, Haemophilus influenzae Rd
cagcaaaacuuuuuc

SEQ ID NO: 728240 - RNA, 21 nt, Haemophilus influenzae Rd
cagcaaaagcaagaucuaaaa

SEQ ID NO: 728241 - RNA, 16 nt, Haemophilus influenzae Rd
cagcaaaaugcgugcu

SEQ ID NO: 728242 - RNA, 15 nt, Haemophilus influenzae Rd
cagcaaaccaaggaa

SEQ ID NO: 728243 - RNA, 22 nt, Haemophilus influenzae Rd
cagauucauuguuucucaauaa

SEQ ID NO: 728244 - RNA, 19 nt, Haemophilus influenzae Rd
cagauuuuuacuucaucaa

SEQ ID NO: 728245 - RNA, 11 nt, Haemophilus influenzae Rd
cagauuuuuau

SEQ ID NO: 728246 - RNA, 13 nt, Haemophilus influenzae Rd
cagauuuuuauau

SEQ ID NO: 728247 - RNA, 13 nt, Haemophilus influenzae Rd
cagauuuuuaaau

SEQ ID NO: 728248 - RNA, 18 nt, Haemophilus influenzae Rd
cagauuuuuuaugaccaa

SEQ ID NO: 728249 - RNA, 21 nt, Haemophilus influenzae Rd
cagauuuuuuauuuauuaaga

SEQ ID NO: 728250 - RNA, 17 nt, Haemophilus influenzae Rd
cagauuuuuuucaauga

SEQ ID NO: 728251 - RNA, 21 nt, Haemophilus influenzae Rd
cagauuuuuuucagaaaugac

SEQ ID NO: 728252 - RNA, 16 nt, Haemophilus influenzae Rd
cagauuuuuuuuauau

SEQ ID NO: 728253 - RNA, 20 nt, Haemophilus influenzae Rd
cagauuuuuuuuauaucuuc

SEQ ID NO: 728254 - RNA, 18 nt, Haemophilus influenzae Rd
aaaaucuacucguuuacu

SEQ ID NO: 728255 - RNA, 23 nt, Haemophilus influenzae Rd
aaaaucuaaagguuccucagaga

SEQ ID NO: 728256 - RNA, 22 nt, Haemophilus influenzae Rd
aaaaucggugcaacaauaucau

SEQ ID NO: 728257 - RNA, 21 nt, Haemophilus influenzae Rd
aaaaucguacaucgaaaacau

SEQ ID NO: 728258 - RNA, 23 nt, Haemophilus influenzae Rd
aaaaucguacaucgaaaacauaa

SEQ ID NO: 728259 - RNA, 22 nt, Haemophilus influenzae Rd
cagauuaaaaauucaaugaaau

SEQ ID NO: 728260 - RNA, 20 nt, Haemophilus influenzae Rd
cagcaacgcuugugcauugc

SEQ ID NO: 728261 - RNA, 22 nt, Haemophilus influenzae Rd
cagcaacgcuugugcauugcuc

SEQ ID NO: 728262 - RNA, 15 nt, Haemophilus influenzae Rd
aaaaugcgugcugug

SEQ ID NO: 728263 - RNA, 23 nt, Haemophilus influenzae Rd
cagcaacgguguggaaagaucca

SEQ ID NO: 728264 - RNA, 22 nt, Haemophilus influenzae Rd
cagcaagaaagcguucaucaau

SEQ ID NO: 728265 - RNA, 15 nt, Haemophilus influenzae Rd
cagcaaguucauaua

SEQ ID NO: 728266 - RNA, 14 nt, Haemophilus influenzae Rd
cagcaauaagcaac

SEQ ID NO: 728267 - RNA, 15 nt, Haemophilus influenzae Rd
cagcaauaagcaacg

SEQ ID NO: 728268 - RNA, 15 nt, Haemophilus influenzae Rd
cagcaaauuaucuga

SEQ ID NO: 728269 - RNA, 22 nt, Haemophilus influenzae Rd
cagcaaauuguuugaaaucaaa

SEQ ID NO: 728270 - RNA, 17 nt, Haemophilus influenzae Rd
aaaaugcaaacaagaug

SEQ ID NO: 728271 - RNA, 18 nt, Haemophilus influenzae Rd
aaaaugcaaaguaacuuu

SEQ ID NO: 728272 - RNA, 16 nt, Haemophilus influenzae Rd
cagcuggaaauuccac

SEQ ID NO: 728273 - RNA, 12 nt, Haemophilus influenzae Rd
cagcguuuucaa

SEQ ID NO: 728274 - RNA, 22 nt, Haemophilus influenzae Rd
aaaauucuuuuuucuuccuaug

SEQ ID NO: 728275 - RNA, 22 nt, Haemophilus influenzae Rd
cagcuggcgguuugaaauuuau

SEQ ID NO: 728276 - RNA, 17 nt, Haemophilus influenzae Rd
cagcuucuucaucgcuc

SEQ ID NO: 728277 - RNA, 21 nt, Haemophilus influenzae Rd
caggaaagggauuuuuuauac

SEQ ID NO: 728278 - RNA, 16 nt, Haemophilus influenzae Rd
caggaaaauuuuauaa

SEQ ID NO: 728279 - RNA, 13 nt, Haemophilus influenzae Rd
cagcuuuacucau

SEQ ID NO: 728280 - RNA, 22 nt, Haemophilus influenzae Rd
caggauuaaugcuauaaaucca

SEQ ID NO: 728281 - RNA, 19 nt, Haemophilus influenzae Rd
aaaauuucagacaaaacuu

SEQ ID NO: 728282 - RNA, 20 nt, Haemophilus influenzae Rd
aaaauuucagacaaaacuua

SEQ ID NO: 728283 - RNA, 12 nt, Haemophilus influenzae Rd
aaaauuucagcu

SEQ ID NO: 728284 - RNA, 18 nt, Haemophilus influenzae Rd
aaaauuuauuuuaaaauc

SEQ ID NO: 728285 - RNA, 18 nt, Haemophilus influenzae Rd
aaaauuucaauaaaaaau

SEQ ID NO: 728286 - RNA, 16 nt, Haemophilus influenzae Rd
caggcaagccagacag

SEQ ID NO: 728287 - RNA, 19 nt, Haemophilus influenzae Rd
caggauuuguuucugucau

SEQ ID NO: 728288 - RNA, 15 nt, Haemophilus influenzae Rd
caggcgacucauaau

SEQ ID NO: 728289 - RNA, 18 nt, Haemophilus influenzae Rd
cagguaauguuucauaaa

SEQ ID NO: 728290 - RNA, 15 nt, Haemophilus influenzae Rd
cagguaauuucucug

SEQ ID NO: 728291 - RNA, 15 nt, Haemophilus influenzae Rd
caggguuuucaucau

SEQ ID NO: 728292 - RNA, 14 nt, Haemophilus influenzae Rd
cagggcuuuauuuu

SEQ ID NO: 728293 - RNA, 21 nt, Haemophilus influenzae Rd
cagggauauugccuaauagaa

SEQ ID NO: 728294 - RNA, 12 nt, Haemophilus influenzae Rd
aaacaaaauaaa

SEQ ID NO: 728295 - RNA, 18 nt, Haemophilus influenzae Rd
cagccuauuuuuagaaaa

SEQ ID NO: 728296 - RNA, 13 nt, Haemophilus influenzae Rd
cagcgaccaccaa

SEQ ID NO: 728297 - RNA, 23 nt, Haemophilus influenzae Rd
cagccuuucgacaagccucccgu

SEQ ID NO: 728298 - RNA, 14 nt, Haemophilus influenzae Rd
cagcccaaauaaag

SEQ ID NO: 728299 - RNA, 13 nt, Haemophilus influenzae Rd
cagccacuucuuc

SEQ ID NO: 728300 - RNA, 16 nt, Haemophilus influenzae Rd
cagccauaaaugcuac

SEQ ID NO: 728301 - RNA, 14 nt, Haemophilus influenzae Rd
cagccaaacaaauu

SEQ ID NO: 728302 - RNA, 16 nt, Haemophilus influenzae Rd
cagccaaauuuuucuu

SEQ ID NO: 728303 - RNA, 18 nt, Haemophilus influenzae Rd
cagccaaauuuuucuuuu

SEQ ID NO: 728304 - RNA, 19 nt, Haemophilus influenzae Rd
cagccaaauuuuucuuuuc

SEQ ID NO: 728305 - RNA, 22 nt, Haemophilus influenzae Rd
cagccacuaauuucacaccauu

SEQ ID NO: 728306 - RNA, 14 nt, Haemophilus influenzae Rd
cagccaagguuuuu

SEQ ID NO: 728307 - RNA, 16 nt, Haemophilus influenzae Rd
aaaauuaagaaaauaa

SEQ ID NO: 728308 - RNA, 17 nt, Haemophilus influenzae Rd
aaaauuaauacugaaau

SEQ ID NO: 728309 - RNA, 19 nt, Haemophilus influenzae Rd
aaaauuaauacugaaauga

SEQ ID NO: 728310 - RNA, 20 nt, Haemophilus influenzae Rd
aaaauuaauacugaaaugau

SEQ ID NO: 728311 - RNA, 18 nt, Haemophilus influenzae Rd
aaaauuaaucauaaaaau

SEQ ID NO: 728312 - RNA, 19 nt, Haemophilus influenzae Rd
aaaauuaaucauaaaaaug

SEQ ID NO: 728313 - RNA, 12 nt, Haemophilus influenzae Rd
aaaauuaaaacu

SEQ ID NO: 728314 - RNA, 16 nt, Haemophilus influenzae Rd
aaaauuaaauugaaaa

SEQ ID NO: 728315 - RNA, 17 nt, Haemophilus influenzae Rd
aaaauuaaauugaaaaa

SEQ ID NO: 728316 - RNA, 20 nt, Haemophilus influenzae Rd
aaaauuaaaaauuuaauacu

SEQ ID NO: 728317 - RNA, 16 nt, Haemophilus influenzae Rd
cagcguaaaaaugcug

SEQ ID NO: 728318 - RNA, 16 nt, Haemophilus influenzae Rd
cagcgguuggcuucca

SEQ ID NO: 728319 - RNA, 15 nt, Haemophilus influenzae Rd
aaaauuauuugacuu

SEQ ID NO: 728320 - RNA, 13 nt, Haemophilus influenzae Rd
aaaauucaaagaa

SEQ ID NO: 728321 - RNA, 14 nt, Haemophilus influenzae Rd
aaaauucaaagaag

SEQ ID NO: 728322 - RNA, 14 nt, Haemophilus influenzae Rd
aaaauuaucugcuc

SEQ ID NO: 728323 - RNA, 15 nt, Haemophilus influenzae Rd
aaaauuaucuggcaa

SEQ ID NO: 728324 - RNA, 20 nt, Haemophilus influenzae Rd
aaaauuauaaaccaguuaaa

SEQ ID NO: 728325 - RNA, 14 nt, Haemophilus influenzae Rd
aaaauuauaauauu

SEQ ID NO: 728326 - RNA, 23 nt, Haemophilus influenzae Rd
aaaauuauaauauuuaaauuagc

SEQ ID NO: 728327 - RNA, 12 nt, Haemophilus influenzae Rd
aaaauuagguaa

SEQ ID NO: 728328 - RNA, 18 nt, Haemophilus influenzae Rd
cagcgugaauauaagaaa

SEQ ID NO: 728329 - RNA, 18 nt, Haemophilus influenzae Rd
aaaauucauuauuacuuu

SEQ ID NO: 728330 - RNA, 18 nt, Haemophilus influenzae Rd
aaaauucaucauuacuuu

SEQ ID NO: 728331 - RNA, 12 nt, Haemophilus influenzae Rd
aaaauuccaguu

SEQ ID NO: 728332 - RNA, 23 nt, Haemophilus influenzae Rd
aaaauuccaguucuccuucucca

SEQ ID NO: 728333 - RNA, 19 nt, Haemophilus influenzae Rd
aaaauucguacuuuugauu

SEQ ID NO: 728334 - RNA, 17 nt, Human
uuauagaauauuuauua

SEQ ID NO: 728335 - RNA, 14 nt, Human
uuauauuugaaaua

SEQ ID NO: 728336 - RNA, 16 nt, Human
uguuuuaggaauacau

SEQ ID NO: 728337 - RNA, 18 nt, Human
uuacauuuguauaaaaua

SEQ ID NO: 728338 - RNA, 18 nt, Human
ucauucuugaaagcugug

SEQ ID NO: 728339 - RNA, 16 nt, Human
ucagaaaacaaggaug

SEQ ID NO: 728340 - RNA, 12 nt, Human
ucacuugaaccc

SEQ ID NO: 728341 - RNA, 13 nt, Human
ucauuaaaguucu

SEQ ID NO: 728342 - RNA, 18 nt, Human
ugaucagcuuauugucua

SEQ ID NO: 728343 - RNA, 22 nt, Human
uggcucacgccuguaaucccag

SEQ ID NO: 728344 - RNA, 13 nt, Human
ugcuguauuuuaa

SEQ ID NO: 728345 - RNA, 16 nt, Human
ugcuucuguuuuauaa

SEQ ID NO: 728346 - RNA, 13 nt, Human
ugcaaauugucac

SEQ ID NO: 728347 - RNA, 16 nt, Human
ugcauuauauuuauua

SEQ ID NO: 728348 - RNA, 15 nt, Human
ugccccggggagggg

SEQ ID NO: 728349 - RNA, 19 nt, Human
uauaauuuuuuucaauauu

SEQ ID NO: 728350 - RNA, 15 nt, Human
uauauuuacaaaugg

SEQ ID NO: 728351 - RNA, 13 nt, Human
uaucacuugucaa

SEQ ID NO: 728352 - RNA, 17 nt, Human
uagauguauagguugau

SEQ ID NO: 728353 - RNA, 14 nt, Human
uaaaguucuaguga

SEQ ID NO: 728354 - RNA, 12 nt, Human
guuuuugugaaa

SEQ ID NO: 728355 - RNA, 13 nt, Human
uaaaaauaaauuu

SEQ ID NO: 728356 - RNA, 13 nt, Human
uaaauuugguucu

SEQ ID NO: 728357 - RNA, 17 nt, Human
uaacgauaaaagacagu

SEQ ID NO: 728358 - RNA, 16 nt, Human
gcuacaggauuugaaa

SEQ ID NO: 728359 - RNA, 12 nt, Human
ccuccagcugcc

SEQ ID NO: 728360 - RNA, 22 nt, Human
ccucagaaaacaaggaugaauu

SEQ ID NO: 728361 - RNA, 16 nt, Human
ccugagccccaaaagg

SEQ ID NO: 728362 - RNA, 12 nt, Human
ccuuuucccaac

SEQ ID NO: 728363 - RNA, 21 nt, Human
uugaugaagaaguugauaugc

SEQ ID NO: 728364 - RNA, 17 nt, Human
uuggacgagaaaacaau

SEQ ID NO: 728365 - RNA, 13 nt, Human
uugggaccccuga

SEQ ID NO: 728366 - RNA, 20 nt, Human
uuccuaauuccacagcugcu

SEQ ID NO: 728367 - RNA, 24 nt, Human
uuagcuggaaaaguauguuagugc

SEQ ID NO: 728368 - RNA, 15 nt, Human
uguuuuuaagcuguu

SEQ ID NO: 728369 - RNA, 15 nt, Human
uuauauuugaaauau

SEQ ID NO: 728370 - RNA, 17 nt, Human
uuauaucaauuuaaaaa

SEQ ID NO: 728371 - RNA, 12 nt, Human
uuauaauuuaaa

SEQ ID NO: 728372 - RNA, 15 nt, Human
uuauaauuuaaaaua

SEQ ID NO: 728373 - RNA, 14 nt, Human
uuauacccccugca

SEQ ID NO: 728374 - RNA, 16 nt, Human
uuauagaauauuuauu

SEQ ID NO: 728375 - RNA, 14 nt, Human
uucauucaauaucu

SEQ ID NO: 728376 - RNA, 23 nt, Human
uuccaagccucauguccacuggu

SEQ ID NO: 728377 - RNA, 23 nt, Human
uucacuuccaagagccuuuuuuu

SEQ ID NO: 728378 - RNA, 22 nt, Human
cucaacccccauuucuauuuau

SEQ ID NO: 728379 - RNA, 17 nt, Human
cucuaggaaauauuuau

SEQ ID NO: 728380 - RNA, 21 nt, Human
cucucuuauagaauauuuauu

SEQ ID NO: 728381 - RNA, 22 nt, Human
cucucuuauagaauauuuauua

SEQ ID NO: 728382 - RNA, 20 nt, Human
cucugucucaaaaaauaaaa

SEQ ID NO: 728383 - RNA, 19 nt, Human
gaaagaaaauaacaauaaa

SEQ ID NO: 728384 - RNA, 22 nt, Human
gacucugucucaaaaaauaaaa

SEQ ID NO: 728385 - RNA, 18 nt, Human
cugggauagcugacccag

SEQ ID NO: 728386 - RNA, 16 nt, Human
cugccuaagugcagcc

SEQ ID NO: 728387 - RNA, 23 nt, Human
cuuccaagagccuuuuuuugaaa

SEQ ID NO: 728388 - RNA, 16 nt, Human
cuuauagaauauuuau

SEQ ID NO: 728389 - RNA, 20 nt, Human
cuugagaaaccuuauuguac

SEQ ID NO: 728390 - RNA, 20 nt, Human
gcaucacaugaacuuguaaa

SEQ ID NO: 728391 - RNA, 21 nt, Human
gcagagguccacaacacacag

SEQ ID NO: 728392 - RNA, 18 nt, Human
gcaagcucuaucaccaag

SEQ ID NO: 728393 - RNA, 13 nt, Human
gcauuuaauaugg

SEQ ID NO: 728394 - RNA, 15 nt, Human
gauuaccagggacug

SEQ ID NO: 728395 - RNA, 10 nt, Human
aaauuugguu

SEQ ID NO: 728396 - RNA, 14 nt, Human
aaccuugaaaacuu

SEQ ID NO: 728397 - RNA, 13 nt, Human
aaaguguuugaaa

SEQ ID NO: 728398 - RNA, 14 nt, Human
aaauaacgauaaaa

SEQ ID NO: 728399 - RNA, 14 nt, Human
aaauaaauuugguu

SEQ ID NO: 728400 - RNA, 15 nt, Human
aaaugcauuucuaaa

SEQ ID NO: 728401 - RNA, 16 nt, Human
aagccuccuuuuaaag

SEQ ID NO: 728402 - RNA, 16 nt, Human
acuaguuguaauuuuu

SEQ ID NO: 728403 - RNA, 22 nt, Human
acuacauggaagaccucauuuu

SEQ ID NO: 728404 - RNA, 14 nt, Human
acucauuaaaugga

SEQ ID NO: 728405 - RNA, 16 nt, Human
acgccuguaaucccag

SEQ ID NO: 728406 - RNA, 20 nt, Human
acguauugcauuuaauuuau

SEQ ID NO: 728407 - RNA, 12 nt, Human
acugcuacaaau

SEQ ID NO: 728408 - RNA, 19 nt, Human
accuaaauuugguucuagg

SEQ ID NO: 728409 - RNA, 19 nt, Human
aauuguauuacaaauccaa

SEQ ID NO: 728410 - RNA, 13 nt, Human
aauuuauucaauu

SEQ ID NO: 728411 - RNA, 19 nt, Human
aauuuuuucucuaggaaau

SEQ ID NO: 728412 - RNA, 16 nt, Human
aacacaugauccugca

SEQ ID NO: 728413 - RNA, 16 nt, Human
aacaauaacgauaaaa

SEQ ID NO: 728414 - RNA, 17 nt, Human
aagacucugucucaaaa

SEQ ID NO: 728415 - RNA, 13 nt, Human
aagaaaugaaagc

SEQ ID NO: 728416 - RNA, 20 nt, Human
aaccaaggcuagaaccaccu

SEQ ID NO: 728417 - RNA, 14 nt, Human
auccauacauuugu

SEQ ID NO: 728418 - RNA, 21 nt, Human
auauuucagauaaucacaaua

SEQ ID NO: 728419 - RNA, 23 nt, Human
aucaccaaggcugauuaaaccaa

SEQ ID NO: 728420 - RNA, 15 nt, Human
auauugacuuuuuau

SEQ ID NO: 728421 - RNA, 18 nt, Human
aguauuucuaugaaauau

SEQ ID NO: 728422 - RNA, 18 nt, Human
agaaugauuaugaauuac

SEQ ID NO: 728423 - RNA, 12 nt, Human
agaaacauuugg

SEQ ID NO: 728424 - RNA, 15 nt, Human
aggcugauuaaacca

SEQ ID NO: 728425 - RNA, 20 nt, Human
agacucuaggacauaaauua

SEQ ID NO: 728426 - RNA, 15 nt, Human
agaggaaugaaguac

SEQ ID NO: 728427 - RNA, 19 nt, Human
caaggaaaaaauaacaaug

SEQ ID NO: 728428 - RNA, 13 nt, Human
caacuauauuguu

SEQ ID NO: 728429 - RNA, 15 nt, Human
auuaaaguucuagug

SEQ ID NO: 728430 - RNA, 13 nt, Human
augggacauuugc

SEQ ID NO: 728431 - RNA, 22 nt, Human
augguuguauuauuuuuuaaaa

SEQ ID NO: 728432 - RNA, 17 nt, Human
caggaguuccuaaccag

SEQ ID NO: 728433 - RNA, 23 nt, Human
cauacuucuuaggguuaugauua

SEQ ID NO: 728434 - RNA, 14 nt, Human
cauauauaacaaug

SEQ ID NO: 728435 - RNA, 18 nt, Human
cagcuuuccucaaaacuu

SEQ ID NO: 728436 - RNA, 18 nt, Human
cagcucugcauacucauu

SEQ ID NO: 728437 - RNA, 16 nt, Human
cauuucuauuuauuua

SEQ ID NO: 728438 - RNA, 12 nt, Human
cauuauauuuau

SEQ ID NO: 728439 - RNA, 14 nt, Human
cauuaaaguucuag

SEQ ID NO: 728440 - RNA, 12 nt, Human
cccauccugccc

SEQ ID NO: 728441 - RNA, 15 nt, Human
ccauuucuauuuauu

SEQ ID NO: 728442 - RNA, 18 nt, Human
ccuuggggccuaugcaga

SEQ ID NO: 728443 - RNA, 20 nt, Human
gacaaggaaaaaauaacaau

SEQ ID NO: 728444 - RNA, 20 nt, Human
gagccuuuuuuugaaaaaaa

SEQ ID NO: 728445 - RNA, 21 nt, Human
gcugagggcauagaaguaaaa

SEQ ID NO: 728446 - RNA, 23 nt, Human
gcuuugaaacgaggauugggaaa

SEQ ID NO: 728447 - RNA, 22 nt, Human
ggaagugacgguuuaaugggca

SEQ ID NO: 728448 - RNA, 14 nt, Human
cgcucgcuuccgca

SEQ ID NO: 728449 - RNA, 12 nt, Human
gaauaaauaaau

SEQ ID NO: 728450 - RNA, 14 nt, Human
gaauaucaguuauu

SEQ ID NO: 728451 - RNA, 17 nt, Human
cuucuuucaugaagggg

SEQ ID NO: 728452 - RNA, 23 nt, Human
uagucacuaguuguaauuuuuuu

SEQ ID NO: 728453 - RNA, 14 nt, Human
uauaauuuaaaaua

SEQ ID NO: 728454 - RNA, 15 nt, Human
uauaauuuaaauaua

SEQ ID NO: 728455 - RNA, 23 nt, Human
uauaauuuugugaagcaaaauuu

SEQ ID NO: 728456 - RNA, 13 nt, Human
uauagaauauuua

SEQ ID NO: 728457 - RNA, 19 nt, Human
uaaaagacagugaaagaaa

SEQ ID NO: 728458 - RNA, 21 nt, Human
uaacaaccuaaauuugguucu

SEQ ID NO: 728459 - RNA, 15 nt, Human
uccauccugaggcuc

SEQ ID NO: 728460 - RNA, 19 nt, Human
guaugaaaaugucauuguu

SEQ ID NO: 728461 - RNA, 12 nt, Human
gugaaagaaaau

SEQ ID NO: 728462 - RNA, 14 nt, Human
guuuaauucugaaa

SEQ ID NO: 728463 - RNA, 17 nt, Human
uaaaagacaaggaaaaa

SEQ ID NO: 728464 - RNA, 20 nt, Human
guuuugcaagccagauuuuc

SEQ ID NO: 728465 - RNA, 20 nt, Human
guaccucucuuauagaauau

SEQ ID NO: 728466 - RNA, 11 nt, Human
ugaccacugca

SEQ ID NO: 728467 - RNA, 14 nt, Human
ugaauacuuuauaa

SEQ ID NO: 728468 - RNA, 17 nt, Human
ugaacuugguuuuaauu

SEQ ID NO: 728469 - RNA, 13 nt, Human
ugaagaaguugau

SEQ ID NO: 728470 - RNA, 21 nt, Human
ugccucagaaaacaaggauga

SEQ ID NO: 728471 - RNA, 21 nt, Human
ugaaacgaggauugggaaaaa

SEQ ID NO: 728472 - RNA, 17 nt, Human
ugaaagaaaauaacgau

SEQ ID NO: 728473 - RNA, 14 nt, Human
uguauuuuaaaaga

SEQ ID NO: 728474 - RNA, 17 nt, Human
ugucucuacuaaaaaua

SEQ ID NO: 728475 - RNA, 17 nt, Human
ugugaccacugcagaag

SEQ ID NO: 728476 - RNA, 20 nt, Human
uguuuuaagauaaauuauaa

SEQ ID NO: 728477 - RNA, 20 nt, Human
uguuuaggauguugaaaaag

SEQ ID NO: 728478 - RNA, 12 nt, Human
uguuauuuauaa

SEQ ID NO: 728479 - RNA, 16 nt, Human
uggcuaguaucaaaag

SEQ ID NO: 728480 - RNA, 23 nt, Human
uuugcuaagcauuccaacuaucu

SEQ ID NO: 728481 - RNA, 20 nt, Human
uuuguauaaaauaauuuuua

SEQ ID NO: 728482 - RNA, 14 nt, Human
uuucaauauuuauu

SEQ ID NO: 728483 - RNA, 15 nt, Human
uuucacauuuaaaua

SEQ ID NO: 728484 - RNA, 18 nt, Human
uuucaguuauuauauuua

SEQ ID NO: 728485 - RNA, 19 nt, Human
uuucucuaggaaauauuua

SEQ ID NO: 728486 - RNA, 16 nt, Human
uguaaaggaauuuaaa

SEQ ID NO: 728487 - RNA, 12 nt, Human
ucucaauauuuc

SEQ ID NO: 728488 - RNA, 14 nt, Human
ucucacauuuauau

SEQ ID NO: 728489 - RNA, 17 nt, Human
ucucuuauagaauauuu

SEQ ID NO: 728490 - RNA, 13 nt, Human
uucuaugaaauau

SEQ ID NO: 728491 - RNA, 15 nt, Human
uucuauuuauuuacu

SEQ ID NO: 728492 - RNA, 16 nt, Human
uucuauaauuuaaaua

SEQ ID NO: 728493 - RNA, 16 nt, Human
ugugagaugcuagaac

SEQ ID NO: 728494 - RNA, 16 nt, Human
uuguagauaauacagu

SEQ ID NO: 728495 - RNA, 19 nt, Human
uuguauuauuuuuuaaaaa

SEQ ID NO: 728496 - RNA, 22 nt, Human
uuuagaaagaagcccaauauua

SEQ ID NO: 728497 - RNA, 22 nt, Human
uugccaaauauaaauaaaaaua

SEQ ID NO: 728498 - RNA, 23 nt, Human
uuggacgagaaaacaauaacgau

SEQ ID NO: 728499 - RNA, 14 nt, Human
uugacacuuaaaaa

SEQ ID NO: 728500 - RNA, 14 nt, Human
guaaugcauuaugg

SEQ ID NO: 728501 - RNA, 18 nt, Human
gggcauggguuuuauuau

SEQ ID NO: 728502 - RNA, 23 nt, Human
gggcgcucgcuuccgcauccuag

SEQ ID NO: 728503 - RNA, 14 nt, Human
ucaauauuuauuau

SEQ ID NO: 728504 - RNA, 18 nt, Human
uccccuauccuacuuccc

SEQ ID NO: 728505 - RNA, 14 nt, Human
uccucccuucucuu

SEQ ID NO: 728506 - RNA, 15 nt, Human
uauuuuauaucaauu

SEQ ID NO: 728507 - RNA, 19 nt, Human
uauuuguacaccaauauuc

SEQ ID NO: 728508 - RNA, 14 nt, Human
uacuaauuauaccc

SEQ ID NO: 728509 - RNA, 22 nt, Human
gucugugagaugcuagaacucc

SEQ ID NO: 728510 - RNA, 21 nt, Human
uaauccucaguuuuugugaaa

SEQ ID NO: 728511 - RNA, 15 nt, Human
uaaugccacuaaauu

SEQ ID NO: 728512 - RNA, 12 nt, Human
uaauuagugaac

SEQ ID NO: 728513 - RNA, 12 nt, Human
uaagauaaauua

SEQ ID NO: 728514 - RNA, 14 nt, Human
gugugggcaauguu

SEQ ID NO: 728515 - RNA, 16 nt, Human
guuaugauuaaguaau

SEQ ID NO: 728516 - RNA, 19 nt, Human
aaaauaacaauaaaagaca

SEQ ID NO: 728517 - RNA, 15 nt, Human
aaaagcuccauuuuu

SEQ ID NO: 728518 - RNA, 13 nt, Human
aaaagcuuuuuuu

SEQ ID NO: 728519 - RNA, 16 nt, Human
aaaagguauuuuaauc

SEQ ID NO: 728520 - RNA, 17 nt, Human
aaacaauaacgauaaaa

SEQ ID NO: 728521 - RNA, 13 nt, Human
aauuggagcucgu

SEQ ID NO: 728522 - RNA, 15 nt, Human
acaagaaaugaaagc

SEQ ID NO: 728523 - RNA, 13 nt, Human
aauaaaaauaaau

SEQ ID NO: 728524 - RNA, 22 nt, Human
aauaucuuuuuuuuaauaaacc

SEQ ID NO: 728525 - RNA, 19 nt, Human
aaaauaacgauaaaagaca

SEQ ID NO: 728526 - RNA, 22 nt, Human
aaaacaauaacgauaaaagaca

SEQ ID NO: 728527 - RNA, 17 nt, Human
aaaauaaaaauaaauuu

SEQ ID NO: 728528 - RNA, 22 nt, Human
aaugaauggcuaagcaaaaugu

SEQ ID NO: 728529 - RNA, 18 nt, Human
aaugaaaguugauaagua

SEQ ID NO: 728530 - RNA, 22 nt, Human
aaucaccaaggcugauuaaacc

SEQ ID NO: 728531 - RNA, 21 nt, Human
aauaugccccauucaacaucu

SEQ ID NO: 728532 - RNA, 15 nt, Human
agaagaacugaaauc

SEQ ID NO: 728533 - RNA, 20 nt, Human
agaagcccaauauuauaauu

SEQ ID NO: 728534 - RNA, 14 nt, Human
agaaaaucaggcug

SEQ ID NO: 728535 - RNA, 14 nt, Human
accuguaaucccag

SEQ ID NO: 728536 - RNA, 18 nt, Human
accucccucuaauuuauc

SEQ ID NO: 728537 - RNA, 18 nt, Human
acgcucucuggccuucgg

SEQ ID NO: 728538 - RNA, 14 nt, Human
acugcauuauauuu

SEQ ID NO: 728539 - RNA, 17 nt, Human
accccugagcuugcaga

SEQ ID NO: 728540 - RNA, 17 nt, Human
agcagucaggaaagaga

SEQ ID NO: 728541 - RNA, 21 nt, Human
acauagugaggagcuuugaaa

SEQ ID NO: 728542 - RNA, 14 nt, Human
aguuauuuuuaaac

SEQ ID NO: 728543 - RNA, 22 nt, Human
auaauuuuuauauuugaaauau

SEQ ID NO: 728544 - RNA, 12 nt, Human
auaaaaauaaau

SEQ ID NO: 728545 - RNA, 23 nt, Human
aggauuuauguuuaauucugaaa

SEQ ID NO: 728546 - RNA, 13 nt, Human
aucuuguaaaggu

SEQ ID NO: 728547 - RNA, 14 nt, Human
augaaguacucaua

SEQ ID NO: 728548 - RNA, 21 nt, Human
aucuuuuuuuuaauaaaccau

SEQ ID NO: 728549 - RNA, 17 nt, Human
augaauuaaguuuuuuu

SEQ ID NO: 728550 - RNA, 19 nt, Human
auugacacuuaaaaauggu

SEQ ID NO: 728551 - RNA, 22 nt, Human
auucauagcagcuuauucacaa

SEQ ID NO: 728552 - RNA, 14 nt, Human
auuauaauuuuuuu

SEQ ID NO: 728553 - RNA, 15 nt, Human
augaauuacauuugu

SEQ ID NO: 728554 - RNA, 20 nt, Human
cacgcucugggucgccggca

SEQ ID NO: 728555 - RNA, 17 nt, Human
auuuaccacuuguguuu

SEQ ID NO: 728556 - RNA, 13 nt, Human
auuuauuuuaaua

SEQ ID NO: 728557 - RNA, 15 nt, Human
auuuuaauaauguuu

SEQ ID NO: 728558 - RNA, 21 nt, Human
caaaagguauuuuaaucacca

SEQ ID NO: 728559 - RNA, 12 nt, Human
auuuuuauauuu

SEQ ID NO: 728560 - RNA, 16 nt, Human
auuuucaccuguuuuu

SEQ ID NO: 728561 - RNA, 21 nt, Human
cucuaggaaauauuuauuuua

SEQ ID NO: 728562 - RNA, 17 nt, Human
cucuaggacauaaauua

SEQ ID NO: 728563 - RNA, 22 nt, Human
cugauaugggucuugauaaaug

SEQ ID NO: 728564 - RNA, 14 nt, Human
cagugaaagaaaau

SEQ ID NO: 728565 - RNA, 20 nt, Human
cacuuggucugugagaugcu

SEQ ID NO: 728566 - RNA, 14 nt, Human
cacuccagccugag

SEQ ID NO: 728567 - RNA, 21 nt, Human
caguuuuaacuagaauuuauu

SEQ ID NO: 728568 - RNA, 22 nt, Human
cuuguuggacgagaaaacaaua

SEQ ID NO: 728569 - RNA, 20 nt, Human
agccagauuuuccugaaaac

SEQ ID NO: 728570 - RNA, 18 nt, Human
gacggagccgggaaagaa

SEQ ID NO: 728571 - RNA, 15 nt, Human
gaacgauuuagaaag

SEQ ID NO: 728572 - RNA, 18 nt, Human
gaaagaagcccaauauua

SEQ ID NO: 728573 - RNA, 19 nt, Human
gcaaugugacuuaaugcca

SEQ ID NO: 728574 - RNA, 14 nt, Human
gcauuuaauuuauu

SEQ ID NO: 728575 - RNA, 12 nt, Human
gcacuaaacaaa

SEQ ID NO: 728576 - RNA, 16 nt, Human
gugcauauuuuauuau

SEQ ID NO: 728577 - RNA, 14 nt, Human
gcuacuaauuuuaa

SEQ ID NO: 728578 - RNA, 18 nt, Human
gcuccauuuuuagugaaa

SEQ ID NO: 728579 - RNA, 20 nt, Human
ggccagcuuguuauuuauaa

SEQ ID NO: 728580 - RNA, 19 nt, Human
gcuacaaaugcauuucuaa

SEQ ID NO: 728581 - RNA, 16 nt, Human
ucauagcagauuuuaa

SEQ ID NO: 728582 - RNA, 13 nt, Human
ucauggaauugga

SEQ ID NO: 728583 - RNA, 22 nt, Human
ucucuccucuccccaugauguu

SEQ ID NO: 728584 - RNA, 13 nt, Human
ucuauaauuuaaa

SEQ ID NO: 728585 - RNA, 12 nt, Human
ucuaauuuaucu

SEQ ID NO: 728586 - RNA, 18 nt, Human
ucaaucagccuaguugau

SEQ ID NO: 728587 - RNA, 17 nt, Human
ucacaggggacaggaug

SEQ ID NO: 728588 - RNA, 15 nt, Human
uagaauauuuauuac

SEQ ID NO: 728589 - RNA, 16 nt, Human
uacuaauuuuaaaaug

SEQ ID NO: 728590 - RNA, 12 nt, Human
uaagugaaauaa

SEQ ID NO: 728591 - RNA, 14 nt, Human
uaauccuaaacaua

SEQ ID NO: 728592 - RNA, 15 nt, Human
uaauagaacucaguu

SEQ ID NO: 728593 - RNA, 17 nt, Human
agcuacuaauuuuaaaa

SEQ ID NO: 728594 - RNA, 21 nt, Human
uuugaauaaauaaauguaucu

SEQ ID NO: 728595 - RNA, 16 nt, Human
uuucuaugaaauauua

SEQ ID NO: 728596 - RNA, 23 nt, Human
ugcauagguuuaauaauuuuuaa

SEQ ID NO: 728597 - RNA, 17 nt, Human
uuuaacuagaauuuauu

SEQ ID NO: 728598 - RNA, 19 nt, Human
uuguaaaggaauuuaaaaa

SEQ ID NO: 728599 - RNA, 12 nt, Human
uuucaauauuua

SEQ ID NO: 728600 - RNA, 19 nt, Human
aguguuuuaagauaaauua

SEQ ID NO: 728601 - RNA, 23 nt, Human
agguauuuuaaucaccaaggcug

SEQ ID NO: 728602 - RNA, 19 nt, Human
auguccacugguucuucuu

SEQ ID NO: 728603 - RNA, 12 nt, Human
aucucaauauuu

SEQ ID NO: 728604 - RNA, 15 nt, Human
auccuucagccugaa

SEQ ID NO: 728605 - RNA, 22 nt, Human
augcuguauuuuaaaagaauga

SEQ ID NO: 728606 - RNA, 19 nt, Human
augcaguucugaagaagau

SEQ ID NO: 728607 - RNA, 19 nt, Human
auagaacucaguuuuaacu

SEQ ID NO: 728608 - RNA, 16 nt, Human
auagcagauuuuaauu

SEQ ID NO: 728609 - RNA, 13 nt, Human
auaauuuuuaauu

SEQ ID NO: 728610 - RNA, 22 nt, Human
auaagcuuguauuccuuuuucu

SEQ ID NO: 728611 - RNA, 21 nt, Human
auaaauuagaggucuccaaaa

SEQ ID NO: 728612 - RNA, 19 nt, Human
auaaaauaauuuuuauauu

SEQ ID NO: 728613 - RNA, 21 nt, Human
auaaaaauaauccucaguuuu

SEQ ID NO: 728614 - RNA, 14 nt, Human
auauauauuuuuuu

SEQ ID NO: 728615 - RNA, 18 nt, Human
auaggaauugacccacaa

SEQ ID NO: 728616 - RNA, 17 nt, Human
auaucuuuuuuuuaaua

SEQ ID NO: 728617 - RNA, 22 nt, Human
auaucuuuuuuuuaauaaacca

SEQ ID NO: 728618 - RNA, 22 nt, Human
auauuuauuacuguaagaaaau

SEQ ID NO: 728619 - RNA, 18 nt, Human
auauuuuuuuuuuuaaaa

SEQ ID NO: 728620 - RNA, 15 nt, Human
auucaccuuccagug

SEQ ID NO: 728621 - RNA, 23 nt, Human
auuuagaaagaagcccaauauua

SEQ ID NO: 728622 - RNA, 13 nt, Human
auuguaaaauggu

SEQ ID NO: 728623 - RNA, 14 nt, Human
caagacccaaaagg

SEQ ID NO: 728624 - RNA, 21 nt, Human
caaauguucaucaaugaauga

SEQ ID NO: 728625 - RNA, 17 nt, Human
auuuugaauaaauaaau

SEQ ID NO: 728626 - RNA, 18 nt, Human
caauuuaaaaaaaaaccu

SEQ ID NO: 728627 - RNA, 16 nt, Human
cccaaauguucaucaa

SEQ ID NO: 728628 - RNA, 22 nt, Human
ccacagcuguaugauucccagc

SEQ ID NO: 728629 - RNA, 17 nt, Human
ccaauauuauaauuuuu

SEQ ID NO: 728630 - RNA, 14 nt, Human
cauuucuauuuauu

SEQ ID NO: 728631 - RNA, 14 nt, Human
cauuuguauaaaau

SEQ ID NO: 728632 - RNA, 15 nt, Human
cauuuguauaaaaua

SEQ ID NO: 728633 - RNA, 13 nt, Human
caguaaaauccac

SEQ ID NO: 728634 - RNA, 15 nt, Human
cagggacuugaaccc

SEQ ID NO: 728635 - RNA, 17 nt, Human
caggaaccacaagacug

SEQ ID NO: 728636 - RNA, 20 nt, Human
cagugaaagaaaauaacaau

SEQ ID NO: 728637 - RNA, 21 nt, Human
cagugaaagaaaauaacaaua

SEQ ID NO: 728638 - RNA, 16 nt, Human
cagugucaaugcagcc

SEQ ID NO: 728639 - RNA, 13 nt, Human
acaagagcuuaac

SEQ ID NO: 728640 - RNA, 23 nt, Human
cucagucucccucccuuggggcc

SEQ ID NO: 728641 - RNA, 20 nt, Human
cugucacgugugggcaaugu

SEQ ID NO: 728642 - RNA, 23 nt, Human
uacauuguuugucugucuucaua

SEQ ID NO: 728643 - RNA, 21 nt, Human
ucaagucuuucacauuuaaau

SEQ ID NO: 728644 - RNA, 16 nt, Human
gacauuugcucaugga

SEQ ID NO: 728645 - RNA, 15 nt, Human
cuguaaaauaauaac

SEQ ID NO: 728646 - RNA, 11 nt, Human
uaaaaauaaau

SEQ ID NO: 728647 - RNA, 22 nt, Human
ggcauuuaggccaugggacagg

SEQ ID NO: 728648 - RNA, 14 nt, Human
cagagguugcagug

SEQ ID NO: 728649 - RNA, 18 nt, Human
cuucucacauuuauauuu

SEQ ID NO: 728650 - RNA, 22 nt, Human
uggguuccuuccucugagccuu

SEQ ID NO: 728651 - RNA, 20 nt, Human
aggagauggaaguugcagug

SEQ ID NO: 728652 - RNA, 20 nt, Human
guuccuuccucugagccuug

SEQ ID NO: 728653 - RNA, 17 nt, Human
acuaguuguaauuuuuu

SEQ ID NO: 728654 - RNA, 18 nt, Human
uucucuaggaaauauuua

SEQ ID NO: 728655 - RNA, 12 nt, Human
uuauuauaguca

SEQ ID NO: 728656 - RNA, 13 nt, Human
agcuguggccagc

SEQ ID NO: 728657 - RNA, 22 nt, Human
ugaaaaaguucugcagauaaac

SEQ ID NO: 728658 - RNA, 19 nt, Human
ccucucuuccucccuggaa

SEQ ID NO: 728659 - RNA, 13 nt, Human
aguaugaaaaugu

SEQ ID NO: 728660 - RNA, 14 nt, Human
cggggaggggcgcu

SEQ ID NO: 728661 - RNA, 22 nt, Human
guggcgcuggcugcgcucggcc

SEQ ID NO: 728662 - RNA, 14 nt, Human
uaaaguaugugcau

SEQ ID NO: 728663 - RNA, 14 nt, Human
agaugcuagaacuc

SEQ ID NO: 728664 - RNA, 22 nt, Human
uuguucuugugaacccaaagug

SEQ ID NO: 728665 - RNA, 14 nt, Human
acauauauaacaau

SEQ ID NO: 728666 - RNA, 19 nt, Human
gcacuaguauuucuaugaa

SEQ ID NO: 728667 - RNA, 17 nt, Human
acacuaagagagaauga

SEQ ID NO: 728668 - RNA, 21 nt, Human
caagacccaaaaggcagaagc

SEQ ID NO: 728669 - RNA, 14 nt, Human
ugacacuuaaaaau

SEQ ID NO: 728670 - RNA, 12 nt, Human
cucccugccccc

SEQ ID NO: 728671 - RNA, 19 nt, Human
ucuugugaacccaaagugu

SEQ ID NO: 728672 - RNA, 18 nt, Human
gcaaagcccagcuugaaa

SEQ ID NO: 728673 - RNA, 23 nt, Human
gaaaacaauaacgauaaaagaca

SEQ ID NO: 728674 - RNA, 15 nt, Human
caagacucugucuca

SEQ ID NO: 728675 - RNA, 20 nt, Human
aacaaugcuguauuuuaaaa

SEQ ID NO: 728676 - RNA, 23 nt, Human
uacuuccagggcuacgcgcgcuc

SEQ ID NO: 728677 - RNA, 14 nt, Human
gaaugauuaugaau

SEQ ID NO: 728678 - RNA, 20 nt, Human
ccagcuggccgggagccuga

SEQ ID NO: 728679 - RNA, 14 nt, Human
aacagaagcuucca

SEQ ID NO: 728680 - RNA, 14 nt, Human
uccagauccuggaa

SEQ ID NO: 728681 - RNA, 20 nt, Human
uagaugcaguucugaagaag

SEQ ID NO: 728682 - RNA, 14 nt, Human
cacuaaacaaagag

SEQ ID NO: 728683 - RNA, 22 nt, Human
ccgggagccugaucaccugccc

SEQ ID NO: 728684 - RNA, 22 nt, Human
gucacaggaaguagaggaggcc

SEQ ID NO: 728685 - RNA, 22 nt, Human
cccacuuccucccggccgcgcu

SEQ ID NO: 728686 - RNA, 22 nt, Human
agcacagccucuuagaugcagu

SEQ ID NO: 728687 - RNA, 12 nt, Human
acccccugggag

SEQ ID NO: 728688 - RNA, 17 nt, Human
cguaaucguguccccua

SEQ ID NO: 728689 - RNA, 22 nt, Human
ggcugcugguggcgcuggcugc

SEQ ID NO: 728690 - RNA, 15 nt, Human
uuuaauaauuuuuaa

SEQ ID NO: 728691 - RNA, 14 nt, Human
ugagcucagcccug

SEQ ID NO: 728692 - RNA, 18 nt, Human
uuauuauagucacuaguu

SEQ ID NO: 728693 - RNA, 12 nt, Human
agacagugaaag

SEQ ID NO: 728694 - RNA, 14 nt, Human
cuguuuuuaagcug

SEQ ID NO: 728695 - RNA, 22 nt, Human
agcgcgcgcgcccucuggcugc

SEQ ID NO: 728696 - RNA, 22 nt, Human
agaagcaccaaucaugaauuag

SEQ ID NO: 728697 - RNA, 18 nt, Human
uguauuauuuuuuaaaaa

SEQ ID NO: 728698 - RNA, 13 nt, Human
auguaucuuauuc

SEQ ID NO: 728699 - RNA, 21 nt, Human
uauuuauaacaaccuaaauuu

SEQ ID NO: 728700 - RNA, 15 nt, Human
uuugaauaaauaaau

SEQ ID NO: 728701 - RNA, 15 nt, Human
aaauauuuauuuuaa

SEQ ID NO: 728702 - RNA, 20 nt, Human
accucugccucagaaaacaa

SEQ ID NO: 728703 - RNA, 18 nt, Human
auggaaguaaauguuguu

SEQ ID NO: 728704 - RNA, 20 nt, Human
aaggagccaaacauccuaca

SEQ ID NO: 728705 - RNA, 13 nt, Human
auuuuaaaagaau

SEQ ID NO: 728706 - RNA, 21 nt, Human
aaacaauaacgauaaaagaca

SEQ ID NO: 728707 - RNA, 18 nt, Human
auuuauuuacugagcuuc

SEQ ID NO: 728708 - RNA, 21 nt, Human
uuauguuuaauucugaaagca

SEQ ID NO: 728709 - RNA, 18 nt, Human
gacccacuggacucaccu

SEQ ID NO: 728710 - RNA, 12 nt, Human
uauaauuuaaaa

SEQ ID NO: 728711 - RNA, 20 nt, Human
ugaaaaucuuauaauuuaaa

SEQ ID NO: 728712 - RNA, 20 nt, Human
aauaauuuuuauauuugaaa

SEQ ID NO: 728713 - RNA, 23 nt, Human
ucccgcuguuccucgccacgcuc

SEQ ID NO: 728714 - RNA, 19 nt, Human
gcuuguauuccuuuuucuc

SEQ ID NO: 728715 - RNA, 18 nt, Human
uuuuaaaaaagaaacauu

SEQ ID NO: 728716 - RNA, 16 nt, Human
cagggcuacgcgcgcu

SEQ ID NO: 728717 - RNA, 19 nt, Human
gucaaucagccuaguugau

SEQ ID NO: 728718 - RNA, 20 nt, Human
ggguuccuuccucugagccu

SEQ ID NO: 728719 - RNA, 13 nt, Human
uaacaauaaaaga

SEQ ID NO: 728720 - RNA, 20 nt, Human
cgcaggaccaucccggccgg

SEQ ID NO: 728721 - RNA, 16 nt, Human
cauagaaguaaaaaca

SEQ ID NO: 728722 - RNA, 23 nt, Human
ggggagccaacagaagcuuccau

SEQ ID NO: 728723 - RNA, 16 nt, Human
aaguugcagugagcug

SEQ ID NO: 728724 - RNA, 18 nt, Human
uuacuguaagaaaauauc

SEQ ID NO: 728725 - RNA, 12 nt, Human
acacuuaaaaau

SEQ ID NO: 728726 - RNA, 18 nt, Human
cugagaccaaggcccccg

SEQ ID NO: 728727 - RNA, 13 nt, Human
aauaaaaauaaau

SEQ ID NO: 728728 - RNA, 16 nt, Human
auuccaccuacaugag

SEQ ID NO: 728729 - RNA, 19 nt, Human
augaguaacugauuuguaa

SEQ ID NO: 728730 - RNA, 15 nt, Human
cgcgcugcgcgccgc

SEQ ID NO: 728731 - RNA, 19 nt, Human
cucugucucaaaaaauaaa

SEQ ID NO: 728732 - RNA, 20 nt, Human
ccaggcggguccgggucgca

SEQ ID NO: 728733 - RNA, 19 nt, Human
gacggagccgggaaagaag

SEQ ID NO: 728734 - RNA, 18 nt, Human
ucaaggguacacugccuu

SEQ ID NO: 728735 - RNA, 13 nt, Human
cacaacuauauug

SEQ ID NO: 728736 - RNA, 18 nt, Human
guauuauuuuuuaaaaaa

SEQ ID NO: 728737 - RNA, 17 nt, Human
aaagcagggacuugaac

SEQ ID NO: 728738 - RNA, 22 nt, Human
uggaaaguuuaugguuguauua

SEQ ID NO: 728739 - RNA, 13 nt, Human
auuggacaguaaa

SEQ ID NO: 728740 - RNA, 17 nt, Human
uaauuuuuauauuugaa

SEQ ID NO: 728741 - RNA, 14 nt, Human
uucacauuuaaaua

SEQ ID NO: 728742 - RNA, 13 nt, Human
uaacgauaaaaga

SEQ ID NO: 728743 - RNA, 18 nt, Human
ccgggccgacggagccgg

SEQ ID NO: 728744 - RNA, 20 nt, Human
acggacgaaccuugaaaacu

SEQ ID NO: 728745 - RNA, 17 nt, Human
aaucuuucacaggggac

SEQ ID NO: 728746 - RNA, 18 nt, Human
uuuauguuuaauucugaa

SEQ ID NO: 728747 - RNA, 13 nt, Human
ccugagcuugcag

SEQ ID NO: 728748 - RNA, 16 nt, Human
caauguucccccucuc

SEQ ID NO: 728749 - RNA, 19 nt, Human
aagucuuucacauuuaaau

SEQ ID NO: 728750 - RNA, 16 nt, Human
ccucauuaucagucca

SEQ ID NO: 728751 - RNA, 15 nt, Human
gaaaugaaagcaggg

SEQ ID NO: 728752 - RNA, 22 nt, Human
ugauaguuguaccgcaauguga

SEQ ID NO: 728753 - RNA, 14 nt, Human
cucaggcuggcacc

SEQ ID NO: 728754 - RNA, 18 nt, Human
gaauaauccuaaacauau

SEQ ID NO: 728755 - RNA, 15 nt, Human
gcgagcgcgcgcgcc

SEQ ID NO: 728756 - RNA, 14 nt, Human
aaaaauacaaaaau

SEQ ID NO: 728757 - RNA, 18 nt, Human
ugcauagguuuaauaauu

SEQ ID NO: 728758 - RNA, 13 nt, Human
uaauuuuuuucaa

SEQ ID NO: 728759 - RNA, 17 nt, Human
cggccgcgcugcgcgcc

SEQ ID NO: 728760 - RNA, 13 nt, Human
ucuaagaagugaa

SEQ ID NO: 728761 - RNA, 17 nt, Human
agcugccccggggaggg

SEQ ID NO: 728762 - RNA, 21 nt, Human
aagcuccauuuuuagugaaau

SEQ ID NO: 728763 - RNA, 23 nt, Human
ccaggagauggaaguugcaguga

SEQ ID NO: 728764 - RNA, 20 nt, Human
uguaaagcuuugugcagauu

SEQ ID NO: 728765 - RNA, 20 nt, Human
cccugcacuccagccugagc

SEQ ID NO: 728766 - RNA, 15 nt, Human
ucuggcuccagcugg

SEQ ID NO: 728767 - RNA, 15 nt, Human
agucaccucauggaa

SEQ ID NO: 728768 - RNA, 11 nt, Human
ccggccgcgcu

SEQ ID NO: 728769 - RNA, 15 nt, Human
agaaaacaauaacga

SEQ ID NO: 728770 - RNA, 17 nt, Human
uauauuguagauaauac

SEQ ID NO: 728771 - RNA, 17 nt, Human
uauaauuuuuuucaaua

SEQ ID NO: 728772 - RNA, 21 nt, Human
auauuuuuuuuuuuaaaaaaa

SEQ ID NO: 728773 - RNA, 17 nt, Human
acuuccagauccuggaa

SEQ ID NO: 728774 - RNA, 17 nt, Human
acuguaaagcuuugugc

SEQ ID NO: 728775 - RNA, 15 nt, Human
ggccugagaccaagg

SEQ ID NO: 728776 - RNA, 15 nt, Human
cuuuggggagccaac

SEQ ID NO: 728777 - RNA, 20 nt, Human
acaugagguacugagaguga

SEQ ID NO: 728778 - RNA, 15 nt, Human
ccuguacuccagccu

SEQ ID NO: 728779 - RNA, 13 nt, Human
aaaugaaagcagg

SEQ ID NO: 728780 - RNA, 21 nt, Human
uaaauaaauguaucuuauuca

SEQ ID NO: 728781 - RNA, 12 nt, Human
cgcucggccugc

SEQ ID NO: 728782 - RNA, 17 nt, Human
agacacacugaagaagc

SEQ ID NO: 728783 - RNA, 23 nt, Human
aggcuuuaaaacuuauccuccau

SEQ ID NO: 728784 - RNA, 20 nt, Human
aauaucuuuuuuuuaauaaa

SEQ ID NO: 728785 - RNA, 16 nt, Human
uucaguuauuauauuu

SEQ ID NO: 728786 - RNA, 18 nt, Human
aaauaacgauaaaagaca

SEQ ID NO: 728787 - RNA, 23 nt, Human
ucuuagaugcaguucugaagaag

SEQ ID NO: 728788 - RNA, 23 nt, Human
ggaacaguuaccucugccucaga

SEQ ID NO: 728789 - RNA, 18 nt, Human
ucuaugaaauauuauguu

SEQ ID NO: 728790 - RNA, 20 nt, Human
cugagaccaaggcccccggg

SEQ ID NO: 728791 - RNA, 21 nt, Human
aaagaaaauaacgauaaaaga

SEQ ID NO: 728792 - RNA, 23 nt, Human
gcccuggugccucaccccuugcc

SEQ ID NO: 728793 - RNA, 17 nt, Human
gccgcgcugcgcgccgc

SEQ ID NO: 728794 - RNA, 16 nt, Human
gucuaucuuugagcgc

SEQ ID NO: 728795 - RNA, 17 nt, Human
caagacccaaaaggcag

SEQ ID NO: 728796 - RNA, 18 nt, Human
uuuguuaaaugauuucau

SEQ ID NO: 728797 - RNA, 19 nt, Human
aaagacagugaaagaaaau

SEQ ID NO: 728798 - RNA, 20 nt, Human
uccagccugagcgacaguga

SEQ ID NO: 728799 - RNA, 12 nt, Human
gaaggggcggcg

SEQ ID NO: 728800 - RNA, 17 nt, Human
acuugaacccauauuug

SEQ ID NO: 728801 - RNA, 15 nt, Human
uggcgcgcaccugua

SEQ ID NO: 728802 - RNA, 12 nt, Human
aauuuaaauaua

SEQ ID NO: 728803 - RNA, 22 nt, Human
aguauguuagugcaaauuguca

SEQ ID NO: 728804 - RNA, 23 nt, Human
gcugccccggggaggggcgcucg

SEQ ID NO: 728805 - RNA, 15 nt, Human
cgcgccgcgcuccuc

SEQ ID NO: 728806 - RNA, 16 nt, Human
auaacuggaaacuuca

SEQ ID NO: 728807 - RNA, 21 nt, Human
augugcauauuuuauuauagu

SEQ ID NO: 728808 - RNA, 14 nt, Human
agacaucaacagau

SEQ ID NO: 728809 - RNA, 15 nt, Human
ccaggcggguccggg

SEQ ID NO: 728810 - RNA, 21 nt, Human
ccauccugccccugagcccau

SEQ ID NO: 728811 - RNA, 13 nt, Human
gaagaacugaaau

SEQ ID NO: 728812 - RNA, 14 nt, Human
agguugcagugagc

SEQ ID NO: 728813 - RNA, 20 nt, Human
ggcuccggacgcugcugccg

SEQ ID NO: 728814 - RNA, 20 nt, Human
ggccuaugcagagguccaca

SEQ ID NO: 728815 - RNA, 15 nt, Human
acuuuauaaaggauu

SEQ ID NO: 728816 - RNA, 20 nt, Human
uuuaaauaaaguguuugaaa

SEQ ID NO: 728817 - RNA, 21 nt, Human
aaaauuuuuucucuaggaaau

SEQ ID NO: 728818 - RNA, 21 nt, Human
uauuauuuuauagcuacuaau

SEQ ID NO: 728819 - RNA, 13 nt, Human
gccuccagcugcc

SEQ ID NO: 728820 - RNA, 22 nt, Human
gaggggagcaugggaagugacg

SEQ ID NO: 728821 - RNA, 18 nt, Human
cucuauguucuaagaagu

SEQ ID NO: 728822 - RNA, 20 nt, Human
gaaacgaggauugggaaaaa

SEQ ID NO: 728823 - RNA, 20 nt, Human
ugagucccaggcugagccuc

SEQ ID NO: 728824 - RNA, 16 nt, Human
agguugcagugagccg

SEQ ID NO: 728825 - RNA, 14 nt, Human
aaaacuucagacau

SEQ ID NO: 728826 - RNA, 15 nt, Human
ucuuauaauuuaaaa

SEQ ID NO: 728827 - RNA, 14 nt, Human
uaaaauccauacau

SEQ ID NO: 728828 - RNA, 20 nt, Human
aggcugagaugggagaauca

SEQ ID NO: 728829 - RNA, 16 nt, Human
cuuauagaauauuuau

SEQ ID NO: 728830 - RNA, 20 nt, Human
uaacaagccuccuuuuaaag

SEQ ID NO: 728831 - RNA, 18 nt, Human
aggaaaaaauaacaauga

SEQ ID NO: 728832 - RNA, 15 nt, Human
auauuuuuuguuaaa

SEQ ID NO: 728833 - RNA, 16 nt, Human
agagguccacaacaca

SEQ ID NO: 728834 - RNA, 13 nt, Human
uacuuuauuuucu

SEQ ID NO: 728835 - RNA, 21 nt, Human
ccgacggagccgggaaagaag

SEQ ID NO: 728836 - RNA, 21 nt, Human
acaugagguacugagagugaa

SEQ ID NO: 728837 - RNA, 17 nt, Human
uguaaaggaauuuaaaa

SEQ ID NO: 728838 - RNA, 21 nt, Human
auggcagcuuuccucaaaacu

SEQ ID NO: 728839 - RNA, 16 nt, Human
accuguuuuuaagcug

SEQ ID NO: 728840 - RNA, 11 nt, Human
auuuuugaagc

SEQ ID NO: 728841 - RNA, 23 nt, Human
cuggccgggagccugaucaccug

SEQ ID NO: 728842 - RNA, 16 nt, Human
ccacuuggucugugag

SEQ ID NO: 728843 - RNA, 21 nt, Human
ggcaccgcuguacgcgagcgc

SEQ ID NO: 728844 - RNA, 20 nt, Human
cacuguggguagacacacau

SEQ ID NO: 728845 - RNA, 19 nt, Human
auagcuacuaauuuuaaaa

SEQ ID NO: 728846 - RNA, 15 nt, Human
gacaguauggcagcu

SEQ ID NO: 728847 - RNA, 15 nt, Human
gacagggaggacgcu

SEQ ID NO: 728848 - RNA, 18 nt, Human
acugagcuucucugugaa

SEQ ID NO: 728849 - RNA, 18 nt, Human
acaaauccaaugaaauga

SEQ ID NO: 728850 - RNA, 13 nt, Human
agaaaugaaagca

SEQ ID NO: 728851 - RNA, 18 nt, Human
ucuucuggguuccuuccu

SEQ ID NO: 728852 - RNA, 19 nt, Human
ggcgggagggcgcggggcg

SEQ ID NO: 728853 - RNA, 15 nt, Human
acaagacccaaaagg

SEQ ID NO: 728854 - RNA, 19 nt, Human
aaacaaaaggauaaugaau

SEQ ID NO: 728855 - RNA, 19 nt, Human
uccccuauccuacuucccc

SEQ ID NO: 728856 - RNA, 20 nt, Human
uaugcuucuguuuuauaauu

SEQ ID NO: 728857 - RNA, 13 nt, Human
uuauguuuaauuc

SEQ ID NO: 728858 - RNA, 13 nt, Human
caacucccugccc

SEQ ID NO: 728859 - RNA, 18 nt, Human
cauaagggaggaaaaaaa

SEQ ID NO: 728860 - RNA, 15 nt, Human
cuuuaaaacuuaucc

SEQ ID NO: 728861 - RNA, 16 nt, Human
ugcucgcccacuuccu

SEQ ID NO: 728862 - RNA, 13 nt, Human
ccucuggcuccag

SEQ ID NO: 728863 - RNA, 21 nt, Human
uacauaagggaggaaaaaaaa

SEQ ID NO: 728864 - RNA, 17 nt, Human
ggaaauauuuauuuuaa

SEQ ID NO: 728865 - RNA, 22 nt, Human
uuuaauaauguuucaaacauau

SEQ ID NO: 728866 - RNA, 19 nt, Human
cucuguucugcacacagca

SEQ ID NO: 728867 - RNA, 22 nt, Human
auuuucuucucacauuuauauu

SEQ ID NO: 728868 - RNA, 15 nt, Human
auaucaauuuaaaaa

SEQ ID NO: 728869 - RNA, 18 nt, Human
uaaguuuuuuuuuaaaaa

SEQ ID NO: 728870 - RNA, 22 nt, Human
gaauuucuucaacucccugccc

SEQ ID NO: 728871 - RNA, 18 nt, Human
gcacuccagccugagcga

SEQ ID NO: 728872 - RNA, 17 nt, Human
ugaaggauuuauguuua

SEQ ID NO: 728873 - RNA, 15 nt, Human
gccucagucucccuc

SEQ ID NO: 728874 - RNA, 16 nt, Human
uuauagaauauuuauu

SEQ ID NO: 728875 - RNA, 14 nt, Human
aaccugagccccaa

SEQ ID NO: 728876 - RNA, 13 nt, Human
auaacuggaaacu

SEQ ID NO: 728877 - RNA, 13 nt, Human
acuguaaaauaau

SEQ ID NO: 728878 - RNA, 20 nt, Human
ucgcaggaccaucccggccg

SEQ ID NO: 728879 - RNA, 18 nt, Human
gaggcugaggcgggugga

SEQ ID NO: 728880 - RNA, 16 nt, Human
gccuaagugcagcccc

SEQ ID NO: 728881 - RNA, 19 nt, Human
cuagaguuuagcuggaaaa

SEQ ID NO: 728882 - RNA, 21 nt, Human
ugggaggcugagaugggagaa

SEQ ID NO: 728883 - RNA, 19 nt, Human
ugagucccaggcugagccu

SEQ ID NO: 728884 - RNA, 16 nt, Human
cauggguuuuauuaua

SEQ ID NO: 728885 - RNA, 11 nt, Human
gguuuuauuau

SEQ ID NO: 728886 - RNA, 22 nt, Human
ugucucuacuaaaaauacaaaa

SEQ ID NO: 728887 - RNA, 21 nt, Human
aaaaaguucugcagauaaaca

SEQ ID NO: 728888 - RNA, 14 nt, Human
aaauauuauuuuau

SEQ ID NO: 728889 - RNA, 13 nt, Human
aucucaauauuuc

SEQ ID NO: 728890 - RNA, 17 nt, Human
agagacagaaagcagaa

SEQ ID NO: 728891 - RNA, 19 nt, Human
ucaccaaggcugauuaaac

SEQ ID NO: 728892 - RNA, 13 nt, Human
auaaauaaaaaua

SEQ ID NO: 728893 - RNA, 22 nt, Human
ccccuuccuaauuccacagcug

SEQ ID NO: 728894 - RNA, 21 nt, Human
uauuacuguaagaaaauauca

SEQ ID NO: 728895 - RNA, 14 nt, Human
ugcucauggaauug

SEQ ID NO: 728896 - RNA, 15 nt, Human
aaauacaaaaauuag

SEQ ID NO: 728897 - RNA, 23 nt, Human
uuuccaucaaggguacacugccu

SEQ ID NO: 728898 - RNA, 16 nt, Human
cuguacuccagccugg

SEQ ID NO: 728899 - RNA, 14 nt, Human
aauauuuauuuuaa

SEQ ID NO: 728900 - RNA, 22 nt, Human
agaaugagagacacacugaaga

SEQ ID NO: 728901 - RNA, 19 nt, Human
cucaccucccccaucucuu

SEQ ID NO: 728902 - RNA, 14 nt, Human
agucucccucccuu

SEQ ID NO: 728903 - RNA, 19 nt, Human
ugaacaaauuuacagagac

SEQ ID NO: 728904 - RNA, 19 nt, Human
cugucucaaaaaauaaaaa

SEQ ID NO: 728905 - RNA, 20 nt, Human
uugauaaguacaugauaagc

SEQ ID NO: 728906 - RNA, 23 nt, Human
cccggccggcgcgcucaucccac

SEQ ID NO: 728907 - RNA, 19 nt, Human
auccuacaagacacaguga

SEQ ID NO: 728908 - RNA, 11 nt, Human
cauaugaaaag

SEQ ID NO: 728909 - RNA, 16 nt, Human
gaaagaagagccggag

SEQ ID NO: 728910 - RNA, 22 nt, Human
gaugcaguuguugcccacagcu

SEQ ID NO: 728911 - RNA, 17 nt, Human
gccuaagugcagccccg

SEQ ID NO: 728912 - RNA, 18 nt, Human
gaaacaaaaggauaauga

SEQ ID NO: 728913 - RNA, 16 nt, Human
aacuugguuuuaauua

SEQ ID NO: 728914 - RNA, 12 nt, Human
guagacacacau

SEQ ID NO: 728915 - RNA, 16 nt, Human
aucaguuauuuuuaaa

SEQ ID NO: 728916 - RNA, 13 nt, Human
aaaaauccuacuu

SEQ ID NO: 728917 - RNA, 21 nt, Human
ucgcccacuuccucccggccg

SEQ ID NO: 728918 - RNA, 18 nt, Human
caugccccuguacuccag

SEQ ID NO: 728919 - RNA, 19 nt, Human
cgcccacuagacccacugg

SEQ ID NO: 728920 - RNA, 17 nt, Human
gcgcgcuccgcgcagcu

SEQ ID NO: 728921 - RNA, 12 nt, Human
gcugaugcaguu

SEQ ID NO: 728922 - RNA, 23 nt, Human
cagagguugcagugagccgagau

SEQ ID NO: 728923 - RNA, 22 nt, Human
gugccucaccccuugccauaau

SEQ ID NO: 728924 - RNA, 12 nt, Human
uauuauuuuuua

SEQ ID NO: 728925 - RNA, 17 nt, Human
aaccuagggugauauua

SEQ ID NO: 728926 - RNA, 14 nt, Human
ggaaagaagagccg

SEQ ID NO: 728927 - RNA, 16 nt, Human
ggccuccauccugagg

SEQ ID NO: 728928 - RNA, 15 nt, Human
uugacccacaagaaa

SEQ ID NO: 728929 - RNA, 11 nt, Human
gagguaaaagc

SEQ ID NO: 728930 - RNA, 23 nt, Human
uuuauaugcuucuguuuuauaau

SEQ ID NO: 728931 - RNA, 13 nt, Human
auaacgauaaaag

SEQ ID NO: 728932 - RNA, 14 nt, Human
aagcaucacaugaa

SEQ ID NO: 728933 - RNA, 18 nt, Human
ugccauaauuacuauguc

SEQ ID NO: 728934 - RNA, 17 nt, Human
cgcgccuccgcuacuuc

SEQ ID NO: 728935 - RNA, 23 nt, Human
agcaugucgucaaagcugaaaug

SEQ ID NO: 728936 - RNA, 15 nt, Human
uacaaaugcauuucu

SEQ ID NO: 728937 - RNA, 16 nt, Human
uguaguccuguaaugg

SEQ ID NO: 728938 - RNA, 21 nt, Human
aggacagcccuucuuuccaca

SEQ ID NO: 728939 - RNA, 19 nt, Human
caauucuugccaaauauaa

SEQ ID NO: 728940 - RNA, 13 nt, Human
uggcuccagcugg

SEQ ID NO: 728941 - RNA, 14 nt, Human
cucccucccuuggg

SEQ ID NO: 728942 - RNA, 17 nt, Human
auggcuaguaucaaaag

SEQ ID NO: 728943 - RNA, 17 nt, Human
ugcagcgaguacuuccc

SEQ ID NO: 728944 - RNA, 22 nt, Human
uuugaugcuacaggauuugaaa

SEQ ID NO: 728945 - RNA, 14 nt, Human
cuaagcauuccaac

SEQ ID NO: 728946 - RNA, 13 nt, Human
ugaaaaucuuaua

SEQ ID NO: 728947 - RNA, 20 nt, Human
agcuuauugucuagugaaac

SEQ ID NO: 728948 - RNA, 20 nt, Human
cuucaacucccugcccccca

SEQ ID NO: 728949 - RNA, 15 nt, Human
caaauccaaugaaau

SEQ ID NO: 728950 - RNA, 19 nt, Human
ugaucaccugcccugcuga

SEQ ID NO: 728951 - RNA, 14 nt, Human
cuguaaucccagcu

SEQ ID NO: 728952 - RNA, 13 nt, Human
gauuguaaaaugg

SEQ ID NO: 728953 - RNA, 14 nt, Human
ucuaggaaauauuu

SEQ ID NO: 728954 - RNA, 14 nt, Human
agagacagaaagca

SEQ ID NO: 728955 - RNA, 19 nt, Human
auuggagcucgugggacag

SEQ ID NO: 728956 - RNA, 18 nt, Human
uaucaaaagaaagaaaau

SEQ ID NO: 728957 - RNA, 19 nt, Human
aaaauaacaauaaaagaca

SEQ ID NO: 728958 - RNA, 19 nt, Human
ccccugcaaagcccagcuu

SEQ ID NO: 728959 - RNA, 20 nt, Human
auauuuuauaucaauuuaaa

SEQ ID NO: 728960 - RNA, 17 nt, Human
aauuugguucuaggccg

SEQ ID NO: 728961 - RNA, 18 nt, Human
acagagacagaaagcaga

SEQ ID NO: 728962 - RNA, 19 nt, Human
augaaagcagggacuugaa

SEQ ID NO: 728963 - RNA, 19 nt, Human
cuuccagauccuggaaauc

SEQ ID NO: 728964 - RNA, 15 nt, Human
gcccacuagacccac

SEQ ID NO: 728965 - RNA, 20 nt, Human
caagcucuaucaccaaggag

SEQ ID NO: 728966 - RNA, 15 nt, Human
ggcaagcucuaucac

SEQ ID NO: 728967 - RNA, 23 nt, Human
aaagcccagcuugaaaccuucac

SEQ ID NO: 728968 - RNA, 21 nt, Human
ccucccuuggggccuaugcag

SEQ ID NO: 728969 - RNA, 15 nt, Human
uaggaaauauuuauu

SEQ ID NO: 728970 - RNA, 14 nt, Human
uaaaggaauuuaaa

SEQ ID NO: 728971 - RNA, 23 nt, Human
cgcaggaccaucccggccggcgc

SEQ ID NO: 728972 - RNA, 17 nt, Human
gaaguugcagugagcug

SEQ ID NO: 728973 - RNA, 20 nt, Human
gaccauacuaauuauacccc

SEQ ID NO: 728974 - RNA, 22 nt, Human
auaacaaugcuguauuuuaaaa

SEQ ID NO: 728975 - RNA, 14 nt, Human
cucuaggacauaaa

SEQ ID NO: 728976 - RNA, 15 nt, Human
gccuguaaucccagc

SEQ ID NO: 728977 - RNA, 18 nt, Human
acucuuaagaagacugca

SEQ ID NO: 728978 - RNA, 21 nt, Human
aaugaauggcuaagcaaaaug

SEQ ID NO: 728979 - RNA, 21 nt, Human
gaaaacaauaacgauaaaaga

SEQ ID NO: 728980 - RNA, 12 nt, Human
uuuuauauuuga

SEQ ID NO: 728981 - RNA, 15 nt, Human
cccggccggcgcgcu

SEQ ID NO: 728982 - RNA, 20 nt, Human
cagcuuguuauuuauaacaa

SEQ ID NO: 728983 - RNA, 12 nt, Human
ggaggcugagau

SEQ ID NO: 728984 - RNA, 17 nt, Human
uucacuguaaaauaaua

SEQ ID NO: 728985 - RNA, 14 nt, Human
caaggaaaaaauaa

SEQ ID NO: 728986 - RNA, 23 nt, Human
gauagauaggucagugcaaauac

SEQ ID NO: 728987 - RNA, 19 nt, Human
aguuguaauuuuuuugugg

SEQ ID NO: 728988 - RNA, 20 nt, Human
acaagacccaaaaggcagaa

SEQ ID NO: 728989 - RNA, 13 nt, Human
cugccuucucaac

SEQ ID NO: 728990 - RNA, 14 nt, Human
gcgcugcgcgccgc

SEQ ID NO: 728991 - RNA, 16 nt, Human
ccccugcacuccagcc

SEQ ID NO: 728992 - RNA, 12 nt, Human
ucuuucaugaag

SEQ ID NO: 728993 - RNA, 16 nt, Human
gccgcgcugcgcgccg

SEQ ID NO: 728994 - RNA, 13 nt, Human
aucauuaaaguuc

SEQ ID NO: 728995 - RNA, 15 nt, Human
auccuagucucuauc

SEQ ID NO: 728996 - RNA, 16 nt, Human
cuagaacucccuuuca

SEQ ID NO: 728997 - RNA, 21 nt, Human
cgaaguauccuucagccugaa

SEQ ID NO: 728998 - RNA, 20 nt, Human
auuacauuuguauaaaauaa

SEQ ID NO: 728999 - RNA, 17 nt, Human
ugaucaccugcccugcu

SEQ ID NO: 729000 - RNA, 12 nt, Human
caggacagcccu

SEQ ID NO: 729001 - RNA, 12 nt, Human
agacucugucuc

SEQ ID NO: 729002 - RNA, 14 nt, Human
uccaagccugacca

SEQ ID NO: 729003 - RNA, 14 nt, Human
auaaauaaaaauaa

SEQ ID NO: 729004 - RNA, 19 nt, Human
agauuugagcucagcccug

SEQ ID NO: 729005 - RNA, 14 nt, Human
aaauauaaauaaaa

SEQ ID NO: 729006 - RNA, 22 nt, Human
ccucccuuggggccuaugcaga

SEQ ID NO: 729007 - RNA, 13 nt, Human
gaggcaagagaau

SEQ ID NO: 729008 - RNA, 20 nt, Human
uugaacccgggaggcagagg

SEQ ID NO: 729009 - RNA, 17 nt, Human
ccuguaaucccagcacu

SEQ ID NO: 729010 - RNA, 14 nt, Human
aaaaauaaaaauaa

SEQ ID NO: 729011 - RNA, 11 nt, Human
acuaaaaauac

SEQ ID NO: 729012 - RNA, 12 nt, Human
aauaauuuuuaa

SEQ ID NO: 729013 - RNA, 22 nt, Human
cgggucgcaggaccaucccggc

SEQ ID NO: 729014 - RNA, 22 nt, Human
cuaagcuucacuguaaaauaau

SEQ ID NO: 729015 - RNA, 17 nt, Human
caagccuccuuuuaaag

SEQ ID NO: 729016 - RNA, 21 nt, Human
cuaguaucaaaagaaagaaaa

SEQ ID NO: 729017 - RNA, 14 nt, Human
cuugagguaaaagc

SEQ ID NO: 729018 - RNA, 17 nt, Human
gcaaauugucacaggac

SEQ ID NO: 729019 - RNA, 14 nt, Human
uucccgcuguuccu

SEQ ID NO: 729020 - RNA, 23 nt, Human
caucaacagauaaauaguuuaug

SEQ ID NO: 729021 - RNA, 15 nt, Human
cagccagcacagccu

SEQ ID NO: 729022 - RNA, 18 nt, Human
auuuaggccaugggacag

SEQ ID NO: 729023 - RNA, 22 nt, Human
ucuagcaugucgucaaagcuga

SEQ ID NO: 729024 - RNA, 15 nt, Human
gagaugcuagaacuc

SEQ ID NO: 729025 - RNA, 14 nt, Human
aauacucuuaggaa

SEQ ID NO: 729026 - RNA, 22 nt, Human
auauaugcuaagucuuauauau

SEQ ID NO: 729027 - RNA, 18 nt, Human
uuuuagugaaauauuauu

SEQ ID NO: 729028 - RNA, 20 nt, Human
uuacaaauccaaugaaauga

SEQ ID NO: 729029 - RNA, 23 nt, Human
aguaauuggaaaggcagcucuaa

SEQ ID NO: 729030 - RNA, 11 nt, Human
ucaccuccccc

SEQ ID NO: 729031 - RNA, 14 nt, Human
agaaaugaaagcag

SEQ ID NO: 729032 - RNA, 22 nt, Human
aucaucaagucuuucacauuua

SEQ ID NO: 729033 - RNA, 14 nt, Human
ccugccccccagcc

SEQ ID NO: 729034 - RNA, 21 nt, Human
cucugucucaaaaaauaaaaa

SEQ ID NO: 729035 - RNA, 20 nt, Human
uuccacagaagcuccaggua

SEQ ID NO: 729036 - RNA, 15 nt, Human
agccgggaaagaaga

SEQ ID NO: 729037 - RNA, 17 nt, Human
uaaaagacagugaaaga

SEQ ID NO: 729038 - RNA, 21 nt, Human
auaguuguaccgcaaugugac

SEQ ID NO: 729039 - RNA, 21 nt, Human
uauaaaauaauuuuuauauuu

SEQ ID NO: 729040 - RNA, 13 nt, Human
agcucugcccauc

SEQ ID NO: 729041 - RNA, 22 nt, Human
caauaaaagacaaggaaaaaau

SEQ ID NO: 729042 - RNA, 14 nt, Human
aauauuauuuuaua

SEQ ID NO: 729043 - RNA, 23 nt, Human
caacggggugaaacccugucucu

SEQ ID NO: 729044 - RNA, 22 nt, Human
auauuuacaaaugggaaacaaa

SEQ ID NO: 729045 - RNA, 19 nt, Human
cagcacgggggccaaggau

SEQ ID NO: 729046 - RNA, 16 nt, Human
aaauauuuauuuuaau

SEQ ID NO: 729047 - RNA, 17 nt, Human
auauuugaaauauugac

SEQ ID NO: 729048 - RNA, 15 nt, Human
ugcagauaaacagua

SEQ ID NO: 729049 - RNA, 17 nt, Human
gccggagccuccagcug

SEQ ID NO: 729050 - RNA, 11 nt, Human
ugcagugagcc

SEQ ID NO: 729051 - RNA, 21 nt, Human
gcugagucccaggcugagccu

SEQ ID NO: 729052 - RNA, 16 nt, Human
auuauacccccugcaa

SEQ ID NO: 729053 - RNA, 14 nt, Human
ggacucaccucccc

SEQ ID NO: 729054 - RNA, 18 nt, Human
acaugaacuuguaaagga

SEQ ID NO: 729055 - RNA, 12 nt, Human
auauuauaauuu

SEQ ID NO: 729056 - RNA, 21 nt, Human
caacccccauuucuauuuauu

SEQ ID NO: 729057 - RNA, 12 nt, Human
gauaaaagacag

SEQ ID NO: 729058 - RNA, 13 nt, Human
gaagagccggagc

SEQ ID NO: 729059 - RNA, 15 nt, Human
auuugaguguuuuaa

SEQ ID NO: 729060 - RNA, 12 nt, Human
aagaaaauaacg

SEQ ID NO: 729061 - RNA, 18 nt, Human
cagcuacuugggaggcug

SEQ ID NO: 729062 - RNA, 14 nt, Human
auauuuauuaccuc

SEQ ID NO: 729063 - RNA, 21 nt, Human
aacuuauccuccaugaauauc

SEQ ID NO: 729064 - RNA, 14 nt, Human
acccaaaaggcaga

SEQ ID NO: 729065 - RNA, 16 nt, Human
gcuccggacgcugcug

SEQ ID NO: 729066 - RNA, 17 nt, Human
ggcccugugcggccugg

SEQ ID NO: 729067 - RNA, 19 nt, Human
ucucuaucauuaaaguucu

SEQ ID NO: 729068 - RNA, 22 nt, Human
aaaaaaccugagccccaaaagg

SEQ ID NO: 729069 - RNA, 16 nt, Human
cucagcccuggugggc

SEQ ID NO: 729070 - RNA, 22 nt, Human
cggccugcucgcccacuuccuc

SEQ ID NO: 729071 - RNA, 16 nt, Human
ugacacuuaaaaaugg

SEQ ID NO: 729072 - RNA, 18 nt, Human
gccuccagcugccccggg

SEQ ID NO: 729073 - RNA, 14 nt, Human
cggacggcuccgga

SEQ ID NO: 729074 - RNA, 18 nt, Human
ccggagccuccagcugcc

SEQ ID NO: 729075 - RNA, 16 nt, Human
ugacuuaaugccacua

SEQ ID NO: 729076 - RNA, 18 nt, Human
gccuucggccuccauccu

SEQ ID NO: 729077 - RNA, 15 nt, Human
uauuguaccucucuu

SEQ ID NO: 729078 - RNA, 23 nt, Human
uagacacacaugaaguccaagca

SEQ ID NO: 729079 - RNA, 21 nt, Human
cagccugggugacagagcaag

SEQ ID NO: 729080 - RNA, 12 nt, Human
gcauccuagucu

SEQ ID NO: 729081 - RNA, 19 nt, Human
cuccgcuacuuccagggcu

SEQ ID NO: 729082 - RNA, 14 nt, Human
uccacaacacacag

SEQ ID NO: 729083 - RNA, 21 nt, Human
auuuuccugaaaacccuugcc

SEQ ID NO: 729084 - RNA, 14 nt, Human
agcaaguauuagaa

SEQ ID NO: 729085 - RNA, 21 nt, Human
caccagucugacuguuuccau

SEQ ID NO: 729086 - RNA, 19 nt, Human
gguuccuuccucugagccu

SEQ ID NO: 729087 - RNA, 12 nt, Human
ucuuaagaagac

SEQ ID NO: 729088 - RNA, 16 nt, Human
cacgugugggcaaugu

SEQ ID NO: 729089 - RNA, 22 nt, Human
cuccagccugagcgacagugag

SEQ ID NO: 729090 - RNA, 20 nt, Human
aaagagugaaggauuuaugu

SEQ ID NO: 729091 - RNA, 16 nt, Human
ccugccccccagcccu

SEQ ID NO: 729092 - RNA, 14 nt, Human
cucgcccacuuccu

SEQ ID NO: 729093 - RNA, 13 nt, Human
aucaaugaaugaa

SEQ ID NO: 729094 - RNA, 13 nt, Human
ucacuguaaaaua

SEQ ID NO: 729095 - RNA, 16 nt, Human
gggccgacggagccgg

SEQ ID NO: 729096 - RNA, 20 nt, Human
aguuguuucuacuacaugga

SEQ ID NO: 729097 - RNA, 19 nt, Human
acauuuguauaaaauaauu

SEQ ID NO: 729098 - RNA, 19 nt, Human
auagugaggagcuuugaaa

SEQ ID NO: 729099 - RNA, 20 nt, Human
uguaaaggaauuuaaaaauc

SEQ ID NO: 729100 - RNA, 19 nt, Human
gagguacugagagugaaca

SEQ ID NO: 729101 - RNA, 16 nt, Human
auacauguuacaacac

SEQ ID NO: 729102 - RNA, 18 nt, Human
gacauuugcucauggaau

SEQ ID NO: 729103 - RNA, 18 nt, Human
aucuacacuccagugaga

SEQ ID NO: 729104 - RNA, 14 nt, Human
aucaguuauuuuua

SEQ ID NO: 729105 - RNA, 16 nt, Human
agcuugaaaccuucac

SEQ ID NO: 729106 - RNA, 18 nt, Human
cccacuggacucaccucc

SEQ ID NO: 729107 - RNA, 14 nt, Human
aauaaaaauaaauu

SEQ ID NO: 729108 - RNA, 14 nt, Human
uaaauaaaaauaau

SEQ ID NO: 729109 - RNA, 14 nt, Human
ggagccuccagcug

SEQ ID NO: 729110 - RNA, 14 nt, Human
cccggccggcgcgc

SEQ ID NO: 729111 - RNA, 12 nt, Human
gucauuguucuu

SEQ ID NO: 729112 - RNA, 18 nt, Human
cugagucccaggcugagc

SEQ ID NO: 729113 - RNA, 17 nt, Human
auuuugaauaaauaaau

SEQ ID NO: 729114 - RNA, 15 nt, Human
gcugguggcgcuggc

SEQ ID NO: 729115 - RNA, 16 nt, Human
auuuuaauaauguuuc

SEQ ID NO: 729116 - RNA, 16 nt, Human
agccucagucucccuc

SEQ ID NO: 729117 - RNA, 19 nt, Human
gaaaauaacgauaaaagac

SEQ ID NO: 729118 - RNA, 16 nt, Human
aaaauaauccucaguu

SEQ ID NO: 729119 - RNA, 22 nt, Human
caucgcaauguaagacucggga

SEQ ID NO: 729120 - RNA, 20 nt, Human
augucgucaaagcugaaaug

SEQ ID NO: 729121 - RNA, 21 nt, Human
cccccauuguggucacaggaa

SEQ ID NO: 729122 - RNA, 16 nt, Human
auuuguauaaaauaau

SEQ ID NO: 729123 - RNA, 20 nt, Human
uaaaagacagugaaagaaaa

SEQ ID NO: 729124 - RNA, 15 nt, Human
cugaggcaagagaau

SEQ ID NO: 729125 - RNA, 18 nt, Human
aaaagacaaggaaaaaau

SEQ ID NO: 729126 - RNA, 22 nt, Human
gcuaaaacaagcacuaaacaaa

SEQ ID NO: 729127 - RNA, 15 nt, Human
aucaguaugaaaaug

SEQ ID NO: 729128 - RNA, 12 nt, Human
gaauuggagcuc

SEQ ID NO: 729129 - RNA, 14 nt, Human
auugucuagugaaa

SEQ ID NO: 729130 - RNA, 15 nt, Human
auaauuuugugaagc

SEQ ID NO: 729131 - RNA, 18 nt, Human
aaaaucuuauaauuuaaa

SEQ ID NO: 729132 - RNA, 15 nt, Human
cccuguacuccagcc

SEQ ID NO: 729133 - RNA, 17 nt, Human
cacgccuguaaucccag

SEQ ID NO: 729134 - RNA, 20 nt, Human
caagccuccuuuuaaaguaa

SEQ ID NO: 729135 - RNA, 21 nt, Human
uguauaaaauaauuuuuauau

SEQ ID NO: 729136 - RNA, 15 nt, Human
gccccauucaacauc

SEQ ID NO: 729137 - RNA, 20 nt, Human
auauauuuuuuuuuuuaaaa

SEQ ID NO: 729138 - RNA, 16 nt, Human
cagggcucacagaauu

SEQ ID NO: 729139 - RNA, 12 nt, Human
auauaaauaaaa

SEQ ID NO: 729140 - RNA, 12 nt, Human
auaaaaauaaau

SEQ ID NO: 729141 - RNA, 12 nt, Human
aaaauaacaaua

SEQ ID NO: 729142 - RNA, 17 nt, Human
auuauuuuuuaaaaaaa

SEQ ID NO: 729143 - RNA, 19 nt, Human
guaguccuguaauggaagc

SEQ ID NO: 729144 - RNA, 22 nt, Human
cgcgcagcucaggcuggcaccg

SEQ ID NO: 729145 - RNA, 22 nt, Human
agugagcagucaggaaagagaa

SEQ ID NO: 729146 - RNA, 13 nt, Human
acaaggaaaaaau

SEQ ID NO: 729147 - RNA, 18 nt, Human
auuugcuggagcucugcc

SEQ ID NO: 729148 - RNA, 15 nt, Human
acugaagaagcacca

SEQ ID NO: 729149 - RNA, 19 nt, Human
aagcauuccaacuaucuca

SEQ ID NO: 729150 - RNA, 16 nt, Human
acauuuauauuuuugu

SEQ ID NO: 729151 - RNA, 18 nt, Human
caugaauuaguuuuauau

SEQ ID NO: 729152 - RNA, 10 nt, Human
acuuccuccc

SEQ ID NO: 729153 - RNA, 14 nt, Human
cucccggccgcgcu

SEQ ID NO: 729154 - RNA, 21 nt, Human
cuaccaaaaaucucaauauuu

SEQ ID NO: 729155 - RNA, 15 nt, Human
cuuugaugauuaauu

SEQ ID NO: 729156 - RNA, 23 nt, Human
cgagccccaggcggguccggguc

SEQ ID NO: 729157 - RNA, 16 nt, Human
cuacacuccagugaga

SEQ ID NO: 729158 - RNA, 14 nt, Human
cacaagaaaugaaa

SEQ ID NO: 729159 - RNA, 14 nt, Human
uucuaugaaauauu

SEQ ID NO: 729160 - RNA, 12 nt, Human
caugggaaguga

SEQ ID NO: 729161 - RNA, 22 nt, Human
uuuauugaggcuuuaaaacuua

SEQ ID NO: 729162 - RNA, 17 nt, Human
ucuuucacauuuaaaua

SEQ ID NO: 729163 - RNA, 14 nt, Human
acauagugaggagc

SEQ ID NO: 729164 - RNA, 22 nt, Human
auggaaauguuuacagaucccc

SEQ ID NO: 729165 - RNA, 14 nt, Human
uauagaauauuuau

SEQ ID NO: 729166 - RNA, 16 nt, Human
cucgccacgcucuggg

SEQ ID NO: 729167 - RNA, 16 nt, Human
gagaaacuggaacucu

SEQ ID NO: 729168 - RNA, 22 nt, Human
agaaaccuuauuguaccucucu

SEQ ID NO: 729169 - RNA, 23 nt, Human
gaaaaugucauuguucuugugaa

SEQ ID NO: 729170 - RNA, 17 nt, Human
caauucgauccccuguc

SEQ ID NO: 729171 - RNA, 19 nt, Human
ggccugcucgcccacuucc

SEQ ID NO: 729172 - RNA, 16 nt, Human
ucccugccccccagcc

SEQ ID NO: 729173 - RNA, 17 nt, Human
uuauuacuguaagaaaa

SEQ ID NO: 729174 - RNA, 16 nt, Human
uugccauaauuacuau

SEQ ID NO: 729175 - RNA, 20 nt, Human
caggcugagccucagucucc

SEQ ID NO: 729176 - RNA, 13 nt, Human
ccaaaagguauuu

SEQ ID NO: 729177 - RNA, 19 nt, Human
cuccucggacggcuccgga

SEQ ID NO: 729178 - RNA, 13 nt, Human
gcagaacagugau

SEQ ID NO: 729179 - RNA, 17 nt, Human
uccugccccugagccca

SEQ ID NO: 729180 - RNA, 23 nt, Human
acucuauguucuaagaagugaaa

SEQ ID NO: 729181 - RNA, 20 nt, Human
cccugccccccagcccuccu

SEQ ID NO: 729182 - RNA, 22 nt, Human
cccaugauguuuagaaacacaa

SEQ ID NO: 729183 - RNA, 18 nt, Human
agguccacaacacacaga

SEQ ID NO: 729184 - RNA, 19 nt, Human
ccucaacccccauuucuau

SEQ ID NO: 729185 - RNA, 15 nt, Human
ugagguaaccucauu

SEQ ID NO: 729186 - RNA, 18 nt, Human
cuccagccugagcgacag

SEQ ID NO: 729187 - RNA, 15 nt, Human
cauuccaagccucau

SEQ ID NO: 729188 - RNA, 22 nt, Human
gcgacucuauagacucuaggac

SEQ ID NO: 729189 - RNA, 22 nt, Human
uacaugagguacugagagugaa

SEQ ID NO: 729190 - RNA, 17 nt, Human
caaacauauauaacaau

SEQ ID NO: 729191 - RNA, 22 nt, Human
cucuggccuucggccuccaucc

SEQ ID NO: 729192 - RNA, 22 nt, Human
cuucagccugaaagaggaauga

SEQ ID NO: 729193 - RNA, 20 nt, Human
cucuguucugcacacagcac

SEQ ID NO: 729194 - RNA, 17 nt, Human
ucgggauuaguacacac

SEQ ID NO: 729195 - RNA, 12 nt, Human
uucccugaccuc

SEQ ID NO: 729196 - RNA, 13 nt, Human
acggggugaaacc

SEQ ID NO: 729197 - RNA, 16 nt, Human
uggggauagugaggca

SEQ ID NO: 729198 - RNA, 21 nt, Human
gcccugcugagucccaggcug

SEQ ID NO: 729199 - RNA, 14 nt, Human
gcgcccucuggcug

SEQ ID NO: 729200 - RNA, 19 nt, Human
ggaucuggggcucugggau

SEQ ID NO: 729201 - RNA, 14 nt, Human
cggggagcgagccc

SEQ ID NO: 729202 - RNA, 13 nt, Human
aacaauaaaagac

SEQ ID NO: 729203 - RNA, 15 nt, Human
aaggaauuuaaaaau

SEQ ID NO: 729204 - RNA, 19 nt, Human
aaauaugccccauucaaca

SEQ ID NO: 729205 - RNA, 19 nt, Human
guuauuauauuuacaaaug

SEQ ID NO: 729206 - RNA, 21 nt, Human
uuacauuuguauaaaauaauu

SEQ ID NO: 729207 - RNA, 19 nt, Human
aaugaauggcuaagcaaaa

SEQ ID NO: 729208 - RNA, 13 nt, Human
uuccucugagccu

SEQ ID NO: 729209 - RNA, 15 nt, Human
uggacgagaaaacaa

SEQ ID NO: 729210 - RNA, 18 nt, Human
auagcuacuaauuuuaaa

SEQ ID NO: 729211 - RNA, 18 nt, Human
cagggaggacgcucucug

SEQ ID NO: 729212 - RNA, 17 nt, Human
acaaaugcauuucuaaa

SEQ ID NO: 729213 - RNA, 16 nt, Human
ucuugagguaaaagca

SEQ ID NO: 729214 - RNA, 18 nt, Human
uaauaauguuucaaacau

SEQ ID NO: 729215 - RNA, 12 nt, Human
gggcgcgguggc

SEQ ID NO: 729216 - RNA, 22 nt, Human
uguugcccacagcuguaugauu

SEQ ID NO: 729217 - RNA, 14 nt, Human
cgcuccgcgcagcu

SEQ ID NO: 729218 - RNA, 19 nt, Human
uuuauaucaauuuaaaaaa

SEQ ID NO: 729219 - RNA, 11 nt, Human
aauauuauaau

SEQ ID NO: 729220 - RNA, 16 nt, Human
ugagaugcuagaacuc

SEQ ID NO: 729221 - RNA, 18 nt, Human
cggagccuccagcugccc

SEQ ID NO: 729222 - RNA, 15 nt, Human
uguuaaaugauuuca

SEQ ID NO: 729223 - RNA, 16 nt, Human
ucaaaaaauaaaaaua

SEQ ID NO: 729224 - RNA, 16 nt, Human
aucaauuuaaaaaaaa

SEQ ID NO: 729225 - RNA, 15 nt, Human
aggagauggaaguug

SEQ ID NO: 729226 - RNA, 21 nt, Human
caagacucugucucaaaaaau

SEQ ID NO: 729227 - RNA, 21 nt, Human
ucuucaacucccugcccccca

SEQ ID NO: 729228 - RNA, 23 nt, Human
cccagcccuccuuaucaaaggac

SEQ ID NO: 729229 - RNA, 16 nt, Human
auccaaugaaaugagu

SEQ ID NO: 729230 - RNA, 14 nt, Human
cgucccccucuggc

SEQ ID NO: 729231 - RNA, 19 nt, Human
acaaauuuacagagacaga

SEQ ID NO: 729232 - RNA, 13 nt, Human
uacagagacagaa

SEQ ID NO: 729233 - RNA, 15 nt, Human
gaagauguagaggag

SEQ ID NO: 729234 - RNA, 21 nt, Human
auguuuacagauccccaagcc

SEQ ID NO: 729235 - RNA, 22 nt, Human
uucuagcuguugagcuguuuuc

SEQ ID NO: 729236 - RNA, 20 nt, Human
cacuagacccacuggacuca

SEQ ID NO: 729237 - RNA, 13 nt, Human
aaauaaaaauaau

SEQ ID NO: 729238 - RNA, 17 nt, Human
cuuccucugagccuugg

SEQ ID NO: 729239 - RNA, 20 nt, Human
aaaacuuauccuccaugaau

SEQ ID NO: 729240 - RNA, 13 nt, Human
gcccccgggccga

SEQ ID NO: 729241 - RNA, 17 nt, Human
ucuuauagaauauuuau

SEQ ID NO: 729242 - RNA, 16 nt, Human
aggguguguaaguaga

SEQ ID NO: 729243 - RNA, 17 nt, Human
uacaaaugcauuucuaa

SEQ ID NO: 729244 - RNA, 22 nt, Human
guacacugccuucucaacucca

SEQ ID NO: 729245 - RNA, 17 nt, Human
auaucaauuuaaaaaaa

SEQ ID NO: 729246 - RNA, 23 nt, Human
agcucugcccauccugccccuga

SEQ ID NO: 729247 - RNA, 19 nt, Human
cuaagcuucacuguaaaau

SEQ ID NO: 729248 - RNA, 18 nt, Human
acugccuucucaacucca

SEQ ID NO: 729249 - RNA, 15 nt, Human
uauuuauuuuaauaa

SEQ ID NO: 729250 - RNA, 17 nt, Human
gaagcaccaaucaugaa

SEQ ID NO: 729251 - RNA, 15 nt, Human
cuugaaaacuuuaug

SEQ ID NO: 729252 - RNA, 18 nt, Human
uaauuuugaauaaauaaa

SEQ ID NO: 729253 - RNA, 16 nt, Human
cuccauccugaggcuc

SEQ ID NO: 729254 - RNA, 19 nt, Human
uagugagcagucaggaaag

SEQ ID NO: 729255 - RNA, 22 nt, Human
augguuguauuauuuuuuaaaa

SEQ ID NO: 729256 - RNA, 19 nt, Human
ucaguccaugaagauguag

SEQ ID NO: 729257 - RNA, 13 nt, Human
uuuucaauauuua

SEQ ID NO: 729258 - RNA, 14 nt, Human
agcucguggaacag

SEQ ID NO: 729259 - RNA, 16 nt, Human
cuguaaucccagcacu

SEQ ID NO: 729260 - RNA, 23 nt, Human
uccaaacugacucuuaagaagac

SEQ ID NO: 729261 - RNA, 17 nt, Human
aaauguucaucaaugaa

SEQ ID NO: 729262 - RNA, 15 nt, Human
aaugauuaugaauua

SEQ ID NO: 729263 - RNA, 20 nt, Human
uuugcaagccagauuuuccu

SEQ ID NO: 729264 - RNA, 13 nt, Human
aggaaaaaauaac

SEQ ID NO: 729265 - RNA, 15 nt, Human
ugaaacccugucucu

SEQ ID NO: 729266 - RNA, 13 nt, Human
cgagccccaggcg

SEQ ID NO: 729267 - RNA, 17 nt, Human
cgcgagcgcgcgcgccc

SEQ ID NO: 729268 - RNA, 16 nt, Human
ugaaguacucauacau

SEQ ID NO: 729269 - RNA, 17 nt, Human
gaaaaucaggcuggcca

SEQ ID NO: 729270 - RNA, 22 nt, Human
uguugagcuguuuucccugacc

SEQ ID NO: 729271 - RNA, 18 nt, Human
auaaaguguuugaaagcu

SEQ ID NO: 729272 - RNA, 21 nt, Human
auccccaagccuggcaaggga

SEQ ID NO: 729273 - RNA, 23 nt, Human
auguuaaaacugggacaggggag

SEQ ID NO: 729274 - RNA, 15 nt, Human
cgcgcuccgcgcagc

SEQ ID NO: 729275 - RNA, 14 nt, Human
ccaucccggccggc

SEQ ID NO: 729276 - RNA, 17 nt, Human
cuccuuaucaaaggaca

SEQ ID NO: 729277 - RNA, 16 nt, Human
uguccccuauccuacu

SEQ ID NO: 729278 - RNA, 21 nt, Human
aaaugucuugcuugauuguau

SEQ ID NO: 729279 - RNA, 12 nt, Human
gcucagcccugg

SEQ ID NO: 729280 - RNA, 13 nt, Human
auccuagucucua

SEQ ID NO: 729281 - RNA, 13 nt, Human
ucuuauucacauc

SEQ ID NO: 729282 - RNA, 16 nt, Human
uaaaauccauacauuu

SEQ ID NO: 729283 - RNA, 14 nt, Human
acucuauagacucu

SEQ ID NO: 729284 - RNA, 21 nt, Human
ugaccauacuaauuauacccc

SEQ ID NO: 729285 - RNA, 15 nt, Human
cccccagcccuccuu

SEQ ID NO: 729286 - RNA, 20 nt, Human
acuccagugagacagcucug

SEQ ID NO: 729287 - RNA, 22 nt, Human
cccuauccuacuuccccuuccu

SEQ ID NO: 729288 - RNA, 20 nt, Human
uguaagaaaauaucacuugu

SEQ ID NO: 729289 - RNA, 16 nt, Human
cuuugaugauuaauuc

SEQ ID NO: 729290 - RNA, 15 nt, Human
aucaaaggacaccau

SEQ ID NO: 729291 - RNA, 14 nt, Human
ugugaaaagcucca

SEQ ID NO: 729292 - RNA, 18 nt, Human
ccaaccuggaguugaaaa

SEQ ID NO: 729293 - RNA, 21 nt, Human
gcgcucggccugcucgcccac

SEQ ID NO: 729294 - RNA, 15 nt, Human
augggacagggagga

SEQ ID NO: 729295 - RNA, 20 nt, Human
cagcuggccgggagccugau

SEQ ID NO: 729296 - RNA, 17 nt, Human
aguuauuuuuaaacugu

SEQ ID NO: 729297 - RNA, 17 nt, Human
cugcgcucggccugcuc

SEQ ID NO: 729298 - RNA, 18 nt, Human
auccuucagccugaaaga

SEQ ID NO: 729299 - RNA, 16 nt, Human
cauuucuaaagccauu

SEQ ID NO: 729300 - RNA, 16 nt, Human
gaagagaaaccaggga

SEQ ID NO: 729301 - RNA, 14 nt, Human
ccggagccuccagc

SEQ ID NO: 729302 - RNA, 12 nt, Human
uuaauaaaccau

SEQ ID NO: 729303 - RNA, 17 nt, Human
agaugggagaaucacuu

SEQ ID NO: 729304 - RNA, 18 nt, Human
gaaaugaaagcagggacu

SEQ ID NO: 729305 - RNA, 17 nt, Human
augccccgucccccucu

SEQ ID NO: 729306 - RNA, 22 nt, Human
aauugacccacaagaaaugaaa

SEQ ID NO: 729307 - RNA, 19 nt, Human
aauaaauguaucuuauuca

SEQ ID NO: 729308 - RNA, 18 nt, Human
ccuguaaucccagcuacu

SEQ ID NO: 729309 - RNA, 16 nt, Human
uccuguaauggaagca

SEQ ID NO: 729310 - RNA, 23 nt, Human
cugauaucaugccccuguacucc

SEQ ID NO: 729311 - RNA, 17 nt, Human
caacauggugaaacccc

SEQ ID NO: 729312 - RNA, 17 nt, Human
aauaacgauaaaagaca

SEQ ID NO: 729313 - RNA, 21 nt, Human
cggcuccggacgcugcugccg

SEQ ID NO: 729314 - RNA, 17 nt, Human
aaauauaaauaaaaaua

SEQ ID NO: 729315 - RNA, 19 nt, Human
agcuacuaauuuuaaaaug

SEQ ID NO: 729316 - RNA, 14 nt, Human
cuggagcucugccc

SEQ ID NO: 729317 - RNA, 21 nt, Human
aggcucuuuugggauuuuuga

SEQ ID NO: 729318 - RNA, 14 nt, Human
cuggaaaucagggu

SEQ ID NO: 729319 - RNA, 20 nt, Human
aaugaauacuuuauaaagga

SEQ ID NO: 729320 - RNA, 15 nt, Human
guuuuucuuuucauu

SEQ ID NO: 729321 - RNA, 13 nt, Human
uccucccggccgc

SEQ ID NO: 729322 - RNA, 18 nt, Human
uaagcuucacuguaaaau

SEQ ID NO: 729323 - RNA, 14 nt, Human
uaauccuaaacaua

SEQ ID NO: 729324 - RNA, 23 nt, Human
ggcuaagcuucacuguaaaauaa

SEQ ID NO: 729325 - RNA, 21 nt, Human
acagugaaagaaaauaacaau

SEQ ID NO: 729326 - RNA, 15 nt, Human
uccauccugaggcuc

SEQ ID NO: 729327 - RNA, 23 nt, Human
ggaugguucccuugaugaagaag

SEQ ID NO: 729328 - RNA, 21 nt, Human
ugagcucagcccuggugggca

SEQ ID NO: 729329 - RNA, 16 nt, Human
gacaagcucacagacc

SEQ ID NO: 729330 - RNA, 17 nt, Human
ugcacaucaaaauaugc

SEQ ID NO: 729331 - RNA, 22 nt, Human
ggcagcuuuccucaaaacuuca

SEQ ID NO: 729332 - RNA, 15 nt, Human
auaauccuaaacaua

SEQ ID NO: 729333 - RNA, 15 nt, Human
acgagauacagaauu

SEQ ID NO: 729334 - RNA, 20 nt, Human
cugcacuccagccugagcga

SEQ ID NO: 729335 - RNA, 21 nt, Human
ugaaacgaggauugggaaaaa

SEQ ID NO: 729336 - RNA, 18 nt, Human
ucuuauagaauauuuauu

SEQ ID NO: 729337 - RNA, 14 nt, Human
auccuugaagauuu

SEQ ID NO: 729338 - RNA, 19 nt, Human
cuucuggguuccuuccucu

SEQ ID NO: 729339 - RNA, 21 nt, Human
augucauuugcuggagcucug

SEQ ID NO: 729340 - RNA, 16 nt, Human
ccugagcuugcagaga

SEQ ID NO: 729341 - RNA, 18 nt, Human
cuaauuuaucuugucucu

SEQ ID NO: 729342 - RNA, 16 nt, Human
uccugcaauuccacuu

SEQ ID NO: 729343 - RNA, 16 nt, Human
aaaaauuccaagugau

SEQ ID NO: 729344 - RNA, 16 nt, Human
cuguacgcgagcgcgc

SEQ ID NO: 729345 - RNA, 23 nt, Human
aauauuuauuuuaauaauguuuc

SEQ ID NO: 729346 - RNA, 15 nt, Human
aguaugugcauauuu

SEQ ID NO: 729347 - RNA, 13 nt, Human
agccuccagcugc

SEQ ID NO: 729348 - RNA, 22 nt, Human
uuuauagcuacuaauuuuaaaa

SEQ ID NO: 729349 - RNA, 20 nt, Human
guccccuauccuacuucccc

SEQ ID NO: 729350 - RNA, 13 nt, Human
aaguucuagugac

SEQ ID NO: 729351 - RNA, 17 nt, Human
ugaaaaucuuauaauuu

SEQ ID NO: 729352 - RNA, 18 nt, Human
uuuugugaagcaaaauuu

SEQ ID NO: 729353 - RNA, 20 nt, Human
ucacaugaacuuguaaagga

SEQ ID NO: 729354 - RNA, 15 nt, Human
ugccccgucccccuc

SEQ ID NO: 729355 - RNA, 18 nt, Human
cagucucccucccuuggg

SEQ ID NO: 729356 - RNA, 20 nt, Human
auuuugugauugauuauaug

SEQ ID NO: 729357 - RNA, 17 nt, Human
aucccagcacuuuggga

SEQ ID NO: 729358 - RNA, 15 nt, Human
uuauuuuuaaacugu

SEQ ID NO: 729359 - RNA, 20 nt, Human
uccuccaugaauaucaguua

SEQ ID NO: 729360 - RNA, 13 nt, Human
auccugaggcucc

SEQ ID NO: 729361 - RNA, 22 nt, Human
cucugagccuugggaccccuga

SEQ ID NO: 729362 - RNA, 21 nt, Human
aacuuguaaaggaauuuaaaa

SEQ ID NO: 729363 - RNA, 19 nt, Human
guacaagagcuuaacagug

SEQ ID NO: 729364 - RNA, 20 nt, Human
ucauucacucaacaaacaua

SEQ ID NO: 729365 - RNA, 22 nt, Human
agacccacuggacucaccuccc

SEQ ID NO: 729366 - RNA, 21 nt, Human
auuuacaaaugggaaacaaaa

SEQ ID NO: 729367 - RNA, 14 nt, Human
cagucucccucccu

SEQ ID NO: 729368 - RNA, 22 nt, Human
caugaguaacugauuuguaaca

SEQ ID NO: 729369 - RNA, 23 nt, Human
cccacuggacucaccucccccau

SEQ ID NO: 729370 - RNA, 12 nt, Human
cucuaucauuaa

SEQ ID NO: 729371 - RNA, 16 nt, Human
ccuguacuccagccug

SEQ ID NO: 729372 - RNA, 15 nt, Human
gugaacuugguuuua

SEQ ID NO: 729373 - RNA, 17 nt, Human
gcuguacgcgagcgcgc

SEQ ID NO: 729374 - RNA, 23 nt, Human
caccaaggagccaaacauccuac

SEQ ID NO: 729375 - RNA, 15 nt, Human
uugccuaauuuguuu

SEQ ID NO: 729376 - RNA, 13 nt, Human
ccaaggaugcccc

SEQ ID NO: 729377 - RNA, 12 nt, Human
ucaacaugguga

SEQ ID NO: 729378 - RNA, 11 nt, Human
gcaugguuuag

SEQ ID NO: 729379 - RNA, 16 nt, Human
aaauaguuuaugauuc

SEQ ID NO: 729380 - RNA, 19 nt, Human
acagucaccucauggaauu

SEQ ID NO: 729381 - RNA, 17 nt, Human
cagacaucaacagauaa

SEQ ID NO: 729382 - RNA, 13 nt, Human
auauauauuuuuu

SEQ ID NO: 729383 - RNA, 19 nt, Human
agcucugcccauccugccc

SEQ ID NO: 729384 - RNA, 14 nt, Human
cuggccgggagccu

SEQ ID NO: 729385 - RNA, 21 nt, Human
uaguauuucuaugaaauauua

SEQ ID NO: 729386 - RNA, 22 nt, Human
aucccagcuacuugggaggcug

SEQ ID NO: 729387 - RNA, 16 nt, Human
guuccuuccucugagc

SEQ ID NO: 729388 - RNA, 19 nt, Human
cacacuaugguauuugagu

SEQ ID NO: 729389 - RNA, 18 nt, Human
caguuguugcccacagcu

SEQ ID NO: 729390 - RNA, 23 nt, Human
ggcgacucuauagacucuaggac

SEQ ID NO: 729391 - RNA, 15 nt, Human
cuucaacucccugcc

SEQ ID NO: 729392 - RNA, 16 nt, Human
ccuccuuaucaaagga

SEQ ID NO: 729393 - RNA, 15 nt, Human
uggcucacgccugua

SEQ ID NO: 729394 - RNA, 14 nt, Human
ucucaaaaaauaaa

SEQ ID NO: 729395 - RNA, 14 nt, Human
uaacuaauuuuaac

SEQ ID NO: 729396 - RNA, 14 nt, Human
cgagcgcgcgcgcc

SEQ ID NO: 729397 - RNA, 18 nt, Human
uauagcuacuaauuuuaa

SEQ ID NO: 729398 - RNA, 20 nt, Human
uaagugaaauaagccagaca

SEQ ID NO: 729399 - RNA, 15 nt, Human
acaucaacagauaaa

SEQ ID NO: 729400 - RNA, 18 nt, Human
ccuugggaccccugagcu

SEQ ID NO: 729401 - RNA, 21 nt, Human
gaaauguuuacagauccccaa

SEQ ID NO: 729402 - RNA, 15 nt, Human
uccgcauccuagucu

SEQ ID NO: 729403 - RNA, 20 nt, Human
gaaacauuugguaaggggaa

SEQ ID NO: 729404 - RNA, 16 nt, Human
acccagccccuugaga

SEQ ID NO: 729405 - RNA, 19 nt, Human
gaaaaugucauuguucuug

SEQ ID NO: 729406 - RNA, 19 nt, Human
agguaaccucauuaucagu

SEQ ID NO: 729407 - RNA, 17 nt, Human
uccuacaagacacagug

SEQ ID NO: 729408 - RNA, 16 nt, Human
auuaauucaccuucca

SEQ ID NO: 729409 - RNA, 14 nt, Human
auuuguauaaaaua

SEQ ID NO: 729410 - RNA, 22 nt, Human
ggacaguaaaauccacagacca

SEQ ID NO: 729411 - RNA, 17 nt, Human
cccggccggcgcgcuca

SEQ ID NO: 729412 - RNA, 14 nt, Human
uauuuauuuuaaua

SEQ ID NO: 729413 - RNA, 20 nt, Human
acggcuccggacgcugcugc

SEQ ID NO: 729414 - RNA, 22 nt, Human
aauaaauguaucuuauucacau

SEQ ID NO: 729415 - RNA, 13 nt, Human
agccgggaaagaa

SEQ ID NO: 729416 - RNA, 24 nt, Human
gucgcaggaccaucccggccggcg

SEQ ID NO: 729417 - RNA, 21 nt, Human
uagaaagaagcccaauauuau

SEQ ID NO: 729418 - RNA, 19 nt, Human
cuaguaucaaaagaaagaa

SEQ ID NO: 729419 - RNA, 19 nt, Human
cuggacucaccucccccau

SEQ ID NO: 729420 - RNA, 18 nt, Human
gaaaauaacaauaaaaga

SEQ ID NO: 729421 - RNA, 19 nt, Human
aaaagacagugaaagaaaa

SEQ ID NO: 729422 - RNA, 18 nt, Human
acaaaugcauuucuaaag

SEQ ID NO: 729423 - RNA, 22 nt, Human
aaccagggagccccuuugauga

SEQ ID NO: 729424 - RNA, 13 nt, Human
ccucccccaucuc

SEQ ID NO: 729425 - RNA, 14 nt, Human
gaaaacaauaacga

SEQ ID NO: 729426 - RNA, 13 nt, Human
aacacaacuauau

SEQ ID NO: 729427 - RNA, 15 nt, Human
ccgucccccucuggc

SEQ ID NO: 729428 - RNA, 17 nt, Human
acaaaugggaaacaaaa

SEQ ID NO: 729429 - RNA, 21 nt, Human
gggagccugaucaccugcccu

SEQ ID NO: 729430 - RNA, 13 nt, Human
gcuacgcgcgcuc

SEQ ID NO: 729431 - RNA, 18 nt, Human
uuuucucuccucucccca

SEQ ID NO: 729432 - RNA, 23 nt, Human
caagagaauugcuugaacccagg

SEQ ID NO: 729433 - RNA, 22 nt, Human
gacucaccucccccaucucuuc

SEQ ID NO: 729434 - RNA, 18 nt, Human
uaaugaauacuuuauaaa

SEQ ID NO: 729435 - RNA, 16 nt, Human
gcgcagcucaggcugg

SEQ ID NO: 729436 - RNA, 14 nt, Human
ggaaucuuguaaag

SEQ ID NO: 729437 - RNA, 15 nt, Human
gccuugggaccccug

SEQ ID NO: 729438 - RNA, 17 nt, Human
gaaugagagacacacug

SEQ ID NO: 729439 - RNA, 18 nt, Human
agccggagccuccagcug

SEQ ID NO: 729440 - RNA, 14 nt, Human
cucaccccuugcca

SEQ ID NO: 729441 - RNA, 23 nt, Human
gucucccucccuuggggccuaug

SEQ ID NO: 729442 - RNA, 21 nt, Human
cacuugaacccgggaggcaga

SEQ ID NO: 729443 - RNA, 18 nt, Human
ugcucgcccacuuccucc

SEQ ID NO: 729444 - RNA, 17 nt, Human
ccaaaagguauuuuaau

SEQ ID NO: 729445 - RNA, 16 nt, Human
aagacugcacaucaaa

SEQ ID NO: 729446 - RNA, 22 nt, Human
ugagacucugucucaguccaug

SEQ ID NO: 729447 - RNA, 18 nt, Human
ugggcacaggguuuaugu

SEQ ID NO: 729448 - RNA, 19 nt, Human
acuucccgcuguuccucgc

SEQ ID NO: 729449 - RNA, 18 nt, Human
ccugccuaagugcagccc

SEQ ID NO: 729450 - RNA, 21 nt, Human
auuauauggcuugaguuuaaa

SEQ ID NO: 729451 - RNA, 18 nt, Human
gcugcugccgugggccug

SEQ ID NO: 729452 - RNA, 20 nt, Human
ucuucuggguuccuuccucu

SEQ ID NO: 729453 - RNA, 21 nt, Human
ccuaauuuguuuucccuucuu

SEQ ID NO: 729454 - RNA, 14 nt, Human
aagugugacucauu

SEQ ID NO: 729455 - RNA, 18 nt, Human
acauguuacaacacggac

SEQ ID NO: 729456 - RNA, 20 nt, Human
ccagggcuacgcgcgcuccg

SEQ ID NO: 729457 - RNA, 20 nt, Human
cugauauuggacaguaaaau

SEQ ID NO: 729458 - RNA, 16 nt, Human
gacauagaauuaacac

SEQ ID NO: 729459 - RNA, 13 nt, Human
aggcuagauguau

SEQ ID NO: 729460 - RNA, 14 nt, Human
aauauuauguuaaa

SEQ ID NO: 729461 - RNA, 13 nt, Human
cugcacuccagcc

SEQ ID NO: 729462 - RNA, 15 nt, Human
agagacagaaagcag

SEQ ID NO: 729463 - RNA, 14 nt, Human
agcucuaucaccaa

SEQ ID NO: 729464 - RNA, 22 nt, Human
cgcaccuguaaucccagcuacu

SEQ ID NO: 729465 - RNA, 16 nt, Human
uauaugucacuuugcu

SEQ ID NO: 729466 - RNA, 15 nt, Human
gccuaagugcagccc

SEQ ID NO: 729467 - RNA, 13 nt, Human
cucaaaaaauaaa

SEQ ID NO: 729468 - RNA, 17 nt, Human
auguuuacagaucccca

SEQ ID NO: 729469 - RNA, 23 nt, Human
ugagcugauaucaugccccugua

SEQ ID NO: 729470 - RNA, 21 nt, Human
auauaugcuaagucuuauaua

SEQ ID NO: 729471 - RNA, 20 nt, Human
augguuuagaaagcuugccc

SEQ ID NO: 729472 - RNA, 21 nt, Human
aucuuuuuuuuaauaaaccau

SEQ ID NO: 729473 - RNA, 21 nt, Human
cuucucacauuuauauuuuug

SEQ ID NO: 729474 - RNA, 18 nt, Human
ugagcucagcccuggugg

SEQ ID NO: 729475 - RNA, 19 nt, Human
agacucgggauuaguacac

SEQ ID NO: 729476 - RNA, 17 nt, Human
aauguaucuuauucaca

SEQ ID NO: 729477 - RNA, 23 nt, Human
aguacucauacauguuacaacac

SEQ ID NO: 729478 - RNA, 18 nt, Human
cccaagccuggcaaggga

SEQ ID NO: 729479 - RNA, 19 nt, Human
ggaauuucuucaacucccu

SEQ ID NO: 729480 - RNA, 16 nt, Human
cccuauccuacuuccc

SEQ ID NO: 729481 - RNA, 14 nt, Human
gccgcgcuccucgg

SEQ ID NO: 729482 - RNA, 15 nt, Human
ggcaauagucaaauu

SEQ ID NO: 729483 - RNA, 15 nt, Human
ucccacccgcccacc

SEQ ID NO: 729484 - RNA, 21 nt, Human
gaggcugaggcggguggauca

SEQ ID NO: 729485 - RNA, 23 nt, Human
gaggcauuuaggccaugggacag

SEQ ID NO: 729486 - RNA, 16 nt, Human
ucuucaacucccugcc

SEQ ID NO: 729487 - RNA, 21 nt, Human
gcgccgcgcuccucggacggc

SEQ ID NO: 729488 - RNA, 14 nt, Human
auuuaaauauaugc

SEQ ID NO: 729489 - RNA, 20 nt, Human
uuauugaggcuuuaaaacuu

SEQ ID NO: 729490 - RNA, 13 nt, Human
acacuuaaaaaug

SEQ ID NO: 729491 - RNA, 14 nt, Human
ccuugaugaagaag

SEQ ID NO: 729492 - RNA, 15 nt, Human
auuuacugagcuucu

SEQ ID NO: 729493 - RNA, 21 nt, Human
aggguuaugauuaaguaauga

SEQ ID NO: 729494 - RNA, 14 nt, Human
ggcuccagcuggcc

SEQ ID NO: 729495 - RNA, 12 nt, Human
ccaggcugagcc

SEQ ID NO: 729496 - RNA, 17 nt, Human
guauuauuuuuuaaaaa

SEQ ID NO: 729497 - RNA, 15 nt, Human
auuucauucaauauc

SEQ ID NO: 729498 - RNA, 22 nt, Human
aauaauccuaaacauaugaauu

SEQ ID NO: 729499 - RNA, 13 nt, Human
aggauuugaaauu

SEQ ID NO: 729500 - RNA, 19 nt, Human
ggagccuccagcugccccg

SEQ ID NO: 729501 - RNA, 13 nt, Human
gagacagcucugc

SEQ ID NO: 729502 - RNA, 17 nt, Human
cugaucaccugcccugc

SEQ ID NO: 729503 - RNA, 14 nt, Human
ccaugggacaggga

SEQ ID NO: 729504 - RNA, 21 nt, Human
augaauacuuuauaaaggauu

SEQ ID NO: 729505 - RNA, 22 nt, Human
aaagcuuugugcagauucuuua

SEQ ID NO: 729506 - RNA, 15 nt, Human
cuaagugcagccccg

SEQ ID NO: 729507 - RNA, 14 nt, Human
ucuuuuuuuuaaua

SEQ ID NO: 729508 - RNA, 15 nt, Human
accaaggcugauuaa

SEQ ID NO: 729509 - RNA, 15 nt, Human
ccaaggagccaaaca

SEQ ID NO: 729510 - RNA, 18 nt, Human
uacauaaaguaugugcau

SEQ ID NO: 729511 - RNA, 16 nt, Human
cuucggccuccauccu

SEQ ID NO: 729512 - RNA, 18 nt, Human
gcccuggugggcagagag

SEQ ID NO: 729513 - RNA, 22 nt, Human
cgcgcgccuccgcuacuuccag

SEQ ID NO: 729514 - RNA, 20 nt, Human
auugcuugaacccaggagau

SEQ ID NO: 729515 - RNA, 19 nt, Human
gaggcagagguugcaguga

SEQ ID NO: 729516 - RNA, 20 nt, Human
uagucucuaucauuaaaguu

SEQ ID NO: 729517 - RNA, 22 nt, Human
ugguuguauuauuuuuuaaaaa

SEQ ID NO: 729518 - RNA, 19 nt, Human
cccccucuggcuccagcug

SEQ ID NO: 729519 - RNA, 17 nt, Human
auuuauaacaaccuaaa

SEQ ID NO: 729520 - RNA, 23 nt, Human
agaaugauuaugaauuacauuug

SEQ ID NO: 729521 - RNA, 14 nt, Human
ccuaaccagccugg

SEQ ID NO: 729522 - RNA, 19 nt, Human
cggccugcucgcccacuuc

SEQ ID NO: 729523 - RNA, 17 nt, Human
gcaccuguaaucccagc

SEQ ID NO: 729524 - RNA, 13 nt, Human
agcuguugagcug

SEQ ID NO: 729525 - RNA, 11 nt, Human
cuguuuuauaa

SEQ ID NO: 729526 - RNA, 19 nt, Human
caucaaggguacacugccu

SEQ ID NO: 729527 - RNA, 18 nt, Human
gccggagccuccagcugc

SEQ ID NO: 729528 - RNA, 14 nt, Human
agcuguugagcugu

SEQ ID NO: 729529 - RNA, 11 nt, Human
caauaaaagac

SEQ ID NO: 729530 - RNA, 17 nt, Human
cuaucucauuuccaagc

SEQ ID NO: 729531 - RNA, 20 nt, Human
ugagagugaacaaauuuaca

SEQ ID NO: 729532 - RNA, 12 nt, Human
gguuuauauaag

SEQ ID NO: 729533 - RNA, 19 nt, Human
cagagaugaggccgccaug

SEQ ID NO: 729534 - RNA, 15 nt, Human
cagucucccucccuu

SEQ ID NO: 729535 - RNA, 19 nt, Human
aagcuuguauuccuuuuuc

SEQ ID NO: 729536 - RNA, 17 nt, Human
ucuauaauuuaaauaua

SEQ ID NO: 729537 - RNA, 19 nt, Human
aauguuuacagauccccaa

SEQ ID NO: 729538 - RNA, 16 nt, Human
aagguccuggcaaaga

SEQ ID NO: 729539 - RNA, 19 nt, Human
cgccacgcucugggucgcc

SEQ ID NO: 729540 - RNA, 14 nt, Human
augauguuuagaaa

SEQ ID NO: 729541 - RNA, 17 nt, Human
ccuacuuccccuuccua

SEQ ID NO: 729542 - RNA, 23 nt, Human
gccgggaaagaagagccggagcc

SEQ ID NO: 729543 - RNA, 18 nt, Human
auuuuaauuuugaauaaa

SEQ ID NO: 729544 - RNA, 18 nt, Human
auuuuaacucuauaaugu

SEQ ID NO: 729545 - RNA, 18 nt, Human
ugguucuaauagaacuca

SEQ ID NO: 729546 - RNA, 13 nt, Human
aaauccuugaaga

SEQ ID NO: 729547 - RNA, 21 nt, Human
cuauguucuaagaagugaaaa

SEQ ID NO: 729548 - RNA, 19 nt, Human
cauuguuugucugucuuca

SEQ ID NO: 729549 - RNA, 18 nt, Human
gaagagccggagccucca

SEQ ID NO: 729550 - RNA, 16 nt, Human
acauuugcucauggaa

SEQ ID NO: 729551 - RNA, 20 nt, Human
guucugcagauaaacaguag

SEQ ID NO: 729552 - RNA, 16 nt, Human
uuuauauuugaaauau

SEQ ID NO: 729553 - RNA, 22 nt, Human
ccggcgcgcucaucccacccgc

SEQ ID NO: 729554 - RNA, 20 nt, Human
aauuuuuucucuaggaaaua

SEQ ID NO: 729555 - RNA, 14 nt, Human
acacugaagaagca

SEQ ID NO: 729556 - RNA, 19 nt, Human
uaaaaauaaaaauaaauuu

SEQ ID NO: 729557 - RNA, 17 nt, Human
ugaaauauuauuuuaua

SEQ ID NO: 729558 - RNA, 22 nt, Human
agaugaucaguaugaaaauguc

SEQ ID NO: 729559 - RNA, 20 nt, Human
uuuaauuuugaauaaauaaa

SEQ ID NO: 729560 - RNA, 20 nt, Human
ugaggcuccacuuggucugu

SEQ ID NO: 729561 - RNA, 17 nt, Human
uugccaaauauaaauaa

SEQ ID NO: 729562 - RNA, 13 nt, Human
cuaugaaauauua

SEQ ID NO: 729563 - RNA, 20 nt, Human
ggccaugggacagggaggac

SEQ ID NO: 729564 - RNA, 17 nt, Human
gggaaauccacacugag

SEQ ID NO: 729565 - RNA, 18 nt, Human
gaugcaguucugaagaag

SEQ ID NO: 729566 - RNA, 17 nt, Human
guguccccuauccuacu

SEQ ID NO: 729567 - RNA, 18 nt, Human
cuuucacauuuaaauaaa

SEQ ID NO: 729568 - RNA, 18 nt, Human
uauuuucuauaauuuaaa

SEQ ID NO: 729569 - RNA, 15 nt, Human
auagaaguaaaaaca

SEQ ID NO: 729570 - RNA, 16 nt, Human
aucaaaagaaagaaaa

SEQ ID NO: 729571 - RNA, 19 nt, Human
aggucuaccaaaaaucuca

SEQ ID NO: 729572 - RNA, 21 nt, Human
aagacucgggauuaguacaca

SEQ ID NO: 729573 - RNA, 20 nt, Human
auuacuguaagaaaauauca

SEQ ID NO: 729574 - RNA, 21 nt, Human
aauaauguuucaaacauauau

SEQ ID NO: 729575 - RNA, 17 nt, Human
caaauauaaauaaaaau

SEQ ID NO: 729576 - RNA, 18 nt, Human
aauccacacugagcugag

SEQ ID NO: 729577 - RNA, 14 nt, Human
ugaagauguagagg

SEQ ID NO: 729578 - RNA, 14 nt, Human
ugcuagaacucccu

SEQ ID NO: 729579 - RNA, 20 nt, Human
aagaugguaccaccagucug

SEQ ID NO: 729580 - RNA, 14 nt, Human
cgcugcgcgccgcg

SEQ ID NO: 729581 - RNA, 19 nt, Human
auaaaagacagugaaagaa

SEQ ID NO: 729582 - RNA, 15 nt, Human
cauguccacugguuc

SEQ ID NO: 729583 - RNA, 15 nt, Human
cugcagauaaacagu

SEQ ID NO: 729584 - RNA, 18 nt, Human
gaacgauuuagaaagaag

SEQ ID NO: 729585 - RNA, 16 nt, Human
aauauaaauaaaaaua

SEQ ID NO: 729586 - RNA, 18 nt, Human
ccugucacgugugggcaa

SEQ ID NO: 729587 - RNA, 17 nt, Human
ucugggauagcugaccc

SEQ ID NO: 729588 - RNA, 16 nt, Human
acauccuacaagacac

SEQ ID NO: 729589 - RNA, 17 nt, Human
cuauccuacuuccccuu

SEQ ID NO: 729590 - RNA, 16 nt, Human
gcuugaacccaggaga

SEQ ID NO: 729591 - RNA, 16 nt, Human
gagcucgugggacagu

SEQ ID NO: 729592 - RNA, 17 nt, Human
aaucuuauaauuuaaaa

SEQ ID NO: 729593 - RNA, 14 nt, Human
ggccgggagccuga

SEQ ID NO: 729594 - RNA, 14 nt, Human
aauuccucugggaa

SEQ ID NO: 729595 - RNA, 22 nt, Human
gaaaacaauaacgauaaaagac

SEQ ID NO: 729596 - RNA, 22 nt, Human
auauauaacaaugcuguauuuu

SEQ ID NO: 729597 - RNA, 17 nt, Human
cuuugaugauuaauuca

SEQ ID NO: 729598 - RNA, 15 nt, Human
gcuguugagcuguuu

SEQ ID NO: 729599 - RNA, 22 nt, Human
cacuaguauuucuaugaaauau

SEQ ID NO: 729600 - RNA, 22 nt, Human
ugaagcaaaauuuuuucucuag

SEQ ID NO: 729601 - RNA, 18 nt, Human
ugugaccacugcagaaga

SEQ ID NO: 729602 - RNA, 22 nt, Human
gccccggggaggggcgcucgcu

SEQ ID NO: 729603 - RNA, 19 nt, Human
auuucuucaacucccugcc

SEQ ID NO: 729604 - RNA, 21 nt, Human
aagucuuucacauuuaaauaa

SEQ ID NO: 729605 - RNA, 21 nt, Human
guauacugugugcuaaaacaa

SEQ ID NO: 729606 - RNA, 18 nt, Human
gcuccauuuuuagugaaa

SEQ ID NO: 729607 - RNA, 17 nt, Human
aauaacaauaaaagaca

SEQ ID NO: 729608 - RNA, 17 nt, Human
ucuuauaauuuaaaaua

SEQ ID NO: 729609 - RNA, 20 nt, Human
gccuaauuuguuuucccuuc

SEQ ID NO: 729610 - RNA, 18 nt, Human
caaggcuagaaccaccug

SEQ ID NO: 729611 - RNA, 18 nt, Human
cucccuuggggccuaugc

SEQ ID NO: 729612 - RNA, 17 nt, Human
aggccaugggacaggga

SEQ ID NO: 729613 - RNA, 22 nt, Human
ucucuacuaaaaauacaaaaau

SEQ ID NO: 729614 - RNA, 16 nt, Human
uaaaagacaaggaaaa

SEQ ID NO: 729615 - RNA, 13 nt, Human
ucuacuaaaaaua

SEQ ID NO: 729616 - RNA, 22 nt, Human
agcuacuugggaggcugaggca

SEQ ID NO: 729617 - RNA, 14 nt, Human
acuuggucugugag

SEQ ID NO: 729618 - RNA, 19 nt, Human
caaggaugccccguccccc

SEQ ID NO: 729619 - RNA, 19 nt, Human
uggaacaguuaccucugcc

SEQ ID NO: 729620 - RNA, 16 nt, Human
cgcucaucccacccgc

SEQ ID NO: 729621 - RNA, 19 nt, Human
cuggccuucggccuccauc

SEQ ID NO: 729622 - RNA, 23 nt, Human
gggagccugaucaccugcccugc

SEQ ID NO: 729623 - RNA, 14 nt, Human
uuuuaaaaaagaaa

SEQ ID NO: 729624 - RNA, 17 nt, Human
caaggcccccgggccga

SEQ ID NO: 729625 - RNA, 17 nt, Human
ugaccacugcagaagac

SEQ ID NO: 729626 - RNA, 19 nt, Human
aaaacguauugcauuuaau

SEQ ID NO: 729627 - RNA, 12 nt, Human
uuucuauuuauu

SEQ ID NO: 729628 - RNA, 14 nt, Human
aaaagacagugaaa

SEQ ID NO: 729629 - RNA, 16 nt, Human
cugcacuccagccuga

SEQ ID NO: 729630 - RNA, 17 nt, Human
aaaguacaagagcuuaa

SEQ ID NO: 729631 - RNA, 19 nt, Human
uacaaaaaaaaaaaaaaau

SEQ ID NO: 729632 - RNA, 19 nt, Human
uaaauguaucuuauucaca

SEQ ID NO: 729633 - RNA, 22 nt, Human
aauuuaaaaaaaaaccugagcc

SEQ ID NO: 729634 - RNA, 16 nt, Human
uuuuagugaaauauua

SEQ ID NO: 729635 - RNA, 17 nt, Human
auauuuuuuuuuuuaaa

SEQ ID NO: 729636 - RNA, 18 nt, Human
gaaaauaucacuugucaa

SEQ ID NO: 729637 - RNA, 11 nt, Human
uccucugggaa

SEQ ID NO: 729638 - RNA, 16 nt, Human
ggggagcgagccccag

SEQ ID NO: 729639 - RNA, 14 nt, Human
uaugaauuacauuu

SEQ ID NO: 729640 - RNA, 17 nt, Human
cucccuggaaucuugua

SEQ ID NO: 729641 - RNA, 17 nt, Human
ccugagcuugcagagau

SEQ ID NO: 729642 - RNA, 20 nt, Human
uguuggugaacuugguuuua

SEQ ID NO: 729643 - RNA, 21 nt, Human
aauuaaguuuuuuuuuaaaaa

SEQ ID NO: 729644 - RNA, 22 nt, Human
cagcacgggggccaaggaugcc

SEQ ID NO: 729645 - RNA, 20 nt, Human
cgcgcucaucccacccgccc

SEQ ID NO: 729646 - RNA, 12 nt, Human
uuuuuuuuaaaa

SEQ ID NO: 729647 - RNA, 13 nt, Human
uuauucacaagac

SEQ ID NO: 729648 - RNA, 21 nt, Human
uccuucagccugaaagaggaa

SEQ ID NO: 729649 - RNA, 21 nt, Human
ccagggcuacgcgcgcuccgc

SEQ ID NO: 729650 - RNA, 10 nt, Human
ccugagcccc

SEQ ID NO: 729651 - RNA, 14 nt, Human
aacgauaaaagaca

SEQ ID NO: 729652 - RNA, 20 nt, Human
auaacaaugcuguauuuuaa

SEQ ID NO: 729653 - RNA, 18 nt, Human
gaugccccgucccccucu

SEQ ID NO: 729654 - RNA, 22 nt, Human
cuaccuguucgcgcgccuccgc

SEQ ID NO: 729655 - RNA, 20 nt, Human
ugauuauaugucacuuugcu

SEQ ID NO: 729656 - RNA, 23 nt, Human
cucagcccuggugggcagagagg

SEQ ID NO: 729657 - RNA, 15 nt, Human
uuuagugaaauauua

SEQ ID NO: 729658 - RNA, 17 nt, Human
aaaccuuauuguaccuc

SEQ ID NO: 729659 - RNA, 15 nt, Human
aaugaauggcuaagc

SEQ ID NO: 729660 - RNA, 14 nt, Human
uuaugauuaaguaa

SEQ ID NO: 729661 - RNA, 13 nt, Human
agagguccacaac

SEQ ID NO: 729662 - RNA, 21 nt, Human
acucugucucaaaaaauaaaa

SEQ ID NO: 729663 - RNA, 17 nt, Human
ugugaacgauuuagaaa

SEQ ID NO: 729664 - RNA, 13 nt, Human
ggaaguagaggag

SEQ ID NO: 729665 - RNA, 21 nt, Human
aaacgaggauugggaaaaagu

SEQ ID NO: 729666 - RNA, 20 nt, Human
agaggagaaacuggaacucu

SEQ ID NO: 729667 - RNA, 19 nt, Human
uugugccccugcacuccag

SEQ ID NO: 729668 - RNA, 12 nt, Human
gcgagccccagg

SEQ ID NO: 729669 - RNA, 19 nt, Human
acuggacucaccuccccca

SEQ ID NO: 729670 - RNA, 13 nt, Human
uuaaaaaagaaac

SEQ ID NO: 729671 - RNA, 16 nt, Human
ugugcauauuuuauua

SEQ ID NO: 729672 - RNA, 20 nt, Human
aagcuucacuguaaaauaau

SEQ ID NO: 729673 - RNA, 16 nt, Human
caauaacgauaaaaga

SEQ ID NO: 729674 - RNA, 12 nt, Human
gacagugaaaga

SEQ ID NO: 729675 - RNA, 18 nt, Human
cauagguuuaauaauuuu

SEQ ID NO: 729676 - RNA, 18 nt, Human
acuguaaagcuuugugca

SEQ ID NO: 729677 - RNA, 19 nt, Human
gucuuucacauuuaaauaa

SEQ ID NO: 729678 - RNA, 22 nt, Human
cauaaauguugacaugggacau

SEQ ID NO: 729679 - RNA, 20 nt, Human
agcuacuaauuuuaaaaugu

SEQ ID NO: 729680 - RNA, 17 nt, Human
uuuucaccuguuuuuaa

SEQ ID NO: 729681 - RNA, 17 nt, Human
cccacuggacucaccuc

SEQ ID NO: 729682 - RNA, 22 nt, Human
uggacgagaaaacaauaacgau

SEQ ID NO: 729683 - RNA, 19 nt, Human
auaauuuuuauauuugaaa

SEQ ID NO: 729684 - RNA, 18 nt, Human
aaauggaaguaaauguug

SEQ ID NO: 729685 - RNA, 21 nt, Human
aaaaacguauugcauuuaauu

SEQ ID NO: 729686 - RNA, 16 nt, Human
auccuacaagacacag

SEQ ID NO: 729687 - RNA, 18 nt, Human
ggagccgggaaagaagag

SEQ ID NO: 729688 - RNA, 22 nt, Human
cucugggauagcugacccagcc

SEQ ID NO: 729689 - RNA, 13 nt, Human
aagcauuccaacu

SEQ ID NO: 729690 - RNA, 18 nt, Human
ugaaaaaguucugcagau

SEQ ID NO: 729691 - RNA, 12 nt, Human
auuuuaaaagaa

SEQ ID NO: 729692 - RNA, 23 nt, Human
auauaacaaugcuguauuuuaaa

SEQ ID NO: 729693 - RNA, 23 nt, Human
auuuuauagcuacuaauuuuaaa

SEQ ID NO: 729694 - RNA, 16 nt, Human
cggggagcgagcccca

SEQ ID NO: 729695 - RNA, 18 nt, Human
gaaaauaacgauaaaaga

SEQ ID NO: 729696 - RNA, 21 nt, Human
aaagcugaaauggacuuuugu

SEQ ID NO: 729697 - RNA, 22 nt, Human
caccucccccaucucuucuggg

SEQ ID NO: 729698 - RNA, 15 nt, Human
ccucauguccacugg

SEQ ID NO: 729699 - RNA, 15 nt, Human
acucaacaaacauaa

SEQ ID NO: 729700 - RNA, 20 nt, Human
cucgcuuccgcauccuaguc

SEQ ID NO: 729701 - RNA, 12 nt, Human
aaugcagccccc

SEQ ID NO: 729702 - RNA, 15 nt, Human
cacuuccucccggcc

SEQ ID NO: 729703 - RNA, 13 nt, Human
cgggaggcagagg

SEQ ID NO: 729704 - RNA, 15 nt, Human
aaaauaacaaugaaa

SEQ ID NO: 729705 - RNA, 17 nt, Human
agccuccagcugccccg

SEQ ID NO: 729706 - RNA, 20 nt, Human
ucuucauagcagauuuuaau

SEQ ID NO: 729707 - RNA, 18 nt, Human
uguaaaggaauuuaaaaa

SEQ ID NO: 729708 - RNA, 19 nt, Human
gcuguuccucgccacgcuc

SEQ ID NO: 729709 - RNA, 18 nt, Human
accaccugccuauauuuu

SEQ ID NO: 729710 - RNA, 23 nt, Human
uguugcccacagcuguaugauuc

SEQ ID NO: 729711 - RNA, 17 nt, Human
ucagacauagaauuaac

SEQ ID NO: 729712 - RNA, 13 nt, Human
cacacugaagaag

SEQ ID NO: 729713 - RNA, 15 nt, Human
ugcuucuguuuuaua

SEQ ID NO: 729714 - RNA, 20 nt, Human
ccaaauguucaucaaugaau

SEQ ID NO: 729715 - RNA, 20 nt, Human
acagcccuucuuuccacaga

SEQ ID NO: 729716 - RNA, 16 nt, Human
uaacaauaaaagacaa

SEQ ID NO: 729717 - RNA, 18 nt, Human
aaggaugccccguccccc

SEQ ID NO: 729718 - RNA, 22 nt, Human
uugaaaaucuuauaauuuaaaa

SEQ ID NO: 729719 - RNA, 15 nt, Human
ccuugccaugugcua

SEQ ID NO: 729720 - RNA, 18 nt, Human
uauaacaaugcuguauuu

SEQ ID NO: 729721 - RNA, 19 nt, Human
cacaggaaccacaagacug

SEQ ID NO: 729722 - RNA, 11 nt, Human
gcuguuuccau

SEQ ID NO: 729723 - RNA, 15 nt, Human
uguauuuuaaaagaa

SEQ ID NO: 729724 - RNA, 16 nt, Human
uuaauaauuuuuaauu

SEQ ID NO: 729725 - RNA, 12 nt, Human
acagagacagaa

SEQ ID NO: 729726 - RNA, 19 nt, Human
ccgcagggugaacugcagc

SEQ ID NO: 729727 - RNA, 18 nt, Human
cauggaauuggagcucgu

SEQ ID NO: 729728 - RNA, 22 nt, Human
aauuacauuuguauaaaauaau

SEQ ID NO: 729729 - RNA, 22 nt, Human
gaaaaucuuauaauuuaaaaua

SEQ ID NO: 729730 - RNA, 21 nt, Human
gccugaucaccugcccugcug

SEQ ID NO: 729731 - RNA, 16 nt, Human
agucucuaucauuaaa

SEQ ID NO: 729732 - RNA, 19 nt, Human
aaguugcauagguuuaaua

SEQ ID NO: 729733 - RNA, 16 nt, Human
uggcgcuggcugcgcu

SEQ ID NO: 729734 - RNA, 19 nt, Human
auaaaagacaaggaaaaaa

SEQ ID NO: 729735 - RNA, 13 nt, Human
aucaggcuggcca

SEQ ID NO: 729736 - RNA, 16 nt, Human
acaugaacuuguaaag

SEQ ID NO: 729737 - RNA, 19 nt, Human
ucgcccacuuccucccggc

SEQ ID NO: 729738 - RNA, 15 nt, Human
aaggaaaaaauaaca

SEQ ID NO: 729739 - RNA, 20 nt, Human
uauaugcuaagucuuauaua

SEQ ID NO: 729740 - RNA, 12 nt, Human
agugcagccccg

SEQ ID NO: 729741 - RNA, 21 nt, Human
gcggcgggagggcgcggggcg

SEQ ID NO: 729742 - RNA, 14 nt, Human
acaaauccaaugaa

SEQ ID NO: 729743 - RNA, 18 nt, Human
gagccgggaaagaagagc

SEQ ID NO: 729744 - RNA, 13 nt, Human
cacauuuaaauaa

SEQ ID NO: 729745 - RNA, 12 nt, Human
caacccaaaugu

SEQ ID NO: 729746 - RNA, 20 nt, Human
ccagcuugaaaccuucacuu

SEQ ID NO: 729747 - RNA, 15 nt, Human
cugaaagaggaauga

SEQ ID NO: 729748 - RNA, 13 nt, Human
gggcggggagcga

SEQ ID NO: 729749 - RNA, 17 nt, Human
cuggacucaccuccccc

SEQ ID NO: 729750 - RNA, 22 nt, Human
gcggggagcgagccccaggcgg

SEQ ID NO: 729751 - RNA, 15 nt, Human
gauccugcaauucca

SEQ ID NO: 729752 - RNA, 19 nt, Human
ucagugucaaugcagcccc

SEQ ID NO: 729753 - RNA, 23 nt, Human
uagauaggucagugcaaauacuc

SEQ ID NO: 729754 - RNA, 15 nt, Human
gggaaagaagagccg

SEQ ID NO: 729755 - RNA, 21 nt, Human
ucauucacucaacaaacauaa

SEQ ID NO: 729756 - RNA, 23 nt, Human
uuagaugcaguucugaagaagau

SEQ ID NO: 729757 - RNA, 12 nt, Human
aggggcgcucgc

SEQ ID NO: 729758 - RNA, 18 nt, Human
agcugcucaauaaaguac

SEQ ID NO: 729759 - RNA, 16 nt, Human
ucaucaaugaaugaau

SEQ ID NO: 729760 - RNA, 17 nt, Human
uuaaauggucaauuuug

SEQ ID NO: 729761 - RNA, 15 nt, Human
cuaucuuugagcgcc

SEQ ID NO: 729762 - RNA, 18 nt, Human
gccccugcacuccagccu

SEQ ID NO: 729763 - RNA, 17 nt, Human
auuuuaauaauguuuca

SEQ ID NO: 729764 - RNA, 21 nt, Human
uacaugagguacugagaguga

SEQ ID NO: 729765 - RNA, 17 nt, Human
cauccuagucucuauca

SEQ ID NO: 729766 - RNA, 16 nt, Human
uuauaauuuaaaauau

SEQ ID NO: 729767 - RNA, 17 nt, Human
cucuuuugggauuuuug

SEQ ID NO: 729768 - RNA, 17 nt, Human
uuccaagccucaugucc

SEQ ID NO: 729769 - RNA, 16 nt, Human
ugcaugguuuagaaag

SEQ ID NO: 729770 - RNA, 15 nt, Human
uugcucauggaauug

SEQ ID NO: 729771 - RNA, 21 nt, Human
uagggugauauuaaccagggg

SEQ ID NO: 729772 - RNA, 19 nt, Human
aauauuauguuaaaacugg

SEQ ID NO: 729773 - RNA, 16 nt, Human
auuugaugcuacagga

SEQ ID NO: 729774 - RNA, 20 nt, Human
ugagcgcccacuagacccac

SEQ ID NO: 729775 - RNA, 19 nt, Human
auuguaguccuguaaugga

SEQ ID NO: 729776 - RNA, 18 nt, Human
aagggaauuucuucaacu

SEQ ID NO: 729777 - RNA, 14 nt, Human
cucaacaaacauaa

SEQ ID NO: 729778 - RNA, 19 nt, Human
uggugaacuugguuuuaau

SEQ ID NO: 729779 - RNA, 20 nt, Human
uaacgauaaaagacagugaa

SEQ ID NO: 729780 - RNA, 23 nt, Human
uguaaucccagcacuuugggagg

SEQ ID NO: 729781 - RNA, 12 nt, Human
acucccugcccc

SEQ ID NO: 729782 - RNA, 19 nt, Human
cucugcauacucauuagga

SEQ ID NO: 729783 - RNA, 17 nt, Human
ccacugcagaagacagu

SEQ ID NO: 729784 - RNA, 12 nt, Human
aaaaaaacguau

SEQ ID NO: 729785 - RNA, 22 nt, Human
cuuccuaauuccacagcugcuc

SEQ ID NO: 729786 - RNA, 11 nt, Human
cgauaaaagac

SEQ ID NO: 729787 - RNA, 19 nt, Human
guuguauuauuuuuuaaaa

SEQ ID NO: 729788 - RNA, 14 nt, Human
aagaagugaaaauc

SEQ ID NO: 729789 - RNA, 16 nt, Human
aagggaggaaaaaaaa

SEQ ID NO: 729790 - RNA, 12 nt, Human
ucuacacuccag

SEQ ID NO: 729791 - RNA, 15 nt, Human
uuagugaaauauuau

SEQ ID NO: 729792 - RNA, 20 nt, Human
agaugcaguucugaagaaga

SEQ ID NO: 729793 - RNA, 21 nt, Human
acgcucucuggccuucggccu

SEQ ID NO: 729794 - RNA, 17 nt, Human
aaacauccuacaagaca

SEQ ID NO: 729795 - RNA, 13 nt, Human
aucuacacuccag

SEQ ID NO: 729796 - RNA, 17 nt, Human
cagugaaagaaaauaac

SEQ ID NO: 729797 - RNA, 18 nt, Human
ccuucggccuccauccug

SEQ ID NO: 729798 - RNA, 13 nt, Human
uuuaaaaaagaaa

SEQ ID NO: 729799 - RNA, 15 nt, Human
gccccugcacuccag

SEQ ID NO: 729800 - RNA, 13 nt, Human
uaauuuuuauauu

SEQ ID NO: 729801 - RNA, 14 nt, Human
cuccagugagacag

SEQ ID NO: 729802 - RNA, 18 nt, Human
uagugaaauauuauuuua

SEQ ID NO: 729803 - RNA, 23 nt, Human
gcgcuggcugcgcucggccugcu

SEQ ID NO: 729804 - RNA, 13 nt, Human
uuauagaauauuu

SEQ ID NO: 729805 - RNA, 20 nt, Human
guauuauuuuuuaaaaaaau

SEQ ID NO: 729806 - RNA, 15 nt, Human
aaaagacaaggaaaa

SEQ ID NO: 729807 - RNA, 21 nt, Human
accaaggagccaaacauccua

SEQ ID NO: 729808 - RNA, 15 nt, Human
ccuuccagugucucg

SEQ ID NO: 729809 - RNA, 19 nt, Human
uguauacugugugcuaaaa

SEQ ID NO: 729810 - RNA, 13 nt, Human
cugugcggccugg

SEQ ID NO: 729811 - RNA, 18 nt, Human
auuuguauaaaauaauuu

SEQ ID NO: 729812 - RNA, 16 nt, Human
gaaucacuugaacccg

SEQ ID NO: 729813 - RNA, 12 nt, Human
cggccggcgcgc

SEQ ID NO: 729814 - RNA, 22 nt, Human
gcauccuagucucuaucauuaa

SEQ ID NO: 729815 - RNA, 21 nt, Human
ugcucaauaaaguacaagagc

SEQ ID NO: 729816 - RNA, 15 nt, Human
augguuguauuauuu

SEQ ID NO: 729817 - RNA, 15 nt, Human
ugagcgcccacuaga

SEQ ID NO: 729818 - RNA, 13 nt, Human
gggaaagaagagc

SEQ ID NO: 729819 - RNA, 21 nt, Human
aaugucauuguucuugugaac

SEQ ID NO: 729820 - RNA, 16 nt, Human
cuucaacucccugccc

SEQ ID NO: 729821 - RNA, 21 nt, Human
ccaaagugugacucauuaaau

SEQ ID NO: 729822 - RNA, 12 nt, Human
cuucaacucccu

SEQ ID NO: 729823 - RNA, 16 nt, Human
ucaguuuuugugaaaa

SEQ ID NO: 729824 - RNA, 19 nt, Human
uuggcaagcucuaucacca

SEQ ID NO: 729825 - RNA, 15 nt, Human
uauauauauauauuu

SEQ ID NO: 729826 - RNA, 19 nt, Human
uaucucauuuccaagcaag

SEQ ID NO: 729827 - RNA, 19 nt, Human
agaaaauaacgauaaaaga

SEQ ID NO: 729828 - RNA, 21 nt, Human
cauuuucuucucacauuuaua

SEQ ID NO: 729829 - RNA, 19 nt, Human
aaaguucuagugaccgaga

SEQ ID NO: 729830 - RNA, 14 nt, Human
ccucggacggcucc

SEQ ID NO: 729831 - RNA, 21 nt, Human
gcucggccugcucgcccacuu

SEQ ID NO: 729832 - RNA, 12 nt, Human
ggcugaugcagu

SEQ ID NO: 729833 - RNA, 23 nt, Human
gggaaagaagagccggagccucc

SEQ ID NO: 729834 - RNA, 13 nt, Human
ccaccugccuaua

SEQ ID NO: 729835 - RNA, 16 nt, Human
aaauccacacugagcu

SEQ ID NO: 729836 - RNA, 23 nt, Human
gguggcgcuggcugcgcucggcc

SEQ ID NO: 729837 - RNA, 18 nt, Human
cugagccuugggaccccu

SEQ ID NO: 729838 - RNA, 16 nt, Human
ugacaagcucacagac

SEQ ID NO: 729839 - RNA, 21 nt, Human
aaaauaugccccauucaacau

SEQ ID NO: 729840 - RNA, 22 nt, Human
uuaaaaaaaaaacguauugcau

SEQ ID NO: 729841 - RNA, 16 nt, Human
ugccucaccccuugcc

SEQ ID NO: 729842 - RNA, 16 nt, Human
uauguucuaagaagug

SEQ ID NO: 729843 - RNA, 15 nt, Human
cucccuuggggccua

SEQ ID NO: 729844 - RNA, 13 nt, Human
ccaggcugagccu

SEQ ID NO: 729845 - RNA, 11 nt, Human
aauuccacagc

SEQ ID NO: 729846 - RNA, 14 nt, Human
cacuuauaggaauu

SEQ ID NO: 729847 - RNA, 14 nt, Human
ccuuaucaaaggac

SEQ ID NO: 729848 - RNA, 15 nt, Human
cuuccucccggccgc

SEQ ID NO: 729849 - RNA, 18 nt, Human
aaauauuuauuuuaauaa

SEQ ID NO: 729850 - RNA, 17 nt, Human
cuucacuguaaaauaau

SEQ ID NO: 729851 - RNA, 17 nt, Human
gggagcgagccccaggc

SEQ ID NO: 729852 - RNA, 13 nt, Human
augauuccaccua

SEQ ID NO: 729853 - RNA, 19 nt, Human
gccgcgcugcgcgccgcgc

SEQ ID NO: 729854 - RNA, 12 nt, Human
aguguuugaaag

SEQ ID NO: 729855 - RNA, 23 nt, Human
gucuccaaaaucggaucuggggc

SEQ ID NO: 729856 - RNA, 19 nt, Human
auuaaguuuuuuuuuaaaa

SEQ ID NO: 729857 - RNA, 15 nt, Human
gcugcgcucggccug

SEQ ID NO: 729858 - RNA, 18 nt, Human
cagugaaagaaaauaaca

SEQ ID NO: 729859 - RNA, 22 nt, Human
caaauuuacagagacagaaagc

SEQ ID NO: 729860 - RNA, 17 nt, Human
uaacgauaaaagacagu

SEQ ID NO: 729861 - RNA, 12 nt, Human
uucucuaggaaa

SEQ ID NO: 729862 - RNA, 17 nt, Human
ccucagucucccucccu

SEQ ID NO: 729863 - RNA, 15 nt, Human
agccgggcauggugg

SEQ ID NO: 729864 - RNA, 14 nt, Human
uuccgcauccuagu

SEQ ID NO: 729865 - RNA, 22 nt, Human
cggggagcgagccccaggcggg

SEQ ID NO: 729866 - RNA, 14 nt, Human
cgcucgcuuccgca

SEQ ID NO: 729867 - RNA, 16 nt, Human
agggaggacgcucucu

SEQ ID NO: 729868 - RNA, 22 nt, Human
aucccagcacuuugggaggcug

SEQ ID NO: 729869 - RNA, 20 nt, Human
ucaaaacuucagacauagaa

SEQ ID NO: 729870 - RNA, 16 nt, Human
cacuggacucaccucc

SEQ ID NO: 729871 - RNA, 20 nt, Human
aaaacaagcacuaaacaaag

SEQ ID NO: 729872 - RNA, 19 nt, Human
gcggcccugugcggccugg

SEQ ID NO: 729873 - RNA, 12 nt, Human
gccggcgcgcuc

SEQ ID NO: 729874 - RNA, 18 nt, Human
guuaguauuguccagguc

SEQ ID NO: 729875 - RNA, 14 nt, Human
auggaaguaaaugu

SEQ ID NO: 729876 - RNA, 23 nt, Human
ucuagcaugucgucaaagcugaa

SEQ ID NO: 729877 - RNA, 14 nt, Human
auuuauuuuaauaa

SEQ ID NO: 729878 - RNA, 10 nt, Human
caacucccug

SEQ ID NO: 729879 - RNA, 13 nt, Human
cauuucuauuuau

SEQ ID NO: 729880 - RNA, 12 nt, Human
caccuguuuuua

SEQ ID NO: 729881 - RNA, 22 nt, Human
aggcuccacuuggucugugaga

SEQ ID NO: 729882 - RNA, 12 nt, Human
gaaaauaacaau

SEQ ID NO: 729883 - RNA, 22 nt, Human
uucaauaucuuuuuuuuaauaa

SEQ ID NO: 729884 - RNA, 15 nt, Human
gugaccacugcagaa

SEQ ID NO: 729885 - RNA, 14 nt, Human
uuuuaauuuugaau

SEQ ID NO: 729886 - RNA, 19 nt, Human
auuuacagagacagaaagc

SEQ ID NO: 729887 - RNA, 16 nt, Human
agugaaauauuauuuu

SEQ ID NO: 729888 - RNA, 17 nt, Human
cugcacuccagccugag

SEQ ID NO: 729889 - RNA, 20 nt, Human
gagccucagucucccucccu

SEQ ID NO: 729890 - RNA, 16 nt, Human
cugcugagucccaggc

SEQ ID NO: 729891 - RNA, 14 nt, Human
cucccuuggggccu

SEQ ID NO: 729892 - RNA, 17 nt, Human
aauguuguuuuaggaau

SEQ ID NO: 729893 - RNA, 17 nt, Human
cugccucagaaaacaag

SEQ ID NO: 729894 - RNA, 16 nt, Human
ccugcaaagcccagcu

SEQ ID NO: 729895 - RNA, 13 nt, Human
agcccagcuugaa

SEQ ID NO: 729896 - RNA, 18 nt, Human
auguuaaaacugggacag

SEQ ID NO: 729897 - RNA, 12 nt, Human
uuuugaaaccaa

SEQ ID NO: 729898 - RNA, 24 nt, Human
uggccgggagccugaucaccugcc

SEQ ID NO: 729899 - RNA, 16 nt, Human
auaauccuaaacauau

SEQ ID NO: 729900 - RNA, 23 nt, Human
augucaauucuugccaaauauaa

SEQ ID NO: 729901 - RNA, 23 nt, Human
ugaauuauguuugcauguucacu

SEQ ID NO: 729902 - RNA, 14 nt, Human
ccaaugaaaugagu

SEQ ID NO: 729903 - RNA, 17 nt, Human
uuauaaucuuucacagg

SEQ ID NO: 729904 - RNA, 23 nt, Human
aaguauccuucagccugaaagag

SEQ ID NO: 729905 - RNA, 13 nt, Human
uccuacuuccccu

SEQ ID NO: 729906 - RNA, 17 nt, Human
aagacagugaaagaaaa

SEQ ID NO: 729907 - RNA, 18 nt, Human
ucucaaaaaauaaaaaua

SEQ ID NO: 729908 - RNA, 14 nt, Human
ccucagucucccuc

SEQ ID NO: 729909 - RNA, 22 nt, Human
cuccugccuaagugcagccccg

SEQ ID NO: 729910 - RNA, 21 nt, Human
agucucccucccuuggggccu

SEQ ID NO: 729911 - RNA, 22 nt, Human
auaaaguaugugcauauuuuau

SEQ ID NO: 729912 - RNA, 19 nt, Human
acagugauuaccagggacu

SEQ ID NO: 729913 - RNA, 21 nt, Human
agagccggagccuccagcugc

SEQ ID NO: 729914 - RNA, 23 nt, Human
uauguuaaaacugggacagggga

SEQ ID NO: 729915 - RNA, 21 nt, Human
gucucagugucaaugcagccc

SEQ ID NO: 729916 - RNA, 19 nt, Human
uauuuacugagcuucucug

SEQ ID NO: 729917 - RNA, 22 nt, Human
accuaacgaaguauccuucagc

SEQ ID NO: 729918 - RNA, 18 nt, Human
ggaccaucccggccggcg

SEQ ID NO: 729919 - RNA, 14 nt, Human
agccuccagcugcc

SEQ ID NO: 729920 - RNA, 24 nt, Human
ucucuaucauuaaaguucuaguga

SEQ ID NO: 729921 - RNA, 14 nt, Human
gagagugaacaaau

SEQ ID NO: 729922 - RNA, 13 nt, Human
guaacuaauuuua

SEQ ID NO: 729923 - RNA, 23 nt, Human
uaggauggcuaguaucaaaagaa

SEQ ID NO: 729924 - RNA, 15 nt, Human
aaucucaauauuuca

SEQ ID NO: 729925 - RNA, 15 nt, Human
cucgcccacuuccuc

SEQ ID NO: 729926 - RNA, 15 nt, Human
guaaggggaauugag

SEQ ID NO: 729927 - RNA, 20 nt, Human
ccccuauccuacuuccccuu

SEQ ID NO: 729928 - RNA, 18 nt, Human
aaaaauaaaaauaaaaau

SEQ ID NO: 729929 - RNA, 16 nt, Human
ugagcucagcccuggu

SEQ ID NO: 729930 - RNA, 23 nt, Human
uuuguauaaaauaauuuuuauau

SEQ ID NO: 729931 - RNA, 14 nt, Human
ccacccgcccaccg

SEQ ID NO: 729932 - RNA, 14 nt, Human
auacaaaaaaaaaa

SEQ ID NO: 729933 - RNA, 19 nt, Human
uguaguguuggagaagaac

SEQ ID NO: 729934 - RNA, 13 nt, Human
aagaaaauaacga

SEQ ID NO: 729935 - RNA, 21 nt, Human
uuuguauaaaauaauuuuuau

SEQ ID NO: 729936 - RNA, 22 nt, Human
agcagcauaaauguugacaugg

SEQ ID NO: 729937 - RNA, 15 nt, Human
uuuuaagauaaauua

SEQ ID NO: 729938 - RNA, 16 nt, Human
uucacauuuaaauaaa

SEQ ID NO: 729939 - RNA, 14 nt, Human
cuacaagacacagu

SEQ ID NO: 729940 - RNA, 18 nt, Human
gaccccugagcuugcaga

SEQ ID NO: 729941 - RNA, 20 nt, Human
gcucgcccacuuccucccgg

SEQ ID NO: 729942 - RNA, 13 nt, Human
augcuagaacucc

SEQ ID NO: 729943 - RNA, 15 nt, Human
ucccccaucucuucu

SEQ ID NO: 729944 - RNA, 21 nt, Human
gaaaugaguuuuucuuuucau

SEQ ID NO: 729945 - RNA, 13 nt, Human
uaaacauguuuau

SEQ ID NO: 729946 - RNA, 21 nt, Human
ccaaggaugccccgucccccu

SEQ ID NO: 729947 - RNA, 17 nt, Human
aucaugccccuguacuc

SEQ ID NO: 729948 - RNA, 17 nt, Human
ccucuggcuccagcugg

SEQ ID NO: 729949 - RNA, 13 nt, Human
gacaaggaaaaaa

SEQ ID NO: 729950 - RNA, 13 nt, Human
ccacaacacacag

SEQ ID NO: 729951 - RNA, 21 nt, Human
ccucuguucugcacacagcac

SEQ ID NO: 729952 - RNA, 19 nt, Human
cuccagcuggccgggagcc

SEQ ID NO: 729953 - RNA, 20 nt, Human
caagagccuuuuuuugaaaa

SEQ ID NO: 729954 - RNA, 17 nt, Human
guucgcgcgccuccgcu

SEQ ID NO: 729955 - RNA, 13 nt, Human
aacucuauaaugu

SEQ ID NO: 729956 - RNA, 15 nt, Human
aacgauaaaagacag

SEQ ID NO: 729957 - RNA, 18 nt, Human
uccuaauuccacagcugc

SEQ ID NO: 729958 - RNA, 13 nt, Human
cgcgcugcgcgcc

SEQ ID NO: 729959 - RNA, 21 nt, Human
gauaaaagacagugaaagaaa

SEQ ID NO: 729960 - RNA, 19 nt, Human
ccccuauccuacuuccccu

SEQ ID NO: 729961 - RNA, 22 nt, Human
aacucccugccccccagcccuc

SEQ ID NO: 729962 - RNA, 22 nt, Human
ucaacuccaaacugacucuuaa

SEQ ID NO: 729963 - RNA, 16 nt, Human
ucuuggucucaguguc

SEQ ID NO: 729964 - RNA, 18 nt, Human
aaaucuuauaauuuaaaa

SEQ ID NO: 729965 - RNA, 20 nt, Human
acuucuuaggguuaugauua

SEQ ID NO: 729966 - RNA, 16 nt, Human
uggucugugagaugcu

SEQ ID NO: 729967 - RNA, 15 nt, Human
cuucucuucacaguc

SEQ ID NO: 729968 - RNA, 16 nt, Human
ggcauggguuuuauua

SEQ ID NO: 729969 - RNA, 18 nt, Human
uuguaaaggaauuuaaaa

SEQ ID NO: 729970 - RNA, 15 nt, Human
auuauagucacuagu

SEQ ID NO: 729971 - RNA, 23 nt, Human
gaaaaaguucugcagauaaacag

SEQ ID NO: 729972 - RNA, 20 nt, Human
aucccggccggcgcgcucau

SEQ ID NO: 729973 - RNA, 15 nt, Human
ugaaauuguauuaca

SEQ ID NO: 729974 - RNA, 11 nt, Human
uuauuuuuaaa

SEQ ID NO: 729975 - RNA, 19 nt, Human
auacuaauuauacccccug

SEQ ID NO: 729976 - RNA, 16 nt, Human
ucaaaagaaagaaaau

SEQ ID NO: 729977 - RNA, 16 nt, Human
uauccuacuuccccuu

SEQ ID NO: 729978 - RNA, 14 nt, Human
ugaggcuuuaaaac

SEQ ID NO: 729979 - RNA, 15 nt, Human
gcgcgccuccgcuac

SEQ ID NO: 729980 - RNA, 23 nt, Human
caugcugucuacacuaagagaga

SEQ ID NO: 729981 - RNA, 13 nt, Human
cuucuuucaugaa

SEQ ID NO: 729982 - RNA, 23 nt, Human
ggccuccauccugaggcuccacu

SEQ ID NO: 729983 - RNA, 20 nt, Human
aaaaucuuauaauuuaaaau

SEQ ID NO: 729984 - RNA, 23 nt, Human
aaauuuacagagacagaaagcag

SEQ ID NO: 729985 - RNA, 14 nt, Human
ugagcuugcagaga

SEQ ID NO: 729986 - RNA, 14 nt, Human
gugagcuacaaaug

SEQ ID NO: 729987 - RNA, 15 nt, Human
augauaacuggaaac

SEQ ID NO: 729988 - RNA, 17 nt, Human
aaagcuccauuuuuagu

SEQ ID NO: 729989 - RNA, 19 nt, Human
ugaaauuguauuacaaauc

SEQ ID NO: 729990 - RNA, 11 nt, Human
augggacaggg

SEQ ID NO: 729991 - RNA, 13 nt, Human
uuugguucuaaua

SEQ ID NO: 729992 - RNA, 19 nt, Human
uuauggcacuaguauuucu

SEQ ID NO: 729993 - RNA, 14 nt, Human
auuguccaggucua

SEQ ID NO: 729994 - RNA, 23 nt, Human
uaauuuguaguguuggagaagaa

SEQ ID NO: 729995 - RNA, 17 nt, Human
agaauugcuugaaccca

SEQ ID NO: 729996 - RNA, 13 nt, Human
cuccagcugcccc

SEQ ID NO: 729997 - RNA, 20 nt, Human
cacagcacgggggccaagga

SEQ ID NO: 729998 - RNA, 21 nt, Human
caacacacagauuugagcuca

SEQ ID NO: 729999 - RNA, 14 nt, Human
acccgcccaccgca

SEQ ID NO: 730000 - RNA, 22 nt, Human
ccaaacauccuacaagacacag

SEQ ID NO: 730001 - RNA, 14 nt, Human
uaguaucaaaagaa

SEQ ID NO: 730002 - RNA, 16 nt, Human
agaugcuagaacuccc

SEQ ID NO: 730003 - RNA, 17 nt, Human
uaucaauuuaaaaaaaa

SEQ ID NO: 730004 - RNA, 18 nt, Human
auggcuugaguuuaaauu

SEQ ID NO: 730005 - RNA, 18 nt, Human
cuuccucugagccuuggg

SEQ ID NO: 730006 - RNA, 22 nt, Human
uuauuuauaacaaccuaaauuu

SEQ ID NO: 730007 - RNA, 19 nt, Human
ucccgcuguuccucgccac

SEQ ID NO: 730008 - RNA, 21 nt, Human
uuguaauuuuuuugugggaaa

SEQ ID NO: 730009 - RNA, 18 nt, Human
acugacucuuaagaagac

SEQ ID NO: 730010 - RNA, 16 nt, Human
cuucuggguuccuucc

SEQ ID NO: 730011 - RNA, 16 nt, Human
ugcacaucaaaauaug

SEQ ID NO: 730012 - RNA, 14 nt, Human
acccgggaggcaga

SEQ ID NO: 730013 - RNA, 12 nt, Human
uauucacaagac

SEQ ID NO: 730014 - RNA, 15 nt, Human
aaaaacguauugcau

SEQ ID NO: 730015 - RNA, 14 nt, Human
auccaaugaaauga

SEQ ID NO: 730016 - RNA, 18 nt, Human
uuuugugggaaauccaca

SEQ ID NO: 730017 - RNA, 19 nt, Human
uuaaauggaaguaaauguu

SEQ ID NO: 730018 - RNA, 22 nt, Human
ugaccauacuaauuauaccccc

SEQ ID NO: 730019 - RNA, 22 nt, Human
ugaauggcuaagcaaaauguga

SEQ ID NO: 730020 - RNA, 19 nt, Human
cugcaaagcccagcuugaa

SEQ ID NO: 730021 - RNA, 14 nt, Human
aguacuucccgcug

SEQ ID NO: 730022 - RNA, 23 nt, Human
gaaaaucuuauaauuuaaaauau

SEQ ID NO: 730023 - RNA, 22 nt, Human
ucuggguuccuuccucugagcc

SEQ ID NO: 730024 - RNA, 16 nt, Human
caugggacagggagga

SEQ ID NO: 730025 - RNA, 20 nt, Human
uuaacacaugauccugcaau

SEQ ID NO: 730026 - RNA, 13 nt, Human
auuuuuuaaaaaa

SEQ ID NO: 730027 - RNA, 18 nt, Human
cuccgcgcagcucaggcu

SEQ ID NO: 730028 - RNA, 17 nt, Human
acccacuggacucaccu

SEQ ID NO: 730029 - RNA, 17 nt, Human
ggagggcgcggggcggg

SEQ ID NO: 730030 - RNA, 22 nt, Human
caagacucugucucaaaaaaua

SEQ ID NO: 730031 - RNA, 18 nt, Human
uguggucacaggaaguag

SEQ ID NO: 730032 - RNA, 18 nt, Human
ugaacuugguuuuaauua

SEQ ID NO: 730033 - RNA, 16 nt, Human
acgccuguaaucccag

SEQ ID NO: 730034 - RNA, 14 nt, Human
uugacccacaagaa

SEQ ID NO: 730035 - RNA, 22 nt, Human
caucucuucuggguuccuuccu

SEQ ID NO: 730036 - RNA, 15 nt, Human
ucacaggacagcccu

SEQ ID NO: 730037 - RNA, 17 nt, Human
agugauuaccagggacu

SEQ ID NO: 730038 - RNA, 20 nt, Human
cggagccuccagcugccccg

SEQ ID NO: 730039 - RNA, 16 nt, Human
caugguuuagaaagcu

SEQ ID NO: 730040 - RNA, 14 nt, Human
gaaagcagaacagu

SEQ ID NO: 730041 - RNA, 17 nt, Human
uuauauuugaaauauug

SEQ ID NO: 730042 - RNA, 22 nt, Human
ccgcgcagcucaggcuggcacc

SEQ ID NO: 730043 - RNA, 14 nt, Human
cugccccccagccc

SEQ ID NO: 730044 - RNA, 13 nt, Human
aaaauaacgauaa

SEQ ID NO: 730045 - RNA, 22 nt, Human
aaauguugacaugggacauuug

SEQ ID NO: 730046 - RNA, 15 nt, Human
agccugaaagaggaa

SEQ ID NO: 730047 - RNA, 20 nt, Human
agcccuggugggcagagagg

SEQ ID NO: 730048 - RNA, 18 nt, Human
gccccgucccccucuggc

SEQ ID NO: 730049 - RNA, 17 nt, Human
uuugaguguuuuaagau

SEQ ID NO: 730050 - RNA, 21 nt, Human
ccggggaggggcgcucgcuuc

SEQ ID NO: 730051 - RNA, 22 nt, Human
gcuccgcgcagcucaggcuggc

SEQ ID NO: 730052 - RNA, 16 nt, Human
cuuccucccuggaauc

SEQ ID NO: 730053 - RNA, 19 nt, Human
cuacuugggaggcugaggc

SEQ ID NO: 730054 - RNA, 18 nt, Human
acucuaggacauaaauua

SEQ ID NO: 730055 - RNA, 16 nt, Human
cugaucaccugcccug

SEQ ID NO: 730056 - RNA, 14 nt, Human
ugagaugcuagaac

SEQ ID NO: 730057 - RNA, 19 nt, Human
cggccuccauccugaggcu

SEQ ID NO: 730058 - RNA, 14 nt, Human
uuucuaugaaauau

SEQ ID NO: 730059 - RNA, 14 nt, Human
aucaaaagaaagaa

SEQ ID NO: 730060 - RNA, 14 nt, Human
auuauuuuuuaaaa

SEQ ID NO: 730061 - RNA, 14 nt, Human
uauaauuuaaaaua

SEQ ID NO: 730062 - RNA, 13 nt, Human
auugucuagugaa

SEQ ID NO: 730063 - RNA, 14 nt, Human
cauuaaaguucuag

SEQ ID NO: 730064 - RNA, 23 nt, Human
uggcuugaguuuaaauuguaaua

SEQ ID NO: 730065 - RNA, 16 nt, Human
acggagccgggaaaga

SEQ ID NO: 730066 - RNA, 16 nt, Human
caccuguaaucccagc

SEQ ID NO: 730067 - RNA, 15 nt, Human
ucuaugaaauauuau

SEQ ID NO: 730068 - RNA, 19 nt, Human
uggcaagcucuaucaccaa

SEQ ID NO: 730069 - RNA, 22 nt, Human
agcuuguauuccuuuuucucuc

SEQ ID NO: 730070 - RNA, 18 nt, Human
uucuagcuguugagcugu

SEQ ID NO: 730071 - RNA, 13 nt, Human
ucucccucccuug

SEQ ID NO: 730072 - RNA, 19 nt, Human
cugccccccagcccuccuu

SEQ ID NO: 730073 - RNA, 22 nt, Human
aauuuuuucucuaggaaauauu

SEQ ID NO: 730074 - RNA, 15 nt, Human
aagcacuaaacaaag

SEQ ID NO: 730075 - RNA, 18 nt, Human
acaaaaggauaaugaaua

SEQ ID NO: 730076 - RNA, 15 nt, Human
ggccuccauccugag

SEQ ID NO: 730077 - RNA, 21 nt, Human
cacaugaacuuguaaaggaau

SEQ ID NO: 730078 - RNA, 16 nt, Human
auaucaguuauuuuua

SEQ ID NO: 730079 - RNA, 14 nt, Human
cuuggucugugaga

SEQ ID NO: 730080 - RNA, 21 nt, Human
gacagugaaagaaaauaacaa

SEQ ID NO: 730081 - RNA, 18 nt, Human
cugcagcgaguacuuccc

SEQ ID NO: 730082 - RNA, 22 nt, Human
cugggacaggggagaaccuagg

SEQ ID NO: 730083 - RNA, 14 nt, Human
auuugaaauuguau

SEQ ID NO: 730084 - RNA, 21 nt, Human
ugaugcuacaggauuugaaau

SEQ ID NO: 730085 - RNA, 17 nt, Human
gcgcucaucccacccgc

SEQ ID NO: 730086 - RNA, 19 nt, Human
cugagccucagucucccuc

SEQ ID NO: 730087 - RNA, 15 nt, Human
ggccuucggccucca

SEQ ID NO: 730088 - RNA, 20 nt, Human
auuauaauuuuuuucaauau

SEQ ID NO: 730089 - RNA, 15 nt, Human
gccucuuagaugcag

SEQ ID NO: 730090 - RNA, 13 nt, Human
gguauuugagugu

SEQ ID NO: 730091 - RNA, 18 nt, Human
acagaaagcagaacagug

SEQ ID NO: 730092 - RNA, 19 nt, Human
ugcacacagcacgggggcc

SEQ ID NO: 730093 - RNA, 22 nt, Human
uacauaagggaggaaaaaaaau

SEQ ID NO: 730094 - RNA, 14 nt, Human
guauuuuaaaagaa

SEQ ID NO: 730095 - RNA, 14 nt, Human
caaggcuagaacca

SEQ ID NO: 730096 - RNA, 23 nt, Human
ccccggggaggggcgcucgcuuc

SEQ ID NO: 730097 - RNA, 19 nt, Human
agccuccagcugccccggg

SEQ ID NO: 730098 - RNA, 14 nt, Human
ggaccaucccggcc

SEQ ID NO: 730099 - RNA, 12 nt, Human
cuuccucugagc

SEQ ID NO: 730100 - RNA, 23 nt, Human
cagcugccccggggaggggcgcu

SEQ ID NO: 730101 - RNA, 18 nt, Human
auaaauguaucuuauuca

SEQ ID NO: 730102 - RNA, 18 nt, Human
acaaaugggaaacaaaag

SEQ ID NO: 730103 - RNA, 19 nt, Human
uucccuugaugaagaaguu

SEQ ID NO: 730104 - RNA, 19 nt, Human
ucacgccuguaaucccagc

SEQ ID NO: 730105 - RNA, 15 nt, Human
ugagcucagcccugg

SEQ ID NO: 730106 - RNA, 21 nt, Human
ugccuguaaucacagcuacuu

SEQ ID NO: 730107 - RNA, 16 nt, Human
ggcagagagguaggga

SEQ ID NO: 730108 - RNA, 17 nt, Human
uuacagagacagaaagc

SEQ ID NO: 730109 - RNA, 23 nt, Human
aaagaugaucaguaugaaaaugu

SEQ ID NO: 730110 - RNA, 14 nt, Human
aagagugaaggauu

SEQ ID NO: 730111 - RNA, 14 nt, Human
ggcaauagucaaau

SEQ ID NO: 730112 - RNA, 16 nt, Human
ccaggcugagccucag

SEQ ID NO: 730113 - RNA, 14 nt, Human
ugcuucuguuuuau

SEQ ID NO: 730114 - RNA, 17 nt, Human
ucugugagaugcuagaa

SEQ ID NO: 730115 - RNA, 16 nt, Human
ccauuuuuagugaaau

SEQ ID NO: 730116 - RNA, 19 nt, Human
gaaagaaaauaacaauaaa

SEQ ID NO: 730117 - RNA, 12 nt, Human
ccuucagccuga

SEQ ID NO: 730118 - RNA, 14 nt, Human
uaaauaguuuauga

SEQ ID NO: 730119 - RNA, 22 nt, Human
uccgcauccuagucucuaucau

SEQ ID NO: 730120 - RNA, 13 nt, Human
uggacgagaaaac

SEQ ID NO: 730121 - RNA, 21 nt, Human
auuauauuuauuacuguaaga

SEQ ID NO: 730122 - RNA, 19 nt, Human
cucacauuuauauuuuugu

SEQ ID NO: 730123 - RNA, 23 nt, Human
acugucuuguuggacgagaaaac

SEQ ID NO: 730124 - RNA, 21 nt, Human
caagacugcacaucaaaauau

SEQ ID NO: 730125 - RNA, 14 nt, Human
cuuaggaagagaaa

SEQ ID NO: 730126 - RNA, 15 nt, Human
agccucagucucccu

SEQ ID NO: 730127 - RNA, 19 nt, Human
uccuagucucuaucauuaa

SEQ ID NO: 730128 - RNA, 12 nt, Human
cgcgccuccgcu

SEQ ID NO: 730129 - RNA, 14 nt, Human
cagauuugagcuca

SEQ ID NO: 730130 - RNA, 14 nt, Human
gcuggagcucugcc

SEQ ID NO: 730131 - RNA, 22 nt, Human
uacugagagugaacaaauuuac

SEQ ID NO: 730132 - RNA, 15 nt, Human
ugccgugggccugag

SEQ ID NO: 730133 - RNA, 17 nt, Human
uuaauaauuuuuaauua

SEQ ID NO: 730134 - RNA, 12 nt, Human
acaagaaaugaa

SEQ ID NO: 730135 - RNA, 13 nt, Human
gcgcgccuccgcu

SEQ ID NO: 730136 - RNA, 18 nt, Human
aaccuuauuguaccucuc

SEQ ID NO: 730137 - RNA, 16 nt, Human
aaaaauacaaaaauua

SEQ ID NO: 730138 - RNA, 15 nt, Human
caguuauuuuuaaac

SEQ ID NO: 730139 - RNA, 22 nt, Human
uuaccucugccucagaaaacaa

SEQ ID NO: 730140 - RNA, 21 nt, Human
aaugugacuuaaugccacuaa

SEQ ID NO: 730141 - RNA, 20 nt, Human
cugagccucagucucccucc

SEQ ID NO: 730142 - RNA, 20 nt, Human
uuucuucaacucccugcccc

SEQ ID NO: 730143 - RNA, 13 nt, Human
aaaugggaaacaa

SEQ ID NO: 730144 - RNA, 11 nt, Human
aaccugagccc

SEQ ID NO: 730145 - RNA, 13 nt, Human
cucugagccuugg

SEQ ID NO: 730146 - RNA, 15 nt, Human
uauaauuuaaauaua

SEQ ID NO: 730147 - RNA, 15 nt, Human
uaacugcuacaaaua

SEQ ID NO: 730148 - RNA, 16 nt, Human
acaaggaugaauuaag

SEQ ID NO: 730149 - RNA, 20 nt, Human
aacaagccuccuuuuaaagu

SEQ ID NO: 730150 - RNA, 17 nt, Human
aagacaaggaaaaaaua

SEQ ID NO: 730151 - RNA, 17 nt, Human
uugugaagcaaaauuuu

SEQ ID NO: 730152 - RNA, 18 nt, Human
auaauccuaaacauauga

SEQ ID NO: 730153 - RNA, 21 nt, Human
cgagccccaggcggguccggg

SEQ ID NO: 730154 - RNA, 18 nt, Human
agaagcaacccaaauguu

SEQ ID NO: 730155 - RNA, 19 nt, Human
aaauuagaggucuccaaaa

SEQ ID NO: 730156 - RNA, 21 nt, Human
acagcccuucuuuccacagaa

SEQ ID NO: 730157 - RNA, 14 nt, Human
auuuauuauuuuca

SEQ ID NO: 730158 - RNA, 12 nt, Human
gcaaagcccagc

SEQ ID NO: 730159 - RNA, 22 nt, Human
aucaccaaggcugauuaaacca

SEQ ID NO: 730160 - RNA, 13 nt, Human
uccagcugccccg

SEQ ID NO: 730161 - RNA, 22 nt, Human
acaccuuguacuuuauuuucua

SEQ ID NO: 730162 - RNA, 18 nt, Human
aagucuuucacauuuaaa

SEQ ID NO: 730163 - RNA, 14 nt, Human
uugccaugugcuag

SEQ ID NO: 730164 - RNA, 22 nt, Human
agacucugucucaguccaugaa

SEQ ID NO: 730165 - RNA, 18 nt, Human
cuccauccugaggcucca

SEQ ID NO: 730166 - RNA, 15 nt, Human
uacuaauuuuaaaau

SEQ ID NO: 730167 - RNA, 11 nt, Human
ccugagcccca

SEQ ID NO: 730168 - RNA, 16 nt, Human
agugaaagaaaauaac

SEQ ID NO: 730169 - RNA, 15 nt, Human
ucugucucaguccau

SEQ ID NO: 730170 - RNA, 22 nt, Human
aaagacagugaaagaaaauaac

SEQ ID NO: 730171 - RNA, 19 nt, Human
gcugccccggggaggggcg

SEQ ID NO: 730172 - RNA, 21 nt, Human
agggugauauuaaccaggggc

SEQ ID NO: 730173 - RNA, 17 nt, Human
cauuguuugucugucuu

SEQ ID NO: 730174 - RNA, 22 nt, Human
cuucaacucccugccccccagc

SEQ ID NO: 730175 - RNA, 20 nt, Human
gcgcgcucaucccacccgcc

SEQ ID NO: 730176 - RNA, 14 nt, Human
ucuauuuauuuacu

SEQ ID NO: 730177 - RNA, 16 nt, Human
ccagggcuacgcgcgc

SEQ ID NO: 730178 - RNA, 13 nt, Human
aagugcagccccg

SEQ ID NO: 730179 - RNA, 13 nt, Human
aagacagugaaag

SEQ ID NO: 730180 - RNA, 21 nt, Human
aaucaccaaggcugauuaaac

SEQ ID NO: 730181 - RNA, 18 nt, Human
ggcuccggacgcugcugc

SEQ ID NO: 730182 - RNA, 16 nt, Human
aauuccacagcugcuc

SEQ ID NO: 730183 - RNA, 22 nt, Human
uuccccuuccuaauuccacagc

SEQ ID NO: 730184 - RNA, 18 nt, Human
cugcucaauaaaguacaa

SEQ ID NO: 730185 - RNA, 21 nt, Human
cuggccuucggccuccauccu

SEQ ID NO: 730186 - RNA, 16 nt, Human
gaauggcuaagcaaaa

SEQ ID NO: 730187 - RNA, 19 nt, Human
ccaaggcccccgggccgac

SEQ ID NO: 730188 - RNA, 17 nt, Human
uaugugcauauuuuauu

SEQ ID NO: 730189 - RNA, 19 nt, Human
cgcucugggucgccggcau

SEQ ID NO: 730190 - RNA, 15 nt, Human
cgcauccuagucucu

SEQ ID NO: 730191 - RNA, 13 nt, Human
cggccggcgcgcu

SEQ ID NO: 730192 - RNA, 14 nt, Human
ucucuacuaaaaau

SEQ ID NO: 730193 - RNA, 16 nt, Human
uugucaauaaaaucca

SEQ ID NO: 730194 - RNA, 21 nt, Human
uuauuuucuauaauuuaaaua

SEQ ID NO: 730195 - RNA, 12 nt, Human
aauaaaguacaa

SEQ ID NO: 730196 - RNA, 19 nt, Human
auuuucuauaauuuaaaua

SEQ ID NO: 730197 - RNA, 18 nt, Human
ugugcauauuuuauuaua

SEQ ID NO: 730198 - RNA, 16 nt, Human
auuuuuuuuuuuaaaa

SEQ ID NO: 730199 - RNA, 14 nt, Human
ucaccuguuuuuaa

SEQ ID NO: 730200 - RNA, 16 nt, Human
caggaaguagaggagg

SEQ ID NO: 730201 - RNA, 14 nt, Human
cagugaaagaaaau

SEQ ID NO: 730202 - RNA, 16 nt, Human
auugucuagugaaacu

SEQ ID NO: 730203 - RNA, 23 nt, Human
aucauuaaaguucuagugaccga

SEQ ID NO: 730204 - RNA, 14 nt, Human
auuuauguuuaauu

SEQ ID NO: 730205 - RNA, 16 nt, Human
cagggacuugaaccca

SEQ ID NO: 730206 - RNA, 16 nt, Human
uuacccccugggagcc

SEQ ID NO: 730207 - RNA, 17 nt, Human
uucugagcauuuaauau

SEQ ID NO: 730208 - RNA, 22 nt, Human
agagccggagccuccagcugcc

SEQ ID NO: 730209 - RNA, 21 nt, Human
auucauagcagcuuauucaca

SEQ ID NO: 730210 - RNA, 23 nt, Human
ggccugagaccaaggcccccggg

SEQ ID NO: 730211 - RNA, 14 nt, Human
acaagagcuuaaca

SEQ ID NO: 730212 - RNA, 15 nt, Human
cuacaagacacagug

SEQ ID NO: 730213 - RNA, 11 nt, Human
uuauauuuauu

SEQ ID NO: 730214 - RNA, 16 nt, Human
agugucaaugcagccc

SEQ ID NO: 730215 - RNA, 13 nt, Human
cacaacacacaga

SEQ ID NO: 730216 - RNA, 20 nt, Human
cgcauccuagucucuaucau

SEQ ID NO: 730217 - RNA, 17 nt, Human
agcgacagugagacucu

SEQ ID NO: 730218 - RNA, 19 nt, Human
ccccugagcuugcagagau

SEQ ID NO: 730219 - RNA, 17 nt, Human
gugccuguaaucacagc

SEQ ID NO: 730220 - RNA, 19 nt, Human
ugcucgcccacuuccuccc

SEQ ID NO: 730221 - RNA, 18 nt, Human
acuggacucaccuccccc

SEQ ID NO: 730222 - RNA, 19 nt, Human
uauaauuuuuuucaauauu

SEQ ID NO: 730223 - RNA, 23 nt, Human
ugaaaaucuuauaauuuaaaaua

SEQ ID NO: 730224 - RNA, 19 nt, Human
aaucuacacuccagugaga

SEQ ID NO: 730225 - RNA, 15 nt, Human
cgcccacuuccuccc

SEQ ID NO: 730226 - RNA, 19 nt, Human
ugaaauggacuuuuguaca

SEQ ID NO: 730227 - RNA, 21 nt, Human
agccucuuagaugcaguucug

SEQ ID NO: 730228 - RNA, 20 nt, Human
aaagacaaggaaaaaauaac

SEQ ID NO: 730229 - RNA, 11 nt, Human
accauuuuuac

SEQ ID NO: 730230 - RNA, 19 nt, Human
guacugagagugaacaaau

SEQ ID NO: 730231 - RNA, 17 nt, Human
caccucccccaucucuu

SEQ ID NO: 730232 - RNA, 22 nt, Human
cugcucaauaaaguacaagagc

SEQ ID NO: 730233 - RNA, 14 nt, Human
agagguccacaaca

SEQ ID NO: 730234 - RNA, 22 nt, Human
cacuuccaagagccuuuuuuug

SEQ ID NO: 730235 - RNA, 23 nt, Human
caaagcugaaauggacuuuugua

SEQ ID NO: 730236 - RNA, 21 nt, Human
cagugagacagcucugcauac

SEQ ID NO: 730237 - RNA, 16 nt, Human
aaauuagccgggcaug

SEQ ID NO: 730238 - RNA, 13 nt, Human
cgcuuccgcaucc

SEQ ID NO: 730239 - RNA, 22 nt, Human
agaaaacaauaacgauaaaaga

SEQ ID NO: 730240 - RNA, 18 nt, Human
aauuuuuuugugggaaau

SEQ ID NO: 730241 - RNA, 22 nt, Human
ggguuccuuccucugagccuug

SEQ ID NO: 730242 - RNA, 20 nt, Human
acuaaauugacacuuaaaaa

SEQ ID NO: 730243 - RNA, 17 nt, Human
cccacuagacccacugg

SEQ ID NO: 730244 - RNA, 16 nt, Human
aagcuucacuguaaaa

SEQ ID NO: 730245 - RNA, 14 nt, Human
ugcuaagucuuaua

SEQ ID NO: 730246 - RNA, 17 nt, Human
agucccaggcugagccu

SEQ ID NO: 730247 - RNA, 21 nt, Human
guuguaauuuuuuugugggaa

SEQ ID NO: 730248 - RNA, 20 nt, Human
gaaaauaacaauaaaagaca

SEQ ID NO: 730249 - RNA, 23 nt, Human
ggcugcgcucggccugcucgccc

SEQ ID NO: 730250 - RNA, 23 nt, Human
aagagccuuuuuuugaaaaaaag

SEQ ID NO: 730251 - RNA, 14 nt, Human
uccacuuggucugu

SEQ ID NO: 730252 - RNA, 18 nt, Human
cagcugcucaauaaagua

SEQ ID NO: 730253 - RNA, 13 nt, Human
gguccacaacaca

SEQ ID NO: 730254 - RNA, 16 nt, Human
ccuaagugcagccccg

SEQ ID NO: 730255 - RNA, 20 nt, Human
gggaggcagagguugcagug

SEQ ID NO: 730256 - RNA, 14 nt, Human
uaaaagacaaggaa

SEQ ID NO: 730257 - RNA, 17 nt, Human
ugugcauauuuuauuau

SEQ ID NO: 730258 - RNA, 20 nt, Human
uggaauaauccuaaacauau

SEQ ID NO: 730259 - RNA, 12 nt, Human
uugggaggcuga

SEQ ID NO: 730260 - RNA, 12 nt, Human
agaaaacaauaa

SEQ ID NO: 730261 - RNA, 23 nt, Human
ggucucagugucaaugcagcccc

SEQ ID NO: 730262 - RNA, 19 nt, Human
aaaguaugugcauauuuua

SEQ ID NO: 730263 - RNA, 16 nt, Human
agugaaggauuuaugu

SEQ ID NO: 730264 - RNA, 19 nt, Human
augugcauauuuuauuaua

SEQ ID NO: 730265 - RNA, 17 nt, Human
agcuacuaauuuuaaaa

SEQ ID NO: 730266 - RNA, 16 nt, Human
ccucagucucccuccc

SEQ ID NO: 730267 - RNA, 19 nt, Human
cccauggcacucuauguuc

SEQ ID NO: 730268 - RNA, 16 nt, Human
ggaugccccguccccc

SEQ ID NO: 730269 - RNA, 18 nt, Human
guuucaaacauauauaac

SEQ ID NO: 730270 - RNA, 13 nt, Human
gcuguacgcgagc

SEQ ID NO: 730271 - RNA, 15 nt, Human
aaauauaaauaaaaa

SEQ ID NO: 730272 - RNA, 18 nt, Human
gagucccaggcugagccu

SEQ ID NO: 730273 - RNA, 20 nt, Human
cagcugccccggggaggggc

SEQ ID NO: 730274 - RNA, 14 nt, Human
aauguaucuuauuc

SEQ ID NO: 730275 - RNA, 19 nt, Human
agaaaauaacaauaaaaga

SEQ ID NO: 730276 - RNA, 17 nt, Human
augcagagguccacaac

SEQ ID NO: 730277 - RNA, 20 nt, Human
gcggggcggggagcgagccc

SEQ ID NO: 730278 - RNA, 16 nt, Human
aauuucuucaacuccc

SEQ ID NO: 730279 - RNA, 14 nt, Human
caagacucugucuc

SEQ ID NO: 730280 - RNA, 15 nt, Human
auuauuuuuuaaaaa

SEQ ID NO: 730281 - RNA, 14 nt, Human
ccacuggacucacc

SEQ ID NO: 730282 - RNA, 21 nt, Human
gcuccgcgcagcucaggcugg

SEQ ID NO: 730283 - RNA, 14 nt, Human
ucccuugaugaaga

SEQ ID NO: 730284 - RNA, 14 nt, Human
auuuucuauaauuu

SEQ ID NO: 730285 - RNA, 23 nt, Human
auaaaguaugugcauauuuuauu

SEQ ID NO: 730286 - RNA, 19 nt, Human
agacagugaaagaaaauaa

SEQ ID NO: 730287 - RNA, 13 nt, Human
gcuggagcucugc

SEQ ID NO: 730288 - RNA, 19 nt, Human
ucaauucuugccaaauaua

SEQ ID NO: 730289 - RNA, 22 nt, Human
aaccuacacgagauacagaauu

SEQ ID NO: 730290 - RNA, 15 nt, Human
cgcucggccugcucg

SEQ ID NO: 730291 - RNA, 16 nt, Human
uggcaagcucuaucac

SEQ ID NO: 730292 - RNA, 13 nt, Human
cauuuguauaaaa

SEQ ID NO: 730293 - RNA, 22 nt, Human
caagagaauugcuugaacccag

SEQ ID NO: 730294 - RNA, 16 nt, Human
ccuagucucuaucauu

SEQ ID NO: 730295 - RNA, 20 nt, Human
cccuuccuaauuccacagcu

SEQ ID NO: 730296 - RNA, 18 nt, Human
gcccacuuccucccggcc

SEQ ID NO: 730297 - RNA, 20 nt, Human
cuacuuccccuuccuaauuc

SEQ ID NO: 730298 - RNA, 13 nt, Human
uuuaaaaaaaaac

SEQ ID NO: 730299 - RNA, 14 nt, Human
ugcuguauuuuaaa

SEQ ID NO: 730300 - RNA, 14 nt, Human
cagauccuggaaau

SEQ ID NO: 730301 - RNA, 17 nt, Human
gacagugaaagaaaaua

SEQ ID NO: 730302 - RNA, 22 nt, Human
ccgggaggcagagguugcagug

SEQ ID NO: 730303 - RNA, 22 nt, Human
ugaguguugccuaauuuguuuu

SEQ ID NO: 730304 - RNA, 22 nt, Human
uguaccucucuuauagaauauu

SEQ ID NO: 730305 - RNA, 19 nt, Human
augcagagguccacaacac

SEQ ID NO: 730306 - RNA, 16 nt, Human
ccugagcgacagugag

SEQ ID NO: 730307 - RNA, 21 nt, Human
uuaacuagaauuuauucaauu

SEQ ID NO: 730308 - RNA, 15 nt, Human
ccugcaaagcccagc

SEQ ID NO: 730309 - RNA, 13 nt, Human
cugggucgccggc

SEQ ID NO: 730310 - RNA, 17 nt, Human
ucaacccccauuucuau

SEQ ID NO: 730311 - RNA, 19 nt, Human
aguuauuuuuaaacuguaa

SEQ ID NO: 730312 - RNA, 13 nt, Human
ucuauaauuuaaa

SEQ ID NO: 730313 - RNA, 16 nt, Human
ccgcauccuagucucu

SEQ ID NO: 730314 - RNA, 17 nt, Human
cauuaaaguucuaguga

SEQ ID NO: 730315 - RNA, 13 nt, Human
uucuaggccgggc

SEQ ID NO: 730316 - RNA, 13 nt, Human
guuauuuuuaaac

SEQ ID NO: 730317 - RNA, 23 nt, Human
gccggcgcgcucaucccacccgc

SEQ ID NO: 730318 - RNA, 20 nt, Human
acuagaguuuagcuggaaaa

SEQ ID NO: 730319 - RNA, 15 nt, Human
gcuguauuuuaaaag

SEQ ID NO: 730320 - RNA, 17 nt, Human
cugagcgacagugagac

SEQ ID NO: 730321 - RNA, 17 nt, Human
aauaugcucuaaacaug

SEQ ID NO: 730322 - RNA, 21 nt, Human
gaagagccggagccuccagcu

SEQ ID NO: 730323 - RNA, 18 nt, Human
caagccucauguccacug

SEQ ID NO: 730324 - RNA, 14 nt, Human
cugcugagucccag

SEQ ID NO: 730325 - RNA, 14 nt, Human
uauuugaaauauug

SEQ ID NO: 730326 - RNA, 12 nt, Human
cagugaaagaaa

SEQ ID NO: 730327 - RNA, 13 nt, Human
ccccagcccuccu

SEQ ID NO: 730328 - RNA, 17 nt, Human
auguugacaugggacau

SEQ ID NO: 730329 - RNA, 14 nt, Human
aauggcuaagcaaa

SEQ ID NO: 730330 - RNA, 19 nt, Human
acaauaacgauaaaagaca

SEQ ID NO: 730331 - RNA, 14 nt, Human
gcuggcaccgcugu

SEQ ID NO: 730332 - RNA, 12 nt, Human
gcccccgggccg

SEQ ID NO: 730333 - RNA, 15 nt, Human
uuugaguguuuuaag

SEQ ID NO: 730334 - RNA, 20 nt, Human
aaagacagugaaagaaaaua

SEQ ID NO: 730335 - RNA, 16 nt, Human
auaaugaauacuuuau

SEQ ID NO: 730336 - RNA, 20 nt, Human
ccagcacuuugggaggcuga

SEQ ID NO: 730337 - RNA, 18 nt, Human
uacauuuguauaaaauaa

SEQ ID NO: 730338 - RNA, 19 nt, Human
gcacacagcacgggggcca

SEQ ID NO: 730339 - RNA, 15 nt, Human
aagccuccuuuuaaa

SEQ ID NO: 730340 - RNA, 18 nt, Human
uaaaagacaaggaaaaaa

SEQ ID NO: 730341 - RNA, 18 nt, Human
cgccuguaaucccagcac

SEQ ID NO: 730342 - RNA, 16 nt, Human
uuaaauuguaauaggc

SEQ ID NO: 730343 - RNA, 21 nt, Human
gccaaauauaaauaaaaauaa

SEQ ID NO: 730344 - RNA, 14 nt, Human
cuacaaauacucuu

SEQ ID NO: 730345 - RNA, 14 nt, Human
gccucagucucccu

SEQ ID NO: 730346 - RNA, 20 nt, Human
auaauccuaaacauaugaau

SEQ ID NO: 730347 - RNA, 22 nt, Human
uuuuauagcuacuaauuuuaaa

SEQ ID NO: 730348 - RNA, 13 nt, Human
cuugucucugggc

SEQ ID NO: 730349 - RNA, 18 nt, Human
uucugauauuggacagua

SEQ ID NO: 730350 - RNA, 12 nt, Human
uaagaagacugc

SEQ ID NO: 730351 - RNA, 22 nt, Human
uuguaacaagccuccuuuuaaa

SEQ ID NO: 730352 - RNA, 19 nt, Human
gagccucagucucccuccc

SEQ ID NO: 730353 - RNA, 15 nt, Human
aaacauaugaauuau

SEQ ID NO: 730354 - RNA, 14 nt, Human
caauuccucuggga

SEQ ID NO: 730355 - RNA, 14 nt, Human
acgagaaaacaaua

SEQ ID NO: 730356 - RNA, 17 nt, Human
agccgggaaagaagagc

SEQ ID NO: 730357 - RNA, 14 nt, Human
cuaaacauaugaau

SEQ ID NO: 730358 - RNA, 19 nt, Human
cgauuuagaaagaagccca

SEQ ID NO: 730359 - RNA, 23 nt, Human
auucaauaucuuuuuuuuaauaa

SEQ ID NO: 730360 - RNA, 12 nt, Human
cacaacacacag

SEQ ID NO: 730361 - RNA, 16 nt, Human
augcuguauuuuaaaa

SEQ ID NO: 730362 - RNA, 21 nt, Human
uaauaggcguaacuaauuuua

SEQ ID NO: 730363 - RNA, 20 nt, Human
aaauccuugaagauuuacca

SEQ ID NO: 730364 - RNA, 14 nt, Human
ccugagaccaaggc

SEQ ID NO: 730365 - RNA, 17 nt, Human
ucugucucaaaaaauaa

SEQ ID NO: 730366 - RNA, 24 nt, Human
uaauuuaaaauaugcucuaaacau

SEQ ID NO: 730367 - RNA, 19 nt, Human
acucugucucaguccauga

SEQ ID NO: 730368 - RNA, 16 nt, Human
cuggcugcgcucggcc

SEQ ID NO: 730369 - RNA, 17 nt, Human
cggcccugugcggccug

SEQ ID NO: 730370 - RNA, 16 nt, Human
ccugaucaccugcccu

SEQ ID NO: 730371 - RNA, 15 nt, Human
gcucgcuuccgcauc

SEQ ID NO: 730372 - RNA, 19 nt, Human
cccacuggacucaccuccc

SEQ ID NO: 730373 - RNA, 21 nt, Human
auuugaguguuuuaagauaaa

SEQ ID NO: 730374 - RNA, 13 nt, Human
gcggccuggucua

SEQ ID NO: 730375 - RNA, 15 nt, Human
aguaaauguuguuuu

SEQ ID NO: 730376 - RNA, 21 nt, Human
uuacaaugcauucugagguaa

SEQ ID NO: 730377 - RNA, 20 nt, Human
gaagagccggagccuccagc

SEQ ID NO: 730378 - RNA, 17 nt, Human
aagcccaauauuauaau

SEQ ID NO: 730379 - RNA, 15 nt, Human
cuaagcaaaauguga

SEQ ID NO: 730380 - RNA, 13 nt, Human
cgaguacuucccg

SEQ ID NO: 730381 - RNA, 22 nt, Human
cuggguuccuuccucugagccu

SEQ ID NO: 730382 - RNA, 20 nt, Human
acuuuauuuucuauaauuua

SEQ ID NO: 730383 - RNA, 13 nt, Human
uaaauuugguucu

SEQ ID NO: 730384 - RNA, 20 nt, Human
uaaaacaagcacuaaacaaa

SEQ ID NO: 730385 - RNA, 14 nt, Human
uauguauauuuuau

SEQ ID NO: 730386 - RNA, 14 nt, Human
aguuuuuuuuuaaa

SEQ ID NO: 730387 - RNA, 18 nt, Human
aacaaugcuguauuuuaa

SEQ ID NO: 730388 - RNA, 19 nt, Human
uccagaaagugacaagcuc

SEQ ID NO: 730389 - RNA, 22 nt, Human
uagacacacaugaaguccaagc

SEQ ID NO: 730390 - RNA, 14 nt, Human
uuucaauauuuauu

SEQ ID NO: 730391 - RNA, 21 nt, Human
cugcccugcugagucccaggc

SEQ ID NO: 730392 - RNA, 16 nt, Human
aauugacccacaagaa

SEQ ID NO: 730393 - RNA, 17 nt, Human
gccuccuuuuaaaguaa

SEQ ID NO: 730394 - RNA, 19 nt, Human
aauuuuuauauuugaaaua

SEQ ID NO: 730395 - RNA, 19 nt, Human
uggaaauguuuacagaucc

SEQ ID NO: 730396 - RNA, 15 nt, Human
ggauuccccuaaccu

SEQ ID NO: 730397 - RNA, 23 nt, Human
agagcaagacucugucucaaaaa

SEQ ID NO: 730398 - RNA, 12 nt, Human
gcgagcgcgcgc

SEQ ID NO: 730399 - RNA, 15 nt, Human
cucccugccccccag

SEQ ID NO: 730400 - RNA, 16 nt, Human
cuagaaccaccugccu

SEQ ID NO: 730401 - RNA, 22 nt, Human
cgcgcuccgcgcagcucaggcu

SEQ ID NO: 730402 - RNA, 15 nt, Human
ggacucaccuccccc

SEQ ID NO: 730403 - RNA, 19 nt, Human
caacucccugccccccagc

SEQ ID NO: 730404 - RNA, 21 nt, Human
ucaugccccuguacuccagcc

SEQ ID NO: 730405 - RNA, 15 nt, Human
ugggacagggaggac

SEQ ID NO: 730406 - RNA, 18 nt, Human
uguacuuuauuuucuaua

SEQ ID NO: 730407 - RNA, 14 nt, Human
ggccuucggccucc

SEQ ID NO: 730408 - RNA, 20 nt, Human
aguuuuuuuuuaaaaaagaa

SEQ ID NO: 730409 - RNA, 21 nt, Human
gcccauccugccccugagccc

SEQ ID NO: 730410 - RNA, 17 nt, Human
gaagaccucauuuugaa

SEQ ID NO: 730411 - RNA, 14 nt, Human
aucaccaaggcuga

SEQ ID NO: 730412 - RNA, 17 nt, Human
agugagacagcucugca

SEQ ID NO: 730413 - RNA, 11 nt, Human
aauuuaaauau

SEQ ID NO: 730414 - RNA, 17 nt, Human
augaucaguaugaaaau

SEQ ID NO: 730415 - RNA, 15 nt, Human
gcccugugcggccug

SEQ ID NO: 730416 - RNA, 15 nt, Human
ccagcacagccucuu

SEQ ID NO: 730417 - RNA, 16 nt, Human
accuuauuguaccucu

SEQ ID NO: 730418 - RNA, 14 nt, Human
uuauuauauuuaca

SEQ ID NO: 730419 - RNA, 23 nt, Human
acgaggauugggaaaaaguaauu

SEQ ID NO: 730420 - RNA, 21 nt, Human
cuggcugcgcucggccugcuc

SEQ ID NO: 730421 - RNA, 12 nt, Human
gacgagaaaaca

SEQ ID NO: 730422 - RNA, 13 nt, Human
cucagaaaacaag

SEQ ID NO: 730423 - RNA, 20 nt, Human
ccagugagacagcucugcau

SEQ ID NO: 730424 - RNA, 15 nt, Human
ugauuucauucaaua

SEQ ID NO: 730425 - RNA, 15 nt, Human
cacuaugguauuuga

SEQ ID NO: 730426 - RNA, 11 nt, Human
auaauuuaaau

SEQ ID NO: 730427 - RNA, 13 nt, Human
uuggacgagaaaa

SEQ ID NO: 730428 - RNA, 21 nt, Human
cccacuggacucaccuccccc

SEQ ID NO: 730429 - RNA, 20 nt, Human
auaaauggcuuccuggcaau

SEQ ID NO: 730430 - RNA, 22 nt, Human
aggcccccgggccgacggagcc

SEQ ID NO: 730431 - RNA, 16 nt, Human
cugcgcgccgcgcucc

SEQ ID NO: 730432 - RNA, 23 nt, Human
cuuaagaagacugcauuauauuu

SEQ ID NO: 730433 - RNA, 21 nt, Human
accagagccugaguguugccu

SEQ ID NO: 730434 - RNA, 15 nt, Human
cuacuaauuuuaaaa

SEQ ID NO: 730435 - RNA, 14 nt, Human
gagccgggaaagaa

SEQ ID NO: 730436 - RNA, 19 nt, Human
uguuggacgagaaaacaau

SEQ ID NO: 730437 - RNA, 18 nt, Human
ucucuaggaaauauuuau

SEQ ID NO: 730438 - RNA, 14 nt, Human
cugaggcuccacuu

SEQ ID NO: 730439 - RNA, 20 nt, Human
uauacugugugcuaaaacaa

SEQ ID NO: 730440 - RNA, 15 nt, Human
cacuuggucugugag

SEQ ID NO: 730441 - RNA, 20 nt, Human
cuggccuucggccuccaucc

SEQ ID NO: 730442 - RNA, 22 nt, Human
ucuacuaaaaauacaaaaaaaa

SEQ ID NO: 730443 - RNA, 16 nt, Human
aaaagcaucacaugaa

SEQ ID NO: 730444 - RNA, 17 nt, Human
uggcuaagcaaaaugug

SEQ ID NO: 730445 - RNA, 21 nt, Human
auuuuuucucuaggaaauauu

SEQ ID NO: 730446 - RNA, 15 nt, Human
gucaaugcagccccc

SEQ ID NO: 730447 - RNA, 16 nt, Human
aaugaaagcagggacu

SEQ ID NO: 730448 - RNA, 20 nt, Human
caaauguucaucaaugaaug

SEQ ID NO: 730449 - RNA, 16 nt, Human
ucgcuuccgcauccua

SEQ ID NO: 730450 - RNA, 21 nt, Human
augcuacaggauuugaaauug

SEQ ID NO: 730451 - RNA, 21 nt, Human
cccccucuccucucuuccucc

SEQ ID NO: 730452 - RNA, 21 nt, Human
accaccugccuauauuuuuug

SEQ ID NO: 730453 - RNA, 14 nt, Human
guaacugauuugua

SEQ ID NO: 730454 - RNA, 16 nt, Human
cacuaguauuucuaug

SEQ ID NO: 730455 - RNA, 15 nt, Human
aguucugaagaagau

SEQ ID NO: 730456 - RNA, 21 nt, Human
gccggcgcgcucaucccaccc

SEQ ID NO: 730457 - RNA, 15 nt, Human
agucucuaucauuaa

SEQ ID NO: 730458 - RNA, 18 nt, Human
ccaagccuggcaagggaa

SEQ ID NO: 730459 - RNA, 17 nt, Human
cugagaugggagaauca

SEQ ID NO: 730460 - RNA, 17 nt, Human
gacaaggaaaaaauaac

SEQ ID NO: 730461 - RNA, 15 nt, Human
uaucaauuuaaaaaa

SEQ ID NO: 730462 - RNA, 20 nt, Human
cagccugagcgacagugaga

SEQ ID NO: 730463 - RNA, 16 nt, Human
cacgggggccaaggau

SEQ ID NO: 730464 - RNA, 19 nt, Human
augaauuacauuuguauaa

SEQ ID NO: 730465 - RNA, 21 nt, Human
auaugcucuaaacauguuuau

SEQ ID NO: 730466 - RNA, 14 nt, Human
ucuugucucugggc

SEQ ID NO: 730467 - RNA, 22 nt, Human
ggccggcgcgcucaucccaccc

SEQ ID NO: 730468 - RNA, 12 nt, Human
agggauggggcu

SEQ ID NO: 730469 - RNA, 15 nt, Human
aaggguacacugccu

SEQ ID NO: 730470 - RNA, 16 nt, Human
gcugcugguggcgcug

SEQ ID NO: 730471 - RNA, 18 nt, Human
gcuccgcgcagcucaggc

SEQ ID NO: 730472 - RNA, 16 nt, Human
caaccuaaauuugguu

SEQ ID NO: 730473 - RNA, 14 nt, Human
uagaauauuuauua

SEQ ID NO: 730474 - RNA, 21 nt, Human
acaguuaccucugccucagaa

SEQ ID NO: 730475 - RNA, 19 nt, Human
ccugccuaagugcagcccc

SEQ ID NO: 730476 - RNA, 22 nt, Human
accaaucaugaauuaguuuuau

SEQ ID NO: 730477 - RNA, 17 nt, Human
ccgcgcagcucaggcug

SEQ ID NO: 730478 - RNA, 17 nt, Human
uaaaagacaaggaaaaa

SEQ ID NO: 730479 - RNA, 12 nt, Human
cggcccugugcg

SEQ ID NO: 730480 - RNA, 12 nt, Human
acacugaagaag

SEQ ID NO: 730481 - RNA, 23 nt, Human
cuucaacucccugccccccagcc

SEQ ID NO: 730482 - RNA, 13 nt, Human
cgcccucuggcug

SEQ ID NO: 730483 - RNA, 24 nt, Human
cauucuggaauaauccuaaacaua

SEQ ID NO: 730484 - RNA, 22 nt, Human
aggauggcuaguaucaaaagaa

SEQ ID NO: 730485 - RNA, 16 nt, Human
cuggccuucggccucc

SEQ ID NO: 730486 - RNA, 19 nt, Human
ucaauauuuauuauuuuca

SEQ ID NO: 730487 - RNA, 22 nt, Human
gggccugagaccaaggcccccg

SEQ ID NO: 730488 - RNA, 14 nt, Human
cagauccccaagcc

SEQ ID NO: 730489 - RNA, 14 nt, Human
ucucuaucauuaaa

SEQ ID NO: 730490 - RNA, 20 nt, Human
uccaagccucauguccacug

SEQ ID NO: 730491 - RNA, 16 nt, Human
aaaauccauacauuug

SEQ ID NO: 730492 - RNA, 17 nt, Human
ugaacuugguuuuaauu

SEQ ID NO: 730493 - RNA, 21 nt, Human
ccaaauauaaauaaaaauaau

SEQ ID NO: 730494 - RNA, 13 nt, Human
uuuagugaaauau

SEQ ID NO: 730495 - RNA, 14 nt, Human
aaagaggaaugaag

SEQ ID NO: 730496 - RNA, 21 nt, Human
ucacaugaacuuguaaaggaa

SEQ ID NO: 730497 - RNA, 23 nt, Human
ccuaaccucauuccccaaccacu

SEQ ID NO: 730498 - RNA, 19 nt, Human
aauuuuguuauguauauuu

SEQ ID NO: 730499 - RNA, 21 nt, Human
aauuuuuauauuugaaauauu

SEQ ID NO: 730500 - RNA, 17 nt, Human
cuuccuaauuccacagc

SEQ ID NO: 730501 - RNA, 14 nt, Human
gccgggcauggugg

SEQ ID NO: 730502 - RNA, 22 nt, Human
ggcuaagcuucacuguaaaaua

SEQ ID NO: 730503 - RNA, 21 nt, Human
ccuggugccucaccccuugcc

SEQ ID NO: 730504 - RNA, 17 nt, Human
uaucaguuauuuuuaaa

SEQ ID NO: 730505 - RNA, 12 nt, Human
auggguuuuauu

SEQ ID NO: 730506 - RNA, 15 nt, Human
auauuuauuaccucu

SEQ ID NO: 730507 - RNA, 13 nt, Human
gcgcucggccugc

SEQ ID NO: 730508 - RNA, 17 nt, Human
gcucggccugcucgccc

SEQ ID NO: 730509 - RNA, 23 nt, Human
uggaaauguuuacagauccccaa

SEQ ID NO: 730510 - RNA, 15 nt, Human
ccucccggccgcgcu

SEQ ID NO: 730511 - RNA, 16 nt, Human
cgcccacuuccucccg

SEQ ID NO: 730512 - RNA, 15 nt, Human
uaaaagacaaggaaa

SEQ ID NO: 730513 - RNA, 23 nt, Human
uacaaaugggaaacaaaaggaua

SEQ ID NO: 730514 - RNA, 12 nt, Human
cuccauuuuuag

SEQ ID NO: 730515 - RNA, 17 nt, Human
aauaaaguguuugaaag

SEQ ID NO: 730516 - RNA, 14 nt, Human
ugaggucaggaguu

SEQ ID NO: 730517 - RNA, 14 nt, Human
uauauauauauuuu

SEQ ID NO: 730518 - RNA, 16 nt, Human
uauaucaauuuaaaaa

SEQ ID NO: 730519 - RNA, 13 nt, Human
aguuguaauuuuu

SEQ ID NO: 730520 - RNA, 20 nt, Human
uuaaugccacuaaauugaca

SEQ ID NO: 730521 - RNA, 14 nt, Human
ugcuggagcucugc

SEQ ID NO: 730522 - RNA, 12 nt, Human
uucagccugaaa

SEQ ID NO: 730523 - RNA, 15 nt, Human
ucaaaggacaccauu

SEQ ID NO: 730524 - RNA, 18 nt, Human
uaaauugacacuuaaaaa

SEQ ID NO: 730525 - RNA, 22 nt, Human
uggcgcuggcugcgcucggccu

SEQ ID NO: 730526 - RNA, 17 nt, Human
cugugcggccuggucua

SEQ ID NO: 730527 - RNA, 14 nt, Human
agaauucauucacu

SEQ ID NO: 730528 - RNA, 15 nt, Human
uucacuguaaaauaa

SEQ ID NO: 730529 - RNA, 19 nt, Human
agaguuuagcuggaaaagu

SEQ ID NO: 730530 - RNA, 22 nt, Human
cuuuccacagaagcuccaggua

SEQ ID NO: 730531 - RNA, 18 nt, Human
acggcuccggacgcugcu

SEQ ID NO: 730532 - RNA, 14 nt, Human
aaagagaacuucca

SEQ ID NO: 730533 - RNA, 21 nt, Human
aagaagcccaauauuauaauu

SEQ ID NO: 730534 - RNA, 21 nt, Human
gcaggaccaucccggccggcg

SEQ ID NO: 730535 - RNA, 19 nt, Human
acuaucucauuuccaagca

SEQ ID NO: 730536 - RNA, 20 nt, Human
caccgcagggugaacugcag

SEQ ID NO: 730537 - RNA, 17 nt, Human
ucucuggccuucggccu

SEQ ID NO: 730538 - RNA, 19 nt, Human
uuuccugaaaacccuugcc

SEQ ID NO: 730539 - RNA, 19 nt, Human
cagauccccaagccuggca

SEQ ID NO: 730540 - RNA, 24 nt, Human
uuugugggaaauccacacugagcu

SEQ ID NO: 730541 - RNA, 15 nt, Human
uaucaguccaaaggg

SEQ ID NO: 730542 - RNA, 13 nt, Human
cgcgcccucuggc

SEQ ID NO: 730543 - RNA, 14 nt, Human
gaaaaaauaacaau

SEQ ID NO: 730544 - RNA, 13 nt, Human
cacuguaaaauaa

SEQ ID NO: 730545 - RNA, 14 nt, Human
guaacuaauuuuaa

SEQ ID NO: 730546 - RNA, 12 nt, Human
uacuaaaaauac

SEQ ID NO: 730547 - RNA, 22 nt, Human
caaaugggaaacaaaaggauaa

SEQ ID NO: 730548 - RNA, 16 nt, Human
ccuccuuuuaaaguaa

SEQ ID NO: 730549 - RNA, 17 nt, Human
uaugcuaagugaaauaa

SEQ ID NO: 730550 - RNA, 21 nt, Human
gaagugaaaaucuacacucca

SEQ ID NO: 730551 - RNA, 15 nt, Human
ccccugagcuugcag

SEQ ID NO: 730552 - RNA, 13 nt, Human
uuuucuuuucauu

SEQ ID NO: 730553 - RNA, 21 nt, Human
cuuucaugaaggggcggcggc

SEQ ID NO: 730554 - RNA, 12 nt, Human
cagaacagugau

SEQ ID NO: 730555 - RNA, 18 nt, Human
ccacuuggucugugagau

SEQ ID NO: 730556 - RNA, 19 nt, Human
agcugauaucaugccccug

SEQ ID NO: 730557 - RNA, 15 nt, Human
ccacaggaaccacaa

SEQ ID NO: 730558 - RNA, 19 nt, Human
agccuggucaacaugguga

SEQ ID NO: 730559 - RNA, 22 nt, Human
gcuugcagagaugaggccgcca

SEQ ID NO: 730560 - RNA, 16 nt, Human
cucuaggacauaaauu

SEQ ID NO: 730561 - RNA, 19 nt, Human
gguuuaauaauuuuuaauu

SEQ ID NO: 730562 - RNA, 13 nt, Human
uuccccuaaccuc

SEQ ID NO: 730563 - RNA, 23 nt, Human
caauaacgauaaaagacagugaa

SEQ ID NO: 730564 - RNA, 15 nt, Human
aauaacgauaaaaga

SEQ ID NO: 730565 - RNA, 16 nt, Human
cgcgcgcuccgcgcag

SEQ ID NO: 730566 - RNA, 21 nt, Human
cccccucuggcuccagcuggc

SEQ ID NO: 730567 - RNA, 15 nt, Human
gagcgcgcgcgcccu

SEQ ID NO: 730568 - RNA, 16 nt, Human
uaaauaaaaauaaucc

SEQ ID NO: 730569 - RNA, 17 nt, Human
cucguggaacaguuacc

SEQ ID NO: 730570 - RNA, 13 nt, Human
agaauuuauucaa

SEQ ID NO: 730571 - RNA, 23 nt, Human
gccccugcacuccagccugagcg

SEQ ID NO: 730572 - RNA, 16 nt, Human
aagcauuuagauguau

SEQ ID NO: 730573 - RNA, 16 nt, Human
auccuugaagauuuac

SEQ ID NO: 730574 - RNA, 17 nt, Human
accugagccccaaaagg

SEQ ID NO: 730575 - RNA, 15 nt, Human
auauaaauaaaaaua

SEQ ID NO: 730576 - RNA, 14 nt, Human
uggacucaccuccc

SEQ ID NO: 730577 - RNA, 15 nt, Human
aaagaaagaaaauca

SEQ ID NO: 730578 - RNA, 15 nt, Human
cacaggacagcccuu

SEQ ID NO: 730579 - RNA, 19 nt, Human
agagccggagccuccagcu

SEQ ID NO: 730580 - RNA, 18 nt, Human
uaaauguuguuuuaggaa

SEQ ID NO: 730581 - RNA, 21 nt, Human
aauuuacagagacagaaagca

SEQ ID NO: 730582 - RNA, 14 nt, Human
aaaagaaagaaaau

SEQ ID NO: 730583 - RNA, 18 nt, Human
uuuuauaucaauuuaaaa

SEQ ID NO: 730584 - RNA, 22 nt, Human
ggacagcccuucuuuccacaga

SEQ ID NO: 730585 - RNA, 20 nt, Human
agagacacacugaagaagca

SEQ ID NO: 730586 - RNA, 20 nt, Human
uguaauaggcguaacuaauu

SEQ ID NO: 730587 - RNA, 19 nt, Human
cuuggggccuaugcagagg

SEQ ID NO: 730588 - RNA, 19 nt, Human
cucauggaauuggagcucg

SEQ ID NO: 730589 - RNA, 19 nt, Human
uccauccugaggcuccacu

SEQ ID NO: 730590 - RNA, 15 nt, Human
caaggaaaaaauaac

SEQ ID NO: 730591 - RNA, 20 nt, Human
uuauuaccucugauaccuca

SEQ ID NO: 730592 - RNA, 11 nt, Human
ucaccugcccu

SEQ ID NO: 730593 - RNA, 19 nt, Human
agugaggagcuuugaaacg

SEQ ID NO: 730594 - RNA, 21 nt, Human
uauacugugugcuaaaacaag

SEQ ID NO: 730595 - RNA, 19 nt, Human
gcagggugaacugcagcga

SEQ ID NO: 730596 - RNA, 16 nt, Human
augccccgucccccuc

SEQ ID NO: 730597 - RNA, 15 nt, Human
ccugccccccagccc

SEQ ID NO: 730598 - RNA, 17 nt, Human
ugaaauaagccagacau

SEQ ID NO: 730599 - RNA, 21 nt, Human
uguaaaauggugugaccacug

SEQ ID NO: 730600 - RNA, 14 nt, Human
gcaaagcccagcuu

SEQ ID NO: 730601 - RNA, 16 nt, Human
gcagcucaggcuggca

SEQ ID NO: 730602 - RNA, 19 nt, Human
uuauauauauauauuuuuu

SEQ ID NO: 730603 - RNA, 17 nt, Human
auaaaguacaagagcuu

SEQ ID NO: 730604 - RNA, 22 nt, Human
auuuuaauuuugaauaaauaaa

SEQ ID NO: 730605 - RNA, 20 nt, Human
uuguaccucucuuauagaau

SEQ ID NO: 730606 - RNA, 11 nt, Human
aauaaauaaau

SEQ ID NO: 730607 - RNA, 22 nt, Human
cccccugcaaagcccagcuuga

SEQ ID NO: 730608 - RNA, 15 nt, Human
ucauaauaaguugca

SEQ ID NO: 730609 - RNA, 12 nt, Human
aauuuuaaaaug

SEQ ID NO: 730610 - RNA, 15 nt, Human
aagugaaaaucuaca

SEQ ID NO: 730611 - RNA, 19 nt, Human
gugaacuugguuuuaauua

SEQ ID NO: 730612 - RNA, 16 nt, Human
ggcgggagggcgcggg

SEQ ID NO: 730613 - RNA, 23 nt, Human
cauuguggucacaggaaguagag

SEQ ID NO: 730614 - RNA, 19 nt, Human
uauauuuuugugauuuugu

SEQ ID NO: 730615 - RNA, 20 nt, Human
ugguuguauuauuuuuuaaa

SEQ ID NO: 730616 - RNA, 16 nt, Human
aaaguguuugaaagcu

SEQ ID NO: 730617 - RNA, 16 nt, Human
agugagacagcucugc

SEQ ID NO: 730618 - RNA, 15 nt, Human
guuuuauuauauaua

SEQ ID NO: 730619 - RNA, 14 nt, Human
auauuuauuuuaau

SEQ ID NO: 730620 - RNA, 20 nt, Human
cugcucgcccacuuccuccc

SEQ ID NO: 730621 - RNA, 18 nt, Human
cucuggccuucggccucc

SEQ ID NO: 730622 - RNA, 12 nt, Human
cagauuuuccug

SEQ ID NO: 730623 - RNA, 19 nt, Human
cauggaauuggagcucgug

SEQ ID NO: 730624 - RNA, 20 nt, Human
ugauuucugagcauuuaaua

SEQ ID NO: 730625 - RNA, 16 nt, Human
cugagcuugcagagau

SEQ ID NO: 730626 - RNA, 18 nt, Human
cucuacuaaaaauacaaa

SEQ ID NO: 730627 - RNA, 15 nt, Human
accuguaaucccagc

SEQ ID NO: 730628 - RNA, 18 nt, Human
agccgggaaagaagagcc

SEQ ID NO: 730629 - RNA, 22 nt, Human
gcagagagguagggauggggcu

SEQ ID NO: 730630 - RNA, 22 nt, Human
gaagugaaaaucuacacuccag

SEQ ID NO: 730631 - RNA, 16 nt, Human
acaaauccaaugaaau

SEQ ID NO: 730632 - RNA, 18 nt, Human
ccuguuuuuaagcuguuu

SEQ ID NO: 730633 - RNA, 13 nt, Human
ugugcggccuggu

SEQ ID NO: 730634 - RNA, 23 nt, Human
cucuacuaaaaauacaaaaaaaa

SEQ ID NO: 730635 - RNA, 14 nt, Human
gauaaaagacagug

SEQ ID NO: 730636 - RNA, 13 nt, Human
ugcauuucuaaag

SEQ ID NO: 730637 - RNA, 16 nt, Human
auaucaauuuaaaaaa

SEQ ID NO: 730638 - RNA, 17 nt, Human
gccccccagcccuccuu

SEQ ID NO: 730639 - RNA, 20 nt, Human
aaacuuuaugcuaagugaaa

SEQ ID NO: 730640 - RNA, 23 nt, Human
gggccuaugcagagguccacaac

SEQ ID NO: 730641 - RNA, 14 nt, Human
cuaagucuuauaua

SEQ ID NO: 730642 - RNA, 21 nt, Human
ggggagccaacagaagcuucc

SEQ ID NO: 730643 - RNA, 16 nt, Human
gaccaaggcccccggg

SEQ ID NO: 730644 - RNA, 13 nt, Human
gggaggggcgcuc

SEQ ID NO: 730645 - RNA, 16 nt, Human
aaauauaaauaaaaau

SEQ ID NO: 730646 - RNA, 22 nt, Human
ccucuaauuuaucuugucucug

SEQ ID NO: 730647 - RNA, 23 nt, Human
caccucauggaauuggagcucgu

SEQ ID NO: 730648 - RNA, 17 nt, Human
cucagucucccucccuu

SEQ ID NO: 730649 - RNA, 19 nt, Human
agucaaauugugugaaagg

SEQ ID NO: 730650 - RNA, 22 nt, Human
gacucugucucaaaaaauaaaa

SEQ ID NO: 730651 - RNA, 20 nt, Human
cggcccugugcggccugguc

SEQ ID NO: 730652 - RNA, 18 nt, Human
acauuuauauuuuuguga

SEQ ID NO: 730653 - RNA, 13 nt, Human
ucuuauaauuuaa

SEQ ID NO: 730654 - RNA, 21 nt, Human
ugcccauccugccccugagcc

SEQ ID NO: 730655 - RNA, 17 nt, Human
cgauaaaagacagugaa

SEQ ID NO: 730656 - RNA, 12 nt, Human
cauaaaguaugu

SEQ ID NO: 730657 - RNA, 23 nt, Human
ccgcagggugaacugcagcgagu

SEQ ID NO: 730658 - RNA, 17 nt, Human
caauaacgauaaaagac

SEQ ID NO: 730659 - RNA, 13 nt, Human
aacaagccuccuu

SEQ ID NO: 730660 - RNA, 16 nt, Human
uaaugaauacuuuaua

SEQ ID NO: 730661 - RNA, 17 nt, Human
cgcucaucccacccgcc

SEQ ID NO: 730662 - RNA, 16 nt, Human
auuauaauuuuuuuca

SEQ ID NO: 730663 - RNA, 16 nt, Human
cgcuuccgcauccuag

SEQ ID NO: 730664 - RNA, 14 nt, Human
cuguaaucacagcu

SEQ ID NO: 730665 - RNA, 15 nt, Human
uuaauuuguaguguu

SEQ ID NO: 730666 - RNA, 17 nt, Human
acucaccucccccaucu

SEQ ID NO: 730667 - RNA, 18 nt, Human
uucaauaucuuuuuuuua

SEQ ID NO: 730668 - RNA, 14 nt, Human
cugacccagccccu

SEQ ID NO: 730669 - RNA, 15 nt, Human
aagccuggcaaggga

SEQ ID NO: 730670 - RNA, 15 nt, Human
auauugacuuuuuau

SEQ ID NO: 730671 - RNA, 15 nt, Human
cagugaaagaaaaua

SEQ ID NO: 730672 - RNA, 14 nt, Human
uuauaaguuacaua

SEQ ID NO: 730673 - RNA, 13 nt, Human
uucuauaauuuaa

SEQ ID NO: 730674 - RNA, 16 nt, Human
gaaaaaauaacaauga

SEQ ID NO: 730675 - RNA, 16 nt, Human
cgcuguuccucgccac

SEQ ID NO: 730676 - RNA, 17 nt, Human
caaauccaaugaaauga

SEQ ID NO: 730677 - RNA, 14 nt, Human
ucuauaauuuaaau

SEQ ID NO: 730678 - RNA, 23 nt, Human
aucucuucuggguuccuuccucu

SEQ ID NO: 730679 - RNA, 17 nt, Human
augauuaaguaaugaua

SEQ ID NO: 730680 - RNA, 17 nt, Human
uuagccgggcauggugg

SEQ ID NO: 730681 - RNA, 18 nt, Human
acauuugcucauggaauu

SEQ ID NO: 730682 - RNA, 15 nt, Human
uuacagagacagaaa

SEQ ID NO: 730683 - RNA, 20 nt, Human
cucgcccacuuccucccggc

SEQ ID NO: 730684 - RNA, 19 nt, Human
uaucacuugucaauaaaau

SEQ ID NO: 730685 - RNA, 16 nt, Human
cuuuaugcuaagugaa

SEQ ID NO: 730686 - RNA, 14 nt, Human
uugugauugauuau

SEQ ID NO: 730687 - RNA, 24 nt, Human
ccccugagcuugcagagaugaggc

SEQ ID NO: 730688 - RNA, 22 nt, Human
agacucgggauuaguacacacu

SEQ ID NO: 730689 - RNA, 22 nt, Human
cugaggcuccacuuggucugug

SEQ ID NO: 730690 - RNA, 20 nt, Human
guuauuuauaacaaccuaaa

SEQ ID NO: 730691 - RNA, 11 nt, Human
gcauccuaguc

SEQ ID NO: 730692 - RNA, 15 nt, Human
auccugccccugagc

SEQ ID NO: 730693 - RNA, 12 nt, Human
cauagaaguaaa

SEQ ID NO: 730694 - RNA, 14 nt, Human
uauaauuuaaauau

SEQ ID NO: 730695 - RNA, 19 nt, Human
ggagggcgcggggcgggga

SEQ ID NO: 730696 - RNA, 21 nt, Human
ccccugcaaagcccagcuuga

SEQ ID NO: 730697 - RNA, 12 nt, Human
aagaaaauaaca

SEQ ID NO: 730698 - RNA, 20 nt, Human
cugguggcgcuggcugcgcu

SEQ ID NO: 730699 - RNA, 11 nt, Human
ggggaggggcg

SEQ ID NO: 730700 - RNA, 17 nt, Human
agcucugcccauccugc

SEQ ID NO: 730701 - RNA, 16 nt, Human
aacagaagcuuccauu

SEQ ID NO: 730702 - RNA, 13 nt, Human
guggcgcuggcug

SEQ ID NO: 730703 - RNA, 23 nt, Human
gggaaacaaaaggauaaugaaua

SEQ ID NO: 730704 - RNA, 15 nt, Human
uagggugauauuaac

SEQ ID NO: 730705 - RNA, 21 nt, Human
aaguuuaugguuguauuauuu

SEQ ID NO: 730706 - RNA, 21 nt, Human
gccugagaccaaggcccccgg

SEQ ID NO: 730707 - RNA, 19 nt, Human
ggagccugaucaccugccc

SEQ ID NO: 730708 - RNA, 18 nt, Human
accauuuuugaaaccaaa

SEQ ID NO: 730709 - RNA, 14 nt, Human
uggcuugaguuuaa

SEQ ID NO: 730710 - RNA, 15 nt, Human
uacaggauuugaaau

SEQ ID NO: 730711 - RNA, 22 nt, Human
caaggaugccccgucccccucu

SEQ ID NO: 730712 - RNA, 20 nt, Human
cugcacacagcacgggggcc

SEQ ID NO: 730713 - RNA, 20 nt, Human
ccauacuaauuauacccccu

SEQ ID NO: 730714 - RNA, 18 nt, Human
aucuuauaauuuaaaaua

SEQ ID NO: 730715 - RNA, 12 nt, Human
ucaauauuuauu

SEQ ID NO: 730716 - RNA, 19 nt, Human
cuuccuaauuccacagcug

SEQ ID NO: 730717 - RNA, 17 nt, Human
ugguucccuugaugaag

SEQ ID NO: 730718 - RNA, 19 nt, Human
aagguccuggcaaagauga

SEQ ID NO: 730719 - RNA, 19 nt, Human
ugaucaguaugaaaauguc

SEQ ID NO: 730720 - RNA, 12 nt, Human
ccccuugccaua

SEQ ID NO: 730721 - RNA, 21 nt, Human
uuuauauaagcuuguauuccu

SEQ ID NO: 730722 - RNA, 22 nt, Human
auagaauauuuauuaccucuga

SEQ ID NO: 730723 - RNA, 21 nt, Human
cuaagcuucacuguaaaauaa

SEQ ID NO: 730724 - RNA, 21 nt, Human
cuccagcuggccgggagccug

SEQ ID NO: 730725 - RNA, 23 nt, Human
augguauuugaguguuuuaagau

SEQ ID NO: 730726 - RNA, 13 nt, Human
ccuccuuuuaaag

SEQ ID NO: 730727 - RNA, 15 nt, Human
uucacauuuaaauaa

SEQ ID NO: 730728 - RNA, 20 nt, Human
agccuuuuuuugaaaaaaag

SEQ ID NO: 730729 - RNA, 14 nt, Human
agucugacuguuuc

SEQ ID NO: 730730 - RNA, 11 nt, Human
uuuuuuuaaaa

SEQ ID NO: 730731 - RNA, 13 nt, Human
uauuucuaugaaa

SEQ ID NO: 730732 - RNA, 19 nt, Human
cugcgcgccgcgcuccucg

SEQ ID NO: 730733 - RNA, 20 nt, Human
cuuauucacaagacccaaaa

SEQ ID NO: 730734 - RNA, 15 nt, Human
gccgacggagccggg

SEQ ID NO: 730735 - RNA, 20 nt, Human
uacaucccuuaccugggaaa

SEQ ID NO: 730736 - RNA, 19 nt, Human
aaaaucuuauaauuuaaaa

SEQ ID NO: 730737 - RNA, 21 nt, Human
uaaaagacagugaaagaaaau

SEQ ID NO: 730738 - RNA, 22 nt, Human
aaauaacaaugaaaguugauaa

SEQ ID NO: 730739 - RNA, 22 nt, Human
uguauacugugugcuaaaacaa

SEQ ID NO: 730740 - RNA, 16 nt, Human
cugagccucagucucc

SEQ ID NO: 730741 - RNA, 17 nt, Human
gcgcccucuggcugcug

SEQ ID NO: 730742 - RNA, 19 nt, Human
cagcuacuugggaggcuga

SEQ ID NO: 730743 - RNA, 23 nt, Human
auuucugagcauuuaauauggau

SEQ ID NO: 730744 - RNA, 19 nt, Human
ucaacauggugaaaccccg

SEQ ID NO: 730745 - RNA, 10 nt, Human
auguuuucag

SEQ ID NO: 730746 - RNA, 22 nt, Human
uauuccuuuuucucuccucucc

SEQ ID NO: 730747 - RNA, 23 nt, Human
gaaugagagacacacugaagaag

SEQ ID NO: 730748 - RNA, 15 nt, Human
cgggagccugaucac

SEQ ID NO: 730749 - RNA, 14 nt, Human
gagcucagcccugg

SEQ ID NO: 730750 - RNA, 13 nt, Human
uuuauuauauaua

SEQ ID NO: 730751 - RNA, 20 nt, Human
agaagaacugaaaucauacu

SEQ ID NO: 730752 - RNA, 14 nt, Human
ucaaugcagccccc

SEQ ID NO: 730753 - RNA, 19 nt, Human
auauauuuuuuuuuuuaaa

SEQ ID NO: 730754 - RNA, 20 nt, Human
accuacacgagauacagaau

SEQ ID NO: 730755 - RNA, 19 nt, Human
uguaaagguccuggcaaag

SEQ ID NO: 730756 - RNA, 23 nt, Human
uagauguauagguugaugguggu

SEQ ID NO: 730757 - RNA, 20 nt, Human
ccgcagggugaacugcagcg

SEQ ID NO: 730758 - RNA, 16 nt, Human
ccugagaccaaggccc

SEQ ID NO: 730759 - RNA, 17 nt, Human
aagcuuuuuuugaauca

SEQ ID NO: 730760 - RNA, 18 nt, Human
ggcgcuggcugcgcucgg

SEQ ID NO: 730761 - RNA, 18 nt, Human
aguucuccacuagcuaug

SEQ ID NO: 730762 - RNA, 18 nt, Human
acuuuaugcuaagugaaa

SEQ ID NO: 730763 - RNA, 13 nt, Human
uaagugcagcccc

SEQ ID NO: 730764 - RNA, 23 nt, Human
ugaaaugaguuuuucuuuucauu

SEQ ID NO: 730765 - RNA, 14 nt, Human
uugcagugagcuga

SEQ ID NO: 730766 - RNA, 21 nt, Human
gccuuuucccaacuccagaaa

SEQ ID NO: 730767 - RNA, 15 nt, Human
agacagcucugcaua

SEQ ID NO: 730768 - RNA, 20 nt, Human
uauuuauuacuguaagaaaa

SEQ ID NO: 730769 - RNA, 21 nt, Human
cccuauccuacuuccccuucc

SEQ ID NO: 730770 - RNA, 23 nt, Human
uccagguagaggguguguaagua

SEQ ID NO: 730771 - RNA, 18 nt, Human
ggauagcugacccagccc

SEQ ID NO: 730772 - RNA, 18 nt, Human
ucacgccuguaaucccag

SEQ ID NO: 730773 - RNA, 11 nt, Human
auuuaaaaauc

SEQ ID NO: 730774 - RNA, 21 nt, Human
cagagguccacaacacacaga

SEQ ID NO: 730775 - RNA, 23 nt, Human
gauauuaaccaggggccaugaau

SEQ ID NO: 730776 - RNA, 17 nt, Human
uuucacauuuaaauaaa

SEQ ID NO: 730777 - RNA, 15 nt, Human
guggcgcgcaccugu

SEQ ID NO: 730778 - RNA, 15 nt, Human
accucccccaucucu

SEQ ID NO: 730779 - RNA, 22 nt, Human
agaagagccggagccuccagcu

SEQ ID NO: 730780 - RNA, 13 nt, Human
aauaaaaauaaaa

SEQ ID NO: 730781 - RNA, 20 nt, Human
acaagacacagugaccauac

SEQ ID NO: 730782 - RNA, 20 nt, Human
aaaaaccugagccccaaaag

SEQ ID NO: 730783 - RNA, 16 nt, Human
aauuuuuaauuauaug

SEQ ID NO: 730784 - RNA, 22 nt, Human
gcgcggcgggagggcgcggggc

SEQ ID NO: 730785 - RNA, 16 nt, Human
cggagccuccagcugc

SEQ ID NO: 730786 - RNA, 12 nt, Human
gaagaccucauu

SEQ ID NO: 730787 - RNA, 21 nt, Human
cucuucuggguuccuuccucu

SEQ ID NO: 730788 - RNA, 19 nt, Human
uauuauaauuuuuuucaau

SEQ ID NO: 730789 - RNA, 23 nt, Human
uaacgauaaaagacagugaaaga

SEQ ID NO: 730790 - RNA, 19 nt, Human
ucaguuauuauauuuacaa

SEQ ID NO: 730791 - RNA, 20 nt, Human
caggaguuccuaaccagccu

SEQ ID NO: 730792 - RNA, 13 nt, Human
gcuguugagcugu

SEQ ID NO: 730793 - RNA, 15 nt, Human
uccuacaagacacag

SEQ ID NO: 730794 - RNA, 20 nt, Human
gcagagaugaggccgccaug

SEQ ID NO: 730795 - RNA, 23 nt, Human
uguaaucccagcuacuugggagg

SEQ ID NO: 730796 - RNA, 22 nt, Human
acauccuacaagacacagugac

SEQ ID NO: 730797 - RNA, 14 nt, Human
aaccagagccugag

SEQ ID NO: 730798 - RNA, 19 nt, Human
gcugcugguggcgcuggcu

SEQ ID NO: 730799 - RNA, 18 nt, Human
agauccccaagccuggca

SEQ ID NO: 730800 - RNA, 15 nt, Human
aagccagauuuuccu

SEQ ID NO: 730801 - RNA, 20 nt, Human
agaagagccggagccuccag

SEQ ID NO: 730802 - RNA, 22 nt, Human
cuagucucuaucauuaaaguuc

SEQ ID NO: 730803 - RNA, 15 nt, Human
acaaggaaaaaauaa

SEQ ID NO: 730804 - RNA, 17 nt, Human
caagaaaugaaagcagg

SEQ ID NO: 730805 - RNA, 23 nt, Human
uccaacuaucucauuuccaagca

SEQ ID NO: 730806 - RNA, 18 nt, Human
gagccucagucucccucc

SEQ ID NO: 730807 - RNA, 14 nt, Human
aaaauacaaaaaaa

SEQ ID NO: 730808 - RNA, 22 nt, Human
gugugaccacugcagaagacag

SEQ ID NO: 730809 - RNA, 18 nt, Human
auauuauaauuuuuuuca

SEQ ID NO: 730810 - RNA, 19 nt, Human
gcucauggaauuggagcuc

SEQ ID NO: 730811 - RNA, 17 nt, Human
guuuuaggaauacauaa

SEQ ID NO: 730812 - RNA, 18 nt, Human
cugaccucccucuaauuu

SEQ ID NO: 730813 - RNA, 22 nt, Human
agaaagugacaagcucacagac

SEQ ID NO: 730814 - RNA, 15 nt, Human
gaaagaaaauaacga

SEQ ID NO: 730815 - RNA, 14 nt, Human
aggcugaggcaaga

SEQ ID NO: 730816 - RNA, 14 nt, Human
agcgcgcgcgcccu

SEQ ID NO: 730817 - RNA, 16 nt, Human
aaaaugugauauguac

SEQ ID NO: 730818 - RNA, 16 nt, Human
uuccgcauccuagucu

SEQ ID NO: 730819 - RNA, 15 nt, Human
ccuggugggcagaga

SEQ ID NO: 730820 - RNA, 20 nt, Human
gcuugcagagaugaggccgc

SEQ ID NO: 730821 - RNA, 19 nt, Human
ggacucaccucccccaucu

SEQ ID NO: 730822 - RNA, 18 nt, Human
auagucaaauugugugaa

SEQ ID NO: 730823 - RNA, 14 nt, Human
augggccauaugaa

SEQ ID NO: 730824 - RNA, 22 nt, Human
ugaguuuuucuuuucauuuacc

SEQ ID NO: 730825 - RNA, 17 nt, Human
ccagggcuacgcgcgcu

SEQ ID NO: 730826 - RNA, 21 nt, Human
uacauaaaguaugugcauauu

SEQ ID NO: 730827 - RNA, 22 nt, Human
acaugagguacugagagugaac

SEQ ID NO: 730828 - RNA, 14 nt, Human
caaaugcauuucua

SEQ ID NO: 730829 - RNA, 23 nt, Human
ucggccuccauccugaggcucca

SEQ ID NO: 730830 - RNA, 17 nt, Human
aaaaauccuacuuucau

SEQ ID NO: 730831 - RNA, 16 nt, Human
ggagccuccagcugcc

SEQ ID NO: 730832 - RNA, 22 nt, Human
auuacuguaagaaaauaucacu

SEQ ID NO: 730833 - RNA, 23 nt, Human
uguagguagaucuggucuuuaga

SEQ ID NO: 730834 - RNA, 20 nt, Human
ccugccuaagugcagccccg

SEQ ID NO: 730835 - RNA, 19 nt, Human
aacuagaauuuauucaauu

SEQ ID NO: 730836 - RNA, 13 nt, Human
gggcggcggcccu

SEQ ID NO: 730837 - RNA, 23 nt, Human
acaaauacucuuaggaagagaaa

SEQ ID NO: 730838 - RNA, 23 nt, Human
augaauuaaguuuuuuuuuaaaa

SEQ ID NO: 730839 - RNA, 22 nt, Human
cuuguaaaggaauuuaaaaauc

SEQ ID NO: 730840 - RNA, 22 nt, Human
aaacauguuuaucguauuugau

SEQ ID NO: 730841 - RNA, 14 nt, Human
aaucucaauauuuc

SEQ ID NO: 730842 - RNA, 11 nt, Human
acugggacagg

SEQ ID NO: 730843 - RNA, 15 nt, Human
gucccaggcugagcc

SEQ ID NO: 730844 - RNA, 15 nt, Human
ugccccccagcccuc

SEQ ID NO: 730845 - RNA, 18 nt, Human
acaagccuccuuuuaaag

SEQ ID NO: 730846 - RNA, 16 nt, Human
gcuucacuguaaaaua

SEQ ID NO: 730847 - RNA, 23 nt, Human
guuguaauuuuuuugugggaaau

SEQ ID NO: 730848 - RNA, 17 nt, Human
uaacugauuuguaacaa

SEQ ID NO: 730849 - RNA, 13 nt, Human
ugggaggcugaga

SEQ ID NO: 730850 - RNA, 13 nt, Human
ccauuccaagccu

SEQ ID NO: 730851 - RNA, 21 nt, Human
ucuuaggguuaugauuaagua

SEQ ID NO: 730852 - RNA, 12 nt, Human
gaaucuuguaaa

SEQ ID NO: 730853 - RNA, 12 nt, Human
cuggcuccagcu

SEQ ID NO: 730854 - RNA, 19 nt, Human
uauauuuuuuguuaaauga

SEQ ID NO: 730855 - RNA, 12 nt, Human
uguuugaaagcu

SEQ ID NO: 730856 - RNA, 15 nt, Human
uuaauucugaaagca

SEQ ID NO: 730857 - RNA, 23 nt, Human
aauaauccucaguuuuugugaaa

SEQ ID NO: 730858 - RNA, 10 nt, Human
uuuuuaaaaa

SEQ ID NO: 730859 - RNA, 13 nt, Human
ugccuaauuuguu

SEQ ID NO: 730860 - RNA, 17 nt, Human
auuuucuauaauuuaaa

SEQ ID NO: 730861 - RNA, 17 nt, Human
auaauuuaaauauaugc

SEQ ID NO: 730862 - RNA, 16 nt, Human
ccucaaaacuucagac

SEQ ID NO: 730863 - RNA, 16 nt, Human
auuuuuagugaaauau

SEQ ID NO: 730864 - RNA, 18 nt, Human
agcaaaauuuuuucucua

SEQ ID NO: 730865 - RNA, 16 nt, Human
aauaaaguguuugaaa

SEQ ID NO: 730866 - RNA, 22 nt, Human
ugaaaccccgucucuacuaaaa

SEQ ID NO: 730867 - RNA, 16 nt, Human
uacaaaugggaaacaa

SEQ ID NO: 730868 - RNA, 17 nt, Human
ccaaggaugccccgucc

SEQ ID NO: 730869 - RNA, 16 nt, Human
uccuagucucuaucau

SEQ ID NO: 730870 - RNA, 20 nt, Human
ggagauggaaguugcaguga

SEQ ID NO: 730871 - RNA, 15 nt, Human
uagauaggccauggg

SEQ ID NO: 730872 - RNA, 15 nt, Human
caggaaguagaggag

SEQ ID NO: 730873 - RNA, 17 nt, Human
augaauaucaguuauuu

SEQ ID NO: 730874 - RNA, 14 nt, Human
gcugauuaaaccaa

SEQ ID NO: 730875 - RNA, 23 nt, Human
cacagauuugagcucagcccugg

SEQ ID NO: 730876 - RNA, 14 nt, Human
cugagucccaggcu

SEQ ID NO: 730877 - RNA, 19 nt, Human
accauuuuggcaagcucua

SEQ ID NO: 730878 - RNA, 14 nt, Human
cgcgcccucuggcu

SEQ ID NO: 730879 - RNA, 21 nt, Human
uccauccugaggcuccacuug

SEQ ID NO: 730880 - RNA, 13 nt, Human
aagcuguggccag

SEQ ID NO: 730881 - RNA, 15 nt, Human
auuugguaaggggaa

SEQ ID NO: 730882 - RNA, 14 nt, Human
cugcugguggcgcu

SEQ ID NO: 730883 - RNA, 23 nt, Human
gcuuuggucuaucuuugagcgcc

SEQ ID NO: 730884 - RNA, 20 nt, Human
gccgggcgugguggugagug

SEQ ID NO: 730885 - RNA, 16 nt, Human
cauuuguauaaaauaa

SEQ ID NO: 730886 - RNA, 14 nt, Human
cgagccccaggcgg

SEQ ID NO: 730887 - RNA, 13 nt, Human
acaagaaaugaaa

SEQ ID NO: 730888 - RNA, 17 nt, Human
aggguguguaaguagau

SEQ ID NO: 730889 - RNA, 23 nt, Human
aacuuguaaaggaauuuaaaaau

SEQ ID NO: 730890 - RNA, 22 nt, Human
uauuucuaugaaauauuauguu

SEQ ID NO: 730891 - RNA, 21 nt, Human
ggcgcuggcugcgcucggccu

SEQ ID NO: 730892 - RNA, 13 nt, Human
cuucucaacucca

SEQ ID NO: 730893 - RNA, 15 nt, Human
uuuaugguuguauua

SEQ ID NO: 730894 - RNA, 14 nt, Human
caguucugaagaag

SEQ ID NO: 730895 - RNA, 16 nt, Human
ccuaugcagaggucca

SEQ ID NO: 730896 - RNA, 16 nt, Human
ccccaucucuucuggg

SEQ ID NO: 730897 - RNA, 12 nt, Human
ucccccucuggc

SEQ ID NO: 730898 - RNA, 13 nt, Human
ugaaagaaaauaa

SEQ ID NO: 730899 - RNA, 22 nt, Human
gagucccaggcugagccucagu

SEQ ID NO: 730900 - RNA, 19 nt, Human
uauuuuaauaauguuucaa

SEQ ID NO: 730901 - RNA, 15 nt, Human
uuuuaggaauacaua

SEQ ID NO: 730902 - RNA, 12 nt, Human
uccaaagggcau

SEQ ID NO: 730903 - RNA, 13 nt, Human
cucaccuccccca

SEQ ID NO: 730904 - RNA, 13 nt, Human
ucaucccacccgc

SEQ ID NO: 730905 - RNA, 23 nt, Human
ggccugcucgcccacuuccuccc

SEQ ID NO: 730906 - RNA, 22 nt, Human
guguccccuauccuacuucccc

SEQ ID NO: 730907 - RNA, 22 nt, Human
uucauucacucaacaaacauaa

SEQ ID NO: 730908 - RNA, 14 nt, Human
ccucuccucucuuc

SEQ ID NO: 730909 - RNA, 19 nt, Human
cuacuaaaaauacaaaaau

SEQ ID NO: 730910 - RNA, 22 nt, Human
auucugagguaaccucauuauc

SEQ ID NO: 730911 - RNA, 15 nt, Human
gcagcucaggcuggc

SEQ ID NO: 730912 - RNA, 21 nt, Human
agcccuucuuuccacagaagc

SEQ ID NO: 730913 - RNA, 17 nt, Human
aguugauaaguacauga

SEQ ID NO: 730914 - RNA, 23 nt, Human
auucugagguaaccucauuauca

SEQ ID NO: 730915 - RNA, 23 nt, Human
uuuuauagcuacuaauuuuaaaa

SEQ ID NO: 730916 - RNA, 12 nt, Human
aauacuuuauaa

SEQ ID NO: 730917 - RNA, 14 nt, Human
aauuguauuacaaa

SEQ ID NO: 730918 - RNA, 21 nt, Human
auauauuuuuuuuuuuaaaaa

SEQ ID NO: 730919 - RNA, 17 nt, Human
ucuauaauguguucauu

SEQ ID NO: 730920 - RNA, 15 nt, Human
ggagccuccagcugc

SEQ ID NO: 730921 - RNA, 22 nt, Human
auaucuuuuuuuuaauaaacca

SEQ ID NO: 730922 - RNA, 22 nt, Human
cccagcccuccuuaucaaagga

SEQ ID NO: 730923 - RNA, 14 nt, Human
cuucucuucacagu

SEQ ID NO: 730924 - RNA, 14 nt, Human
cucagucucccucc

SEQ ID NO: 730925 - RNA, 20 nt, Human
agcuucacuguaaaauaaua

SEQ ID NO: 730926 - RNA, 20 nt, Human
aagacagugaaagaaaauaa

SEQ ID NO: 730927 - RNA, 17 nt, Human
ucauacuucuuaggguu

SEQ ID NO: 730928 - RNA, 13 nt, Human
aagacaaggaaaa

SEQ ID NO: 730929 - RNA, 21 nt, Human
uucccgcuguuccucgccacg

SEQ ID NO: 730930 - RNA, 23 nt, Human
guauuugaguguuuuaagauaaa

SEQ ID NO: 730931 - RNA, 12 nt, Human
gcuguugagcug

SEQ ID NO: 730932 - RNA, 13 nt, Human
agaauauuuauua

SEQ ID NO: 730933 - RNA, 17 nt, Human
uuccaagugauugaaac

SEQ ID NO: 730934 - RNA, 18 nt, Human
cugcugguggcgcuggcu

SEQ ID NO: 730935 - RNA, 21 nt, Human
aagaagagccggagccuccag

SEQ ID NO: 730936 - RNA, 19 nt, Human
aaacaauaacgauaaaaga

SEQ ID NO: 730937 - RNA, 22 nt, Human
cucagcccuggugggcagagag

SEQ ID NO: 730938 - RNA, 16 nt, Human
aaaauaacaauaaaag

SEQ ID NO: 730939 - RNA, 21 nt, Human
ugaacaaauuuacagagacag

SEQ ID NO: 730940 - RNA, 16 nt, Human
gacaaggaaaaaauaa

SEQ ID NO: 730941 - RNA, 21 nt, Human
gacagucaccucauggaauug

SEQ ID NO: 730942 - RNA, 21 nt, Human
uaauuuugaauaaauaaaugu

SEQ ID NO: 730943 - RNA, 15 nt, Human
gagccggagccucca

SEQ ID NO: 730944 - RNA, 15 nt, Human
cagcgaguacuuccc

SEQ ID NO: 730945 - RNA, 18 nt, Human
gcgcuggcugcgcucggc

SEQ ID NO: 730946 - RNA, 20 nt, Human
aaaagacagugaaagaaaau

SEQ ID NO: 730947 - RNA, 22 nt, Human
cacagauuugagcucagcccug

SEQ ID NO: 730948 - RNA, 20 nt, Human
cuaaaugucaaucagccuag

SEQ ID NO: 730949 - RNA, 13 nt, Human
gagccuccagcug

SEQ ID NO: 730950 - RNA, 19 nt, Human
gccugaucaccugcccugc

SEQ ID NO: 730951 - RNA, 15 nt, Human
uaacgauaaaagaca

SEQ ID NO: 730952 - RNA, 21 nt, Human
gcaaaauuuuuucucuaggaa

SEQ ID NO: 730953 - RNA, 18 nt, Human
uggucaauuuuguuaugu

SEQ ID NO: 730954 - RNA, 15 nt, Human
cuaguaauuggaaag

SEQ ID NO: 730955 - RNA, 17 nt, Human
aaauccuacuuucauaa

SEQ ID NO: 730956 - RNA, 19 nt, Human
ccaccugccuauauuuuuu

SEQ ID NO: 730957 - RNA, 14 nt, Human
uuuguauaaaauaa

SEQ ID NO: 730958 - RNA, 22 nt, Human
agucuuucacauuuaaauaaag

SEQ ID NO: 730959 - RNA, 18 nt, Human
uuauuacuguaagaaaau

SEQ ID NO: 730960 - RNA, 12 nt, Human
auagaauauuua

SEQ ID NO: 730961 - RNA, 13 nt, Human
caccaaggagcca

SEQ ID NO: 730962 - RNA, 15 nt, Human
agugacaagcucaca

SEQ ID NO: 730963 - RNA, 12 nt, Human
acugaaaucaua

SEQ ID NO: 730964 - RNA, 16 nt, Human
guucugcacacagcac

SEQ ID NO: 730965 - RNA, 15 nt, Human
guugcagugagcuga

SEQ ID NO: 730966 - RNA, 15 nt, Human
ucaguuuuugugaaa

SEQ ID NO: 730967 - RNA, 17 nt, Human
auaaaguaugugcauau

SEQ ID NO: 730968 - RNA, 13 nt, Human
agagcaagacucu

SEQ ID NO: 730969 - RNA, 20 nt, Human
uaugaaaaggcuaagcuuca

SEQ ID NO: 730970 - RNA, 15 nt, Human
cuggacucaccuccc

SEQ ID NO: 730971 - RNA, 17 nt, Human
ccugccccccagcccuc

SEQ ID NO: 730972 - RNA, 22 nt, Human
uuuauggcacuaguauuucuau

SEQ ID NO: 730973 - RNA, 19 nt, Human
acggagccgggaaagaaga

SEQ ID NO: 730974 - RNA, 14 nt, Human
ucccacccgcccac

SEQ ID NO: 730975 - RNA, 15 nt, Human
cucuacuaaaaauac

SEQ ID NO: 730976 - RNA, 13 nt, Human
uauauauuuuuuu

SEQ ID NO: 730977 - RNA, 17 nt, Human
gacgagaaaacaauaac

SEQ ID NO: 730978 - RNA, 19 nt, Human
cuguacgcgagcgcgcgcg

SEQ ID NO: 730979 - RNA, 13 nt, Human
aacucccugcccc

SEQ ID NO: 730980 - RNA, 20 nt, Human
cuugccauaauuacuauguc

SEQ ID NO: 730981 - RNA, 13 nt, Human
uuuaagauaaauu

SEQ ID NO: 730982 - RNA, 19 nt, Human
gcccacuuccucccggccg

SEQ ID NO: 730983 - RNA, 18 nt, Human
cccaggcugagccucagu

SEQ ID NO: 730984 - RNA, 18 nt, Human
caugaagauguagaggag

SEQ ID NO: 730985 - RNA, 16 nt, Human
caggcugagccucagu

SEQ ID NO: 730986 - RNA, 15 nt, Human
aauauaaauaaaaau

SEQ ID NO: 730987 - RNA, 15 nt, Human
uauaaauaaaaauaa

SEQ ID NO: 730988 - RNA, 18 nt, Human
cagagacagaaagcagaa

SEQ ID NO: 730989 - RNA, 23 nt, Human
agccuugggaccccugagcuugc

SEQ ID NO: 730990 - RNA, 19 nt, Human
aagugugacucauuaaaug

SEQ ID NO: 730991 - RNA, 22 nt, Human
accccugagcuugcagagauga

SEQ ID NO: 730992 - RNA, 13 nt, Human
agcgacagugaga

SEQ ID NO: 730993 - RNA, 19 nt, Human
auguuuacagauccccaag

SEQ ID NO: 730994 - RNA, 13 nt, Human
cccggccgcgcug

SEQ ID NO: 730995 - RNA, 15 nt, Human
aauugacccacaaga

SEQ ID NO: 730996 - RNA, 17 nt, Human
aacaguuaccucugccu

SEQ ID NO: 730997 - RNA, 14 nt, Human
gacggagccgggaa

SEQ ID NO: 730998 - RNA, 16 nt, Human
cagauccccaagccug

SEQ ID NO: 730999 - RNA, 16 nt, Human
accucugccucagaaa

SEQ ID NO: 731000 - RNA, 21 nt, Human
cgcccacuuccucccggccgc

SEQ ID NO: 731001 - RNA, 22 nt, Human
uaaaacaagcacuaaacaaaga

SEQ ID NO: 731002 - RNA, 20 nt, Human
uuccuaaccagccuggucaa

SEQ ID NO: 731003 - RNA, 16 nt, Human
uuguaaaggaauuuaa

SEQ ID NO: 731004 - RNA, 17 nt, Human
cauuuguauaaaauaau

SEQ ID NO: 731005 - RNA, 21 nt, Human
caaagcccagcuugaaaccuu

SEQ ID NO: 731006 - RNA, 16 nt, Human
ugcauagguuuaauaa

SEQ ID NO: 731007 - RNA, 17 nt, Human
cuuugggaggcugaggc

SEQ ID NO: 731008 - RNA, 21 nt, Human
aauucauucacucaacaaaca

SEQ ID NO: 731009 - RNA, 20 nt, Human
gaacguaaucguguccccua

SEQ ID NO: 731010 - RNA, 18 nt, Human
cccacuagacccacugga

SEQ ID NO: 731011 - RNA, 17 nt, Human
uccagcuggccgggagc

SEQ ID NO: 731012 - RNA, 23 nt, Human
agggcgcggggcggggagcgagc

SEQ ID NO: 731013 - RNA, 13 nt, Human
aaaauaacaauga

SEQ ID NO: 731014 - RNA, 12 nt, Human
auucugaaagca

SEQ ID NO: 731015 - RNA, 16 nt, Human
cugagcgacagugaga

SEQ ID NO: 731016 - RNA, 13 nt, Human
agaaguaaaaaca

SEQ ID NO: 731017 - RNA, 13 nt, Human
aaacauccuacaa

SEQ ID NO: 731018 - RNA, 19 nt, Human
agccugaucaccugcccug

SEQ ID NO: 731019 - RNA, 19 nt, Human
cucugccucagaaaacaag

SEQ ID NO: 731020 - RNA, 20 nt, Human
gaauucauucacucaacaaa

SEQ ID NO: 731021 - RNA, 18 nt, Human
cucucuuauagaauauuu

SEQ ID NO: 731022 - RNA, 16 nt, Human
agcaagacucugucuc

SEQ ID NO: 731023 - RNA, 14 nt, Human
ggggcggggagcga

SEQ ID NO: 731024 - RNA, 22 nt, Human
agcccuccuuaucaaaggacac

SEQ ID NO: 731025 - RNA, 18 nt, Human
auuuauuacuguaagaaa

SEQ ID NO: 731026 - RNA, 20 nt, Human
cucggacggcuccggacgcu

SEQ ID NO: 731027 - RNA, 17 nt, Human
gucaaagcugaaaugga

SEQ ID NO: 731028 - RNA, 16 nt, Human
ucugcagauaaacagu

SEQ ID NO: 731029 - RNA, 18 nt, Human
gccuggucaacaugguga

SEQ ID NO: 731030 - RNA, 16 nt, Human
aauuacauuuguauaa

SEQ ID NO: 731031 - RNA, 22 nt, Human
cgcccacuuccucccggccgcg

SEQ ID NO: 731032 - RNA, 20 nt, Human
uaauaaguugcauagguuua

SEQ ID NO: 731033 - RNA, 21 nt, Human
gcacuguggguagacacacau

SEQ ID NO: 731034 - RNA, 20 nt, Human
aauuuugugaagcaaaauuu

SEQ ID NO: 731035 - RNA, 16 nt, Human
aaagacaaggaaaaaa

SEQ ID NO: 731036 - RNA, 18 nt, Human
acauuguuugucugucuu

SEQ ID NO: 731037 - RNA, 18 nt, Human
uauuuucaguuauuauau

SEQ ID NO: 731038 - RNA, 11 nt, Human
uucacagggga

SEQ ID NO: 731039 - RNA, 19 nt, Human
uaguuuaugauuccaccua

SEQ ID NO: 731040 - RNA, 13 nt, Human
uguauauuuuaua

SEQ ID NO: 731041 - RNA, 16 nt, Human
uaaaggaauuuaaaaa

SEQ ID NO: 731042 - RNA, 22 nt, Human
aauaugccccauucaacaucua

SEQ ID NO: 731043 - RNA, 21 nt, Human
ccuagucucuaucauuaaagu

SEQ ID NO: 731044 - RNA, 21 nt, Human
uuuucaggcuagauguaugua

SEQ ID NO: 731045 - RNA, 20 nt, Human
ccuccugccuaagugcagcc

SEQ ID NO: 731046 - RNA, 17 nt, Human
ccugcucgcccacuucc

SEQ ID NO: 731047 - RNA, 22 nt, Human
uaauaggcguaacuaauuuuaa

SEQ ID NO: 731048 - RNA, 20 nt, Human
cucccugccccccagcccuc

SEQ ID NO: 731049 - RNA, 23 nt, Human
guaauuccguagguuauuuucag

SEQ ID NO: 731050 - RNA, 14 nt, Human
agauguagaggaga

SEQ ID NO: 731051 - RNA, 20 nt, Human
guaucaaaagaaagaaaauc

SEQ ID NO: 731052 - RNA, 14 nt, Human
guacuccagccugg

SEQ ID NO: 731053 - RNA, 22 nt, Human
aaagggcauggguuuuauuaua

SEQ ID NO: 731054 - RNA, 18 nt, Human
ccuuccuaauuccacagc

SEQ ID NO: 731055 - RNA, 13 nt, Human
aggggcgcucgcu

SEQ ID NO: 731056 - RNA, 18 nt, Human
aauaucaguuauuuuuaa

SEQ ID NO: 731057 - RNA, 20 nt, Human
ccauuguggucacaggaagu

SEQ ID NO: 731058 - RNA, 18 nt, Human
uucauagcagauuuuaau

SEQ ID NO: 731059 - RNA, 20 nt, Human
uuaaauggucaauuuuguua

SEQ ID NO: 731060 - RNA, 16 nt, Human
uucucuaggaaauauu

SEQ ID NO: 731061 - RNA, 12 nt, Human
aaaagaaagaaa

SEQ ID NO: 731062 - RNA, 14 nt, Human
acuaauuuuaaaau

SEQ ID NO: 731063 - RNA, 14 nt, Human
cuuucauaauaagu

SEQ ID NO: 731064 - RNA, 23 nt, Human
ggacggcuccggacgcugcugcc

SEQ ID NO: 731065 - RNA, 14 nt, Human
uuuucaauauuuau

SEQ ID NO: 731066 - RNA, 21 nt, Human
uguuuuaagauaaauuauaag

SEQ ID NO: 731067 - RNA, 18 nt, Human
aauuuuuuucaauauuua

SEQ ID NO: 731068 - RNA, 21 nt, Human
cucaguccaugaagauguaga

SEQ ID NO: 731069 - RNA, 24 nt, Human
cauaugaaaaggcuaagcuucacu

SEQ ID NO: 731070 - RNA, 18 nt, Human
gagccaacagaagcuucc

SEQ ID NO: 731071 - RNA, 15 nt, Human
auaaaguguuugaaa

SEQ ID NO: 731072 - RNA, 14 nt, Human
cgcgcugcgcgccg

SEQ ID NO: 731073 - RNA, 20 nt, Human
cagugaaagaaaauaacgau

SEQ ID NO: 731074 - RNA, 19 nt, Human
ugagcgcccacuagaccca

SEQ ID NO: 731075 - RNA, 21 nt, Human
gaaaaaaagcuuuuuuugaau

SEQ ID NO: 731076 - RNA, 17 nt, Human
uccauccugaggcucca

SEQ ID NO: 731077 - RNA, 18 nt, Human
auucuugccaaauauaaa

SEQ ID NO: 731078 - RNA, 20 nt, Human
augcuucuguuuuauaauuu

SEQ ID NO: 731079 - RNA, 15 nt, Human
cucgugggacaguca

SEQ ID NO: 731080 - RNA, 22 nt, Human
aaaucaggguuaguauugucca

SEQ ID NO: 731081 - RNA, 22 nt, Human
cuggggcucugggauagcugac

SEQ ID NO: 731082 - RNA, 12 nt, Human
ucugcacacagc

SEQ ID NO: 731083 - RNA, 21 nt, Human
auaauuuuuauauuugaaaua

SEQ ID NO: 731084 - RNA, 19 nt, Human
auuauuuuuuaaaaaaauu

SEQ ID NO: 731085 - RNA, 15 nt, Human
aaaaaauaacaauga

SEQ ID NO: 731086 - RNA, 15 nt, Human
ugcaauuccacuuau

SEQ ID NO: 731087 - RNA, 13 nt, Human
aaaaaugguuuaa

SEQ ID NO: 731088 - RNA, 19 nt, Human
gcuguacgcgagcgcgcgc

SEQ ID NO: 731089 - RNA, 15 nt, Human
gacucaccuccccca

SEQ ID NO: 731090 - RNA, 19 nt, Human
ggaaaaaauaacaaugaaa

SEQ ID NO: 731091 - RNA, 23 nt, Human
ccagcuacuugggaggcugaggc

SEQ ID NO: 731092 - RNA, 16 nt, Human
cagaagcaacccaaau

SEQ ID NO: 731093 - RNA, 14 nt, Human
accacaagacugca

SEQ ID NO: 731094 - RNA, 19 nt, Human
cuucuuacaaugcauucug

SEQ ID NO: 731095 - RNA, 14 nt, Human
ucagucucccuccc

SEQ ID NO: 731096 - RNA, 23 nt, Human
cacaagaaaugaaagcagggacu

SEQ ID NO: 731097 - RNA, 18 nt, Human
ugccuaauuuguuuuccc

SEQ ID NO: 731098 - RNA, 13 nt, Human
auauuuuauuaua

SEQ ID NO: 731099 - RNA, 17 nt, Human
gcgccuccgcuacuucc

SEQ ID NO: 731100 - RNA, 19 nt, Human
cccugccccccagcccucc

SEQ ID NO: 731101 - RNA, 19 nt, Human
auaucaguuauuuuuaaac

SEQ ID NO: 731102 - RNA, 21 nt, Human
auacauaaaguaugugcauau

SEQ ID NO: 731103 - RNA, 22 nt, Human
gaugguucccuugaugaagaag

SEQ ID NO: 731104 - RNA, 16 nt, Human
cccccagcccuccuua

SEQ ID NO: 731105 - RNA, 15 nt, Human
cucaacaaacauaau

SEQ ID NO: 731106 - RNA, 18 nt, Human
cuggaaacuucagcgguu

SEQ ID NO: 731107 - RNA, 18 nt, Human
cagcuuauugucuaguga

SEQ ID NO: 731108 - RNA, 16 nt, Human
cuguucgcgcgccucc

SEQ ID NO: 731109 - RNA, 16 nt, Human
uauuuuugugauuuug

SEQ ID NO: 731110 - RNA, 16 nt, Human
ugaauuaguuuuauau

SEQ ID NO: 731111 - RNA, 13 nt, Human
cggccgcgcugcg

SEQ ID NO: 731112 - RNA, 12 nt, Human
gguauuuuaauc

SEQ ID NO: 731113 - RNA, 19 nt, Human
auucuuuacccccugggag

SEQ ID NO: 731114 - RNA, 15 nt, Human
aaaaauaacaaugaa

SEQ ID NO: 731115 - RNA, 12 nt, Human
ucaccccuugcc

SEQ ID NO: 731116 - RNA, 18 nt, Human
gccuuggggcugaugcag

SEQ ID NO: 731117 - RNA, 17 nt, Human
gccgggaaagaagagcc

SEQ ID NO: 731118 - RNA, 19 nt, Human
ccccucuggcuccagcugg

SEQ ID NO: 731119 - RNA, 20 nt, Human
accucauggaauuggagcuc

SEQ ID NO: 731120 - RNA, 16 nt, Human
uaagauaaauuauaag

SEQ ID NO: 731121 - RNA, 20 nt, Human
gcccauccugccccugagcc

SEQ ID NO: 731122 - RNA, 18 nt, Human
auuaaguuuuuuuuuaaa

SEQ ID NO: 731123 - RNA, 14 nt, Human
cucccucuaauuua

SEQ ID NO: 731124 - RNA, 18 nt, Human
guuuaugguuguauuauu

SEQ ID NO: 731125 - RNA, 19 nt, Human
gcuccgcgcagcucaggcu

SEQ ID NO: 731126 - RNA, 15 nt, Human
uccgcuacuuccagg

SEQ ID NO: 731127 - RNA, 14 nt, Human
gucccaggcugagc

SEQ ID NO: 731128 - RNA, 14 nt, Human
cggccggcgcgcuc

SEQ ID NO: 731129 - RNA, 12 nt, Human
cccccagcccuc

SEQ ID NO: 731130 - RNA, 22 nt, Human
auauauauuuuuuuuuuuaaaa

SEQ ID NO: 731131 - RNA, 18 nt, Human
uuauuauauauauauauu

SEQ ID NO: 731132 - RNA, 15 nt, Human
guucugcagauaaac

SEQ ID NO: 731133 - RNA, 11 nt, Human
gggaaagaaga

SEQ ID NO: 731134 - RNA, 20 nt, Human
auuuucaguuauuauauuua

SEQ ID NO: 731135 - RNA, 22 nt, Human
uaaaauaauuuuuauauuugaa

SEQ ID NO: 731136 - RNA, 15 nt, Human
ccagauccuggaaau

SEQ ID NO: 731137 - RNA, 14 nt, Human
aagcaacccaaaug

SEQ ID NO: 731138 - RNA, 20 nt, Human
gaaaauaacgauaaaagaca

SEQ ID NO: 731139 - RNA, 17 nt, Human
ccacuggacucaccucc

SEQ ID NO: 731140 - RNA, 21 nt, Human
gagccggagccuccagcugcc

SEQ ID NO: 731141 - RNA, 14 nt, Human
ugagacucugucuc

SEQ ID NO: 731142 - RNA, 14 nt, Human
cggagccuccagcu

SEQ ID NO: 731143 - RNA, 20 nt, Human
aauaagccagacaucaacag

SEQ ID NO: 731144 - RNA, 16 nt, Human
uacauuuguauaaaau

SEQ ID NO: 731145 - RNA, 14 nt, Human
uugaauaaauaaau

SEQ ID NO: 731146 - RNA, 18 nt, Human
gagcgacagugagacucu

SEQ ID NO: 731147 - RNA, 15 nt, Human
ugucaauaaaaucca

SEQ ID NO: 731148 - RNA, 12 nt, Human
aagagcuuaaca

SEQ ID NO: 731149 - RNA, 20 nt, Human
caaacauccuacaagacaca

SEQ ID NO: 731150 - RNA, 19 nt, Human
gucaaauugugugaaaggu

SEQ ID NO: 731151 - RNA, 23 nt, Human
gccugaguguugccuaauuuguu

SEQ ID NO: 731152 - RNA, 14 nt, Human
agaaaauaacaaua

SEQ ID NO: 731153 - RNA, 15 nt, Human
uggggcuuccuaacu

SEQ ID NO: 731154 - RNA, 15 nt, Human
uaacaauaaaagaca

SEQ ID NO: 731155 - RNA, 13 nt, Human
gaaccuaggguga

SEQ ID NO: 731156 - RNA, 22 nt, Human
caagcacuaaacaaagagugaa

SEQ ID NO: 731157 - RNA, 11 nt, Human
caacucccugc

SEQ ID NO: 731158 - RNA, 19 nt, Human
agagccuuuuuuugaaaaa

SEQ ID NO: 731159 - RNA, 15 nt, Human
gagccuccagcugcc

SEQ ID NO: 731160 - RNA, 22 nt, Human
uguucugauauuggacaguaaa

SEQ ID NO: 731161 - RNA, 18 nt, Human
ccuguucgcgcgccuccg

SEQ ID NO: 731162 - RNA, 21 nt, Human
caauuuuguuauguauauuuu

SEQ ID NO: 731163 - RNA, 14 nt, Human
uaguuucccuugca

SEQ ID NO: 731164 - RNA, 15 nt, Human
gcaacccaaauguuc

SEQ ID NO: 731165 - RNA, 16 nt, Human
uguucuaagaagugaa

SEQ ID NO: 731166 - RNA, 18 nt, Human
aaagagugaaggauuuau

SEQ ID NO: 731167 - RNA, 14 nt, Human
auuaauucaccuuc

SEQ ID NO: 731168 - RNA, 17 nt, Human
agcuucacuguaaaaua

SEQ ID NO: 731169 - RNA, 13 nt, Human
aguuaccucugcc

SEQ ID NO: 731170 - RNA, 14 nt, Human
auauuugaaauauu

SEQ ID NO: 731171 - RNA, 15 nt, Human
ucagucucccucccu

SEQ ID NO: 731172 - RNA, 21 nt, Human
uacuucccgcuguuccucgcc

SEQ ID NO: 731173 - RNA, 13 nt, Human
uuuaaaaauccua

SEQ ID NO: 731174 - RNA, 22 nt, Human
aagacccaaaaggcagaagcaa

SEQ ID NO: 731175 - RNA, 18 nt, Human
ccgcuacuuccagggcua

SEQ ID NO: 731176 - RNA, 12 nt, Human
cuccagcugccc

SEQ ID NO: 731177 - RNA, 22 nt, Human
cagaagcuuccauuccaagccu

SEQ ID NO: 731178 - RNA, 19 nt, Human
uuccucccuucucuucaca

SEQ ID NO: 731179 - RNA, 20 nt, Human
aaucuuucacaggggacagg

SEQ ID NO: 731180 - RNA, 16 nt, Human
augaauacuuuauaaa

SEQ ID NO: 731181 - RNA, 21 nt, Human
gccacgcucugggucgccggc

SEQ ID NO: 731182 - RNA, 17 nt, Human
agaaaugaaagcaggga

SEQ ID NO: 731183 - RNA, 19 nt, Human
auuugguucuaggccgggc

SEQ ID NO: 731184 - RNA, 18 nt, Human
uacuuuauuuucuauaau

SEQ ID NO: 731185 - RNA, 21 nt, Human
auuccuuuuucucuccucucc

SEQ ID NO: 731186 - RNA, 14 nt, Human
auuucuaugaaaua

SEQ ID NO: 731187 - RNA, 14 nt, Human
uaagcuguuuccau

SEQ ID NO: 731188 - RNA, 20 nt, Human
uaaaagacaaggaaaaaaua

SEQ ID NO: 731189 - RNA, 14 nt, Human
ggaguuccuaacca

SEQ ID NO: 731190 - RNA, 14 nt, Human
uucagccugaaaga

SEQ ID NO: 731191 - RNA, 15 nt, Human
acagaagcuuccauu

SEQ ID NO: 731192 - RNA, 12 nt, Human
cucauggaauug

SEQ ID NO: 731193 - RNA, 21 nt, Human
caucccacccgcccaccgcag

SEQ ID NO: 731194 - RNA, 14 nt, Human
gcgcgcuccgcgca

SEQ ID NO: 731195 - RNA, 18 nt, Human
uaguaucaaaagaaagaa

SEQ ID NO: 731196 - RNA, 22 nt, Human
agccaaacauccuacaagacac

SEQ ID NO: 731197 - RNA, 15 nt, Human
uugacacuuaaaaau

SEQ ID NO: 731198 - RNA, 16 nt, Human
uuuucucuaggaaaua

SEQ ID NO: 731199 - RNA, 20 nt, Human
agcucaggcuggcaccgcug

SEQ ID NO: 731200 - RNA, 23 nt, Human
auaucuuuuuuuuaauaaaccau

SEQ ID NO: 731201 - RNA, 19 nt, Human
uggaaguaaauguuguuuu

SEQ ID NO: 731202 - RNA, 18 nt, Human
cccucuggcuccagcugg

SEQ ID NO: 731203 - RNA, 23 nt, Human
auaauguguucauucuggaauaa

SEQ ID NO: 731204 - RNA, 14 nt, Human
cugggucgccggca

SEQ ID NO: 731205 - RNA, 14 nt, Human
gcgagcgcgcgcgc

SEQ ID NO: 731206 - RNA, 16 nt, Human
gcauccuagucucuau

SEQ ID NO: 731207 - RNA, 21 nt, Human
aguuguugcccacagcuguau

SEQ ID NO: 731208 - RNA, 12 nt, Human
auaacuggaaac

SEQ ID NO: 731209 - RNA, 19 nt, Human
uauacugugugcuaaaaca

SEQ ID NO: 731210 - RNA, 17 nt, Human
cucgugggacagucacc

SEQ ID NO: 731211 - RNA, 13 nt, Human
ucucaaaaaauaa

SEQ ID NO: 731212 - RNA, 15 nt, Human
acauaagggaggaaa

SEQ ID NO: 731213 - RNA, 17 nt, Human
ccaaaaaucucaauauu

SEQ ID NO: 731214 - RNA, 20 nt, Human
ggagccugaucaccugcccu

SEQ ID NO: 731215 - RNA, 14 nt, Human
auauuuauuauuuu

SEQ ID NO: 731216 - RNA, 21 nt, Human
ccugaucaccugcccugcuga

SEQ ID NO: 731217 - RNA, 17 nt, Human
uccacaacacacagauu

SEQ ID NO: 731218 - RNA, 18 nt, Human
ggaggacgcucucuggcc

SEQ ID NO: 731219 - RNA, 21 nt, Human
uccuacaagacacagugacca

SEQ ID NO: 731220 - RNA, 17 nt, Human
auaagggaggaaaaaaa

SEQ ID NO: 731221 - RNA, 22 nt, Human
auauaaauaaaaauaauccuca

SEQ ID NO: 731222 - RNA, 19 nt, Human
auucccagccagcacagcc

SEQ ID NO: 731223 - RNA, 15 nt, Human
ugcuguauuuuaaaa

SEQ ID NO: 731224 - RNA, 22 nt, Human
gauaaaagacagugaaagaaaa

SEQ ID NO: 731225 - RNA, 18 nt, Human
augguauuugaguguuuu

SEQ ID NO: 731226 - RNA, 19 nt, Human
ccgggcgugguggugagug

SEQ ID NO: 731227 - RNA, 17 nt, Human
ccuauccuacuuccccu

SEQ ID NO: 731228 - RNA, 17 nt, Human
uccucugagccuuggga

SEQ ID NO: 731229 - RNA, 19 nt, Human
cuucccgcuguuccucgcc

SEQ ID NO: 731230 - RNA, 16 nt, Human
cugagcauuuaauaug

SEQ ID NO: 731231 - RNA, 23 nt, Human
agcccuccuuaucaaaggacacc

SEQ ID NO: 731232 - RNA, 11 nt, Human
gcgcuggcugc

SEQ ID NO: 731233 - RNA, 20 nt, Human
gggagccccaauucgauccc

SEQ ID NO: 731234 - RNA, 15 nt, Human
gugggccugagacca

SEQ ID NO: 731235 - RNA, 20 nt, Human
gauugugccccugcacucca

SEQ ID NO: 731236 - RNA, 15 nt, Human
ccuguucgcgcgccu

SEQ ID NO: 731237 - RNA, 17 nt, Human
aggcuagaaccaccugc

SEQ ID NO: 731238 - RNA, 18 nt, Human
aaauauaaauaaaaauaa

SEQ ID NO: 731239 - RNA, 15 nt, Human
gcaagcucuaucacc

SEQ ID NO: 731240 - RNA, 13 nt, Human
cucgccacgcucu

SEQ ID NO: 731241 - RNA, 18 nt, Human
uggagggaagccuugggg

SEQ ID NO: 731242 - RNA, 16 nt, Human
aaauauuauguuaaaa

SEQ ID NO: 731243 - RNA, 17 nt, Human
cuaccuguucgcgcgcc

SEQ ID NO: 731244 - RNA, 15 nt, Human
augaauuaaguuuuu

SEQ ID NO: 731245 - RNA, 17 nt, Human
cgcgcugcgcgccgcgc

SEQ ID NO: 731246 - RNA, 18 nt, Human
agccugaucaccugcccu

SEQ ID NO: 731247 - RNA, 23 nt, Human
aucacagcuacuugggaggcuga

SEQ ID NO: 731248 - RNA, 18 nt, Human
cugagggcauagaaguaa

SEQ ID NO: 731249 - RNA, 21 nt, Human
uuccuaauuccacagcugcuc

SEQ ID NO: 731250 - RNA, 16 nt, Human
ccacuuccucccggcc

SEQ ID NO: 731251 - RNA, 18 nt, Human
agagaaugagagacacac

SEQ ID NO: 731252 - RNA, 20 nt, Human
aagucuuucacauuuaaaua

SEQ ID NO: 731253 - RNA, 21 nt, Human
cauuucuugagguaaaagcau

SEQ ID NO: 731254 - RNA, 18 nt, Human
cagauuugagcucagccc

SEQ ID NO: 731255 - RNA, 22 nt, Human
aaugggcacaggguuuauguuu

SEQ ID NO: 731256 - RNA, 18 nt, Human
aacuagaauuuauucaau

SEQ ID NO: 731257 - RNA, 14 nt, Human
cccugccccccagc

SEQ ID NO: 731258 - RNA, 18 nt, Human
aaaaguucugcagauaaa

SEQ ID NO: 731259 - RNA, 16 nt, Human
cagcuuuccucaaaac

SEQ ID NO: 731260 - RNA, 16 nt, Human
ugaaguccaagcauuu

SEQ ID NO: 731261 - RNA, 16 nt, Human
cccacuggacucaccu

SEQ ID NO: 731262 - RNA, 17 nt, Human
ggcuccggacgcugcug

SEQ ID NO: 731263 - RNA, 14 nt, Human
aauaguuuaugauu

SEQ ID NO: 731264 - RNA, 15 nt, Human
gccuaauuuguuuuc

SEQ ID NO: 731265 - RNA, 18 nt, Human
cagaaagcagaacaguga

SEQ ID NO: 731266 - RNA, 13 nt, Human
cccaaaaggcaga

SEQ ID NO: 731267 - RNA, 13 nt, Human
uucaccuguuuuu

SEQ ID NO: 731268 - RNA, 22 nt, Human
cggagccuccagcugccccggg

SEQ ID NO: 731269 - RNA, 17 nt, Human
cugguggcgcuggcugc

SEQ ID NO: 731270 - RNA, 23 nt, Human
cuugauaaauggcuuccuggcaa

SEQ ID NO: 731271 - RNA, 15 nt, Human
agaauaccacaggaa

SEQ ID NO: 731272 - RNA, 20 nt, Human
agccuuggggcugaugcagu

SEQ ID NO: 731273 - RNA, 15 nt, Human
cuuuucccaacucca

SEQ ID NO: 731274 - RNA, 16 nt, Human
cauggugaaaccccgu

SEQ ID NO: 731275 - RNA, 19 nt, Human
ccauccugccccugagccc

SEQ ID NO: 731276 - RNA, 22 nt, Human
aucucuucuggguuccuuccuc

SEQ ID NO: 731277 - RNA, 15 nt, Human
ccgugggccugagac

SEQ ID NO: 731278 - RNA, 16 nt, Human
cagucucccucccuug

SEQ ID NO: 731279 - RNA, 23 nt, Human
uuguaaagguccuggcaaagaug

SEQ ID NO: 731280 - RNA, 23 nt, Human
acuaguuguaauuuuuuuguggg

SEQ ID NO: 731281 - RNA, 18 nt, Human
agugucaaugcagccccc

SEQ ID NO: 731282 - RNA, 17 nt, Human
aaagaaacauuugguaa

SEQ ID NO: 731283 - RNA, 16 nt, Human
ugcuguauuuuaaaag

SEQ ID NO: 731284 - RNA, 23 nt, Human
ucaauaucuuuuuuuuaauaaac

SEQ ID NO: 731285 - RNA, 13 nt, Human
uuuuaaaaaagaa

SEQ ID NO: 731286 - RNA, 16 nt, Human
aagaaaauaacaauaa

SEQ ID NO: 731287 - RNA, 13 nt, Human
aaaaauacaaaaa

SEQ ID NO: 731288 - RNA, 16 nt, Human
cuucacuguaaaauaa

SEQ ID NO: 731289 - RNA, 16 nt, Human
augcuaagugaaauaa

SEQ ID NO: 731290 - RNA, 13 nt, Human
uuaugcuaaguga

SEQ ID NO: 731291 - RNA, 23 nt, Human
acguaaucguguccccuauccua

SEQ ID NO: 731292 - RNA, 14 nt, Human
ugagaaaccuuauu

SEQ ID NO: 731293 - RNA, 19 nt, Human
guccaggucuaccaaaaau

SEQ ID NO: 731294 - RNA, 13 nt, Human
ugagcgacaguga

SEQ ID NO: 731295 - RNA, 19 nt, Human
cagauucuuuacccccugg

SEQ ID NO: 731296 - RNA, 13 nt, Human
gcucucuggccuu

SEQ ID NO: 731297 - RNA, 16 nt, Human
accuguucgcgcgccu

SEQ ID NO: 731298 - RNA, 17 nt, Human
ucucaaaaaauaaaaau

SEQ ID NO: 731299 - RNA, 14 nt, Human
acagaauuuuaugc

SEQ ID NO: 731300 - RNA, 16 nt, Human
ucuuauaauuuaaaau

SEQ ID NO: 731301 - RNA, 17 nt, Human
cccaggcugagccucag

SEQ ID NO: 731302 - RNA, 20 nt, Human
agagccggagccuccagcug

SEQ ID NO: 731303 - RNA, 15 nt, Human
ucaauuccucuggga

SEQ ID NO: 731304 - RNA, 12 nt, Human
aucguguccccu

SEQ ID NO: 731305 - RNA, 23 nt, Human
ugucaauucuugccaaauauaaa

SEQ ID NO: 731306 - RNA, 18 nt, Human
cccugaccucccucuaau

SEQ ID NO: 731307 - RNA, 23 nt, Human
uuguaacaagccuccuuuuaaag

SEQ ID NO: 731308 - RNA, 20 nt, Human
aaggaugccccgucccccuc

SEQ ID NO: 731309 - RNA, 23 nt, Human
ccacuucauucuugaaagcugug

SEQ ID NO: 731310 - RNA, 22 nt, Human
accauuucuugagguaaaagca

SEQ ID NO: 731311 - RNA, 14 nt, Human
aacucaguuuuaac

SEQ ID NO: 731312 - RNA, 17 nt, Human
cuacacuccagugagac

SEQ ID NO: 731313 - RNA, 14 nt, Human
acgcgcgcuccgcg

SEQ ID NO: 731314 - RNA, 16 nt, Human
aaaugggaaacaaaag

SEQ ID NO: 731315 - RNA, 17 nt, Human
gccugagcgacagugag

SEQ ID NO: 731316 - RNA, 19 nt, Human
cuaccuguucgcgcgccuc

SEQ ID NO: 731317 - RNA, 13 nt, Human
aaaaaauaaaaau

SEQ ID NO: 731318 - RNA, 15 nt, Human
uuauagcuacuaauu

SEQ ID NO: 731319 - RNA, 16 nt, Human
cugcucucaguucacu

SEQ ID NO: 731320 - RNA, 17 nt, Human
ccccaguuguuucuacu

SEQ ID NO: 731321 - RNA, 13 nt, Human
agacacagugacc

SEQ ID NO: 731322 - RNA, 23 nt, Human
cacuggacucaccucccccaucu

SEQ ID NO: 731323 - RNA, 22 nt, Human
gugaacaaauuuacagagacag

SEQ ID NO: 731324 - RNA, 22 nt, Human
caguauggcagcuuuccucaaa

SEQ ID NO: 731325 - RNA, 22 nt, Human
augcagagguccacaacacaca

SEQ ID NO: 731326 - RNA, 17 nt, Human
agggcauagaaguaaaa

SEQ ID NO: 731327 - RNA, 14 nt, Human
ccagcuggccggga

SEQ ID NO: 731328 - RNA, 19 nt, Human
caccuguaaucccagcuac

SEQ ID NO: 731329 - RNA, 23 nt, Human
ucuccauguacuggcaagaccug

SEQ ID NO: 731330 - RNA, 18 nt, Human
uaauuuuaacucuauaau

SEQ ID NO: 731331 - RNA, 13 nt, Human
uaugaaauauuau

SEQ ID NO: 731332 - RNA, 17 nt, Human
aaauaacgauaaaagac

SEQ ID NO: 731333 - RNA, 20 nt, Human
aagggcuguuauaaucuuuc

SEQ ID NO: 731334 - RNA, 18 nt, Human
ucuucaacucccugcccc

SEQ ID NO: 731335 - RNA, 14 nt, Human
aggcaagagaauug

SEQ ID NO: 731336 - RNA, 21 nt, Human
auguuuaauucugaaagcaac

SEQ ID NO: 731337 - RNA, 12 nt, Human
cuaagaagugaa

SEQ ID NO: 731338 - RNA, 20 nt, Human
aaauaauuuuuauauuugaa

SEQ ID NO: 731339 - RNA, 16 nt, Human
uucccaacuccagaaa

SEQ ID NO: 731340 - RNA, 15 nt, Human
auuccccuaaccuca

SEQ ID NO: 731341 - RNA, 17 nt, Human
agucugacuguuuccau

SEQ ID NO: 731342 - RNA, 22 nt, Human
uauuucagauaaucacaauaca

SEQ ID NO: 731343 - RNA, 20 nt, Human
cccggccgcgcugcgcgccg

SEQ ID NO: 731344 - RNA, 15 nt, Human
accagggagccccuu

SEQ ID NO: 731345 - RNA, 17 nt, Human
agaagagccggagccuc

SEQ ID NO: 731346 - RNA, 19 nt, Human
gccccccagcccuccuuau

SEQ ID NO: 731347 - RNA, 13 nt, Human
aaagaagagccgg

SEQ ID NO: 731348 - RNA, 12 nt, Human
cauuauauuuau

SEQ ID NO: 731349 - RNA, 13 nt, Human
ccagcccuccuua

SEQ ID NO: 731350 - RNA, 14 nt, Human
gcuccgcgcagcuc

SEQ ID NO: 731351 - RNA, 20 nt, Human
ucauuccccaaccacuucau

SEQ ID NO: 731352 - RNA, 22 nt, Human
agaauuuuaugcggcauuuucu

SEQ ID NO: 731353 - RNA, 14 nt, Human
ugguauguuuucag

SEQ ID NO: 731354 - RNA, 15 nt, Human
aaaaaagaaacauuu

SEQ ID NO: 731355 - RNA, 16 nt, Human
uaggauguugaaaaag

SEQ ID NO: 731356 - RNA, 19 nt, Human
cagaaagcagaacagugau

SEQ ID NO: 731357 - RNA, 16 nt, Human
aaauaacaaugaaagu

SEQ ID NO: 731358 - RNA, 14 nt, Human
uucaauauuuauua

SEQ ID NO: 731359 - RNA, 14 nt, Human
cucccugcccccca

SEQ ID NO: 731360 - RNA, 16 nt, Human
cuuauaauuuaaaaua

SEQ ID NO: 731361 - RNA, 13 nt, Human
acaauaaaagaca

SEQ ID NO: 731362 - RNA, 18 nt, Human
gccugagcgacagugaga

SEQ ID NO: 731363 - RNA, 21 nt, Human
uuauagcuacuaauuuuaaaa

SEQ ID NO: 731364 - RNA, 16 nt, Human
gccaaggaugccccgu

SEQ ID NO: 731365 - RNA, 18 nt, Human
cagccucuuagaugcagu

SEQ ID NO: 731366 - RNA, 13 nt, Human
ccugccccccagc

SEQ ID NO: 731367 - RNA, 17 nt, Human
uuauaucaauuuaaaaa

SEQ ID NO: 731368 - RNA, 16 nt, Human
ccuacaugagguacug

SEQ ID NO: 731369 - RNA, 13 nt, Human
aagacucugucuc

SEQ ID NO: 731370 - RNA, 13 nt, Human
cugagagugaaca

SEQ ID NO: 731371 - RNA, 22 nt, Human
uaaacuguaaagcuuugugcag

SEQ ID NO: 731372 - RNA, 18 nt, Human
cuccauuuuuagugaaau

SEQ ID NO: 731373 - RNA, 14 nt, Human
cguguccccuaucc

SEQ ID NO: 731374 - RNA, 22 nt, Human
gucucuacuaaaaauacaaaaa

SEQ ID NO: 731375 - RNA, 19 nt, Human
agaugcuagaacucccuuu

SEQ ID NO: 731376 - RNA, 23 nt, Human
agcuuccauuccaagccugacca

SEQ ID NO: 731377 - RNA, 12 nt, Human
cuacaagacaca

SEQ ID NO: 731378 - RNA, 18 nt, Human
aaguugauaugccuuuuc

SEQ ID NO: 731379 - RNA, 14 nt, Human
uacccccugggagc

SEQ ID NO: 731380 - RNA, 19 nt, Human
ucugagcauuuaauaugga

SEQ ID NO: 731381 - RNA, 15 nt, Human
ccacaagaaaugaaa

SEQ ID NO: 731382 - RNA, 15 nt, Human
gcagagguugcagug

SEQ ID NO: 731383 - RNA, 18 nt, Human
ccugcucgcccacuuccu

SEQ ID NO: 731384 - RNA, 16 nt, Human
guuuuuuuuuaaaaaa

SEQ ID NO: 731385 - RNA, 14 nt, Human
uugaaauuguauua

SEQ ID NO: 731386 - RNA, 17 nt, Human
gacucaccucccccauc

SEQ ID NO: 731387 - RNA, 17 nt, Human
ggccaugggacagggag

SEQ ID NO: 731388 - RNA, 20 nt, Human
uuaaguuuuuuuuuaaaaaa

SEQ ID NO: 731389 - RNA, 22 nt, Human
caagcucuaucaccaaggagcc

SEQ ID NO: 731390 - RNA, 15 nt, Human
uggacucaccucccc

SEQ ID NO: 731391 - RNA, 21 nt, Human
cugcgcucggccugcucgccc

SEQ ID NO: 731392 - RNA, 15 nt, Human
cagaauucauucacu

SEQ ID NO: 731393 - RNA, 16 nt, Human
uagcuacuaauuuuaa

SEQ ID NO: 731394 - RNA, 16 nt, Human
auccuccaugaauauc

SEQ ID NO: 731395 - RNA, 14 nt, Human
aaugauuaugaauu

SEQ ID NO: 731396 - RNA, 18 nt, Human
acugugugcuaaaacaag

SEQ ID NO: 731397 - RNA, 16 nt, Human
auuguuugucugucuu

SEQ ID NO: 731398 - RNA, 19 nt, Human
acuucagcgguuuauauaa

SEQ ID NO: 731399 - RNA, 20 nt, Human
gacggcuccggacgcugcug

SEQ ID NO: 731400 - RNA, 23 nt, Human
ccccucuggcuccagcuggccgg

SEQ ID NO: 731401 - RNA, 17 nt, Human
uuuuuaauuauauggcu

SEQ ID NO: 731402 - RNA, 18 nt, Human
cuuuccacagaagcucca

SEQ ID NO: 731403 - RNA, 15 nt, Human
ucuggggcucuggga

SEQ ID NO: 731404 - RNA, 14 nt, Human
uugggaaaaaguaa

SEQ ID NO: 731405 - RNA, 13 nt, Human
cccugcacuccag

SEQ ID NO: 731406 - RNA, 13 nt, Human
ugaaauuguauua

SEQ ID NO: 731407 - RNA, 15 nt, Human
aagaaaauaacaaua

SEQ ID NO: 731408 - RNA, 16 nt, Human
gccaugugcuaguaau

SEQ ID NO: 731409 - RNA, 13 nt, Human
acacacaugaagu

SEQ ID NO: 731410 - RNA, 16 nt, Human
gccucagucucccucc

SEQ ID NO: 731411 - RNA, 16 nt, Human
ugcaaauugucacagg

SEQ ID NO: 731412 - RNA, 19 nt, Human
cccugcaaagcccagcuug

SEQ ID NO: 731413 - RNA, 23 nt, Human
cuagacccacuggacucaccucc

SEQ ID NO: 731414 - RNA, 19 nt, Human
gugacuuaaugccacuaaa

SEQ ID NO: 731415 - RNA, 21 nt, Human
aauuuguuuucccuucuuaca

SEQ ID NO: 731416 - RNA, 16 nt, Human
cgccuguaaucccagc

SEQ ID NO: 731417 - RNA, 20 nt, Human
auaagccagacaucaacaga

SEQ ID NO: 731418 - RNA, 18 nt, Human
uuacaaaugggaaacaaa

SEQ ID NO: 731419 - RNA, 19 nt, Human
augaaguacucauacaugu

SEQ ID NO: 731420 - RNA, 21 nt, Human
guggccagcuuguuauuuaua

SEQ ID NO: 731421 - RNA, 11 nt, Human
gccaugggaca

SEQ ID NO: 731422 - RNA, 22 nt, Human
cuacuugggaggcugaggcaag

SEQ ID NO: 731423 - RNA, 12 nt, Human
uaauuccacagc

SEQ ID NO: 731424 - RNA, 14 nt, Human
uucuggaauaaucc

SEQ ID NO: 731425 - RNA, 15 nt, Human
ugguuuagaaagcuu

SEQ ID NO: 731426 - RNA, 11 nt, Human
caucuagugag

SEQ ID NO: 731427 - RNA, 18 nt, Human
acuagaauuuauucaauu

SEQ ID NO: 731428 - RNA, 18 nt, Human
uuggggccuaugcagagg

SEQ ID NO: 731429 - RNA, 14 nt, Human
ugaucaccugcccu

SEQ ID NO: 731430 - RNA, 17 nt, Human
gaaagaagcccaauauu

SEQ ID NO: 731431 - RNA, 18 nt, Human
cacuccagugagacagcu

SEQ ID NO: 731432 - RNA, 15 nt, Human
ucugcagauaaacag

SEQ ID NO: 731433 - RNA, 18 nt, Human
gaagcaccaaucaugaau

SEQ ID NO: 731434 - RNA, 16 nt, Human
gugagacagcucugca

SEQ ID NO: 731435 - RNA, 22 nt, Human
ccauuucuugagguaaaagcau

SEQ ID NO: 731436 - RNA, 22 nt, Human
cauuuaaauaaaguguuugaaa

SEQ ID NO: 731437 - RNA, 13 nt, Human
cuagaauuuauuc

SEQ ID NO: 731438 - RNA, 21 nt, Human
cugagccucagucucccuccc

SEQ ID NO: 731439 - RNA, 17 nt, Human
guuuaauucugaaagca

SEQ ID NO: 731440 - RNA, 14 nt, Human
accauuuuuacuug

SEQ ID NO: 731441 - RNA, 20 nt, Human
ucaagucuuucacauuuaaa

SEQ ID NO: 731442 - RNA, 17 nt, Human
aaagacaaggaaaaaau

SEQ ID NO: 731443 - RNA, 23 nt, Human
agaguuuagcuggaaaaguaugu

SEQ ID NO: 731444 - RNA, 23 nt, Human
ugcauagguuuaauaauuuuuaa

SEQ ID NO: 731445 - RNA, 20 nt, Human
cugccgugggccugagacca

SEQ ID NO: 731446 - RNA, 18 nt, Human
ccauccugccccugagcc

SEQ ID NO: 731447 - RNA, 16 nt, Human
gaagauguagaggaga

SEQ ID NO: 731448 - RNA, 14 nt, Human
acuaaaaauacaaa

SEQ ID NO: 731449 - RNA, 15 nt, Human
acuagaauuuauuca

SEQ ID NO: 731450 - RNA, 18 nt, Human
uaaaauccauacauuugu

SEQ ID NO: 731451 - RNA, 18 nt, Human
uuaacuagaauuuauuca

SEQ ID NO: 731452 - RNA, 17 nt, Human
cuaagcuucacuguaaa

SEQ ID NO: 731453 - RNA, 21 nt, Human
ccuuuuuuugaaaaaaagcuu

SEQ ID NO: 731454 - RNA, 17 nt, Human
cuggcugcugguggcgc

SEQ ID NO: 731455 - RNA, 12 nt, Human
aaaugaaagcag

SEQ ID NO: 731456 - RNA, 20 nt, Human
ccuguucgcgcgccuccgcu

SEQ ID NO: 731457 - RNA, 22 nt, Human
gcggguccgggucgcaggacca

SEQ ID NO: 731458 - RNA, 22 nt, Human
gcugguggcgcuggcugcgcuc

SEQ ID NO: 731459 - RNA, 15 nt, Human
agggcucacagaauu

SEQ ID NO: 731460 - RNA, 20 nt, Human
ucaauaaaauccauacauuu

SEQ ID NO: 731461 - RNA, 13 nt, Human
caguuauuauauu

SEQ ID NO: 731462 - RNA, 14 nt, Human
gcucgcccacuucc

SEQ ID NO: 731463 - RNA, 20 nt, Human
agccuaguugaucagcuuau

SEQ ID NO: 731464 - RNA, 18 nt, Human
ggcccugugcggccuggu

SEQ ID NO: 731465 - RNA, 19 nt, Human
auuuucaguuauuauauuu

SEQ ID NO: 731466 - RNA, 18 nt, Human
cuuugagcgcccacuaga

SEQ ID NO: 731467 - RNA, 22 nt, Human
aagagccuuuuuuugaaaaaaa

SEQ ID NO: 731468 - RNA, 13 nt, Human
acuaauuuuaaaa

SEQ ID NO: 731469 - RNA, 21 nt, Human
guccccuauccuacuuccccu

SEQ ID NO: 731470 - RNA, 19 nt, Human
ggcaccgcuguacgcgagc

SEQ ID NO: 731471 - RNA, 20 nt, Human
cgcucggccugcucgcccac

SEQ ID NO: 731472 - RNA, 18 nt, Human
ccuaacugcuacaaauac

SEQ ID NO: 731473 - RNA, 18 nt, Human
cgcgagcgcgcgcgcccu

SEQ ID NO: 731474 - RNA, 22 nt, Human
auucuugaaagcuguggccagc

SEQ ID NO: 731475 - RNA, 17 nt, Human
agguccacaacacacag

SEQ ID NO: 731476 - RNA, 17 nt, Human
gccaugggacagggagg

SEQ ID NO: 731477 - RNA, 14 nt, Human
gagcccauggcacu

SEQ ID NO: 731478 - RNA, 22 nt, Human
aggacaccauuuuggcaagcuc

SEQ ID NO: 731479 - RNA, 22 nt, Human
gaugcaguucugaagaagaugg

SEQ ID NO: 731480 - RNA, 14 nt, Human
ccggggaggggcgc

SEQ ID NO: 731481 - RNA, 16 nt, Human
acaugaaguccaagca

SEQ ID NO: 731482 - RNA, 20 nt, Human
gagccugaucaccugcccug

SEQ ID NO: 731483 - RNA, 17 nt, Human
gcaagcucuaucaccaa

SEQ ID NO: 731484 - RNA, 21 nt, Human
agucacuaguuguaauuuuuu

SEQ ID NO: 731485 - RNA, 20 nt, Human
agcugccccggggaggggcg

SEQ ID NO: 731486 - RNA, 15 nt, Human
acauccuacaagaca

SEQ ID NO: 731487 - RNA, 22 nt, Human
caccagucugacuguuuccauc

SEQ ID NO: 731488 - RNA, 20 nt, Human
gacauuugcucauggaauug

SEQ ID NO: 731489 - RNA, 18 nt, Human
cuucacuguaaaauaaua

SEQ ID NO: 731490 - RNA, 17 nt, Human
gacagucaccucaugga

SEQ ID NO: 731491 - RNA, 21 nt, Human
auaauuuuuuucaauauuuau

SEQ ID NO: 731492 - RNA, 22 nt, Human
gcacagccucuuagaugcaguu

SEQ ID NO: 731493 - RNA, 16 nt, Human
acuaguuucccuugca

SEQ ID NO: 731494 - RNA, 23 nt, Human
uguucuugugaacccaaagugug

SEQ ID NO: 731495 - RNA, 17 nt, Human
uaucuuuuuuuuaauaa

SEQ ID NO: 731496 - RNA, 12 nt, Human
acaagacacagu

SEQ ID NO: 731497 - RNA, 23 nt, Human
ucuaccaaaaaucucaauauuuc

SEQ ID NO: 731498 - RNA, 18 nt, Human
uauauuuuuuuuuuuaaa

SEQ ID NO: 731499 - RNA, 18 nt, Human
aagaccucauuuugaagg

SEQ ID NO: 731500 - RNA, 15 nt, Human
acagugaaagaaaau

SEQ ID NO: 731501 - RNA, 12 nt, Human
ggggcggcggcc

SEQ ID NO: 731502 - RNA, 21 nt, Human
cgacagugagacucugucuca

SEQ ID NO: 731503 - RNA, 18 nt, Human
uccagcuggccgggagcc

SEQ ID NO: 731504 - RNA, 15 nt, Human
auuucuaugaaauau

SEQ ID NO: 731505 - RNA, 21 nt, Human
caaggaaaaaauaacaaugaa

SEQ ID NO: 731506 - RNA, 16 nt, Human
uaucaaaagaaagaaa

SEQ ID NO: 731507 - RNA, 23 nt, Human
cugaaaucauacuucuuaggguu

SEQ ID NO: 731508 - RNA, 14 nt, Human
acuggacucaccuc

SEQ ID NO: 731509 - RNA, 16 nt, Human
ccuggugggcagagag

SEQ ID NO: 731510 - RNA, 17 nt, Human
cccccugcaaagcccag

SEQ ID NO: 731511 - RNA, 13 nt, Human
ccuaaccagccug

SEQ ID NO: 731512 - RNA, 13 nt, Human
cgcgagcgcgcgc

SEQ ID NO: 731513 - RNA, 15 nt, Human
cugcacuccagccug

SEQ ID NO: 731514 - RNA, 23 nt, Human
aucaccaaggcugauuaaaccaa

SEQ ID NO: 731515 - RNA, 15 nt, Human
caccuguaaucccag

SEQ ID NO: 731516 - RNA, 16 nt, Human
agguacuucaaauccu

SEQ ID NO: 731517 - RNA, 12 nt, Human
acaugagguacu

SEQ ID NO: 731518 - RNA, 15 nt, Human
uccaagccucauguc

SEQ ID NO: 731519 - RNA, 19 nt, Human
accccugagcuugcagaga

SEQ ID NO: 731520 - RNA, 18 nt, Human
ccaauauuauaauuuuuu

SEQ ID NO: 731521 - RNA, 20 nt, Human
auuuauugaggcuuuaaaac

SEQ ID NO: 731522 - RNA, 23 nt, Human
ugucacgugugggcaauguuccc

SEQ ID NO: 731523 - RNA, 13 nt, Human
aaaguguuugaaa

SEQ ID NO: 731524 - RNA, 14 nt, Human
gauuaguacacacu

SEQ ID NO: 731525 - RNA, 15 nt, Human
cugacucuuaagaag

SEQ ID NO: 731526 - RNA, 15 nt, Human
gcacagccucuuaga

SEQ ID NO: 731527 - RNA, 19 nt, Human
uuugccaaguucuccacua

SEQ ID NO: 731528 - RNA, 10 nt, Human
ggggaggggc

SEQ ID NO: 731529 - RNA, 15 nt, Human
cggagccuccagcug

SEQ ID NO: 731530 - RNA, 16 nt, Human
ugugagaugcuagaac

SEQ ID NO: 731531 - RNA, 23 nt, Human
aagagccggagccuccagcugcc

SEQ ID NO: 731532 - RNA, 20 nt, Human
ugccccccagcccuccuuau

SEQ ID NO: 731533 - RNA, 15 nt, Human
aaauaauuuuuauau

SEQ ID NO: 731534 - RNA, 22 nt, Human
cgcuggcugcgcucggccugcu

SEQ ID NO: 731535 - RNA, 16 nt, Human
ucucuaggaaauauuu

SEQ ID NO: 731536 - RNA, 14 nt, Human
caugaacuuguaaa

SEQ ID NO: 731537 - RNA, 23 nt, Human
ggaggcagagguugcagugagcc

SEQ ID NO: 731538 - RNA, 23 nt, Human
caucucuucuggguuccuuccuc

SEQ ID NO: 731539 - RNA, 15 nt, Human
uaaauaaauguaucu

SEQ ID NO: 731540 - RNA, 18 nt, Human
aagacucugucucaaaaa

SEQ ID NO: 731541 - RNA, 19 nt, Human
ugggacaggggagaaccua

SEQ ID NO: 731542 - RNA, 16 nt, Human
aaaagcuccauuuuua

SEQ ID NO: 731543 - RNA, 15 nt, Human
aauacuuuauaaagg

SEQ ID NO: 731544 - RNA, 16 nt, Human
uucuauaauuuaaaua

SEQ ID NO: 731545 - RNA, 22 nt, Human
cccaggcggguccgggucgcag

SEQ ID NO: 731546 - RNA, 18 nt, Human
gaaguaaauguuguuuua

SEQ ID NO: 731547 - RNA, 18 nt, Human
uuuauggcacuaguauuu

SEQ ID NO: 731548 - RNA, 19 nt, Human
uggugagugccuguaauca

SEQ ID NO: 731549 - RNA, 15 nt, Human
ucuuauagaauauuu

SEQ ID NO: 731550 - RNA, 16 nt, Human
aacaauaaaagacaag

SEQ ID NO: 731551 - RNA, 14 nt, Human
cauagaaguaaaaa

SEQ ID NO: 731552 - RNA, 13 nt, Human
caacaucuaguga

SEQ ID NO: 731553 - RNA, 10 nt, Human
accugagccc

SEQ ID NO: 731554 - RNA, 15 nt, Human
cccugccccccagcc

SEQ ID NO: 731555 - RNA, 16 nt, Human
gcugcgcgccgcgcuc

SEQ ID NO: 731556 - RNA, 23 nt, Human
ccagccugggugacagagcaaga

SEQ ID NO: 731557 - RNA, 17 nt, Human
uuuaaaaaaaaaacgua

SEQ ID NO: 731558 - RNA, 14 nt, Human
uauaaauaaaaaua

SEQ ID NO: 731559 - RNA, 17 nt, Human
cgccuccgcuacuucca

SEQ ID NO: 731560 - RNA, 20 nt, Human
uaggaauugacccacaagaa

SEQ ID NO: 731561 - RNA, 23 nt, Human
ugcagagguccacaacacacaga

SEQ ID NO: 731562 - RNA, 13 nt, Human
ugauuauauguca

SEQ ID NO: 731563 - RNA, 23 nt, Human
cuacacgagauacagaauuuuau

SEQ ID NO: 731564 - RNA, 12 nt, Human
ugagagacacac

SEQ ID NO: 731565 - RNA, 20 nt, Human
accgcuguacgcgagcgcgc

SEQ ID NO: 731566 - RNA, 21 nt, Human
uuuuauggcacuaguauuucu

SEQ ID NO: 731567 - RNA, 12 nt, Human
cuugguuuuaau

SEQ ID NO: 731568 - RNA, 13 nt, Human
cagcucaggcugg

SEQ ID NO: 731569 - RNA, 23 nt, Human
ugccccggggaggggcgcucgcu

SEQ ID NO: 731570 - RNA, 15 nt, Human
acucaccucccccau

SEQ ID NO: 731571 - RNA, 17 nt, Human
cuggagggaagccuugg

SEQ ID NO: 731572 - RNA, 14 nt, Human
cacaacacacagau

SEQ ID NO: 731573 - RNA, 19 nt, Human
cggggcggggagcgagccc

SEQ ID NO: 731574 - RNA, 22 nt, Human
aaacaaggaugaauuaaguuuu

SEQ ID NO: 731575 - RNA, 19 nt, Human
guaaagcuuugugcagauu

SEQ ID NO: 731576 - RNA, 19 nt, Human
gaggcugaggcaagagaau

SEQ ID NO: 731577 - RNA, 13 nt, Human
uuaaauuguaaua

SEQ ID NO: 731578 - RNA, 13 nt, Human
aguguuugaaagc

SEQ ID NO: 731579 - RNA, 18 nt, Human
ccucuggcuccagcuggc

SEQ ID NO: 731580 - RNA, 15 nt, Human
acaaaugggaaacaa

SEQ ID NO: 731581 - RNA, 18 nt, Human
uccucgccacgcucuggg

SEQ ID NO: 731582 - RNA, 22 nt, Human
ccacagcuguaugauucccagc

SEQ ID NO: 731583 - RNA, 20 nt, Human
caaauauaaauaaaaauaau

SEQ ID NO: 731584 - RNA, 15 nt, Human
uauaauuuuuuucaa

SEQ ID NO: 731585 - RNA, 21 nt, Human
gaaagcagggacuugaaccca

SEQ ID NO: 731586 - RNA, 17 nt, Human
aaauaacaauaaaagac

SEQ ID NO: 731587 - RNA, 18 nt, Human
agcuuugugcagauucuu

SEQ ID NO: 731588 - RNA, 22 nt, Human
aagacucugucucaaaaaauaa

SEQ ID NO: 731589 - RNA, 15 nt, Human
cuggguuccuuccuc

SEQ ID NO: 731590 - RNA, 18 nt, Human
auccccaagccuggcaag

SEQ ID NO: 731591 - RNA, 19 nt, Human
auuuugugaagcaaaauuu

SEQ ID NO: 731592 - RNA, 20 nt, Human
augcaguuguugcccacagc

SEQ ID NO: 731593 - RNA, 22 nt, Human
gagccucagucucccucccuug

SEQ ID NO: 731594 - RNA, 14 nt, Human
uugcuggagcucug

SEQ ID NO: 731595 - RNA, 13 nt, Human
cccuccuuaucaa

SEQ ID NO: 731596 - RNA, 17 nt, Human
cucaggcuggcaccgcu

SEQ ID NO: 731597 - RNA, 16 nt, Human
ccacuuauaggaauug

SEQ ID NO: 731598 - RNA, 20 nt, Human
accugauuucugagcauuua

SEQ ID NO: 731599 - RNA, 15 nt, Human
acaggguuuauguuu

SEQ ID NO: 731600 - RNA, 21 nt, Human
cucaaaacuucagacauagaa

SEQ ID NO: 731601 - RNA, 21 nt, Human
aaaagguauuuuaaucaccaa

SEQ ID NO: 731602 - RNA, 21 nt, Human
acucauuaaauggaaguaaau

SEQ ID NO: 731603 - RNA, 15 nt, Human
ccggagccuccagcu

SEQ ID NO: 731604 - RNA, 19 nt, Human
aaaauaacgauaaaagaca

SEQ ID NO: 731605 - RNA, 23 nt, Human
aggaugguucccuugaugaagaa

SEQ ID NO: 731606 - RNA, 20 nt, Human
gcgcggggcggggagcgagc

SEQ ID NO: 731607 - RNA, 11 nt, Human
gccuccagcug

SEQ ID NO: 731608 - RNA, 20 nt, Human
aauucuugccaaauauaaau

SEQ ID NO: 731609 - RNA, 19 nt, Human
caugaguaacugauuugua

SEQ ID NO: 731610 - RNA, 23 nt, Human
ccagcacuuugggaggcugaggc

SEQ ID NO: 731611 - RNA, 22 nt, Human
uagaauauuuauuaccucugau

SEQ ID NO: 731612 - RNA, 20 nt, Human
auucccagccagcacagccu

SEQ ID NO: 731613 - RNA, 18 nt, Human
auuauuuuuuaaaaaaau

SEQ ID NO: 731614 - RNA, 23 nt, Human
ggaugaauuaaguuuuuuuuuaa

SEQ ID NO: 731615 - RNA, 17 nt, Human
aauucuugccaaauaua

SEQ ID NO: 731616 - RNA, 20 nt, Human
auacugugugcuaaaacaag

SEQ ID NO: 731617 - RNA, 14 nt, Human
ccaaauauaaauaa

SEQ ID NO: 731618 - RNA, 18 nt, Human
auuuuuagugaaauauua

SEQ ID NO: 731619 - RNA, 23 nt, Human
cuaguaauuggaaaggcagcucu

SEQ ID NO: 731620 - RNA, 15 nt, Human
caagcucacagaccu

SEQ ID NO: 731621 - RNA, 14 nt, Human
aaaagaaacauuug

SEQ ID NO: 731622 - RNA, 21 nt, Human
aauaauccucaguuuuuguga

SEQ ID NO: 731623 - RNA, 14 nt, Human
aagcucuaucacca

SEQ ID NO: 731624 - RNA, 22 nt, Human
uugacccacaagaaaugaaagc

SEQ ID NO: 731625 - RNA, 22 nt, Human
uauccuacuuccccuuccuaau

SEQ ID NO: 731626 - RNA, 22 nt, Human
cuuccauuccaagccugaccac

SEQ ID NO: 731627 - RNA, 21 nt, Human
cuaaauugacacuuaaaaaug

SEQ ID NO: 731628 - RNA, 14 nt, Human
ccccugagcuugca

SEQ ID NO: 731629 - RNA, 21 nt, Human
ugaaauggacuuuuguacaua

SEQ ID NO: 731630 - RNA, 16 nt, Human
cucucuuccucccugg

SEQ ID NO: 731631 - RNA, 18 nt, Human
aaagaaaaucaggcuggc

SEQ ID NO: 731632 - RNA, 12 nt, Human
gccccugagccc

SEQ ID NO: 731633 - RNA, 13 nt, Human
ccucauggaauug

SEQ ID NO: 731634 - RNA, 18 nt, Human
cccgggccgacggagccg

SEQ ID NO: 731635 - RNA, 16 nt, Human
ugcuaagucuuauaua

SEQ ID NO: 731636 - RNA, 23 nt, Human
cucauguccacugguucuucuug

SEQ ID NO: 731637 - RNA, 21 nt, Human
cugccccggggaggggcgcuc

SEQ ID NO: 731638 - RNA, 15 nt, Human
agacaaggaaaaaau

SEQ ID NO: 731639 - RNA, 19 nt, Human
ccuccauccugaggcucca

SEQ ID NO: 731640 - RNA, 15 nt, Human
agcucuaucaccaag

SEQ ID NO: 731641 - RNA, 20 nt, Human
aauuaaguuuuuuuuuaaaa

SEQ ID NO: 731642 - RNA, 16 nt, Human
caaaaggauaaugaau

SEQ ID NO: 731643 - RNA, 14 nt, Human
cucugccucagaaa

SEQ ID NO: 731644 - RNA, 14 nt, Human
cuaaauuugguucu

SEQ ID NO: 731645 - RNA, 16 nt, Human
aggccaugggacaggg

SEQ ID NO: 731646 - RNA, 19 nt, Human
ugagguaaccucauuauca

SEQ ID NO: 731647 - RNA, 11 nt, Human
ggucacaggaa

SEQ ID NO: 731648 - RNA, 21 nt, Human
aaauaauuuuuauauuugaaa

SEQ ID NO: 731649 - RNA, 16 nt, Human
cacuuaaaaaugguuu

SEQ ID NO: 731650 - RNA, 19 nt, Human
aguauuucuaugaaauauu

SEQ ID NO: 731651 - RNA, 14 nt, Human
cugucucaguccau

SEQ ID NO: 731652 - RNA, 22 nt, Human
caaugcuguauuuuaaaagaau

SEQ ID NO: 731653 - RNA, 18 nt, Human
cuuuucccaacuccagaa

SEQ ID NO: 731654 - RNA, 15 nt, Human
gaggucaggaguucc

SEQ ID NO: 731655 - RNA, 19 nt, Human
agcagcuuauucacaagac

SEQ ID NO: 731656 - RNA, 15 nt, Human
aauucugaaagcaac

SEQ ID NO: 731657 - RNA, 15 nt, Human
aagaagugaaaaucu

SEQ ID NO: 731658 - RNA, 13 nt, Human
ccagcacagccuc

SEQ ID NO: 731659 - RNA, 19 nt, Human
ugcagcgaguacuucccgc

SEQ ID NO: 731660 - RNA, 16 nt, Human
aguugcagugagcuga

SEQ ID NO: 731661 - RNA, 16 nt, Human
auuucuauuuauuuac

SEQ ID NO: 731662 - RNA, 16 nt, Human
uuucuauaauuuaaau

SEQ ID NO: 731663 - RNA, 16 nt, Human
ugaaauuguauuacaa

SEQ ID NO: 731664 - RNA, 12 nt, Human
uaucuuauucac

SEQ ID NO: 731665 - RNA, 22 nt, Human
cggagccgggaaagaagagccg

SEQ ID NO: 731666 - RNA, 13 nt, Human
cgcugcgcgccgc

SEQ ID NO: 731667 - RNA, 22 nt, Human
aaagagugaaggauuuauguuu

SEQ ID NO: 731668 - RNA, 23 nt, Human
ggucuaucuuugagcgcccacua

SEQ ID NO: 731669 - RNA, 18 nt, Human
auagaauuaacacaugau

SEQ ID NO: 731670 - RNA, 17 nt, Human
agaaucacuugaacccg

SEQ ID NO: 731671 - RNA, 20 nt, Human
ccagcuacuugggaggcuga

SEQ ID NO: 731672 - RNA, 17 nt, Human
guugcugggggggauug

SEQ ID NO: 731673 - RNA, 22 nt, Human
aggaugccccgucccccucugg

SEQ ID NO: 731674 - RNA, 15 nt, Human
ccaucccggccggcg

SEQ ID NO: 731675 - RNA, 17 nt, Human
aauauuuauuaccucug

SEQ ID NO: 731676 - RNA, 21 nt, Human
caucuagcaugucgucaaagc

SEQ ID NO: 731677 - RNA, 15 nt, Human
ccucucuuccucccu

SEQ ID NO: 731678 - RNA, 17 nt, Human
agacagugaaagaaaau

SEQ ID NO: 731679 - RNA, 21 nt, Human
acagugauuaccagggacuga

SEQ ID NO: 731680 - RNA, 18 nt, Human
gcgcgcccucuggcugcu

SEQ ID NO: 731681 - RNA, 22 nt, Human
uuugaaacgaggauugggaaaa

SEQ ID NO: 731682 - RNA, 14 nt, Human
auaaaauaauuuuu

SEQ ID NO: 731683 - RNA, 16 nt, Human
acuaaacaaagaguga

SEQ ID NO: 731684 - RNA, 13 nt, Human
aauuuuuauauuu

SEQ ID NO: 731685 - RNA, 15 nt, Human
cccugcaaagcccag

SEQ ID NO: 731686 - RNA, 14 nt, Human
aauauaaauaaaaa

SEQ ID NO: 731687 - RNA, 22 nt, Human
uucuaauagaacucaguuuuaa

SEQ ID NO: 731688 - RNA, 15 nt, Human
gaaaacaaggaugaa

SEQ ID NO: 731689 - RNA, 17 nt, Human
gauaaaagacagugaaa

SEQ ID NO: 731690 - RNA, 19 nt, Human
cucggccugcucgcccacu

SEQ ID NO: 731691 - RNA, 15 nt, Human
ccggggaggggcgcu

SEQ ID NO: 731692 - RNA, 17 nt, Human
cuuguuauuuauaacaa

SEQ ID NO: 731693 - RNA, 22 nt, Human
aaacauccuacaagacacagug

SEQ ID NO: 731694 - RNA, 21 nt, Human
cugauauuggacaguaaaauc

SEQ ID NO: 731695 - RNA, 13 nt, Human
agcagauuuuaau

SEQ ID NO: 731696 - RNA, 16 nt, Human
caaccacuucauucuu

SEQ ID NO: 731697 - RNA, 21 nt, Human
cagcucaggcuggcaccgcug

SEQ ID NO: 731698 - RNA, 15 nt, Human
aucaauuuaaaaaaa

SEQ ID NO: 731699 - RNA, 15 nt, Human
uucggccuccauccu

SEQ ID NO: 731700 - RNA, 20 nt, Human
gcgcugcgcgccgcgcuccu

SEQ ID NO: 731701 - RNA, 16 nt, Human
cucaauaaaguacaag

SEQ ID NO: 731702 - RNA, 17 nt, Human
guccaaagggcaugggu

SEQ ID NO: 731703 - RNA, 17 nt, Human
aucaaggguacacugcc

SEQ ID NO: 731704 - RNA, 18 nt, Human
aaaguaacccuacaaaac

SEQ ID NO: 731705 - RNA, 12 nt, Human
gggaaagaagag

SEQ ID NO: 731706 - RNA, 16 nt, Human
ggcugagccucagucu

SEQ ID NO: 731707 - RNA, 16 nt, Human
uuucacauuuaaauaa

SEQ ID NO: 731708 - RNA, 21 nt, Human
cucagugucaaugcagccccc

SEQ ID NO: 731709 - RNA, 18 nt, Human
caaggcugauuaaaccaa

SEQ ID NO: 731710 - RNA, 19 nt, Human
ugaaaccaaaccagagccu

SEQ ID NO: 731711 - RNA, 18 nt, Human
uaaaagacagugaaagaa

SEQ ID NO: 731712 - RNA, 17 nt, Human
ggagcucguggaacagu

SEQ ID NO: 731713 - RNA, 17 nt, Human
auaaguacaugauaagc

SEQ ID NO: 731714 - RNA, 19 nt, Human
gagccugaucaccugcccu

SEQ ID NO: 731715 - RNA, 14 nt, Human
ccugccccugagcc

SEQ ID NO: 731716 - RNA, 20 nt, Human
ugagagacacacugaagaag

SEQ ID NO: 731717 - RNA, 14 nt, Human
gaaagcuguggcca

SEQ ID NO: 731718 - RNA, 17 nt, Human
gcaugguuuagaaagcu

SEQ ID NO: 731719 - RNA, 18 nt, Human
gaagcaaaauuuuuucuc

SEQ ID NO: 731720 - RNA, 22 nt, Human
gaauuaaguuuuuuuuuaaaaa

SEQ ID NO: 731721 - RNA, 14 nt, Human
uagcugacccagcc

SEQ ID NO: 731722 - RNA, 12 nt, Human
gucccaggcuga

SEQ ID NO: 731723 - RNA, 21 nt, Human
gcgcucaucccacccgcccac

SEQ ID NO: 731724 - RNA, 23 nt, Human
uaaaagacagugaaagaaaauaa

SEQ ID NO: 731725 - RNA, 18 nt, Human
ccggggaggggcgcucgc

SEQ ID NO: 731726 - RNA, 16 nt, Human
ucagucucccucccuu

SEQ ID NO: 731727 - RNA, 21 nt, Human
aucuuguaaagguccuggcaa

SEQ ID NO: 731728 - RNA, 23 nt, Human
augaauaucaguuauuuuuaaac

SEQ ID NO: 731729 - RNA, 18 nt, Human
uaacuagaauuuauucaa

SEQ ID NO: 731730 - RNA, 13 nt, Human
caucccacccgcc

SEQ ID NO: 731731 - RNA, 15 nt, Human
gaccacugcagaaga

SEQ ID NO: 731732 - RNA, 17 nt, Human
aguauuucuaugaaaua

SEQ ID NO: 731733 - RNA, 23 nt, Human
ucaggaguuccuaaccagccugg

SEQ ID NO: 731734 - RNA, 15 nt, Human
aaaauacaaaaaaaa

SEQ ID NO: 731735 - RNA, 17 nt, Human
agaacucccuuucaaca

SEQ ID NO: 731736 - RNA, 19 nt, Human
ggcugcugguggcgcuggc

SEQ ID NO: 731737 - RNA, 14 nt, Human
ggaaguagaggagg

SEQ ID NO: 731738 - RNA, 13 nt, Human
acagcccuucuuu

SEQ ID NO: 731739 - RNA, 21 nt, Human
gaaaaguauguuagugcaaau

SEQ ID NO: 731740 - RNA, 13 nt, Human
auugauuauaugu

SEQ ID NO: 731741 - RNA, 17 nt, Human
uucucuaggaaauauuu

SEQ ID NO: 731742 - RNA, 21 nt, Human
cuuguuggacgagaaaacaau

SEQ ID NO: 731743 - RNA, 13 nt, Human
gagccggagccuc

SEQ ID NO: 731744 - RNA, 14 nt, Human
uacuaauuuuaaaa

SEQ ID NO: 731745 - RNA, 15 nt, Human
cuuaagaagacugca

SEQ ID NO: 731746 - RNA, 17 nt, Human
cuaguuguaauuuuuuu

SEQ ID NO: 731747 - RNA, 23 nt, Human
ugaauuacauuuguauaaaauaa

SEQ ID NO: 731748 - RNA, 15 nt, Human
uccagauccuggaaa

SEQ ID NO: 731749 - RNA, 20 nt, Human
acggagccgggaaagaagag

SEQ ID NO: 731750 - RNA, 13 nt, Human
uuuugaaucauca

SEQ ID NO: 731751 - RNA, 19 nt, Human
auugaggacacugauaugg

SEQ ID NO: 731752 - RNA, 13 nt, Human
aaauaaaaauaaa

SEQ ID NO: 731753 - RNA, 22 nt, Human
acagauuugagcucagcccugg

SEQ ID NO: 731754 - RNA, 15 nt, Human
auuuuaaaagaauga

SEQ ID NO: 731755 - RNA, 13 nt, Human
cuuaucaaaggac

SEQ ID NO: 731756 - RNA, 12 nt, Human
aaggaugccccg

SEQ ID NO: 731757 - RNA, 14 nt, Human
aaaggaauuuaaaa

SEQ ID NO: 731758 - RNA, 22 nt, Human
uuuccaagcaaguauuagaaua

SEQ ID NO: 731759 - RNA, 14 nt, Human
cugcaaagcccagc

SEQ ID NO: 731760 - RNA, 21 nt, Human
cugggauagcugacccagccc

SEQ ID NO: 731761 - RNA, 22 nt, Human
gaaauaagccagacaucaacag

SEQ ID NO: 731762 - RNA, 20 nt, Human
cucuacuaaaaauacaaaaa

SEQ ID NO: 731763 - RNA, 19 nt, Human
gacagucaccucauggaau

SEQ ID NO: 731764 - RNA, 22 nt, Human
ugggcacuguggguagacacac

SEQ ID NO: 731765 - RNA, 15 nt, Human
auagcagauuuuaau

SEQ ID NO: 731766 - RNA, 22 nt, Human
cagcccuggugggcagagaggu

SEQ ID NO: 731767 - RNA, 12 nt, Human
accccugagcuu

SEQ ID NO: 731768 - RNA, 15 nt, Human
cucguggaacaguua

SEQ ID NO: 731769 - RNA, 17 nt, Human
acaagaaaugaaagcag

SEQ ID NO: 731770 - RNA, 14 nt, Human
cucuggcuccagcu

SEQ ID NO: 731771 - RNA, 18 nt, Human
gaggcuccacuuggucug

SEQ ID NO: 731772 - RNA, 12 nt, Human
agcccaauauua

SEQ ID NO: 731773 - RNA, 23 nt, Human
uaaguuuuuuuuuaaaaaagaaa

SEQ ID NO: 731774 - RNA, 18 nt, Human
ccugaaagaggaaugaag

SEQ ID NO: 731775 - RNA, 23 nt, Human
gaccccugagcuugcagagauga

SEQ ID NO: 731776 - RNA, 22 nt, Human
ccauacuaauuauacccccugc

SEQ ID NO: 731777 - RNA, 21 nt, Human
ccuccagcugccccggggagg

SEQ ID NO: 731778 - RNA, 21 nt, Human
gacagaaagcagaacagugau

SEQ ID NO: 731779 - RNA, 12 nt, Human
ggggcucuggga

SEQ ID NO: 731780 - RNA, 19 nt, Human
uacuucuuaggguuaugau

SEQ ID NO: 731781 - RNA, 12 nt, Human
uaguacacacuu

SEQ ID NO: 731782 - RNA, 13 nt, Human
ggggcucugggau

SEQ ID NO: 731783 - RNA, 17 nt, Human
ccccauuucuauuuauu

SEQ ID NO: 731784 - RNA, 13 nt, Human
agacagcucugca

SEQ ID NO: 731785 - RNA, 13 nt, Human
uauuuauuuuaau

SEQ ID NO: 731786 - RNA, 17 nt, Human
agcugacccagccccuu

SEQ ID NO: 731787 - RNA, 19 nt, Human
caccuguuuuuaagcuguu

SEQ ID NO: 731788 - RNA, 15 nt, Human
aucuuauaauuuaaa

SEQ ID NO: 731789 - RNA, 17 nt, Human
uaauuccacagcugcuc

SEQ ID NO: 731790 - RNA, 15 nt, Human
auaaauaaaaauaau

SEQ ID NO: 731791 - RNA, 18 nt, Human
ccugcaaagcccagcuug

SEQ ID NO: 731792 - RNA, 16 nt, Human
acagagacagaaagca

SEQ ID NO: 731793 - RNA, 15 nt, Human
ccucagucucccucc

SEQ ID NO: 731794 - RNA, 17 nt, Human
guuuaauaauuuuuaau

SEQ ID NO: 731795 - RNA, 23 nt, Human
auuauauggcuugaguuuaaauu

SEQ ID NO: 731796 - RNA, 15 nt, Human
uucugcacacagcac

SEQ ID NO: 731797 - RNA, 23 nt, Human
uuuagaaagaagcccaauauuau

SEQ ID NO: 731798 - RNA, 23 nt, Human
aaaauaucacuugucaauaaaau

SEQ ID NO: 731799 - RNA, 21 nt, Human
auuuguauaaaauaauuuuua

SEQ ID NO: 731800 - RNA, 16 nt, Human
ggaggggcgcucgcuu

SEQ ID NO: 731801 - RNA, 17 nt, Human
uguucuaagaagugaaa

SEQ ID NO: 731802 - RNA, 23 nt, Human
uuauagcuacuaauuuuaaaaug

SEQ ID NO: 731803 - RNA, 13 nt, Human
agccucagucucc

SEQ ID NO: 731804 - RNA, 22 nt, Human
agacucugucucaaaaaauaaa

SEQ ID NO: 731805 - RNA, 17 nt, Human
cuggcugcgcucggccu

SEQ ID NO: 731806 - RNA, 21 nt, Human
ugaaauuguauuacaaaucca

SEQ ID NO: 731807 - RNA, 14 nt, Human
ugcucauggaauug

SEQ ID NO: 731808 - RNA, 15 nt, Human
guuugcauguucacu

SEQ ID NO: 731809 - RNA, 21 nt, Human
gucuuugccaaguucuccacu

SEQ ID NO: 731810 - RNA, 21 nt, Human
ucauuuugaagggaaauuuca

SEQ ID NO: 731811 - RNA, 15 nt, Human
uauuacuguaagaaa

SEQ ID NO: 731812 - RNA, 20 nt, Human
uaaaaugucuugcuugauug

SEQ ID NO: 731813 - RNA, 20 nt, Human
cuaccaaaaaucucaauauu

SEQ ID NO: 731814 - RNA, 19 nt, Human
cuacagggcucacagaauu

SEQ ID NO: 731815 - RNA, 17 nt, Human
gaggagcuuugaaacga

SEQ ID NO: 731816 - RNA, 23 nt, Human
gacagucaccucauggaauugga

SEQ ID NO: 731817 - RNA, 14 nt, Human
ccuugaugaagaag

SEQ ID NO: 731818 - RNA, 16 nt, Human
auggaauuggagcucg

SEQ ID NO: 731819 - RNA, 16 nt, Human
aaauccaaugaaauga

SEQ ID NO: 731820 - RNA, 21 nt, Human
acagaagcuccagguagaggg

SEQ ID NO: 731821 - RNA, 22 nt, Human
acuccaaacugacucuuaagaa

SEQ ID NO: 731822 - RNA, 22 nt, Human
aaauaaaguguuugaaagcuuu

SEQ ID NO: 731823 - RNA, 12 nt, Human
aaaaaaagcuuu

SEQ ID NO: 731824 - RNA, 19 nt, Human
gaaguuggcuggugucccu

SEQ ID NO: 731825 - RNA, 16 nt, Human
cuauaauguguucauu

SEQ ID NO: 731826 - RNA, 15 nt, Human
cuaaacauguuuauc

SEQ ID NO: 731827 - RNA, 20 nt, Human
ccuacacgagauacagaauu

SEQ ID NO: 731828 - RNA, 12 nt, Human
ugcucauggaau

SEQ ID NO: 731829 - RNA, 13 nt, Human
ugauguuuagaaa

SEQ ID NO: 731830 - RNA, 13 nt, Human
ugauaacuggaaa

SEQ ID NO: 731831 - RNA, 22 nt, Human
ugaauuauguuugcauguucac

SEQ ID NO: 731832 - RNA, 11 nt, Human
ucauggaauug

SEQ ID NO: 731833 - RNA, 22 nt, Human
ucagaaaacaaggaugaauuaa

SEQ ID NO: 731834 - RNA, 17 nt, Human
uccaagcaaguauuaga

SEQ ID NO: 731835 - RNA, 21 nt, Human
uguuugcuaagcauuccaacu

SEQ ID NO: 731836 - RNA, 16 nt, Human
ccaaucaugaauuagu

SEQ ID NO: 731837 - RNA, 11 nt, Human
cauguucacuu

SEQ ID NO: 731838 - RNA, 18 nt, Human
cauggaauuggagcucgu

SEQ ID NO: 731839 - RNA, 22 nt, Human
caagcauuuagauguauagguu

SEQ ID NO: 731840 - RNA, 16 nt, Human
cacaugaaguccaagc

SEQ ID NO: 731841 - RNA, 22 nt, Human
cacagaccuuugaacuagaguu

SEQ ID NO: 731842 - RNA, 23 nt, Human
caaaauaugccccauucaacauc

SEQ ID NO: 731843 - RNA, 20 nt, Human
caacuaucucauuuccaagc

SEQ ID NO: 731844 - RNA, 14 nt, Human
auggaauuggagcu

SEQ ID NO: 731845 - RNA, 15 nt, Human
auggaauuggagcuc

SEQ ID NO: 731846 - RNA, 14 nt, Human
uuuauauaagcuug

SEQ ID NO: 731847 - RNA, 23 nt, Human
gcggcauuuucuucucacauuua

SEQ ID NO: 731848 - RNA, 19 nt, Human
gagagacacacugaagaag

SEQ ID NO: 731849 - RNA, 22 nt, Human
gacauuugcucauggaauugga

SEQ ID NO: 731850 - RNA, 18 nt, Human
agcaugucgucaaagcug

SEQ ID NO: 731851 - RNA, 14 nt, Human
caguucugaagaag

SEQ ID NO: 731852 - RNA, 12 nt, Human
cucaguucacug

SEQ ID NO: 731853 - RNA, 15 nt, Human
cuccagguagagggu

SEQ ID NO: 731854 - RNA, 16 nt, Human
agagccuuuuuuugaa

SEQ ID NO: 731855 - RNA, 18 nt, Human
agauguauguacuucaug

SEQ ID NO: 731856 - RNA, 17 nt, Human
auuuauguuuaauucug

SEQ ID NO: 731857 - RNA, 22 nt, Human
cacugccuucucaacuccaaac

SEQ ID NO: 731858 - RNA, 13 nt, Human
auuacuguaagaa

SEQ ID NO: 731859 - RNA, 13 nt, Human
auccuugaagauu

SEQ ID NO: 731860 - RNA, 13 nt, Human
accauuucuugag

SEQ ID NO: 731861 - RNA, 22 nt, Human
aaugauaacuggaaacuucagc

SEQ ID NO: 731862 - RNA, 18 nt, Human
aaauaacaaugaaaguug

SEQ ID NO: 731863 - RNA, 13 nt, Human
aaagcugaaaugg

SEQ ID NO: 731864 - RNA, 18 nt, Human
aauguguucauucuggaa

SEQ ID NO: 731865 - RNA, 16 nt, Human
uaaguaaugauaacug

SEQ ID NO: 731866 - RNA, 20 nt, Human
gugauugauuauaugucacu

SEQ ID NO: 731867 - RNA, 15 nt, Human
gucaccucauggaau

SEQ ID NO: 731868 - RNA, 13 nt, Human
uauuauguuaaaa

SEQ ID NO: 731869 - RNA, 20 nt, Human
uauuuuuuaaaaaaauucca

SEQ ID NO: 731870 - RNA, 13 nt, Human
ggaauuggagcuc

SEQ ID NO: 731871 - RNA, 14 nt, Human
uucugaagaagaug

SEQ ID NO: 731872 - RNA, 10 nt, Human
uucacauuua

SEQ ID NO: 731873 - RNA, 19 nt, Human
uucccuugaugaagaaguu

SEQ ID NO: 731874 - RNA, 14 nt, Human
ucucauuuccaagc

SEQ ID NO: 731875 - RNA, 14 nt, Human
accacaagacugca

SEQ ID NO: 731876 - RNA, 15 nt, Human
uggacgagaaaacaa

SEQ ID NO: 731877 - RNA, 21 nt, Human
cuaccaaaaaucucaauauuu

SEQ ID NO: 731878 - RNA, 21 nt, Human
auaugcucuaaacauguuuau

SEQ ID NO: 731879 - RNA, 20 nt, Human
uaaaacaagcacuaaacaaa

SEQ ID NO: 731880 - RNA, 14 nt, Human
uuauuauauuuaca

SEQ ID NO: 731881 - RNA, 15 nt, Human
aagccagauuuuccu

SEQ ID NO: 731882 - RNA, 21 nt, Human
gccuuuucccaacuccagaaa

SEQ ID NO: 731883 - RNA, 19 nt, Human
ucaauucuugccaaauaua

SEQ ID NO: 731884 - RNA, 15 nt, Human
ccagauccuggaaau

SEQ ID NO: 731885 - RNA, 22 nt, Human
uguugcccacagcuguaugauu

SEQ ID NO: 731886 - RNA, 18 nt, Human
uggagggaagccuugggg

SEQ ID NO: 731887 - RNA, 20 nt, Human
accucauggaauuggagcuc

SEQ ID NO: 731888 - RNA, 16 nt, Human
cugagcauuuaauaug

SEQ ID NO: 731889 - RNA, 14 nt, Human
cacuaaacaaagag

SEQ ID NO: 731890 - RNA, 15 nt, Human
agugacaagcucaca

SEQ ID NO: 731891 - RNA, 23 nt, Human
agcaugucgucaaagcugaaaug

SEQ ID NO: 731892 - RNA, 16 nt, Human
gcuucacuguaaaaua

SEQ ID NO: 731893 - RNA, 12 nt, Human
agaaaacaauaa

SEQ ID NO: 731894 - RNA, 14 nt, Human
uauaauuuaaauau

SEQ ID NO: 731895 - RNA, 12 nt, Human
uauuauuuuuua

SEQ ID NO: 731896 - RNA, 18 nt, Human
ucucuaggaaauauuuau

SEQ ID NO: 731897 - RNA, 12 nt, Human
cagauuuuccug

SEQ ID NO: 731898 - RNA, 14 nt, Human
uccagauccuggaa

SEQ ID NO: 731899 - RNA, 15 nt, Human
uauuuauuuuaauaa

SEQ ID NO: 731900 - RNA, 13 nt, Human
aggaaaaaauaac

SEQ ID NO: 731901 - RNA, 15 nt, Human
auaauuuugugaagc

SEQ ID NO: 731902 - RNA, 21 nt, Human
uaaaagacagugaaagaaaau

SEQ ID NO: 731903 - RNA, 16 nt, Human
aaaauaauccucaguu

SEQ ID NO: 731904 - RNA, 21 nt, Human
uuuauauaagcuuguauuccu

SEQ ID NO: 731905 - RNA, 16 nt, Human
uaaaggaauuuaaaaa

SEQ ID NO: 731906 - RNA, 17 nt, Human
aggguguguaaguagau

SEQ ID NO: 731907 - RNA, 22 nt, Human
gauaaaagacagugaaagaaaa

SEQ ID NO: 731908 - RNA, 14 nt, Human
uaaauaaaaauaau

SEQ ID NO: 731909 - RNA, 21 nt, Human
agcccuucuuuccacagaagc

SEQ ID NO: 731910 - RNA, 17 nt, Human
cucuuuugggauuuuug

SEQ ID NO: 731911 - RNA, 20 nt, Human
caagccuccuuuuaaaguaa

SEQ ID NO: 731912 - RNA, 22 nt, Human
gcuaaaacaagcacuaaacaaa

SEQ ID NO: 731913 - RNA, 13 nt, Human
uucuauaauuuaa

SEQ ID NO: 731914 - RNA, 18 nt, Human
uuauuacuguaagaaaau

SEQ ID NO: 731915 - RNA, 18 nt, Human
auaaaguguuugaaagcu

SEQ ID NO: 731916 - RNA, 14 nt, Human
aauuguauuacaaa

SEQ ID NO: 731917 - RNA, 22 nt, Human
ugaagcaaaauuuuuucucuag

SEQ ID NO: 731918 - RNA, 23 nt, Human
cuugauaaauggcuuccuggcaa

SEQ ID NO: 731919 - RNA, 19 nt, Human
uaucacuugucaauaaaau

SEQ ID NO: 731920 - RNA, 18 nt, Human
auuuauuacuguaagaaa

SEQ ID NO: 731921 - RNA, 18 nt, Human
guuuaugguuguauuauu

SEQ ID NO: 731922 - RNA, 15 nt, Human
gaaagaaaauaacga

SEQ ID NO: 731923 - RNA, 11 nt, Human
auaauuuaaau

SEQ ID NO: 731924 - RNA, 14 nt, Human
aaugauuaugaauu

SEQ ID NO: 731925 - RNA, 12 nt, Human
auaacuggaaac

SEQ ID NO: 731926 - RNA, 19 nt, Human
aagcauuccaacuaucuca

SEQ ID NO: 731927 - RNA, 19 nt, Human
auaaaagacaaggaaaaaa

SEQ ID NO: 731928 - RNA, 20 nt, Human
aguuuuuuuuuaaaaaagaa

SEQ ID NO: 731929 - RNA, 21 nt, Human
auuccuuuuucucuccucucc

SEQ ID NO: 731930 - RNA, 13 nt, Human
auaacuggaaacu

SEQ ID NO: 731931 - RNA, 21 nt, Human
uauacugugugcuaaaacaag

SEQ ID NO: 731932 - RNA, 19 nt, Human
aaaagacagugaaagaaaa

SEQ ID NO: 731933 - RNA, 17 nt, Human
guauuauuuuuuaaaaa

SEQ ID NO: 731934 - RNA, 15 nt, Human
caaggaaaaaauaac

SEQ ID NO: 731935 - RNA, 14 nt, Human
aaauauaaauaaaa

SEQ ID NO: 731936 - RNA, 14 nt, Human
auaaauaaaaauaa

SEQ ID NO: 731937 - RNA, 17 nt, Human
auaauuuaaauauaugc

SEQ ID NO: 731938 - RNA, 16 nt, Human
aauaaaguguuugaaa

SEQ ID NO: 731939 - RNA, 22 nt, Human
auauaaauaaaaauaauccuca

SEQ ID NO: 731940 - RNA, 19 nt, Human
auucccagccagcacagcc

SEQ ID NO: 731941 - RNA, 23 nt, Human
aguaauuggaaaggcagcucuaa

SEQ ID NO: 731942 - RNA, 22 nt, Human
auauaugcuaagucuuauauau

SEQ ID NO: 731943 - RNA, 23 nt, Human
auguuaaaacugggacaggggag

SEQ ID NO: 731944 - RNA, 22 nt, Human
uuuaauaauguuucaaacauau

SEQ ID NO: 731945 - RNA, 19 nt, Human
aagcuuguauuccuuuuuc

SEQ ID NO: 731946 - RNA, 17 nt, Human
ccccaguuguuucuacu

SEQ ID NO: 731947 - RNA, 22 nt, Human
guacacugccuucucaacucca

SEQ ID NO: 731948 - RNA, 17 nt, Human
aaagaaacauuugguaa

SEQ ID NO: 731949 - RNA, 18 nt, Human
aaaagacaaggaaaaaau

SEQ ID NO: 731950 - RNA, 13 nt, Human
caguuauuauauu

SEQ ID NO: 731951 - RNA, 20 nt, Human
aaaagacagugaaagaaaau

SEQ ID NO: 731952 - RNA, 14 nt, Human
acagaauuuuaugc

SEQ ID NO: 731953 - RNA, 15 nt, Human
caaauccaaugaaau

SEQ ID NO: 731954 - RNA, 19 nt, Human
uaucucauuuccaagcaag

SEQ ID NO: 731955 - RNA, 22 nt, Human
uugaaaaucuuauaauuuaaaa

SEQ ID NO: 731956 - RNA, 20 nt, Human
ucauucacucaacaaacaua

SEQ ID NO: 731957 - RNA, 23 nt, Human
ugaauuauguuugcauguucacu

SEQ ID NO: 731958 - RNA, 14 nt, Human
auuuucuauaauuu

SEQ ID NO: 731959 - RNA, 15 nt, Human
uuagugaaauauuau

SEQ ID NO: 731960 - RNA, 18 nt, Human
gaugcaguucugaagaag

SEQ ID NO: 731961 - RNA, 15 nt, Human
cuguaaaauaauaac

SEQ ID NO: 731962 - RNA, 23 nt, Human
ggaugguucccuugaugaagaag

SEQ ID NO: 731963 - RNA, 13 nt, Human
uuauguuuaauuc

SEQ ID NO: 731964 - RNA, 19 nt, Human
agucaaauugugugaaagg

SEQ ID NO: 731965 - RNA, 16 nt, Human
uuuauauuugaaauau

SEQ ID NO: 731966 - RNA, 16 nt, Human
acaugaacuuguaaag

SEQ ID NO: 731967 - RNA, 21 nt, Human
cuucucacauuuauauuuuug

SEQ ID NO: 731968 - RNA, 19 nt, Human
augaauuacauuuguauaa

SEQ ID NO: 731969 - RNA, 16 nt, Human
aggguguguaaguaga

SEQ ID NO: 731970 - RNA, 23 nt, Human
gaaaaucuuauaauuuaaaauau

SEQ ID NO: 731971 - RNA, 13 nt, Human
aucucaauauuuc

SEQ ID NO: 731972 - RNA, 13 nt, Human
aagacaaggaaaa

SEQ ID NO: 731973 - RNA, 14 nt, Human
aaucucaauauuuc

SEQ ID NO: 731974 - RNA, 20 nt, Human
uuugcaagccagauuuuccu

SEQ ID NO: 731975 - RNA, 16 nt, Human
aaaaauuccaagugau

SEQ ID NO: 731976 - RNA, 14 nt, Human
uauuuauuuuaaua

SEQ ID NO: 731977 - RNA, 21 nt, Human
aauucauucacucaacaaaca

SEQ ID NO: 731978 - RNA, 23 nt, Human
aacuuguaaaggaauuuaaaaau

SEQ ID NO: 731979 - RNA, 19 nt, Human
uuuccugaaaacccuugcc

SEQ ID NO: 731980 - RNA, 23 nt, Human
ggcuaagcuucacuguaaaauaa

SEQ ID NO: 731981 - RNA, 14 nt, Human
acgagaaaacaaua

SEQ ID NO: 731982 - RNA, 17 nt, Human
ugcacaucaaaauaugc

SEQ ID NO: 731983 - RNA, 14 nt, Human
aauauuauguuaaa

SEQ ID NO: 731984 - RNA, 18 nt, Human
gcuccauuuuuagugaaa

SEQ ID NO: 731985 - RNA, 14 nt, Human
auugucuagugaaa

SEQ ID NO: 731986 - RNA, 17 nt, Human
cagugaaagaaaauaac

SEQ ID NO: 731987 - RNA, 17 nt, Human
uaacugauuuguaacaa

SEQ ID NO: 731988 - RNA, 14 nt, Human
acaaauccaaugaa

SEQ ID NO: 731989 - RNA, 22 nt, Human
aaacauguuuaucguauuugau

SEQ ID NO: 731990 - RNA, 16 nt, Human
cuuauaauuuaaaaua

SEQ ID NO: 731991 - RNA, 20 nt, Human
agccuuuuuuugaaaaaaag

SEQ ID NO: 731992 - RNA, 18 nt, Human
uacuuuauuuucuauaau

SEQ ID NO: 731993 - RNA, 18 nt, Human
caguuguugcccacagcu

SEQ ID NO: 731994 - RNA, 16 nt, Human
caauaacgauaaaaga

SEQ ID NO: 731995 - RNA, 12 nt, Human
gguuuauauaag

SEQ ID NO: 731996 - RNA, 22 nt, Human
gaugcaguucugaagaagaugg

SEQ ID NO: 731997 - RNA, 17 nt, Human
auguugacaugggacau

SEQ ID NO: 731998 - RNA, 23 nt, Human
uagauaggucagugcaaauacuc

SEQ ID NO: 731999 - RNA, 16 nt, Human
accucugccucagaaa

SEQ ID NO: 732000 - RNA, 21 nt, Human
ccaaauauaaauaaaaauaau

SEQ ID NO: 732001 - RNA, 16 nt, Human
cugcucucaguucacu

SEQ ID NO: 732002 - RNA, 15 nt, Human
agaaaacaauaacga

SEQ ID NO: 732003 - RNA, 16 nt, Human
uuuucucuaggaaaua

SEQ ID NO: 732004 - RNA, 14 nt, Human
guaacuaauuuuaa

SEQ ID NO: 732005 - RNA, 13 nt, Human
auuggacaguaaa

SEQ ID NO: 732006 - RNA, 21 nt, Human
uuuucaggcuagauguaugua

SEQ ID NO: 732007 - RNA, 21 nt, Human
gcacuguggguagacacacau

SEQ ID NO: 732008 - RNA, 20 nt, Human
auaacaaugcuguauuuuaa

SEQ ID NO: 732009 - RNA, 16 nt, Human
uccuguaauggaagca

SEQ ID NO: 732010 - RNA, 23 nt, Human
uuguaacaagccuccuuuuaaag

SEQ ID NO: 732011 - RNA, 17 nt, Human
ugaaaaucuuauaauuu

SEQ ID NO: 732012 - RNA, 22 nt, Human
cccaugauguuuagaaacacaa

SEQ ID NO: 732013 - RNA, 18 nt, Human
cagcuuauugucuaguga

SEQ ID NO: 732014 - RNA, 17 nt, Human
gaaugagagacacacug

SEQ ID NO: 732015 - RNA, 15 nt, Human
aaggaauuuaaaaau

SEQ ID NO: 732016 - RNA, 22 nt, Human
gaugcaguuguugcccacagcu

SEQ ID NO: 732017 - RNA, 19 nt, Human
ggaaaaaauaacaaugaaa

SEQ ID NO: 732018 - RNA, 14 nt, Human
acauagugaggagc

SEQ ID NO: 732019 - RNA, 22 nt, Human
aaaucaggguuaguauugucca

SEQ ID NO: 732020 - RNA, 16 nt, Human
aaaguguuugaaagcu

SEQ ID NO: 732021 - RNA, 13 nt, Human
acaaggaaaaaau

SEQ ID NO: 732022 - RNA, 20 nt, Human
gaaaauaacgauaaaagaca

SEQ ID NO: 732023 - RNA, 15 nt, Human
aaauaauuuuuauau

SEQ ID NO: 732024 - RNA, 21 nt, Human
aaaauuuuuucucuaggaaau

SEQ ID NO: 732025 - RNA, 16 nt, Human
ugcacaucaaaauaug

SEQ ID NO: 732026 - RNA, 12 nt, Human
aauuuaaauaua

SEQ ID NO: 732027 - RNA, 15 nt, Human
uuuagugaaauauua

SEQ ID NO: 732028 - RNA, 15 nt, Human
aagcacuaaacaaag

SEQ ID NO: 732029 - RNA, 20 nt, Human
ugauuucugagcauuuaaua

SEQ ID NO: 732030 - RNA, 15 nt, Human
ucacaggacagcccu

SEQ ID NO: 732031 - RNA, 15 nt, Human
gccccauucaacauc

SEQ ID NO: 732032 - RNA, 22 nt, Human
aauuuuuucucuaggaaauauu

SEQ ID NO: 732033 - RNA, 13 nt, Human
gacaaggaaaaaa

SEQ ID NO: 732034 - RNA, 13 nt, Human
aguuaccucugcc

SEQ ID NO: 732035 - RNA, 14 nt, Human
augggccauaugaa

SEQ ID NO: 732036 - RNA, 14 nt, Human
aaauauuauuuuau

SEQ ID NO: 732037 - RNA, 17 nt, Human
aaauauaaauaaaaaua

SEQ ID NO: 732038 - RNA, 15 nt, Human
augaauuaaguuuuu

SEQ ID NO: 732039 - RNA, 21 nt, Human
cuaagcuucacuguaaaauaa

SEQ ID NO: 732040 - RNA, 15 nt, Human
auauugacuuuuuau

SEQ ID NO: 732041 - RNA, 18 nt, Human
acaugaacuuguaaagga

SEQ ID NO: 732042 - RNA, 17 nt, Human
ugaaggauuuauguuua

SEQ ID NO: 732043 - RNA, 12 nt, Human
uguuugaaagcu

SEQ ID NO: 732044 - RNA, 17 nt, Human
auuuucuauaauuuaaa

SEQ ID NO: 732045 - RNA, 13 nt, Human
ugcauuucuaaag

SEQ ID NO: 732046 - RNA, 14 nt, Human
acauauauaacaau

SEQ ID NO: 732047 - RNA, 16 nt, Human
aagaaaauaacaauaa

SEQ ID NO: 732048 - RNA, 17 nt, Human
augauuaaguaaugaua

SEQ ID NO: 732049 - RNA, 23 nt, Human
uguugcccacagcuguaugauuc

SEQ ID NO: 732050 - RNA, 14 nt, Human
uucacauuuaaaua

SEQ ID NO: 732051 - RNA, 23 nt, Human
uccagguagaggguguguaagua

SEQ ID NO: 732052 - RNA, 13 nt, Human
agaaguaaaaaca

SEQ ID NO: 732053 - RNA, 17 nt, Human
aauaacgauaaaagaca

SEQ ID NO: 732054 - RNA, 20 nt, Human
acagcccuucuuuccacaga

SEQ ID NO: 732055 - RNA, 22 nt, Human
aagagccuuuuuuugaaaaaaa

SEQ ID NO: 732056 - RNA, 19 nt, Human
gucuuucacauuuaaauaa

SEQ ID NO: 732057 - RNA, 22 nt, Human
uauuucagauaaucacaauaca

SEQ ID NO: 732058 - RNA, 23 nt, Human
ucuaccaaaaaucucaauauuuc

SEQ ID NO: 732059 - RNA, 20 nt, Human
aagaugguaccaccagucug

SEQ ID NO: 732060 - RNA, 15 nt, Human
aaaauaacaaugaaa

SEQ ID NO: 732061 - RNA, 13 nt, Human
aacaauaaaagac

SEQ ID NO: 732062 - RNA, 19 nt, Human
guccaggucuaccaaaaau

SEQ ID NO: 732063 - RNA, 12 nt, Human
auuuuaaaagaa

SEQ ID NO: 732064 - RNA, 17 nt, Human
auuauuuuuuaaaaaaa

SEQ ID NO: 732065 - RNA, 18 nt, Human
auguuaaaacugggacag

SEQ ID NO: 732066 - RNA, 16 nt, Human
ugaaguccaagcauuu

SEQ ID NO: 732067 - RNA, 17 nt, Human
gucaaagcugaaaugga

SEQ ID NO: 732068 - RNA, 19 nt, Human
auaaaagacagugaaagaa

SEQ ID NO: 732069 - RNA, 19 nt, Human
cuuccagauccuggaaauc

SEQ ID NO: 732070 - RNA, 19 nt, Human
aaaaucuuauaauuuaaaa

SEQ ID NO: 732071 - RNA, 16 nt, Human
uuuuagugaaauauua

SEQ ID NO: 732072 - RNA, 19 nt, Human
aauuuuuauauuugaaaua

SEQ ID NO: 732073 - RNA, 18 nt, Human
caugaauuaguuuuauau

SEQ ID NO: 732074 - RNA, 18 nt, Human
aagaccucauuuugaagg

SEQ ID NO: 732075 - RNA, 12 nt, Human
gaauuggagcuc

SEQ ID NO: 732076 - RNA, 22 nt, Human
ugaguuuuucuuuucauuuacc

SEQ ID NO: 732077 - RNA, 15 nt, Human
uucacuguaaaauaa

SEQ ID NO: 732078 - RNA, 16 nt, Human
uuaauaauuuuuaauu

SEQ ID NO: 732079 - RNA, 17 nt, Human
gacgagaaaacaauaac

SEQ ID NO: 732080 - RNA, 19 nt, Human
uguaguguuggagaagaac

SEQ ID NO: 732081 - RNA, 20 nt, Human
cuaaaugucaaucagccuag

SEQ ID NO: 732082 - RNA, 18 nt, Human
uaaaagacagugaaagaa

SEQ ID NO: 732083 - RNA, 11 nt, Human
uuauauuuauu

SEQ ID NO: 732084 - RNA, 22 nt, Human
auauauaacaaugcuguauuuu

SEQ ID NO: 732085 - RNA, 14 nt, Human
ugcucauggaauug

SEQ ID NO: 732086 - RNA, 22 nt, Human
aauaauccuaaacauaugaauu

SEQ ID NO: 732087 - RNA, 15 nt, Human
cucguggaacaguua

SEQ ID NO: 732088 - RNA, 15 nt, Human
cuuaagaagacugca

SEQ ID NO: 732089 - RNA, 15 nt, Human
cucgugggacaguca

SEQ ID NO: 732090 - RNA, 20 nt, Human
aauuaaguuuuuuuuuaaaa

SEQ ID NO: 732091 - RNA, 15 nt, Human
acagugaaagaaaau

SEQ ID NO: 732092 - RNA, 19 nt, Human
aaacaauaacgauaaaaga

SEQ ID NO: 732093 - RNA, 16 nt, Human
aagcauuuagauguau

SEQ ID NO: 732094 - RNA, 20 nt, Human
agaagaacugaaaucauacu

SEQ ID NO: 732095 - RNA, 20 nt, Human
uaaaagacaaggaaaaaaua

SEQ ID NO: 732096 - RNA, 21 nt, Human
ugaugcuacaggauuugaaau

SEQ ID NO: 732097 - RNA, 23 nt, Human
gggaaacaaaaggauaaugaaua

SEQ ID NO: 732098 - RNA, 16 nt, Human
aagcuucacuguaaaa

SEQ ID NO: 732099 - RNA, 17 nt, Human
ucauacuucuuaggguu

SEQ ID NO: 732100 - RNA, 22 nt, Human
aauaugccccauucaacaucua

SEQ ID NO: 732101 - RNA, 17 nt, Human
cucguggaacaguuacc

SEQ ID NO: 732102 - RNA, 22 nt, Human
gcacagccucuuagaugcaguu

SEQ ID NO: 732103 - RNA, 12 nt, Human
uucucuaggaaa

SEQ ID NO: 732104 - RNA, 13 nt, Human
uaugaaauauuau

SEQ ID NO: 732105 - RNA, 16 nt, Human
uuauaauuuaaaauau

SEQ ID NO: 732106 - RNA, 15 nt, Human
cucaacaaacauaau

SEQ ID NO: 732107 - RNA, 16 nt, Human
acauuugcucauggaa

SEQ ID NO: 732108 - RNA, 21 nt, Human
auuauauggcuugaguuuaaa

SEQ ID NO: 732109 - RNA, 12 nt, Human
auauaaauaaaa

SEQ ID NO: 732110 - RNA, 18 nt, Human
uuuucucuccucucccca

SEQ ID NO: 732111 - RNA, 18 nt, Human
gaaaauaacgauaaaaga

SEQ ID NO: 732112 - RNA, 17 nt, Human
uuauuacuguaagaaaa

SEQ ID NO: 732113 - RNA, 20 nt, Human
aagucuuucacauuuaaaua

SEQ ID NO: 732114 - RNA, 15 nt, Human
cacaggacagcccuu

SEQ ID NO: 732115 - RNA, 12 nt, Human
gaagaccucauu

SEQ ID NO: 732116 - RNA, 15 nt, Human
acugaagaagcacca

SEQ ID NO: 732117 - RNA, 18 nt, Human
auuuuaacucuauaaugu

SEQ ID NO: 732118 - RNA, 19 nt, Human
caugaguaacugauuugua

SEQ ID NO: 732119 - RNA, 16 nt, Human
acaugaaguccaagca

SEQ ID NO: 732120 - RNA, 19 nt, Human
aaaauaacaauaaaagaca

SEQ ID NO: 732121 - RNA, 18 nt, Human
aaagagugaaggauuuau

SEQ ID NO: 732122 - RNA, 23 nt, Human
auauaacaaugcuguauuuuaaa

SEQ ID NO: 732123 - RNA, 18 nt, Human
uuuugugaagcaaaauuu

SEQ ID NO: 732124 - RNA, 15 nt, Human
cuuuucccaacucca

SEQ ID NO: 732125 - RNA, 17 nt, Human
uuauauuugaaauauug

SEQ ID NO: 732126 - RNA, 18 nt, Human
aaaaucuuauaauuuaaa

SEQ ID NO: 732127 - RNA, 19 nt, Human
uuauggcacuaguauuucu

SEQ ID NO: 732128 - RNA, 18 nt, Human
ugcauagguuuaauaauu

SEQ ID NO: 732129 - RNA, 14 nt, Human
auuucuaugaaaua

SEQ ID NO: 732130 - RNA, 13 nt, Human
caacaucuaguga

SEQ ID NO: 732131 - RNA, 14 nt, Human
auuguccaggucua

SEQ ID NO: 732132 - RNA, 18 nt, Human
auuaaguuuuuuuuuaaa

SEQ ID NO: 732133 - RNA, 19 nt, Human
gcacuaguauuucuaugaa

SEQ ID NO: 732134 - RNA, 13 nt, Human
uuuaaaaauccua

SEQ ID NO: 732135 - RNA, 12 nt, Human
cucauggaauug

SEQ ID NO: 732136 - RNA, 13 nt, Human
auaaauaaaaaua

SEQ ID NO: 732137 - RNA, 14 nt, Human
uaaaauccauacau

SEQ ID NO: 732138 - RNA, 17 nt, Human
aauaacaauaaaagaca

SEQ ID NO: 732139 - RNA, 16 nt, Human
aaaagcaucacaugaa

SEQ ID NO: 732140 - RNA, 12 nt, Human
ggcugaugcagu

SEQ ID NO: 732141 - RNA, 21 nt, Human
aguuguugcccacagcuguau

SEQ ID NO: 732142 - RNA, 18 nt, Human
acaaaaggauaaugaaua

SEQ ID NO: 732143 - RNA, 13 nt, Human
aaaguguuugaaa

SEQ ID NO: 732144 - RNA, 15 nt, Human
ucuaugaaauauuau

SEQ ID NO: 732145 - RNA, 11 nt, Human
aauuuaaauau

SEQ ID NO: 732146 - RNA, 13 nt, Human
ugauuauauguca

SEQ ID NO: 732147 - RNA, 19 nt, Human
auagcuacuaauuuuaaaa

SEQ ID NO: 732148 - RNA, 21 nt, Human
acaguuaccucugccucagaa

SEQ ID NO: 732149 - RNA, 23 nt, Human
cuacacgagauacagaauuuuau

SEQ ID NO: 732150 - RNA, 16 nt, Human
uucaguuauuauauuu

SEQ ID NO: 732151 - RNA, 13 nt, Human
uacuuuauuuucu

SEQ ID NO: 732152 - RNA, 19 nt, Human
uguuggacgagaaaacaau

SEQ ID NO: 732153 - RNA, 16 nt, Human
aacuugguuuuaauua

SEQ ID NO: 732154 - RNA, 16 nt, Human
aacaauaaaagacaag

SEQ ID NO: 732155 - RNA, 13 nt, Human
aaaauaacgauaa

SEQ ID NO: 732156 - RNA, 15 nt, Human
cuacuaauuuuaaaa

SEQ ID NO: 732157 - RNA, 14 nt, Human
guaacugauuugua

SEQ ID NO: 732158 - RNA, 15 nt, Human
acaaaugggaaacaa

SEQ ID NO: 732159 - RNA, 18 nt, Human
uuacaaaugggaaacaaa

SEQ ID NO: 732160 - RNA, 16 nt, Human
gccaugugcuaguaau

SEQ ID NO: 732161 - RNA, 22 nt, Human
caccagucugacuguuuccauc

SEQ ID NO: 732162 - RNA, 23 nt, Human
uaauuuguaguguuggagaagaa

SEQ ID NO: 732163 - RNA, 23 nt, Human
uggcuugaguuuaaauuguaaua

SEQ ID NO: 732164 - RNA, 17 nt, Human
cauuuguauaaaauaau

SEQ ID NO: 732165 - RNA, 23 nt, Human
ucuagcaugucgucaaagcugaa

SEQ ID NO: 732166 - RNA, 20 nt, Human
cacuguggguagacacacau

SEQ ID NO: 732167 - RNA, 14 nt, Human
ucccuugaugaaga

SEQ ID NO: 732168 - RNA, 22 nt, Human
aaauguugacaugggacauuug

SEQ ID NO: 732169 - RNA, 20 nt, Human
acuuuauuuucuauaauuua

SEQ ID NO: 732170 - RNA, 14 nt, Human
uuuuaaaaaagaaa

SEQ ID NO: 732171 - RNA, 12 nt, Human
uauaauuuaaaa

SEQ ID NO: 732172 - RNA, 22 nt, Human
agcuuguauuccuuuuucucuc

SEQ ID NO: 732173 - RNA, 22 nt, Human
cugggacaggggagaaccuagg

SEQ ID NO: 732174 - RNA, 16 nt, Human
uaaaagacaaggaaaa

SEQ ID NO: 732175 - RNA, 18 nt, Human
cauagguuuaauaauuuu

SEQ ID NO: 732176 - RNA, 23 nt, Human
caugcugucuacacuaagagaga

SEQ ID NO: 732177 - RNA, 16 nt, Human
ucuuauaauuuaaaau

SEQ ID NO: 732178 - RNA, 23 nt, Human
augucaauucuugccaaauauaa

SEQ ID NO: 732179 - RNA, 13 nt, Human
auugucuagugaa

SEQ ID NO: 732180 - RNA, 13 nt, Human
uuggacgagaaaa

SEQ ID NO: 732181 - RNA, 21 nt, Human
caagacugcacaucaaaauau

SEQ ID NO: 732182 - RNA, 14 nt, Human
ucuaggaaauauuu

SEQ ID NO: 732183 - RNA, 21 nt, Human
aaacgaggauugggaaaaagu

SEQ ID NO: 732184 - RNA, 23 nt, Human
uauguuaaaacugggacagggga

SEQ ID NO: 732185 - RNA, 23 nt, Human
uuuauaugcuucuguuuuauaau

SEQ ID NO: 732186 - RNA, 13 nt, Human
acuaauuuuaaaa

SEQ ID NO: 732187 - RNA, 20 nt, Human
uaacaagccuccuuuuaaag

SEQ ID NO: 732188 - RNA, 18 nt, Human
uuuauggcacuaguauuu

SEQ ID NO: 732189 - RNA, 15 nt, Human
uaacaauaaaagaca

SEQ ID NO: 732190 - RNA, 17 nt, Human
ugaacuugguuuuaauu

SEQ ID NO: 732191 - RNA, 11 nt, Human
caucuagugag

SEQ ID NO: 732192 - RNA, 16 nt, Human
ugacaagcucacagac

SEQ ID NO: 732193 - RNA, 18 nt, Human
cuccauuuuuagugaaau

SEQ ID NO: 732194 - RNA, 20 nt, Human
uaugcuucuguuuuauaauu

SEQ ID NO: 732195 - RNA, 15 nt, Human
gccucuuagaugcag

SEQ ID NO: 732196 - RNA, 16 nt, Human
uacauuuguauaaaau

SEQ ID NO: 732197 - RNA, 13 nt, Human
aagaaaauaacga

SEQ ID NO: 732198 - RNA, 16 nt, Human
uaaauaaaaauaaucc

SEQ ID NO: 732199 - RNA, 13 nt, Human
aaaugggaaacaa

SEQ ID NO: 732200 - RNA, 12 nt, Human
acugaaaucaua

SEQ ID NO: 732201 - RNA, 21 nt, Human
aaauaauuuuuauauuugaaa

SEQ ID NO: 732202 - RNA, 16 nt, Human
auuugaugcuacagga

SEQ ID NO: 732203 - RNA, 17 nt, Human
uucacuguaaaauaaua

SEQ ID NO: 732204 - RNA, 21 nt, Human
gauaaaagacagugaaagaaa

SEQ ID NO: 732205 - RNA, 23 nt, Human
ggaugaauuaaguuuuuuuuuaa

SEQ ID NO: 732206 - RNA, 21 nt, Human
caaggaaaaaauaacaaugaa

SEQ ID NO: 732207 - RNA, 14 nt, Human
cuaagcauuccaac

SEQ ID NO: 732208 - RNA, 15 nt, Human
uugcucauggaauug

SEQ ID NO: 732209 - RNA, 18 nt, Human
acucuuaagaagacugca

SEQ ID NO: 732210 - RNA, 24 nt, Human
cauaugaaaaggcuaagcuucacu

SEQ ID NO: 732211 - RNA, 13 nt, Human
cacuguaaaauaa

SEQ ID NO: 732212 - RNA, 20 nt, Human
augcuucuguuuuauaauuu

SEQ ID NO: 732213 - RNA, 20 nt, Human
aaaaucuuauaauuuaaaau

SEQ ID NO: 732214 - RNA, 13 nt, Human
ugaaauuguauua

SEQ ID NO: 732215 - RNA, 17 nt, Human
caagccuccuuuuaaag

SEQ ID NO: 732216 - RNA, 15 nt, Human
aaaaaauaacaauga

SEQ ID NO: 732217 - RNA, 15 nt, Human
agacaaggaaaaaau

SEQ ID NO: 732218 - RNA, 14 nt, Human
uauaaauaaaaaua

SEQ ID NO: 732219 - RNA, 15 nt, Human
aagccuccuuuuaaa

SEQ ID NO: 732220 - RNA, 12 nt, Human
cuugguuuuaau

SEQ ID NO: 732221 - RNA, 18 nt, Human
aagucuuucacauuuaaa

SEQ ID NO: 732222 - RNA, 11 nt, Human
auuuuugaagc

SEQ ID NO: 732223 - RNA, 18 nt, Human
auuuguauaaaauaauuu

SEQ ID NO: 732224 - RNA, 21 nt, Human
cacaugaacuuguaaaggaau

SEQ ID NO: 732225 - RNA, 20 nt, Human
uuccacagaagcuccaggua

SEQ ID NO: 732226 - RNA, 17 nt, Human
guuuaauucugaaagca

SEQ ID NO: 732227 - RNA, 21 nt, Human
cauuuucuucucacauuuaua

SEQ ID NO: 732228 - RNA, 16 nt, Human
aaaugggaaacaaaag

SEQ ID NO: 732229 - RNA, 18 nt, Human
acaaaugggaaacaaaag

SEQ ID NO: 732230 - RNA, 19 nt, Human
uucccuugaugaagaaguu

SEQ ID NO: 732231 - RNA, 23 nt, Human
auuauauggcuugaguuuaaauu

SEQ ID NO: 732232 - RNA, 22 nt, Human
aaagacagugaaagaaaauaac

SEQ ID NO: 732233 - RNA, 19 nt, Human
uggaacaguuaccucugcc

SEQ ID NO: 732234 - RNA, 15 nt, Human
aaaagacaaggaaaa

SEQ ID NO: 732235 - RNA, 20 nt, Human
auacugugugcuaaaacaag

SEQ ID NO: 732236 - RNA, 22 nt, Human
accaaucaugaauuaguuuuau

SEQ ID NO: 732237 - RNA, 22 nt, Human
caauaaaagacaaggaaaaaau

SEQ ID NO: 732238 - RNA, 17 nt, Human
auauuugaaauauugac

SEQ ID NO: 732239 - RNA, 20 nt, Human
aagcuucacuguaaaauaau

SEQ ID NO: 732240 - RNA, 20 nt, Human
auucccagccagcacagccu

SEQ ID NO: 732241 - RNA, 20 nt, Human
uauaugcuaagucuuauaua

SEQ ID NO: 732242 - RNA, 16 nt, Human
uugucaauaaaaucca

SEQ ID NO: 732243 - RNA, 22 nt, Human
ugggcacuguggguagacacac

SEQ ID NO: 732244 - RNA, 13 nt, Human
uuuaaaaaagaaa

SEQ ID NO: 732245 - RNA, 19 nt, Human
agaaaauaacaauaaaaga

SEQ ID NO: 732246 - RNA, 16 nt, Human
uuucuauaauuuaaau

SEQ ID NO: 732247 - RNA, 16 nt, Human
aaauauuauguuaaaa

SEQ ID NO: 732248 - RNA, 21 nt, Human
agggugauauuaaccaggggc

SEQ ID NO: 732249 - RNA, 18 nt, Human
aaguugauaugccuuuuc

SEQ ID NO: 732250 - RNA, 16 nt, Human
ccauuuuuagugaaau

SEQ ID NO: 732251 - RNA, 17 nt, Human
uaauuuuuauauuugaa

SEQ ID NO: 732252 - RNA, 12 nt, Human
gcugaugcaguu

SEQ ID NO: 732253 - RNA, 22 nt, Human
agaaaacaauaacgauaaaaga

SEQ ID NO: 732254 - RNA, 22 nt, Human
agcacagccucuuagaugcagu

SEQ ID NO: 732255 - RNA, 24 nt, Human
cauucuggaauaauccuaaacaua

SEQ ID NO: 732256 - RNA, 14 nt, Human
auuuauguuuaauu

SEQ ID NO: 732257 - RNA, 13 nt, Human
acaauaaaagaca

SEQ ID NO: 732258 - RNA, 17 nt, Human
uaaaagacaaggaaaaa

SEQ ID NO: 732259 - RNA, 15 nt, Human
guaaggggaauugag

SEQ ID NO: 732260 - RNA, 14 nt, Human
auaaaauaauuuuu

SEQ ID NO: 732261 - RNA, 17 nt, Human
caaauauaaauaaaaau

SEQ ID NO: 732262 - RNA, 12 nt, Human
gauaaaagacag

SEQ ID NO: 732263 - RNA, 18 nt, Human
uaaguuuuuuuuuaaaaa

SEQ ID NO: 732264 - RNA, 23 nt, Human
uuuguauaaaauaauuuuuauau

SEQ ID NO: 732265 - RNA, 20 nt, Human
auuacauuuguauaaaauaa

SEQ ID NO: 732266 - RNA, 18 nt, Human
auaauccuaaacauauga

SEQ ID NO: 732267 - RNA, 16 nt, Human
cacuaguauuucuaug

SEQ ID NO: 732268 - RNA, 21 nt, Human
gaaaaguauguuagugcaaau

SEQ ID NO: 732269 - RNA, 20 nt, Human
aacaagccuccuuuuaaagu

SEQ ID NO: 732270 - RNA, 22 nt, Human
uuugaugcuacaggauuugaaa

SEQ ID NO: 732271 - RNA, 13 nt, Human
ucuauaauuuaaa

SEQ ID NO: 732272 - RNA, 14 nt, Human
cauagaaguaaaaa

SEQ ID NO: 732273 - RNA, 23 nt, Human
ugaaaaucuuauaauuuaaaaua

SEQ ID NO: 732274 - RNA, 19 nt, Human
auuauuuuuuaaaaaaauu

SEQ ID NO: 732275 - RNA, 16 nt, Human
guuuuuuuuuaaaaaa

SEQ ID NO: 732276 - RNA, 15 nt, Human
ucuuauaauuuaaaa

SEQ ID NO: 732277 - RNA, 16 nt, Human
acaaggaugaauuaag

SEQ ID NO: 732278 - RNA, 19 nt, Human
gacagucaccucauggaau

SEQ ID NO: 732279 - RNA, 21 nt, Human
aagcuccauuuuuagugaaau

SEQ ID NO: 732280 - RNA, 17 nt, Human
gauaaaagacagugaaa

SEQ ID NO: 732281 - RNA, 15 nt, Human
uccagauccuggaaa

SEQ ID NO: 732282 - RNA, 13 nt, Human
uggacgagaaaac

SEQ ID NO: 732283 - RNA, 19 nt, Human
gugaacuugguuuuaauua

SEQ ID NO: 732284 - RNA, 20 nt, Human
uauacugugugcuaaaacaa

SEQ ID NO: 732285 - RNA, 14 nt, Human
agaaaauaacaaua

SEQ ID NO: 732286 - RNA, 21 nt, Human
aauuuuuauauuugaaauauu

SEQ ID NO: 732287 - RNA, 19 nt, Human
aagucuuucacauuuaaau

SEQ ID NO: 732288 - RNA, 15 nt, Human
acaaggaaaaaauaa

SEQ ID NO: 732289 - RNA, 18 nt, Human
cauggaauuggagcucgu

SEQ ID NO: 732290 - RNA, 16 nt, Human
aaauaacaaugaaagu

SEQ ID NO: 732291 - RNA, 11 nt, Human
cauaugaaaag

SEQ ID NO: 732292 - RNA, 18 nt, Human
aaaguaacccuacaaaac

SEQ ID NO: 732293 - RNA, 21 nt, Human
aaagaaaauaacgauaaaaga

SEQ ID NO: 732294 - RNA, 14 nt, Human
uucuggaauaaucc

SEQ ID NO: 732295 - RNA, 21 nt, Human
uauuauuuuauagcuacuaau

SEQ ID NO: 732296 - RNA, 18 nt, Human
aguucuccacuagcuaug

SEQ ID NO: 732297 - RNA, 15 nt, Human
auuucuaugaaauau

SEQ ID NO: 732298 - RNA, 23 nt, Human
uaacgauaaaagacagugaaaga

SEQ ID NO: 732299 - RNA, 19 nt, Human
ugggacaggggagaaccua

SEQ ID NO: 732300 - RNA, 16 nt, Human
cagggcucacagaauu

SEQ ID NO: 732301 - RNA, 21 nt, Human
uuuuauggcacuaguauuucu

SEQ ID NO: 732302 - RNA, 14 nt, Human
uuuguauaaaauaa

SEQ ID NO: 732303 - RNA, 14 nt, Human
uuucuaugaaauau

SEQ ID NO: 732304 - RNA, 14 nt, Human
uaugaauuacauuu

SEQ ID NO: 732305 - RNA, 23 nt, Human
uuuuauagcuacuaauuuuaaaa

SEQ ID NO: 732306 - RNA, 19 nt, Human
ugaaauuguauuacaaauc

SEQ ID NO: 732307 - RNA, 14 nt, Human
auuugaaauuguau

SEQ ID NO: 732308 - RNA, 21 nt, Human
auuuuuucucuaggaaauauu

SEQ ID NO: 732309 - RNA, 17 nt, Human
aguugauaaguacauga

SEQ ID NO: 732310 - RNA, 14 nt, Human
ucuauaauuuaaau

SEQ ID NO: 732311 - RNA, 16 nt, Human
aaaauaacaauaaaag

SEQ ID NO: 732312 - RNA, 23 nt, Human
uagacacacaugaaguccaagca

SEQ ID NO: 732313 - RNA, 15 nt, Human
uuuaauaauuuuuaa

SEQ ID NO: 732314 - RNA, 23 nt, Human
cuuaagaagacugcauuauauuu

SEQ ID NO: 732315 - RNA, 17 nt, Human
acaaaugcauuucuaaa

SEQ ID NO: 732316 - RNA, 23 nt, Human
ggaacaguuaccucugccucaga

SEQ ID NO: 732317 - RNA, 16 nt, Human
ugcaaauugucacagg

SEQ ID NO: 732318 - RNA, 21 nt, Human
aauaauguuucaaacauauau

SEQ ID NO: 732319 - RNA, 21 nt, Human
cugauauuggacaguaaaauc

SEQ ID NO: 732320 - RNA, 16 nt, Human
auuuguauaaaauaau

SEQ ID NO: 732321 - RNA, 14 nt, Human
aacgauaaaagaca

SEQ ID NO: 732322 - RNA, 17 nt, Human
cucgugggacagucacc

SEQ ID NO: 732323 - RNA, 23 nt, Human
auuucugagcauuuaauauggau

SEQ ID NO: 732324 - RNA, 15 nt, Human
aaauauuuauuuuaa

SEQ ID NO: 732325 - RNA, 13 nt, Human
guaacuaauuuua

SEQ ID NO: 732326 - RNA, 15 nt, Human
aaugauuaugaauua

SEQ ID NO: 732327 - RNA, 18 nt, Human
gaauaauccuaaacauau

SEQ ID NO: 732328 - RNA, 14 nt, Human
acuaauuuuaaaau

SEQ ID NO: 732329 - RNA, 12 nt, Human
cagugaaagaaa

SEQ ID NO: 732330 - RNA, 17 nt, Human
gaagaccucauuuugaa

SEQ ID NO: 732331 - RNA, 17 nt, Human
uugugaagcaaaauuuu

SEQ ID NO: 732332 - RNA, 22 nt, Human
uaaaacaagcacuaaacaaaga

SEQ ID NO: 732333 - RNA, 14 nt, Human
uugccaugugcuag

SEQ ID NO: 732334 - RNA, 17 nt, Human
ucuuauaauuuaaaaua

SEQ ID NO: 732335 - RNA, 15 nt, Human
ccuugccaugugcua

SEQ ID NO: 732336 - RNA, 14 nt, Human
uugugauugauuau

SEQ ID NO: 732337 - RNA, 14 nt, Human
aagagugaaggauu

SEQ ID NO: 732338 - RNA, 17 nt, Human
cuaagcuucacuguaaa

SEQ ID NO: 732339 - RNA, 15 nt, Human
aauauaaauaaaaau

SEQ ID NO: 732340 - RNA, 15 nt, Human
uauaaauaaaaauaa

SEQ ID NO: 732341 - RNA, 23 nt, Human
ugcauagguuuaauaauuuuuaa

SEQ ID NO: 732342 - RNA, 17 nt, Human
aauaaaguguuugaaag

SEQ ID NO: 732343 - RNA, 14 nt, Human
gaaaacaauaacga

SEQ ID NO: 732344 - RNA, 17 nt, Human
gacagucaccucaugga

SEQ ID NO: 732345 - RNA, 18 nt, Human
uucucuaggaaauauuua

SEQ ID NO: 732346 - RNA, 16 nt, Human
uaaaauccauacauuu

SEQ ID NO: 732347 - RNA, 18 nt, Human
cuuuccacagaagcucca

SEQ ID NO: 732348 - RNA, 14 nt, Human
gauaaaagacagug

SEQ ID NO: 732349 - RNA, 18 nt, Human
cuucucacauuuauauuu

SEQ ID NO: 732350 - RNA, 21 nt, Human
aaagcugaaauggacuuuugu

SEQ ID NO: 732351 - RNA, 16 nt, Human
auaauccuaaacauau

SEQ ID NO: 732352 - RNA, 17 nt, Human
uuaauaauuuuuaauua

SEQ ID NO: 732353 - RNA, 23 nt, Human
ucuuagaugcaguucugaagaag

SEQ ID NO: 732354 - RNA, 16 nt, Human
caaaaggauaaugaau

SEQ ID NO: 732355 - RNA, 17 nt, Human
cuaucucauuuccaagc

SEQ ID NO: 732356 - RNA, 22 nt, Human
uggaaaguuuaugguuguauua

SEQ ID NO: 732357 - RNA, 14 nt, Human
ccuugaugaagaag

SEQ ID NO: 732358 - RNA, 20 nt, Human
accuacacgagauacagaau

SEQ ID NO: 732359 - RNA, 19 nt, Human
uauacugugugcuaaaaca

SEQ ID NO: 732360 - RNA, 12 nt, Human
aaaauaacaaua

SEQ ID NO: 732361 - RNA, 18 nt, Human
uaaaagacaaggaaaaaa

SEQ ID NO: 732362 - RNA, 14 nt, Human
cucugccucagaaa

SEQ ID NO: 732363 - RNA, 17 nt, Human
agucugacuguuuccau

SEQ ID NO: 732364 - RNA, 22 nt, Human
auaacaaugcuguauuuuaaaa

SEQ ID NO: 732365 - RNA, 22 nt, Human
uuguaacaagccuccuuuuaaa

SEQ ID NO: 732366 - RNA, 17 nt, Human
uuucacauuuaaauaaa

SEQ ID NO: 732367 - RNA, 14 nt, Human
gaaaaaauaacaau

SEQ ID NO: 732368 - RNA, 15 nt, Human
augauaacuggaaac

SEQ ID NO: 732369 - RNA, 23 nt, Human
aagagccuuuuuuugaaaaaaag

SEQ ID NO: 732370 - RNA, 14 nt, Human
caugaacuuguaaa

SEQ ID NO: 732371 - RNA, 22 nt, Human
acaccuuguacuuuauuuucua

SEQ ID NO: 732372 - RNA, 23 nt, Human
agaaugauuaugaauuacauuug

SEQ ID NO: 732373 - RNA, 15 nt, Human
gugaacuugguuuua

SEQ ID NO: 732374 - RNA, 17 nt, Human
agggcauagaaguaaaa

SEQ ID NO: 732375 - RNA, 23 nt, Human
acugucuuguuggacgagaaaac

SEQ ID NO: 732376 - RNA, 18 nt, Human
gaagcaccaaucaugaau

SEQ ID NO: 732377 - RNA, 19 nt, Human
agugaggagcuuugaaacg

SEQ ID NO: 732378 - RNA, 19 nt, Human
agacagugaaagaaaauaa

SEQ ID NO: 732379 - RNA, 19 nt, Human
uguauacugugugcuaaaa

SEQ ID NO: 732380 - RNA, 18 nt, Human
aaaucuuauaauuuaaaa

SEQ ID NO: 732381 - RNA, 14 nt, Human
aaagagaacuucca

SEQ ID NO: 732382 - RNA, 21 nt, Human
ucauucacucaacaaacauaa

SEQ ID NO: 732383 - RNA, 19 nt, Human
agaguuuagcuggaaaagu

SEQ ID NO: 732384 - RNA, 15 nt, Human
acgagauacagaauu

SEQ ID NO: 732385 - RNA, 14 nt, Human
cuugagguaaaagc

SEQ ID NO: 732386 - RNA, 22 nt, Human
cuuuccacagaagcuccaggua

SEQ ID NO: 732387 - RNA, 20 nt, Human
accucugccucagaaaacaa

SEQ ID NO: 732388 - RNA, 21 nt, Human
uuauagcuacuaauuuuaaaa

SEQ ID NO: 732389 - RNA, 13 nt, Human
uaauuuuuauauu

SEQ ID NO: 732390 - RNA, 13 nt, Human
ucacuguaaaaua

SEQ ID NO: 732391 - RNA, 23 nt, Human
caauaacgauaaaagacagugaa

SEQ ID NO: 732392 - RNA, 21 nt, Human
uauuacuguaagaaaauauca

SEQ ID NO: 732393 - RNA, 16 nt, Human
aaauauaaauaaaaau

SEQ ID NO: 732394 - RNA, 15 nt, Human
gaaaacaaggaugaa

SEQ ID NO: 732395 - RNA, 20 nt, Human
aaauccuugaagauuuacca

SEQ ID NO: 732396 - RNA, 12 nt, Human
aauaauuuuuaa

SEQ ID NO: 732397 - RNA, 22 nt, Human
ggacagcccuucuuuccacaga

SEQ ID NO: 732398 - RNA, 21 nt, Human
aaaugucuugcuugauuguau

SEQ ID NO: 732399 - RNA, 21 nt, Human
uaauaggcguaacuaauuuua

SEQ ID NO: 732400 - RNA, 19 nt, Human
acuucagcgguuuauauaa

SEQ ID NO: 732401 - RNA, 17 nt, Human
auaaguacaugauaagc

SEQ ID NO: 732402 - RNA, 19 nt, Human
auaauuuuuauauuugaaa

SEQ ID NO: 732403 - RNA, 24 nt, Human
uaauuuaaaauaugcucuaaacau

SEQ ID NO: 732404 - RNA, 14 nt, Human
ccaaugaaaugagu

SEQ ID NO: 732405 - RNA, 12 nt, Human
agacagugaaag

SEQ ID NO: 732406 - RNA, 18 nt, Human
acaagccuccuuuuaaag

SEQ ID NO: 732407 - RNA, 22 nt, Human
agaagcaccaaucaugaauuag

SEQ ID NO: 732408 - RNA, 17 nt, Human
uuauaaucuuucacagg

SEQ ID NO: 732409 - RNA, 22 nt, Human
cuaagcuucacuguaaaauaau

SEQ ID NO: 732410 - RNA, 18 nt, Human
ucuaugaaauauuauguu

SEQ ID NO: 732411 - RNA, 13 nt, Human
aggauuugaaauu

SEQ ID NO: 732412 - RNA, 15 nt, Human
ugaaauuguauuaca

SEQ ID NO: 732413 - RNA, 16 nt, Human
aaauauuuauuuuaau

SEQ ID NO: 732414 - RNA, 20 nt, Human
ucaauaaaauccauacauuu

SEQ ID NO: 732415 - RNA, 16 nt, Human
uuaaauuguaauaggc

SEQ ID NO: 732416 - RNA, 14 nt, Human
aguuuuuuuuuaaa

SEQ ID NO: 732417 - RNA, 19 nt, Human
aauauuauguuaaaacugg

SEQ ID NO: 732418 - RNA, 14 nt, Human
cuaagucuuauaua

SEQ ID NO: 732419 - RNA, 16 nt, Human
auaaugaauacuuuau

SEQ ID NO: 732420 - RNA, 20 nt, Human
caaauauaaauaaaaauaau

SEQ ID NO: 732421 - RNA, 17 nt, Human
caaacauauauaacaau

SEQ ID NO: 732422 - RNA, 22 nt, Human
aaacaaggaugaauuaaguuuu

SEQ ID NO: 732423 - RNA, 22 nt, Human
ucaacuccaaacugacucuuaa

SEQ ID NO: 732424 - RNA, 18 nt, Human
uuuauguuuaauucugaa

SEQ ID NO: 732425 - RNA, 15 nt, Human
auaaauaaaaauaau

SEQ ID NO: 732426 - RNA, 19 nt, Human
aaacaaaaggauaaugaau

SEQ ID NO: 732427 - RNA, 20 nt, Human
uugauaaguacaugauaagc

SEQ ID NO: 732428 - RNA, 20 nt, Human
ucaagucuuucacauuuaaa

SEQ ID NO: 732429 - RNA, 17 nt, Human
gaagcaccaaucaugaa

SEQ ID NO: 732430 - RNA, 16 nt, Human
uucccaacuccagaaa

SEQ ID NO: 732431 - RNA, 13 nt, Human
gaagaacugaaau

SEQ ID NO: 732432 - RNA, 19 nt, Human
ucugagcauuuaauaugga

SEQ ID NO: 732433 - RNA, 19 nt, Human
ugaaauggacuuuuguaca

SEQ ID NO: 732434 - RNA, 12 nt, Human
acacugaagaag

SEQ ID NO: 732435 - RNA, 16 nt, Human
aaaauccauacauuug

SEQ ID NO: 732436 - RNA, 13 nt, Human
cucagaaaacaag

SEQ ID NO: 732437 - RNA, 23 nt, Human
uaaguuuuuuuuuaaaaaagaaa

SEQ ID NO: 732438 - RNA, 21 nt, Human
ucacaugaacuuguaaaggaa

SEQ ID NO: 732439 - RNA, 15 nt, Human
gcacagccucuuaga

SEQ ID NO: 732440 - RNA, 18 nt, Human
uaagcuucacuguaaaau

SEQ ID NO: 732441 - RNA, 20 nt, Human
auaaauggcuuccuggcaau

SEQ ID NO: 732442 - RNA, 20 nt, Human
aaucuuucacaggggacagg

SEQ ID NO: 732443 - RNA, 16 nt, Human
auccaaugaaaugagu

SEQ ID NO: 732444 - RNA, 19 nt, Human
gucaaauugugugaaaggu

SEQ ID NO: 732445 - RNA, 17 nt, Human
acuuccagauccuggaa

SEQ ID NO: 732446 - RNA, 19 nt, Human
uccagaaagugacaagcuc

SEQ ID NO: 732447 - RNA, 20 nt, Human
uauuuauuacuguaagaaaa

SEQ ID NO: 732448 - RNA, 18 nt, Human
auagucaaauugugugaa

SEQ ID NO: 732449 - RNA, 21 nt, Human
gaaaaaaagcuuuuuuugaau

SEQ ID NO: 732450 - RNA, 11 nt, Human
auuuaaaaauc

SEQ ID NO: 732451 - RNA, 14 nt, Human
auauuugaaauauu

SEQ ID NO: 732452 - RNA, 22 nt, Human
cuuguaaaggaauuuaaaaauc

SEQ ID NO: 732453 - RNA, 16 nt, Human
uucucuaggaaauauu

SEQ ID NO: 732454 - RNA, 17 nt, Human
aaaaauccuacuuucau

SEQ ID NO: 732455 - RNA, 23 nt, Human
uguagguagaucuggucuuuaga

SEQ ID NO: 732456 - RNA, 22 nt, Human
aguauguuagugcaaauuguca

SEQ ID NO: 732457 - RNA, 17 nt, Human
uacaaaugcauuucuaa

SEQ ID NO: 732458 - RNA, 21 nt, Human
aauuaaguuuuuuuuuaaaaa

SEQ ID NO: 732459 - RNA, 18 nt, Human
uuuuaaaaaagaaacauu

SEQ ID NO: 732460 - RNA, 13 nt, Human
uuuagugaaauau

SEQ ID NO: 732461 - RNA, 16 nt, Human
uacaaaugggaaacaa

SEQ ID NO: 732462 - RNA, 21 nt, Human
augcuacaggauuugaaauug

SEQ ID NO: 732463 - RNA, 14 nt, Human
agucugacuguuuc

SEQ ID NO: 732464 - RNA, 16 nt, Human
acaaauccaaugaaau

SEQ ID NO: 732465 - RNA, 15 nt, Human
uaaaagacaaggaaa

SEQ ID NO: 732466 - RNA, 20 nt, Human
gaaacgaggauugggaaaaa

SEQ ID NO: 732467 - RNA, 19 nt, Human
auagugaggagcuuugaaa

SEQ ID NO: 732468 - RNA, 13 nt, Human
aaauaaaaauaau

SEQ ID NO: 732469 - RNA, 19 nt, Human
aaauaugccccauucaaca

SEQ ID NO: 732470 - RNA, 14 nt, Human
cuaaacauaugaau

SEQ ID NO: 732471 - RNA, 22 nt, Human
uaaaauaauuuuuauauuugaa

SEQ ID NO: 732472 - RNA, 22 nt, Human
caagcacuaaacaaagagugaa

SEQ ID NO: 732473 - RNA, 15 nt, Human
uacaaaugcauuucu

SEQ ID NO: 732474 - RNA, 22 nt, Human
agaaagugacaagcucacagac

SEQ ID NO: 732475 - RNA, 22 nt, Human
uguucugauauuggacaguaaa

SEQ ID NO: 732476 - RNA, 18 nt, Human
cuuucacauuuaaauaaa

SEQ ID NO: 732477 - RNA, 17 nt, Human
aaauccuacuuucauaa

SEQ ID NO: 732478 - RNA, 22 nt, Human
ggcuaagcuucacuguaaaaua

SEQ ID NO: 732479 - RNA, 21 nt, Human
ucaagucuuucacauuuaaau

SEQ ID NO: 732480 - RNA, 15 nt, Human
ucaguuuuugugaaa

SEQ ID NO: 732481 - RNA, 23 nt, Human
ugaaaugaguuuuucuuuucauu

SEQ ID NO: 732482 - RNA, 23 nt, Human
uuagaugcaguucugaagaagau

SEQ ID NO: 732483 - RNA, 13 nt, Human
cacauuuaaauaa

SEQ ID NO: 732484 - RNA, 13 nt, Human
cauuuguauaaaa

SEQ ID NO: 732485 - RNA, 11 nt, Human
gagguaaaagc

SEQ ID NO: 732486 - RNA, 19 nt, Human
auuguaguccuguaaugga

SEQ ID NO: 732487 - RNA, 16 nt, Human
auuuuuagugaaauau

SEQ ID NO: 732488 - RNA, 14 nt, Human
ugugaaaagcucca

SEQ ID NO: 732489 - RNA, 13 nt, Human
auuuuaaaagaau

SEQ ID NO: 732490 - RNA, 16 nt, Human
cauagaaguaaaaaca

SEQ ID NO: 732491 - RNA, 19 nt, Human
ucaguuauuauauuuacaa

SEQ ID NO: 732492 - RNA, 21 nt, Human
guauacugugugcuaaaacaa

SEQ ID NO: 732493 - RNA, 22 nt, Human
aaccuacacgagauacagaauu

SEQ ID NO: 732494 - RNA, 16 nt, Human
aauuuuuaauuauaug

SEQ ID NO: 732495 - RNA, 15 nt, Human
aaggaaaaaauaaca

SEQ ID NO: 732496 - RNA, 23 nt, Human
gaaugagagacacacugaagaag

SEQ ID NO: 732497 - RNA, 11 nt, Human
cuguuuuauaa

SEQ ID NO: 732498 - RNA, 14 nt, Human
uaaaggaauuuaaa

SEQ ID NO: 732499 - RNA, 13 nt, Human
aacaagccuccuu

SEQ ID NO: 732500 - RNA, 19 nt, Human
guaguccuguaauggaagc

SEQ ID NO: 732501 - RNA, 18 nt, Human
auucuugccaaauauaaa

SEQ ID NO: 732502 - RNA, 22 nt, Human
uauuccuuuuucucuccucucc

SEQ ID NO: 732503 - RNA, 23 nt, Human
uagauguauagguugaugguggu

SEQ ID NO: 732504 - RNA, 18 nt, Human
aucuuauaauuuaaaaua

SEQ ID NO: 732505 - RNA, 19 nt, Human
gguuuaauaauuuuuaauu

SEQ ID NO: 732506 - RNA, 18 nt, Human
acauuugcucauggaauu

SEQ ID NO: 732507 - RNA, 20 nt, Human
augucgucaaagcugaaaug

SEQ ID NO: 732508 - RNA, 14 nt, Human
agcaaguauuagaa

SEQ ID NO: 732509 - RNA, 20 nt, Human
aaagagugaaggauuuaugu

SEQ ID NO: 732510 - RNA, 18 nt, Human
acugugugcuaaaacaag

SEQ ID NO: 732511 - RNA, 16 nt, Human
gagcucgugggacagu

SEQ ID NO: 732512 - RNA, 14 nt, Human
auauuuauuuuaau

SEQ ID NO: 732513 - RNA, 22 nt, Human
aaauaacaaugaaaguugauaa

SEQ ID NO: 732514 - RNA, 23 nt, Human
gauauuaaccaggggccaugaau

SEQ ID NO: 732515 - RNA, 19 nt, Human
guuguauuauuuuuuaaaa

SEQ ID NO: 732516 - RNA, 20 nt, Human
ucacaugaacuuguaaagga

SEQ ID NO: 732517 - RNA, 20 nt, Human
agcuacuaauuuuaaaaugu

SEQ ID NO: 732518 - RNA, 15 nt, Human
uuaauuuguaguguu

SEQ ID NO: 732519 - RNA, 22 nt, Human
accauuucuugagguaaaagca

SEQ ID NO: 732520 - RNA, 13 nt, Human
aggcuagauguau

SEQ ID NO: 732521 - RNA, 22 nt, Human
uucauucacucaacaaacauaa

SEQ ID NO: 732522 - RNA, 11 nt, Human
caauaaaagac

SEQ ID NO: 732523 - RNA, 17 nt, Human
ucuauaauuuaaauaua

SEQ ID NO: 732524 - RNA, 13 nt, Human
cuucucaacucca

SEQ ID NO: 732525 - RNA, 22 nt, Human
caugaguaacugauuuguaaca

SEQ ID NO: 732526 - RNA, 18 nt, Human
aaauauuuauuuuaauaa

SEQ ID NO: 732527 - RNA, 20 nt, Human
uguaagaaaauaucacuugu

SEQ ID NO: 732528 - RNA, 14 nt, Human
auuuaaauauaugc

SEQ ID NO: 732529 - RNA, 22 nt, Human
cacuaguauuucuaugaaauau

SEQ ID NO: 732530 - RNA, 19 nt, Human
cauggaauuggagcucgug

SEQ ID NO: 732531 - RNA, 15 nt, Human
aacgauaaaagacag

SEQ ID NO: 732532 - RNA, 15 nt, Human
augguuguauuauuu

SEQ ID NO: 732533 - RNA, 19 nt, Human
caucaaggguacacugccu

SEQ ID NO: 732534 - RNA, 22 nt, Human
ugguuguauuauuuuuuaaaaa

SEQ ID NO: 732535 - RNA, 19 nt, Human
agcuacuaauuuuaaaaug

SEQ ID NO: 732536 - RNA, 12 nt, Human
gacagugaaaga

SEQ ID NO: 732537 - RNA, 15 nt, Human
cagaauucauucacu

SEQ ID NO: 732538 - RNA, 21 nt, Human
auguuuaauucugaaagcaac

SEQ ID NO: 732539 - RNA, 14 nt, Human
acacugaagaagca

SEQ ID NO: 732540 - RNA, 21 nt, Human
auauaugcuaagucuuauaua

SEQ ID NO: 732541 - RNA, 16 nt, Human
uagcuacuaauuuuaa

SEQ ID NO: 732542 - RNA, 17 nt, Human
caauaacgauaaaagac

SEQ ID NO: 732543 - RNA, 19 nt, Human
gaaaauaacgauaaaagac

SEQ ID NO: 732544 - RNA, 21 nt, Human
aacuuguaaaggaauuuaaaa

SEQ ID NO: 732545 - RNA, 15 nt, Human
cuaguaauuggaaag

SEQ ID NO: 732546 - RNA, 19 nt, Human
aggucuaccaaaaaucuca

SEQ ID NO: 732547 - RNA, 21 nt, Human
aggcucuuuugggauuuuuga

SEQ ID NO: 732548 - RNA, 22 nt, Human
aauuacauuuguauaaaauaau

SEQ ID NO: 732549 - RNA, 16 nt, Human
ugcuguauuuuaaaag

SEQ ID NO: 732550 - RNA, 22 nt, Human
uagacacacaugaaguccaagc

SEQ ID NO: 732551 - RNA, 18 nt, Human
gaaaauaacaauaaaaga

SEQ ID NO: 732552 - RNA, 21 nt, Human
auaauuuuuauauuugaaaua

SEQ ID NO: 732553 - RNA, 16 nt, Human
uuguaaaggaauuuaa

SEQ ID NO: 732554 - RNA, 21 nt, Human
uguauaaaauaauuuuuauau

SEQ ID NO: 732555 - RNA, 13 nt, Human
aaaaauccuacuu

SEQ ID NO: 732556 - RNA, 23 nt, Human
uccaaacugacucuuaagaagac

SEQ ID NO: 732557 - RNA, 21 nt, Human
auuuacaaaugggaaacaaaa

SEQ ID NO: 732558 - RNA, 20 nt, Human
aagacagugaaagaaaauaa

SEQ ID NO: 732559 - RNA, 19 nt, Human
gcuuguauuccuuuuucuc

SEQ ID NO: 732560 - RNA, 22 nt, Human
ggacaguaaaauccacagacca

SEQ ID NO: 732561 - RNA, 20 nt, Human
uacaucccuuaccugggaaa

SEQ ID NO: 732562 - RNA, 16 nt, Human
uguaguccuguaaugg

SEQ ID NO: 732563 - RNA, 16 nt, Human
agugaaggauuuaugu

SEQ ID NO: 732564 - RNA, 18 nt, Human
acugccuucucaacucca

SEQ ID NO: 732565 - RNA, 23 nt, Human
ucuccauguacuggcaagaccug

SEQ ID NO: 732566 - RNA, 23 nt, Human
uacaaaugggaaacaaaaggaua

SEQ ID NO: 732567 - RNA, 17 nt, Human
uauauuguagauaauac

SEQ ID NO: 732568 - RNA, 19 nt, Human
uagugagcagucaggaaag

SEQ ID NO: 732569 - RNA, 14 nt, Human
gaaugauuaugaau

SEQ ID NO: 732570 - RNA, 16 nt, Human
uaacaauaaaagacaa

SEQ ID NO: 732571 - RNA, 16 nt, Human
gacaagcucacagacc

SEQ ID NO: 732572 - RNA, 20 nt, Human
aaagacagugaaagaaaaua

SEQ ID NO: 732573 - RNA, 14 nt, Human
agcucguggaacag

SEQ ID NO: 732574 - RNA, 14 nt, Human
uauuugaaauauug

SEQ ID NO: 732575 - RNA, 13 nt, Human
cacaacuauauug

SEQ ID NO: 732576 - RNA, 15 nt, Human
auuugguaaggggaa

SEQ ID NO: 732577 - RNA, 17 nt, Human
acaaaugggaaacaaaa

SEQ ID NO: 732578 - RNA, 21 nt, Human
cauuucuugagguaaaagcau

SEQ ID NO: 732579 - RNA, 22 nt, Human
uaauaggcguaacuaauuuuaa

SEQ ID NO: 732580 - RNA, 22 nt, Human
uuuauagcuacuaauuuuaaaa

SEQ ID NO: 732581 - RNA, 18 nt, Human
cuucacuguaaaauaaua

SEQ ID NO: 732582 - RNA, 18 nt, Human
aacaaugcuguauuuuaa

SEQ ID NO: 732583 - RNA, 13 nt, Human
ccuccuuuuaaag

SEQ ID NO: 732584 - RNA, 20 nt, Human
gacauuugcucauggaauug

SEQ ID NO: 732585 - RNA, 18 nt, Human
auggcuugaguuuaaauu

SEQ ID NO: 732586 - RNA, 17 nt, Human
agcuucacuguaaaaua

SEQ ID NO: 732587 - RNA, 15 nt, Human
aaaaauaacaaugaa

SEQ ID NO: 732588 - RNA, 19 nt, Human
gaaagaaaauaacaauaaa

SEQ ID NO: 732589 - RNA, 18 nt, Human
acauuuauauuuuuguga

SEQ ID NO: 732590 - RNA, 16 nt, Human
acauuuauauuuuugu

SEQ ID NO: 732591 - RNA, 23 nt, Human
guaauuccguagguuauuuucag

SEQ ID NO: 732592 - RNA, 23 nt, Human
uccaacuaucucauuuccaagca

SEQ ID NO: 732593 - RNA, 23 nt, Human
acgaggauugggaaaaaguaauu

SEQ ID NO: 732594 - RNA, 21 nt, Human
aaguuuaugguuguauuauuu

SEQ ID NO: 732595 - RNA, 11 nt, Human
acugggacagg

SEQ ID NO: 732596 - RNA, 15 nt, Human
uucacauuuaaauaa

SEQ ID NO: 732597 - RNA, 20 nt, Human
auuacuguaagaaaauauca

SEQ ID NO: 732598 - RNA, 15 nt, Human
ccagcacagccucuu

SEQ ID NO: 732599 - RNA, 17 nt, Human
uaacgauaaaagacagu

SEQ ID NO: 732600 - RNA, 20 nt, Human
ugaaaaucuuauaauuuaaa

SEQ ID NO: 732601 - RNA, 15 nt, Human
uagggugauauuaac

SEQ ID NO: 732602 - RNA, 20 nt, Human
aaaacaagcacuaaacaaag

SEQ ID NO: 732603 - RNA, 18 nt, Human
ccaaccuggaguugaaaa

SEQ ID NO: 732604 - RNA, 15 nt, Human
agggcucacagaauu

SEQ ID NO: 732605 - RNA, 14 nt, Human
ugcuguauuuuaaa

SEQ ID NO: 732606 - RNA, 23 nt, Human
auaauguguucauucuggaauaa

SEQ ID NO: 732607 - RNA, 20 nt, Human
uaauaaguugcauagguuua

SEQ ID NO: 732608 - RNA, 15 nt, Human
agaauaccacaggaa

SEQ ID NO: 732609 - RNA, 15 nt, Human
aagaaaauaacaaua

SEQ ID NO: 732610 - RNA, 14 nt, Human
guauuuuaaaagaa

SEQ ID NO: 732611 - RNA, 15 nt, Human
aguucugaagaagau

SEQ ID NO: 732612 - RNA, 17 nt, Human
aagacaaggaaaaaaua

SEQ ID NO: 732613 - RNA, 19 nt, Human
agagccuuuuuuugaaaaa

SEQ ID NO: 732614 - RNA, 15 nt, Human
gcuguauuuuaaaag

SEQ ID NO: 732615 - RNA, 18 nt, Human
gaaacaaaaggauaauga

SEQ ID NO: 732616 - RNA, 21 nt, Human
uaguauuucuaugaaauauua

SEQ ID NO: 732617 - RNA, 14 nt, Human
uaacuaauuuuaac

SEQ ID NO: 732618 - RNA, 23 nt, Human
uuuccaucaaggguacacugccu

SEQ ID NO: 732619 - RNA, 18 nt, Human
gaaaauaucacuugucaa

SEQ ID NO: 732620 - RNA, 19 nt, Human
acaauaacgauaaaagaca

SEQ ID NO: 732621 - RNA, 13 nt, Human
aacucuauaaugu

SEQ ID NO: 732622 - RNA, 13 nt, Human
uuuugaaucauca

SEQ ID NO: 732623 - RNA, 20 nt, Human
aguuguuucuacuacaugga

SEQ ID NO: 732624 - RNA, 20 nt, Human
agcuuauugucuagugaaac

SEQ ID NO: 732625 - RNA, 14 nt, Human
uaauccuaaacaua

SEQ ID NO: 732626 - RNA, 16 nt, Human
ugcuaagucuuauaua

SEQ ID NO: 732627 - RNA, 23 nt, Human
agaguuuagcuggaaaaguaugu

SEQ ID NO: 732628 - RNA, 17 nt, Human
uuccaagugauugaaac

SEQ ID NO: 732629 - RNA, 20 nt, Human
gaaacauuugguaaggggaa

SEQ ID NO: 732630 - RNA, 22 nt, Human
gaauuaaguuuuuuuuuaaaaa

SEQ ID NO: 732631 - RNA, 16 nt, Human
uauaugucacuuugcu

SEQ ID NO: 732632 - RNA, 13 nt, Human
ugaaagaaaauaa

SEQ ID NO: 732633 - RNA, 13 nt, Human
uuaaaaaagaaac

SEQ ID NO: 732634 - RNA, 18 nt, Human
aaauaacgauaaaagaca

SEQ ID NO: 732635 - RNA, 21 nt, Human
ugaaacgaggauugggaaaaa

SEQ ID NO: 732636 - RNA, 15 nt, Human
ugcuucuguuuuaua

SEQ ID NO: 732637 - RNA, 17 nt, Human
caaauccaaugaaauga

SEQ ID NO: 732638 - RNA, 20 nt, Human
aauaauuuuuauauuugaaa

SEQ ID NO: 732639 - RNA, 19 nt, Human
uuugccaaguucuccacua

SEQ ID NO: 732640 - RNA, 17 nt, Human
aguauuucuaugaaaua

SEQ ID NO: 732641 - RNA, 16 nt, Human
aagacugcacaucaaa

SEQ ID NO: 732642 - RNA, 23 nt, Human
gauagauaggucagugcaaauac

SEQ ID NO: 732643 - RNA, 14 nt, Human
uucuaugaaauauu

SEQ ID NO: 732644 - RNA, 18 nt, Human
auagcuacuaauuuuaaa

SEQ ID NO: 732645 - RNA, 18 nt, Human
cuggaaacuucagcgguu

SEQ ID NO: 732646 - RNA, 20 nt, Human
cagugaaagaaaauaacgau

SEQ ID NO: 732647 - RNA, 22 nt, Human
uguauacugugugcuaaaacaa

SEQ ID NO: 732648 - RNA, 22 nt, Human
agugagcagucaggaaagagaa

SEQ ID NO: 732649 - RNA, 20 nt, Human
agccuuggggcugaugcagu

SEQ ID NO: 732650 - RNA, 18 nt, Human
acugacucuuaagaagac

SEQ ID NO: 732651 - RNA, 15 nt, Human
uaacgauaaaagaca

SEQ ID NO: 732652 - RNA, 14 nt, Human
caaaugcauuucua

SEQ ID NO: 732653 - RNA, 20 nt, Human
auuuucaguuauuauauuua

SEQ ID NO: 732654 - RNA, 15 nt, Human
aaaaaagaaacauuu

SEQ ID NO: 732655 - RNA, 19 nt, Human
uggugaacuugguuuuaau

SEQ ID NO: 732656 - RNA, 17 nt, Human
aaauaacgauaaaagac

SEQ ID NO: 732657 - RNA, 21 nt, Human
cuuguuggacgagaaaacaau

SEQ ID NO: 732658 - RNA, 22 nt, Human
cacuuccaagagccuuuuuuug

SEQ ID NO: 732659 - RNA, 13 nt, Human
acuguaaaauaau

SEQ ID NO: 732660 - RNA, 18 nt, Human
uaaugaauacuuuauaaa

SEQ ID NO: 732661 - RNA, 17 nt, Human
ugaaauauuauuuuaua

SEQ ID NO: 732662 - RNA, 12 nt, Human
uuuuuuuuaaaa

SEQ ID NO: 732663 - RNA, 12 nt, Human
aauuuuaaaaug

SEQ ID NO: 732664 - RNA, 21 nt, Human
auuuguauaaaauaauuuuua

SEQ ID NO: 732665 - RNA, 13 nt, Human
aaauccuugaaga

SEQ ID NO: 732666 - RNA, 22 nt, Human
agaauuuuaugcggcauuuucu

SEQ ID NO: 732667 - RNA, 15 nt, Human
ucauaauaaguugca

SEQ ID NO: 732668 - RNA, 14 nt, Human
aaaagacagugaaa

SEQ ID NO: 732669 - RNA, 15 nt, Human
ggcaauagucaaauu

SEQ ID NO: 732670 - RNA, 15 nt, Human
auagaaguaaaaaca

SEQ ID NO: 732671 - RNA, 17 nt, Human
ccaaaaaucucaauauu

SEQ ID NO: 732672 - RNA, 19 nt, Human
acagucaccucauggaauu

SEQ ID NO: 732673 - RNA, 23 nt, Human
aauaauccucaguuuuugugaaa

SEQ ID NO: 732674 - RNA, 20 nt, Human
auuuugugauugauuauaug

SEQ ID NO: 732675 - RNA, 20 nt, Human
agagacacacugaagaagca

SEQ ID NO: 732676 - RNA, 15 nt, Human
uuuaugguuguauua

SEQ ID NO: 732677 - RNA, 20 nt, Human
aauuuuuucucuaggaaaua

SEQ ID NO: 732678 - RNA, 21 nt, Human
gacagucaccucauggaauug

SEQ ID NO: 732679 - RNA, 17 nt, Human
aaccuagggugauauua

SEQ ID NO: 732680 - RNA, 13 nt, Human
uauuuauuuuaau

SEQ ID NO: 732681 - RNA, 14 nt, Human
cagugaaagaaaau

SEQ ID NO: 732682 - RNA, 22 nt, Human
gaaaaucuuauaauuuaaaaua

SEQ ID NO: 732683 - RNA, 21 nt, Human
ucuuaggguuaugauuaagua

SEQ ID NO: 732684 - RNA, 16 nt, Human
aauuacauuuguauaa

SEQ ID NO: 732685 - RNA, 16 nt, Human
uucacauuuaaauaaa

SEQ ID NO: 732686 - RNA, 15 nt, Human
uacaggauuugaaau

SEQ ID NO: 732687 - RNA, 19 nt, Human
cucugccucagaaaacaag

SEQ ID NO: 732688 - RNA, 14 nt, Human
cuggaaaucagggu

SEQ ID NO: 732689 - RNA, 17 nt, Human
gacaaggaaaaaauaac

SEQ ID NO: 732690 - RNA, 12 nt, Human
ucuuaagaagac

SEQ ID NO: 732691 - RNA, 20 nt, Human
gaauucauucacucaacaaa

SEQ ID NO: 732692 - RNA, 14 nt, Human
auuuauuuuaauaa

SEQ ID NO: 732693 - RNA, 19 nt, Human
cucacauuuauauuuuugu

SEQ ID NO: 732694 - RNA, 20 nt, Human
aagggcuguuauaaucuuuc

SEQ ID NO: 732695 - RNA, 20 nt, Human
uuaaguuuuuuuuuaaaaaa

SEQ ID NO: 732696 - RNA, 22 nt, Human
agaaugagagacacacugaaga

SEQ ID NO: 732697 - RNA, 13 nt, Human
auaacgauaaaag

SEQ ID NO: 732698 - RNA, 23 nt, Human
uuauagcuacuaauuuuaaaaug

SEQ ID NO: 732699 - RNA, 16 nt, Human
gacaaggaaaaaauaa

SEQ ID NO: 732700 - RNA, 20 nt, Human
uguaaaggaauuuaaaaauc

SEQ ID NO: 732701 - RNA, 20 nt, Human
aaauaauuuuuauauuugaa

SEQ ID NO: 732702 - RNA, 12 nt, Human
cauagaaguaaa

SEQ ID NO: 732703 - RNA, 20 nt, Human
aauuuugugaagcaaaauuu

SEQ ID NO: 732704 - RNA, 22 nt, Human
uggacgagaaaacaauaacgau

SEQ ID NO: 732705 - RNA, 17 nt, Human
cugccucagaaaacaag

SEQ ID NO: 732706 - RNA, 16 nt, Human
aaagacaaggaaaaaa

SEQ ID NO: 732707 - RNA, 21 nt, Human
auuuuccugaaaacccuugcc

SEQ ID NO: 732708 - RNA, 13 nt, Human
ugaaaaucuuaua

SEQ ID NO: 732709 - RNA, 17 nt, Human
uugccaaauauaaauaa

SEQ ID NO: 732710 - RNA, 16 nt, Human
auugucuagugaaacu

SEQ ID NO: 732711 - RNA, 16 nt, Human
cauuucuaaagccauu

SEQ ID NO: 732712 - RNA, 12 nt, Human
cauuauauuuau

SEQ ID NO: 732713 - RNA, 23 nt, Human
auuuuauagcuacuaauuuuaaa

SEQ ID NO: 732714 - RNA, 11 nt, Human
uucacagggga

SEQ ID NO: 732715 - RNA, 11 nt, Human
cgauaaaagac

SEQ ID NO: 732716 - RNA, 17 nt, Human
uucugagcauuuaauau

SEQ ID NO: 732717 - RNA, 16 nt, Human
ucaguuuuugugaaaa

SEQ ID NO: 732718 - RNA, 14 nt, Human
gugagcuacaaaug

SEQ ID NO: 732719 - RNA, 13 nt, Human
aguguuugaaagc

SEQ ID NO: 732720 - RNA, 22 nt, Human
uuuauggcacuaguauuucuau

SEQ ID NO: 732721 - RNA, 18 nt, Human
gccuuggggcugaugcag

SEQ ID NO: 732722 - RNA, 18 nt, Human
gaagcaaaauuuuuucuc

SEQ ID NO: 732723 - RNA, 15 nt, Human
aaucucaauauuuca

SEQ ID NO: 732724 - RNA, 15 nt, Human
uacuaauuuuaaaau

SEQ ID NO: 732725 - RNA, 16 nt, Human
uaaugaauacuuuaua

SEQ ID NO: 732726 - RNA, 10 nt, Human
auguuuucag

SEQ ID NO: 732727 - RNA, 15 nt, Human
caagcucacagaccu

SEQ ID NO: 732728 - RNA, 20 nt, Human
cugauauuggacaguaaaau

SEQ ID NO: 732729 - RNA, 15 nt, Human
guuuuucuuuucauu

SEQ ID NO: 732730 - RNA, 14 nt, Human
auuuguauaaaaua

SEQ ID NO: 732731 - RNA, 14 nt, Human
aagcaucacaugaa

SEQ ID NO: 732732 - RNA, 20 nt, Human
uaaaagacagugaaagaaaa

SEQ ID NO: 732733 - RNA, 13 nt, Human
auugauuauaugu

SEQ ID NO: 732734 - RNA, 17 nt, Human
ucuauaauguguucauu

SEQ ID NO: 732735 - RNA, 17 nt, Human
auuuuaauaauguuuca

SEQ ID NO: 732736 - RNA, 12 nt, Human
auucugaaagca

SEQ ID NO: 732737 - RNA, 18 nt, Human
cugagggcauagaaguaa

SEQ ID NO: 732738 - RNA, 14 nt, Human
uggcuugaguuuaa

SEQ ID NO: 732739 - RNA, 19 nt, Human
auugaggacacugauaugg

SEQ ID NO: 732740 - RNA, 17 nt, Human
ugguucccuugaugaag

SEQ ID NO: 732741 - RNA, 22 nt, Human
cauaaauguugacaugggacau

SEQ ID NO: 732742 - RNA, 17 nt, Human
aagcuuuuuuugaauca

SEQ ID NO: 732743 - RNA, 12 nt, Human
uuuuauauuuga

SEQ ID NO: 732744 - RNA, 19 nt, Human
acauuuguauaaaauaauu

SEQ ID NO: 732745 - RNA, 18 nt, Human
agagaaugagagacacac

SEQ ID NO: 732746 - RNA, 21 nt, Human
aggguuaugauuaaguaauga

SEQ ID NO: 732747 - RNA, 17 nt, Human
cgauaaaagacagugaa

SEQ ID NO: 732748 - RNA, 15 nt, Human
ugcuguauuuuaaaa

SEQ ID NO: 732749 - RNA, 17 nt, Human
cuggagggaagccuugg

SEQ ID NO: 732750 - RNA, 12 nt, Human
caggacagcccu

SEQ ID NO: 732751 - RNA, 13 nt, Human
uaaacauguuuau

SEQ ID NO: 732752 - RNA, 15 nt, Human
auaaaguguuugaaa

SEQ ID NO: 732753 - RNA, 21 nt, Human
aaaauaugccccauucaacau

SEQ ID NO: 732754 - RNA, 14 nt, Human
uuaugauuaaguaa

SEQ ID NO: 732755 - RNA, 22 nt, Human
agcagcauaaauguugacaugg

SEQ ID NO: 732756 - RNA, 20 nt, Human
uaugaaaaggcuaagcuuca

SEQ ID NO: 732757 - RNA, 21 nt, Human
aauaauccucaguuuuuguga

SEQ ID NO: 732758 - RNA, 18 nt, Human
cuuuucccaacuccagaa

SEQ ID NO: 732759 - RNA, 20 nt, Human
uguaauaggcguaacuaauu

SEQ ID NO: 732760 - RNA, 18 nt, Human
uagugaaauauuauuuua

SEQ ID NO: 732761 - RNA, 15 nt, Human
auaauccuaaacaua

SEQ ID NO: 732762 - RNA, 16 nt, Human
ugcauagguuuaauaa

SEQ ID NO: 732763 - RNA, 14 nt, Human
cagauccuggaaau

SEQ ID NO: 732764 - RNA, 21 nt, Human
ccuuuuuuugaaaaaaagcuu

SEQ ID NO: 732765 - RNA, 14 nt, Human
ugguauguuuucag

SEQ ID NO: 732766 - RNA, 14 nt, Human
auccaaugaaauga

SEQ ID NO: 732767 - RNA, 18 nt, Human
uaaaauccauacauuugu

SEQ ID NO: 732768 - RNA, 18 nt, Human
guuaguauuguccagguc

SEQ ID NO: 732769 - RNA, 16 nt, Human
agguacuucaaauccu

SEQ ID NO: 732770 - RNA, 14 nt, Human
ugcuucuguuuuau

SEQ ID NO: 732771 - RNA, 21 nt, Human
ugaaauggacuuuuguacaua

SEQ ID NO: 732772 - RNA, 12 nt, Human
aguguuugaaag

SEQ ID NO: 732773 - RNA, 17 nt, Human
aagacagugaaagaaaa

SEQ ID NO: 732774 - RNA, 18 nt, Human
uauaacaaugcuguauuu

SEQ ID NO: 732775 - RNA, 15 nt, Human
aaggguacacugccu

SEQ ID NO: 732776 - RNA, 14 nt, Human
uugggaaaaaguaa

SEQ ID NO: 732777 - RNA, 14 nt, Human
uaaaagacaaggaa

SEQ ID NO: 732778 - RNA, 19 nt, Human
acuaucucauuuccaagca

SEQ ID NO: 732779 - RNA, 19 nt, Human
gucaaucagccuaguugau

SEQ ID NO: 732780 - RNA, 17 nt, Human
gcaaauugucacaggac

SEQ ID NO: 732781 - RNA, 20 nt, Human
ugagagacacacugaagaag

SEQ ID NO: 732782 - RNA, 18 nt, Human
uauuuucuauaauuuaaa

SEQ ID NO: 732783 - RNA, 19 nt, Human
auuaaguuuuuuuuuaaaa

SEQ ID NO: 732784 - RNA, 18 nt, Human
cagccucuuagaugcagu

SEQ ID NO: 732785 - RNA, 13 nt, Human
acacacaugaagu

SEQ ID NO: 732786 - RNA, 21 nt, Human
uauaaaauaauuuuuauauuu

SEQ ID NO: 732787 - RNA, 19 nt, Human
aaagacagugaaagaaaau

SEQ ID NO: 732788 - RNA, 13 nt, Human
acagcccuucuuu

SEQ ID NO: 732789 - RNA, 20 nt, Human
accugauuucugagcauuua

SEQ ID NO: 732790 - RNA, 12 nt, Human
ugagagacacac

SEQ ID NO: 732791 - RNA, 21 nt, Human
gaaaugaguuuuucuuuucau

SEQ ID NO: 732792 - RNA, 13 nt, Human
auuuuuuaaaaaa

SEQ ID NO: 732793 - RNA, 14 nt, Human
uauaauuuaaaaua

SEQ ID NO: 732794 - RNA, 14 nt, Human
auuauuuuuuaaaa

SEQ ID NO: 732795 - RNA, 21 nt, Human
gacagugaaagaaaauaacaa

SEQ ID NO: 732796 - RNA, 17 nt, Human
ggagcucguggaacagu

SEQ ID NO: 732797 - RNA, 22 nt, Human
uuuccaagcaaguauuagaaua

SEQ ID NO: 732798 - RNA, 20 nt, Human
acuucuuaggguuaugauua

SEQ ID NO: 732799 - RNA, 16 nt, Human
acuaaacaaagaguga

SEQ ID NO: 732800 - RNA, 18 nt, Human
aggaaaaaauaacaauga

SEQ ID NO: 732801 - RNA, 17 nt, Human
aacaguuaccucugccu

SEQ ID NO: 732802 - RNA, 20 nt, Human
augcaguuguugcccacagc

SEQ ID NO: 732803 - RNA, 21 nt, Human
uuuguauaaaauaauuuuuau

SEQ ID NO: 732804 - RNA, 14 nt, Human
cucaacaaacauaa

SEQ ID NO: 732805 - RNA, 18 nt, Human
ugaacuugguuuuaauua

SEQ ID NO: 732806 - RNA, 13 nt, Human
cugccuucucaac

SEQ ID NO: 732807 - RNA, 14 nt, Human
aaaggaauuuaaaa

SEQ ID NO: 732808 - RNA, 18 nt, Human
guauuauuuuuuaaaaaa

SEQ ID NO: 732809 - RNA, 16 nt, Human
ucucuaggaaauauuu

SEQ ID NO: 732810 - RNA, 18 nt, Human
uuguaaaggaauuuaaaa

SEQ ID NO: 732811 - RNA, 21 nt, Human
uuauuuucuauaauuuaaaua

SEQ ID NO: 732812 - RNA, 15 nt, Human
ugucaauaaaaucca

SEQ ID NO: 732813 - RNA, 17 nt, Human
agcuacuaauuuuaaaa

SEQ ID NO: 732814 - RNA, 14 nt, Human
caaggaaaaaauaa

SEQ ID NO: 732815 - RNA, 15 nt, Human
ccacaggaaccacaa

SEQ ID NO: 732816 - RNA, 13 nt, Human
uuuucuuuucauu

SEQ ID NO: 732817 - RNA, 18 nt, Human
uuuuagugaaauauuauu

SEQ ID NO: 732818 - RNA, 23 nt, Human
uaaaagacagugaaagaaaauaa

SEQ ID NO: 732819 - RNA, 15 nt, Human
uaggaaauauuuauu

SEQ ID NO: 732820 - RNA, 22 nt, Human
caaaugggaaacaaaaggauaa

SEQ ID NO: 732821 - RNA, 17 nt, Human
uucucuaggaaauauuu

SEQ ID NO: 732822 - RNA, 17 nt, Human
uaaaagacagugaaaga

SEQ ID NO: 732823 - RNA, 15 nt, Human
aauaacgauaaaaga

SEQ ID NO: 732824 - RNA, 13 nt, Human
uuuuaaaaaagaa

SEQ ID NO: 732825 - RNA, 14 nt, Human
uugaaauuguauua

SEQ ID NO: 732826 - RNA, 21 nt, Human
gcaaaauuuuuucucuaggaa

SEQ ID NO: 732827 - RNA, 12 nt, Human
aagaaaauaacg

SEQ ID NO: 732828 - RNA, 19 nt, Human
uauauuuuugugauuuugu

SEQ ID NO: 732829 - RNA, 18 nt, Human
guuucaaacauauauaac

SEQ ID NO: 732830 - RNA, 21 nt, Human
gccaaauauaaauaaaaauaa

SEQ ID NO: 732831 - RNA, 20 nt, Human
guauuauuuuuuaaaaaaau

SEQ ID NO: 732832 - RNA, 17 nt, Human
guuuaauaauuuuuaau

SEQ ID NO: 732833 - RNA, 15 nt, Human
aauucugaaagcaac

SEQ ID NO: 732834 - RNA, 19 nt, Human
uacuucuuaggguuaugau

SEQ ID NO: 732835 - RNA, 14 nt, Human
ggcaauagucaaau

SEQ ID NO: 732836 - RNA, 22 nt, Human
cauuuaaauaaaguguuugaaa

SEQ ID NO: 732837 - RNA, 21 nt, Human
uuauguuuaauucugaaagca

SEQ ID NO: 732838 - RNA, 19 nt, Human
cucauggaauuggagcucg

SEQ ID NO: 732839 - RNA, 17 nt, Human
acacuaagagagaauga

SEQ ID NO: 732840 - RNA, 13 nt, Human
cacacugaagaag

SEQ ID NO: 732841 - RNA, 20 nt, Human
uuacaaauccaaugaaauga

SEQ ID NO: 732842 - RNA, 13 nt, Human
uaacaauaaaaga

SEQ ID NO: 732843 - RNA, 23 nt, Human
gaaaacaauaacgauaaaagaca

SEQ ID NO: 732844 - RNA, 20 nt, Human
ugguuguauuauuuuuuaaa

SEQ ID NO: 732845 - RNA, 20 nt, Human
gaaaauaacaauaaaagaca

SEQ ID NO: 732846 - RNA, 17 nt, Human
aauucuugccaaauaua

SEQ ID NO: 732847 - RNA, 14 nt, Human
ugcuaagucuuaua

SEQ ID NO: 732848 - RNA, 17 nt, Human
aauaugcucuaaacaug

SEQ ID NO: 732849 - RNA, 12 nt, Human
uaagaagacugc

SEQ ID NO: 732850 - RNA, 23 nt, Human
cuaguaauuggaaaggcagcucu

SEQ ID NO: 732851 - RNA, 16 nt, Human
auuuuaauaauguuuc

SEQ ID NO: 732852 - RNA, 13 nt, Human
uuaaauuguaaua

SEQ ID NO: 732853 - RNA, 18 nt, Human
uguaaaggaauuuaaaaa

SEQ ID NO: 732854 - RNA, 16 nt, Human
agugaaauauuauuuu

SEQ ID NO: 732855 - RNA, 14 nt, Human
uacuaauuuuaaaa

SEQ ID NO: 732856 - RNA, 15 nt, Human
aaauauaaauaaaaa

SEQ ID NO: 732857 - RNA, 21 nt, Human
aaacaauaacgauaaaagaca

SEQ ID NO: 732858 - RNA, 21 nt, Human
auuauauuuauuacuguaaga

SEQ ID NO: 732859 - RNA, 18 nt, Human
uaauuuuaacucuauaau

SEQ ID NO: 732860 - RNA, 22 nt, Human
uuaccucugccucagaaaacaa

SEQ ID NO: 732861 - RNA, 17 nt, Human
agacagugaaagaaaau

SEQ ID NO: 732862 - RNA, 19 nt, Human
aguauuucuaugaaauauu

SEQ ID NO: 732863 - RNA, 17 nt, Human
aaagacaaggaaaaaau

SEQ ID NO: 732864 - RNA, 22 nt, Human
caaugcuguauuuuaaaagaau

SEQ ID NO: 732865 - RNA, 13 nt, Human
aaaauaacaauga

SEQ ID NO: 732866 - RNA, 23 nt, Human
aggaugguucccuugaugaagaa

SEQ ID NO: 732867 - RNA, 18 nt, Human
auuuuuagugaaauauua

SEQ ID NO: 732868 - RNA, 20 nt, Human
aacaaugcuguauuuuaaaa

SEQ ID NO: 732869 - RNA, 12 nt, Human
cuccauuuuuag

SEQ ID NO: 732870 - RNA, 18 nt, Human
uuacuguaagaaaauauc

SEQ ID NO: 732871 - RNA, 15 nt, Human
cagugaaagaaaaua

SEQ ID NO: 732872 - RNA, 18 nt, Human
uauuuucaguuauuauau

SEQ ID NO: 732873 - RNA, 23 nt, Human
ugucaauucuugccaaauauaaa

SEQ ID NO: 732874 - RNA, 22 nt, Human
gaugguucccuugaugaagaag

SEQ ID NO: 732875 - RNA, 15 nt, Human
auauaaauaaaaaua

SEQ ID NO: 732876 - RNA, 20 nt, Human
aauucuugccaaauauaaau

SEQ ID NO: 732877 - RNA, 22 nt, Human
uuugaaacgaggauugggaaaa

SEQ ID NO: 732878 - RNA, 13 nt, Human
aauuuuuauauuu

SEQ ID NO: 732879 - RNA, 19 nt, Human
auuuucaguuauuauauuu

SEQ ID NO: 732880 - RNA, 20 nt, Human
uaacgauaaaagacagugaa

SEQ ID NO: 732881 - RNA, 16 nt, Human
ugaaauuguauuacaa

SEQ ID NO: 732882 - RNA, 15 nt, Human
uauaauuuaaauaua

SEQ ID NO: 732883 - RNA, 14 nt, Human
aaaagaaacauuug

SEQ ID NO: 732884 - RNA, 22 nt, Human
aaagagugaaggauuuauguuu

SEQ ID NO: 732885 - RNA, 18 nt, Human
uguacuuuauuuucuaua

SEQ ID NO: 732886 - RNA, 17 nt, Human
aaauaacaauaaaagac

SEQ ID NO: 732887 - RNA, 15 nt, Human
acucaacaaacauaa

SEQ ID NO: 732888 - RNA, 20 nt, Human
agaugcaguucugaagaaga

SEQ ID NO: 732889 - RNA, 18 nt, Human
uguauuauuuuuuaaaaa

SEQ ID NO: 732890 - RNA, 15 nt, Human
uuauagcuacuaauu

SEQ ID NO: 732891 - RNA, 15 nt, Human
agucaccucauggaa

SEQ ID NO: 732892 - RNA, 16 nt, Human
ugaauuaguuuuauau

SEQ ID NO: 732893 - RNA, 16 nt, Human
ccuccuuuuaaaguaa

SEQ ID NO: 732894 - RNA, 15 nt, Human
aucuuauaauuuaaa

SEQ ID NO: 732895 - RNA, 14 nt, Human
agaauucauucacu

SEQ ID NO: 732896 - RNA, 13 nt, Human
aagcauuccaacu

SEQ ID NO: 732897 - RNA, 17 nt, Human
aucaaggguacacugcc

SEQ ID NO: 732898 - RNA, 21 nt, Human
uagggugauauuaaccagggg

SEQ ID NO: 732899 - RNA, 16 nt, Human
auccuugaagauuuac

SEQ ID NO: 732900 - RNA, 20 nt, Human
agccuaguugaucagcuuau

SEQ ID NO: 732901 - RNA, 18 nt, Human
uaauaauguuucaaacau

SEQ ID NO: 732902 - RNA, 15 nt, Human
cugacucuuaagaag

SEQ ID NO: 732903 - RNA, 19 nt, Human
augaguaacugauuuguaa

SEQ ID NO: 732904 - RNA, 15 nt, Human
aauacuuuauaaagg

SEQ ID NO: 732905 - RNA, 19 nt, Human
guuauuauauuuacaaaug

SEQ ID NO: 732906 - RNA, 13 nt, Human
gaaccuaggguga

SEQ ID NO: 732907 - RNA, 17 nt, Human
cuucacuguaaaauaau

SEQ ID NO: 732908 - RNA, 19 nt, Human
auuuugugaagcaaaauuu

SEQ ID NO: 732909 - RNA, 18 nt, Human
gacauuugcucauggaau

SEQ ID NO: 732910 - RNA, 17 nt, Human
gccuccuuuuaaaguaa

SEQ ID NO: 732911 - RNA, 19 nt, Human
gcucauggaauuggagcuc

SEQ ID NO: 732912 - RNA, 22 nt, Human
ccauuucuugagguaaaagcau

SEQ ID NO: 732913 - RNA, 22 nt, Human
gaaaacaauaacgauaaaagac

SEQ ID NO: 732914 - RNA, 16 nt, Human
uucuauaauuuaaaua

SEQ ID NO: 732915 - RNA, 18 nt, Human
cagugaaagaaaauaaca

SEQ ID NO: 732916 - RNA, 16 nt, Human
augaauacuuuauaaa

SEQ ID NO: 732917 - RNA, 16 nt, Human
ucuugagguaaaagca

SEQ ID NO: 732918 - RNA, 15 nt, Human
acuuuauaaaggauu

SEQ ID NO: 732919 - RNA, 21 nt, Human
aagucuuucacauuuaaauaa

SEQ ID NO: 732920 - RNA, 18 nt, Human
auuauuuuuuaaaaaaau

SEQ ID NO: 732921 - RNA, 18 nt, Human
ucaaggguacacugccuu

SEQ ID NO: 732922 - RNA, 17 nt, Human
uguaaaggaauuuaaaa

SEQ ID NO: 732923 - RNA, 19 nt, Human
uauuuuaauaauguuucaa

SEQ ID NO: 732924 - RNA, 12 nt, Human
gacgagaaaaca

SEQ ID NO: 732925 - RNA, 15 nt, Human
uuaauucugaaagca

SEQ ID NO: 732926 - RNA, 13 nt, Human
uaacgauaaaaga

SEQ ID NO: 732927 - RNA, 17 nt, Human
aaucuuucacaggggac

SEQ ID NO: 732928 - RNA, 18 nt, Human
uacauuuguauaaaauaa

SEQ ID NO: 732929 - RNA, 14 nt, Human
aauauaaauaaaaa

SEQ ID NO: 732930 - RNA, 16 nt, Human
aaaagcuccauuuuua

SEQ ID NO: 732931 - RNA, 16 nt, Human
auaacuggaaacuuca

SEQ ID NO: 732932 - RNA, 20 nt, Human
uguuggugaacuugguuuua

SEQ ID NO: 732933 - RNA, 18 nt, Human
aaauauaaauaaaaauaa

SEQ ID NO: 732934 - RNA, 22 nt, Human
auuacuguaagaaaauaucacu

SEQ ID NO: 732935 - RNA, 13 nt, Human
cuaugaaauauua

SEQ ID NO: 732936 - RNA, 17 nt, Human
aaucuuauaauuuaaaa

SEQ ID NO: 732937 - RNA, 13 nt, Human
ccucauggaauug

SEQ ID NO: 732938 - RNA, 12 nt, Human
aauacuuuauaa

SEQ ID NO: 732939 - RNA, 22 nt, Human
ccacagcuguaugauucccagc

SEQ ID NO: 732940 - RNA, 14 nt, Human
caguucugaagaag

SEQ ID NO: 732941 - RNA, 16 nt, Human
uauuuuugugauuuug

SEQ ID NO: 732942 - RNA, 18 nt, Human
acaaaugcauuucuaaag

SEQ ID NO: 732943 - RNA, 16 nt, Human
aauauaaauaaaaaua

SEQ ID NO: 732944 - RNA, 19 nt, Human
cuagaguuuagcuggaaaa

SEQ ID NO: 732945 - RNA, 16 nt, Human
cuucacuguaaaauaa

SEQ ID NO: 732946 - RNA, 20 nt, Human
aaugaauacuuuauaaagga

SEQ ID NO: 732947 - RNA, 23 nt, Human
ugaauuacauuuguauaaaauaa

SEQ ID NO: 732948 - RNA, 13 nt, Human
uauuucuaugaaa

SEQ ID NO: 732949 - RNA, 14 nt, Human
ccaaauauaaauaa

SEQ ID NO: 732950 - RNA, 22 nt, Human
agucuuucacauuuaaauaaag

SEQ ID NO: 732951 - RNA, 17 nt, Human
uuuuuaauuauauggcu

SEQ ID NO: 732952 - RNA, 16 nt, Human
gacauuugcucaugga

SEQ ID NO: 732953 - RNA, 20 nt, Human
agcuucacuguaaaauaaua

SEQ ID NO: 732954 - RNA, 21 nt, Human
augaauacuuuauaaaggauu

SEQ ID NO: 732955 - RNA, 20 nt, Human
uggaauaauccuaaacauau

SEQ ID NO: 732956 - RNA, 21 nt, Human
aggacagcccuucuuuccaca

SEQ ID NO: 732957 - RNA, 21 nt, Human
caccagucugacuguuuccau

SEQ ID NO: 732958 - RNA, 17 nt, Human
aaagcuccauuuuuagu

SEQ ID NO: 732959 - RNA, 18 nt, Human
uauagcuacuaauuuuaa

SEQ ID NO: 732960 - RNA, 18 nt, Human
acaaauccaaugaaauga

SEQ ID NO: 732961 - RNA, 15 nt, Human
uagauaggccauggg

SEQ ID NO: 732962 - RNA, 14 nt, Human
cuuucauaauaagu

SEQ ID NO: 732963 - RNA, 15 nt, Human
uguauuuuaaaagaa

SEQ ID NO: 732964 - RNA, 19 nt, Human
cacaggaaccacaagacug

SEQ ID NO: 732965 - RNA, 22 nt, Human
auuuucuucucacauuuauauu

SEQ ID NO: 732966 - RNA, 20 nt, Human
uagaugcaguucugaagaag

SEQ ID NO: 732967 - RNA, 15 nt, Human
aaacauaugaauuau

SEQ ID NO: 732968 - RNA, 20 nt, Human
ugauuauaugucacuuugcu

SEQ ID NO: 732969 - RNA, 21 nt, Human
acagcccuucuuuccacagaa

SEQ ID NO: 732970 - RNA, 13 nt, Human
aacacaacuauau

SEQ ID NO: 732971 - RNA, 23 nt, Human
caaagcugaaauggacuuuugua

SEQ ID NO: 732972 - RNA, 23 nt, Human
aaaauaucacuugucaauaaaau

SEQ ID NO: 732973 - RNA, 12 nt, Human
gaaaauaacaau

SEQ ID NO: 732974 - RNA, 16 nt, Human
cauuuguauaaaauaa

SEQ ID NO: 732975 - RNA, 23 nt, Human
augaauuaaguuuuuuuuuaaaa

SEQ ID NO: 732976 - RNA, 19 nt, Human
auuggagcucgugggacag

SEQ ID NO: 732977 - RNA, 16 nt, Human
uuucacauuuaaauaa

SEQ ID NO: 732978 - RNA, 23 nt, Human
aauauuuauuuuaauaauguuuc

SEQ ID NO: 732979 - RNA, 14 nt, Human
aauauuauuuuaua

SEQ ID NO: 732980 - RNA, 21 nt, Human
agccucuuagaugcaguucug

SEQ ID NO: 732981 - RNA, 17 nt, Human
ggaaauauuuauuuuaa

SEQ ID NO: 732982 - RNA, 20 nt, Human
auaauccuaaacauaugaau

SEQ ID NO: 732983 - RNA, 16 nt, Human
augcuguauuuuaaaa

SEQ ID NO: 732984 - RNA, 21 nt, Human
caucuagcaugucgucaaagc

SEQ ID NO: 732985 - RNA, 20 nt, Human
aaagacaaggaaaaaauaac

SEQ ID NO: 732986 - RNA, 22 nt, Human
aucaucaagucuuucacauuua

SEQ ID NO: 732987 - RNA, 14 nt, Human
augauguuuagaaa

SEQ ID NO: 732988 - RNA, 15 nt, Human
auuauuuuuuaaaaa

SEQ ID NO: 732989 - RNA, 18 nt, Human
uucugauauuggacagua

SEQ ID NO: 732990 - RNA, 22 nt, Human
uauuucuaugaaauauuauguu

SEQ ID NO: 732991 - RNA, 21 nt, Human
acagugaaagaaaauaacaau

SEQ ID NO: 732992 - RNA, 23 nt, Human
caccucauggaauuggagcucgu

SEQ ID NO: 732993 - RNA, 14 nt, Human
aauauuuauuuuaa

SEQ ID NO: 732994 - RNA, 22 nt, Human
auauuuacaaaugggaaacaaa

SEQ ID NO: 732995 - RNA, 19 nt, Human
auuuucuauaauuuaaaua

SEQ ID NO: 732996 - RNA, 15 nt, Human
cagccagcacagccu

SEQ ID NO: 732997 - RNA, 20 nt, Human
acuagaguuuagcuggaaaa

SEQ ID NO: 732998 - RNA, 13 nt, Human
ucuuauaauuuaa

SEQ ID NO: 732999 - RNA, 19 nt, Human
cuaagcuucacuguaaaau

SEQ ID NO: 733000 - RNA, 18 nt, Human
agcaaaauuuuuucucua

SEQ ID NO: 733001 - RNA, 16 nt, Human
gaaaaaauaacaauga

SEQ ID NO: 733002 - RNA, 16 nt, Human
agugaaagaaaauaac

SEQ ID NO: 733003 - RNA, 20 nt, Human
caagagccuuuuuuugaaaa

SEQ ID NO: 733004 - RNA, 17 nt, Human
gacagugaaagaaaaua

SEQ ID NO: 733005 - RNA, 22 nt, Human
uuuuauagcuacuaauuuuaaa

SEQ ID NO: 733006 - RNA, 21 nt, Human
gaaaacaauaacgauaaaaga

SEQ ID NO: 733007 - RNA, 20 nt, Human
uuuaaauaaaguguuugaaa

SEQ ID NO: 733008 - RNA, 21 nt, Human
uuacauuuguauaaaauaauu

SEQ ID NO: 733009 - RNA, 14 nt, Human
auccuugaagauuu

SEQ ID NO: 733010 - RNA, 22 nt, Human
augguuguauuauuuuuuaaaa

SEQ ID NO: 733011 - RNA, 13 nt, Human
ccagcacagccuc

SEQ ID NO: 733012 - RNA, 22 nt, Human
ucuagcaugucgucaaagcuga

SEQ ID NO: 733013 - RNA, 12 nt, Human
aagaaaauaaca

SEQ ID NO: 733014 - RNA, 19 nt, Human
agaaaauaacgauaaaaga

SEQ ID NO: 733015 - RNA, 13 nt, Human
aagacagugaaag

SEQ ID NO: 733016 - RNA, 19 nt, Human
aaaauaacgauaaaagaca

SEQ ID NO: 733017 - RNA, 17 nt, Human
ucuuucacauuuaaaua

SEQ ID NO: 733018 - RNA, 19 nt, Human
aaguugcauagguuuaaua

SEQ ID NO: 733019 - RNA, 19 nt, Human
caauucuugccaaauauaa

SEQ ID NO: 733020 - RNA, 15 nt, Human
auuuuaaaagaauga

SEQ ID NO: 733021 - RNA, 23 nt, Human
cugaaaucauacuucuuaggguu

SEQ ID NO: 733022 - RNA, 12 nt, Human
guagacacacau

SEQ ID NO: 733023 - RNA, 17 nt, Human
agacacacugaagaagc

SEQ ID NO: 733024 - RNA, 15 nt, Leptospira interrogans serovar lai str. 56601
uuuuuguucacuaag

SEQ ID NO: 733025 - RNA, 23 nt, Leptospira interrogans serovar lai str. 56601
uuuugcaaucguccaaucucuuu

SEQ ID NO: 733026 - RNA, 15 nt, Leptospira interrogans serovar lai str. 56601
uuuugagaaaccuuu

SEQ ID NO: 733027 - RNA, 13 nt, Leptospira interrogans serovar lai str. 56601
uuuugaguaauuc

SEQ ID NO: 733028 - RNA, 14 nt, Leptospira interrogans serovar lai str. 56601
uuuuuggaaaucga

SEQ ID NO: 733029 - RNA, 19 nt, Leptospira interrogans serovar lai str. 56601
uuuuucugaaaaaagcuga

SEQ ID NO: 733030 - RNA, 17 nt, Leptospira interrogans serovar lai str. 56601
uuuguaaaaaaauagau

SEQ ID NO: 733031 - RNA, 20 nt, Leptospira interrogans serovar lai str. 56601
uuucgugauaacaaacuuuu

SEQ ID NO: 733032 - RNA, 20 nt, Leptospira interrogans serovar lai str. 56601
uuucgcauaccgaacucacg

SEQ ID NO: 733033 - RNA, 19 nt, Leptospira interrogans serovar lai str. 56601
uuugucguaauuccgacga

SEQ ID NO: 733034 - RNA, 14 nt, Leptospira interrogans serovar lai str. 56601
uuuguccgaaucca

SEQ ID NO: 733035 - RNA, 22 nt, Leptospira interrogans serovar lai str. 56601
uuuuaaucaagugcaguaguuc

SEQ ID NO: 733036 - RNA, 13 nt, Leptospira interrogans serovar lai str. 56601
uuuuagguauuuc

SEQ ID NO: 733037 - RNA, 22 nt, Leptospira interrogans serovar lai str. 56601
uuuuaccaugagcuaauucaac

SEQ ID NO: 733038 - RNA, 18 nt, Leptospira interrogans serovar lai str. 56601
uuuuaucggcguucuaca

SEQ ID NO: 733039 - RNA, 14 nt, Leptospira interrogans serovar lai str. 56601
uuuuauuucuaagu

SEQ ID NO: 733040 - RNA, 20 nt, Leptospira interrogans serovar lai str. 56601
uuuucaaaaauguauccaau

SEQ ID NO: 733041 - RNA, 16 nt, Leptospira interrogans serovar lai str. 56601
uuuucaaaaguauuuu

SEQ ID NO: 733042 - RNA, 22 nt, Leptospira interrogans serovar lai str. 56601
uuuucacauuuuaggaaucaag

SEQ ID NO: 733043 - RNA, 18 nt, Leptospira interrogans serovar lai str. 56601
uuuucucuucuaauucag

SEQ ID NO: 733044 - RNA, 22 nt, Leptospira interrogans serovar lai str. 56601
uuuucucaaaaaaugcauucaa

SEQ ID NO: 733045 - RNA, 22 nt, Leptospira interrogans serovar lai str. 56601
uuuauuauguagccaaaucuga

SEQ ID NO: 733046 - RNA, 16 nt, Leptospira interrogans serovar lai str. 56601
uuuauagucaaauuug

SEQ ID NO: 733047 - RNA, 15 nt, Leptospira interrogans serovar lai str. 56601
uuuauauaaaauuug

SEQ ID NO: 733048 - RNA, 13 nt, Leptospira interrogans serovar lai str. 56601
uuuauacucggaa

SEQ ID NO: 733049 - RNA, 20 nt, Leptospira interrogans serovar lai str. 56601
uuuaaauuuacuacucggac

SEQ ID NO: 733050 - RNA, 16 nt, Leptospira interrogans serovar lai str. 56601
uuuaaauagauucaaa

SEQ ID NO: 733051 - RNA, 18 nt, Leptospira interrogans serovar lai str. 56601
uuucaucucuauaaauug

SEQ ID NO: 733052 - RNA, 23 nt, Leptospira interrogans serovar lai str. 56601
uuucauguccggguuagaaucaa

SEQ ID NO: 733053 - RNA, 14 nt, Leptospira interrogans serovar lai str. 56601
uuuccaaacucaau

SEQ ID NO: 733054 - RNA, 23 nt, Leptospira interrogans serovar lai str. 56601
uuucauugcgggacuuugcucuc

SEQ ID NO: 733055 - RNA, 13 nt, Leptospira interrogans serovar lai str. 56601
uuucgaauucuuu

SEQ ID NO: 733056 - RNA, 14 nt, Leptospira interrogans serovar lai str. 56601
uuguccgaauccaa

SEQ ID NO: 733057 - RNA, 16 nt, Leptospira interrogans serovar lai str. 56601
uugucuacgaucgcaa

SEQ ID NO: 733058 - RNA, 17 nt, Leptospira interrogans serovar lai str. 56601
uugucucaaaauuuaag

SEQ ID NO: 733059 - RNA, 19 nt, Leptospira interrogans serovar lai str. 56601
uuguaugugguaguuccca

SEQ ID NO: 733060 - RNA, 19 nt, Leptospira interrogans serovar lai str. 56601
uuuaaacguuuauuucaaa

SEQ ID NO: 733061 - RNA, 20 nt, Leptospira interrogans serovar lai str. 56601
uuuaaagaaccgacaaucgu

SEQ ID NO: 733062 - RNA, 16 nt, Leptospira interrogans serovar lai str. 56601
uuuaaaaauuagaacu

SEQ ID NO: 733063 - RNA, 22 nt, Leptospira interrogans serovar lai str. 56601
uuguaaagcaacugugggaacu

SEQ ID NO: 733064 - RNA, 13 nt, Leptospira interrogans serovar lai str. 56601
uugcucucgcaau

SEQ ID NO: 733065 - RNA, 15 nt, Leptospira interrogans serovar lai str. 56601
uugcugucgcaacau

SEQ ID NO: 733066 - RNA, 15 nt, Leptospira interrogans serovar lai str. 56601
uuggaaaaaguccuu

SEQ ID NO: 733067 - RNA, 22 nt, Leptospira interrogans serovar lai str. 56601
uuggaaaaaguccuuuugagca

SEQ ID NO: 733068 - RNA, 17 nt, Leptospira interrogans serovar lai str. 56601
uugagcaagaccuugug

SEQ ID NO: 733069 - RNA, 18 nt, Leptospira interrogans serovar lai str. 56601
uuccguuuuuauuucuuu

SEQ ID NO: 733070 - RNA, 20 nt, Leptospira interrogans serovar lai str. 56601
uugaaugagcuagauuuaga

SEQ ID NO: 733071 - RNA, 18 nt, Leptospira interrogans serovar lai str. 56601
uugaauuuuuuaaaugca

SEQ ID NO: 733072 - RNA, 13 nt, Leptospira interrogans serovar lai str. 56601
uugcaucaaagaa

SEQ ID NO: 733073 - RNA, 15 nt, Leptospira interrogans serovar lai str. 56601
uugauaugaaucagc

SEQ ID NO: 733074 - RNA, 12 nt, Leptospira interrogans serovar lai str. 56601
uuccaaguuuuu

SEQ ID NO: 733075 - RNA, 23 nt, Leptospira interrogans serovar lai str. 56601
uuccagaggcaguacaauucaaa

SEQ ID NO: 733076 - RNA, 19 nt, Leptospira interrogans serovar lai str. 56601
uuaugcaaauacaacuuuu

SEQ ID NO: 733077 - RNA, 14 nt, Leptospira interrogans serovar lai str. 56601
uuaugaaagucuuu

SEQ ID NO: 733078 - RNA, 21 nt, Leptospira interrogans serovar lai str. 56601
uuaugauagucaaaacucugu

SEQ ID NO: 733079 - RNA, 19 nt, Leptospira interrogans serovar lai str. 56601
uucaauuuacaucauguaa

SEQ ID NO: 733080 - RNA, 22 nt, Leptospira interrogans serovar lai str. 56601
uucagaaacuggaauauucuuu

SEQ ID NO: 733081 - RNA, 14 nt, Leptospira interrogans serovar lai str. 56601
uuaacaucaaagaa

SEQ ID NO: 733082 - RNA, 21 nt, Leptospira interrogans serovar lai str. 56601
uguuucauguccggguuagaa

SEQ ID NO: 733083 - RNA, 21 nt, Leptospira interrogans serovar lai str. 56601
uuaaucaugugaauucagaaa

SEQ ID NO: 733084 - RNA, 14 nt, Leptospira interrogans serovar lai str. 56601
uuaaucggaacuag

SEQ ID NO: 733085 - RNA, 12 nt, Leptospira interrogans serovar lai str. 56601
uuaaucuguaaa

SEQ ID NO: 733086 - RNA, 22 nt, Leptospira interrogans serovar lai str. 56601
uuaagaaauagaucugauauuu

SEQ ID NO: 733087 - RNA, 20 nt, Leptospira interrogans serovar lai str. 56601
uuaggaaguaaaaucgaguu

SEQ ID NO: 733088 - RNA, 22 nt, Leptospira interrogans serovar lai str. 56601
uuaucuuguguuucaucgaaca

SEQ ID NO: 733089 - RNA, 22 nt, Leptospira interrogans serovar lai str. 56601
uuagacuucucuuuucgaaaau

SEQ ID NO: 733090 - RNA, 14 nt, Leptospira interrogans serovar lai str. 56601
uuagcuaagucuuu

SEQ ID NO: 733091 - RNA, 19 nt, Leptospira interrogans serovar lai str. 56601
uuacuugcaaaaaguaugu

SEQ ID NO: 733092 - RNA, 20 nt, Leptospira interrogans serovar lai str. 56601
uuacagaucgauuccuacuu

SEQ ID NO: 733093 - RNA, 20 nt, Leptospira interrogans serovar lai str. 56601
uuacagauacucaauuugau

SEQ ID NO: 733094 - RNA, 17 nt, Leptospira interrogans serovar lai str. 56601
uuacagauugauucuuu

SEQ ID NO: 733095 - RNA, 18 nt, Leptospira interrogans serovar lai str. 56601
uuaccaauugauaauuug

SEQ ID NO: 733096 - RNA, 20 nt, Leptospira interrogans serovar lai str. 56601
uguaauaguucccacauuug

SEQ ID NO: 733097 - RNA, 14 nt, Leptospira interrogans serovar lai str. 56601
ugguuuuauuucug

SEQ ID NO: 733098 - RNA, 22 nt, Leptospira interrogans serovar lai str. 56601
uggguucuuuacgucaaacuca

SEQ ID NO: 733099 - RNA, 16 nt, Leptospira interrogans serovar lai str. 56601
uguagaaccuggauuu

SEQ ID NO: 733100 - RNA, 19 nt, Leptospira interrogans serovar lai str. 56601
ugugagaguuccacauuuu

SEQ ID NO: 733101 - RNA, 20 nt, Leptospira interrogans serovar lai str. 56601
ugugagaguucccacauuuu

SEQ ID NO: 733102 - RNA, 20 nt, Leptospira interrogans serovar lai str. 56601
uguguuaguucccacauuuu

SEQ ID NO: 733103 - RNA, 23 nt, Leptospira interrogans serovar lai str. 56601
ugugggaacucucacaaaucgug

SEQ ID NO: 733104 - RNA, 20 nt, Leptospira interrogans serovar lai str. 56601
ugugggaguucccacauuua

SEQ ID NO: 733105 - RNA, 23 nt, Leptospira interrogans serovar lai str. 56601
uguuaaccaccucuauggaauuu

SEQ ID NO: 733106 - RNA, 23 nt, Leptospira interrogans serovar lai str. 56601
uguuaaucgccgcuauggaauuu

SEQ ID NO: 733107 - RNA, 23 nt, Leptospira interrogans serovar lai str. 56601
uguuaauuguuguuauggaauuu

SEQ ID NO: 733108 - RNA, 20 nt, Leptospira interrogans serovar lai str. 56601
ugggaauuacuauggaauau

SEQ ID NO: 733109 - RNA, 19 nt, Leptospira interrogans serovar lai str. 56601
uggaucggcuccauauucc

SEQ ID NO: 733110 - RNA, 21 nt, Leptospira interrogans serovar lai str. 56601
uggauuuuuacaccaaacuca

SEQ ID NO: 733111 - RNA, 16 nt, Leptospira interrogans serovar lai str. 56601
ugcauauacggauuuc

SEQ ID NO: 733112 - RNA, 16 nt, Leptospira interrogans serovar lai str. 56601
ugcauaggugauuaaa

SEQ ID NO: 733113 - RNA, 13 nt, Leptospira interrogans serovar lai str. 56601
ugcggagaauguu

SEQ ID NO: 733114 - RNA, 18 nt, Leptospira interrogans serovar lai str. 56601
ugcgacuacgauuucauc

SEQ ID NO: 733115 - RNA, 23 nt, Leptospira interrogans serovar lai str. 56601
ugccucuacaaguucauaagauu

SEQ ID NO: 733116 - RNA, 16 nt, Leptospira interrogans serovar lai str. 56601
ugacuuaagaaauaga

SEQ ID NO: 733117 - RNA, 20 nt, Leptospira interrogans serovar lai str. 56601
ugacugaaaaaaacgucuuu

SEQ ID NO: 733118 - RNA, 20 nt, Leptospira interrogans serovar lai str. 56601
ugcaaaagcuccuuucaucu

SEQ ID NO: 733119 - RNA, 22 nt, Leptospira interrogans serovar lai str. 56601
ugcaaaaucaguuaauacaaaa

SEQ ID NO: 733120 - RNA, 22 nt, Leptospira interrogans serovar lai str. 56601
ugauucugaaaaaaguuagaau

SEQ ID NO: 733121 - RNA, 16 nt, Leptospira interrogans serovar lai str. 56601
ugauuaaaccgguaaa

SEQ ID NO: 733122 - RNA, 21 nt, Leptospira interrogans serovar lai str. 56601
ugcaauacauucuuauaaaga

SEQ ID NO: 733123 - RNA, 17 nt, Leptospira interrogans serovar lai str. 56601
ugcaauuuuacuuauac

SEQ ID NO: 733124 - RNA, 16 nt, Leptospira interrogans serovar lai str. 56601
ugaguuaauuuucgau

SEQ ID NO: 733125 - RNA, 19 nt, Leptospira interrogans serovar lai str. 56601
ugaguuucacaaaaugcug

SEQ ID NO: 733126 - RNA, 15 nt, Leptospira interrogans serovar lai str. 56601
ugaagaaaaaaagau

SEQ ID NO: 733127 - RNA, 15 nt, Leptospira interrogans serovar lai str. 56601
ugaaguuaagaagau

SEQ ID NO: 733128 - RNA, 20 nt, Leptospira interrogans serovar lai str. 56601
ugaaguauuuuacgauucaa

SEQ ID NO: 733129 - RNA, 13 nt, Leptospira interrogans serovar lai str. 56601
ugaauucauugua

SEQ ID NO: 733130 - RNA, 21 nt, Leptospira interrogans serovar lai str. 56601
ugaauuuaggaaauuuucaau

SEQ ID NO: 733131 - RNA, 20 nt, Leptospira interrogans serovar lai str. 56601
ugaauuuuacuaaaaauuca

SEQ ID NO: 733132 - RNA, 19 nt, Leptospira interrogans serovar lai str. 56601
ugaauuugaggagaaucua

SEQ ID NO: 733133 - RNA, 22 nt, Leptospira interrogans serovar lai str. 56601
ugaauacguuauucuauucgua

SEQ ID NO: 733134 - RNA, 16 nt, Leptospira interrogans serovar lai str. 56601
ugaaauagaaaacaga

SEQ ID NO: 733135 - RNA, 13 nt, Leptospira interrogans serovar lai str. 56601
ucuuucuuccgga

SEQ ID NO: 733136 - RNA, 14 nt, Leptospira interrogans serovar lai str. 56601
ucuuucuuccggau

SEQ ID NO: 733137 - RNA, 20 nt, Leptospira interrogans serovar lai str. 56601
ucucccacacauuccgcaaa

SEQ ID NO: 733138 - RNA, 23 nt, Leptospira interrogans serovar lai str. 56601
ugaaaguaauuuaucuguaauuu

SEQ ID NO: 733139 - RNA, 21 nt, Leptospira interrogans serovar lai str. 56601
ugaaacuugaacuguuuaauu

SEQ ID NO: 733140 - RNA, 18 nt, Leptospira interrogans serovar lai str. 56601
ucuuugcgauuuuuccga

SEQ ID NO: 733141 - RNA, 22 nt, Leptospira interrogans serovar lai str. 56601
ucuuuuagaaguggaucuugaa

SEQ ID NO: 733142 - RNA, 20 nt, Leptospira interrogans serovar lai str. 56601
ucgaucuguaaaguucagau

SEQ ID NO: 733143 - RNA, 19 nt, Leptospira interrogans serovar lai str. 56601
ucgaucuguaaaguuuaga

SEQ ID NO: 733144 - RNA, 16 nt, Leptospira interrogans serovar lai str. 56601
ucgauaauucuuuaga

SEQ ID NO: 733145 - RNA, 21 nt, Leptospira interrogans serovar lai str. 56601
ucgaguccuuuuugagaaacu

SEQ ID NO: 733146 - RNA, 22 nt, Leptospira interrogans serovar lai str. 56601
ucgauuccuacuuauuucuaua

SEQ ID NO: 733147 - RNA, 15 nt, Leptospira interrogans serovar lai str. 56601
ucgauuugagcgcag

SEQ ID NO: 733148 - RNA, 18 nt, Leptospira interrogans serovar lai str. 56601
ucgacuuuaguucuccua

SEQ ID NO: 733149 - RNA, 20 nt, Leptospira interrogans serovar lai str. 56601
ucgcagcauaauaaucgcuu

SEQ ID NO: 733150 - RNA, 20 nt, Leptospira interrogans serovar lai str. 56601
ucuaaaauccuauucaacuu

SEQ ID NO: 733151 - RNA, 20 nt, Leptospira interrogans serovar lai str. 56601
ucuaaaauuguaggaacuac

SEQ ID NO: 733152 - RNA, 20 nt, Leptospira interrogans serovar lai str. 56601
ucuaaaauuuguaggaacuc

SEQ ID NO: 733153 - RNA, 14 nt, Leptospira interrogans serovar lai str. 56601
ucguuguauggaaa

SEQ ID NO: 733154 - RNA, 12 nt, Leptospira interrogans serovar lai str. 56601
ucuaacugguuu

SEQ ID NO: 733155 - RNA, 22 nt, Leptospira interrogans serovar lai str. 56601
ucuaaguccacccaaaccggag

SEQ ID NO: 733156 - RNA, 15 nt, Leptospira interrogans serovar lai str. 56601
ucuaauaaaauauga

SEQ ID NO: 733157 - RNA, 19 nt, Leptospira interrogans serovar lai str. 56601
ucuauaaacucaaagaauu

SEQ ID NO: 733158 - RNA, 22 nt, Leptospira interrogans serovar lai str. 56601
uccgauuugguuuucauucaaa

SEQ ID NO: 733159 - RNA, 22 nt, Leptospira interrogans serovar lai str. 56601
uccggcuaaaaaacugauuaaa

SEQ ID NO: 733160 - RNA, 15 nt, Leptospira interrogans serovar lai str. 56601
ucccaguaaauccac

SEQ ID NO: 733161 - RNA, 16 nt, Leptospira interrogans serovar lai str. 56601
uccauaaaaaaugaau

SEQ ID NO: 733162 - RNA, 16 nt, Leptospira interrogans serovar lai str. 56601
ucccacacauuccgca

SEQ ID NO: 733163 - RNA, 22 nt, Leptospira interrogans serovar lai str. 56601
ucccacauuuuugugaaacuua

SEQ ID NO: 733164 - RNA, 16 nt, Leptospira interrogans serovar lai str. 56601
ucccacuuuuaaagaa

SEQ ID NO: 733165 - RNA, 15 nt, Leptospira interrogans serovar lai str. 56601
uccccuugauuccac

SEQ ID NO: 733166 - RNA, 14 nt, Leptospira interrogans serovar lai str. 56601
ucaguaaacucaau

SEQ ID NO: 733167 - RNA, 15 nt, Leptospira interrogans serovar lai str. 56601
ucaucuaaucgaaac

SEQ ID NO: 733168 - RNA, 12 nt, Leptospira interrogans serovar lai str. 56601
uccaauccaaaa

SEQ ID NO: 733169 - RNA, 17 nt, Leptospira interrogans serovar lai str. 56601
uccaauuccuucggaau

SEQ ID NO: 733170 - RNA, 22 nt, Leptospira interrogans serovar lai str. 56601
ucauuuguagagaugauugauu

SEQ ID NO: 733171 - RNA, 15 nt, Leptospira interrogans serovar lai str. 56601
ucauuuuaaacgaac

SEQ ID NO: 733172 - RNA, 13 nt, Leptospira interrogans serovar lai str. 56601
ucauuagaguuau

SEQ ID NO: 733173 - RNA, 22 nt, Leptospira interrogans serovar lai str. 56601
uccaguuggggggaauauacgu

SEQ ID NO: 733174 - RNA, 18 nt, Leptospira interrogans serovar lai str. 56601
ucagaaucauuggaguuu

SEQ ID NO: 733175 - RNA, 17 nt, Leptospira interrogans serovar lai str. 56601
ucaauuuaaaacgagau

SEQ ID NO: 733176 - RNA, 20 nt, Leptospira interrogans serovar lai str. 56601
ucaaugugcgaucaacaagu

SEQ ID NO: 733177 - RNA, 17 nt, Leptospira interrogans serovar lai str. 56601
ucacaauuuuacaaaca

SEQ ID NO: 733178 - RNA, 23 nt, Leptospira interrogans serovar lai str. 56601
ucacaauuuuuuuagaaucauga

SEQ ID NO: 733179 - RNA, 17 nt, Leptospira interrogans serovar lai str. 56601
ucacaaaucauggauuu

SEQ ID NO: 733180 - RNA, 12 nt, Leptospira interrogans serovar lai str. 56601
ucaauuuuccau

SEQ ID NO: 733181 - RNA, 14 nt, Leptospira interrogans serovar lai str. 56601
ucaauuuuccauuu

SEQ ID NO: 733182 - RNA, 15 nt, Leptospira interrogans serovar lai str. 56601
ucacauuuaaggaau

SEQ ID NO: 733183 - RNA, 15 nt, Leptospira interrogans serovar lai str. 56601
ucacauuuuaggaau

SEQ ID NO: 733184 - RNA, 14 nt, Leptospira interrogans serovar lai str. 56601
ucaauaaaacguuu

SEQ ID NO: 733185 - RNA, 23 nt, Leptospira interrogans serovar lai str. 56601
ucaauaauccagcugaaacuaau

SEQ ID NO: 733186 - RNA, 13 nt, Leptospira interrogans serovar lai str. 56601
ucaauaacuugac

SEQ ID NO: 733187 - RNA, 20 nt, Leptospira interrogans serovar lai str. 56601
ucaauacaauaaaaacagau

SEQ ID NO: 733188 - RNA, 21 nt, Leptospira interrogans serovar lai str. 56601
ucaaguuauuguaaaacucca

SEQ ID NO: 733189 - RNA, 16 nt, Leptospira interrogans serovar lai str. 56601
ucaaguaaaacguaga

SEQ ID NO: 733190 - RNA, 21 nt, Leptospira interrogans serovar lai str. 56601
ucaaguaacgaguagaauucu

SEQ ID NO: 733191 - RNA, 17 nt, Leptospira interrogans serovar lai str. 56601
ucaauccuguaaauuca

SEQ ID NO: 733192 - RNA, 19 nt, Leptospira interrogans serovar lai str. 56601
ucaaucuauuaacuuuaca

SEQ ID NO: 733193 - RNA, 20 nt, Leptospira interrogans serovar lai str. 56601
ucaagauuuuacgaacaaau

SEQ ID NO: 733194 - RNA, 16 nt, Leptospira interrogans serovar lai str. 56601
ucaagaucacaauuuu

SEQ ID NO: 733195 - RNA, 17 nt, Leptospira interrogans serovar lai str. 56601
ucaacuacuaaucucua

SEQ ID NO: 733196 - RNA, 19 nt, Leptospira interrogans serovar lai str. 56601
ucaacucuguaaauucaaa

SEQ ID NO: 733197 - RNA, 19 nt, Leptospira interrogans serovar lai str. 56601
ucaaaucuacaaaacuuua

SEQ ID NO: 733198 - RNA, 13 nt, Leptospira interrogans serovar lai str. 56601
ucaacaaacaaau

SEQ ID NO: 733199 - RNA, 17 nt, Leptospira interrogans serovar lai str. 56601
ucaaaauuuaaauccca

SEQ ID NO: 733200 - RNA, 20 nt, Leptospira interrogans serovar lai str. 56601
ucaaaauuuaaaucccauuu

SEQ ID NO: 733201 - RNA, 19 nt, Leptospira interrogans serovar lai str. 56601
ucaaacacucuaaaucuua

SEQ ID NO: 733202 - RNA, 20 nt, Leptospira interrogans serovar lai str. 56601
ucaaagaaaugugggaacuc

SEQ ID NO: 733203 - RNA, 22 nt, Leptospira interrogans serovar lai str. 56601
ucaaagaauuucggcuugauac

SEQ ID NO: 733204 - RNA, 22 nt, Leptospira interrogans serovar lai str. 56601
uauuuaguccguccacaaauug

SEQ ID NO: 733205 - RNA, 15 nt, Leptospira interrogans serovar lai str. 56601
ucaaaaaaauuaaac

SEQ ID NO: 733206 - RNA, 23 nt, Leptospira interrogans serovar lai str. 56601
ucaaaaaauuuuuacgcguaauu

SEQ ID NO: 733207 - RNA, 18 nt, Leptospira interrogans serovar lai str. 56601
ucaaaacuuuuucgaacu

SEQ ID NO: 733208 - RNA, 16 nt, Leptospira interrogans serovar lai str. 56601
ucaaaaauaaauuccc

SEQ ID NO: 733209 - RNA, 21 nt, Leptospira interrogans serovar lai str. 56601
ucaaaaccauuuuugcucaga

SEQ ID NO: 733210 - RNA, 23 nt, Leptospira interrogans serovar lai str. 56601
uauugaauccaucugagaauuuc

SEQ ID NO: 733211 - RNA, 18 nt, Leptospira interrogans serovar lai str. 56601
uauuacuuuuuaaacgau

SEQ ID NO: 733212 - RNA, 19 nt, Leptospira interrogans serovar lai str. 56601
uauuagaauaguaguuuuc

SEQ ID NO: 733213 - RNA, 20 nt, Leptospira interrogans serovar lai str. 56601
uauuagaguuguugaaaggg

SEQ ID NO: 733214 - RNA, 20 nt, Leptospira interrogans serovar lai str. 56601
uagaauuuguucgugaaauu

SEQ ID NO: 733215 - RNA, 15 nt, Leptospira interrogans serovar lai str. 56601
uagaauuuguuugua

SEQ ID NO: 733216 - RNA, 17 nt, Leptospira interrogans serovar lai str. 56601
uagaauccaauacaaaa

SEQ ID NO: 733217 - RNA, 15 nt, Leptospira interrogans serovar lai str. 56601
uagaaucuaaacuuu

SEQ ID NO: 733218 - RNA, 17 nt, Leptospira interrogans serovar lai str. 56601
uagaaucuaaacuuuac

SEQ ID NO: 733219 - RNA, 19 nt, Leptospira interrogans serovar lai str. 56601
uacuuuugaaauagauucu

SEQ ID NO: 733220 - RNA, 11 nt, Leptospira interrogans serovar lai str. 56601
uacuugcaaaa

SEQ ID NO: 733221 - RNA, 21 nt, Leptospira interrogans serovar lai str. 56601
uagagagcguuuuacugaguu

SEQ ID NO: 733222 - RNA, 12 nt, Leptospira interrogans serovar lai str. 56601
uacuaauucaau

SEQ ID NO: 733223 - RNA, 15 nt, Leptospira interrogans serovar lai str. 56601
uacuaauucaauaag

SEQ ID NO: 733224 - RNA, 16 nt, Leptospira interrogans serovar lai str. 56601
uacugaguuucaaacg

SEQ ID NO: 733225 - RNA, 22 nt, Leptospira interrogans serovar lai str. 56601
uagaguguuguguugaguuuca

SEQ ID NO: 733226 - RNA, 14 nt, Leptospira interrogans serovar lai str. 56601
uacauaucaauccu

SEQ ID NO: 733227 - RNA, 19 nt, Leptospira interrogans serovar lai str. 56601
uacauaggaaccugauuuc

SEQ ID NO: 733228 - RNA, 23 nt, Leptospira interrogans serovar lai str. 56601
uacccacucuuugacuacuuccg

SEQ ID NO: 733229 - RNA, 17 nt, Leptospira interrogans serovar lai str. 56601
uacgauucaauucggaa

SEQ ID NO: 733230 - RNA, 13 nt, Leptospira interrogans serovar lai str. 56601
uaaguucaaauuu

SEQ ID NO: 733231 - RNA, 20 nt, Leptospira interrogans serovar lai str. 56601
uaaguuccccuacgcuucca

SEQ ID NO: 733232 - RNA, 22 nt, Leptospira interrogans serovar lai str. 56601
uaaguucgucgucuauaaauuc

SEQ ID NO: 733233 - RNA, 17 nt, Leptospira interrogans serovar lai str. 56601
uaaguagauaaauucuu

SEQ ID NO: 733234 - RNA, 12 nt, Leptospira interrogans serovar lai str. 56601
uaaucggaaaua

SEQ ID NO: 733235 - RNA, 16 nt, Leptospira interrogans serovar lai str. 56601
uaaugaaggaauugga

SEQ ID NO: 733236 - RNA, 16 nt, Leptospira interrogans serovar lai str. 56601
uaaguuuuuaaaucca

SEQ ID NO: 733237 - RNA, 21 nt, Leptospira interrogans serovar lai str. 56601
uaauuucuucauaucaaauuc

SEQ ID NO: 733238 - RNA, 22 nt, Leptospira interrogans serovar lai str. 56601
uaauuucuucauaucaaauuca

SEQ ID NO: 733239 - RNA, 15 nt, Leptospira interrogans serovar lai str. 56601
uaauucuuuagaaau

SEQ ID NO: 733240 - RNA, 19 nt, Leptospira interrogans serovar lai str. 56601
uaauugaaugaagauuacu

SEQ ID NO: 733241 - RNA, 21 nt, Leptospira interrogans serovar lai str. 56601
uaauucugaaaaaguuagaau

SEQ ID NO: 733242 - RNA, 18 nt, Leptospira interrogans serovar lai str. 56601
uaauucuucaauaucuuu

SEQ ID NO: 733243 - RNA, 14 nt, Leptospira interrogans serovar lai str. 56601
uaauugaaacgaau

SEQ ID NO: 733244 - RNA, 20 nt, Leptospira interrogans serovar lai str. 56601
uacaaaaaacugaaacuuga

SEQ ID NO: 733245 - RNA, 15 nt, Leptospira interrogans serovar lai str. 56601
uaauuuguaauucug

SEQ ID NO: 733246 - RNA, 14 nt, Leptospira interrogans serovar lai str. 56601
uaauuuguaggaau

SEQ ID NO: 733247 - RNA, 18 nt, Leptospira interrogans serovar lai str. 56601
uacaaucccggcggaaaa

SEQ ID NO: 733248 - RNA, 15 nt, Leptospira interrogans serovar lai str. 56601
uacaauuguaggaau

SEQ ID NO: 733249 - RNA, 21 nt, Leptospira interrogans serovar lai str. 56601
uacaaucacuuuauauugguu

SEQ ID NO: 733250 - RNA, 14 nt, Leptospira interrogans serovar lai str. 56601
uacaauuuuagaau

SEQ ID NO: 733251 - RNA, 22 nt, Leptospira interrogans serovar lai str. 56601
uaacucaaaauuucggaaccgg

SEQ ID NO: 733252 - RNA, 18 nt, Leptospira interrogans serovar lai str. 56601
uaaagugagcggguaauu

SEQ ID NO: 733253 - RNA, 18 nt, Leptospira interrogans serovar lai str. 56601
uaaauacuuuauaauuga

SEQ ID NO: 733254 - RNA, 13 nt, Leptospira interrogans serovar lai str. 56601
uaaaucgcaaaua

SEQ ID NO: 733255 - RNA, 21 nt, Leptospira interrogans serovar lai str. 56601
uaaacccgccuuguguucauc

SEQ ID NO: 733256 - RNA, 18 nt, Leptospira interrogans serovar lai str. 56601
uaaaaucacaaaaaagau

SEQ ID NO: 733257 - RNA, 14 nt, Leptospira interrogans serovar lai str. 56601
uaaaauaugaguuu

SEQ ID NO: 733258 - RNA, 21 nt, Leptospira interrogans serovar lai str. 56601
uaaaauauuugcauaaacuuc

SEQ ID NO: 733259 - RNA, 20 nt, Leptospira interrogans serovar lai str. 56601
uaaaauaccaauaacuuaac

SEQ ID NO: 733260 - RNA, 15 nt, Leptospira interrogans serovar lai str. 56601
uaaaauagaaacaga

SEQ ID NO: 733261 - RNA, 20 nt, Leptospira interrogans serovar lai str. 56601
uaaagauuuucuaagaaucu

SEQ ID NO: 733262 - RNA, 16 nt, Leptospira interrogans serovar lai str. 56601
uaaacugucggaauua

SEQ ID NO: 733263 - RNA, 17 nt, Leptospira interrogans serovar lai str. 56601
uaaacuguaaacuugau

SEQ ID NO: 733264 - RNA, 17 nt, Leptospira interrogans serovar lai str. 56601
uaaaaagcguuucauug

SEQ ID NO: 733265 - RNA, 15 nt, Leptospira interrogans serovar lai str. 56601
uaaaaauucuucguu

SEQ ID NO: 733266 - RNA, 13 nt, Leptospira interrogans serovar lai str. 56601
uaaaaauugaucu

SEQ ID NO: 733267 - RNA, 22 nt, Leptospira interrogans serovar lai str. 56601
uaaaaauacuaaaagaguaauu

SEQ ID NO: 733268 - RNA, 12 nt, Leptospira interrogans serovar lai str. 56601
uaaaagugaauu

SEQ ID NO: 733269 - RNA, 14 nt, Leptospira interrogans serovar lai str. 56601
uaaaaguaguaguc

SEQ ID NO: 733270 - RNA, 15 nt, Leptospira interrogans serovar lai str. 56601
uaaaaguuugauuuc

SEQ ID NO: 733271 - RNA, 17 nt, Leptospira interrogans serovar lai str. 56601
uaaaauaacgugaguuu

SEQ ID NO: 733272 - RNA, 19 nt, Leptospira interrogans serovar lai str. 56601
uaaaaauuagaacuguguu

SEQ ID NO: 733273 - RNA, 19 nt, Leptospira interrogans serovar lai str. 56601
guucccacaaauuccaauu

SEQ ID NO: 733274 - RNA, 14 nt, Leptospira interrogans serovar lai str. 56601
guucccacaguucc

SEQ ID NO: 733275 - RNA, 16 nt, Leptospira interrogans serovar lai str. 56601
guucccacauucgauu

SEQ ID NO: 733276 - RNA, 23 nt, Leptospira interrogans serovar lai str. 56601
guucccacauuuuaagaaucgau

SEQ ID NO: 733277 - RNA, 16 nt, Leptospira interrogans serovar lai str. 56601
guuccuguggaaacgu

SEQ ID NO: 733278 - RNA, 21 nt, Leptospira interrogans serovar lai str. 56601
guucuuaaauaaaauuuuccg

SEQ ID NO: 733279 - RNA, 17 nt, Leptospira interrogans serovar lai str. 56601
guucuguugaguucauu

SEQ ID NO: 733280 - RNA, 22 nt, Leptospira interrogans serovar lai str. 56601
guucgccuacacuguguucuuu

SEQ ID NO: 733281 - RNA, 17 nt, Leptospira interrogans serovar lai str. 56601
guuauaacguagauuac

SEQ ID NO: 733282 - RNA, 14 nt, Leptospira interrogans serovar lai str. 56601
guuauagaugaaau

SEQ ID NO: 733283 - RNA, 16 nt, Leptospira interrogans serovar lai str. 56601
guuacgcugaguuuga

SEQ ID NO: 733284 - RNA, 23 nt, Leptospira interrogans serovar lai str. 56601
guuacauuugguaauuugugaac

SEQ ID NO: 733285 - RNA, 20 nt, Leptospira interrogans serovar lai str. 56601
guucaucuucucguucggaa

SEQ ID NO: 733286 - RNA, 23 nt, Leptospira interrogans serovar lai str. 56601
guuaauacaaaacuuaaauucgg

SEQ ID NO: 733287 - RNA, 16 nt, Leptospira interrogans serovar lai str. 56601
guguuugcugaguuau

SEQ ID NO: 733288 - RNA, 17 nt, Leptospira interrogans serovar lai str. 56601
gugacggcaaugugcaa

SEQ ID NO: 733289 - RNA, 15 nt, Leptospira interrogans serovar lai str. 56601
gucuugaacuuucuu

SEQ ID NO: 733290 - RNA, 11 nt, Leptospira interrogans serovar lai str. 56601
gguaacucagc

SEQ ID NO: 733291 - RNA, 18 nt, Leptospira interrogans serovar lai str. 56601
guauauauuaaaguauua

SEQ ID NO: 733292 - RNA, 15 nt, Leptospira interrogans serovar lai str. 56601
guauagaaaccgauu

SEQ ID NO: 733293 - RNA, 18 nt, Leptospira interrogans serovar lai str. 56601
guaguagucccacauuuu

SEQ ID NO: 733294 - RNA, 15 nt, Leptospira interrogans serovar lai str. 56601
guacuuacuaaacga

SEQ ID NO: 733295 - RNA, 13 nt, Leptospira interrogans serovar lai str. 56601
guagcaagaacug

SEQ ID NO: 733296 - RNA, 15 nt, Leptospira interrogans serovar lai str. 56601
gguuuguaacuccua

SEQ ID NO: 733297 - RNA, 19 nt, Leptospira interrogans serovar lai str. 56601
gguuuggaguagauuccua

SEQ ID NO: 733298 - RNA, 12 nt, Leptospira interrogans serovar lai str. 56601
guaaaguucuuu

SEQ ID NO: 733299 - RNA, 15 nt, Leptospira interrogans serovar lai str. 56601
guaaauaccuguucg

SEQ ID NO: 733300 - RNA, 22 nt, Leptospira interrogans serovar lai str. 56601
guaaauaucaaaugugagaguu

SEQ ID NO: 733301 - RNA, 19 nt, Leptospira interrogans serovar lai str. 56601
guaaaucgaugguuucaau

SEQ ID NO: 733302 - RNA, 13 nt, Leptospira interrogans serovar lai str. 56601
guaauucuuugga

SEQ ID NO: 733303 - RNA, 19 nt, Leptospira interrogans serovar lai str. 56601
guacaacauccuucaaacu

SEQ ID NO: 733304 - RNA, 20 nt, Leptospira interrogans serovar lai str. 56601
ggauucuacgacaacuauaa

SEQ ID NO: 733305 - RNA, 15 nt, Leptospira interrogans serovar lai str. 56601
gcgaguaacgauuuc

SEQ ID NO: 733306 - RNA, 18 nt, Leptospira interrogans serovar lai str. 56601
gcguuuuguuaauuguug

SEQ ID NO: 733307 - RNA, 15 nt, Leptospira interrogans serovar lai str. 56601
gcguauaagaauguu

SEQ ID NO: 733308 - RNA, 13 nt, Leptospira interrogans serovar lai str. 56601
gcguaagaaaguu

SEQ ID NO: 733309 - RNA, 15 nt, Leptospira interrogans serovar lai str. 56601
gcucgaaguaacuca

SEQ ID NO: 733310 - RNA, 22 nt, Leptospira interrogans serovar lai str. 56601
gcucuaggcgauuuuucgaaac

SEQ ID NO: 733311 - RNA, 22 nt, Leptospira interrogans serovar lai str. 56601
ggaaauucuuuuccaaaaacuu

SEQ ID NO: 733312 - RNA, 16 nt, Leptospira interrogans serovar lai str. 56601
ggaaauagaaagacuu

SEQ ID NO: 733313 - RNA, 14 nt, Leptospira interrogans serovar lai str. 56601
ggacuuuccgaaua

SEQ ID NO: 733314 - RNA, 14 nt, Leptospira interrogans serovar lai str. 56601
ggaauuuuuuugua

SEQ ID NO: 733315 - RNA, 15 nt, Leptospira interrogans serovar lai str. 56601
ggaauauucuuuuua

SEQ ID NO: 733316 - RNA, 12 nt, Leptospira interrogans serovar lai str. 56601
uucauuuccaau

SEQ ID NO: 733317 - RNA, 21 nt, Leptospira interrogans serovar lai str. 56601
uuccaaaaacucaaagaauuu

SEQ ID NO: 733318 - RNA, 13 nt, Leptospira interrogans serovar lai str. 56601
uucauuaaacaau

SEQ ID NO: 733319 - RNA, 13 nt, Leptospira interrogans serovar lai str. 56601
uuccgauuucuuu

SEQ ID NO: 733320 - RNA, 14 nt, Leptospira interrogans serovar lai str. 56601
uucacuuuuccaaa

SEQ ID NO: 733321 - RNA, 19 nt, Leptospira interrogans serovar lai str. 56601
uucaucuguggagaaaauu

SEQ ID NO: 733322 - RNA, 21 nt, Leptospira interrogans serovar lai str. 56601
uuccgcuguaguaucucuugu

SEQ ID NO: 733323 - RNA, 20 nt, Leptospira interrogans serovar lai str. 56601
uucgaaacaaaaucaaagag

SEQ ID NO: 733324 - RNA, 14 nt, Leptospira interrogans serovar lai str. 56601
uuccuuucucugaa

SEQ ID NO: 733325 - RNA, 20 nt, Leptospira interrogans serovar lai str. 56601
uucgacauaagaaagaauuu

SEQ ID NO: 733326 - RNA, 14 nt, Leptospira interrogans serovar lai str. 56601
uucuacauucugaa

SEQ ID NO: 733327 - RNA, 15 nt, Leptospira interrogans serovar lai str. 56601
uucuagaaagaauuu

SEQ ID NO: 733328 - RNA, 22 nt, Leptospira interrogans serovar lai str. 56601
uucuccacuuaaaaaguuuuuc

SEQ ID NO: 733329 - RNA, 23 nt, Leptospira interrogans serovar lai str. 56601
uucucgaaaaucucagaaaauuu

SEQ ID NO: 733330 - RNA, 17 nt, Leptospira interrogans serovar lai str. 56601
uucuaaauugagaauuu

SEQ ID NO: 733331 - RNA, 18 nt, Leptospira interrogans serovar lai str. 56601
uucuaaaauauaggaacu

SEQ ID NO: 733332 - RNA, 20 nt, Leptospira interrogans serovar lai str. 56601
uucguugccggagccaaauu

SEQ ID NO: 733333 - RNA, 21 nt, Leptospira interrogans serovar lai str. 56601
uuagagugccgcaccuuuugg

SEQ ID NO: 733334 - RNA, 17 nt, Leptospira interrogans serovar lai str. 56601
uuagccuggaauucuuu

SEQ ID NO: 733335 - RNA, 17 nt, Leptospira interrogans serovar lai str. 56601
uuacgugauaauucuuu

SEQ ID NO: 733336 - RNA, 18 nt, Leptospira interrogans serovar lai str. 56601
uuacuaaaaauucauauu

SEQ ID NO: 733337 - RNA, 13 nt, Leptospira interrogans serovar lai str. 56601
uuagaaucuaucu

SEQ ID NO: 733338 - RNA, 21 nt, Leptospira interrogans serovar lai str. 56601
uuagaaucugaaccugcaaau

SEQ ID NO: 733339 - RNA, 16 nt, Leptospira interrogans serovar lai str. 56601
uuacgcugaguuugag

SEQ ID NO: 733340 - RNA, 18 nt, Leptospira interrogans serovar lai str. 56601
uuaguaaaaaucaacuug

SEQ ID NO: 733341 - RNA, 19 nt, Leptospira interrogans serovar lai str. 56601
uuauaaaucuguacuuaaa

SEQ ID NO: 733342 - RNA, 14 nt, Leptospira interrogans serovar lai str. 56601
uuaucagaaccuuu

SEQ ID NO: 733343 - RNA, 17 nt, Leptospira interrogans serovar lai str. 56601
uuacacuccucaaagau

SEQ ID NO: 733344 - RNA, 12 nt, Leptospira interrogans serovar lai str. 56601
uuacagaagauu

SEQ ID NO: 733345 - RNA, 15 nt, Leptospira interrogans serovar lai str. 56601
uuacagaucaauucu

SEQ ID NO: 733346 - RNA, 19 nt, Leptospira interrogans serovar lai str. 56601
uuacaguaaaaucuaaauu

SEQ ID NO: 733347 - RNA, 16 nt, Leptospira interrogans serovar lai str. 56601
uuaaacaauugauugc

SEQ ID NO: 733348 - RNA, 18 nt, Leptospira interrogans serovar lai str. 56601
uuaaaugugcgggaacuc

SEQ ID NO: 733349 - RNA, 17 nt, Leptospira interrogans serovar lai str. 56601
uuaaaugugggaacuac

SEQ ID NO: 733350 - RNA, 19 nt, Leptospira interrogans serovar lai str. 56601
uguugaaaagugaguuuuc

SEQ ID NO: 733351 - RNA, 18 nt, Leptospira interrogans serovar lai str. 56601
ugugcaaaggaguauuuu

SEQ ID NO: 733352 - RNA, 16 nt, Leptospira interrogans serovar lai str. 56601
ugucuuuaauuucaau

SEQ ID NO: 733353 - RNA, 17 nt, Leptospira interrogans serovar lai str. 56601
ugucuggaacggaaaug

SEQ ID NO: 733354 - RNA, 16 nt, Leptospira interrogans serovar lai str. 56601
ugucaauuuuccagau

SEQ ID NO: 733355 - RNA, 22 nt, Leptospira interrogans serovar lai str. 56601
ugucguaacuccgacagauuua

SEQ ID NO: 733356 - RNA, 18 nt, Leptospira interrogans serovar lai str. 56601
uguuaguucccacauuuc

SEQ ID NO: 733357 - RNA, 15 nt, Leptospira interrogans serovar lai str. 56601
ugugguagguuucca

SEQ ID NO: 733358 - RNA, 20 nt, Leptospira interrogans serovar lai str. 56601
ugugggaguuuucacauuuu

SEQ ID NO: 733359 - RNA, 21 nt, Leptospira interrogans serovar lai str. 56601
ugugggaacucccacaauuua

SEQ ID NO: 733360 - RNA, 20 nt, Leptospira interrogans serovar lai str. 56601
ugugggaacucccacuuuua

SEQ ID NO: 733361 - RNA, 19 nt, Leptospira interrogans serovar lai str. 56601
aaucgcucgcgaauuucau

SEQ ID NO: 733362 - RNA, 20 nt, Leptospira interrogans serovar lai str. 56601
uuuuagaacugcaguaguuc

SEQ ID NO: 733363 - RNA, 19 nt, Leptospira interrogans serovar lai str. 56601
uuuuagacuggcuucgagu

SEQ ID NO: 733364 - RNA, 18 nt, Leptospira interrogans serovar lai str. 56601
uuuuuacgaaaaaauuga

SEQ ID NO: 733365 - RNA, 15 nt, Leptospira interrogans serovar lai str. 56601
uuuuuaauuucggga

SEQ ID NO: 733366 - RNA, 22 nt, Leptospira interrogans serovar lai str. 56601
uuuuuagaaaauucaaaauuga

SEQ ID NO: 733367 - RNA, 22 nt, Leptospira interrogans serovar lai str. 56601
uuuuuaagaaaacucaaaucua

SEQ ID NO: 733368 - RNA, 22 nt, Leptospira interrogans serovar lai str. 56601
uuuuuaagagccuacaaaucga

SEQ ID NO: 733369 - RNA, 23 nt, Leptospira interrogans serovar lai str. 56601
uuuuuaauauuacauucaauaau

SEQ ID NO: 733370 - RNA, 22 nt, Leptospira interrogans serovar lai str. 56601
aaucguuuuuuguauucugaug

SEQ ID NO: 733371 - RNA, 18 nt, Leptospira interrogans serovar lai str. 56601
aaucuaaacuuacagauu

SEQ ID NO: 733372 - RNA, 15 nt, Leptospira interrogans serovar lai str. 56601
aaucuaagacgaaaa

SEQ ID NO: 733373 - RNA, 23 nt, Leptospira interrogans serovar lai str. 56601
aaucuaguuuauaugaguuccca

SEQ ID NO: 733374 - RNA, 15 nt, Leptospira interrogans serovar lai str. 56601
aaucgugaauuuaca

SEQ ID NO: 733375 - RNA, 13 nt, Leptospira interrogans serovar lai str. 56601
uuuuugaaaaagu

SEQ ID NO: 733376 - RNA, 17 nt, Leptospira interrogans serovar lai str. 56601
aauggggcaauugaagc

SEQ ID NO: 733377 - RNA, 16 nt, Leptospira interrogans serovar lai str. 56601
aaugucccagauucgu

SEQ ID NO: 733378 - RNA, 17 nt, Leptospira interrogans serovar lai str. 56601
aaugagaaagaauuucu

SEQ ID NO: 733379 - RNA, 13 nt, Leptospira interrogans serovar lai str. 56601
aaugauagaaaua

SEQ ID NO: 733380 - RNA, 21 nt, Leptospira interrogans serovar lai str. 56601
aaugaugugggaacucucaca

SEQ ID NO: 733381 - RNA, 14 nt, Leptospira interrogans serovar lai str. 56601
aaugcggaaacuuu

SEQ ID NO: 733382 - RNA, 13 nt, Leptospira interrogans serovar lai str. 56601
uuugaucgguuua

SEQ ID NO: 733383 - RNA, 18 nt, Leptospira interrogans serovar lai str. 56601
uuugaaugaaaagauuuc

SEQ ID NO: 733384 - RNA, 18 nt, Leptospira interrogans serovar lai str. 56601
uuugaaauucagaucuca

SEQ ID NO: 733385 - RNA, 20 nt, Leptospira interrogans serovar lai str. 56601
uuugacguaaaaaaaucugg

SEQ ID NO: 733386 - RNA, 22 nt, Leptospira interrogans serovar lai str. 56601
uuugauauaaucuuaauauuuc

SEQ ID NO: 733387 - RNA, 18 nt, Leptospira interrogans serovar lai str. 56601
uuugagcgcagcucuugu

SEQ ID NO: 733388 - RNA, 15 nt, Leptospira interrogans serovar lai str. 56601
uuugagcgguagaaa

SEQ ID NO: 733389 - RNA, 21 nt, Leptospira interrogans serovar lai str. 56601
uuuggucugucguuugcaucc

SEQ ID NO: 733390 - RNA, 23 nt, Leptospira interrogans serovar lai str. 56601
uuugggcgaauaaaaaacucaau

SEQ ID NO: 733391 - RNA, 20 nt, Leptospira interrogans serovar lai str. 56601
uuuggaucuacuaagauuuc

SEQ ID NO: 733392 - RNA, 20 nt, Leptospira interrogans serovar lai str. 56601
uuugcucagagaauaucuga

SEQ ID NO: 733393 - RNA, 20 nt, Leptospira interrogans serovar lai str. 56601
uuugucguaacuccgacaga

SEQ ID NO: 733394 - RNA, 16 nt, Leptospira interrogans serovar lai str. 56601
uuuguaaugaaaucua

SEQ ID NO: 733395 - RNA, 13 nt, Leptospira interrogans serovar lai str. 56601
uuugugaacuuuu

SEQ ID NO: 733396 - RNA, 15 nt, Leptospira interrogans serovar lai str. 56601
uuugugaaacucaau

SEQ ID NO: 733397 - RNA, 16 nt, Leptospira interrogans serovar lai str. 56601
uuuaaaugugggaacu

SEQ ID NO: 733398 - RNA, 21 nt, Leptospira interrogans serovar lai str. 56601
uuuaaacuuagauucgagucc

SEQ ID NO: 733399 - RNA, 16 nt, Leptospira interrogans serovar lai str. 56601
uuuaaaaauucaacuu

SEQ ID NO: 733400 - RNA, 17 nt, Leptospira interrogans serovar lai str. 56601
uuuaaaauguaggaacc

SEQ ID NO: 733401 - RNA, 18 nt, Leptospira interrogans serovar lai str. 56601
uuuaauuucaauaacuug

SEQ ID NO: 733402 - RNA, 13 nt, Leptospira interrogans serovar lai str. 56601
uuuacaagauuuc

SEQ ID NO: 733403 - RNA, 23 nt, Leptospira interrogans serovar lai str. 56601
uuuacaaagacucggaaauucuc

SEQ ID NO: 733404 - RNA, 20 nt, Leptospira interrogans serovar lai str. 56601
uuuaccaugagcuaauucaa

SEQ ID NO: 733405 - RNA, 16 nt, Leptospira interrogans serovar lai str. 56601
uuuaccuaaaauucag

SEQ ID NO: 733406 - RNA, 13 nt, Leptospira interrogans serovar lai str. 56601
uuuacgaaaauuu

SEQ ID NO: 733407 - RNA, 13 nt, Leptospira interrogans serovar lai str. 56601
uuucugaaacaau

SEQ ID NO: 733408 - RNA, 22 nt, Leptospira interrogans serovar lai str. 56601
uuucugaaacaaucuaaccaag

SEQ ID NO: 733409 - RNA, 21 nt, Leptospira interrogans serovar lai str. 56601
uuucugauaaagaaaaccuuu

SEQ ID NO: 733410 - RNA, 13 nt, Leptospira interrogans serovar lai str. 56601
uuucuucuuugua

SEQ ID NO: 733411 - RNA, 15 nt, Leptospira interrogans serovar lai str. 56601
uuucuugaacucaau

SEQ ID NO: 733412 - RNA, 15 nt, Leptospira interrogans serovar lai str. 56601
uuguaugaguuccca

SEQ ID NO: 733413 - RNA, 22 nt, Leptospira interrogans serovar lai str. 56601
uugucuacgauuucuccaagaa

SEQ ID NO: 733414 - RNA, 21 nt, Leptospira interrogans serovar lai str. 56601
uugucccaaaaacucaaagaa

SEQ ID NO: 733415 - RNA, 21 nt, Leptospira interrogans serovar lai str. 56601
uugucccaaaacuucaaagaa

SEQ ID NO: 733416 - RNA, 15 nt, Leptospira interrogans serovar lai str. 56601
uuguuuugcugaguu

SEQ ID NO: 733417 - RNA, 18 nt, Leptospira interrogans serovar lai str. 56601
uugcaguaaggauucuuu

SEQ ID NO: 733418 - RNA, 18 nt, Leptospira interrogans serovar lai str. 56601
uucugguuccauaaagac

SEQ ID NO: 733419 - RNA, 14 nt, Leptospira interrogans serovar lai str. 56601
uucuuauagaaacu

SEQ ID NO: 733420 - RNA, 13 nt, Leptospira interrogans serovar lai str. 56601
aauauuuccaaau

SEQ ID NO: 733421 - RNA, 17 nt, Leptospira interrogans serovar lai str. 56601
aauauuuuguuuugaaa

SEQ ID NO: 733422 - RNA, 15 nt, Leptospira interrogans serovar lai str. 56601
uguaauaguucccac

SEQ ID NO: 733423 - RNA, 21 nt, Leptospira interrogans serovar lai str. 56601
aauaugaaaggaaucgauucu

SEQ ID NO: 733424 - RNA, 19 nt, Leptospira interrogans serovar lai str. 56601
aauaucuaaucuuuugaaa

SEQ ID NO: 733425 - RNA, 22 nt, Leptospira interrogans serovar lai str. 56601
aauaucuacuuuauuucggauc

SEQ ID NO: 733426 - RNA, 22 nt, Leptospira interrogans serovar lai str. 56601
ugggcucaaaaaggcacauuuu

SEQ ID NO: 733427 - RNA, 15 nt, Leptospira interrogans serovar lai str. 56601
ugcuuuaaucgcuuu

SEQ ID NO: 733428 - RNA, 16 nt, Leptospira interrogans serovar lai str. 56601
uggaaaguaaacuaua

SEQ ID NO: 733429 - RNA, 11 nt, Leptospira interrogans serovar lai str. 56601
uggaaacguca

SEQ ID NO: 733430 - RNA, 11 nt, Leptospira interrogans serovar lai str. 56601
uggaaacgucc

SEQ ID NO: 733431 - RNA, 14 nt, Leptospira interrogans serovar lai str. 56601
aauauauucaauuu

SEQ ID NO: 733432 - RNA, 17 nt, Leptospira interrogans serovar lai str. 56601
aauauagguucuugcaa

SEQ ID NO: 733433 - RNA, 17 nt, Leptospira interrogans serovar lai str. 56601
aauauacuuuucaaacg

SEQ ID NO: 733434 - RNA, 18 nt, Leptospira interrogans serovar lai str. 56601
aauagcagauuuucucaa

SEQ ID NO: 733435 - RNA, 17 nt, Leptospira interrogans serovar lai str. 56601
aauauaauaagagugca

SEQ ID NO: 733436 - RNA, 17 nt, Leptospira interrogans serovar lai str. 56601
acguuauuuuaacuuga

SEQ ID NO: 733437 - RNA, 20 nt, Leptospira interrogans serovar lai str. 56601
acuccaagccgcuugaacaa

SEQ ID NO: 733438 - RNA, 22 nt, Leptospira interrogans serovar lai str. 56601
acuccuugguucaaaguuuuca

SEQ ID NO: 733439 - RNA, 21 nt, Leptospira interrogans serovar lai str. 56601
accuaaugcuauugaauccuu

SEQ ID NO: 733440 - RNA, 21 nt, Leptospira interrogans serovar lai str. 56601
acgaaguuccaacguaccaaa

SEQ ID NO: 733441 - RNA, 15 nt, Leptospira interrogans serovar lai str. 56601
acgaauuaaauacgu

SEQ ID NO: 733442 - RNA, 21 nt, Leptospira interrogans serovar lai str. 56601
acgaucugcuuuuuuaaaccu

SEQ ID NO: 733443 - RNA, 15 nt, Leptospira interrogans serovar lai str. 56601
accccacaaguugaa

SEQ ID NO: 733444 - RNA, 22 nt, Leptospira interrogans serovar lai str. 56601
accccuaagcguucuaagucca

SEQ ID NO: 733445 - RNA, 22 nt, Leptospira interrogans serovar lai str. 56601
acauaagaaagaauuuucuaaa

SEQ ID NO: 733446 - RNA, 18 nt, Leptospira interrogans serovar lai str. 56601
acauuuuugugaaacuua

SEQ ID NO: 733447 - RNA, 17 nt, Leptospira interrogans serovar lai str. 56601
accaagaauuuccaguc

SEQ ID NO: 733448 - RNA, 21 nt, Leptospira interrogans serovar lai str. 56601
accaauaacuuaaccucgcau

SEQ ID NO: 733449 - RNA, 14 nt, Leptospira interrogans serovar lai str. 56601
acauuggacgauuu

SEQ ID NO: 733450 - RNA, 18 nt, Leptospira interrogans serovar lai str. 56601
acacacuguuaguuugca

SEQ ID NO: 733451 - RNA, 14 nt, Leptospira interrogans serovar lai str. 56601
acaauauauucagu

SEQ ID NO: 733452 - RNA, 22 nt, Leptospira interrogans serovar lai str. 56601
acaauuuuagaauuuauuugua

SEQ ID NO: 733453 - RNA, 12 nt, Leptospira interrogans serovar lai str. 56601
acaacuuucaga

SEQ ID NO: 733454 - RNA, 17 nt, Leptospira interrogans serovar lai str. 56601
acaacuuuugaaacuau

SEQ ID NO: 733455 - RNA, 17 nt, Leptospira interrogans serovar lai str. 56601
acaacgcucucuacgga

SEQ ID NO: 733456 - RNA, 13 nt, Leptospira interrogans serovar lai str. 56601
acaaaugauagaa

SEQ ID NO: 733457 - RNA, 21 nt, Leptospira interrogans serovar lai str. 56601
acaaaaaauguuuaaagaauu

SEQ ID NO: 733458 - RNA, 20 nt, Leptospira interrogans serovar lai str. 56601
acaaaacuacuucaaucgac

SEQ ID NO: 733459 - RNA, 18 nt, Leptospira interrogans serovar lai str. 56601
acaaaacacuucuuguaa

SEQ ID NO: 733460 - RNA, 15 nt, Leptospira interrogans serovar lai str. 56601
aaugugggaacuacu

SEQ ID NO: 733461 - RNA, 22 nt, Leptospira interrogans serovar lai str. 56601
aaugugggaacuacuacaaauc

SEQ ID NO: 733462 - RNA, 22 nt, Leptospira interrogans serovar lai str. 56601
ugaguuuuuguuugaaugucaa

SEQ ID NO: 733463 - RNA, 19 nt, Leptospira interrogans serovar lai str. 56601
ugaguuuuuuaaaacgaac

SEQ ID NO: 733464 - RNA, 19 nt, Leptospira interrogans serovar lai str. 56601
ugaguucccacaaauuccu

SEQ ID NO: 733465 - RNA, 18 nt, Leptospira interrogans serovar lai str. 56601
ugaguuagacguuugaaa

SEQ ID NO: 733466 - RNA, 21 nt, Leptospira interrogans serovar lai str. 56601
ugauaauuugugaacuuuuga

SEQ ID NO: 733467 - RNA, 19 nt, Leptospira interrogans serovar lai str. 56601
ugaucgguuuaaaacuagc

SEQ ID NO: 733468 - RNA, 17 nt, Leptospira interrogans serovar lai str. 56601
ugaucuaucuuuccagu

SEQ ID NO: 733469 - RNA, 21 nt, Leptospira interrogans serovar lai str. 56601
ugcauauuccuugagaaaagu

SEQ ID NO: 733470 - RNA, 22 nt, Leptospira interrogans serovar lai str. 56601
ugcagaauguuuucuacaaaua

SEQ ID NO: 733471 - RNA, 15 nt, Leptospira interrogans serovar lai str. 56601
ugcagaaguauucca

SEQ ID NO: 733472 - RNA, 21 nt, Leptospira interrogans serovar lai str. 56601
ucuuucgagauuaaaaucgga

SEQ ID NO: 733473 - RNA, 19 nt, Leptospira interrogans serovar lai str. 56601
ucuuugaacuuuuucaagu

SEQ ID NO: 733474 - RNA, 22 nt, Leptospira interrogans serovar lai str. 56601
ugaaagauuguuuugcugaguu

SEQ ID NO: 733475 - RNA, 22 nt, Leptospira interrogans serovar lai str. 56601
ugaaaguaauuuaucuguaauu

SEQ ID NO: 733476 - RNA, 15 nt, Leptospira interrogans serovar lai str. 56601
ugaaauagaauccua

SEQ ID NO: 733477 - RNA, 17 nt, Leptospira interrogans serovar lai str. 56601
ugaaauuuccacuucaa

SEQ ID NO: 733478 - RNA, 14 nt, Leptospira interrogans serovar lai str. 56601
ugaaauuuuucaau

SEQ ID NO: 733479 - RNA, 15 nt, Leptospira interrogans serovar lai str. 56601
ucuuaacuuuaagca

SEQ ID NO: 733480 - RNA, 15 nt, Leptospira interrogans serovar lai str. 56601
ucuuacaacuuuuga

SEQ ID NO: 733481 - RNA, 22 nt, Leptospira interrogans serovar lai str. 56601
ucugaaaaaaguugaaaucuga

SEQ ID NO: 733482 - RNA, 22 nt, Leptospira interrogans serovar lai str. 56601
ucugaaaagaauugaaaucuga

SEQ ID NO: 733483 - RNA, 23 nt, Leptospira interrogans serovar lai str. 56601
ucugaaccaaauacuuagaauuu

SEQ ID NO: 733484 - RNA, 19 nt, Leptospira interrogans serovar lai str. 56601
ucucuacgguuaucaauag

SEQ ID NO: 733485 - RNA, 14 nt, Leptospira interrogans serovar lai str. 56601
ucuauuuuuggaau

SEQ ID NO: 733486 - RNA, 18 nt, Leptospira interrogans serovar lai str. 56601
ucucaaaaaaugcauuca

SEQ ID NO: 733487 - RNA, 18 nt, Leptospira interrogans serovar lai str. 56601
ucguauucggaaauuuga

SEQ ID NO: 733488 - RNA, 13 nt, Leptospira interrogans serovar lai str. 56601
ucggacgauuucu

SEQ ID NO: 733489 - RNA, 21 nt, Leptospira interrogans serovar lai str. 56601
ucgcguuuuauaauaaauuga

SEQ ID NO: 733490 - RNA, 12 nt, Leptospira interrogans serovar lai str. 56601
ucgcucgcaaau

SEQ ID NO: 733491 - RNA, 12 nt, Leptospira interrogans serovar lai str. 56601
ucgcucaaauuu

SEQ ID NO: 733492 - RNA, 22 nt, Leptospira interrogans serovar lai str. 56601
aauacgaucuaauuuguaagaa

SEQ ID NO: 733493 - RNA, 18 nt, Leptospira interrogans serovar lai str. 56601
aauacgacagauucaauu

SEQ ID NO: 733494 - RNA, 22 nt, Leptospira interrogans serovar lai str. 56601
ucgagucgcgugccuucacaua

SEQ ID NO: 733495 - RNA, 21 nt, Leptospira interrogans serovar lai str. 56601
ucgacgauuuuacgaacaaau

SEQ ID NO: 733496 - RNA, 18 nt, Leptospira interrogans serovar lai str. 56601
ucgacguaaagaauucau

SEQ ID NO: 733497 - RNA, 15 nt, Leptospira interrogans serovar lai str. 56601
ucgacguaagaaucc

SEQ ID NO: 733498 - RNA, 18 nt, Leptospira interrogans serovar lai str. 56601
ucgacuuuugaaaaucca

SEQ ID NO: 733499 - RNA, 14 nt, Leptospira interrogans serovar lai str. 56601
uccugcuaacugau

SEQ ID NO: 733500 - RNA, 21 nt, Leptospira interrogans serovar lai str. 56601
uccguagccgcuucaaaguug

SEQ ID NO: 733501 - RNA, 18 nt, Leptospira interrogans serovar lai str. 56601
uccucuaugaaacuuagu

SEQ ID NO: 733502 - RNA, 21 nt, Leptospira interrogans serovar lai str. 56601
uccgaaaucccaaaaccgaau

SEQ ID NO: 733503 - RNA, 13 nt, Leptospira interrogans serovar lai str. 56601
uccgaauacaaag

SEQ ID NO: 733504 - RNA, 20 nt, Leptospira interrogans serovar lai str. 56601
ucacgguucgguggaaacuc

SEQ ID NO: 733505 - RNA, 22 nt, Leptospira interrogans serovar lai str. 56601
ucacauuaaaauaggauuuaaa

SEQ ID NO: 733506 - RNA, 17 nt, Leptospira interrogans serovar lai str. 56601
ucacgaacacaaauucu

SEQ ID NO: 733507 - RNA, 16 nt, Leptospira interrogans serovar lai str. 56601
uccaaccauuuaauag

SEQ ID NO: 733508 - RNA, 12 nt, Leptospira interrogans serovar lai str. 56601
ucaugagaaaca

SEQ ID NO: 733509 - RNA, 22 nt, Leptospira interrogans serovar lai str. 56601
uacaaaauguuuuuauaucuua

SEQ ID NO: 733510 - RNA, 16 nt, Leptospira interrogans serovar lai str. 56601
uacaaaacacuguuuc

SEQ ID NO: 733511 - RNA, 21 nt, Leptospira interrogans serovar lai str. 56601
uaauuuuucuuugaaggaucu

SEQ ID NO: 733512 - RNA, 18 nt, Leptospira interrogans serovar lai str. 56601
uacaaaacuuuacgaguu

SEQ ID NO: 733513 - RNA, 19 nt, Leptospira interrogans serovar lai str. 56601
uagaaauugugggaacuau

SEQ ID NO: 733514 - RNA, 16 nt, Leptospira interrogans serovar lai str. 56601
uagaaauuuaauuuga

SEQ ID NO: 733515 - RNA, 16 nt, Leptospira interrogans serovar lai str. 56601
uagaaccaguaucguu

SEQ ID NO: 733516 - RNA, 13 nt, Leptospira interrogans serovar lai str. 56601
uagaacucuuuua

SEQ ID NO: 733517 - RNA, 16 nt, Leptospira interrogans serovar lai str. 56601
uagaaucuaaacuuua

SEQ ID NO: 733518 - RNA, 14 nt, Leptospira interrogans serovar lai str. 56601
uagacuuucuuuga

SEQ ID NO: 733519 - RNA, 13 nt, Leptospira interrogans serovar lai str. 56601
uagaucaauuugu

SEQ ID NO: 733520 - RNA, 21 nt, Leptospira interrogans serovar lai str. 56601
uagaguuguugaaaaauucca

SEQ ID NO: 733521 - RNA, 19 nt, Leptospira interrogans serovar lai str. 56601
uaucgaauucacguuaaaa

SEQ ID NO: 733522 - RNA, 22 nt, Leptospira interrogans serovar lai str. 56601
uaucgaauacauuuaaacuuuu

SEQ ID NO: 733523 - RNA, 17 nt, Leptospira interrogans serovar lai str. 56601
uauucuuaaaauguagg

SEQ ID NO: 733524 - RNA, 18 nt, Leptospira interrogans serovar lai str. 56601
uauucuaauuuuuaucca

SEQ ID NO: 733525 - RNA, 17 nt, Leptospira interrogans serovar lai str. 56601
uauuccagaaguauuuu

SEQ ID NO: 733526 - RNA, 20 nt, Leptospira interrogans serovar lai str. 56601
uaugucucuaaucacggcgu

SEQ ID NO: 733527 - RNA, 13 nt, Leptospira interrogans serovar lai str. 56601
uauuuuaggauuu

SEQ ID NO: 733528 - RNA, 17 nt, Leptospira interrogans serovar lai str. 56601
uauuucuaauaguugaa

SEQ ID NO: 733529 - RNA, 12 nt, Leptospira interrogans serovar lai str. 56601
uauuuaggauuu

SEQ ID NO: 733530 - RNA, 16 nt, Leptospira interrogans serovar lai str. 56601
uauuuuauaauucuga

SEQ ID NO: 733531 - RNA, 11 nt, Leptospira interrogans serovar lai str. 56601
uauuuucauag

SEQ ID NO: 733532 - RNA, 14 nt, Leptospira interrogans serovar lai str. 56601
uauucuucgcuuaa

SEQ ID NO: 733533 - RNA, 15 nt, Leptospira interrogans serovar lai str. 56601
uauuuacuuuuucca

SEQ ID NO: 733534 - RNA, 22 nt, Leptospira interrogans serovar lai str. 56601
uauuuuugugaaacucaaugca

SEQ ID NO: 733535 - RNA, 19 nt, Leptospira interrogans serovar lai str. 56601
ucaacaaaauuacuucaau

SEQ ID NO: 733536 - RNA, 21 nt, Leptospira interrogans serovar lai str. 56601
ucaaauucaugauaguuaauu

SEQ ID NO: 733537 - RNA, 14 nt, Leptospira interrogans serovar lai str. 56601
ucaacaaauauucc

SEQ ID NO: 733538 - RNA, 15 nt, Leptospira interrogans serovar lai str. 56601
ucaacaauucuauug

SEQ ID NO: 733539 - RNA, 15 nt, Leptospira interrogans serovar lai str. 56601
uauaguuccuacaau

SEQ ID NO: 733540 - RNA, 15 nt, Leptospira interrogans serovar lai str. 56601
uauaauauucuuuua

SEQ ID NO: 733541 - RNA, 22 nt, Leptospira interrogans serovar lai str. 56601
uauaaauauggauuuuuccaac

SEQ ID NO: 733542 - RNA, 21 nt, Leptospira interrogans serovar lai str. 56601
uauaaaacaaucuucaaauuc

SEQ ID NO: 733543 - RNA, 13 nt, Leptospira interrogans serovar lai str. 56601
uauaaagauuucc

SEQ ID NO: 733544 - RNA, 16 nt, Leptospira interrogans serovar lai str. 56601
uauauaaaucaaagca

SEQ ID NO: 733545 - RNA, 20 nt, Leptospira interrogans serovar lai str. 56601
uaucaaugaucauauccgaa

SEQ ID NO: 733546 - RNA, 19 nt, Leptospira interrogans serovar lai str. 56601
uaguuuccaaaaaagacuu

SEQ ID NO: 733547 - RNA, 15 nt, Leptospira interrogans serovar lai str. 56601
uagguuccaauucca

SEQ ID NO: 733548 - RNA, 17 nt, Leptospira interrogans serovar lai str. 56601
uaguaugcgaaauuccu

SEQ ID NO: 733549 - RNA, 16 nt, Leptospira interrogans serovar lai str. 56601
aaguucacaaauugca

SEQ ID NO: 733550 - RNA, 17 nt, Leptospira interrogans serovar lai str. 56601
aaguucccaaauugcca

SEQ ID NO: 733551 - RNA, 21 nt, Leptospira interrogans serovar lai str. 56601
aaguuaucguccccacucguu

SEQ ID NO: 733552 - RNA, 16 nt, Leptospira interrogans serovar lai str. 56601
aaguuacucauuucca

SEQ ID NO: 733553 - RNA, 14 nt, Leptospira interrogans serovar lai str. 56601
aaguuaauucuaaa

SEQ ID NO: 733554 - RNA, 16 nt, Leptospira interrogans serovar lai str. 56601
guuauuaaaauuuccc

SEQ ID NO: 733555 - RNA, 18 nt, Leptospira interrogans serovar lai str. 56601
aaguguuccgacaagaau

SEQ ID NO: 733556 - RNA, 18 nt, Leptospira interrogans serovar lai str. 56601
aaguguaaaauuaaaauc

SEQ ID NO: 733557 - RNA, 20 nt, Leptospira interrogans serovar lai str. 56601
aaguggguuguuaugcaaau

SEQ ID NO: 733558 - RNA, 23 nt, Leptospira interrogans serovar lai str. 56601
uaaucuuuugaguauuuaacuuc

SEQ ID NO: 733559 - RNA, 16 nt, Leptospira interrogans serovar lai str. 56601
uaaucgauuuuacaga

SEQ ID NO: 733560 - RNA, 22 nt, Leptospira interrogans serovar lai str. 56601
uaauuucuuuuuauacucggaa

SEQ ID NO: 733561 - RNA, 20 nt, Leptospira interrogans serovar lai str. 56601
uaauaaaucaaucuacuuga

SEQ ID NO: 733562 - RNA, 20 nt, Leptospira interrogans serovar lai str. 56601
uaauaaucgcuuucgcauug

SEQ ID NO: 733563 - RNA, 16 nt, Leptospira interrogans serovar lai str. 56601
uaaguuugugagaguu

SEQ ID NO: 733564 - RNA, 17 nt, Leptospira interrogans serovar lai str. 56601
uaagcugaagacuucca

SEQ ID NO: 733565 - RNA, 19 nt, Leptospira interrogans serovar lai str. 56601
uaagauuucguucggaaaa

SEQ ID NO: 733566 - RNA, 15 nt, Leptospira interrogans serovar lai str. 56601
uaaagugaaucucuu

SEQ ID NO: 733567 - RNA, 22 nt, Leptospira interrogans serovar lai str. 56601
uaaagauuuccuaauaacuugu

SEQ ID NO: 733568 - RNA, 21 nt, Leptospira interrogans serovar lai str. 56601
uaaacuccuaggcaaauccuu

SEQ ID NO: 733569 - RNA, 18 nt, Leptospira interrogans serovar lai str. 56601
uaaacagucgcuaaacuc

SEQ ID NO: 733570 - RNA, 15 nt, Leptospira interrogans serovar lai str. 56601
uaaacuauacaaagu

SEQ ID NO: 733571 - RNA, 14 nt, Leptospira interrogans serovar lai str. 56601
uaaagaaaaccaga

SEQ ID NO: 733572 - RNA, 14 nt, Leptospira interrogans serovar lai str. 56601
guuucaauuuagaa

SEQ ID NO: 733573 - RNA, 17 nt, Leptospira interrogans serovar lai str. 56601
uaaaacuguaaauuaga

SEQ ID NO: 733574 - RNA, 16 nt, Leptospira interrogans serovar lai str. 56601
uaaaagaguaauucua

SEQ ID NO: 733575 - RNA, 19 nt, Leptospira interrogans serovar lai str. 56601
uaaaacuuuucuaaauuga

SEQ ID NO: 733576 - RNA, 21 nt, Leptospira interrogans serovar lai str. 56601
uaaaauucaguuucaaacuga

SEQ ID NO: 733577 - RNA, 17 nt, Leptospira interrogans serovar lai str. 56601
uaaaauuccgaauucua

SEQ ID NO: 733578 - RNA, 21 nt, Leptospira interrogans serovar lai str. 56601
uaaaauuagauuuguguuauu

SEQ ID NO: 733579 - RNA, 19 nt, Leptospira interrogans serovar lai str. 56601
uaaaaguuuuggaagauuc

SEQ ID NO: 733580 - RNA, 13 nt, Leptospira interrogans serovar lai str. 56601
uaaaauaaaauuc

SEQ ID NO: 733581 - RNA, 17 nt, Leptospira interrogans serovar lai str. 56601
uaaaauguaggaacuac

SEQ ID NO: 733582 - RNA, 18 nt, Leptospira interrogans serovar lai str. 56601
uaaaauuaaaguaaauuc

SEQ ID NO: 733583 - RNA, 17 nt, Leptospira interrogans serovar lai str. 56601
uaaaauuuagaaauaga

SEQ ID NO: 733584 - RNA, 21 nt, Leptospira interrogans serovar lai str. 56601
uaaaauuugauuccaagauuu

SEQ ID NO: 733585 - RNA, 13 nt, Leptospira interrogans serovar lai str. 56601
uaaauauaucuuc

SEQ ID NO: 733586 - RNA, 13 nt, Leptospira interrogans serovar lai str. 56601
uaaauauucucua

SEQ ID NO: 733587 - RNA, 19 nt, Leptospira interrogans serovar lai str. 56601
uaaauauuuauuacaaagu

SEQ ID NO: 733588 - RNA, 14 nt, Leptospira interrogans serovar lai str. 56601
uaaauauuuccaaa

SEQ ID NO: 733589 - RNA, 19 nt, Leptospira interrogans serovar lai str. 56601
uaaaucgcugauaaauuuc

SEQ ID NO: 733590 - RNA, 17 nt, Leptospira interrogans serovar lai str. 56601
uaaaucugucggaauua

SEQ ID NO: 733591 - RNA, 16 nt, Leptospira interrogans serovar lai str. 56601
uaaauguaggaacuac

SEQ ID NO: 733592 - RNA, 15 nt, Leptospira interrogans serovar lai str. 56601
uaaauguauauucgu

SEQ ID NO: 733593 - RNA, 17 nt, Leptospira interrogans serovar lai str. 56601
uaaauuagcuuaagaau

SEQ ID NO: 733594 - RNA, 14 nt, Leptospira interrogans serovar lai str. 56601
uaaauuaaucugua

SEQ ID NO: 733595 - RNA, 20 nt, Leptospira interrogans serovar lai str. 56601
uaaauucacuguuaaaagau

SEQ ID NO: 733596 - RNA, 17 nt, Leptospira interrogans serovar lai str. 56601
uaaauuccguaaaauuc

SEQ ID NO: 733597 - RNA, 16 nt, Leptospira interrogans serovar lai str. 56601
uaaauucgaucuaaga

SEQ ID NO: 733598 - RNA, 22 nt, Leptospira interrogans serovar lai str. 56601
uaaauucgcaaaaaaaauucga

SEQ ID NO: 733599 - RNA, 23 nt, Leptospira interrogans serovar lai str. 56601
uaaauucuaauugugggaacuca

SEQ ID NO: 733600 - RNA, 19 nt, Leptospira interrogans serovar lai str. 56601
uaaauuuugaaacaaauuc

SEQ ID NO: 733601 - RNA, 17 nt, Leptospira interrogans serovar lai str. 56601
uaaauuuuucggaaaua

SEQ ID NO: 733602 - RNA, 16 nt, Leptospira interrogans serovar lai str. 56601
uaaauuuuuuagaaau

SEQ ID NO: 733603 - RNA, 15 nt, Leptospira interrogans serovar lai str. 56601
uaaauugaaacuaua

SEQ ID NO: 733604 - RNA, 14 nt, Leptospira interrogans serovar lai str. 56601
guucuaguauuauu

SEQ ID NO: 733605 - RNA, 14 nt, Leptospira interrogans serovar lai str. 56601
agccgcuauggaag

SEQ ID NO: 733606 - RNA, 19 nt, Leptospira interrogans serovar lai str. 56601
agcgagagacgcugaguua

SEQ ID NO: 733607 - RNA, 14 nt, Leptospira interrogans serovar lai str. 56601
agcgaugaucgauu

SEQ ID NO: 733608 - RNA, 15 nt, Leptospira interrogans serovar lai str. 56601
agaguuguccuaaaa

SEQ ID NO: 733609 - RNA, 14 nt, Leptospira interrogans serovar lai str. 56601
agaguuguugaaaa

SEQ ID NO: 733610 - RNA, 19 nt, Leptospira interrogans serovar lai str. 56601
agacucggaaauucucaaa

SEQ ID NO: 733611 - RNA, 19 nt, Leptospira interrogans serovar lai str. 56601
agacgcugaguuaaccuac

SEQ ID NO: 733612 - RNA, 22 nt, Leptospira interrogans serovar lai str. 56601
agaacugcaguaguucccgcag

SEQ ID NO: 733613 - RNA, 20 nt, Leptospira interrogans serovar lai str. 56601
agaacuuuacagaucgauuc

SEQ ID NO: 733614 - RNA, 14 nt, Leptospira interrogans serovar lai str. 56601
agaagccugaguuu

SEQ ID NO: 733615 - RNA, 19 nt, Leptospira interrogans serovar lai str. 56601
agaaccuuuaguuuccaaa

SEQ ID NO: 733616 - RNA, 15 nt, Leptospira interrogans serovar lai str. 56601
agaaauguaggaacu

SEQ ID NO: 733617 - RNA, 17 nt, Leptospira interrogans serovar lai str. 56601
agaaauuaaaguaucca

SEQ ID NO: 733618 - RNA, 21 nt, Leptospira interrogans serovar lai str. 56601
agaaauuaaaguauccauucg

SEQ ID NO: 733619 - RNA, 20 nt, Leptospira interrogans serovar lai str. 56601
agaaauuaauuucuaaacaa

SEQ ID NO: 733620 - RNA, 15 nt, Leptospira interrogans serovar lai str. 56601
agaaauacuuugauu

SEQ ID NO: 733621 - RNA, 21 nt, Leptospira interrogans serovar lai str. 56601
agaauuuauuuucauaggaaa

SEQ ID NO: 733622 - RNA, 16 nt, Leptospira interrogans serovar lai str. 56601
agaauucuuugaacca

SEQ ID NO: 733623 - RNA, 21 nt, Leptospira interrogans serovar lai str. 56601
agaauuuuuaugagcuuugua

SEQ ID NO: 733624 - RNA, 15 nt, Leptospira interrogans serovar lai str. 56601
agaauagauucuuaa

SEQ ID NO: 733625 - RNA, 16 nt, Leptospira interrogans serovar lai str. 56601
agaauaugucguugua

SEQ ID NO: 733626 - RNA, 14 nt, Leptospira interrogans serovar lai str. 56601
agaaugaacucaac

SEQ ID NO: 733627 - RNA, 20 nt, Leptospira interrogans serovar lai str. 56601
agaaucuugggguuuuugua

SEQ ID NO: 733628 - RNA, 17 nt, Leptospira interrogans serovar lai str. 56601
agaaucugaacuuuaua

SEQ ID NO: 733629 - RNA, 16 nt, Leptospira interrogans serovar lai str. 56601
agaaugagucuuuuua

SEQ ID NO: 733630 - RNA, 19 nt, Leptospira interrogans serovar lai str. 56601
agaaguuguaucagauguu

SEQ ID NO: 733631 - RNA, 16 nt, Leptospira interrogans serovar lai str. 56601
agauuuagauucuaaa

SEQ ID NO: 733632 - RNA, 18 nt, Leptospira interrogans serovar lai str. 56601
agauuuucuaagaaucug

SEQ ID NO: 733633 - RNA, 15 nt, Leptospira interrogans serovar lai str. 56601
agauuuuuaucgauu

SEQ ID NO: 733634 - RNA, 12 nt, Leptospira interrogans serovar lai str. 56601
agauucuugaua

SEQ ID NO: 733635 - RNA, 17 nt, Leptospira interrogans serovar lai str. 56601
agauugaguuucacaaa

SEQ ID NO: 733636 - RNA, 20 nt, Leptospira interrogans serovar lai str. 56601
aguagaaagauuaaauucua

SEQ ID NO: 733637 - RNA, 20 nt, Leptospira interrogans serovar lai str. 56601
aguacuauauuuuugugaaa

SEQ ID NO: 733638 - RNA, 16 nt, Leptospira interrogans serovar lai str. 56601
aguauaaauucgcaaa

SEQ ID NO: 733639 - RNA, 17 nt, Leptospira interrogans serovar lai str. 56601
agucccauuuagcaauu

SEQ ID NO: 733640 - RNA, 18 nt, Leptospira interrogans serovar lai str. 56601
agucuuuuuacuugcaaa

SEQ ID NO: 733641 - RNA, 20 nt, Leptospira interrogans serovar lai str. 56601
agucuagaaauguaggaacu

SEQ ID NO: 733642 - RNA, 13 nt, Leptospira interrogans serovar lai str. 56601
aguuaauucuaaa

SEQ ID NO: 733643 - RNA, 22 nt, Leptospira interrogans serovar lai str. 56601
aguuauagcgucguuaaauuug

SEQ ID NO: 733644 - RNA, 14 nt, Leptospira interrogans serovar lai str. 56601
aguuuccacagauu

SEQ ID NO: 733645 - RNA, 19 nt, Leptospira interrogans serovar lai str. 56601
auaucuuuauuuaauacga

SEQ ID NO: 733646 - RNA, 15 nt, Leptospira interrogans serovar lai str. 56601
auaucuuaagaauug

SEQ ID NO: 733647 - RNA, 18 nt, Leptospira interrogans serovar lai str. 56601
auauuauuuguaguuuca

SEQ ID NO: 733648 - RNA, 16 nt, Leptospira interrogans serovar lai str. 56601
auauucguguucuauu

SEQ ID NO: 733649 - RNA, 20 nt, Leptospira interrogans serovar lai str. 56601
auauugagcuaauucuuaaa

SEQ ID NO: 733650 - RNA, 23 nt, Leptospira interrogans serovar lai str. 56601
auaguuuguuaucaauagaaaua

SEQ ID NO: 733651 - RNA, 18 nt, Leptospira interrogans serovar lai str. 56601
auauagaaccaucucaaa

SEQ ID NO: 733652 - RNA, 14 nt, Leptospira interrogans serovar lai str. 56601
auauagcucuugaa

SEQ ID NO: 733653 - RNA, 20 nt, Leptospira interrogans serovar lai str. 56601
auauaguauaaauucgcaaa

SEQ ID NO: 733654 - RNA, 16 nt, Leptospira interrogans serovar lai str. 56601
auauaguuaaauuuug

SEQ ID NO: 733655 - RNA, 16 nt, Leptospira interrogans serovar lai str. 56601
auauauucaaaagauu

SEQ ID NO: 733656 - RNA, 22 nt, Leptospira interrogans serovar lai str. 56601
auaguucccacauuugaauacg

SEQ ID NO: 733657 - RNA, 12 nt, Leptospira interrogans serovar lai str. 56601
auaguauccaaa

SEQ ID NO: 733658 - RNA, 16 nt, Leptospira interrogans serovar lai str. 56601
auacuugauauuucug

SEQ ID NO: 733659 - RNA, 14 nt, Leptospira interrogans serovar lai str. 56601
auagaaguucggaa

SEQ ID NO: 733660 - RNA, 18 nt, Leptospira interrogans serovar lai str. 56601
auacgaguaaaaauucuu

SEQ ID NO: 733661 - RNA, 23 nt, Leptospira interrogans serovar lai str. 56601
auacgcuucucuugcuugaacca

SEQ ID NO: 733662 - RNA, 21 nt, Leptospira interrogans serovar lai str. 56601
auaccuugggcugguaagccu

SEQ ID NO: 733663 - RNA, 23 nt, Leptospira interrogans serovar lai str. 56601
auacaaaaaauguuuaaagaauu

SEQ ID NO: 733664 - RNA, 23 nt, Leptospira interrogans serovar lai str. 56601
auaccagccugccaaaagaacuu

SEQ ID NO: 733665 - RNA, 21 nt, Leptospira interrogans serovar lai str. 56601
aguuugacguaaaaaaaucug

SEQ ID NO: 733666 - RNA, 21 nt, Leptospira interrogans serovar lai str. 56601
aguuuccccaagacuuugaaa

SEQ ID NO: 733667 - RNA, 16 nt, Leptospira interrogans serovar lai str. 56601
aguuucuugaacucaa

SEQ ID NO: 733668 - RNA, 23 nt, Leptospira interrogans serovar lai str. 56601
auaaguuuugauagaaaaacucu

SEQ ID NO: 733669 - RNA, 15 nt, Leptospira interrogans serovar lai str. 56601
auaaguuguuauaaa

SEQ ID NO: 733670 - RNA, 12 nt, Leptospira interrogans serovar lai str. 56601
auaauaaaacuu

SEQ ID NO: 733671 - RNA, 19 nt, Leptospira interrogans serovar lai str. 56601
auaauacuaccaaagcuug

SEQ ID NO: 733672 - RNA, 19 nt, Leptospira interrogans serovar lai str. 56601
auaacuuuaaaaaauaaga

SEQ ID NO: 733673 - RNA, 16 nt, Leptospira interrogans serovar lai str. 56601
aggauaaaacggauuu

SEQ ID NO: 733674 - RNA, 19 nt, Leptospira interrogans serovar lai str. 56601
aggauaaaacggauuucuu

SEQ ID NO: 733675 - RNA, 19 nt, Leptospira interrogans serovar lai str. 56601
aggaguauaagucgaucua

SEQ ID NO: 733676 - RNA, 17 nt, Leptospira interrogans serovar lai str. 56601
agcguccgcaauauccc

SEQ ID NO: 733677 - RNA, 14 nt, Leptospira interrogans serovar lai str. 56601
aggaauccaugauu

SEQ ID NO: 733678 - RNA, 22 nt, Leptospira interrogans serovar lai str. 56601
agcuuucuccuucccucgaaau

SEQ ID NO: 733679 - RNA, 14 nt, Leptospira interrogans serovar lai str. 56601
cacauuuuaaaguu

SEQ ID NO: 733680 - RNA, 21 nt, Leptospira interrogans serovar lai str. 56601
caauuuuucugaaaaguuuau

SEQ ID NO: 733681 - RNA, 14 nt, Leptospira interrogans serovar lai str. 56601
cacaaaacgaucau

SEQ ID NO: 733682 - RNA, 16 nt, Leptospira interrogans serovar lai str. 56601
caauuaaacuucaaaa

SEQ ID NO: 733683 - RNA, 19 nt, Leptospira interrogans serovar lai str. 56601
caauucccauuaaagucca

SEQ ID NO: 733684 - RNA, 23 nt, Leptospira interrogans serovar lai str. 56601
caaugaugaauucugggaaccgg

SEQ ID NO: 733685 - RNA, 14 nt, Leptospira interrogans serovar lai str. 56601
caagcgcucgccuu

SEQ ID NO: 733686 - RNA, 18 nt, Leptospira interrogans serovar lai str. 56601
caagaacuggauucaaaa

SEQ ID NO: 733687 - RNA, 17 nt, Leptospira interrogans serovar lai str. 56601
caacucuucuucuagau

SEQ ID NO: 733688 - RNA, 13 nt, Leptospira interrogans serovar lai str. 56601
caaauaacgauuc

SEQ ID NO: 733689 - RNA, 16 nt, Leptospira interrogans serovar lai str. 56601
caaaguuuauaagaga

SEQ ID NO: 733690 - RNA, 16 nt, Leptospira interrogans serovar lai str. 56601
caaaguaaguucaaau

SEQ ID NO: 733691 - RNA, 20 nt, Leptospira interrogans serovar lai str. 56601
caaaguauuuucuagauagg

SEQ ID NO: 733692 - RNA, 23 nt, Leptospira interrogans serovar lai str. 56601
caacgaaaauagauagagaauua

SEQ ID NO: 733693 - RNA, 12 nt, Leptospira interrogans serovar lai str. 56601
auuuugauugug

SEQ ID NO: 733694 - RNA, 11 nt, Leptospira interrogans serovar lai str. 56601
auuuugccaau

SEQ ID NO: 733695 - RNA, 12 nt, Leptospira interrogans serovar lai str. 56601
auuuucuagaua

SEQ ID NO: 733696 - RNA, 16 nt, Leptospira interrogans serovar lai str. 56601
auuuucgauugcucuc

SEQ ID NO: 733697 - RNA, 14 nt, Leptospira interrogans serovar lai str. 56601
auuuucuaaagauu

SEQ ID NO: 733698 - RNA, 18 nt, Leptospira interrogans serovar lai str. 56601
auuuuaucagauguguaa

SEQ ID NO: 733699 - RNA, 21 nt, Leptospira interrogans serovar lai str. 56601
auuuuacgaacgaauucuaaa

SEQ ID NO: 733700 - RNA, 14 nt, Leptospira interrogans serovar lai str. 56601
auuuuaggaaucaa

SEQ ID NO: 733701 - RNA, 20 nt, Leptospira interrogans serovar lai str. 56601
auuuuauaaucgaauuucca

SEQ ID NO: 733702 - RNA, 20 nt, Leptospira interrogans serovar lai str. 56601
auuuuuuagaaaucaauucu

SEQ ID NO: 733703 - RNA, 17 nt, Leptospira interrogans serovar lai str. 56601
auuuuuuaacaauucua

SEQ ID NO: 733704 - RNA, 20 nt, Leptospira interrogans serovar lai str. 56601
auuuuuuaaaugcagcuauu

SEQ ID NO: 733705 - RNA, 16 nt, Leptospira interrogans serovar lai str. 56601
auuuuuuaacaacucu

SEQ ID NO: 733706 - RNA, 17 nt, Leptospira interrogans serovar lai str. 56601
auuuuuuaacaacucua

SEQ ID NO: 733707 - RNA, 16 nt, Leptospira interrogans serovar lai str. 56601
auuuuuggaaauucca

SEQ ID NO: 733708 - RNA, 20 nt, Leptospira interrogans serovar lai str. 56601
auuuuugugaaacuuaaucu

SEQ ID NO: 733709 - RNA, 16 nt, Leptospira interrogans serovar lai str. 56601
auuuuuuuagaaucau

SEQ ID NO: 733710 - RNA, 14 nt, Leptospira interrogans serovar lai str. 56601
auuuuuucuuccgg

SEQ ID NO: 733711 - RNA, 17 nt, Leptospira interrogans serovar lai str. 56601
auuuuuaucuugaucca

SEQ ID NO: 733712 - RNA, 16 nt, Leptospira interrogans serovar lai str. 56601
auuuuucaacaacucu

SEQ ID NO: 733713 - RNA, 17 nt, Leptospira interrogans serovar lai str. 56601
auuuuucaacaacucua

SEQ ID NO: 733714 - RNA, 19 nt, Leptospira interrogans serovar lai str. 56601
auuuuucuuuuaaaauucg

SEQ ID NO: 733715 - RNA, 22 nt, Leptospira interrogans serovar lai str. 56601
auuuuucuaaaaaaacgcgaau

SEQ ID NO: 733716 - RNA, 20 nt, Leptospira interrogans serovar lai str. 56601
auuuuucugaaaaaaguugg

SEQ ID NO: 733717 - RNA, 21 nt, Leptospira interrogans serovar lai str. 56601
caaaaauagggaaaacucaac

SEQ ID NO: 733718 - RNA, 21 nt, Leptospira interrogans serovar lai str. 56601
caaaaccuaucuaacgauccu

SEQ ID NO: 733719 - RNA, 12 nt, Leptospira interrogans serovar lai str. 56601
caaaacuuaaau

SEQ ID NO: 733720 - RNA, 22 nt, Leptospira interrogans serovar lai str. 56601
caaaagaguuuucaaucgaaga

SEQ ID NO: 733721 - RNA, 21 nt, Leptospira interrogans serovar lai str. 56601
caaaaggauuccauuucauug

SEQ ID NO: 733722 - RNA, 12 nt, Leptospira interrogans serovar lai str. 56601
caaaaucggaau

SEQ ID NO: 733723 - RNA, 20 nt, Leptospira interrogans serovar lai str. 56601
caaaaucggcgccugcauuu

SEQ ID NO: 733724 - RNA, 16 nt, Leptospira interrogans serovar lai str. 56601
auuucauuuuuuucga

SEQ ID NO: 733725 - RNA, 24 nt, Leptospira interrogans serovar lai str. 56601
auuucauccaugucuucuaaaucu

SEQ ID NO: 733726 - RNA, 16 nt, Leptospira interrogans serovar lai str. 56601
auuuauuuguaaaucc

SEQ ID NO: 733727 - RNA, 15 nt, Leptospira interrogans serovar lai str. 56601
auuucaaguuuucuu

SEQ ID NO: 733728 - RNA, 18 nt, Leptospira interrogans serovar lai str. 56601
auuuaucuguaaaauuug

SEQ ID NO: 733729 - RNA, 21 nt, Leptospira interrogans serovar lai str. 56601
auuccauuuuuuagaauccca

SEQ ID NO: 733730 - RNA, 19 nt, Leptospira interrogans serovar lai str. 56601
auucccauccgaaauccca

SEQ ID NO: 733731 - RNA, 13 nt, Leptospira interrogans serovar lai str. 56601
auuuaaauucccu

SEQ ID NO: 733732 - RNA, 20 nt, Leptospira interrogans serovar lai str. 56601
auuuacaaucgaacggauuc

SEQ ID NO: 733733 - RNA, 16 nt, Leptospira interrogans serovar lai str. 56601
auuuacuuuuuccaaa

SEQ ID NO: 733734 - RNA, 14 nt, Leptospira interrogans serovar lai str. 56601
auuuacuacaucua

SEQ ID NO: 733735 - RNA, 19 nt, Leptospira interrogans serovar lai str. 56601
auuuauauauauucacaaa

SEQ ID NO: 733736 - RNA, 16 nt, Leptospira interrogans serovar lai str. 56601
auuuggacgaauccgg

SEQ ID NO: 733737 - RNA, 19 nt, Leptospira interrogans serovar lai str. 56601
auuugcuaaaauaagaauc

SEQ ID NO: 733738 - RNA, 17 nt, Leptospira interrogans serovar lai str. 56601
auuugacguaaaggaau

SEQ ID NO: 733739 - RNA, 15 nt, Leptospira interrogans serovar lai str. 56601
auuugaauacgacag

SEQ ID NO: 733740 - RNA, 19 nt, Leptospira interrogans serovar lai str. 56601
auuuguucgugaaauugug

SEQ ID NO: 733741 - RNA, 19 nt, Leptospira interrogans serovar lai str. 56601
auuuguucuuaaaauugug

SEQ ID NO: 733742 - RNA, 19 nt, Leptospira interrogans serovar lai str. 56601
auuuguuuuuaaaauugug

SEQ ID NO: 733743 - RNA, 21 nt, Leptospira interrogans serovar lai str. 56601
auuuguuuguuauaagaauuu

SEQ ID NO: 733744 - RNA, 13 nt, Leptospira interrogans serovar lai str. 56601
auuuuaagaaucg

SEQ ID NO: 733745 - RNA, 16 nt, Leptospira interrogans serovar lai str. 56601
auuuuaagaucuauuc

SEQ ID NO: 733746 - RNA, 17 nt, Leptospira interrogans serovar lai str. 56601
auuuuacauacgaucua

SEQ ID NO: 733747 - RNA, 21 nt, Leptospira interrogans serovar lai str. 56601
auuuuaccgauaagucuagaa

SEQ ID NO: 733748 - RNA, 23 nt, Leptospira interrogans serovar lai str. 56601
auuucuaaauugugagaacuaca

SEQ ID NO: 733749 - RNA, 22 nt, Leptospira interrogans serovar lai str. 56601
auuuccuuuucgacuauuucuu

SEQ ID NO: 733750 - RNA, 20 nt, Leptospira interrogans serovar lai str. 56601
auuucuuaaaagauucuauu

SEQ ID NO: 733751 - RNA, 18 nt, Leptospira interrogans serovar lai str. 56601
auuugacaauuugugaac

SEQ ID NO: 733752 - RNA, 17 nt, Leptospira interrogans serovar lai str. 56601
auuucucucaaauucuu

SEQ ID NO: 733753 - RNA, 19 nt, Leptospira interrogans serovar lai str. 56601
auuauaaucuuuguaugag

SEQ ID NO: 733754 - RNA, 17 nt, Leptospira interrogans serovar lai str. 56601
auuacuucaauugucca

SEQ ID NO: 733755 - RNA, 21 nt, Leptospira interrogans serovar lai str. 56601
auucauuuaaaaauugaucuc

SEQ ID NO: 733756 - RNA, 14 nt, Leptospira interrogans serovar lai str. 56601
auuccagaaguauu

SEQ ID NO: 733757 - RNA, 22 nt, Leptospira interrogans serovar lai str. 56601
auuaucuucuaauuaaauucua

SEQ ID NO: 733758 - RNA, 14 nt, Leptospira interrogans serovar lai str. 56601
auuaucuaaagcuu

SEQ ID NO: 733759 - RNA, 13 nt, Leptospira interrogans serovar lai str. 56601
auucaauucggaa

SEQ ID NO: 733760 - RNA, 15 nt, Leptospira interrogans serovar lai str. 56601
auucaagacuuuaua

SEQ ID NO: 733761 - RNA, 22 nt, Leptospira interrogans serovar lai str. 56601
auucaacuuagaacuuguccca

SEQ ID NO: 733762 - RNA, 19 nt, Leptospira interrogans serovar lai str. 56601
auuaauuacagaauugauu

SEQ ID NO: 733763 - RNA, 12 nt, Leptospira interrogans serovar lai str. 56601
auuaagucacau

SEQ ID NO: 733764 - RNA, 13 nt, Leptospira interrogans serovar lai str. 56601
auuacaaaucgac

SEQ ID NO: 733765 - RNA, 22 nt, Leptospira interrogans serovar lai str. 56601
auuacauaaguucgguguaaaa

SEQ ID NO: 733766 - RNA, 20 nt, Leptospira interrogans serovar lai str. 56601
auuaauuuuucaacaacucu

SEQ ID NO: 733767 - RNA, 17 nt, Leptospira interrogans serovar lai str. 56601
auuacccauuuccgauu

SEQ ID NO: 733768 - RNA, 13 nt, Leptospira interrogans serovar lai str. 56601
auuaaaacugcuc

SEQ ID NO: 733769 - RNA, 17 nt, Leptospira interrogans serovar lai str. 56601
auuaacggccaaauuug

SEQ ID NO: 733770 - RNA, 22 nt, Leptospira interrogans serovar lai str. 56601
auuaagaaaaauuaaaauucua

SEQ ID NO: 733771 - RNA, 19 nt, Leptospira interrogans serovar lai str. 56601
auuaagaacuuucucgaaa

SEQ ID NO: 733772 - RNA, 20 nt, Leptospira interrogans serovar lai str. 56601
augcucggcuucuucaaugu

SEQ ID NO: 733773 - RNA, 21 nt, Leptospira interrogans serovar lai str. 56601
augauucuaacuuuugcaauc

SEQ ID NO: 733774 - RNA, 22 nt, Leptospira interrogans serovar lai str. 56601
aucgauuuguaaaauucagauu

SEQ ID NO: 733775 - RNA, 14 nt, Leptospira interrogans serovar lai str. 56601
aucgauuccaaucg

SEQ ID NO: 733776 - RNA, 22 nt, Leptospira interrogans serovar lai str. 56601
auccguaaaaaucaaacucguu

SEQ ID NO: 733777 - RNA, 16 nt, Leptospira interrogans serovar lai str. 56601
aucgauaacuugauuu

SEQ ID NO: 733778 - RNA, 13 nt, Leptospira interrogans serovar lai str. 56601
aucgcuucuaugg

SEQ ID NO: 733779 - RNA, 17 nt, Leptospira interrogans serovar lai str. 56601
aucguaggcacguggaa

SEQ ID NO: 733780 - RNA, 12 nt, Leptospira interrogans serovar lai str. 56601
aucgucccgauc

SEQ ID NO: 733781 - RNA, 14 nt, Leptospira interrogans serovar lai str. 56601
aucucuuaaucgaa

SEQ ID NO: 733782 - RNA, 17 nt, Leptospira interrogans serovar lai str. 56601
aucucaaaauaaaucga

SEQ ID NO: 733783 - RNA, 22 nt, Leptospira interrogans serovar lai str. 56601
aucucaaaauaaaucgauuaca

SEQ ID NO: 733784 - RNA, 13 nt, Leptospira interrogans serovar lai str. 56601
aucucagaaaauu

SEQ ID NO: 733785 - RNA, 14 nt, Leptospira interrogans serovar lai str. 56601
aucgguaaauacga

SEQ ID NO: 733786 - RNA, 14 nt, Leptospira interrogans serovar lai str. 56601
auccauaaguuccu

SEQ ID NO: 733787 - RNA, 14 nt, Leptospira interrogans serovar lai str. 56601
auccacuacggaag

SEQ ID NO: 733788 - RNA, 13 nt, Leptospira interrogans serovar lai str. 56601
aucccguaaaacu

SEQ ID NO: 733789 - RNA, 15 nt, Leptospira interrogans serovar lai str. 56601
aucaucgucuaauca

SEQ ID NO: 733790 - RNA, 13 nt, Leptospira interrogans serovar lai str. 56601
aucaguuccgguu

SEQ ID NO: 733791 - RNA, 18 nt, Leptospira interrogans serovar lai str. 56601
auauuggauaauuccaca

SEQ ID NO: 733792 - RNA, 14 nt, Leptospira interrogans serovar lai str. 56601
cccgauacagaaua

SEQ ID NO: 733793 - RNA, 12 nt, Leptospira interrogans serovar lai str. 56601
cccgaagaauua

SEQ ID NO: 733794 - RNA, 10 nt, Leptospira interrogans serovar lai str. 56601
caugaagaag

SEQ ID NO: 733795 - RNA, 13 nt, Leptospira interrogans serovar lai str. 56601
caucugagaauuu

SEQ ID NO: 733796 - RNA, 18 nt, Leptospira interrogans serovar lai str. 56601
caugccaaacacgaauuc

SEQ ID NO: 733797 - RNA, 20 nt, Leptospira interrogans serovar lai str. 56601
cauggaaauuuuuccgucga

SEQ ID NO: 733798 - RNA, 22 nt, Leptospira interrogans serovar lai str. 56601
cauggagaauaaaacgcugagu

SEQ ID NO: 733799 - RNA, 18 nt, Leptospira interrogans serovar lai str. 56601
cauuccgcaaaaauuccu

SEQ ID NO: 733800 - RNA, 19 nt, Leptospira interrogans serovar lai str. 56601
cauuccgcaaaaauuccuu

SEQ ID NO: 733801 - RNA, 12 nt, Leptospira interrogans serovar lai str. 56601
cauucuuuccau

SEQ ID NO: 733802 - RNA, 15 nt, Leptospira interrogans serovar lai str. 56601
cauuuuaagaaucga

SEQ ID NO: 733803 - RNA, 15 nt, Leptospira interrogans serovar lai str. 56601
cauuuuaggaaucga

SEQ ID NO: 733804 - RNA, 21 nt, Leptospira interrogans serovar lai str. 56601
ccaaacauucaaauuucugaa

SEQ ID NO: 733805 - RNA, 21 nt, Leptospira interrogans serovar lai str. 56601
ccaaacucuuaaucugcugaa

SEQ ID NO: 733806 - RNA, 15 nt, Leptospira interrogans serovar lai str. 56601
ccaaaugcgaccuaa

SEQ ID NO: 733807 - RNA, 22 nt, Leptospira interrogans serovar lai str. 56601
cauagaagugaagcgcuugagu

SEQ ID NO: 733808 - RNA, 18 nt, Leptospira interrogans serovar lai str. 56601
cauaguaaacacaaucgu

SEQ ID NO: 733809 - RNA, 20 nt, Leptospira interrogans serovar lai str. 56601
cauacuuaauuucaaucuau

SEQ ID NO: 733810 - RNA, 13 nt, Leptospira interrogans serovar lai str. 56601
cauaacagaauuu

SEQ ID NO: 733811 - RNA, 22 nt, Leptospira interrogans serovar lai str. 56601
cauaaauuuuuuggaaaucgaa

SEQ ID NO: 733812 - RNA, 15 nt, Leptospira interrogans serovar lai str. 56601
caguuccacuuuaaa

SEQ ID NO: 733813 - RNA, 19 nt, Leptospira interrogans serovar lai str. 56601
cauccaaccuccgaucacg

SEQ ID NO: 733814 - RNA, 15 nt, Leptospira interrogans serovar lai str. 56601
caguacaagaaucaa

SEQ ID NO: 733815 - RNA, 16 nt, Leptospira interrogans serovar lai str. 56601
caguacaagaaucaaa

SEQ ID NO: 733816 - RNA, 15 nt, Leptospira interrogans serovar lai str. 56601
caguacaauucaaaa

SEQ ID NO: 733817 - RNA, 19 nt, Leptospira interrogans serovar lai str. 56601
cagguuuuaaacuauagag

SEQ ID NO: 733818 - RNA, 22 nt, Leptospira interrogans serovar lai str. 56601
cacuuauucuuauaagaaucga

SEQ ID NO: 733819 - RNA, 23 nt, Leptospira interrogans serovar lai str. 56601
caccuucugaaaguaguauucuu

SEQ ID NO: 733820 - RNA, 14 nt, Leptospira interrogans serovar lai str. 56601
cacgaauuccucaa

SEQ ID NO: 733821 - RNA, 18 nt, Leptospira interrogans serovar lai str. 56601
cagaauuuaggcaauuuu

SEQ ID NO: 733822 - RNA, 18 nt, Leptospira interrogans serovar lai str. 56601
cagaaugucuuagaauuu

SEQ ID NO: 733823 - RNA, 17 nt, Leptospira interrogans serovar lai str. 56601
cagauaugacaauuucu

SEQ ID NO: 733824 - RNA, 12 nt, Leptospira interrogans serovar lai str. 56601
cagaucaauucu

SEQ ID NO: 733825 - RNA, 14 nt, Leptospira interrogans serovar lai str. 56601
cagaucaagaauua

SEQ ID NO: 733826 - RNA, 14 nt, Leptospira interrogans serovar lai str. 56601
cagauggagaauug

SEQ ID NO: 733827 - RNA, 23 nt, Leptospira interrogans serovar lai str. 56601
cggcuuuaguuugaaagaacguu

SEQ ID NO: 733828 - RNA, 15 nt, Leptospira interrogans serovar lai str. 56601
cggaucaauucugaa

SEQ ID NO: 733829 - RNA, 18 nt, Leptospira interrogans serovar lai str. 56601
cgagccauucuaauuuca

SEQ ID NO: 733830 - RNA, 15 nt, Leptospira interrogans serovar lai str. 56601
cgaaaugguuccgau

SEQ ID NO: 733831 - RNA, 12 nt, Leptospira interrogans serovar lai str. 56601
cgaagaauccga

SEQ ID NO: 733832 - RNA, 15 nt, Leptospira interrogans serovar lai str. 56601
cgaauacauuuaaac

SEQ ID NO: 733833 - RNA, 18 nt, Leptospira interrogans serovar lai str. 56601
cgaaaaguuuuccgguuc

SEQ ID NO: 733834 - RNA, 23 nt, Leptospira interrogans serovar lai str. 56601
ccuuuacauaauaauacagaauu

SEQ ID NO: 733835 - RNA, 19 nt, Leptospira interrogans serovar lai str. 56601
ccugguuuuuuguuggcuc

SEQ ID NO: 733836 - RNA, 11 nt, Leptospira interrogans serovar lai str. 56601
cgcauuuagaa

SEQ ID NO: 733837 - RNA, 14 nt, Leptospira interrogans serovar lai str. 56601
cgcauuuagaagau

SEQ ID NO: 733838 - RNA, 18 nt, Leptospira interrogans serovar lai str. 56601
cgcauuuagcaauuugcg

SEQ ID NO: 733839 - RNA, 13 nt, Leptospira interrogans serovar lai str. 56601
cgaguucaacuua

SEQ ID NO: 733840 - RNA, 14 nt, Leptospira interrogans serovar lai str. 56601
cgauguaauuccag

SEQ ID NO: 733841 - RNA, 15 nt, Leptospira interrogans serovar lai str. 56601
cgauugagaauucua

SEQ ID NO: 733842 - RNA, 19 nt, Leptospira interrogans serovar lai str. 56601
cgauucuaaauuauuuaac

SEQ ID NO: 733843 - RNA, 16 nt, Leptospira interrogans serovar lai str. 56601
cgauucuaacugguuu

SEQ ID NO: 733844 - RNA, 18 nt, Leptospira interrogans serovar lai str. 56601
cgauucuaggaucuaugu

SEQ ID NO: 733845 - RNA, 24 nt, Leptospira interrogans serovar lai str. 56601
ccgcauaaaacucuaaauucagaa

SEQ ID NO: 733846 - RNA, 21 nt, Leptospira interrogans serovar lai str. 56601
ccguccaaugugggaacuacu

SEQ ID NO: 733847 - RNA, 13 nt, Leptospira interrogans serovar lai str. 56601
ccuccaaacacua

SEQ ID NO: 733848 - RNA, 18 nt, Leptospira interrogans serovar lai str. 56601
ccgggagcgcuugaaaau

SEQ ID NO: 733849 - RNA, 13 nt, Leptospira interrogans serovar lai str. 56601
gccaauuccaaac

SEQ ID NO: 733850 - RNA, 19 nt, Leptospira interrogans serovar lai str. 56601
gccaguuuuuugagaaaca

SEQ ID NO: 733851 - RNA, 17 nt, Leptospira interrogans serovar lai str. 56601
gauuccacgaauugccg

SEQ ID NO: 733852 - RNA, 18 nt, Leptospira interrogans serovar lai str. 56601
gauuuuucaacaacucua

SEQ ID NO: 733853 - RNA, 21 nt, Leptospira interrogans serovar lai str. 56601
gauuuuuuaaguagaaccuaa

SEQ ID NO: 733854 - RNA, 21 nt, Leptospira interrogans serovar lai str. 56601
gauuuuuuaaucuggaaacgu

SEQ ID NO: 733855 - RNA, 17 nt, Leptospira interrogans serovar lai str. 56601
gauuuuuucugguggaa

SEQ ID NO: 733856 - RNA, 14 nt, Leptospira interrogans serovar lai str. 56601
gauuuuaaucuccg

SEQ ID NO: 733857 - RNA, 16 nt, Leptospira interrogans serovar lai str. 56601
gauuuguccgaaucca

SEQ ID NO: 733858 - RNA, 14 nt, Leptospira interrogans serovar lai str. 56601
gauguaggaacuac

SEQ ID NO: 733859 - RNA, 15 nt, Leptospira interrogans serovar lai str. 56601
gauggagauuacuuu

SEQ ID NO: 733860 - RNA, 18 nt, Leptospira interrogans serovar lai str. 56601
gaugagcuuuuuuagaaa

SEQ ID NO: 733861 - RNA, 18 nt, Leptospira interrogans serovar lai str. 56601
gaucuacuaagauuucuu

SEQ ID NO: 733862 - RNA, 20 nt, Leptospira interrogans serovar lai str. 56601
gaucgacuguaauuaauuca

SEQ ID NO: 733863 - RNA, 17 nt, Leptospira interrogans serovar lai str. 56601
gauaauuuuuguuugua

SEQ ID NO: 733864 - RNA, 15 nt, Leptospira interrogans serovar lai str. 56601
gauaauucgugaacu

SEQ ID NO: 733865 - RNA, 16 nt, Leptospira interrogans serovar lai str. 56601
gauaguaccaaguuau

SEQ ID NO: 733866 - RNA, 14 nt, Leptospira interrogans serovar lai str. 56601
gagucgaaugcgac

SEQ ID NO: 733867 - RNA, 16 nt, Leptospira interrogans serovar lai str. 56601
gaguauuaucuuuaua

SEQ ID NO: 733868 - RNA, 15 nt, Leptospira interrogans serovar lai str. 56601
gaggugaaauuucca

SEQ ID NO: 733869 - RNA, 13 nt, Leptospira interrogans serovar lai str. 56601
gacguaguucuuc

SEQ ID NO: 733870 - RNA, 20 nt, Leptospira interrogans serovar lai str. 56601
gaauuccgggaauauucgua

SEQ ID NO: 733871 - RNA, 21 nt, Leptospira interrogans serovar lai str. 56601
gaauucgacguaaggaacuca

SEQ ID NO: 733872 - RNA, 22 nt, Leptospira interrogans serovar lai str. 56601
gaauuauuuacuuuuuccaaaa

SEQ ID NO: 733873 - RNA, 14 nt, Leptospira interrogans serovar lai str. 56601
gaauuaauucucca

SEQ ID NO: 733874 - RNA, 19 nt, Leptospira interrogans serovar lai str. 56601
gaauuaagcagaagcuuua

SEQ ID NO: 733875 - RNA, 13 nt, Leptospira interrogans serovar lai str. 56601
gaauagucaaugg

SEQ ID NO: 733876 - RNA, 14 nt, Leptospira interrogans serovar lai str. 56601
gaauaaaaacuuga

SEQ ID NO: 733877 - RNA, 18 nt, Leptospira interrogans serovar lai str. 56601
gaaguuuaccccgaagag

SEQ ID NO: 733878 - RNA, 12 nt, Leptospira interrogans serovar lai str. 56601
gacaaaguauuu

SEQ ID NO: 733879 - RNA, 12 nt, Leptospira interrogans serovar lai str. 56601
gaacuuuacaga

SEQ ID NO: 733880 - RNA, 11 nt, Leptospira interrogans serovar lai str. 56601
gaacuuuagag

SEQ ID NO: 733881 - RNA, 19 nt, Leptospira interrogans serovar lai str. 56601
gaacuuuuuuuagaaucau

SEQ ID NO: 733882 - RNA, 17 nt, Leptospira interrogans serovar lai str. 56601
gaagauaaauauuucca

SEQ ID NO: 733883 - RNA, 18 nt, Leptospira interrogans serovar lai str. 56601
gaagaauaugucguugua

SEQ ID NO: 733884 - RNA, 20 nt, Leptospira interrogans serovar lai str. 56601
gaaacgauguauugaguuua

SEQ ID NO: 733885 - RNA, 22 nt, Leptospira interrogans serovar lai str. 56601
gaagcaguuuuguuaauugcca

SEQ ID NO: 733886 - RNA, 23 nt, Leptospira interrogans serovar lai str. 56601
gaagauucuucuccucuuccgga

SEQ ID NO: 733887 - RNA, 17 nt, Leptospira interrogans serovar lai str. 56601
gaaaaauuaauucucca

SEQ ID NO: 733888 - RNA, 12 nt, Leptospira interrogans serovar lai str. 56601
gaaaaauuuccc

SEQ ID NO: 733889 - RNA, 16 nt, Leptospira interrogans serovar lai str. 56601
gaaaaauuucuuuguc

SEQ ID NO: 733890 - RNA, 15 nt, Leptospira interrogans serovar lai str. 56601
gaaaaagggauucua

SEQ ID NO: 733891 - RNA, 16 nt, Leptospira interrogans serovar lai str. 56601
gaaaaaguccuuuuga

SEQ ID NO: 733892 - RNA, 21 nt, Leptospira interrogans serovar lai str. 56601
gaaaaaguuggaaucuaaacu

SEQ ID NO: 733893 - RNA, 19 nt, Leptospira interrogans serovar lai str. 56601
cuuuuuuuacgcggaacau

SEQ ID NO: 733894 - RNA, 22 nt, Leptospira interrogans serovar lai str. 56601
gaaaaugaccaaaauuuccaac

SEQ ID NO: 733895 - RNA, 19 nt, Leptospira interrogans serovar lai str. 56601
cuuugaaccacaguuccua

SEQ ID NO: 733896 - RNA, 22 nt, Leptospira interrogans serovar lai str. 56601
cuuugaaaauugugggaacuau

SEQ ID NO: 733897 - RNA, 16 nt, Leptospira interrogans serovar lai str. 56601
cuuucucugaauucac

SEQ ID NO: 733898 - RNA, 17 nt, Leptospira interrogans serovar lai str. 56601
cuuugcgauugagaauu

SEQ ID NO: 733899 - RNA, 20 nt, Leptospira interrogans serovar lai str. 56601
cuuugagaugugggaacuac

SEQ ID NO: 733900 - RNA, 21 nt, Leptospira interrogans serovar lai str. 56601
cuugucccaaaaacucaaaga

SEQ ID NO: 733901 - RNA, 21 nt, Leptospira interrogans serovar lai str. 56601
cuucucuuuuaaaaacuuguu

SEQ ID NO: 733902 - RNA, 18 nt, Leptospira interrogans serovar lai str. 56601
cuucuggaaaaauuccua

SEQ ID NO: 733903 - RNA, 23 nt, Leptospira interrogans serovar lai str. 56601
cuugaaaaagcggucuugaaaau

SEQ ID NO: 733904 - RNA, 15 nt, Leptospira interrogans serovar lai str. 56601
cuuacgucgaacuca

SEQ ID NO: 733905 - RNA, 21 nt, Leptospira interrogans serovar lai str. 56601
cuuagaauuuuuucguuccuu

SEQ ID NO: 733906 - RNA, 15 nt, Leptospira interrogans serovar lai str. 56601
cuuagaguaaaacuu

SEQ ID NO: 733907 - RNA, 17 nt, Leptospira interrogans serovar lai str. 56601
cuuaaucugcugaauuu

SEQ ID NO: 733908 - RNA, 19 nt, Leptospira interrogans serovar lai str. 56601
cuuaauguaaaguucuuuu

SEQ ID NO: 733909 - RNA, 21 nt, Leptospira interrogans serovar lai str. 56601
cuuacagccugauaaauuccg

SEQ ID NO: 733910 - RNA, 15 nt, Leptospira interrogans serovar lai str. 56601
cuguuaaucagagca

SEQ ID NO: 733911 - RNA, 19 nt, Leptospira interrogans serovar lai str. 56601
cugcuugacaucuuuuaaa

SEQ ID NO: 733912 - RNA, 12 nt, Leptospira interrogans serovar lai str. 56601
cugcucaauaaa

SEQ ID NO: 733913 - RNA, 15 nt, Leptospira interrogans serovar lai str. 56601
cgguuaacgcguuga

SEQ ID NO: 733914 - RNA, 18 nt, Leptospira interrogans serovar lai str. 56601
cguaguuuuuguuccgaa

SEQ ID NO: 733915 - RNA, 16 nt, Leptospira interrogans serovar lai str. 56601
cgucguuaaauuugcg

SEQ ID NO: 733916 - RNA, 19 nt, Leptospira interrogans serovar lai str. 56601
cucucuacggaucgcguuu

SEQ ID NO: 733917 - RNA, 20 nt, Leptospira interrogans serovar lai str. 56601
cugaaauaaauuuaaauguu

SEQ ID NO: 733918 - RNA, 19 nt, Leptospira interrogans serovar lai str. 56601
cucuucuaauucaguuuuu

SEQ ID NO: 733919 - RNA, 23 nt, Leptospira interrogans serovar lai str. 56601
cucuuauaaaauuuuagauacgu

SEQ ID NO: 733920 - RNA, 13 nt, Leptospira interrogans serovar lai str. 56601
cuaagucuuuaaa

SEQ ID NO: 733921 - RNA, 21 nt, Leptospira interrogans serovar lai str. 56601
cuaaguuuuacagaggauuug

SEQ ID NO: 733922 - RNA, 13 nt, Leptospira interrogans serovar lai str. 56601
cuaacgcaaguuc

SEQ ID NO: 733923 - RNA, 16 nt, Leptospira interrogans serovar lai str. 56601
cuaucuauuagaacau

SEQ ID NO: 733924 - RNA, 16 nt, Leptospira interrogans serovar lai str. 56601
cuaugguugcucugca

SEQ ID NO: 733925 - RNA, 23 nt, Leptospira interrogans serovar lai str. 56601
cuauguccuuuuuuucuuuuaaa

SEQ ID NO: 733926 - RNA, 15 nt, Leptospira interrogans serovar lai str. 56601
cuauaauuuaacgug

SEQ ID NO: 733927 - RNA, 14 nt, Leptospira interrogans serovar lai str. 56601
cuauaauuuccgga

SEQ ID NO: 733928 - RNA, 16 nt, Leptospira interrogans serovar lai str. 56601
cuauaauuuccggaau

SEQ ID NO: 733929 - RNA, 19 nt, Leptospira interrogans serovar lai str. 56601
cuauaaaucauucgauacu

SEQ ID NO: 733930 - RNA, 13 nt, Leptospira interrogans serovar lai str. 56601
cuaggaacuccuu

SEQ ID NO: 733931 - RNA, 19 nt, Leptospira interrogans serovar lai str. 56601
cuaggaacugcuuccaaaa

SEQ ID NO: 733932 - RNA, 20 nt, Leptospira interrogans serovar lai str. 56601
cuaaaaagaaaguugcaaag

SEQ ID NO: 733933 - RNA, 18 nt, Leptospira interrogans serovar lai str. 56601
cuaaaagauccgcuacaa

SEQ ID NO: 733934 - RNA, 17 nt, Leptospira interrogans serovar lai str. 56601
cuaaaccaccaaccgaa

SEQ ID NO: 733935 - RNA, 15 nt, Leptospira interrogans serovar lai str. 56601
cuaaaauuuccauga

SEQ ID NO: 733936 - RNA, 13 nt, Leptospira interrogans serovar lai str. 56601
cuaaacaaaaugu

SEQ ID NO: 733937 - RNA, 20 nt, Leptospira interrogans serovar lai str. 56601
cuaaauugaaacuaaagacg

SEQ ID NO: 733938 - RNA, 22 nt, Leptospira interrogans serovar lai str. 56601
cuaaauuaauauuuauaaaaca

SEQ ID NO: 733939 - RNA, 14 nt, Leptospira interrogans serovar lai str. 56601
cguucguaguuuuu

SEQ ID NO: 733940 - RNA, 19 nt, Leptospira interrogans serovar lai str. 56601
cguaaucugugggaacuac

SEQ ID NO: 733941 - RNA, 15 nt, Leptospira interrogans serovar lai str. 56601
cguaauaguucccac

SEQ ID NO: 733942 - RNA, 20 nt, Leptospira interrogans serovar lai str. 56601
cgucucacuccccauggguc

SEQ ID NO: 733943 - RNA, 14 nt, Leptospira interrogans serovar lai str. 56601
cguaaaccaagaau

SEQ ID NO: 733944 - RNA, 17 nt, Leptospira interrogans serovar lai str. 56601
aaccgcaccaucuaaag

SEQ ID NO: 733945 - RNA, 15 nt, Leptospira interrogans serovar lai str. 56601
cguuuugacacucua

SEQ ID NO: 733946 - RNA, 19 nt, Leptospira interrogans serovar lai str. 56601
cuaaaaauuguugaagaau

SEQ ID NO: 733947 - RNA, 15 nt, Leptospira interrogans serovar lai str. 56601
cuaaaaguaugaacu

SEQ ID NO: 733948 - RNA, 19 nt, Leptospira interrogans serovar lai str. 56601
cguuuaaauacauuaagau

SEQ ID NO: 733949 - RNA, 15 nt, Leptospira interrogans serovar lai str. 56601
cguuuaacaauucua

SEQ ID NO: 733950 - RNA, 18 nt, Leptospira interrogans serovar lai str. 56601
cuagaaauguaggaacuc

SEQ ID NO: 733951 - RNA, 14 nt, Leptospira interrogans serovar lai str. 56601
cuacggaucgcguu

SEQ ID NO: 733952 - RNA, 23 nt, Leptospira interrogans serovar lai str. 56601
cuaaucgagcuuuucuguucauu

SEQ ID NO: 733953 - RNA, 22 nt, Leptospira interrogans serovar lai str. 56601
cuacaccaguauucaauuccaa

SEQ ID NO: 733954 - RNA, 22 nt, Leptospira interrogans serovar lai str. 56601
cuaauuuacuacaucuaaugau

SEQ ID NO: 733955 - RNA, 21 nt, Leptospira interrogans serovar lai str. 56601
cuacaaaaauuuaauaacauu

SEQ ID NO: 733956 - RNA, 15 nt, Leptospira interrogans serovar lai str. 56601
cuacaaaauuuagaa

SEQ ID NO: 733957 - RNA, 13 nt, Leptospira interrogans serovar lai str. 56601
cuaguaguuccca

SEQ ID NO: 733958 - RNA, 23 nt, Leptospira interrogans serovar lai str. 56601
cuaguauauucuaauagucucau

SEQ ID NO: 733959 - RNA, 19 nt, Leptospira interrogans serovar lai str. 56601
gaccgcagacuguaucaua

SEQ ID NO: 733960 - RNA, 16 nt, Leptospira interrogans serovar lai str. 56601
aacggucgauugaagc

SEQ ID NO: 733961 - RNA, 20 nt, Leptospira interrogans serovar lai str. 56601
gaccuuucuaaaaauuuccg

SEQ ID NO: 733962 - RNA, 22 nt, Leptospira interrogans serovar lai str. 56601
gaauucacguuauuuagaucaa

SEQ ID NO: 733963 - RNA, 15 nt, Leptospira interrogans serovar lai str. 56601
gaaugugggaacuac

SEQ ID NO: 733964 - RNA, 20 nt, Leptospira interrogans serovar lai str. 56601
gaauuccuauucaguuucca

SEQ ID NO: 733965 - RNA, 13 nt, Leptospira interrogans serovar lai str. 56601
gacauucuaaaca

SEQ ID NO: 733966 - RNA, 14 nt, Leptospira interrogans serovar lai str. 56601
aacgagacgcugaa

SEQ ID NO: 733967 - RNA, 23 nt, Leptospira interrogans serovar lai str. 56601
aacgaguuuuuguuaucaacuuu

SEQ ID NO: 733968 - RNA, 12 nt, Leptospira interrogans serovar lai str. 56601
gaagauuuguaa

SEQ ID NO: 733969 - RNA, 18 nt, Leptospira interrogans serovar lai str. 56601
gaagaggugaaauuucca

SEQ ID NO: 733970 - RNA, 20 nt, Leptospira interrogans serovar lai str. 56601
gaagcuuuuaguuguacaaa

SEQ ID NO: 733971 - RNA, 15 nt, Leptospira interrogans serovar lai str. 56601
gaagccugaguuuga

SEQ ID NO: 733972 - RNA, 18 nt, Leptospira interrogans serovar lai str. 56601
gaauaggaucagaauuuc

SEQ ID NO: 733973 - RNA, 19 nt, Leptospira interrogans serovar lai str. 56601
gaaucgcucgcgaauuuca

SEQ ID NO: 733974 - RNA, 14 nt, Leptospira interrogans serovar lai str. 56601
gaaucuaauuucag

SEQ ID NO: 733975 - RNA, 19 nt, Leptospira interrogans serovar lai str. 56601
gaaccuuuaguuuccaaaa

SEQ ID NO: 733976 - RNA, 15 nt, Leptospira interrogans serovar lai str. 56601
gaaaucuaguucaac

SEQ ID NO: 733977 - RNA, 22 nt, Leptospira interrogans serovar lai str. 56601
gaacauaaguuacucauuucca

SEQ ID NO: 733978 - RNA, 20 nt, Leptospira interrogans serovar lai str. 56601
gaaagguuauccucugaacu

SEQ ID NO: 733979 - RNA, 13 nt, Leptospira interrogans serovar lai str. 56601
gaaagaucaugaa

SEQ ID NO: 733980 - RNA, 17 nt, Leptospira interrogans serovar lai str. 56601
cuuguuauuaaaaucua

SEQ ID NO: 733981 - RNA, 15 nt, Leptospira interrogans serovar lai str. 56601
gaaacuauuauacuu

SEQ ID NO: 733982 - RNA, 23 nt, Leptospira interrogans serovar lai str. 56601
cucuugaacagaaagaucaugaa

SEQ ID NO: 733983 - RNA, 16 nt, Leptospira interrogans serovar lai str. 56601
cuuggugauaaucauc

SEQ ID NO: 733984 - RNA, 19 nt, Leptospira interrogans serovar lai str. 56601
cuuaccaccguguugacaa

SEQ ID NO: 733985 - RNA, 17 nt, Leptospira interrogans serovar lai str. 56601
cuuaccuccuuuuucaa

SEQ ID NO: 733986 - RNA, 19 nt, Leptospira interrogans serovar lai str. 56601
cuuagaaugugggaacuac

SEQ ID NO: 733987 - RNA, 14 nt, Leptospira interrogans serovar lai str. 56601
cuuacggggaauuu

SEQ ID NO: 733988 - RNA, 19 nt, Leptospira interrogans serovar lai str. 56601
cuuaaucugugggaacuau

SEQ ID NO: 733989 - RNA, 18 nt, Leptospira interrogans serovar lai str. 56601
cuuaaucugugggaacuc

SEQ ID NO: 733990 - RNA, 16 nt, Leptospira interrogans serovar lai str. 56601
cuuacaaacuccguga

SEQ ID NO: 733991 - RNA, 19 nt, Leptospira interrogans serovar lai str. 56601
cuuaauuuguaggaacuac

SEQ ID NO: 733992 - RNA, 20 nt, Leptospira interrogans serovar lai str. 56601
cuuacaccgaauucaaguua

SEQ ID NO: 733993 - RNA, 23 nt, Leptospira interrogans serovar lai str. 56601
cuuagguuuuguaauaguuccca

SEQ ID NO: 733994 - RNA, 23 nt, Leptospira interrogans serovar lai str. 56601
cuguaaaaugauguaggaacuac

SEQ ID NO: 733995 - RNA, 23 nt, Leptospira interrogans serovar lai str. 56601
cuguaaaaugaugugggaacuau

SEQ ID NO: 733996 - RNA, 20 nt, Leptospira interrogans serovar lai str. 56601
cuguaaaacuuaguucccgc

SEQ ID NO: 733997 - RNA, 18 nt, Leptospira interrogans serovar lai str. 56601
gauuaugguaaaauuuca

SEQ ID NO: 733998 - RNA, 13 nt, Leptospira interrogans serovar lai str. 56601
gauuagcuuaacu

SEQ ID NO: 733999 - RNA, 12 nt, Leptospira interrogans serovar lai str. 56601
gauuaugaagaa

SEQ ID NO: 734000 - RNA, 12 nt, Leptospira interrogans serovar lai str. 56601
gauuagaguuaa

SEQ ID NO: 734001 - RNA, 15 nt, Leptospira interrogans serovar lai str. 56601
gauuccuuuccgauu

SEQ ID NO: 734002 - RNA, 16 nt, Leptospira interrogans serovar lai str. 56601
gauuugcaucgacaaa

SEQ ID NO: 734003 - RNA, 15 nt, Leptospira interrogans serovar lai str. 56601
gcaaaauaucuggaa

SEQ ID NO: 734004 - RNA, 21 nt, Leptospira interrogans serovar lai str. 56601
gcaaaacacuuuccuuaaacc

SEQ ID NO: 734005 - RNA, 12 nt, Leptospira interrogans serovar lai str. 56601
gcaaaaaguaug

SEQ ID NO: 734006 - RNA, 20 nt, Leptospira interrogans serovar lai str. 56601
aacuuagaaucuaucucaaa

SEQ ID NO: 734007 - RNA, 14 nt, Leptospira interrogans serovar lai str. 56601
gcaagaaaaucugg

SEQ ID NO: 734008 - RNA, 21 nt, Leptospira interrogans serovar lai str. 56601
gcaagaaccguaacugacauu

SEQ ID NO: 734009 - RNA, 15 nt, Leptospira interrogans serovar lai str. 56601
aacuuuuucaagugu

SEQ ID NO: 734010 - RNA, 23 nt, Leptospira interrogans serovar lai str. 56601
aagaaaagguguggauaccuuua

SEQ ID NO: 734011 - RNA, 20 nt, Leptospira interrogans serovar lai str. 56601
aagaaaauacauaggaaccu

SEQ ID NO: 734012 - RNA, 22 nt, Leptospira interrogans serovar lai str. 56601
gaucagugauucgaaauuuuca

SEQ ID NO: 734013 - RNA, 23 nt, Leptospira interrogans serovar lai str. 56601
gaucguguucuaaauugaaacua

SEQ ID NO: 734014 - RNA, 23 nt, Leptospira interrogans serovar lai str. 56601
gaucuauaucgugaaacuuucca

SEQ ID NO: 734015 - RNA, 17 nt, Leptospira interrogans serovar lai str. 56601
gaguuugaaagauuguu

SEQ ID NO: 734016 - RNA, 17 nt, Leptospira interrogans serovar lai str. 56601
gauaaaaaacgaaucau

SEQ ID NO: 734017 - RNA, 14 nt, Leptospira interrogans serovar lai str. 56601
gaguucguaugagu

SEQ ID NO: 734018 - RNA, 20 nt, Leptospira interrogans serovar lai str. 56601
gaguuccacauuuuaaaggu

SEQ ID NO: 734019 - RNA, 16 nt, Leptospira interrogans serovar lai str. 56601
aacuaccacaaaacuu

SEQ ID NO: 734020 - RNA, 18 nt, Leptospira interrogans serovar lai str. 56601
aacuaccacagaaagcuu

SEQ ID NO: 734021 - RNA, 20 nt, Leptospira interrogans serovar lai str. 56601
aacguuuuguugaguuugaa

SEQ ID NO: 734022 - RNA, 22 nt, Leptospira interrogans serovar lai str. 56601
aacuaggucgcauuuagcaauu

SEQ ID NO: 734023 - RNA, 15 nt, Leptospira interrogans serovar lai str. 56601
aacucaaagaaauuu

SEQ ID NO: 734024 - RNA, 18 nt, Leptospira interrogans serovar lai str. 56601
gagaacgaugcuugagcu

SEQ ID NO: 734025 - RNA, 19 nt, Leptospira interrogans serovar lai str. 56601
gacuucucuuuucgaaaau

SEQ ID NO: 734026 - RNA, 12 nt, Leptospira interrogans serovar lai str. 56601
gagaguucccac

SEQ ID NO: 734027 - RNA, 17 nt, Leptospira interrogans serovar lai str. 56601
gagaucauuaaugcgaa

SEQ ID NO: 734028 - RNA, 23 nt, Leptospira interrogans serovar lai str. 56601
gagaaugaucaauagaauuguug

SEQ ID NO: 734029 - RNA, 21 nt, Leptospira interrogans serovar lai str. 56601
gagaaguuaaaaaaugaauuu

SEQ ID NO: 734030 - RNA, 15 nt, Leptospira interrogans serovar lai str. 56601
aacucauucuaguuu

SEQ ID NO: 734031 - RNA, 14 nt, Leptospira interrogans serovar lai str. 56601
aacucacguuaaau

SEQ ID NO: 734032 - RNA, 16 nt, Leptospira interrogans serovar lai str. 56601
aacucauauagaaauu

SEQ ID NO: 734033 - RNA, 14 nt, Leptospira interrogans serovar lai str. 56601
aagaaucauuugca

SEQ ID NO: 734034 - RNA, 18 nt, Leptospira interrogans serovar lai str. 56601
aagagccuacaaaucgaa

SEQ ID NO: 734035 - RNA, 18 nt, Leptospira interrogans serovar lai str. 56601
aagagaugauuucuugag

SEQ ID NO: 734036 - RNA, 19 nt, Leptospira interrogans serovar lai str. 56601
gcgacccauaggaaagcgu

SEQ ID NO: 734037 - RNA, 19 nt, Leptospira interrogans serovar lai str. 56601
gcgacucagaaaacucagc

SEQ ID NO: 734038 - RNA, 19 nt, Leptospira interrogans serovar lai str. 56601
gcgauccguagagagcguu

SEQ ID NO: 734039 - RNA, 20 nt, Leptospira interrogans serovar lai str. 56601
aagcagauuuguccguuuga

SEQ ID NO: 734040 - RNA, 22 nt, Leptospira interrogans serovar lai str. 56601
gcuggaaauaucaaugaucaua

SEQ ID NO: 734041 - RNA, 21 nt, Leptospira interrogans serovar lai str. 56601
gcguuuaaaccuucuuuaaga

SEQ ID NO: 734042 - RNA, 22 nt, Leptospira interrogans serovar lai str. 56601
gucccauuuagcaauuugugaa

SEQ ID NO: 734043 - RNA, 13 nt, Leptospira interrogans serovar lai str. 56601
guaucagaaucaa

SEQ ID NO: 734044 - RNA, 16 nt, Leptospira interrogans serovar lai str. 56601
gucaaugguugcaaaa

SEQ ID NO: 734045 - RNA, 12 nt, Leptospira interrogans serovar lai str. 56601
guaggaacuauu

SEQ ID NO: 734046 - RNA, 21 nt, Leptospira interrogans serovar lai str. 56601
aaguauuuuacgauucaauuc

SEQ ID NO: 734047 - RNA, 12 nt, Leptospira interrogans serovar lai str. 56601
guagaucuuuua

SEQ ID NO: 734048 - RNA, 16 nt, Leptospira interrogans serovar lai str. 56601
gguuuucuaauuuaug

SEQ ID NO: 734049 - RNA, 19 nt, Leptospira interrogans serovar lai str. 56601
guaaaagagacauugaaga

SEQ ID NO: 734050 - RNA, 19 nt, Leptospira interrogans serovar lai str. 56601
guaaaucuauucuuaaaau

SEQ ID NO: 734051 - RNA, 24 nt, Leptospira interrogans serovar lai str. 56601
guaagaguuccuacaucauuugua

SEQ ID NO: 734052 - RNA, 13 nt, Leptospira interrogans serovar lai str. 56601
guacaagaaucaa

SEQ ID NO: 734053 - RNA, 18 nt, Leptospira interrogans serovar lai str. 56601
guaauaguucccacaguu

SEQ ID NO: 734054 - RNA, 18 nt, Leptospira interrogans serovar lai str. 56601
aaguaaauucgaucuaag

SEQ ID NO: 734055 - RNA, 14 nt, Leptospira interrogans serovar lai str. 56601
gggcgaaucgcucg

SEQ ID NO: 734056 - RNA, 22 nt, Leptospira interrogans serovar lai str. 56601
aaguaaucuuuauagguuucuu

SEQ ID NO: 734057 - RNA, 20 nt, Leptospira interrogans serovar lai str. 56601
aaguaauuacccuaaagcua

SEQ ID NO: 734058 - RNA, 16 nt, Leptospira interrogans serovar lai str. 56601
ggucgauuuugauucg

SEQ ID NO: 734059 - RNA, 22 nt, Leptospira interrogans serovar lai str. 56601
aagguauaaaauaaaaauuuca

SEQ ID NO: 734060 - RNA, 13 nt, Leptospira interrogans serovar lai str. 56601
ggcgaaucgcucg

SEQ ID NO: 734061 - RNA, 20 nt, Leptospira interrogans serovar lai str. 56601
ggaacuaccacaaaacuuaa

SEQ ID NO: 734062 - RNA, 15 nt, Leptospira interrogans serovar lai str. 56601
ggaauuacuacauuu

SEQ ID NO: 734063 - RNA, 20 nt, Leptospira interrogans serovar lai str. 56601
cgcgauccguagagagcguu

SEQ ID NO: 734064 - RNA, 17 nt, Leptospira interrogans serovar lai str. 56601
cggaugugaauucucua

SEQ ID NO: 734065 - RNA, 16 nt, Leptospira interrogans serovar lai str. 56601
aacauuccaauuuccu

SEQ ID NO: 734066 - RNA, 10 nt, Leptospira interrogans serovar lai str. 56601
cgcaaguaau

SEQ ID NO: 734067 - RNA, 19 nt, Leptospira interrogans serovar lai str. 56601
cgauacugccaaugaugau

SEQ ID NO: 734068 - RNA, 21 nt, Leptospira interrogans serovar lai str. 56601
ccuugaacuuacaaagcacuu

SEQ ID NO: 734069 - RNA, 22 nt, Leptospira interrogans serovar lai str. 56601
ccuucuacaauccucgcuuuua

SEQ ID NO: 734070 - RNA, 15 nt, Leptospira interrogans serovar lai str. 56601
ccuugugacaaucgg

SEQ ID NO: 734071 - RNA, 19 nt, Leptospira interrogans serovar lai str. 56601
cgaaagcgauuguaacgaa

SEQ ID NO: 734072 - RNA, 13 nt, Leptospira interrogans serovar lai str. 56601
cgaaaauucugaa

SEQ ID NO: 734073 - RNA, 18 nt, Leptospira interrogans serovar lai str. 56601
ccuuuuuaacucccugau

SEQ ID NO: 734074 - RNA, 19 nt, Leptospira interrogans serovar lai str. 56601
cgaaauuacgacuguucac

SEQ ID NO: 734075 - RNA, 17 nt, Leptospira interrogans serovar lai str. 56601
aacacaaauauuaagaa

SEQ ID NO: 734076 - RNA, 12 nt, Leptospira interrogans serovar lai str. 56601
aacacaaucugu

SEQ ID NO: 734077 - RNA, 16 nt, Leptospira interrogans serovar lai str. 56601
cgagagacgcugaguu

SEQ ID NO: 734078 - RNA, 20 nt, Leptospira interrogans serovar lai str. 56601
cgaauuugacguaaaggaau

SEQ ID NO: 734079 - RNA, 16 nt, Leptospira interrogans serovar lai str. 56601
cgaaugcacuguagag

SEQ ID NO: 734080 - RNA, 16 nt, Leptospira interrogans serovar lai str. 56601
aaauuaaaauccucaa

SEQ ID NO: 734081 - RNA, 14 nt, Leptospira interrogans serovar lai str. 56601
aaauuagauuuauu

SEQ ID NO: 734082 - RNA, 15 nt, Leptospira interrogans serovar lai str. 56601
aaauuaauuucuaaa

SEQ ID NO: 734083 - RNA, 17 nt, Leptospira interrogans serovar lai str. 56601
aaauuacugauuucaaa

SEQ ID NO: 734084 - RNA, 15 nt, Leptospira interrogans serovar lai str. 56601
aaauuaaaguaucca

SEQ ID NO: 734085 - RNA, 23 nt, Leptospira interrogans serovar lai str. 56601
aaauucaggauaaacauccucaa

SEQ ID NO: 734086 - RNA, 20 nt, Leptospira interrogans serovar lai str. 56601
aaauucaucaauuuuggaaa

SEQ ID NO: 734087 - RNA, 12 nt, Leptospira interrogans serovar lai str. 56601
aaauguagaaac

SEQ ID NO: 734088 - RNA, 17 nt, Leptospira interrogans serovar lai str. 56601
aaauguaguaguuucca

SEQ ID NO: 734089 - RNA, 17 nt, Leptospira interrogans serovar lai str. 56601
aaaugugagaguuccca

SEQ ID NO: 734090 - RNA, 15 nt, Leptospira interrogans serovar lai str. 56601
aaaugugggaacuac

SEQ ID NO: 734091 - RNA, 22 nt, Leptospira interrogans serovar lai str. 56601
aaauguuaaaaaacuauaaauc

SEQ ID NO: 734092 - RNA, 22 nt, Leptospira interrogans serovar lai str. 56601
aaauguuauuuuguauaaagua

SEQ ID NO: 734093 - RNA, 13 nt, Leptospira interrogans serovar lai str. 56601
aaaugauagaaac

SEQ ID NO: 734094 - RNA, 21 nt, Leptospira interrogans serovar lai str. 56601
aaaugagaaagaauuucuaaa

SEQ ID NO: 734095 - RNA, 14 nt, Leptospira interrogans serovar lai str. 56601
aaaugaguaaacua

SEQ ID NO: 734096 - RNA, 16 nt, Leptospira interrogans serovar lai str. 56601
aaauuuuuuuguaauc

SEQ ID NO: 734097 - RNA, 17 nt, Leptospira interrogans serovar lai str. 56601
aaauuuguaggaacuca

SEQ ID NO: 734098 - RNA, 20 nt, Leptospira interrogans serovar lai str. 56601
aaauuuguaggaacucauac

SEQ ID NO: 734099 - RNA, 22 nt, Leptospira interrogans serovar lai str. 56601
aaauugaauuuaaaaguuuccc

SEQ ID NO: 734100 - RNA, 16 nt, Leptospira interrogans serovar lai str. 56601
aaauugacaaagaguu

SEQ ID NO: 734101 - RNA, 23 nt, Leptospira interrogans serovar lai str. 56601
aaauugacaaagaguuguuuauc

SEQ ID NO: 734102 - RNA, 24 nt, Leptospira interrogans serovar lai str. 56601
aaauugcagaauguuuucuacaaa

SEQ ID NO: 734103 - RNA, 12 nt, Leptospira interrogans serovar lai str. 56601
aaauucuuuguc

SEQ ID NO: 734104 - RNA, 18 nt, Leptospira interrogans serovar lai str. 56601
aaauucugucucuuuaua

SEQ ID NO: 734105 - RNA, 23 nt, Leptospira interrogans serovar lai str. 56601
aaauucuuaaaaaauauuuucug

SEQ ID NO: 734106 - RNA, 19 nt, Leptospira interrogans serovar lai str. 56601
aaauucuacaccuucuaaa

SEQ ID NO: 734107 - RNA, 17 nt, Leptospira interrogans serovar lai str. 56601
aaauucauuuuucugaa

SEQ ID NO: 734108 - RNA, 18 nt, Leptospira interrogans serovar lai str. 56601
aaauucauuuuucugaaa

SEQ ID NO: 734109 - RNA, 13 nt, Leptospira interrogans serovar lai str. 56601
ccuacaaaucgaa

SEQ ID NO: 734110 - RNA, 19 nt, Leptospira interrogans serovar lai str. 56601
ccuaauaaacaaaauucaa

SEQ ID NO: 734111 - RNA, 19 nt, Leptospira interrogans serovar lai str. 56601
ccuaaaaugugggaacuac

SEQ ID NO: 734112 - RNA, 18 nt, Leptospira interrogans serovar lai str. 56601
ccuauaucaacaaucgga

SEQ ID NO: 734113 - RNA, 22 nt, Leptospira interrogans serovar lai str. 56601
cccagaaaggaacuaaguuuaa

SEQ ID NO: 734114 - RNA, 17 nt, Leptospira interrogans serovar lai str. 56601
ccauaaaaaacauaaga

SEQ ID NO: 734115 - RNA, 20 nt, Leptospira interrogans serovar lai str. 56601
ccauagagaacgcgaacuuu

SEQ ID NO: 734116 - RNA, 13 nt, Leptospira interrogans serovar lai str. 56601
ccagucaaguaaa

SEQ ID NO: 734117 - RNA, 19 nt, Leptospira interrogans serovar lai str. 56601
cccgaagauucuauuaaga

SEQ ID NO: 734118 - RNA, 18 nt, Leptospira interrogans serovar lai str. 56601
aaauacuuuauuuguauu

SEQ ID NO: 734119 - RNA, 22 nt, Leptospira interrogans serovar lai str. 56601
aaauagauucuaauuuuucaaa

SEQ ID NO: 734120 - RNA, 21 nt, Leptospira interrogans serovar lai str. 56601
aaauaucaaugaucauauccg

SEQ ID NO: 734121 - RNA, 14 nt, Leptospira interrogans serovar lai str. 56601
aaauauggauuuuu

SEQ ID NO: 734122 - RNA, 18 nt, Leptospira interrogans serovar lai str. 56601
aaauauucagaaacugga

SEQ ID NO: 734123 - RNA, 19 nt, Leptospira interrogans serovar lai str. 56601
aaauauucgaucaaguaag

SEQ ID NO: 734124 - RNA, 18 nt, Leptospira interrogans serovar lai str. 56601
aaauaaaugugggaacuc

SEQ ID NO: 734125 - RNA, 20 nt, Leptospira interrogans serovar lai str. 56601
aaaguuugggauauucugaa

SEQ ID NO: 734126 - RNA, 19 nt, Leptospira interrogans serovar lai str. 56601
aaauaauacaauucugaaa

SEQ ID NO: 734127 - RNA, 24 nt, Leptospira interrogans serovar lai str. 56601
aaauacaucucuuuuuuaaagccu

SEQ ID NO: 734128 - RNA, 20 nt, Leptospira interrogans serovar lai str. 56601
aaauaccaauaacuuaaccu

SEQ ID NO: 734129 - RNA, 13 nt, Leptospira interrogans serovar lai str. 56601
aaauacgauucga

SEQ ID NO: 734130 - RNA, 15 nt, Leptospira interrogans serovar lai str. 56601
aaauacgauucgaaa

SEQ ID NO: 734131 - RNA, 22 nt, Leptospira interrogans serovar lai str. 56601
aaauacuaaauuaaguuuauuc

SEQ ID NO: 734132 - RNA, 14 nt, Leptospira interrogans serovar lai str. 56601
aaauacgcuucucu

SEQ ID NO: 734133 - RNA, 15 nt, Leptospira interrogans serovar lai str. 56601
aaaguguuuuuguaa

SEQ ID NO: 734134 - RNA, 23 nt, Leptospira interrogans serovar lai str. 56601
ccacuuuaaaaaugaucuaagau

SEQ ID NO: 734135 - RNA, 15 nt, Leptospira interrogans serovar lai str. 56601
ccaauaaaaacuaau

SEQ ID NO: 734136 - RNA, 20 nt, Leptospira interrogans serovar lai str. 56601
ccacagugaaagauuaaaga

SEQ ID NO: 734137 - RNA, 16 nt, Leptospira interrogans serovar lai str. 56601
cauuuaccuaaaauuc

SEQ ID NO: 734138 - RNA, 16 nt, Leptospira interrogans serovar lai str. 56601
cauuucaaguuuucuu

SEQ ID NO: 734139 - RNA, 20 nt, Leptospira interrogans serovar lai str. 56601
cauuucguaaaauccaugau

SEQ ID NO: 734140 - RNA, 24 nt, Leptospira interrogans serovar lai str. 56601
cauuucuaugauauggaauuccga

SEQ ID NO: 734141 - RNA, 17 nt, Leptospira interrogans serovar lai str. 56601
cauuuugauaauuucau

SEQ ID NO: 734142 - RNA, 13 nt, Leptospira interrogans serovar lai str. 56601
cauuuuuucauac

SEQ ID NO: 734143 - RNA, 16 nt, Leptospira interrogans serovar lai str. 56601
cauuuuuauuugcauu

SEQ ID NO: 734144 - RNA, 21 nt, Leptospira interrogans serovar lai str. 56601
ccaaaaagaaaaacagguaaa

SEQ ID NO: 734145 - RNA, 17 nt, Leptospira interrogans serovar lai str. 56601
ccaaaauauucagaaac

SEQ ID NO: 734146 - RNA, 23 nt, Leptospira interrogans serovar lai str. 56601
ccaaaaucccagaaaggaacuaa

SEQ ID NO: 734147 - RNA, 15 nt, Leptospira interrogans serovar lai str. 56601
cauuaaaauaggauu

SEQ ID NO: 734148 - RNA, 19 nt, Leptospira interrogans serovar lai str. 56601
cauuaccaauugauaauuu

SEQ ID NO: 734149 - RNA, 17 nt, Leptospira interrogans serovar lai str. 56601
caugucucaguucaaaa

SEQ ID NO: 734150 - RNA, 23 nt, Leptospira interrogans serovar lai str. 56601
cauucaucaaaguuauuucgauu

SEQ ID NO: 734151 - RNA, 13 nt, Leptospira interrogans serovar lai str. 56601
cauuccaauuucc

SEQ ID NO: 734152 - RNA, 18 nt, Leptospira interrogans serovar lai str. 56601
cauugaguuacgcugagu

SEQ ID NO: 734153 - RNA, 15 nt, Leptospira interrogans serovar lai str. 56601
cauucggagacuuga

SEQ ID NO: 734154 - RNA, 13 nt, Leptospira interrogans serovar lai str. 56601
cauucuucaaaua

SEQ ID NO: 734155 - RNA, 23 nt, Leptospira interrogans serovar lai str. 56601
caguaaaaaagcgaaagaaugua

SEQ ID NO: 734156 - RNA, 17 nt, Leptospira interrogans serovar lai str. 56601
caucgaaaaaacaaaua

SEQ ID NO: 734157 - RNA, 16 nt, Leptospira interrogans serovar lai str. 56601
cauaucaaauucauga

SEQ ID NO: 734158 - RNA, 22 nt, Leptospira interrogans serovar lai str. 56601
cauaaauggcguauaagaaugu

SEQ ID NO: 734159 - RNA, 23 nt, Leptospira interrogans serovar lai str. 56601
cauaaauggcguauaagaauguu

SEQ ID NO: 734160 - RNA, 15 nt, Leptospira interrogans serovar lai str. 56601
aaagcacaaaacgau

SEQ ID NO: 734161 - RNA, 19 nt, Leptospira interrogans serovar lai str. 56601
aaagauuuuucuucuucau

SEQ ID NO: 734162 - RNA, 17 nt, Leptospira interrogans serovar lai str. 56601
cagcauaauaaucgcuu

SEQ ID NO: 734163 - RNA, 21 nt, Leptospira interrogans serovar lai str. 56601
cagauacgcccguaaauuucu

SEQ ID NO: 734164 - RNA, 17 nt, Leptospira interrogans serovar lai str. 56601
aaacuuagguuuuguaa

SEQ ID NO: 734165 - RNA, 13 nt, Leptospira interrogans serovar lai str. 56601
aaacuuucggaau

SEQ ID NO: 734166 - RNA, 15 nt, Leptospira interrogans serovar lai str. 56601
aaacuuuuagaauuc

SEQ ID NO: 734167 - RNA, 16 nt, Leptospira interrogans serovar lai str. 56601
aaacuuuuauaaaauc

SEQ ID NO: 734168 - RNA, 19 nt, Leptospira interrogans serovar lai str. 56601
cacguucaacguucaaaca

SEQ ID NO: 734169 - RNA, 13 nt, Leptospira interrogans serovar lai str. 56601
cagagauuccgau

SEQ ID NO: 734170 - RNA, 14 nt, Leptospira interrogans serovar lai str. 56601
aaagaacgauuuuu

SEQ ID NO: 734171 - RNA, 15 nt, Leptospira interrogans serovar lai str. 56601
aaagaauacgauuua

SEQ ID NO: 734172 - RNA, 18 nt, Leptospira interrogans serovar lai str. 56601
cagaaaccguuguaugau

SEQ ID NO: 734173 - RNA, 14 nt, Leptospira interrogans serovar lai str. 56601
cagaaacguucgua

SEQ ID NO: 734174 - RNA, 21 nt, Leptospira interrogans serovar lai str. 56601
caacucuguaaauucaaagca

SEQ ID NO: 734175 - RNA, 15 nt, Leptospira interrogans serovar lai str. 56601
caaucgauaacuuga

SEQ ID NO: 734176 - RNA, 21 nt, Leptospira interrogans serovar lai str. 56601
caaucgaucuguaaaauucag

SEQ ID NO: 734177 - RNA, 22 nt, Leptospira interrogans serovar lai str. 56601
caauacuuuauagguucuggau

SEQ ID NO: 734178 - RNA, 16 nt, Leptospira interrogans serovar lai str. 56601
caaguaaaucugagga

SEQ ID NO: 734179 - RNA, 12 nt, Leptospira interrogans serovar lai str. 56601
caauuaaaucca

SEQ ID NO: 734180 - RNA, 16 nt, Leptospira interrogans serovar lai str. 56601
caauuugugaacuuuc

SEQ ID NO: 734181 - RNA, 23 nt, Leptospira interrogans serovar lai str. 56601
caauugaagcaguuuuguuaauc

SEQ ID NO: 734182 - RNA, 20 nt, Leptospira interrogans serovar lai str. 56601
caauuccuguaguauuucca

SEQ ID NO: 734183 - RNA, 16 nt, Leptospira interrogans serovar lai str. 56601
caaucuuacaaguuau

SEQ ID NO: 734184 - RNA, 21 nt, Leptospira interrogans serovar lai str. 56601
auuuacguaugaguuucucca

SEQ ID NO: 734185 - RNA, 23 nt, Leptospira interrogans serovar lai str. 56601
auuuagauuuguguuaguuccca

SEQ ID NO: 734186 - RNA, 23 nt, Leptospira interrogans serovar lai str. 56601
auuuagguuugugguaguuccca

SEQ ID NO: 734187 - RNA, 13 nt, Leptospira interrogans serovar lai str. 56601
auuuauaaaacga

SEQ ID NO: 734188 - RNA, 18 nt, Leptospira interrogans serovar lai str. 56601
auuuaguuuuuguaugag

SEQ ID NO: 734189 - RNA, 21 nt, Leptospira interrogans serovar lai str. 56601
caaaucuuucacuuuaaaaca

SEQ ID NO: 734190 - RNA, 14 nt, Leptospira interrogans serovar lai str. 56601
caaauggagaauua

SEQ ID NO: 734191 - RNA, 16 nt, Leptospira interrogans serovar lai str. 56601
caacauugaguuugag

SEQ ID NO: 734192 - RNA, 23 nt, Leptospira interrogans serovar lai str. 56601
caacgcucuuuaugaaucgcguu

SEQ ID NO: 734193 - RNA, 17 nt, Leptospira interrogans serovar lai str. 56601
caauuuugccaauucca

SEQ ID NO: 734194 - RNA, 21 nt, Leptospira interrogans serovar lai str. 56601
cacauuauuuaaugaauccua

SEQ ID NO: 734195 - RNA, 23 nt, Leptospira interrogans serovar lai str. 56601
augggaguucguaugaguuccca

SEQ ID NO: 734196 - RNA, 19 nt, Leptospira interrogans serovar lai str. 56601
auggaauuuauuauaucga

SEQ ID NO: 734197 - RNA, 20 nt, Leptospira interrogans serovar lai str. 56601
auggaauuuauuauaucgaa

SEQ ID NO: 734198 - RNA, 21 nt, Leptospira interrogans serovar lai str. 56601
auggaauuuuucaacaacucu

SEQ ID NO: 734199 - RNA, 22 nt, Leptospira interrogans serovar lai str. 56601
augaucgucgcuugauuccaag

SEQ ID NO: 734200 - RNA, 19 nt, Leptospira interrogans serovar lai str. 56601
auugaguuaauuuucgauu

SEQ ID NO: 734201 - RNA, 21 nt, Leptospira interrogans serovar lai str. 56601
auugaguuacgcugaguuuga

SEQ ID NO: 734202 - RNA, 15 nt, Leptospira interrogans serovar lai str. 56601
auuggauucuuucga

SEQ ID NO: 734203 - RNA, 22 nt, Leptospira interrogans serovar lai str. 56601
auugguguuguguuaguuccca

SEQ ID NO: 734204 - RNA, 21 nt, Leptospira interrogans serovar lai str. 56601
auuguuucauaaaauucuccg

SEQ ID NO: 734205 - RNA, 16 nt, Leptospira interrogans serovar lai str. 56601
auuguuguuauggaau

SEQ ID NO: 734206 - RNA, 16 nt, Leptospira interrogans serovar lai str. 56601
auuuaaaaauugaucu

SEQ ID NO: 734207 - RNA, 23 nt, Leptospira interrogans serovar lai str. 56601
auuguugaaaaauuaauucucca

SEQ ID NO: 734208 - RNA, 15 nt, Leptospira interrogans serovar lai str. 56601
auuguugaagaauua

SEQ ID NO: 734209 - RNA, 23 nt, Leptospira interrogans serovar lai str. 56601
auuguugaagaauuaauucucca

SEQ ID NO: 734210 - RNA, 16 nt, Leptospira interrogans serovar lai str. 56601
auuguugcuauggaau

SEQ ID NO: 734211 - RNA, 22 nt, Leptospira interrogans serovar lai str. 56601
auuccuucguuuuguugugaac

SEQ ID NO: 734212 - RNA, 18 nt, Leptospira interrogans serovar lai str. 56601
auuccuuuuaagaauacu

SEQ ID NO: 734213 - RNA, 20 nt, Leptospira interrogans serovar lai str. 56601
auuccuaaaaugugggaacu

SEQ ID NO: 734214 - RNA, 17 nt, Leptospira interrogans serovar lai str. 56601
auucucuuuugaccaaa

SEQ ID NO: 734215 - RNA, 17 nt, Leptospira interrogans serovar lai str. 56601
auugaauuucuucgauu

SEQ ID NO: 734216 - RNA, 14 nt, Leptospira interrogans serovar lai str. 56601
auugaguuucuaua

SEQ ID NO: 734217 - RNA, 16 nt, Leptospira interrogans serovar lai str. 56601
auugaguuucuugaac

SEQ ID NO: 734218 - RNA, 15 nt, Leptospira interrogans serovar lai str. 56601
auucuuuaaaauaga

SEQ ID NO: 734219 - RNA, 20 nt, Leptospira interrogans serovar lai str. 56601
auucuuaaaauguaggaacu

SEQ ID NO: 734220 - RNA, 14 nt, Leptospira interrogans serovar lai str. 56601
auguuuuucugaua

SEQ ID NO: 734221 - RNA, 15 nt, Leptospira interrogans serovar lai str. 56601
auuaaaguaaauucg

SEQ ID NO: 734222 - RNA, 15 nt, Leptospira interrogans serovar lai str. 56601
auuaaaauccucaac

SEQ ID NO: 734223 - RNA, 22 nt, Leptospira interrogans serovar lai str. 56601
auguuauagacaacguuacuuu

SEQ ID NO: 734224 - RNA, 12 nt, Leptospira interrogans serovar lai str. 56601
auguucaaauuc

SEQ ID NO: 734225 - RNA, 20 nt, Leptospira interrogans serovar lai str. 56601
auuauaguuuuauuagaacu

SEQ ID NO: 734226 - RNA, 21 nt, Leptospira interrogans serovar lai str. 56601
auuaguuuucuucuauuucuu

SEQ ID NO: 734227 - RNA, 16 nt, Leptospira interrogans serovar lai str. 56601
auuagcuuaagaauuu

SEQ ID NO: 734228 - RNA, 14 nt, Leptospira interrogans serovar lai str. 56601
aucggagucauaac

SEQ ID NO: 734229 - RNA, 22 nt, Leptospira interrogans serovar lai str. 56601
aucgaucuguaaaauucagauu

SEQ ID NO: 734230 - RNA, 23 nt, Leptospira interrogans serovar lai str. 56601
aucgauagaaguaguaguuccca

SEQ ID NO: 734231 - RNA, 21 nt, Leptospira interrogans serovar lai str. 56601
aucgauaggaguauaagucga

SEQ ID NO: 734232 - RNA, 19 nt, Leptospira interrogans serovar lai str. 56601
aucuuuguaugaguuccca

SEQ ID NO: 734233 - RNA, 19 nt, Leptospira interrogans serovar lai str. 56601
augaguucccacauucgau

SEQ ID NO: 734234 - RNA, 23 nt, Leptospira interrogans serovar lai str. 56601
augacuuaaucugugggaacucu

SEQ ID NO: 734235 - RNA, 19 nt, Leptospira interrogans serovar lai str. 56601
aucuuagaauaauaggaau

SEQ ID NO: 734236 - RNA, 19 nt, Leptospira interrogans serovar lai str. 56601
aucuuagaaugugggaacu

SEQ ID NO: 734237 - RNA, 14 nt, Leptospira interrogans serovar lai str. 56601
aucuuacaaguuau

SEQ ID NO: 734238 - RNA, 14 nt, Leptospira interrogans serovar lai str. 56601
aucuuaaauaucga

SEQ ID NO: 734239 - RNA, 16 nt, Leptospira interrogans serovar lai str. 56601
aucuucuguaaaacuu

SEQ ID NO: 734240 - RNA, 17 nt, Leptospira interrogans serovar lai str. 56601
aucuuuauagguuucuu

SEQ ID NO: 734241 - RNA, 23 nt, Leptospira interrogans serovar lai str. 56601
aucuguaaaaugauguaggaacu

SEQ ID NO: 734242 - RNA, 23 nt, Leptospira interrogans serovar lai str. 56601
aucggcuccauauuccagaagua

SEQ ID NO: 734243 - RNA, 20 nt, Leptospira interrogans serovar lai str. 56601
aucguuuauaaaucgaaucg

SEQ ID NO: 734244 - RNA, 17 nt, Leptospira interrogans serovar lai str. 56601
aucuaaacuuugcaaau

SEQ ID NO: 734245 - RNA, 20 nt, Leptospira interrogans serovar lai str. 56601
aucuaaacuuugcaaaucga

SEQ ID NO: 734246 - RNA, 15 nt, Leptospira interrogans serovar lai str. 56601
aucuaaugauuucuu

SEQ ID NO: 734247 - RNA, 20 nt, Leptospira interrogans serovar lai str. 56601
aucuacuuacauagaacuca

SEQ ID NO: 734248 - RNA, 13 nt, Leptospira interrogans serovar lai str. 56601
aucuacuugaauu

SEQ ID NO: 734249 - RNA, 21 nt, Leptospira interrogans serovar lai str. 56601
aucacguucaacguucaaaca

SEQ ID NO: 734250 - RNA, 18 nt, Leptospira interrogans serovar lai str. 56601
aucaaagcaaaguuucuu

SEQ ID NO: 734251 - RNA, 13 nt, Leptospira interrogans serovar lai str. 56601
aucaaauccgaaa

SEQ ID NO: 734252 - RNA, 17 nt, Leptospira interrogans serovar lai str. 56601
auauuagaguuucuaaa

SEQ ID NO: 734253 - RNA, 19 nt, Leptospira interrogans serovar lai str. 56601
aucaacucuguaaauucaa

SEQ ID NO: 734254 - RNA, 16 nt, Leptospira interrogans serovar lai str. 56601
auauacaauaaauaga

SEQ ID NO: 734255 - RNA, 19 nt, Leptospira interrogans serovar lai str. 56601
auauaagaucuaucucaaa

SEQ ID NO: 734256 - RNA, 19 nt, Leptospira interrogans serovar lai str. 56601
auacguuauuuccgucguu

SEQ ID NO: 734257 - RNA, 14 nt, Leptospira interrogans serovar lai str. 56601
auacguuuacucca

SEQ ID NO: 734258 - RNA, 14 nt, Leptospira interrogans serovar lai str. 56601
auacuaaauuaagu

SEQ ID NO: 734259 - RNA, 18 nt, Leptospira interrogans serovar lai str. 56601
auacggaugugaauucuc

SEQ ID NO: 734260 - RNA, 23 nt, Leptospira interrogans serovar lai str. 56601
auagaaaccaguaauaguuugua

SEQ ID NO: 734261 - RNA, 13 nt, Leptospira interrogans serovar lai str. 56601
auagaauuuugca

SEQ ID NO: 734262 - RNA, 21 nt, Leptospira interrogans serovar lai str. 56601
aguuuuuugaguccacagguu

SEQ ID NO: 734263 - RNA, 17 nt, Leptospira interrogans serovar lai str. 56601
aguuuugagauuacaaa

SEQ ID NO: 734264 - RNA, 18 nt, Leptospira interrogans serovar lai str. 56601
aguuuugcgggaacuccc

SEQ ID NO: 734265 - RNA, 18 nt, Leptospira interrogans serovar lai str. 56601
aguuuuuguuaucaacuu

SEQ ID NO: 734266 - RNA, 15 nt, Leptospira interrogans serovar lai str. 56601
aguuuucauuacaaa

SEQ ID NO: 734267 - RNA, 18 nt, Leptospira interrogans serovar lai str. 56601
aguuuuuauauucuagaa

SEQ ID NO: 734268 - RNA, 16 nt, Leptospira interrogans serovar lai str. 56601
aguuuuacagaagauu

SEQ ID NO: 734269 - RNA, 21 nt, Leptospira interrogans serovar lai str. 56601
aguuucuacauuuuugugaaa

SEQ ID NO: 734270 - RNA, 18 nt, Leptospira interrogans serovar lai str. 56601
aguuucacagaaacccuc

SEQ ID NO: 734271 - RNA, 22 nt, Leptospira interrogans serovar lai str. 56601
aguuuccacucuuugacccaua

SEQ ID NO: 734272 - RNA, 19 nt, Leptospira interrogans serovar lai str. 56601
auaagucgaucuacuaaau

SEQ ID NO: 734273 - RNA, 20 nt, Leptospira interrogans serovar lai str. 56601
auacccguuuauaccgaaac

SEQ ID NO: 734274 - RNA, 17 nt, Leptospira interrogans serovar lai str. 56601
auacgauucgaaagauu

SEQ ID NO: 734275 - RNA, 14 nt, Leptospira interrogans serovar lai str. 56601
auaauagauuucug

SEQ ID NO: 734276 - RNA, 16 nt, Leptospira interrogans serovar lai str. 56601
auaauaaauuuuucug

SEQ ID NO: 734277 - RNA, 13 nt, Leptospira interrogans serovar lai str. 56601
auaauuuacuuca

SEQ ID NO: 734278 - RNA, 14 nt, Leptospira interrogans serovar lai str. 56601
auaauuuacuucau

SEQ ID NO: 734279 - RNA, 19 nt, Leptospira interrogans serovar lai str. 56601
auaauaugaauucauugua

SEQ ID NO: 734280 - RNA, 14 nt, Leptospira interrogans serovar lai str. 56601
auacaaaguuugua

SEQ ID NO: 734281 - RNA, 20 nt, Leptospira interrogans serovar lai str. 56601
auacaaaguuuguaguaacu

SEQ ID NO: 734282 - RNA, 22 nt, Leptospira interrogans serovar lai str. 56601
auaauuuuuacucaaagaaucg

SEQ ID NO: 734283 - RNA, 16 nt, Leptospira interrogans serovar lai str. 56601
auaauuuuuguuugua

SEQ ID NO: 734284 - RNA, 17 nt, Leptospira interrogans serovar lai str. 56601
auaauuuuaauauuucg

SEQ ID NO: 734285 - RNA, 18 nt, Leptospira interrogans serovar lai str. 56601
auaauuuuaauauuucga

SEQ ID NO: 734286 - RNA, 17 nt, Leptospira interrogans serovar lai str. 56601
aguauguuuuucuaaua

SEQ ID NO: 734287 - RNA, 17 nt, Leptospira interrogans serovar lai str. 56601
aguauguuuuucugaua

SEQ ID NO: 734288 - RNA, 17 nt, Leptospira interrogans serovar lai str. 56601
aguauuauaaacagucg

SEQ ID NO: 734289 - RNA, 16 nt, Leptospira interrogans serovar lai str. 56601
agugaauuuguaauuc

SEQ ID NO: 734290 - RNA, 22 nt, Leptospira interrogans serovar lai str. 56601
agugaauuuguaauucuucaau

SEQ ID NO: 734291 - RNA, 18 nt, Leptospira interrogans serovar lai str. 56601
aguugauuaugauccaaa

SEQ ID NO: 734292 - RNA, 20 nt, Leptospira interrogans serovar lai str. 56601
aguugauuucagaucauaaa

SEQ ID NO: 734293 - RNA, 24 nt, Leptospira interrogans serovar lai str. 56601
aguucggaagauuuuucaaucuaa

SEQ ID NO: 734294 - RNA, 21 nt, Leptospira interrogans serovar lai str. 56601
aguucucaagaucauucuauu

SEQ ID NO: 734295 - RNA, 18 nt, Leptospira interrogans serovar lai str. 56601
aguucuaauguuguuaaa

SEQ ID NO: 734296 - RNA, 17 nt, Leptospira interrogans serovar lai str. 56601
aguucccacaaauucca

SEQ ID NO: 734297 - RNA, 19 nt, Leptospira interrogans serovar lai str. 56601
aguucccacaaauuccaau

SEQ ID NO: 734298 - RNA, 17 nt, Leptospira interrogans serovar lai str. 56601
aguucccacaaauucug

SEQ ID NO: 734299 - RNA, 18 nt, Leptospira interrogans serovar lai str. 56601
aguucccacaguuugaaa

SEQ ID NO: 734300 - RNA, 19 nt, Leptospira interrogans serovar lai str. 56601
aguucccacauuuugugaa

SEQ ID NO: 734301 - RNA, 20 nt, Leptospira interrogans serovar lai str. 56601
aguaaaaucuaaauuuguaa

SEQ ID NO: 734302 - RNA, 20 nt, Leptospira interrogans serovar lai str. 56601
aguaaaacgcucucuacgga

SEQ ID NO: 734303 - RNA, 14 nt, Leptospira interrogans serovar lai str. 56601
agguuguaacucaa

SEQ ID NO: 734304 - RNA, 14 nt, Leptospira interrogans serovar lai str. 56601
aguagaauucucag

SEQ ID NO: 734305 - RNA, 21 nt, Leptospira interrogans serovar lai str. 56601
agguauuuuagagaaacuuua

SEQ ID NO: 734306 - RNA, 18 nt, Leptospira interrogans serovar lai str. 56601
aaacgcgauccguagaga

SEQ ID NO: 734307 - RNA, 16 nt, Leptospira interrogans serovar lai str. 56601
agcuccagucaaguua

SEQ ID NO: 734308 - RNA, 20 nt, Leptospira interrogans serovar lai str. 56601
agcauuacuacagacaaucc

SEQ ID NO: 734309 - RNA, 22 nt, Leptospira interrogans serovar lai str. 56601
aaacgaacuuuucuauaaaauc

SEQ ID NO: 734310 - RNA, 15 nt, Leptospira interrogans serovar lai str. 56601
aaacgauuaauccau

SEQ ID NO: 734311 - RNA, 15 nt, Leptospira interrogans serovar lai str. 56601
aaaccucucggaaua

SEQ ID NO: 734312 - RNA, 21 nt, Leptospira interrogans serovar lai str. 56601
aaacccagcgccucauuucuu

SEQ ID NO: 734313 - RNA, 14 nt, Leptospira interrogans serovar lai str. 56601
agauuuuucaaucu

SEQ ID NO: 734314 - RNA, 23 nt, Leptospira interrogans serovar lai str. 56601
agauuuuucguucuaagaaucuu

SEQ ID NO: 734315 - RNA, 20 nt, Leptospira interrogans serovar lai str. 56601
acuuuaagcaaagauuaagu

SEQ ID NO: 734316 - RNA, 14 nt, Leptospira interrogans serovar lai str. 56601
acuuucagcuacaa

SEQ ID NO: 734317 - RNA, 22 nt, Leptospira interrogans serovar lai str. 56601
acuuucauugauaauuucuagu

SEQ ID NO: 734318 - RNA, 20 nt, Leptospira interrogans serovar lai str. 56601
agcaagcacauccgcauucu

SEQ ID NO: 734319 - RNA, 20 nt, Leptospira interrogans serovar lai str. 56601
acgcgauccguagagagcgu

SEQ ID NO: 734320 - RNA, 20 nt, Leptospira interrogans serovar lai str. 56601
acgcgaucuauagagagcgu

SEQ ID NO: 734321 - RNA, 20 nt, Leptospira interrogans serovar lai str. 56601
acgcgauucauaaagagcgu

SEQ ID NO: 734322 - RNA, 20 nt, Leptospira interrogans serovar lai str. 56601
acgcuaaaauaaaguaucca

SEQ ID NO: 734323 - RNA, 13 nt, Leptospira interrogans serovar lai str. 56601
acgcguugauuuc

SEQ ID NO: 734324 - RNA, 13 nt, Leptospira interrogans serovar lai str. 56601
accuuaaguuuca

SEQ ID NO: 734325 - RNA, 23 nt, Leptospira interrogans serovar lai str. 56601
accuggauuuguaauaguuccca

SEQ ID NO: 734326 - RNA, 18 nt, Leptospira interrogans serovar lai str. 56601
acguaaugugaguucgac

SEQ ID NO: 734327 - RNA, 18 nt, Leptospira interrogans serovar lai str. 56601
acguaaagaacuucgauc

SEQ ID NO: 734328 - RNA, 14 nt, Leptospira interrogans serovar lai str. 56601
acguaaauucgaua

SEQ ID NO: 734329 - RNA, 21 nt, Leptospira interrogans serovar lai str. 56601
acguauguguaaugauuucag

SEQ ID NO: 734330 - RNA, 14 nt, Leptospira interrogans serovar lai str. 56601
acggggccguucga

SEQ ID NO: 734331 - RNA, 21 nt, Leptospira interrogans serovar lai str. 56601
acuauuacaaaucgacgauuu

SEQ ID NO: 734332 - RNA, 17 nt, Leptospira interrogans serovar lai str. 56601
acucaacgaagucucca

SEQ ID NO: 734333 - RNA, 15 nt, Leptospira interrogans serovar lai str. 56601
acucaucuaaucgaa

SEQ ID NO: 734334 - RNA, 17 nt, Leptospira interrogans serovar lai str. 56601
acuucuaaaaaauucuu

SEQ ID NO: 734335 - RNA, 15 nt, Leptospira interrogans serovar lai str. 56601
acuugccauggaaau

SEQ ID NO: 734336 - RNA, 18 nt, Leptospira interrogans serovar lai str. 56601
acuuuagagcaguucaau

SEQ ID NO: 734337 - RNA, 17 nt, Leptospira interrogans serovar lai str. 56601
acucuaauguaggaacu

SEQ ID NO: 734338 - RNA, 16 nt, Leptospira interrogans serovar lai str. 56601
acuggauucaaaauug

SEQ ID NO: 734339 - RNA, 22 nt, Leptospira interrogans serovar lai str. 56601
acccugguuucaaaaaaucgac

SEQ ID NO: 734340 - RNA, 16 nt, Leptospira interrogans serovar lai str. 56601
aaaauuaacuuugaua

SEQ ID NO: 734341 - RNA, 19 nt, Leptospira interrogans serovar lai str. 56601
accccuuuuuuaagaaucu

SEQ ID NO: 734342 - RNA, 20 nt, Leptospira interrogans serovar lai str. 56601
accccuuuuuuaagaaucuc

SEQ ID NO: 734343 - RNA, 22 nt, Leptospira interrogans serovar lai str. 56601
acaaaauuaggcuuaucuguaa

SEQ ID NO: 734344 - RNA, 15 nt, Leptospira interrogans serovar lai str. 56601
acaaaaucugaauuu

SEQ ID NO: 734345 - RNA, 18 nt, Leptospira interrogans serovar lai str. 56601
aauuuuuaaaaguagaau

SEQ ID NO: 734346 - RNA, 22 nt, Leptospira interrogans serovar lai str. 56601
aauuuuaucuuaauguaaaguu

SEQ ID NO: 734347 - RNA, 18 nt, Leptospira interrogans serovar lai str. 56601
aauuuucuuaguuuugua

SEQ ID NO: 734348 - RNA, 17 nt, Leptospira interrogans serovar lai str. 56601
aauuuucuuuagaaauu

SEQ ID NO: 734349 - RNA, 13 nt, Leptospira interrogans serovar lai str. 56601
aauuuucuuucua

SEQ ID NO: 734350 - RNA, 19 nt, Leptospira interrogans serovar lai str. 56601
aauuuuacuaaaaauucau

SEQ ID NO: 734351 - RNA, 15 nt, Leptospira interrogans serovar lai str. 56601
aauuuuaguaaacua

SEQ ID NO: 734352 - RNA, 17 nt, Leptospira interrogans serovar lai str. 56601
aauuuuaaguucagauu

SEQ ID NO: 734353 - RNA, 16 nt, Leptospira interrogans serovar lai str. 56601
aauuuggaaauuguga

SEQ ID NO: 734354 - RNA, 24 nt, Leptospira interrogans serovar lai str. 56601
acauuuuaaaaauucaacuuguaa

SEQ ID NO: 734355 - RNA, 23 nt, Leptospira interrogans serovar lai str. 56601
accaaccucucacuucuugaacu

SEQ ID NO: 734356 - RNA, 17 nt, Leptospira interrogans serovar lai str. 56601
acaucuaaugauuucuu

SEQ ID NO: 734357 - RNA, 13 nt, Leptospira interrogans serovar lai str. 56601
acaugagcauucu

SEQ ID NO: 734358 - RNA, 16 nt, Leptospira interrogans serovar lai str. 56601
acauccgcauucucac

SEQ ID NO: 734359 - RNA, 16 nt, Leptospira interrogans serovar lai str. 56601
acauccuucaaacuuu

SEQ ID NO: 734360 - RNA, 20 nt, Leptospira interrogans serovar lai str. 56601
accagcguuuugcugaguuu

SEQ ID NO: 734361 - RNA, 19 nt, Leptospira interrogans serovar lai str. 56601
aaucauggccuucuggaaa

SEQ ID NO: 734362 - RNA, 16 nt, Leptospira interrogans serovar lai str. 56601
aaucaugugaauucag

SEQ ID NO: 734363 - RNA, 21 nt, Leptospira interrogans serovar lai str. 56601
aaucaugaaccauggauuuuu

SEQ ID NO: 734364 - RNA, 17 nt, Leptospira interrogans serovar lai str. 56601
aaucauauccaauuuca

SEQ ID NO: 734365 - RNA, 13 nt, Leptospira interrogans serovar lai str. 56601
aauccauaucuac

SEQ ID NO: 734366 - RNA, 14 nt, Leptospira interrogans serovar lai str. 56601
aaucccaaauucuu

SEQ ID NO: 734367 - RNA, 16 nt, Leptospira interrogans serovar lai str. 56601
aaucguuuguaaaauc

SEQ ID NO: 734368 - RNA, 17 nt, Leptospira interrogans serovar lai str. 56601
aaucuaguucaacguaa

SEQ ID NO: 734369 - RNA, 12 nt, Leptospira interrogans serovar lai str. 56601
aaucuaacugua

SEQ ID NO: 734370 - RNA, 16 nt, Leptospira interrogans serovar lai str. 56601
aaucgugaauuuacca

SEQ ID NO: 734371 - RNA, 23 nt, Leptospira interrogans serovar lai str. 56601
aaucgauuucuaaauugugagaa

SEQ ID NO: 734372 - RNA, 15 nt, Leptospira interrogans serovar lai str. 56601
aaucgccucuugaag

SEQ ID NO: 734373 - RNA, 20 nt, Leptospira interrogans serovar lai str. 56601
aaucgagauugauauuucuu

SEQ ID NO: 734374 - RNA, 16 nt, Leptospira interrogans serovar lai str. 56601
aauggaggauccuuuc

SEQ ID NO: 734375 - RNA, 13 nt, Leptospira interrogans serovar lai str. 56601
aauggacucauaa

SEQ ID NO: 734376 - RNA, 18 nt, Leptospira interrogans serovar lai str. 56601
aauguauccaauccaaaa

SEQ ID NO: 734377 - RNA, 14 nt, Leptospira interrogans serovar lai str. 56601
aauguauaauccuu

SEQ ID NO: 734378 - RNA, 14 nt, Leptospira interrogans serovar lai str. 56601
aaugauuucuugau

SEQ ID NO: 734379 - RNA, 12 nt, Leptospira interrogans serovar lai str. 56601
aaucuccacuau

SEQ ID NO: 734380 - RNA, 19 nt, Leptospira interrogans serovar lai str. 56601
aaucuccgcucuauuucca

SEQ ID NO: 734381 - RNA, 17 nt, Leptospira interrogans serovar lai str. 56601
aaucugaacauaaaauc

SEQ ID NO: 734382 - RNA, 12 nt, Leptospira interrogans serovar lai str. 56601
aaucuucaaguu

SEQ ID NO: 734383 - RNA, 20 nt, Leptospira interrogans serovar lai str. 56601
aaucugugggaacuaucaca

SEQ ID NO: 734384 - RNA, 14 nt, Leptospira interrogans serovar lai str. 56601
aaucuuaacuuuaa

SEQ ID NO: 734385 - RNA, 21 nt, Leptospira interrogans serovar lai str. 56601
aauuuagguuaagucguugua

SEQ ID NO: 734386 - RNA, 12 nt, Leptospira interrogans serovar lai str. 56601
aauuuagaaauu

SEQ ID NO: 734387 - RNA, 16 nt, Leptospira interrogans serovar lai str. 56601
aauucuuaaaaugugg

SEQ ID NO: 734388 - RNA, 17 nt, Leptospira interrogans serovar lai str. 56601
aauucuuccuucuugaa

SEQ ID NO: 734389 - RNA, 19 nt, Leptospira interrogans serovar lai str. 56601
aauuuaaguuuuucuuaaa

SEQ ID NO: 734390 - RNA, 23 nt, Leptospira interrogans serovar lai str. 56601
aauugaauucuuccuucuugaaa

SEQ ID NO: 734391 - RNA, 14 nt, Leptospira interrogans serovar lai str. 56601
aauucguuccaaau

SEQ ID NO: 734392 - RNA, 18 nt, Leptospira interrogans serovar lai str. 56601
aauucuaaaauuguagaa

SEQ ID NO: 734393 - RNA, 16 nt, Leptospira interrogans serovar lai str. 56601
aauucagcaucgaaua

SEQ ID NO: 734394 - RNA, 21 nt, Leptospira interrogans serovar lai str. 56601
aauucaccuuccaaagauuuu

SEQ ID NO: 734395 - RNA, 19 nt, Leptospira interrogans serovar lai str. 56601
aauuacacggccaacaucg

SEQ ID NO: 734396 - RNA, 13 nt, Leptospira interrogans serovar lai str. 56601
aauuaggucacau

SEQ ID NO: 734397 - RNA, 15 nt, Leptospira interrogans serovar lai str. 56601
aauuaguucuucaaa

SEQ ID NO: 734398 - RNA, 16 nt, Leptospira interrogans serovar lai str. 56601
aauucaacuuguaaaa

SEQ ID NO: 734399 - RNA, 17 nt, Leptospira interrogans serovar lai str. 56601
aauacagugucuugaaa

SEQ ID NO: 734400 - RNA, 19 nt, Leptospira interrogans serovar lai str. 56601
aauacauaggaaccugauu

SEQ ID NO: 734401 - RNA, 19 nt, Leptospira interrogans serovar lai str. 56601
aauaauuguugaauaucua

SEQ ID NO: 734402 - RNA, 22 nt, Leptospira interrogans serovar lai str. 56601
aauagaauuguguuaguuccca

SEQ ID NO: 734403 - RNA, 18 nt, Leptospira interrogans serovar lai str. 56601
aauagaauuuuuguagaa

SEQ ID NO: 734404 - RNA, 21 nt, Leptospira interrogans serovar lai str. 56601
aauagacuaacgauuguaaaa

SEQ ID NO: 734405 - RNA, 16 nt, Leptospira interrogans serovar lai str. 56601
aauagaguuguugaaa

SEQ ID NO: 734406 - RNA, 13 nt, Leptospira interrogans serovar lai str. 56601
aauagaaauacca

SEQ ID NO: 734407 - RNA, 19 nt, Leptospira interrogans serovar lai str. 56601
aauacgaaaacaauuccaa

SEQ ID NO: 734408 - RNA, 16 nt, Leptospira interrogans serovar lai str. 56601
aauaaaauaugaguuu

SEQ ID NO: 734409 - RNA, 12 nt, Leptospira interrogans serovar lai str. 56601
aauaaaauuccu

SEQ ID NO: 734410 - RNA, 16 nt, Leptospira interrogans serovar lai str. 56601
aauaaaauuuuccgga

SEQ ID NO: 734411 - RNA, 13 nt, Leptospira interrogans serovar lai str. 56601
aauaagauuuguu

SEQ ID NO: 734412 - RNA, 20 nt, Leptospira interrogans serovar lai str. 56601
aauaacguaugauguaagga

SEQ ID NO: 734413 - RNA, 18 nt, Leptospira interrogans serovar lai str. 56601
aagucagguuuuaucaaa

SEQ ID NO: 734414 - RNA, 19 nt, Leptospira interrogans serovar lai str. 56601
aaguuugugagaguuccca

SEQ ID NO: 734415 - RNA, 17 nt, Leptospira interrogans serovar lai str. 56601
aaguuuaugaauuucca

SEQ ID NO: 734416 - RNA, 21 nt, Leptospira interrogans serovar lai str. 56601
aaguauucucccccaacugaa

SEQ ID NO: 734417 - RNA, 15 nt, Leptospira interrogans serovar lai str. 56601
aaguaguaguuccca

SEQ ID NO: 734418 - RNA, 20 nt, Leptospira interrogans serovar lai str. 56601
aaguaguaugcgaaauuccu

SEQ ID NO: 734419 - RNA, 14 nt, Leptospira interrogans serovar lai str. 56601
aaguacuaauucaa

SEQ ID NO: 734420 - RNA, 15 nt, Leptospira interrogans serovar lai str. 56601
aagguuuucgauucc

SEQ ID NO: 734421 - RNA, 19 nt, Leptospira interrogans serovar lai str. 56601
aagguuuucgauuccgauc

SEQ ID NO: 734422 - RNA, 23 nt, Leptospira interrogans serovar lai str. 56601
aagguugagcaguaaaaucuuua

SEQ ID NO: 734423 - RNA, 14 nt, Leptospira interrogans serovar lai str. 56601
aaguaaaaagacuc

SEQ ID NO: 734424 - RNA, 13 nt, Leptospira interrogans serovar lai str. 56601
aaguaaaauuaca

SEQ ID NO: 734425 - RNA, 17 nt, Leptospira interrogans serovar lai str. 56601
aagcugaacuuaaaauc

SEQ ID NO: 734426 - RNA, 16 nt, Leptospira interrogans serovar lai str. 56601
aagauaacaucuugaa

SEQ ID NO: 734427 - RNA, 11 nt, Leptospira interrogans serovar lai str. 56601
aagagucaaac

SEQ ID NO: 734428 - RNA, 19 nt, Leptospira interrogans serovar lai str. 56601
aacguuauacaauauuucg

SEQ ID NO: 734429 - RNA, 13 nt, Leptospira interrogans serovar lai str. 56601
aacgugaguucgg

SEQ ID NO: 734430 - RNA, 13 nt, Leptospira interrogans serovar lai str. 56601
aacgugaguucgu

SEQ ID NO: 734431 - RNA, 18 nt, Leptospira interrogans serovar lai str. 56601
aacuaaaaccgaccugca

SEQ ID NO: 734432 - RNA, 21 nt, Leptospira interrogans serovar lai str. 56601
aagauaugaauuaauuuguaa

SEQ ID NO: 734433 - RNA, 17 nt, Leptospira interrogans serovar lai str. 56601
aagaucuauuccuaaaa

SEQ ID NO: 734434 - RNA, 23 nt, Leptospira interrogans serovar lai str. 56601
aagauugaacgguaaaaucuuua

SEQ ID NO: 734435 - RNA, 22 nt, Leptospira interrogans serovar lai str. 56601
aagauucauuucguaaaaucca

SEQ ID NO: 734436 - RNA, 20 nt, Leptospira interrogans serovar lai str. 56601
aagauuacauuuuucuaaau

SEQ ID NO: 734437 - RNA, 17 nt, Leptospira interrogans serovar lai str. 56601
aagauuuuuacucacac

SEQ ID NO: 734438 - RNA, 15 nt, Leptospira interrogans serovar lai str. 56601
aagauuuuucuuuaa

SEQ ID NO: 734439 - RNA, 17 nt, Leptospira interrogans serovar lai str. 56601
aacgauguauugaguuu

SEQ ID NO: 734440 - RNA, 21 nt, Leptospira interrogans serovar lai str. 56601
aaccuucggguuccguagaac

SEQ ID NO: 734441 - RNA, 19 nt, Leptospira interrogans serovar lai str. 56601
aacgcgauccauagaaagc

SEQ ID NO: 734442 - RNA, 16 nt, Leptospira interrogans serovar lai str. 56601
aacguaguaguuccua

SEQ ID NO: 734443 - RNA, 16 nt, Leptospira interrogans serovar lai str. 56601
aacgucauaguuccca

SEQ ID NO: 734444 - RNA, 12 nt, Leptospira interrogans serovar lai str. 56601
aacgguaaaauc

SEQ ID NO: 734445 - RNA, 22 nt, Leptospira interrogans serovar lai str. 56601
aaccaaccucucacuucuugaa

SEQ ID NO: 734446 - RNA, 18 nt, Leptospira interrogans serovar lai str. 56601
aacauuuauuuuucguaa

SEQ ID NO: 734447 - RNA, 23 nt, Leptospira interrogans serovar lai str. 56601
aaccagaaaguuaguaguuccca

SEQ ID NO: 734448 - RNA, 20 nt, Leptospira interrogans serovar lai str. 56601
aaccagagauuccgauucuc

SEQ ID NO: 734449 - RNA, 21 nt, Leptospira interrogans serovar lai str. 56601
aaccaucucaaaaauaucuua

SEQ ID NO: 734450 - RNA, 18 nt, Leptospira interrogans serovar lai str. 56601
aacccugccaaaauccca

SEQ ID NO: 734451 - RNA, 13 nt, Leptospira interrogans serovar lai str. 56601
aaaagauuucaaa

SEQ ID NO: 734452 - RNA, 19 nt, Leptospira interrogans serovar lai str. 56601
aaauuuuugacuaccuuua

SEQ ID NO: 734453 - RNA, 15 nt, Leptospira interrogans serovar lai str. 56601
aaauugacaaagagu

SEQ ID NO: 734454 - RNA, 17 nt, Leptospira interrogans serovar lai str. 56601
aaauugaguuucacaaa

SEQ ID NO: 734455 - RNA, 15 nt, Leptospira interrogans serovar lai str. 56601
aaauugaguuuucca

SEQ ID NO: 734456 - RNA, 16 nt, Leptospira interrogans serovar lai str. 56601
aaauugauguuuugua

SEQ ID NO: 734457 - RNA, 13 nt, Leptospira interrogans serovar lai str. 56601
aaauuguagaaac

SEQ ID NO: 734458 - RNA, 16 nt, Leptospira interrogans serovar lai str. 56601
aaauuaguucuucaaa

SEQ ID NO: 734459 - RNA, 15 nt, Leptospira interrogans serovar lai str. 56601
aaauucauuuuucug

SEQ ID NO: 734460 - RNA, 15 nt, Leptospira interrogans serovar lai str. 56601
aaauucaguuucaaa

SEQ ID NO: 734461 - RNA, 15 nt, Leptospira interrogans serovar lai str. 56601
aaauucuuuuccaaa

SEQ ID NO: 734462 - RNA, 14 nt, Leptospira interrogans serovar lai str. 56601
aaauucuaaacuug

SEQ ID NO: 734463 - RNA, 23 nt, Leptospira interrogans serovar lai str. 56601
aaauucuaugggaauuuuuguaa

SEQ ID NO: 734464 - RNA, 20 nt, Leptospira interrogans serovar lai str. 56601
aaauucuacaccuucuaaau

SEQ ID NO: 734465 - RNA, 17 nt, Leptospira interrogans serovar lai str. 56601
aaauuccgaauucuaaa

SEQ ID NO: 734466 - RNA, 20 nt, Leptospira interrogans serovar lai str. 56601
aaauuccaauuuuucugaaa

SEQ ID NO: 734467 - RNA, 12 nt, Leptospira interrogans serovar lai str. 56601
aaaucaagauuu

SEQ ID NO: 734468 - RNA, 20 nt, Leptospira interrogans serovar lai str. 56601
aaaucaaagcaaaguuucuu

SEQ ID NO: 734469 - RNA, 14 nt, Leptospira interrogans serovar lai str. 56601
aaauguaggaaccc

SEQ ID NO: 734470 - RNA, 15 nt, Leptospira interrogans serovar lai str. 56601
aaauguaggaacuac

SEQ ID NO: 734471 - RNA, 18 nt, Leptospira interrogans serovar lai str. 56601
aaauguaggaacucauac

SEQ ID NO: 734472 - RNA, 19 nt, Leptospira interrogans serovar lai str. 56601
aaauguaaucucgauuucu

SEQ ID NO: 734473 - RNA, 22 nt, Leptospira interrogans serovar lai str. 56601
aaauguaaucucgauuucuaaa

SEQ ID NO: 734474 - RNA, 22 nt, Leptospira interrogans serovar lai str. 56601
aaaucuuuagaauuuuucgaaa

SEQ ID NO: 734475 - RNA, 16 nt, Leptospira interrogans serovar lai str. 56601
aacagaauguucuuag

SEQ ID NO: 734476 - RNA, 23 nt, Leptospira interrogans serovar lai str. 56601
aaaaauaauacaauucugaaauu

SEQ ID NO: 734477 - RNA, 17 nt, Leptospira interrogans serovar lai str. 56601
aaagauuugcucuuaau

SEQ ID NO: 734478 - RNA, 17 nt, Leptospira interrogans serovar lai str. 56601
aaacuuggguuucuuaa

SEQ ID NO: 734479 - RNA, 19 nt, Leptospira interrogans serovar lai str. 56601
aaacuuggguuucuuaaau

SEQ ID NO: 734480 - RNA, 16 nt, Leptospira interrogans serovar lai str. 56601
aaacuugauauuucug

SEQ ID NO: 734481 - RNA, 16 nt, Leptospira interrogans serovar lai str. 56601
aaacuuagguuuugua

SEQ ID NO: 734482 - RNA, 14 nt, Leptospira interrogans serovar lai str. 56601
aaacuacuguaaga

SEQ ID NO: 734483 - RNA, 16 nt, Leptospira interrogans serovar lai str. 56601
aaacucaguaaaacgc

SEQ ID NO: 734484 - RNA, 22 nt, Leptospira interrogans serovar lai str. 56601
aaacgaucauacuuuagaaauu

SEQ ID NO: 734485 - RNA, 18 nt, Leptospira interrogans serovar lai str. 56601
aaacgauacaaauuccgu

SEQ ID NO: 734486 - RNA, 22 nt, Leptospira interrogans serovar lai str. 56601
aaacgauuaugauuuuuuugaa

SEQ ID NO: 734487 - RNA, 22 nt, Leptospira interrogans serovar lai str. 56601
aaaaaauguaaucucgauuucu

SEQ ID NO: 734488 - RNA, 16 nt, Leptospira interrogans serovar lai str. 56601
aaaaaauuucuucaau

SEQ ID NO: 734489 - RNA, 15 nt, Leptospira interrogans serovar lai str. 56601
aaaaaagcugaacuu

SEQ ID NO: 734490 - RNA, 21 nt, Leptospira interrogans serovar lai str. 56601
aaaggagccaacacauuccau

SEQ ID NO: 734491 - RNA, 21 nt, Leptospira interrogans serovar lai str. 56601
aaaguauguuuuucugauaga

SEQ ID NO: 734492 - RNA, 20 nt, Leptospira interrogans serovar lai str. 56601
aaaaauucaguucugaacuu

SEQ ID NO: 734493 - RNA, 21 nt, Leptospira interrogans serovar lai str. 56601
aaaaauuaacuuucuucgauu

SEQ ID NO: 734494 - RNA, 16 nt, Leptospira interrogans serovar lai str. 56601
aaaaaucaggcuuuau

SEQ ID NO: 734495 - RNA, 15 nt, Leptospira interrogans serovar lai str. 56601
aaaaaucugcucuau

SEQ ID NO: 734496 - RNA, 10 nt, Leptospira interrogans serovar lai str. 56601
aaaaaucgau

SEQ ID NO: 734497 - RNA, 14 nt, Leptospira interrogans serovar lai str. 56601
aaaaaucgauuuga

SEQ ID NO: 734498 - RNA, 22 nt, Leptospira interrogans serovar lai str. 56601
aaauacgauucgaaagauuuuu

SEQ ID NO: 734499 - RNA, 14 nt, Leptospira interrogans serovar lai str. 56601
aaaguuguugaaaa

SEQ ID NO: 734500 - RNA, 12 nt, Leptospira interrogans serovar lai str. 56601
aaaguuagaauc

SEQ ID NO: 734501 - RNA, 16 nt, Leptospira interrogans serovar lai str. 56601
aaaguguuaguuccca

SEQ ID NO: 734502 - RNA, 12 nt, Leptospira interrogans serovar lai str. 56601
aaauaggauuua

SEQ ID NO: 734503 - RNA, 22 nt, Leptospira interrogans serovar lai str. 56601
aaauagugguuuguaguaguuc

SEQ ID NO: 734504 - RNA, 16 nt, Leptospira interrogans serovar lai str. 56601
aaauaucgaauuucuu

SEQ ID NO: 734505 - RNA, 16 nt, Leptospira interrogans serovar lai str. 56601
aaauauacuuuucaaa

SEQ ID NO: 734506 - RNA, 21 nt, Leptospira interrogans serovar lai str. 56601
aaauaucaguuucuccggcga

SEQ ID NO: 734507 - RNA, 15 nt, Leptospira interrogans serovar lai str. 56601
uuuuuauggaauugu

SEQ ID NO: 734508 - RNA, 20 nt, Leptospira interrogans serovar lai str. 56601
uuuuucagaaaaagugaauu

SEQ ID NO: 734509 - RNA, 19 nt, Leptospira interrogans serovar lai str. 56601
uuuugucuuuaaaauugug

SEQ ID NO: 734510 - RNA, 23 nt, Leptospira interrogans serovar lai str. 56601
uuuugucuccugucaauuuucca

SEQ ID NO: 734511 - RNA, 13 nt, Leptospira interrogans serovar lai str. 56601
uuuuaagauuaca

SEQ ID NO: 734512 - RNA, 23 nt, Leptospira interrogans serovar lai str. 56601
uuuuaaauuagcuuaagaauuuc

SEQ ID NO: 734513 - RNA, 15 nt, Leptospira interrogans serovar lai str. 56601
uuuuaaauuuaucua

SEQ ID NO: 734514 - RNA, 16 nt, Leptospira interrogans serovar lai str. 56601
uuuucaugaauuaaag

SEQ ID NO: 734515 - RNA, 20 nt, Leptospira interrogans serovar lai str. 56601
uuuucagacuuugaaugcaa

SEQ ID NO: 734516 - RNA, 15 nt, Leptospira interrogans serovar lai str. 56601
uuuuaauaauucaaa

SEQ ID NO: 734517 - RNA, 22 nt, Leptospira interrogans serovar lai str. 56601
uuuucauaaauacaaaguauuc

SEQ ID NO: 734518 - RNA, 19 nt, Leptospira interrogans serovar lai str. 56601
uuuguuccaaaaacucaaa

SEQ ID NO: 734519 - RNA, 20 nt, Leptospira interrogans serovar lai str. 56601
uuuguuguaucgaacucacg

SEQ ID NO: 734520 - RNA, 19 nt, Leptospira interrogans serovar lai str. 56601
uuuguucuaaaaacucaaa

SEQ ID NO: 734521 - RNA, 14 nt, Leptospira interrogans serovar lai str. 56601
uuuuggcauuccca

SEQ ID NO: 734522 - RNA, 16 nt, Leptospira interrogans serovar lai str. 56601
uuuuguaaaaauucuc

SEQ ID NO: 734523 - RNA, 14 nt, Leptospira interrogans serovar lai str. 56601
uuuuguaaguuuuc

SEQ ID NO: 734524 - RNA, 22 nt, Leptospira interrogans serovar lai str. 56601
uuuuguaaguuuuccauucuca

SEQ ID NO: 734525 - RNA, 14 nt, Leptospira interrogans serovar lai str. 56601
uuuucuaguaguuc

SEQ ID NO: 734526 - RNA, 22 nt, Leptospira interrogans serovar lai str. 56601
uuuucguuucugaggaauuaag

SEQ ID NO: 734527 - RNA, 23 nt, Leptospira interrogans serovar lai str. 56601
uuuucgucgacuuugacuugaaa

SEQ ID NO: 734528 - RNA, 20 nt, Leptospira interrogans serovar lai str. 56601
uuuucccgaaagaacuccac

SEQ ID NO: 734529 - RNA, 22 nt, Leptospira interrogans serovar lai str. 56601
uuugauuggauucuuucgacuu

SEQ ID NO: 734530 - RNA, 14 nt, Leptospira interrogans serovar lai str. 56601
uuugauuuuagaaa

SEQ ID NO: 734531 - RNA, 12 nt, Leptospira interrogans serovar lai str. 56601
uuucuuccggau

SEQ ID NO: 734532 - RNA, 13 nt, Leptospira interrogans serovar lai str. 56601
uuugaaguauuuu

SEQ ID NO: 734533 - RNA, 21 nt, Leptospira interrogans serovar lai str. 56601
uuugaaaaaguugggaucuaa

SEQ ID NO: 734534 - RNA, 18 nt, Leptospira interrogans serovar lai str. 56601
uuugagcaguucuaaucu

SEQ ID NO: 734535 - RNA, 23 nt, Leptospira interrogans serovar lai str. 56601
uuuccgaauaggaucagaauuuc

SEQ ID NO: 734536 - RNA, 14 nt, Leptospira interrogans serovar lai str. 56601
uuucugaaaaaagu

SEQ ID NO: 734537 - RNA, 22 nt, Leptospira interrogans serovar lai str. 56601
uuguaaucuguggacuuaugag

SEQ ID NO: 734538 - RNA, 12 nt, Leptospira interrogans serovar lai str. 56601
uugaaaauucua

SEQ ID NO: 734539 - RNA, 21 nt, Leptospira interrogans serovar lai str. 56601
uugaaacaaauucucauuuag

SEQ ID NO: 734540 - RNA, 19 nt, Leptospira interrogans serovar lai str. 56601
uucuuucuauuuuuuccga

SEQ ID NO: 734541 - RNA, 20 nt, Leptospira interrogans serovar lai str. 56601
uucuugucggaacacuugaa

SEQ ID NO: 734542 - RNA, 14 nt, Leptospira interrogans serovar lai str. 56601
uuuaaucaaaugca

SEQ ID NO: 734543 - RNA, 13 nt, Leptospira interrogans serovar lai str. 56601
uuuaaucaaugug

SEQ ID NO: 734544 - RNA, 18 nt, Leptospira interrogans serovar lai str. 56601
uuuacaaauuaguauuuu

SEQ ID NO: 734545 - RNA, 15 nt, Leptospira interrogans serovar lai str. 56601
uuuacaaauuggcag

SEQ ID NO: 734546 - RNA, 19 nt, Leptospira interrogans serovar lai str. 56601
uuuacggaucaaaauucuu

SEQ ID NO: 734547 - RNA, 19 nt, Leptospira interrogans serovar lai str. 56601
uuuacaauuaaacuucaaa

SEQ ID NO: 734548 - RNA, 19 nt, Leptospira interrogans serovar lai str. 56601
uuuacaauuuauugaccag

SEQ ID NO: 734549 - RNA, 23 nt, Leptospira interrogans serovar lai str. 56601
uuuacgaaaguugaaaguuuuuc

SEQ ID NO: 734550 - RNA, 16 nt, Leptospira interrogans serovar lai str. 56601
uuguuuccucuugaag

SEQ ID NO: 734551 - RNA, 12 nt, Leptospira interrogans serovar lai str. 56601
uuguucaaagaa

SEQ ID NO: 734552 - RNA, 15 nt, Leptospira interrogans serovar lai str. 56601
uuguuaaacaacgug

SEQ ID NO: 734553 - RNA, 13 nt, Leptospira interrogans serovar lai str. 56601
uuucaauuuauca

SEQ ID NO: 734554 - RNA, 22 nt, Leptospira interrogans serovar lai str. 56601
uuucaaucuaacccauucaaca

SEQ ID NO: 734555 - RNA, 23 nt, Leptospira interrogans serovar lai str. 56601
uuuagaaaaagcacaaaacgauc

SEQ ID NO: 734556 - RNA, 17 nt, Leptospira interrogans serovar lai str. 56601
uuuacuucuaacgcaag

SEQ ID NO: 734557 - RNA, 19 nt, Leptospira interrogans serovar lai str. 56601
uuuagaguuaagagaauuu

SEQ ID NO: 734558 - RNA, 23 nt, Leptospira interrogans serovar lai str. 56601
uuuagaaucagaaugaacucaac

SEQ ID NO: 734559 - RNA, 17 nt, Leptospira interrogans serovar lai str. 56601
uuuauccauaaauucua

SEQ ID NO: 734560 - RNA, 22 nt, Leptospira interrogans serovar lai str. 56601
uucuuaaauaaaauuuuccgga

SEQ ID NO: 734561 - RNA, 21 nt, Leptospira interrogans serovar lai str. 56601
uucuucaugauuuuuuaaucu

SEQ ID NO: 734562 - RNA, 14 nt, Leptospira interrogans serovar lai str. 56601
uucuuccagagauu

SEQ ID NO: 734563 - RNA, 21 nt, Leptospira interrogans serovar lai str. 56601
uucucaaaaaaugcauucaaa

SEQ ID NO: 734564 - RNA, 21 nt, Leptospira interrogans serovar lai str. 56601
uucuauaaacucaaagaauuu

SEQ ID NO: 734565 - RNA, 21 nt, Leptospira interrogans serovar lai str. 56601
uucucugcuauuauaaucuuu

SEQ ID NO: 734566 - RNA, 13 nt, Leptospira interrogans serovar lai str. 56601
uucugaaacuuuu

SEQ ID NO: 734567 - RNA, 17 nt, Leptospira interrogans serovar lai str. 56601
uucucuucuaauucagu

SEQ ID NO: 734568 - RNA, 18 nt, Leptospira interrogans serovar lai str. 56601
uucugaauauuuuauccg

SEQ ID NO: 734569 - RNA, 18 nt, Leptospira interrogans serovar lai str. 56601
uucugaacguaguaguuc

SEQ ID NO: 734570 - RNA, 14 nt, Leptospira interrogans serovar lai str. 56601
uucguuaaguuauc

SEQ ID NO: 734571 - RNA, 15 nt, Leptospira interrogans serovar lai str. 56601
uucguuauaaacaau

SEQ ID NO: 734572 - RNA, 21 nt, Leptospira interrogans serovar lai str. 56601
uucguuauaauuuucaugaac

SEQ ID NO: 734573 - RNA, 22 nt, Leptospira interrogans serovar lai str. 56601
uucuagaauauaaccguaauua

SEQ ID NO: 734574 - RNA, 16 nt, Leptospira interrogans serovar lai str. 56601
uucuaggaaacucaag

SEQ ID NO: 734575 - RNA, 15 nt, Leptospira interrogans serovar lai str. 56601
uucuaaccggaauuu

SEQ ID NO: 734576 - RNA, 16 nt, Leptospira interrogans serovar lai str. 56601
uucuacgaauuucaga

SEQ ID NO: 734577 - RNA, 21 nt, Leptospira interrogans serovar lai str. 56601
uucguaguuuuuguuccgaaa

SEQ ID NO: 734578 - RNA, 16 nt, Leptospira interrogans serovar lai str. 56601
uucccguuuagaaauu

SEQ ID NO: 734579 - RNA, 18 nt, Leptospira interrogans serovar lai str. 56601
uucccuuuugaucuuuaa

SEQ ID NO: 734580 - RNA, 16 nt, Leptospira interrogans serovar lai str. 56601
uuccgaaccuuaccac

SEQ ID NO: 734581 - RNA, 17 nt, Leptospira interrogans serovar lai str. 56601
uuccgauucacuuccau

SEQ ID NO: 734582 - RNA, 21 nt, Leptospira interrogans serovar lai str. 56601
uuccgacaagaaugagucuuu

SEQ ID NO: 734583 - RNA, 14 nt, Leptospira interrogans serovar lai str. 56601
uuccuuuuuccgga

SEQ ID NO: 734584 - RNA, 12 nt, Leptospira interrogans serovar lai str. 56601
uuauaauucaaa

SEQ ID NO: 734585 - RNA, 13 nt, Leptospira interrogans serovar lai str. 56601
uuauaauaaauug

SEQ ID NO: 734586 - RNA, 13 nt, Leptospira interrogans serovar lai str. 56601
uuauaagaaucga

SEQ ID NO: 734587 - RNA, 17 nt, Leptospira interrogans serovar lai str. 56601
uuauaaauguaggaacu

SEQ ID NO: 734588 - RNA, 14 nt, Leptospira interrogans serovar lai str. 56601
uuauaaaaacaagu

SEQ ID NO: 734589 - RNA, 19 nt, Leptospira interrogans serovar lai str. 56601
uuauaaaacaaucuucaaa

SEQ ID NO: 734590 - RNA, 16 nt, Leptospira interrogans serovar lai str. 56601
uuauagauauaacuua

SEQ ID NO: 734591 - RNA, 12 nt, Leptospira interrogans serovar lai str. 56601
uuacucaaagaa

SEQ ID NO: 734592 - RNA, 17 nt, Leptospira interrogans serovar lai str. 56601
uuacguuauaauucuuu

SEQ ID NO: 734593 - RNA, 23 nt, Leptospira interrogans serovar lai str. 56601
uuaauuuguuuggauucuccauc

SEQ ID NO: 734594 - RNA, 13 nt, Leptospira interrogans serovar lai str. 56601
uuaauuuuucaau

SEQ ID NO: 734595 - RNA, 15 nt, Leptospira interrogans serovar lai str. 56601
uuacgaaaacuauuu

SEQ ID NO: 734596 - RNA, 23 nt, Leptospira interrogans serovar lai str. 56601
uuaaaaaagauaagucuaacgug

SEQ ID NO: 734597 - RNA, 17 nt, Leptospira interrogans serovar lai str. 56601
uuaaaaacuugaaucga

SEQ ID NO: 734598 - RNA, 19 nt, Leptospira interrogans serovar lai str. 56601
uuaaaaagcucaucucauc

SEQ ID NO: 734599 - RNA, 21 nt, Leptospira interrogans serovar lai str. 56601
uuaaaaccaaucgauaacuug

SEQ ID NO: 734600 - RNA, 16 nt, Leptospira interrogans serovar lai str. 56601
uuaaaaguuugauuuc

SEQ ID NO: 734601 - RNA, 20 nt, Leptospira interrogans serovar lai str. 56601
uuaaacucauucuaguuugu

SEQ ID NO: 734602 - RNA, 20 nt, Leptospira interrogans serovar lai str. 56601
uuaaaucccauuuuaacgug

SEQ ID NO: 734603 - RNA, 21 nt, Leptospira interrogans serovar lai str. 56601
uuaaauacacucuuucaaugu

SEQ ID NO: 734604 - RNA, 16 nt, Leptospira interrogans serovar lai str. 56601
uuaaagccucaugaaa

SEQ ID NO: 734605 - RNA, 15 nt, Leptospira interrogans serovar lai str. 56601
uuaauauuucgaugu

SEQ ID NO: 734606 - RNA, 17 nt, Leptospira interrogans serovar lai str. 56601
uuaaaugugggaacuaa

SEQ ID NO: 734607 - RNA, 22 nt, Leptospira interrogans serovar lai str. 56601
uucaacuuuuugaagaaacaau

SEQ ID NO: 734608 - RNA, 18 nt, Leptospira interrogans serovar lai str. 56601
uucaacuuuuuucagaaa

SEQ ID NO: 734609 - RNA, 19 nt, Leptospira interrogans serovar lai str. 56601
uucaaucgaccguuuccau

SEQ ID NO: 734610 - RNA, 15 nt, Leptospira interrogans serovar lai str. 56601
uucaaucuccccaaa

SEQ ID NO: 734611 - RNA, 19 nt, Leptospira interrogans serovar lai str. 56601
uucaauuguccauuucaau

SEQ ID NO: 734612 - RNA, 18 nt, Leptospira interrogans serovar lai str. 56601
uucacgacgucuaugacg

SEQ ID NO: 734613 - RNA, 22 nt, Leptospira interrogans serovar lai str. 56601
uuauuuuuaacgugaauucgac

SEQ ID NO: 734614 - RNA, 17 nt, Leptospira interrogans serovar lai str. 56601
uucaaaacuuugacaga

SEQ ID NO: 734615 - RNA, 14 nt, Leptospira interrogans serovar lai str. 56601
uuauuggaaaaagu

SEQ ID NO: 734616 - RNA, 17 nt, Leptospira interrogans serovar lai str. 56601
uuauuuacgccgaauuc

SEQ ID NO: 734617 - RNA, 13 nt, Leptospira interrogans serovar lai str. 56601
uuauuuuaacuug

SEQ ID NO: 734618 - RNA, 15 nt, Leptospira interrogans serovar lai str. 56601
uuauuuucagauugu

SEQ ID NO: 734619 - RNA, 15 nt, Leptospira interrogans serovar lai str. 56601
uuauuuuagaaugug

SEQ ID NO: 734620 - RNA, 19 nt, Leptospira interrogans serovar lai str. 56601
uuauuaugugacuuaaucu

SEQ ID NO: 734621 - RNA, 14 nt, Leptospira interrogans serovar lai str. 56601
uucauuuuuacaau

SEQ ID NO: 734622 - RNA, 13 nt, Leptospira interrogans serovar lai str. 56601
uucauuuuuccau

SEQ ID NO: 734623 - RNA, 16 nt, Leptospira interrogans serovar lai str. 56601
uucauuuaccuaaaau

SEQ ID NO: 734624 - RNA, 14 nt, Leptospira interrogans serovar lai str. 56601
uucauucuuuccau

SEQ ID NO: 734625 - RNA, 18 nt, Leptospira interrogans serovar lai str. 56601
uuccaagaccucaaauaa

SEQ ID NO: 734626 - RNA, 22 nt, Leptospira interrogans serovar lai str. 56601
uuccaagaccucaaauaacuuu

SEQ ID NO: 734627 - RNA, 23 nt, Leptospira interrogans serovar lai str. 56601
uuccauuucuguaacauccaaac

SEQ ID NO: 734628 - RNA, 14 nt, Leptospira interrogans serovar lai str. 56601
uucaucuuuuccau

SEQ ID NO: 734629 - RNA, 17 nt, Leptospira interrogans serovar lai str. 56601
uucaucuacguuucaau

SEQ ID NO: 734630 - RNA, 20 nt, Leptospira interrogans serovar lai str. 56601
ugguaguucccacaaauuaa

SEQ ID NO: 734631 - RNA, 17 nt, Leptospira interrogans serovar lai str. 56601
ugcuuugguuuucauaa

SEQ ID NO: 734632 - RNA, 20 nt, Leptospira interrogans serovar lai str. 56601
uggucaauaaauuguaugca

SEQ ID NO: 734633 - RNA, 18 nt, Leptospira interrogans serovar lai str. 56601
ugucuugccauuuccaau

SEQ ID NO: 734634 - RNA, 17 nt, Leptospira interrogans serovar lai str. 56601
uguaaauccguauacuu

SEQ ID NO: 734635 - RNA, 13 nt, Leptospira interrogans serovar lai str. 56601
uguccauuucaau

SEQ ID NO: 734636 - RNA, 20 nt, Leptospira interrogans serovar lai str. 56601
ugcgguaguucccacauuuu

SEQ ID NO: 734637 - RNA, 21 nt, Leptospira interrogans serovar lai str. 56601
ugaucaauagaauuguugaaa

SEQ ID NO: 734638 - RNA, 16 nt, Leptospira interrogans serovar lai str. 56601
ugauuucagauucauc

SEQ ID NO: 734639 - RNA, 16 nt, Leptospira interrogans serovar lai str. 56601
ugacuaucaacaagaa

SEQ ID NO: 734640 - RNA, 23 nt, Leptospira interrogans serovar lai str. 56601
ugagagagaguucuacugaguuu

SEQ ID NO: 734641 - RNA, 22 nt, Leptospira interrogans serovar lai str. 56601
ugagaguuccacauuuuaaagg

SEQ ID NO: 734642 - RNA, 23 nt, Leptospira interrogans serovar lai str. 56601
ugagaguucccacguuuuaaagg

SEQ ID NO: 734643 - RNA, 13 nt, Leptospira interrogans serovar lai str. 56601
ugagauuacaaaa

SEQ ID NO: 734644 - RNA, 17 nt, Leptospira interrogans serovar lai str. 56601
ugaguaagauauuaaca

SEQ ID NO: 734645 - RNA, 21 nt, Leptospira interrogans serovar lai str. 56601
ugauaauucgugaacuuuaga

SEQ ID NO: 734646 - RNA, 15 nt, Leptospira interrogans serovar lai str. 56601
ugauaauucuuuaga

SEQ ID NO: 734647 - RNA, 13 nt, Leptospira interrogans serovar lai str. 56601
ugaaaaaucgauu

SEQ ID NO: 734648 - RNA, 19 nt, Leptospira interrogans serovar lai str. 56601
ucuuuuuuaaaacauccuc

SEQ ID NO: 734649 - RNA, 21 nt, Leptospira interrogans serovar lai str. 56601
ugaaaagauccgacauaugcu

SEQ ID NO: 734650 - RNA, 19 nt, Leptospira interrogans serovar lai str. 56601
ugaaaauugugggaacuac

SEQ ID NO: 734651 - RNA, 15 nt, Leptospira interrogans serovar lai str. 56601
ugaaaccagauuucc

SEQ ID NO: 734652 - RNA, 21 nt, Leptospira interrogans serovar lai str. 56601
ugaaaccaucuacagaaccca

SEQ ID NO: 734653 - RNA, 15 nt, Leptospira interrogans serovar lai str. 56601
ucuuuacucuaucca

SEQ ID NO: 734654 - RNA, 18 nt, Leptospira interrogans serovar lai str. 56601
ucuuuauauaaaauuuga

SEQ ID NO: 734655 - RNA, 19 nt, Leptospira interrogans serovar lai str. 56601
ugaaaaaacggccgacguu

SEQ ID NO: 734656 - RNA, 21 nt, Leptospira interrogans serovar lai str. 56601
ucuuuaaugagucugucccaa

SEQ ID NO: 734657 - RNA, 21 nt, Leptospira interrogans serovar lai str. 56601
ucuuuaaaaauaggaauucga

SEQ ID NO: 734658 - RNA, 15 nt, Leptospira interrogans serovar lai str. 56601
ucuugaaaauucaaa

SEQ ID NO: 734659 - RNA, 20 nt, Leptospira interrogans serovar lai str. 56601
ucuugagaaaggagaacuca

SEQ ID NO: 734660 - RNA, 19 nt, Leptospira interrogans serovar lai str. 56601
ucuucuaauucaguuuuuc

SEQ ID NO: 734661 - RNA, 15 nt, Leptospira interrogans serovar lai str. 56601
ucuucuaauugcaac

SEQ ID NO: 734662 - RNA, 17 nt, Leptospira interrogans serovar lai str. 56601
ucuucaccaagcuccuc

SEQ ID NO: 734663 - RNA, 15 nt, Leptospira interrogans serovar lai str. 56601
ucuuacaauuuuaga

SEQ ID NO: 734664 - RNA, 15 nt, Leptospira interrogans serovar lai str. 56601
ucuuauacucuuaaa

SEQ ID NO: 734665 - RNA, 16 nt, Leptospira interrogans serovar lai str. 56601
ucuuaaauucuaauug

SEQ ID NO: 734666 - RNA, 16 nt, Leptospira interrogans serovar lai str. 56601
ucucguuuucuuacgu

SEQ ID NO: 734667 - RNA, 16 nt, Leptospira interrogans serovar lai str. 56601
ucucguuuuuuuacga

SEQ ID NO: 734668 - RNA, 14 nt, Leptospira interrogans serovar lai str. 56601
ucucacuucuugaa

SEQ ID NO: 734669 - RNA, 17 nt, Leptospira interrogans serovar lai str. 56601
ucuacaaaacuuuacga

SEQ ID NO: 734670 - RNA, 17 nt, Leptospira interrogans serovar lai str. 56601
ucuaauugugggaacuc

SEQ ID NO: 734671 - RNA, 13 nt, Leptospira interrogans serovar lai str. 56601
ucuacucuugaag

SEQ ID NO: 734672 - RNA, 19 nt, Leptospira interrogans serovar lai str. 56601
ucuauguaagaaaaucugg

SEQ ID NO: 734673 - RNA, 16 nt, Leptospira interrogans serovar lai str. 56601
ucuacaguuucgauug

SEQ ID NO: 734674 - RNA, 18 nt, Leptospira interrogans serovar lai str. 56601
ucguaagauaugaauuaa

SEQ ID NO: 734675 - RNA, 23 nt, Leptospira interrogans serovar lai str. 56601
ucguacggauugccuaaauuccu

SEQ ID NO: 734676 - RNA, 19 nt, Leptospira interrogans serovar lai str. 56601
ucggaaauauaacaauucu

SEQ ID NO: 734677 - RNA, 12 nt, Leptospira interrogans serovar lai str. 56601
ucgaaaaguuuu

SEQ ID NO: 734678 - RNA, 13 nt, Leptospira interrogans serovar lai str. 56601
uccuuuuaagaau

SEQ ID NO: 734679 - RNA, 15 nt, Leptospira interrogans serovar lai str. 56601
uccuuuuuuacugau

SEQ ID NO: 734680 - RNA, 17 nt, Leptospira interrogans serovar lai str. 56601
ucgaauuguauccgaaa

SEQ ID NO: 734681 - RNA, 14 nt, Leptospira interrogans serovar lai str. 56601
ucgaauuuccauuu

SEQ ID NO: 734682 - RNA, 16 nt, Leptospira interrogans serovar lai str. 56601
ucgaauggaaaucuuu

SEQ ID NO: 734683 - RNA, 18 nt, Leptospira interrogans serovar lai str. 56601
ucgaauggaaaucuuuua

SEQ ID NO: 734684 - RNA, 22 nt, Leptospira interrogans serovar lai str. 56601
ucgaaucggguuugucuucgau

SEQ ID NO: 734685 - RNA, 15 nt, Leptospira interrogans serovar lai str. 56601
ucgaaucauuuugua

SEQ ID NO: 734686 - RNA, 18 nt, Leptospira interrogans serovar lai str. 56601
ucgaacuuuuuuuagaau

SEQ ID NO: 734687 - RNA, 20 nt, Leptospira interrogans serovar lai str. 56601
ucgaacuuuuuuuagaauca

SEQ ID NO: 734688 - RNA, 22 nt, Leptospira interrogans serovar lai str. 56601
uccaugauucugaaaaaaguua

SEQ ID NO: 734689 - RNA, 19 nt, Leptospira interrogans serovar lai str. 56601
uccgcuguaugaaaacgau

SEQ ID NO: 734690 - RNA, 14 nt, Leptospira interrogans serovar lai str. 56601
ucagacugauauuc

SEQ ID NO: 734691 - RNA, 21 nt, Leptospira interrogans serovar lai str. 56601
ucacugaaaauuuaauuacga

SEQ ID NO: 734692 - RNA, 18 nt, Leptospira interrogans serovar lai str. 56601
uauuuaacuucguugaaa

SEQ ID NO: 734693 - RNA, 12 nt, Leptospira interrogans serovar lai str. 56601
uauuucuaaguc

SEQ ID NO: 734694 - RNA, 14 nt, Leptospira interrogans serovar lai str. 56601
uauuuuaacuugag

SEQ ID NO: 734695 - RNA, 20 nt, Leptospira interrogans serovar lai str. 56601
ucacgauuuuacaaacaaau

SEQ ID NO: 734696 - RNA, 23 nt, Leptospira interrogans serovar lai str. 56601
ucacgauuuuacaaacaaauucu

SEQ ID NO: 734697 - RNA, 21 nt, Leptospira interrogans serovar lai str. 56601
uccaagaccucaaauaacuuu

SEQ ID NO: 734698 - RNA, 16 nt, Leptospira interrogans serovar lai str. 56601
uccacauuuuagggau

SEQ ID NO: 734699 - RNA, 20 nt, Leptospira interrogans serovar lai str. 56601
uccaaacccaaugauucuaa

SEQ ID NO: 734700 - RNA, 19 nt, Leptospira interrogans serovar lai str. 56601
uccaaaacaaucuuagaau

SEQ ID NO: 734701 - RNA, 21 nt, Leptospira interrogans serovar lai str. 56601
ucauguccggguuagaaucaa

SEQ ID NO: 734702 - RNA, 15 nt, Leptospira interrogans serovar lai str. 56601
ucaugaucaaauuca

SEQ ID NO: 734703 - RNA, 15 nt, Leptospira interrogans serovar lai str. 56601
ucaguuucaaacuga

SEQ ID NO: 734704 - RNA, 14 nt, Leptospira interrogans serovar lai str. 56601
ucaggucacauuuu

SEQ ID NO: 734705 - RNA, 13 nt, Leptospira interrogans serovar lai str. 56601
ucagugauucgaa

SEQ ID NO: 734706 - RNA, 17 nt, Leptospira interrogans serovar lai str. 56601
uauaaucgaauuuccau

SEQ ID NO: 734707 - RNA, 17 nt, Leptospira interrogans serovar lai str. 56601
uauaauugauucgauau

SEQ ID NO: 734708 - RNA, 14 nt, Leptospira interrogans serovar lai str. 56601
uauaauuuccggaa

SEQ ID NO: 734709 - RNA, 22 nt, Leptospira interrogans serovar lai str. 56601
uauaauuuucuuaauaaacuuu

SEQ ID NO: 734710 - RNA, 19 nt, Leptospira interrogans serovar lai str. 56601
uauacaagacuucuauacu

SEQ ID NO: 734711 - RNA, 21 nt, Leptospira interrogans serovar lai str. 56601
uaguuuucucgaacuacccaa

SEQ ID NO: 734712 - RNA, 20 nt, Leptospira interrogans serovar lai str. 56601
uaguuuuuucaaaaauucca

SEQ ID NO: 734713 - RNA, 20 nt, Leptospira interrogans serovar lai str. 56601
uauaaaauaccaauaacuua

SEQ ID NO: 734714 - RNA, 20 nt, Leptospira interrogans serovar lai str. 56601
uauaaaauaucuuuaauuga

SEQ ID NO: 734715 - RNA, 23 nt, Leptospira interrogans serovar lai str. 56601
uauaaagauuuccuaauaacuug

SEQ ID NO: 734716 - RNA, 19 nt, Leptospira interrogans serovar lai str. 56601
uauaaacugucggaauuac

SEQ ID NO: 734717 - RNA, 18 nt, Leptospira interrogans serovar lai str. 56601
uauaaauguaggaacuac

SEQ ID NO: 734718 - RNA, 11 nt, Leptospira interrogans serovar lai str. 56601
uauaaauucgc

SEQ ID NO: 734719 - RNA, 21 nt, Leptospira interrogans serovar lai str. 56601
uauagaaguucggaagauuuu

SEQ ID NO: 734720 - RNA, 16 nt, Leptospira interrogans serovar lai str. 56601
uauauuuugaacaagu

SEQ ID NO: 734721 - RNA, 21 nt, Leptospira interrogans serovar lai str. 56601
uagugaagauuuguaaaauug

SEQ ID NO: 734722 - RNA, 14 nt, Leptospira interrogans serovar lai str. 56601
uagugaucgcguuu

SEQ ID NO: 734723 - RNA, 18 nt, Leptospira interrogans serovar lai str. 56601
uaguucccacaaauucca

SEQ ID NO: 734724 - RNA, 22 nt, Leptospira interrogans serovar lai str. 56601
uaguuccuauauuuuaaauuca

SEQ ID NO: 734725 - RNA, 13 nt, Leptospira interrogans serovar lai str. 56601
uaguuauaacguu

SEQ ID NO: 734726 - RNA, 16 nt, Leptospira interrogans serovar lai str. 56601
uauuauuuucagauug

SEQ ID NO: 734727 - RNA, 16 nt, Leptospira interrogans serovar lai str. 56601
uauuguaauaaaucga

SEQ ID NO: 734728 - RNA, 20 nt, Leptospira interrogans serovar lai str. 56601
uauugcugucauaaaccgau

SEQ ID NO: 734729 - RNA, 16 nt, Leptospira interrogans serovar lai str. 56601
uaugguccaaucagau

SEQ ID NO: 734730 - RNA, 23 nt, Leptospira interrogans serovar lai str. 56601
uaugaagaaaaccuaaaauagau

SEQ ID NO: 734731 - RNA, 16 nt, Leptospira interrogans serovar lai str. 56601
uauuaaauuaacguga

SEQ ID NO: 734732 - RNA, 19 nt, Leptospira interrogans serovar lai str. 56601
uauuaaauugaguuuucca

SEQ ID NO: 734733 - RNA, 22 nt, Leptospira interrogans serovar lai str. 56601
uauuaaauugaguuuuccaaua

SEQ ID NO: 734734 - RNA, 23 nt, Leptospira interrogans serovar lai str. 56601
uaucagaaccuuuaguuuccaaa

SEQ ID NO: 734735 - RNA, 21 nt, Leptospira interrogans serovar lai str. 56601
uaucaaugaucauauccgaaa

SEQ ID NO: 734736 - RNA, 24 nt, Leptospira interrogans serovar lai str. 56601
uaucaacaaucggagucauaacuu

SEQ ID NO: 734737 - RNA, 20 nt, Leptospira interrogans serovar lai str. 56601
uauccaauuucaauuucuuc

SEQ ID NO: 734738 - RNA, 14 nt, Leptospira interrogans serovar lai str. 56601
uaucauagaaccug

SEQ ID NO: 734739 - RNA, 23 nt, Leptospira interrogans serovar lai str. 56601
uagauuuauauguuucuuuugua

SEQ ID NO: 734740 - RNA, 21 nt, Leptospira interrogans serovar lai str. 56601
uagauucaaaagucuauuucu

SEQ ID NO: 734741 - RNA, 23 nt, Leptospira interrogans serovar lai str. 56601
uagauucaauuauuauaaacuuc

SEQ ID NO: 734742 - RNA, 17 nt, Leptospira interrogans serovar lai str. 56601
uagaagccugaguuuga

SEQ ID NO: 734743 - RNA, 18 nt, Leptospira interrogans serovar lai str. 56601
uagaagccugaguuugag

SEQ ID NO: 734744 - RNA, 14 nt, Leptospira interrogans serovar lai str. 56601
uagaauaaucggaa

SEQ ID NO: 734745 - RNA, 22 nt, Leptospira interrogans serovar lai str. 56601
uaggaaucgaucuguaaaguuc

SEQ ID NO: 734746 - RNA, 18 nt, Leptospira interrogans serovar lai str. 56601
uacuaaaaauucauauug

SEQ ID NO: 734747 - RNA, 18 nt, Leptospira interrogans serovar lai str. 56601
uacguaaagaacuucgau

SEQ ID NO: 734748 - RNA, 18 nt, Leptospira interrogans serovar lai str. 56601
uacucuacuauaaacuuc

SEQ ID NO: 734749 - RNA, 18 nt, Leptospira interrogans serovar lai str. 56601
uagaaagauuaaauucua

SEQ ID NO: 734750 - RNA, 17 nt, Leptospira interrogans serovar lai str. 56601
uagaaauguaggaacuc

SEQ ID NO: 734751 - RNA, 21 nt, Leptospira interrogans serovar lai str. 56601
uagaaagcgaugcauugaguu

SEQ ID NO: 734752 - RNA, 20 nt, Leptospira interrogans serovar lai str. 56601
uagaaauuuauaauauucuu

SEQ ID NO: 734753 - RNA, 21 nt, Leptospira interrogans serovar lai str. 56601
uacgaaucuguucgucguuua

SEQ ID NO: 734754 - RNA, 20 nt, Leptospira interrogans serovar lai str. 56601
uacgacaaguccucuaugaa

SEQ ID NO: 734755 - RNA, 14 nt, Leptospira interrogans serovar lai str. 56601
uacauuuuuagaau

SEQ ID NO: 734756 - RNA, 16 nt, Leptospira interrogans serovar lai str. 56601
uacaucuaaugauuuc

SEQ ID NO: 734757 - RNA, 16 nt, Leptospira interrogans serovar lai str. 56601
uacauuaguuaacgug

SEQ ID NO: 734758 - RNA, 21 nt, Leptospira interrogans serovar lai str. 56601
uaccaaauaaauauuuccggc

SEQ ID NO: 734759 - RNA, 16 nt, Leptospira interrogans serovar lai str. 56601
uaaaacuucuuuaagg

SEQ ID NO: 734760 - RNA, 15 nt, Leptospira interrogans serovar lai str. 56601
uaaaagaccuucgga

SEQ ID NO: 734761 - RNA, 15 nt, Leptospira interrogans serovar lai str. 56601
uaaaagaagaugcuu

SEQ ID NO: 734762 - RNA, 23 nt, Leptospira interrogans serovar lai str. 56601
uaaaaugcggaaacuuuuucguu

SEQ ID NO: 734763 - RNA, 16 nt, Leptospira interrogans serovar lai str. 56601
uaaaaugugggaacuc

SEQ ID NO: 734764 - RNA, 16 nt, Leptospira interrogans serovar lai str. 56601
uaaaacugcgguaaua

SEQ ID NO: 734765 - RNA, 21 nt, Leptospira interrogans serovar lai str. 56601
uaaaacuucagccgcuucauc

SEQ ID NO: 734766 - RNA, 23 nt, Leptospira interrogans serovar lai str. 56601
uaaaaacaaguuuaaaugaaaug

SEQ ID NO: 734767 - RNA, 14 nt, Leptospira interrogans serovar lai str. 56601
uaaaaaaaucacua

SEQ ID NO: 734768 - RNA, 15 nt, Leptospira interrogans serovar lai str. 56601
uaaaaaaaugauuuc

SEQ ID NO: 734769 - RNA, 17 nt, Leptospira interrogans serovar lai str. 56601
guuuuucaacaacucua

SEQ ID NO: 734770 - RNA, 15 nt, Leptospira interrogans serovar lai str. 56601
guuuuuguuuguauc

SEQ ID NO: 734771 - RNA, 16 nt, Leptospira interrogans serovar lai str. 56601
guuuuuuaaucggaga

SEQ ID NO: 734772 - RNA, 15 nt, Leptospira interrogans serovar lai str. 56601
uaaaaacgucuaguc

SEQ ID NO: 734773 - RNA, 20 nt, Leptospira interrogans serovar lai str. 56601
uaaaaaccuaguguuuaauu

SEQ ID NO: 734774 - RNA, 15 nt, Leptospira interrogans serovar lai str. 56601
uaaaaccaaaaugcu

SEQ ID NO: 734775 - RNA, 22 nt, Leptospira interrogans serovar lai str. 56601
uaaaaccaaucgauaacuugau

SEQ ID NO: 734776 - RNA, 23 nt, Leptospira interrogans serovar lai str. 56601
uaaaaaagauaagucuaacguga

SEQ ID NO: 734777 - RNA, 22 nt, Leptospira interrogans serovar lai str. 56601
uaaaaaaccgucccaaaaucuu

SEQ ID NO: 734778 - RNA, 16 nt, Leptospira interrogans serovar lai str. 56601
uaaaaaacgaaucaua

SEQ ID NO: 734779 - RNA, 19 nt, Leptospira interrogans serovar lai str. 56601
uaaaggaauccaugauucu

SEQ ID NO: 734780 - RNA, 23 nt, Leptospira interrogans serovar lai str. 56601
uaaagccgaucugugauugaaca

SEQ ID NO: 734781 - RNA, 14 nt, Leptospira interrogans serovar lai str. 56601
uaaagcaaaaccua

SEQ ID NO: 734782 - RNA, 18 nt, Leptospira interrogans serovar lai str. 56601
uaaaauuuguaggaacuc

SEQ ID NO: 734783 - RNA, 14 nt, Leptospira interrogans serovar lai str. 56601
uaaaauuaaaucuu

SEQ ID NO: 734784 - RNA, 18 nt, Leptospira interrogans serovar lai str. 56601
uaaaauuuuuuuaagaau

SEQ ID NO: 734785 - RNA, 16 nt, Leptospira interrogans serovar lai str. 56601
uaaauuccuuccaagu

SEQ ID NO: 734786 - RNA, 23 nt, Leptospira interrogans serovar lai str. 56601
uaaauucggaaauuuuaaucuuc

SEQ ID NO: 734787 - RNA, 18 nt, Leptospira interrogans serovar lai str. 56601
uaaauucuacaaauucuu

SEQ ID NO: 734788 - RNA, 16 nt, Leptospira interrogans serovar lai str. 56601
uaaaugugggaacuac

SEQ ID NO: 734789 - RNA, 13 nt, Leptospira interrogans serovar lai str. 56601
uaaauauugaucu

SEQ ID NO: 734790 - RNA, 21 nt, Leptospira interrogans serovar lai str. 56601
uaaauauugaucuaaacuagc

SEQ ID NO: 734791 - RNA, 18 nt, Leptospira interrogans serovar lai str. 56601
uaaaucaauccucuuuga

SEQ ID NO: 734792 - RNA, 19 nt, Leptospira interrogans serovar lai str. 56601
uaaaucaauuuucuuucua

SEQ ID NO: 734793 - RNA, 18 nt, Leptospira interrogans serovar lai str. 56601
uaaaucaugaucaaauuc

SEQ ID NO: 734794 - RNA, 18 nt, Leptospira interrogans serovar lai str. 56601
uaaauuuacuacucggac

SEQ ID NO: 734795 - RNA, 16 nt, Leptospira interrogans serovar lai str. 56601
uaaauugugagaacua

SEQ ID NO: 734796 - RNA, 21 nt, Leptospira interrogans serovar lai str. 56601
uaaauuuaaauguucaaauuc

SEQ ID NO: 734797 - RNA, 15 nt, Leptospira interrogans serovar lai str. 56601
uaacagaaaaauguu

SEQ ID NO: 734798 - RNA, 19 nt, Leptospira interrogans serovar lai str. 56601
uaaccgacuugagauuccu

SEQ ID NO: 734799 - RNA, 21 nt, Leptospira interrogans serovar lai str. 56601
uaacgguacucaauuuuacag

SEQ ID NO: 734800 - RNA, 23 nt, Leptospira interrogans serovar lai str. 56601
uaauuuaguuauaacguuauaaa

SEQ ID NO: 734801 - RNA, 14 nt, Leptospira interrogans serovar lai str. 56601
uaauuguagauucu

SEQ ID NO: 734802 - RNA, 22 nt, Leptospira interrogans serovar lai str. 56601
uaauuucucuuauuagaacuca

SEQ ID NO: 734803 - RNA, 21 nt, Leptospira interrogans serovar lai str. 56601
uaauuucauuauuagaguugu

SEQ ID NO: 734804 - RNA, 13 nt, Leptospira interrogans serovar lai str. 56601
uaaugcugauuuu

SEQ ID NO: 734805 - RNA, 18 nt, Leptospira interrogans serovar lai str. 56601
uaaucuuuauagguuucu

SEQ ID NO: 734806 - RNA, 16 nt, Leptospira interrogans serovar lai str. 56601
uacaauaaaaauuaga

SEQ ID NO: 734807 - RNA, 23 nt, Leptospira interrogans serovar lai str. 56601
uacagaauaaauacauacaauga

SEQ ID NO: 734808 - RNA, 20 nt, Leptospira interrogans serovar lai str. 56601
uaaucuccgcucuauuucca

SEQ ID NO: 734809 - RNA, 17 nt, Leptospira interrogans serovar lai str. 56601
uaauauggguauugguu

SEQ ID NO: 734810 - RNA, 18 nt, Leptospira interrogans serovar lai str. 56601
uaauauuucgauguaauu

SEQ ID NO: 734811 - RNA, 21 nt, Leptospira interrogans serovar lai str. 56601
uaagauuaugguaaaauuuca

SEQ ID NO: 734812 - RNA, 14 nt, Leptospira interrogans serovar lai str. 56601
uaagagccuacaaa

SEQ ID NO: 734813 - RNA, 19 nt, Leptospira interrogans serovar lai str. 56601
uaagaauaauuuaaacuua

SEQ ID NO: 734814 - RNA, 19 nt, Leptospira interrogans serovar lai str. 56601
uaagaccgucucaagauuu

SEQ ID NO: 734815 - RNA, 21 nt, Leptospira interrogans serovar lai str. 56601
uaaggaaguguuugcugaguu

SEQ ID NO: 734816 - RNA, 20 nt, Leptospira interrogans serovar lai str. 56601
uaagcucuccuacgcuucaa

SEQ ID NO: 734817 - RNA, 14 nt, Leptospira interrogans serovar lai str. 56601
guugaaagaaucua

SEQ ID NO: 734818 - RNA, 19 nt, Leptospira interrogans serovar lai str. 56601
guucuaaccggaauuucca

SEQ ID NO: 734819 - RNA, 12 nt, Leptospira interrogans serovar lai str. 56601
guucuaaucucg

SEQ ID NO: 734820 - RNA, 15 nt, Leptospira interrogans serovar lai str. 56601
guucuauaaacucaa

SEQ ID NO: 734821 - RNA, 18 nt, Leptospira interrogans serovar lai str. 56601
guugcaguuccuugaacu

SEQ ID NO: 734822 - RNA, 12 nt, Leptospira interrogans serovar lai str. 56601
guugaguucuuu

SEQ ID NO: 734823 - RNA, 13 nt, Leptospira interrogans serovar lai str. 56601
guuugugagaguu

SEQ ID NO: 734824 - RNA, 19 nt, Leptospira interrogans serovar lai str. 56601
guuuuguuaaccaccucua

SEQ ID NO: 734825 - RNA, 16 nt, Leptospira interrogans serovar lai str. 56601
guuuucgauuccgauc

SEQ ID NO: 734826 - RNA, 17 nt, Leptospira interrogans serovar lai str. 56601
guuugcaaguagaaguc

SEQ ID NO: 734827 - RNA, 13 nt, Leptospira interrogans serovar lai str. 56601
guuugaguuucuu

SEQ ID NO: 734828 - RNA, 18 nt, Leptospira interrogans serovar lai str. 56601
guuugauaauuugugaac

SEQ ID NO: 734829 - RNA, 17 nt, Leptospira interrogans serovar lai str. 56601
guuuccggaauccgauu

SEQ ID NO: 734830 - RNA, 19 nt, Leptospira interrogans serovar lai str. 56601
guuucauaaaauucuccga

SEQ ID NO: 734831 - RNA, 17 nt, Leptospira interrogans serovar lai str. 56601
gggaacuacuaugaaau

SEQ ID NO: 734832 - RNA, 13 nt, Leptospira interrogans serovar lai str. 56601
guaaaacgcucuc

SEQ ID NO: 734833 - RNA, 13 nt, Leptospira interrogans serovar lai str. 56601
guaaaauuuagau

SEQ ID NO: 734834 - RNA, 16 nt, Leptospira interrogans serovar lai str. 56601
guaaaaucgaguuuca

SEQ ID NO: 734835 - RNA, 22 nt, Leptospira interrogans serovar lai str. 56601
guaaagacgauccuuuuuugua

SEQ ID NO: 734836 - RNA, 19 nt, Leptospira interrogans serovar lai str. 56601
guaaacuaucgaaugcgac

SEQ ID NO: 734837 - RNA, 16 nt, Leptospira interrogans serovar lai str. 56601
ggucucaacaacucua

SEQ ID NO: 734838 - RNA, 14 nt, Leptospira interrogans serovar lai str. 56601
gucauaaaccgauu

SEQ ID NO: 734839 - RNA, 19 nt, Leptospira interrogans serovar lai str. 56601
gucauuucaguucugagac

SEQ ID NO: 734840 - RNA, 19 nt, Leptospira interrogans serovar lai str. 56601
guccaaucagauuuuugua

SEQ ID NO: 734841 - RNA, 18 nt, Leptospira interrogans serovar lai str. 56601
guaagggaaaguuauuuc

SEQ ID NO: 734842 - RNA, 20 nt, Leptospira interrogans serovar lai str. 56601
guagagaagcagcauugagu

SEQ ID NO: 734843 - RNA, 17 nt, Leptospira interrogans serovar lai str. 56601
guauuacucagaguuau

SEQ ID NO: 734844 - RNA, 21 nt, Leptospira interrogans serovar lai str. 56601
guauuguuaagauaaauuuag

SEQ ID NO: 734845 - RNA, 20 nt, Leptospira interrogans serovar lai str. 56601
gucucaaaauuaagaaucaa

SEQ ID NO: 734846 - RNA, 16 nt, Leptospira interrogans serovar lai str. 56601
gugaaacuuaaucuca

SEQ ID NO: 734847 - RNA, 15 nt, Leptospira interrogans serovar lai str. 56601
gugccucucgccaaa

SEQ ID NO: 734848 - RNA, 13 nt, Leptospira interrogans serovar lai str. 56601
gcuagauuuagau

SEQ ID NO: 734849 - RNA, 17 nt, Leptospira interrogans serovar lai str. 56601
ggaaucuaaacuuugua

SEQ ID NO: 734850 - RNA, 17 nt, Leptospira interrogans serovar lai str. 56601
gcuccagucuaaguaug

SEQ ID NO: 734851 - RNA, 17 nt, Leptospira interrogans serovar lai str. 56601
ucggaacuagggaauuu

SEQ ID NO: 734852 - RNA, 20 nt, Leptospira interrogans serovar lai str. 56601
uccuaaaaugugggaacucu

SEQ ID NO: 734853 - RNA, 19 nt, Leptospira interrogans serovar lai str. 56601
uccuaaaauugugggaacu

SEQ ID NO: 734854 - RNA, 20 nt, Leptospira interrogans serovar lai str. 56601
uccuacauguaaaacuuaga

SEQ ID NO: 734855 - RNA, 21 nt, Leptospira interrogans serovar lai str. 56601
ucgaauacgacagauucaauu

SEQ ID NO: 734856 - RNA, 20 nt, Leptospira interrogans serovar lai str. 56601
ucgaagaugguacuuuacga

SEQ ID NO: 734857 - RNA, 22 nt, Leptospira interrogans serovar lai str. 56601
ucgaacuucguuggaaaguuuu

SEQ ID NO: 734858 - RNA, 17 nt, Leptospira interrogans serovar lai str. 56601
ucgauuuguaaaauuca

SEQ ID NO: 734859 - RNA, 19 nt, Leptospira interrogans serovar lai str. 56601
ugcaaucguccaaucucuu

SEQ ID NO: 734860 - RNA, 17 nt, Leptospira interrogans serovar lai str. 56601
ugcaauuccuucggaau

SEQ ID NO: 734861 - RNA, 14 nt, Leptospira interrogans serovar lai str. 56601
ugauacuuucggac

SEQ ID NO: 734862 - RNA, 19 nt, Leptospira interrogans serovar lai str. 56601
ugagacgcugaguuugaaa

SEQ ID NO: 734863 - RNA, 20 nt, Leptospira interrogans serovar lai str. 56601
ugagaugaggaaguucccgg

SEQ ID NO: 734864 - RNA, 12 nt, Leptospira interrogans serovar lai str. 56601
ugaauuuacagu

SEQ ID NO: 734865 - RNA, 24 nt, Leptospira interrogans serovar lai str. 56601
ugaaugaaaccugaaucuauugua

SEQ ID NO: 734866 - RNA, 14 nt, Leptospira interrogans serovar lai str. 56601
ugaauucucuaucu

SEQ ID NO: 734867 - RNA, 13 nt, Leptospira interrogans serovar lai str. 56601
ugaagacuuccac

SEQ ID NO: 734868 - RNA, 12 nt, Leptospira interrogans serovar lai str. 56601
ugaacuuucgag

SEQ ID NO: 734869 - RNA, 13 nt, Leptospira interrogans serovar lai str. 56601
ugaagaaacacuu

SEQ ID NO: 734870 - RNA, 16 nt, Leptospira interrogans serovar lai str. 56601
ugaauauuucuucguu

SEQ ID NO: 734871 - RNA, 18 nt, Leptospira interrogans serovar lai str. 56601
ugaauauuuuuaaacuca

SEQ ID NO: 734872 - RNA, 15 nt, Leptospira interrogans serovar lai str. 56601
ucuuccuucuugaaa

SEQ ID NO: 734873 - RNA, 13 nt, Leptospira interrogans serovar lai str. 56601
ucuugaaauucuc

SEQ ID NO: 734874 - RNA, 13 nt, Leptospira interrogans serovar lai str. 56601
ugaaaagugaguu

SEQ ID NO: 734875 - RNA, 21 nt, Leptospira interrogans serovar lai str. 56601
ucuuuuuuaaaccgauuucaa

SEQ ID NO: 734876 - RNA, 22 nt, Leptospira interrogans serovar lai str. 56601
ucuuuuuuuaccgaagacgcau

SEQ ID NO: 734877 - RNA, 18 nt, Leptospira interrogans serovar lai str. 56601
ugaaaaaaguuggaauuu

SEQ ID NO: 734878 - RNA, 16 nt, Leptospira interrogans serovar lai str. 56601
ugaaaaaaaacaaaga

SEQ ID NO: 734879 - RNA, 14 nt, Leptospira interrogans serovar lai str. 56601
ugaaaaaaauuaga

SEQ ID NO: 734880 - RNA, 15 nt, Leptospira interrogans serovar lai str. 56601
ucuuuauaaaucugu

SEQ ID NO: 734881 - RNA, 15 nt, Leptospira interrogans serovar lai str. 56601
ucuuguuuaaaucga

SEQ ID NO: 734882 - RNA, 12 nt, Leptospira interrogans serovar lai str. 56601
ucuuuuagaguu

SEQ ID NO: 734883 - RNA, 13 nt, Leptospira interrogans serovar lai str. 56601
aauagaaagacuu

SEQ ID NO: 734884 - RNA, 15 nt, Leptospira interrogans serovar lai str. 56601
aauacuuuauuugua

SEQ ID NO: 734885 - RNA, 16 nt, Leptospira interrogans serovar lai str. 56601
aauacguuuacuccaa

SEQ ID NO: 734886 - RNA, 21 nt, Leptospira interrogans serovar lai str. 56601
ucuguaaaguucagauucgaa

SEQ ID NO: 734887 - RNA, 15 nt, Leptospira interrogans serovar lai str. 56601
ucugguggaauucgu

SEQ ID NO: 734888 - RNA, 19 nt, Leptospira interrogans serovar lai str. 56601
ucuauccacuaaaauacuu

SEQ ID NO: 734889 - RNA, 14 nt, Leptospira interrogans serovar lai str. 56601
ucuaucaaacgaag

SEQ ID NO: 734890 - RNA, 18 nt, Leptospira interrogans serovar lai str. 56601
ucuauagauugauuuaaa

SEQ ID NO: 734891 - RNA, 16 nt, Leptospira interrogans serovar lai str. 56601
ucuaguuuaaacguuu

SEQ ID NO: 734892 - RNA, 18 nt, Leptospira interrogans serovar lai str. 56601
ucuauaaaacaaaauaga

SEQ ID NO: 734893 - RNA, 17 nt, Leptospira interrogans serovar lai str. 56601
ucuauugugggaacuac

SEQ ID NO: 734894 - RNA, 17 nt, Leptospira interrogans serovar lai str. 56601
ucuauuaugauucuaua

SEQ ID NO: 734895 - RNA, 19 nt, Leptospira interrogans serovar lai str. 56601
ucuauuucccaaaauuuca

SEQ ID NO: 734896 - RNA, 17 nt, Leptospira interrogans serovar lai str. 56601
ucuaaaucgaaucgaau

SEQ ID NO: 734897 - RNA, 16 nt, Leptospira interrogans serovar lai str. 56601
ucuaaaucuuaggaac

SEQ ID NO: 734898 - RNA, 19 nt, Leptospira interrogans serovar lai str. 56601
ucuaaccggaauuuccaaa

SEQ ID NO: 734899 - RNA, 19 nt, Leptospira interrogans serovar lai str. 56601
ucuaaaauauaggaacuac

SEQ ID NO: 734900 - RNA, 20 nt, Leptospira interrogans serovar lai str. 56601
ucuaaaguuguaggaacuac

SEQ ID NO: 734901 - RNA, 18 nt, Leptospira interrogans serovar lai str. 56601
ucguuucugaggaauuaa

SEQ ID NO: 734902 - RNA, 16 nt, Leptospira interrogans serovar lai str. 56601
ucuaaaaagaaucaua

SEQ ID NO: 734903 - RNA, 14 nt, Leptospira interrogans serovar lai str. 56601
ucguuuaagaauuu

SEQ ID NO: 734904 - RNA, 21 nt, Leptospira interrogans serovar lai str. 56601
ucguuagaagacaaugcgauu

SEQ ID NO: 734905 - RNA, 16 nt, Leptospira interrogans serovar lai str. 56601
ucguguuguauggaaa

SEQ ID NO: 734906 - RNA, 14 nt, Leptospira interrogans serovar lai str. 56601
ucagauucaauucu

SEQ ID NO: 734907 - RNA, 21 nt, Leptospira interrogans serovar lai str. 56601
aauaauucaaaauuugauccu

SEQ ID NO: 734908 - RNA, 20 nt, Leptospira interrogans serovar lai str. 56601
ucacuuuuccaaauauacga

SEQ ID NO: 734909 - RNA, 21 nt, Leptospira interrogans serovar lai str. 56601
ucagaaaaaaaaagaauuucu

SEQ ID NO: 734910 - RNA, 16 nt, Leptospira interrogans serovar lai str. 56601
ucagaaaaagugaauu

SEQ ID NO: 734911 - RNA, 20 nt, Leptospira interrogans serovar lai str. 56601
aauaaccuucggguuccgua

SEQ ID NO: 734912 - RNA, 23 nt, Leptospira interrogans serovar lai str. 56601
aauaacuaacgugaguucagaca

SEQ ID NO: 734913 - RNA, 20 nt, Leptospira interrogans serovar lai str. 56601
ucacaauuuuacaaacaaau

SEQ ID NO: 734914 - RNA, 18 nt, Leptospira interrogans serovar lai str. 56601
ucacaauuuuuuuagaau

SEQ ID NO: 734915 - RNA, 20 nt, Leptospira interrogans serovar lai str. 56601
ucacgauuuuacgaacaaau

SEQ ID NO: 734916 - RNA, 19 nt, Leptospira interrogans serovar lai str. 56601
uccaauuguuccgaauuaa

SEQ ID NO: 734917 - RNA, 11 nt, Leptospira interrogans serovar lai str. 56601
uccacuuaaaa

SEQ ID NO: 734918 - RNA, 15 nt, Leptospira interrogans serovar lai str. 56601
uccagaagauugaaa

SEQ ID NO: 734919 - RNA, 13 nt, Leptospira interrogans serovar lai str. 56601
uccacuauggaau

SEQ ID NO: 734920 - RNA, 15 nt, Leptospira interrogans serovar lai str. 56601
uccacuauggaauuu

SEQ ID NO: 734921 - RNA, 14 nt, Leptospira interrogans serovar lai str. 56601
uccagcacugaucg

SEQ ID NO: 734922 - RNA, 22 nt, Leptospira interrogans serovar lai str. 56601
uccauaacagaauuuaggcaau

SEQ ID NO: 734923 - RNA, 15 nt, Leptospira interrogans serovar lai str. 56601
ucauuuaaaaauuga

SEQ ID NO: 734924 - RNA, 17 nt, Leptospira interrogans serovar lai str. 56601
ucauuucguuucccaua

SEQ ID NO: 734925 - RNA, 15 nt, Leptospira interrogans serovar lai str. 56601
ucauuuuacagaaua

SEQ ID NO: 734926 - RNA, 13 nt, Leptospira interrogans serovar lai str. 56601
uccaaucaugaau

SEQ ID NO: 734927 - RNA, 20 nt, Leptospira interrogans serovar lai str. 56601
ucauaguucccacaaauuga

SEQ ID NO: 734928 - RNA, 16 nt, Leptospira interrogans serovar lai str. 56601
ucauauccgaaagaua

SEQ ID NO: 734929 - RNA, 13 nt, Leptospira interrogans serovar lai str. 56601
ucauaucaaauuc

SEQ ID NO: 734930 - RNA, 18 nt, Leptospira interrogans serovar lai str. 56601
ucaaucuccccaaaaucu

SEQ ID NO: 734931 - RNA, 14 nt, Leptospira interrogans serovar lai str. 56601
ucaauuguccauuu

SEQ ID NO: 734932 - RNA, 20 nt, Leptospira interrogans serovar lai str. 56601
ucacaaaaaagauaaaaaga

SEQ ID NO: 734933 - RNA, 12 nt, Leptospira interrogans serovar lai str. 56601
ucaauaacuuga

SEQ ID NO: 734934 - RNA, 20 nt, Leptospira interrogans serovar lai str. 56601
ucaauacaacgaaaacagau

SEQ ID NO: 734935 - RNA, 19 nt, Leptospira interrogans serovar lai str. 56601
ucaauaauguggaacucua

SEQ ID NO: 734936 - RNA, 15 nt, Leptospira interrogans serovar lai str. 56601
ucaaauauacaaagu

SEQ ID NO: 734937 - RNA, 13 nt, Leptospira interrogans serovar lai str. 56601
ucaaauaacuuua

SEQ ID NO: 734938 - RNA, 16 nt, Leptospira interrogans serovar lai str. 56601
ucaacugaaacucuau

SEQ ID NO: 734939 - RNA, 23 nt, Leptospira interrogans serovar lai str. 56601
ucaacugaaacucuaucacgaaa

SEQ ID NO: 734940 - RNA, 20 nt, Leptospira interrogans serovar lai str. 56601
ucaagacaacagaacaaaau

SEQ ID NO: 734941 - RNA, 17 nt, Leptospira interrogans serovar lai str. 56601
uauuauuuuaacuugag

SEQ ID NO: 734942 - RNA, 12 nt, Leptospira interrogans serovar lai str. 56601
uauucaacuugu

SEQ ID NO: 734943 - RNA, 14 nt, Leptospira interrogans serovar lai str. 56601
uauugauccaauug

SEQ ID NO: 734944 - RNA, 11 nt, Leptospira interrogans serovar lai str. 56601
ucaaaauucuu

SEQ ID NO: 734945 - RNA, 17 nt, Leptospira interrogans serovar lai str. 56601
ucaaaauuaagaaucaa

SEQ ID NO: 734946 - RNA, 20 nt, Leptospira interrogans serovar lai str. 56601
ucaaacuaaauuaguucuuc

SEQ ID NO: 734947 - RNA, 12 nt, Leptospira interrogans serovar lai str. 56601
ucaaagaaucga

SEQ ID NO: 734948 - RNA, 17 nt, Leptospira interrogans serovar lai str. 56601
ucaaagaaucuuaggca

SEQ ID NO: 734949 - RNA, 16 nt, Leptospira interrogans serovar lai str. 56601
ucaaagcgggaauucc

SEQ ID NO: 734950 - RNA, 13 nt, Leptospira interrogans serovar lai str. 56601
uauuauaaacagu

SEQ ID NO: 734951 - RNA, 17 nt, Leptospira interrogans serovar lai str. 56601
uauuagaauuguugaaa

SEQ ID NO: 734952 - RNA, 22 nt, Leptospira interrogans serovar lai str. 56601
uauuauccauuucuauaaauug

SEQ ID NO: 734953 - RNA, 16 nt, Leptospira interrogans serovar lai str. 56601
uauuaauuauauucuu

SEQ ID NO: 734954 - RNA, 18 nt, Leptospira interrogans serovar lai str. 56601
uauuaaagucucaaguug

SEQ ID NO: 734955 - RNA, 19 nt, Leptospira interrogans serovar lai str. 56601
uauuaaauuaacgugaguu

SEQ ID NO: 734956 - RNA, 18 nt, Leptospira interrogans serovar lai str. 56601
uaugaguuccuacaauuu

SEQ ID NO: 734957 - RNA, 12 nt, Leptospira interrogans serovar lai str. 56601
uaugaacccgaa

SEQ ID NO: 734958 - RNA, 20 nt, Leptospira interrogans serovar lai str. 56601
uaugaacucuuacaauuuca

SEQ ID NO: 734959 - RNA, 15 nt, Leptospira interrogans serovar lai str. 56601
uaugaaaaacucggu

SEQ ID NO: 734960 - RNA, 23 nt, Leptospira interrogans serovar lai str. 56601
uaucuacaaaagauuuuuaucga

SEQ ID NO: 734961 - RNA, 18 nt, Leptospira interrogans serovar lai str. 56601
uaucagaaaaacauacuu

SEQ ID NO: 734962 - RNA, 23 nt, Leptospira interrogans serovar lai str. 56601
uauacuagaacaauaaccuucgg

SEQ ID NO: 734963 - RNA, 15 nt, Leptospira interrogans serovar lai str. 56601
uauaccgaaacagag

SEQ ID NO: 734964 - RNA, 12 nt, Leptospira interrogans serovar lai str. 56601
uauaucuugaac

SEQ ID NO: 734965 - RNA, 15 nt, Leptospira interrogans serovar lai str. 56601
uagggaaaacucaac

SEQ ID NO: 734966 - RNA, 23 nt, Leptospira interrogans serovar lai str. 56601
uagggccgucuauaaaauucaaa

SEQ ID NO: 734967 - RNA, 19 nt, Leptospira interrogans serovar lai str. 56601
uauacaaaguaaguucaaa

SEQ ID NO: 734968 - RNA, 17 nt, Leptospira interrogans serovar lai str. 56601
uauacaauauuucgucu

SEQ ID NO: 734969 - RNA, 18 nt, Leptospira interrogans serovar lai str. 56601
uauaauuuaguuuuugua

SEQ ID NO: 734970 - RNA, 16 nt, Leptospira interrogans serovar lai str. 56601
uaccacuuacauccca

SEQ ID NO: 734971 - RNA, 19 nt, Leptospira interrogans serovar lai str. 56601
uacgauccucuucuuuguc

SEQ ID NO: 734972 - RNA, 20 nt, Leptospira interrogans serovar lai str. 56601
uacugacagauugauauucu

SEQ ID NO: 734973 - RNA, 17 nt, Leptospira interrogans serovar lai str. 56601
uagaaagaaucuuuuua

SEQ ID NO: 734974 - RNA, 19 nt, Leptospira interrogans serovar lai str. 56601
uagaaacuaaugcaaguuc

SEQ ID NO: 734975 - RNA, 17 nt, Leptospira interrogans serovar lai str. 56601
uagaaacuauucuauag

SEQ ID NO: 734976 - RNA, 20 nt, Leptospira interrogans serovar lai str. 56601
uagaaagacuuuucaucauu

SEQ ID NO: 734977 - RNA, 14 nt, Leptospira interrogans serovar lai str. 56601
uagaaaaacugauu

SEQ ID NO: 734978 - RNA, 18 nt, Leptospira interrogans serovar lai str. 56601
uacuuucggacuuuccga

SEQ ID NO: 734979 - RNA, 17 nt, Leptospira interrogans serovar lai str. 56601
uagaauuugaacuuuac

SEQ ID NO: 734980 - RNA, 14 nt, Leptospira interrogans serovar lai str. 56601
uagaauuuggcuuu

SEQ ID NO: 734981 - RNA, 13 nt, Leptospira interrogans serovar lai str. 56601
uagaauuuuugua

SEQ ID NO: 734982 - RNA, 18 nt, Leptospira interrogans serovar lai str. 56601
uagaaauauugaauccau

SEQ ID NO: 734983 - RNA, 16 nt, Leptospira interrogans serovar lai str. 56601
uaggcuaaucaaauuu

SEQ ID NO: 734984 - RNA, 14 nt, Leptospira interrogans serovar lai str. 56601
uaggaauucauacu

SEQ ID NO: 734985 - RNA, 19 nt, Leptospira interrogans serovar lai str. 56601
uaggauuuaguuccuauag

SEQ ID NO: 734986 - RNA, 19 nt, Leptospira interrogans serovar lai str. 56601
aaguuuuccgguucgaauc

SEQ ID NO: 734987 - RNA, 17 nt, Leptospira interrogans serovar lai str. 56601
aaguuugugagaguucc

SEQ ID NO: 734988 - RNA, 20 nt, Leptospira interrogans serovar lai str. 56601
aaguuugggauauucugaaa

SEQ ID NO: 734989 - RNA, 20 nt, Leptospira interrogans serovar lai str. 56601
aaguugauuaugauccaaac

SEQ ID NO: 734990 - RNA, 14 nt, Leptospira interrogans serovar lai str. 56601
uacaguuaaacuuu

SEQ ID NO: 734991 - RNA, 17 nt, Leptospira interrogans serovar lai str. 56601
uacaguuucgauugaaa

SEQ ID NO: 734992 - RNA, 19 nt, Leptospira interrogans serovar lai str. 56601
uacagauuuauuuuagaau

SEQ ID NO: 734993 - RNA, 14 nt, Leptospira interrogans serovar lai str. 56601
uacauuuuaggaau

SEQ ID NO: 734994 - RNA, 14 nt, Leptospira interrogans serovar lai str. 56601
uacaauuguaggaa

SEQ ID NO: 734995 - RNA, 15 nt, Leptospira interrogans serovar lai str. 56601
uacaauaaaaacaga

SEQ ID NO: 734996 - RNA, 20 nt, Leptospira interrogans serovar lai str. 56601
uaauguugaaugaaaccuga

SEQ ID NO: 734997 - RNA, 18 nt, Leptospira interrogans serovar lai str. 56601
uaauuucaauaacuugac

SEQ ID NO: 734998 - RNA, 17 nt, Leptospira interrogans serovar lai str. 56601
uaauuucgggauauucu

SEQ ID NO: 734999 - RNA, 23 nt, Leptospira interrogans serovar lai str. 56601
uaauuguagauucuuuuagaagu

SEQ ID NO: 735000 - RNA, 15 nt, Leptospira interrogans serovar lai str. 56601
uaacuuacugauuuc

SEQ ID NO: 735001 - RNA, 21 nt, Leptospira interrogans serovar lai str. 56601
uaauauacugcaauaguuucu

SEQ ID NO: 735002 - RNA, 21 nt, Leptospira interrogans serovar lai str. 56601
uaaguuguguugaaucuuaaa

SEQ ID NO: 735003 - RNA, 18 nt, Leptospira interrogans serovar lai str. 56601
uaaguaauuuguggaaac

SEQ ID NO: 735004 - RNA, 14 nt, Leptospira interrogans serovar lai str. 56601
uaaguaggaacuac

SEQ ID NO: 735005 - RNA, 15 nt, Leptospira interrogans serovar lai str. 56601
uaagguugagguucu

SEQ ID NO: 735006 - RNA, 19 nt, Leptospira interrogans serovar lai str. 56601
uaaguaaaaaugcaaauug

SEQ ID NO: 735007 - RNA, 14 nt, Leptospira interrogans serovar lai str. 56601
uaaguuacucauuu

SEQ ID NO: 735008 - RNA, 20 nt, Leptospira interrogans serovar lai str. 56601
uaaguucaucuacguuucaa

SEQ ID NO: 735009 - RNA, 10 nt, Leptospira interrogans serovar lai str. 56601
uaaaaugcug

SEQ ID NO: 735010 - RNA, 19 nt, Leptospira interrogans serovar lai str. 56601
uaaaccgaucaaacucuuu

SEQ ID NO: 735011 - RNA, 14 nt, Leptospira interrogans serovar lai str. 56601
uaaaccgauuuucc

SEQ ID NO: 735012 - RNA, 18 nt, Leptospira interrogans serovar lai str. 56601
guuuuaaucaugugaauu

SEQ ID NO: 735013 - RNA, 22 nt, Leptospira interrogans serovar lai str. 56601
guuugaguuucuuuuugauuag

SEQ ID NO: 735014 - RNA, 21 nt, Leptospira interrogans serovar lai str. 56601
guuucugaaaccagauuuccg

SEQ ID NO: 735015 - RNA, 15 nt, Leptospira interrogans serovar lai str. 56601
guuucuugaacucaa

SEQ ID NO: 735016 - RNA, 15 nt, Leptospira interrogans serovar lai str. 56601
uaaaaauuuccggaa

SEQ ID NO: 735017 - RNA, 14 nt, Leptospira interrogans serovar lai str. 56601
uaaaacaaaauaga

SEQ ID NO: 735018 - RNA, 21 nt, Leptospira interrogans serovar lai str. 56601
uaaaaagcguuucauugaguu

SEQ ID NO: 735019 - RNA, 22 nt, Leptospira interrogans serovar lai str. 56601
uaaaaaauuuuacccugguuuc

SEQ ID NO: 735020 - RNA, 18 nt, Leptospira interrogans serovar lai str. 56601
uaaaaacagaauugaguu

SEQ ID NO: 735021 - RNA, 19 nt, Leptospira interrogans serovar lai str. 56601
uaaaaacagaauugaguuu

SEQ ID NO: 735022 - RNA, 13 nt, Leptospira interrogans serovar lai str. 56601
uaaaaaaaugauu

SEQ ID NO: 735023 - RNA, 21 nt, Leptospira interrogans serovar lai str. 56601
guuuuuuuucaacaacucuaa

SEQ ID NO: 735024 - RNA, 22 nt, Leptospira interrogans serovar lai str. 56601
uaaaaaaacaauuaaucaaauu

SEQ ID NO: 735025 - RNA, 20 nt, Leptospira interrogans serovar lai str. 56601
uaaaaaaacgcgaauuugac

SEQ ID NO: 735026 - RNA, 23 nt, Leptospira interrogans serovar lai str. 56601
uaaaacacaucuuaaaaacucua

SEQ ID NO: 735027 - RNA, 16 nt, Leptospira interrogans serovar lai str. 56601
uaaaauaacgugaguu

SEQ ID NO: 735028 - RNA, 15 nt, Leptospira interrogans serovar lai str. 56601
uaaaauaaaauuccu

SEQ ID NO: 735029 - RNA, 14 nt, Leptospira interrogans serovar lai str. 56601
uaaaauaaacuauc

SEQ ID NO: 735030 - RNA, 22 nt, Leptospira interrogans serovar lai str. 56601
uaaaaccgaccugcagagcgac

SEQ ID NO: 735031 - RNA, 16 nt, Leptospira interrogans serovar lai str. 56601
uaaaauacucaauccg

SEQ ID NO: 735032 - RNA, 23 nt, Leptospira interrogans serovar lai str. 56601
uaaaauacuuuuagaaaauuaga

SEQ ID NO: 735033 - RNA, 23 nt, Leptospira interrogans serovar lai str. 56601
uaaaaugggaaguuuaccccgaa

SEQ ID NO: 735034 - RNA, 16 nt, Leptospira interrogans serovar lai str. 56601
uaaaauguaggaaccc

SEQ ID NO: 735035 - RNA, 21 nt, Leptospira interrogans serovar lai str. 56601
uaaaauccguagccgcuucaa

SEQ ID NO: 735036 - RNA, 19 nt, Leptospira interrogans serovar lai str. 56601
guuuugggacaaacuuuaa

SEQ ID NO: 735037 - RNA, 13 nt, Leptospira interrogans serovar lai str. 56601
guuuuggaaaggu

SEQ ID NO: 735038 - RNA, 17 nt, Leptospira interrogans serovar lai str. 56601
guuuuuacuaugaagac

SEQ ID NO: 735039 - RNA, 21 nt, Leptospira interrogans serovar lai str. 56601
guuuuugaaaugcaguuucuu

SEQ ID NO: 735040 - RNA, 13 nt, Leptospira interrogans serovar lai str. 56601
guuuucauucaaa

SEQ ID NO: 735041 - RNA, 16 nt, Leptospira interrogans serovar lai str. 56601
guugcaauccaaaguu

SEQ ID NO: 735042 - RNA, 19 nt, Leptospira interrogans serovar lai str. 56601
guucuuuuauauaaucuaa

SEQ ID NO: 735043 - RNA, 21 nt, Leptospira interrogans serovar lai str. 56601
guucuucggcguugaguuuuu

SEQ ID NO: 735044 - RNA, 18 nt, Leptospira interrogans serovar lai str. 56601
guucauucauccuaagaa

SEQ ID NO: 735045 - RNA, 22 nt, Leptospira interrogans serovar lai str. 56601
guuccgacaagaaugagucuuu

SEQ ID NO: 735046 - RNA, 18 nt, Leptospira interrogans serovar lai str. 56601
guuccuauauagauccug

SEQ ID NO: 735047 - RNA, 15 nt, Leptospira interrogans serovar lai str. 56601
aaguucuuuucuuaa

SEQ ID NO: 735048 - RNA, 15 nt, Leptospira interrogans serovar lai str. 56601
guuaucgcuaauaca

SEQ ID NO: 735049 - RNA, 14 nt, Leptospira interrogans serovar lai str. 56601
guuaucuucgaaau

SEQ ID NO: 735050 - RNA, 19 nt, Leptospira interrogans serovar lai str. 56601
guucagaugaauugaauuu

SEQ ID NO: 735051 - RNA, 19 nt, Leptospira interrogans serovar lai str. 56601
gugcucgaaguaacucagc

SEQ ID NO: 735052 - RNA, 18 nt, Leptospira interrogans serovar lai str. 56601
ugccuaaauuuuuaucac

SEQ ID NO: 735053 - RNA, 12 nt, Leptospira interrogans serovar lai str. 56601
aauagauuucua

SEQ ID NO: 735054 - RNA, 23 nt, Leptospira interrogans serovar lai str. 56601
aauagauggagaacucucucaaa

SEQ ID NO: 735055 - RNA, 14 nt, Leptospira interrogans serovar lai str. 56601
aauagauucuuaau

SEQ ID NO: 735056 - RNA, 20 nt, Leptospira interrogans serovar lai str. 56601
aauaguuuguacaucuuaaa

SEQ ID NO: 735057 - RNA, 22 nt, Leptospira interrogans serovar lai str. 56601
aauaguucccacauuuuucaaa

SEQ ID NO: 735058 - RNA, 19 nt, Leptospira interrogans serovar lai str. 56601
aauagugauacaauguucc

SEQ ID NO: 735059 - RNA, 14 nt, Leptospira interrogans serovar lai str. 56601
aauaguauccaaaa

SEQ ID NO: 735060 - RNA, 18 nt, Leptospira interrogans serovar lai str. 56601
ugcugaauugcucaaaga

SEQ ID NO: 735061 - RNA, 21 nt, Leptospira interrogans serovar lai str. 56601
uggauuuuauuuuuacaaaga

SEQ ID NO: 735062 - RNA, 15 nt, Leptospira interrogans serovar lai str. 56601
uggauaggauuccau

SEQ ID NO: 735063 - RNA, 20 nt, Leptospira interrogans serovar lai str. 56601
uggacugcaaaaucaguuaa

SEQ ID NO: 735064 - RNA, 16 nt, Leptospira interrogans serovar lai str. 56601
uguaaaauuuggauuu

SEQ ID NO: 735065 - RNA, 19 nt, Leptospira interrogans serovar lai str. 56601
uguaaacuauuacguaaug

SEQ ID NO: 735066 - RNA, 16 nt, Leptospira interrogans serovar lai str. 56601
uguaagaaaaacuagg

SEQ ID NO: 735067 - RNA, 17 nt, Leptospira interrogans serovar lai str. 56601
ugucccaaaaacucaaa

SEQ ID NO: 735068 - RNA, 21 nt, Leptospira interrogans serovar lai str. 56601
aaucaagugcaguaguuccua

SEQ ID NO: 735069 - RNA, 18 nt, Leptospira interrogans serovar lai str. 56601
aauauuuuuccagcgauu

SEQ ID NO: 735070 - RNA, 17 nt, Leptospira interrogans serovar lai str. 56601
ugggaacuacuacaaga

SEQ ID NO: 735071 - RNA, 14 nt, Leptospira interrogans serovar lai str. 56601
aauuuacuucaauu

SEQ ID NO: 735072 - RNA, 20 nt, Leptospira interrogans serovar lai str. 56601
aauuuagcuaagucuuuaaa

SEQ ID NO: 735073 - RNA, 20 nt, Leptospira interrogans serovar lai str. 56601
aauuuaguauauuuugaucu

SEQ ID NO: 735074 - RNA, 17 nt, Leptospira interrogans serovar lai str. 56601
aauuuaguuuuuguaug

SEQ ID NO: 735075 - RNA, 17 nt, Leptospira interrogans serovar lai str. 56601
aauuuauauaguaaaua

SEQ ID NO: 735076 - RNA, 16 nt, Leptospira interrogans serovar lai str. 56601
aauuuacgauucuaaa

SEQ ID NO: 735077 - RNA, 23 nt, Leptospira interrogans serovar lai str. 56601
aauuuaacuacacgagagcugcu

SEQ ID NO: 735078 - RNA, 19 nt, Leptospira interrogans serovar lai str. 56601
aauuguuugaaaguuccca

SEQ ID NO: 735079 - RNA, 21 nt, Leptospira interrogans serovar lai str. 56601
aauuguuugaaaguucccaaa

SEQ ID NO: 735080 - RNA, 16 nt, Leptospira interrogans serovar lai str. 56601
aauugugagaacuacu

SEQ ID NO: 735081 - RNA, 15 nt, Leptospira interrogans serovar lai str. 56601
aauugugggaacuca

SEQ ID NO: 735082 - RNA, 19 nt, Leptospira interrogans serovar lai str. 56601
aauugugggaacucacaca

SEQ ID NO: 735083 - RNA, 21 nt, Leptospira interrogans serovar lai str. 56601
aauugugggacuauuaggaaa

SEQ ID NO: 735084 - RNA, 18 nt, Leptospira interrogans serovar lai str. 56601
aauuguguaugaguuccu

SEQ ID NO: 735085 - RNA, 19 nt, Leptospira interrogans serovar lai str. 56601
aauuguaacaguucucaca

SEQ ID NO: 735086 - RNA, 15 nt, Leptospira interrogans serovar lai str. 56601
aauuguaggaacuac

SEQ ID NO: 735087 - RNA, 16 nt, Leptospira interrogans serovar lai str. 56601
aauuguaggaguucau

SEQ ID NO: 735088 - RNA, 21 nt, Leptospira interrogans serovar lai str. 56601
aauuguauccgaaaaauucca

SEQ ID NO: 735089 - RNA, 17 nt, Leptospira interrogans serovar lai str. 56601
aauuggaauaucggaau

SEQ ID NO: 735090 - RNA, 22 nt, Leptospira interrogans serovar lai str. 56601
aauugaauucuuccuucuugaa

SEQ ID NO: 735091 - RNA, 22 nt, Leptospira interrogans serovar lai str. 56601
aauugaguuuuuuauucccaaa

SEQ ID NO: 735092 - RNA, 23 nt, Leptospira interrogans serovar lai str. 56601
aauugcacauaaaagaccuucgg

SEQ ID NO: 735093 - RNA, 14 nt, Leptospira interrogans serovar lai str. 56601
aauucuuugaacca

SEQ ID NO: 735094 - RNA, 13 nt, Leptospira interrogans serovar lai str. 56601
aauucguuccaaa

SEQ ID NO: 735095 - RNA, 18 nt, Leptospira interrogans serovar lai str. 56601
aauucguugagacgaaaa

SEQ ID NO: 735096 - RNA, 14 nt, Leptospira interrogans serovar lai str. 56601
aauucgguugacuc

SEQ ID NO: 735097 - RNA, 21 nt, Leptospira interrogans serovar lai str. 56601
aauuaaagcgucucauuucuu

SEQ ID NO: 735098 - RNA, 16 nt, Leptospira interrogans serovar lai str. 56601
aaugcuauugaauccu

SEQ ID NO: 735099 - RNA, 16 nt, Leptospira interrogans serovar lai str. 56601
aauuccuuccaaguuu

SEQ ID NO: 735100 - RNA, 22 nt, Leptospira interrogans serovar lai str. 56601
aauucgccguaaaaaauccaug

SEQ ID NO: 735101 - RNA, 20 nt, Leptospira interrogans serovar lai str. 56601
aauuauuuacuuuuuccaaa

SEQ ID NO: 735102 - RNA, 13 nt, Leptospira interrogans serovar lai str. 56601
aauucagauuuca

SEQ ID NO: 735103 - RNA, 23 nt, Leptospira interrogans serovar lai str. 56601
aaucuauucuuaaaauguaggaa

SEQ ID NO: 735104 - RNA, 15 nt, Leptospira interrogans serovar lai str. 56601
aaucugaaauucauc

SEQ ID NO: 735105 - RNA, 16 nt, Leptospira interrogans serovar lai str. 56601
uuuugggauuugaauu

SEQ ID NO: 735106 - RNA, 14 nt, Leptospira interrogans serovar lai str. 56601
uuuuguaguaguuc

SEQ ID NO: 735107 - RNA, 13 nt, Leptospira interrogans serovar lai str. 56601
uuuuguaacuuuu

SEQ ID NO: 735108 - RNA, 21 nt, Leptospira interrogans serovar lai str. 56601
uuuuuccaaaagcaaaaucga

SEQ ID NO: 735109 - RNA, 12 nt, Leptospira interrogans serovar lai str. 56601
uuuuucgcaaau

SEQ ID NO: 735110 - RNA, 16 nt, Leptospira interrogans serovar lai str. 56601
uuuuuccuuuuacgga

SEQ ID NO: 735111 - RNA, 20 nt, Leptospira interrogans serovar lai str. 56601
uuuuucugaaaaaagcugaa

SEQ ID NO: 735112 - RNA, 20 nt, Leptospira interrogans serovar lai str. 56601
uuuuucugaaaaaaguugaa

SEQ ID NO: 735113 - RNA, 15 nt, Leptospira interrogans serovar lai str. 56601
uuuuucugaaaaagu

SEQ ID NO: 735114 - RNA, 13 nt, Leptospira interrogans serovar lai str. 56601
aaucuuuaaguuu

SEQ ID NO: 735115 - RNA, 20 nt, Leptospira interrogans serovar lai str. 56601
aaucugugggaacucucaca

SEQ ID NO: 735116 - RNA, 12 nt, Leptospira interrogans serovar lai str. 56601
aaugcaaguucu

SEQ ID NO: 735117 - RNA, 11 nt, Leptospira interrogans serovar lai str. 56601
uuuuauuucua

SEQ ID NO: 735118 - RNA, 11 nt, Leptospira interrogans serovar lai str. 56601
uuuuauuucug

SEQ ID NO: 735119 - RNA, 13 nt, Leptospira interrogans serovar lai str. 56601
uuuuaucgcaaag

SEQ ID NO: 735120 - RNA, 16 nt, Leptospira interrogans serovar lai str. 56601
uuuuauguaauauuuc

SEQ ID NO: 735121 - RNA, 16 nt, Leptospira interrogans serovar lai str. 56601
uuuuaaguaauauuuc

SEQ ID NO: 735122 - RNA, 17 nt, Leptospira interrogans serovar lai str. 56601
uuuuaacaacucuaauu

SEQ ID NO: 735123 - RNA, 17 nt, Leptospira interrogans serovar lai str. 56601
uuuuaagaaaacucaaa

SEQ ID NO: 735124 - RNA, 23 nt, Leptospira interrogans serovar lai str. 56601
uuucucccuuaccuccuuuuuca

SEQ ID NO: 735125 - RNA, 21 nt, Leptospira interrogans serovar lai str. 56601
uuuucccgcuaaaaguacuuc

SEQ ID NO: 735126 - RNA, 15 nt, Leptospira interrogans serovar lai str. 56601
uuuuccucgaauuca

SEQ ID NO: 735127 - RNA, 13 nt, Leptospira interrogans serovar lai str. 56601
uuuucagguugaa

SEQ ID NO: 735128 - RNA, 21 nt, Leptospira interrogans serovar lai str. 56601
uuuucacaaaaaaauucuccu

SEQ ID NO: 735129 - RNA, 15 nt, Leptospira interrogans serovar lai str. 56601
uuuucuaaugcauuu

SEQ ID NO: 735130 - RNA, 13 nt, Leptospira interrogans serovar lai str. 56601
uuuucuaguuuuc

SEQ ID NO: 735131 - RNA, 13 nt, Leptospira interrogans serovar lai str. 56601
uuuugagauuaca

SEQ ID NO: 735132 - RNA, 21 nt, Leptospira interrogans serovar lai str. 56601
uuuccaaaagcaaaaucgauu

SEQ ID NO: 735133 - RNA, 21 nt, Leptospira interrogans serovar lai str. 56601
uuuccaaccauuuaauagauc

SEQ ID NO: 735134 - RNA, 21 nt, Leptospira interrogans serovar lai str. 56601
uuuccguaccccaaagauuuc

SEQ ID NO: 735135 - RNA, 17 nt, Leptospira interrogans serovar lai str. 56601
uuucgaccuuaacucuu

SEQ ID NO: 735136 - RNA, 16 nt, Leptospira interrogans serovar lai str. 56601
uuuaucuuagaguugu

SEQ ID NO: 735137 - RNA, 13 nt, Leptospira interrogans serovar lai str. 56601
uuuauaaauugug

SEQ ID NO: 735138 - RNA, 18 nt, Leptospira interrogans serovar lai str. 56601
uuuauucguaaaaucuua

SEQ ID NO: 735139 - RNA, 17 nt, Leptospira interrogans serovar lai str. 56601
uuucaaaaaaucgacuu

SEQ ID NO: 735140 - RNA, 16 nt, Leptospira interrogans serovar lai str. 56601
uuucaaaaucuucaaa

SEQ ID NO: 735141 - RNA, 12 nt, Leptospira interrogans serovar lai str. 56601
uuucaaguuuuc

SEQ ID NO: 735142 - RNA, 22 nt, Leptospira interrogans serovar lai str. 56601
uuucaauacaauaaaaacagau

SEQ ID NO: 735143 - RNA, 17 nt, Leptospira interrogans serovar lai str. 56601
aaucgaaacuauaacgg

SEQ ID NO: 735144 - RNA, 13 nt, Leptospira interrogans serovar lai str. 56601
uuguuaugcaaau

SEQ ID NO: 735145 - RNA, 15 nt, Leptospira interrogans serovar lai str. 56601
uuuaagaaucaucuu

SEQ ID NO: 735146 - RNA, 17 nt, Leptospira interrogans serovar lai str. 56601
uuuacgaacaaauucua

SEQ ID NO: 735147 - RNA, 15 nt, Leptospira interrogans serovar lai str. 56601
uuuagaaaauucaaa

SEQ ID NO: 735148 - RNA, 18 nt, Leptospira interrogans serovar lai str. 56601
uuuagacaaaaaauucuu

SEQ ID NO: 735149 - RNA, 23 nt, Leptospira interrogans serovar lai str. 56601
uuuagaaucaaaaugaacucaac

SEQ ID NO: 735150 - RNA, 23 nt, Leptospira interrogans serovar lai str. 56601
uuuagauaagagacaaauauuuc

SEQ ID NO: 735151 - RNA, 14 nt, Leptospira interrogans serovar lai str. 56601
uuuaguaguauuua

SEQ ID NO: 735152 - RNA, 13 nt, Leptospira interrogans serovar lai str. 56601
uuguagagauuga

SEQ ID NO: 735153 - RNA, 14 nt, Leptospira interrogans serovar lai str. 56601
uuggaaucuaaacu

SEQ ID NO: 735154 - RNA, 22 nt, Leptospira interrogans serovar lai str. 56601
uuggagaccaaaaaucaaauuu

SEQ ID NO: 735155 - RNA, 20 nt, Leptospira interrogans serovar lai str. 56601
uuggaacuuuuuaucauuag

SEQ ID NO: 735156 - RNA, 15 nt, Leptospira interrogans serovar lai str. 56601
uugcgaaagugaucc

SEQ ID NO: 735157 - RNA, 19 nt, Leptospira interrogans serovar lai str. 56601
uugaauacguuuacuccaa

SEQ ID NO: 735158 - RNA, 19 nt, Leptospira interrogans serovar lai str. 56601
uugaauauagcacaaauga

SEQ ID NO: 735159 - RNA, 11 nt, Leptospira interrogans serovar lai str. 56601
uugaacucaau

SEQ ID NO: 735160 - RNA, 17 nt, Leptospira interrogans serovar lai str. 56601
uugaccggcuucgaucg

SEQ ID NO: 735161 - RNA, 16 nt, Leptospira interrogans serovar lai str. 56601
uugaguucgacguaag

SEQ ID NO: 735162 - RNA, 16 nt, Leptospira interrogans serovar lai str. 56601
uugaguuugacguaag

SEQ ID NO: 735163 - RNA, 15 nt, Leptospira interrogans serovar lai str. 56601
uugagaaaaguguuu

SEQ ID NO: 735164 - RNA, 17 nt, Leptospira interrogans serovar lai str. 56601
uucugaaaguaguauuc

SEQ ID NO: 735165 - RNA, 15 nt, Leptospira interrogans serovar lai str. 56601
uucuauaaacucaaa

SEQ ID NO: 735166 - RNA, 18 nt, Leptospira interrogans serovar lai str. 56601
uucuauaaacucaaagaa

SEQ ID NO: 735167 - RNA, 14 nt, Leptospira interrogans serovar lai str. 56601
uucucauauugaaa

SEQ ID NO: 735168 - RNA, 14 nt, Leptospira interrogans serovar lai str. 56601
uucuugaacucaau

SEQ ID NO: 735169 - RNA, 18 nt, Leptospira interrogans serovar lai str. 56601
uucuucuccucuuccgga

SEQ ID NO: 735170 - RNA, 14 nt, Leptospira interrogans serovar lai str. 56601
uucuuugaacuuuu

SEQ ID NO: 735171 - RNA, 13 nt, Leptospira interrogans serovar lai str. 56601
uucuuuucaaaag

SEQ ID NO: 735172 - RNA, 22 nt, Leptospira interrogans serovar lai str. 56601
uucuuuuccaaaaacuuucgga

SEQ ID NO: 735173 - RNA, 15 nt, Leptospira interrogans serovar lai str. 56601
uugaaaauucuaaga

SEQ ID NO: 735174 - RNA, 23 nt, Leptospira interrogans serovar lai str. 56601
uugaaaaaguugggaucuaaacu

SEQ ID NO: 735175 - RNA, 19 nt, Leptospira interrogans serovar lai str. 56601
uugaaaggugauuccggua

SEQ ID NO: 735176 - RNA, 14 nt, Leptospira interrogans serovar lai str. 56601
uugaaaguaucaga

SEQ ID NO: 735177 - RNA, 15 nt, Leptospira interrogans serovar lai str. 56601
uugaaauucagaucu

SEQ ID NO: 735178 - RNA, 20 nt, Leptospira interrogans serovar lai str. 56601
uuccgucuuuuguaaguuuu

SEQ ID NO: 735179 - RNA, 15 nt, Leptospira interrogans serovar lai str. 56601
uuccucuugaagauu

SEQ ID NO: 735180 - RNA, 12 nt, Leptospira interrogans serovar lai str. 56601
uucaauuaacaa

SEQ ID NO: 735181 - RNA, 21 nt, Leptospira interrogans serovar lai str. 56601
uucaauuucuuuaauuucaau

SEQ ID NO: 735182 - RNA, 20 nt, Leptospira interrogans serovar lai str. 56601
uucaacuuuccuuuucgaau

SEQ ID NO: 735183 - RNA, 20 nt, Leptospira interrogans serovar lai str. 56601
uucaacaacucuauuaaaga

SEQ ID NO: 735184 - RNA, 23 nt, Leptospira interrogans serovar lai str. 56601
uucaacaacucucuuguaguuca

SEQ ID NO: 735185 - RNA, 23 nt, Leptospira interrogans serovar lai str. 56601
uucaacaagcuuuggauuuugau

SEQ ID NO: 735186 - RNA, 20 nt, Leptospira interrogans serovar lai str. 56601
uucaaagaaaugugggaacu

SEQ ID NO: 735187 - RNA, 17 nt, Leptospira interrogans serovar lai str. 56601
uuacgaacuuucgagca

SEQ ID NO: 735188 - RNA, 17 nt, Leptospira interrogans serovar lai str. 56601
uuacucgauaauucuuu

SEQ ID NO: 735189 - RNA, 10 nt, Leptospira interrogans serovar lai str. 56601
uuacugaucu

SEQ ID NO: 735190 - RNA, 16 nt, Leptospira interrogans serovar lai str. 56601
uuaccuugaaacuuuu

SEQ ID NO: 735191 - RNA, 14 nt, Leptospira interrogans serovar lai str. 56601
uuacuuuuuccaaa

SEQ ID NO: 735192 - RNA, 19 nt, Leptospira interrogans serovar lai str. 56601
uuauaauucugaauaauug

SEQ ID NO: 735193 - RNA, 22 nt, Leptospira interrogans serovar lai str. 56601
uuacuugaucagacgaaaucga

SEQ ID NO: 735194 - RNA, 21 nt, Leptospira interrogans serovar lai str. 56601
uuagaaauuuuuaauaacaug

SEQ ID NO: 735195 - RNA, 19 nt, Leptospira interrogans serovar lai str. 56601
uuauaguuuuuaacuguuu

SEQ ID NO: 735196 - RNA, 11 nt, Leptospira interrogans serovar lai str. 56601
uuaucuucgaa

SEQ ID NO: 735197 - RNA, 13 nt, Leptospira interrogans serovar lai str. 56601
uuaucuucgaaau

SEQ ID NO: 735198 - RNA, 19 nt, Leptospira interrogans serovar lai str. 56601
uguuuuagaaucuagacgu

SEQ ID NO: 735199 - RNA, 18 nt, Leptospira interrogans serovar lai str. 56601
uguuucaaaaguuagaau

SEQ ID NO: 735200 - RNA, 13 nt, Leptospira interrogans serovar lai str. 56601
uguuucuuuauca

SEQ ID NO: 735201 - RNA, 13 nt, Leptospira interrogans serovar lai str. 56601
uuaaaauaacgug

SEQ ID NO: 735202 - RNA, 12 nt, Leptospira interrogans serovar lai str. 56601
uuaaaaucggaa

SEQ ID NO: 735203 - RNA, 17 nt, Leptospira interrogans serovar lai str. 56601
uuaacguuuucuaucuu

SEQ ID NO: 735204 - RNA, 23 nt, Leptospira interrogans serovar lai str. 56601
uuaauuaaaaaaucauauccaau

SEQ ID NO: 735205 - RNA, 17 nt, Leptospira interrogans serovar lai str. 56601
uuaauuucaauaacuug

SEQ ID NO: 735206 - RNA, 13 nt, Leptospira interrogans serovar lai str. 56601
uuaagcaaaugcc

SEQ ID NO: 735207 - RNA, 13 nt, Leptospira interrogans serovar lai str. 56601
uuaaguaggaacu

SEQ ID NO: 735208 - RNA, 15 nt, Leptospira interrogans serovar lai str. 56601
uuaaguaggaacuac

SEQ ID NO: 735209 - RNA, 14 nt, Leptospira interrogans serovar lai str. 56601
acguaaggaacuca

SEQ ID NO: 735210 - RNA, 13 nt, Leptospira interrogans serovar lai str. 56601
acguauuccaagg

SEQ ID NO: 735211 - RNA, 20 nt, Leptospira interrogans serovar lai str. 56601
acuaauucaauaaguuuaca

SEQ ID NO: 735212 - RNA, 16 nt, Leptospira interrogans serovar lai str. 56601
acuaauuuguaggaau

SEQ ID NO: 735213 - RNA, 14 nt, Leptospira interrogans serovar lai str. 56601
acuaccacagaaag

SEQ ID NO: 735214 - RNA, 13 nt, Leptospira interrogans serovar lai str. 56601
acguuauucuauu

SEQ ID NO: 735215 - RNA, 23 nt, Leptospira interrogans serovar lai str. 56601
acguuaucgaucgagacuucgaa

SEQ ID NO: 735216 - RNA, 19 nt, Leptospira interrogans serovar lai str. 56601
acgugauaauucuuuagaa

SEQ ID NO: 735217 - RNA, 16 nt, Leptospira interrogans serovar lai str. 56601
acuauuuuauuacaau

SEQ ID NO: 735218 - RNA, 21 nt, Leptospira interrogans serovar lai str. 56601
acucaaagaaucgagauugau

SEQ ID NO: 735219 - RNA, 19 nt, Leptospira interrogans serovar lai str. 56601
acucauaaaauaacuucca

SEQ ID NO: 735220 - RNA, 19 nt, Leptospira interrogans serovar lai str. 56601
acucuaaaucuuaggaacu

SEQ ID NO: 735221 - RNA, 15 nt, Leptospira interrogans serovar lai str. 56601
acucuauagauugau

SEQ ID NO: 735222 - RNA, 18 nt, Leptospira interrogans serovar lai str. 56601
acuuaaucugugggaacu

SEQ ID NO: 735223 - RNA, 16 nt, Leptospira interrogans serovar lai str. 56601
acuuaaggguugcauu

SEQ ID NO: 735224 - RNA, 14 nt, Leptospira interrogans serovar lai str. 56601
acuuucgagcaguu

SEQ ID NO: 735225 - RNA, 21 nt, Leptospira interrogans serovar lai str. 56601
acuuucgagcaguucuaaugu

SEQ ID NO: 735226 - RNA, 17 nt, Leptospira interrogans serovar lai str. 56601
acuuugcagacugauuc

SEQ ID NO: 735227 - RNA, 17 nt, Leptospira interrogans serovar lai str. 56601
acuuuacagacugauuu

SEQ ID NO: 735228 - RNA, 17 nt, Leptospira interrogans serovar lai str. 56601
acuuuauagucaaauuu

SEQ ID NO: 735229 - RNA, 19 nt, Leptospira interrogans serovar lai str. 56601
acuuuauucaaaauagaau

SEQ ID NO: 735230 - RNA, 14 nt, Leptospira interrogans serovar lai str. 56601
acuuuauuuacagu

SEQ ID NO: 735231 - RNA, 21 nt, Leptospira interrogans serovar lai str. 56601
agaaaaaaccuccguucccac

SEQ ID NO: 735232 - RNA, 18 nt, Leptospira interrogans serovar lai str. 56601
agaaaaaauuuuucuuaa

SEQ ID NO: 735233 - RNA, 15 nt, Leptospira interrogans serovar lai str. 56601
acuuuuuaucauuag

SEQ ID NO: 735234 - RNA, 14 nt, Leptospira interrogans serovar lai str. 56601
acuuuuuacaugag

SEQ ID NO: 735235 - RNA, 15 nt, Leptospira interrogans serovar lai str. 56601
agaaaaauuuuccga

SEQ ID NO: 735236 - RNA, 17 nt, Leptospira interrogans serovar lai str. 56601
agaaaaauuuuccgaac

SEQ ID NO: 735237 - RNA, 19 nt, Leptospira interrogans serovar lai str. 56601
acuuuuuuuagaaucauag

SEQ ID NO: 735238 - RNA, 22 nt, Leptospira interrogans serovar lai str. 56601
agaaaacuugguuggauuccuu

SEQ ID NO: 735239 - RNA, 23 nt, Leptospira interrogans serovar lai str. 56601
acuuugguuuguaauaguuccca

SEQ ID NO: 735240 - RNA, 15 nt, Leptospira interrogans serovar lai str. 56601
acuuuguaaauugug

SEQ ID NO: 735241 - RNA, 18 nt, Leptospira interrogans serovar lai str. 56601
acuuuuagauaauuauuc

SEQ ID NO: 735242 - RNA, 17 nt, Leptospira interrogans serovar lai str. 56601
acuucuuccauucuaaa

SEQ ID NO: 735243 - RNA, 13 nt, Leptospira interrogans serovar lai str. 56601
acuucucaaauug

SEQ ID NO: 735244 - RNA, 13 nt, Leptospira interrogans serovar lai str. 56601
acuucuaacgcaa

SEQ ID NO: 735245 - RNA, 14 nt, Leptospira interrogans serovar lai str. 56601
acuugaacuguuua

SEQ ID NO: 735246 - RNA, 20 nt, Leptospira interrogans serovar lai str. 56601
acuugaacuguuuaauuucu

SEQ ID NO: 735247 - RNA, 11 nt, Leptospira interrogans serovar lai str. 56601
acgcugaguuu

SEQ ID NO: 735248 - RNA, 17 nt, Leptospira interrogans serovar lai str. 56601
acgcucucuacggaucg

SEQ ID NO: 735249 - RNA, 17 nt, Leptospira interrogans serovar lai str. 56601
acgauaauuuucuuuag

SEQ ID NO: 735250 - RNA, 20 nt, Leptospira interrogans serovar lai str. 56601
acgauugaucagacugauau

SEQ ID NO: 735251 - RNA, 17 nt, Leptospira interrogans serovar lai str. 56601
accuuugauagaacucu

SEQ ID NO: 735252 - RNA, 16 nt, Leptospira interrogans serovar lai str. 56601
accuucuaaaucauag

SEQ ID NO: 735253 - RNA, 22 nt, Leptospira interrogans serovar lai str. 56601
accuaaaauucaguuucaaacu

SEQ ID NO: 735254 - RNA, 19 nt, Leptospira interrogans serovar lai str. 56601
acgaguuuaaccuuuacca

SEQ ID NO: 735255 - RNA, 15 nt, Leptospira interrogans serovar lai str. 56601
accgaauucaaguua

SEQ ID NO: 735256 - RNA, 23 nt, Leptospira interrogans serovar lai str. 56601
acccuaguuuaugugaguuccca

SEQ ID NO: 735257 - RNA, 13 nt, Leptospira interrogans serovar lai str. 56601
acaucggaaacgc

SEQ ID NO: 735258 - RNA, 20 nt, Leptospira interrogans serovar lai str. 56601
acagcgugaguucaauguaa

SEQ ID NO: 735259 - RNA, 17 nt, Leptospira interrogans serovar lai str. 56601
aauuuguaggaacuacu

SEQ ID NO: 735260 - RNA, 21 nt, Leptospira interrogans serovar lai str. 56601
aauuuguaggaacuacugcag

SEQ ID NO: 735261 - RNA, 16 nt, Leptospira interrogans serovar lai str. 56601
aauuugugaacuuucg

SEQ ID NO: 735262 - RNA, 15 nt, Leptospira interrogans serovar lai str. 56601
aauuuggaaauugug

SEQ ID NO: 735263 - RNA, 12 nt, Leptospira interrogans serovar lai str. 56601
aauuuguucaua

SEQ ID NO: 735264 - RNA, 21 nt, Leptospira interrogans serovar lai str. 56601
aauuuguuuuuaaaauuguga

SEQ ID NO: 735265 - RNA, 20 nt, Leptospira interrogans serovar lai str. 56601
aauuuugcaguaaggauucu

SEQ ID NO: 735266 - RNA, 18 nt, Leptospira interrogans serovar lai str. 56601
aauuucuuaaaagauucu

SEQ ID NO: 735267 - RNA, 23 nt, Leptospira interrogans serovar lai str. 56601
aauuucuucauaucaaauucaug

SEQ ID NO: 735268 - RNA, 13 nt, Leptospira interrogans serovar lai str. 56601
acagcaaauucug

SEQ ID NO: 735269 - RNA, 12 nt, Leptospira interrogans serovar lai str. 56601
acacuauaacaa

SEQ ID NO: 735270 - RNA, 17 nt, Leptospira interrogans serovar lai str. 56601
acauucccauccgaaau

SEQ ID NO: 735271 - RNA, 14 nt, Leptospira interrogans serovar lai str. 56601
acauuagaacuacu

SEQ ID NO: 735272 - RNA, 19 nt, Leptospira interrogans serovar lai str. 56601
accauagaagcgagacgaa

SEQ ID NO: 735273 - RNA, 20 nt, Leptospira interrogans serovar lai str. 56601
accauaaauuuuuauuacau

SEQ ID NO: 735274 - RNA, 19 nt, Leptospira interrogans serovar lai str. 56601
accaguaucguuuuccauu

SEQ ID NO: 735275 - RNA, 20 nt, Leptospira interrogans serovar lai str. 56601
accaguauucaauuccaauu

SEQ ID NO: 735276 - RNA, 15 nt, Leptospira interrogans serovar lai str. 56601
aucgaggaaauucua

SEQ ID NO: 735277 - RNA, 18 nt, Leptospira interrogans serovar lai str. 56601
aucgaggaaauucuaugu

SEQ ID NO: 735278 - RNA, 16 nt, Leptospira interrogans serovar lai str. 56601
auccgaaaaauuccac

SEQ ID NO: 735279 - RNA, 23 nt, Leptospira interrogans serovar lai str. 56601
auccuugggauaaauauucucua

SEQ ID NO: 735280 - RNA, 21 nt, Leptospira interrogans serovar lai str. 56601
auccuuucauguuauaucgaa

SEQ ID NO: 735281 - RNA, 17 nt, Leptospira interrogans serovar lai str. 56601
auccuuacuuaccucua

SEQ ID NO: 735282 - RNA, 20 nt, Leptospira interrogans serovar lai str. 56601
auccuuccaaaucugaaucu

SEQ ID NO: 735283 - RNA, 15 nt, Leptospira interrogans serovar lai str. 56601
auccucuucuuuguc

SEQ ID NO: 735284 - RNA, 21 nt, Leptospira interrogans serovar lai str. 56601
auccugaucuauguuauagac

SEQ ID NO: 735285 - RNA, 22 nt, Leptospira interrogans serovar lai str. 56601
augaaaucuaguucaacguaag

SEQ ID NO: 735286 - RNA, 18 nt, Leptospira interrogans serovar lai str. 56601
augaaacuuaguuccuac

SEQ ID NO: 735287 - RNA, 17 nt, Leptospira interrogans serovar lai str. 56601
aucuuuauuuaauacga

SEQ ID NO: 735288 - RNA, 20 nt, Leptospira interrogans serovar lai str. 56601
augaauuuucaaaaucggaa

SEQ ID NO: 735289 - RNA, 19 nt, Leptospira interrogans serovar lai str. 56601
augauagacugaucgucaa

SEQ ID NO: 735290 - RNA, 18 nt, Leptospira interrogans serovar lai str. 56601
augauagaaauauuuaga

SEQ ID NO: 735291 - RNA, 18 nt, Leptospira interrogans serovar lai str. 56601
augauauggaauuccgac

SEQ ID NO: 735292 - RNA, 12 nt, Leptospira interrogans serovar lai str. 56601
augaucaaauuc

SEQ ID NO: 735293 - RNA, 17 nt, Leptospira interrogans serovar lai str. 56601
augcauccaaucaugaa

SEQ ID NO: 735294 - RNA, 23 nt, Leptospira interrogans serovar lai str. 56601
aucuaaauuuguaauaguuccca

SEQ ID NO: 735295 - RNA, 16 nt, Leptospira interrogans serovar lai str. 56601
aucuaagaaauccguu

SEQ ID NO: 735296 - RNA, 17 nt, Leptospira interrogans serovar lai str. 56601
aucuaaaauggacugca

SEQ ID NO: 735297 - RNA, 16 nt, Leptospira interrogans serovar lai str. 56601
aucuaaauauugaucu

SEQ ID NO: 735298 - RNA, 17 nt, Leptospira interrogans serovar lai str. 56601
aucuaaauauugaucua

SEQ ID NO: 735299 - RNA, 18 nt, Leptospira interrogans serovar lai str. 56601
aucuaaauauugaucuaa

SEQ ID NO: 735300 - RNA, 18 nt, Leptospira interrogans serovar lai str. 56601
aucguuuguaaaaucgua

SEQ ID NO: 735301 - RNA, 15 nt, Leptospira interrogans serovar lai str. 56601
aucuaaaaagaauca

SEQ ID NO: 735302 - RNA, 18 nt, Leptospira interrogans serovar lai str. 56601
aucuacuuacauagaacu

SEQ ID NO: 735303 - RNA, 22 nt, Leptospira interrogans serovar lai str. 56601
aucuacuaaaucagaauaaucu

SEQ ID NO: 735304 - RNA, 20 nt, Leptospira interrogans serovar lai str. 56601
aucuaauuuguaagaacacu

SEQ ID NO: 735305 - RNA, 14 nt, Leptospira interrogans serovar lai str. 56601
aucuacauuggaag

SEQ ID NO: 735306 - RNA, 20 nt, Leptospira interrogans serovar lai str. 56601
aucuauuguaauaaaucgaa

SEQ ID NO: 735307 - RNA, 19 nt, Leptospira interrogans serovar lai str. 56601
aucuaucucaaaaauacuu

SEQ ID NO: 735308 - RNA, 19 nt, Leptospira interrogans serovar lai str. 56601
aucuugcucuaaaugacuu

SEQ ID NO: 735309 - RNA, 20 nt, Leptospira interrogans serovar lai str. 56601
aucuucucuagaaacugcau

SEQ ID NO: 735310 - RNA, 15 nt, Leptospira interrogans serovar lai str. 56601
aucuuagauucacuu

SEQ ID NO: 735311 - RNA, 21 nt, Leptospira interrogans serovar lai str. 56601
aucuuauucaauaaaauacca

SEQ ID NO: 735312 - RNA, 19 nt, Leptospira interrogans serovar lai str. 56601
aucuguuucuauuuuaugu

SEQ ID NO: 735313 - RNA, 20 nt, Leptospira interrogans serovar lai str. 56601
aucuuaauauaauaauuccg

SEQ ID NO: 735314 - RNA, 13 nt, Leptospira interrogans serovar lai str. 56601
aucuuaaaaacuu

SEQ ID NO: 735315 - RNA, 21 nt, Leptospira interrogans serovar lai str. 56601
aucuuaaauaucgaauuucuu

SEQ ID NO: 735316 - RNA, 16 nt, Leptospira interrogans serovar lai str. 56601
auugauuuacauucug

SEQ ID NO: 735317 - RNA, 17 nt, Leptospira interrogans serovar lai str. 56601
auugaagaaaaaaagau

SEQ ID NO: 735318 - RNA, 16 nt, Leptospira interrogans serovar lai str. 56601
auugaaggguaacuca

SEQ ID NO: 735319 - RNA, 17 nt, Leptospira interrogans serovar lai str. 56601
auucuuaauagaaucuu

SEQ ID NO: 735320 - RNA, 20 nt, Leptospira interrogans serovar lai str. 56601
auucuucuccucuuccggaa

SEQ ID NO: 735321 - RNA, 20 nt, Leptospira interrogans serovar lai str. 56601
auucuugagacgguucaaug

SEQ ID NO: 735322 - RNA, 14 nt, Leptospira interrogans serovar lai str. 56601
auucuuuagaaauu

SEQ ID NO: 735323 - RNA, 24 nt, Leptospira interrogans serovar lai str. 56601
auucuuuucccgcuaaaaguacuu

SEQ ID NO: 735324 - RNA, 19 nt, Leptospira interrogans serovar lai str. 56601
auugccuaaauuccuucca

SEQ ID NO: 735325 - RNA, 18 nt, Leptospira interrogans serovar lai str. 56601
auuggguauaagaagauu

SEQ ID NO: 735326 - RNA, 15 nt, Leptospira interrogans serovar lai str. 56601
auugguagauugcuu

SEQ ID NO: 735327 - RNA, 14 nt, Leptospira interrogans serovar lai str. 56601
auucaucaaauuug

SEQ ID NO: 735328 - RNA, 16 nt, Leptospira interrogans serovar lai str. 56601
auucccuuuugaucuu

SEQ ID NO: 735329 - RNA, 21 nt, Leptospira interrogans serovar lai str. 56601
auucagaaaaaaaaagaauuu

SEQ ID NO: 735330 - RNA, 18 nt, Leptospira interrogans serovar lai str. 56601
auucagaaaaaaaaucug

SEQ ID NO: 735331 - RNA, 20 nt, Leptospira interrogans serovar lai str. 56601
auucagaaaacagaauguau

SEQ ID NO: 735332 - RNA, 18 nt, Leptospira interrogans serovar lai str. 56601
auuauguagccaaaucug

SEQ ID NO: 735333 - RNA, 20 nt, Leptospira interrogans serovar lai str. 56601
auuaaacuuuuauaaaaucu

SEQ ID NO: 735334 - RNA, 16 nt, Leptospira interrogans serovar lai str. 56601
auuaaagauuugcucu

SEQ ID NO: 735335 - RNA, 20 nt, Leptospira interrogans serovar lai str. 56601
auuaaauucuagcgucuaaa

SEQ ID NO: 735336 - RNA, 14 nt, Leptospira interrogans serovar lai str. 56601
auuaaauucuaugg

SEQ ID NO: 735337 - RNA, 18 nt, Leptospira interrogans serovar lai str. 56601
auuccuguaguauuucca

SEQ ID NO: 735338 - RNA, 13 nt, Leptospira interrogans serovar lai str. 56601
auuccuugagaaa

SEQ ID NO: 735339 - RNA, 15 nt, Leptospira interrogans serovar lai str. 56601
auucgaaauuuucag

SEQ ID NO: 735340 - RNA, 17 nt, Leptospira interrogans serovar lai str. 56601
auucgacguaaggaacu

SEQ ID NO: 735341 - RNA, 17 nt, Leptospira interrogans serovar lai str. 56601
auucgguuauugugaau

SEQ ID NO: 735342 - RNA, 16 nt, Leptospira interrogans serovar lai str. 56601
auucuaaaaaaauacg

SEQ ID NO: 735343 - RNA, 21 nt, Leptospira interrogans serovar lai str. 56601
auucuaaaauuuguaggaacu

SEQ ID NO: 735344 - RNA, 20 nt, Leptospira interrogans serovar lai str. 56601
auucuaaaguuguaggaacu

SEQ ID NO: 735345 - RNA, 19 nt, Leptospira interrogans serovar lai str. 56601
auucuacaauuguaggaau

SEQ ID NO: 735346 - RNA, 20 nt, Leptospira interrogans serovar lai str. 56601
auucuacauuuguagagauu

SEQ ID NO: 735347 - RNA, 23 nt, Leptospira interrogans serovar lai str. 56601
auucuaagaucaaagagaugauu

SEQ ID NO: 735348 - RNA, 15 nt, Leptospira interrogans serovar lai str. 56601
auucuauaaaauuug

SEQ ID NO: 735349 - RNA, 21 nt, Leptospira interrogans serovar lai str. 56601
auucuauaauacaugaauucu

SEQ ID NO: 735350 - RNA, 22 nt, Leptospira interrogans serovar lai str. 56601
auucuccauccgaauugaucuc

SEQ ID NO: 735351 - RNA, 16 nt, Leptospira interrogans serovar lai str. 56601
auucuggauugaucga

SEQ ID NO: 735352 - RNA, 17 nt, Leptospira interrogans serovar lai str. 56601
auucugcucuucuaauu

SEQ ID NO: 735353 - RNA, 22 nt, Leptospira interrogans serovar lai str. 56601
augucuacuugucuuuagaacu

SEQ ID NO: 735354 - RNA, 15 nt, Leptospira interrogans serovar lai str. 56601
augugaauucagaaa

SEQ ID NO: 735355 - RNA, 17 nt, Leptospira interrogans serovar lai str. 56601
augugggaacucucaca

SEQ ID NO: 735356 - RNA, 15 nt, Leptospira interrogans serovar lai str. 56601
augugggaacucuua

SEQ ID NO: 735357 - RNA, 15 nt, Leptospira interrogans serovar lai str. 56601
augugguaguuccca

SEQ ID NO: 735358 - RNA, 14 nt, Leptospira interrogans serovar lai str. 56601
augguaaggaaccc

SEQ ID NO: 735359 - RNA, 13 nt, Leptospira interrogans serovar lai str. 56601
auguaauuccaga

SEQ ID NO: 735360 - RNA, 23 nt, Leptospira interrogans serovar lai str. 56601
auggaagcuaacacaaguuugga

SEQ ID NO: 735361 - RNA, 13 nt, Leptospira interrogans serovar lai str. 56601
auggaaaaaagau

SEQ ID NO: 735362 - RNA, 21 nt, Leptospira interrogans serovar lai str. 56601
auggaauuuuuuaacaacucu

SEQ ID NO: 735363 - RNA, 21 nt, Leptospira interrogans serovar lai str. 56601
auggaauuuuuuaauaacucu

SEQ ID NO: 735364 - RNA, 15 nt, Leptospira interrogans serovar lai str. 56601
auggaugaauugauu

SEQ ID NO: 735365 - RNA, 20 nt, Leptospira interrogans serovar lai str. 56601
caauugacuuucuguauuuu

SEQ ID NO: 735366 - RNA, 18 nt, Leptospira interrogans serovar lai str. 56601
cacaaguuuggaaauuga

SEQ ID NO: 735367 - RNA, 22 nt, Leptospira interrogans serovar lai str. 56601
caauccucgcuuuuaauaauuc

SEQ ID NO: 735368 - RNA, 19 nt, Leptospira interrogans serovar lai str. 56601
caauauuauuuuaacuuga

SEQ ID NO: 735369 - RNA, 23 nt, Leptospira interrogans serovar lai str. 56601
caaucacguucaacguucaaaca

SEQ ID NO: 735370 - RNA, 18 nt, Leptospira interrogans serovar lai str. 56601
caaucugggugaauccgg

SEQ ID NO: 735371 - RNA, 17 nt, Leptospira interrogans serovar lai str. 56601
caauaucccaaauucga

SEQ ID NO: 735372 - RNA, 24 nt, Leptospira interrogans serovar lai str. 56601
caauagaaauacuucuccacgauu

SEQ ID NO: 735373 - RNA, 22 nt, Leptospira interrogans serovar lai str. 56601
caauaaguuuacaucaacucug

SEQ ID NO: 735374 - RNA, 22 nt, Leptospira interrogans serovar lai str. 56601
caaguucgccuacacuguguuc

SEQ ID NO: 735375 - RNA, 16 nt, Leptospira interrogans serovar lai str. 56601
caaguugaauaggauu

SEQ ID NO: 735376 - RNA, 16 nt, Leptospira interrogans serovar lai str. 56601
caaguaaaaagacuca

SEQ ID NO: 735377 - RNA, 15 nt, Leptospira interrogans serovar lai str. 56601
caagcuuuaaauuca

SEQ ID NO: 735378 - RNA, 16 nt, Leptospira interrogans serovar lai str. 56601
caaccgcaccaucuaa

SEQ ID NO: 735379 - RNA, 17 nt, Leptospira interrogans serovar lai str. 56601
caaauucuaaacuugua

SEQ ID NO: 735380 - RNA, 17 nt, Leptospira interrogans serovar lai str. 56601
caaauucucauuuagag

SEQ ID NO: 735381 - RNA, 14 nt, Leptospira interrogans serovar lai str. 56601
caaauuuauaugau

SEQ ID NO: 735382 - RNA, 15 nt, Leptospira interrogans serovar lai str. 56601
caaaucacgauuuua

SEQ ID NO: 735383 - RNA, 21 nt, Leptospira interrogans serovar lai str. 56601
caaaucacaauuuuacaaaca

SEQ ID NO: 735384 - RNA, 18 nt, Leptospira interrogans serovar lai str. 56601
auuguguguuacgguaau

SEQ ID NO: 735385 - RNA, 16 nt, Leptospira interrogans serovar lai str. 56601
auuguguuaguuccca

SEQ ID NO: 735386 - RNA, 23 nt, Leptospira interrogans serovar lai str. 56601
auuguugaaaaauuuauucucua

SEQ ID NO: 735387 - RNA, 20 nt, Leptospira interrogans serovar lai str. 56601
auuguuuaaauagauucaaa

SEQ ID NO: 735388 - RNA, 20 nt, Leptospira interrogans serovar lai str. 56601
caaaauuuagaauuguuauc

SEQ ID NO: 735389 - RNA, 18 nt, Leptospira interrogans serovar lai str. 56601
caaaauuugauccucuaa

SEQ ID NO: 735390 - RNA, 20 nt, Leptospira interrogans serovar lai str. 56601
caaaauuuugcuucugaaca

SEQ ID NO: 735391 - RNA, 18 nt, Leptospira interrogans serovar lai str. 56601
caaacucuuaaucugcug

SEQ ID NO: 735392 - RNA, 13 nt, Leptospira interrogans serovar lai str. 56601
auauuauauuucg

SEQ ID NO: 735393 - RNA, 18 nt, Leptospira interrogans serovar lai str. 56601
auauuuccaaauuguaug

SEQ ID NO: 735394 - RNA, 14 nt, Leptospira interrogans serovar lai str. 56601
auauuuaacuguaa

SEQ ID NO: 735395 - RNA, 14 nt, Leptospira interrogans serovar lai str. 56601
auauuagaacugcu

SEQ ID NO: 735396 - RNA, 14 nt, Leptospira interrogans serovar lai str. 56601
auauuaagaauucu

SEQ ID NO: 735397 - RNA, 17 nt, Leptospira interrogans serovar lai str. 56601
auauuaagaauucuaaa

SEQ ID NO: 735398 - RNA, 18 nt, Leptospira interrogans serovar lai str. 56601
aucaaacucguuucgucu

SEQ ID NO: 735399 - RNA, 22 nt, Leptospira interrogans serovar lai str. 56601
aucaaacuuauaacugcaagaa

SEQ ID NO: 735400 - RNA, 21 nt, Leptospira interrogans serovar lai str. 56601
auauuuucgccgaaacauucg

SEQ ID NO: 735401 - RNA, 22 nt, Leptospira interrogans serovar lai str. 56601
auauuuucgccgaaacauucgg

SEQ ID NO: 735402 - RNA, 19 nt, Leptospira interrogans serovar lai str. 56601
auauuuuacaguaaaacuu

SEQ ID NO: 735403 - RNA, 17 nt, Leptospira interrogans serovar lai str. 56601
aucaaauacaaaaacga

SEQ ID NO: 735404 - RNA, 15 nt, Leptospira interrogans serovar lai str. 56601
aucagaauaaucucc

SEQ ID NO: 735405 - RNA, 18 nt, Leptospira interrogans serovar lai str. 56601
aucagauugauacugcau

SEQ ID NO: 735406 - RNA, 15 nt, Leptospira interrogans serovar lai str. 56601
aucagauuuuuucug

SEQ ID NO: 735407 - RNA, 14 nt, Leptospira interrogans serovar lai str. 56601
auagaguucugaaa

SEQ ID NO: 735408 - RNA, 14 nt, Leptospira interrogans serovar lai str. 56601
auagaucgauucuu

SEQ ID NO: 735409 - RNA, 18 nt, Leptospira interrogans serovar lai str. 56601
auacuuaagcucuaauau

SEQ ID NO: 735410 - RNA, 14 nt, Leptospira interrogans serovar lai str. 56601
auacguuauuuccg

SEQ ID NO: 735411 - RNA, 15 nt, Leptospira interrogans serovar lai str. 56601
auaauguggaacucu

SEQ ID NO: 735412 - RNA, 17 nt, Leptospira interrogans serovar lai str. 56601
auaauuuaguuuuugua

SEQ ID NO: 735413 - RNA, 15 nt, Leptospira interrogans serovar lai str. 56601
auaauucuaucgauu

SEQ ID NO: 735414 - RNA, 18 nt, Leptospira interrogans serovar lai str. 56601
auaauucaagacuuuaua

SEQ ID NO: 735415 - RNA, 20 nt, Leptospira interrogans serovar lai str. 56601
auaauuagaaaaauauuuug

SEQ ID NO: 735416 - RNA, 19 nt, Leptospira interrogans serovar lai str. 56601
aguuuaugugaguucccau

SEQ ID NO: 735417 - RNA, 17 nt, Leptospira interrogans serovar lai str. 56601
aguuuaacuguaaaucc

SEQ ID NO: 735418 - RNA, 15 nt, Leptospira interrogans serovar lai str. 56601
aguuguauccccaua

SEQ ID NO: 735419 - RNA, 13 nt, Leptospira interrogans serovar lai str. 56601
auaaaaacuacau

SEQ ID NO: 735420 - RNA, 20 nt, Leptospira interrogans serovar lai str. 56601
aguuuuuucaaaaauuccaa

SEQ ID NO: 735421 - RNA, 14 nt, Leptospira interrogans serovar lai str. 56601
aguuuugucaaucu

SEQ ID NO: 735422 - RNA, 17 nt, Leptospira interrogans serovar lai str. 56601
aguuuuccuucuagaua

SEQ ID NO: 735423 - RNA, 17 nt, Leptospira interrogans serovar lai str. 56601
aguuuuugugacuuccu

SEQ ID NO: 735424 - RNA, 14 nt, Leptospira interrogans serovar lai str. 56601
aguuuuuagugauu

SEQ ID NO: 735425 - RNA, 17 nt, Leptospira interrogans serovar lai str. 56601
aguuuuucaacaacucu

SEQ ID NO: 735426 - RNA, 22 nt, Leptospira interrogans serovar lai str. 56601
auaaaauccccaguauuuugca

SEQ ID NO: 735427 - RNA, 16 nt, Leptospira interrogans serovar lai str. 56601
auaaacucaaagaauu

SEQ ID NO: 735428 - RNA, 14 nt, Leptospira interrogans serovar lai str. 56601
agucgaaagaauuu

SEQ ID NO: 735429 - RNA, 16 nt, Leptospira interrogans serovar lai str. 56601
aguucgguauacgaau

SEQ ID NO: 735430 - RNA, 22 nt, Leptospira interrogans serovar lai str. 56601
aguuccuauauuuuaaauucaa

SEQ ID NO: 735431 - RNA, 18 nt, Leptospira interrogans serovar lai str. 56601
aguucccaaauugccaaa

SEQ ID NO: 735432 - RNA, 20 nt, Leptospira interrogans serovar lai str. 56601
aguucccacauuuuugugaa

SEQ ID NO: 735433 - RNA, 23 nt, Leptospira interrogans serovar lai str. 56601
aguucccaccuuuuuuuaugaaa

SEQ ID NO: 735434 - RNA, 15 nt, Leptospira interrogans serovar lai str. 56601
aguuccgcgauugaa

SEQ ID NO: 735435 - RNA, 18 nt, Leptospira interrogans serovar lai str. 56601
aguuccgaaaauuugaaa

SEQ ID NO: 735436 - RNA, 16 nt, Leptospira interrogans serovar lai str. 56601
aggauuccauugauuu

SEQ ID NO: 735437 - RNA, 14 nt, Leptospira interrogans serovar lai str. 56601
aggauguaauucca

SEQ ID NO: 735438 - RNA, 19 nt, Leptospira interrogans serovar lai str. 56601
aggauuacuaaugcaaucc

SEQ ID NO: 735439 - RNA, 12 nt, Leptospira interrogans serovar lai str. 56601
aguaaaaucgag

SEQ ID NO: 735440 - RNA, 21 nt, Leptospira interrogans serovar lai str. 56601
aguaaucuuuuuaaaaguuug

SEQ ID NO: 735441 - RNA, 15 nt, Leptospira interrogans serovar lai str. 56601
aguauauauuaaagu

SEQ ID NO: 735442 - RNA, 16 nt, Leptospira interrogans serovar lai str. 56601
aguccuuuuugagaaa

SEQ ID NO: 735443 - RNA, 20 nt, Leptospira interrogans serovar lai str. 56601
aguccuuuuugagaaacuuc

SEQ ID NO: 735444 - RNA, 18 nt, Leptospira interrogans serovar lai str. 56601
agucauuuccuccaaaca

SEQ ID NO: 735445 - RNA, 22 nt, Leptospira interrogans serovar lai str. 56601
agaaaaucugggcgaaucgcuc

SEQ ID NO: 735446 - RNA, 22 nt, Leptospira interrogans serovar lai str. 56601
agaaacaaggcuuuguaauaaa

SEQ ID NO: 735447 - RNA, 20 nt, Leptospira interrogans serovar lai str. 56601
agaaacacucccccuuccga

SEQ ID NO: 735448 - RNA, 17 nt, Leptospira interrogans serovar lai str. 56601
agaaagcucuccaucuu

SEQ ID NO: 735449 - RNA, 17 nt, Leptospira interrogans serovar lai str. 56601
agaaaggaacuaaguuu

SEQ ID NO: 735450 - RNA, 20 nt, Leptospira interrogans serovar lai str. 56601
agaaagaauuuguucauaaa

SEQ ID NO: 735451 - RNA, 18 nt, Leptospira interrogans serovar lai str. 56601
agagaguucuacugaguu

SEQ ID NO: 735452 - RNA, 21 nt, Leptospira interrogans serovar lai str. 56601
agagagcguuuuacugaguuu

SEQ ID NO: 735453 - RNA, 21 nt, Leptospira interrogans serovar lai str. 56601
agaggaguccaugauucugaa

SEQ ID NO: 735454 - RNA, 14 nt, Leptospira interrogans serovar lai str. 56601
agaucaauucuuaa

SEQ ID NO: 735455 - RNA, 15 nt, Leptospira interrogans serovar lai str. 56601
agaucaauucuuuaa

SEQ ID NO: 735456 - RNA, 15 nt, Leptospira interrogans serovar lai str. 56601
agccaauuccaaacg

SEQ ID NO: 735457 - RNA, 16 nt, Leptospira interrogans serovar lai str. 56601
agcguuuuacugaguu

SEQ ID NO: 735458 - RNA, 16 nt, Leptospira interrogans serovar lai str. 56601
agcucagauuccaacu

SEQ ID NO: 735459 - RNA, 22 nt, Leptospira interrogans serovar lai str. 56601
ccaugauuuguaauaguuccca

SEQ ID NO: 735460 - RNA, 23 nt, Leptospira interrogans serovar lai str. 56601
ccaaucaugaauauuuuccaaaa

SEQ ID NO: 735461 - RNA, 16 nt, Leptospira interrogans serovar lai str. 56601
cauuuccaaucgccuc

SEQ ID NO: 735462 - RNA, 19 nt, Leptospira interrogans serovar lai str. 56601
cauugaguuacgcugaguu

SEQ ID NO: 735463 - RNA, 21 nt, Leptospira interrogans serovar lai str. 56601
cauucgggucgauagaaagua

SEQ ID NO: 735464 - RNA, 12 nt, Leptospira interrogans serovar lai str. 56601
cauuuuucaagu

SEQ ID NO: 735465 - RNA, 22 nt, Leptospira interrogans serovar lai str. 56601
cauuuuuccguaaaaaguuaau

SEQ ID NO: 735466 - RNA, 13 nt, Leptospira interrogans serovar lai str. 56601
cauuugaauacga

SEQ ID NO: 735467 - RNA, 15 nt, Leptospira interrogans serovar lai str. 56601
cauuugauugcaaau

SEQ ID NO: 735468 - RNA, 22 nt, Leptospira interrogans serovar lai str. 56601
cauuucuguaacauccaaacuc

SEQ ID NO: 735469 - RNA, 13 nt, Leptospira interrogans serovar lai str. 56601
ccaaaauuuagaa

SEQ ID NO: 735470 - RNA, 14 nt, Leptospira interrogans serovar lai str. 56601
ccaaaaucguccaa

SEQ ID NO: 735471 - RNA, 23 nt, Leptospira interrogans serovar lai str. 56601
cauuagagucguugaaaauucua

SEQ ID NO: 735472 - RNA, 23 nt, Leptospira interrogans serovar lai str. 56601
cauuagaguuguugaacauucca

SEQ ID NO: 735473 - RNA, 23 nt, Leptospira interrogans serovar lai str. 56601
cauguuuuaaugaaaaauuucuu

SEQ ID NO: 735474 - RNA, 18 nt, Leptospira interrogans serovar lai str. 56601
cauucgcgacgauugauc

SEQ ID NO: 735475 - RNA, 22 nt, Leptospira interrogans serovar lai str. 56601
ccagauucacgcucauuagaau

SEQ ID NO: 735476 - RNA, 23 nt, Leptospira interrogans serovar lai str. 56601
ccacuugaauagaaccuuuugaa

SEQ ID NO: 735477 - RNA, 18 nt, Leptospira interrogans serovar lai str. 56601
ccagcguuuugcugaguu

SEQ ID NO: 735478 - RNA, 18 nt, Leptospira interrogans serovar lai str. 56601
cauaggaaauaauuccuc

SEQ ID NO: 735479 - RNA, 13 nt, Leptospira interrogans serovar lai str. 56601
cauagcaacaauu

SEQ ID NO: 735480 - RNA, 20 nt, Leptospira interrogans serovar lai str. 56601
cauaaaaaacauaagaauau

SEQ ID NO: 735481 - RNA, 21 nt, Leptospira interrogans serovar lai str. 56601
cauaccuguuuuaguucaaaa

SEQ ID NO: 735482 - RNA, 22 nt, Leptospira interrogans serovar lai str. 56601
caguaaaaaagcgaaagaaugu

SEQ ID NO: 735483 - RNA, 21 nt, Leptospira interrogans serovar lai str. 56601
caguaaggauucuuuucccgc

SEQ ID NO: 735484 - RNA, 20 nt, Leptospira interrogans serovar lai str. 56601
cagggagugauacgcugagu

SEQ ID NO: 735485 - RNA, 20 nt, Leptospira interrogans serovar lai str. 56601
caggauagguuccaauucca

SEQ ID NO: 735486 - RNA, 22 nt, Leptospira interrogans serovar lai str. 56601
cacuuuuguugcggagaauguu

SEQ ID NO: 735487 - RNA, 15 nt, Leptospira interrogans serovar lai str. 56601
cacuuuuuuaaagug

SEQ ID NO: 735488 - RNA, 12 nt, Leptospira interrogans serovar lai str. 56601
cagaaagaaguu

SEQ ID NO: 735489 - RNA, 13 nt, Leptospira interrogans serovar lai str. 56601
cacuugaauacga

SEQ ID NO: 735490 - RNA, 17 nt, Leptospira interrogans serovar lai str. 56601
cacucccccuuccgauu

SEQ ID NO: 735491 - RNA, 16 nt, Leptospira interrogans serovar lai str. 56601
cagagauaggaauguu

SEQ ID NO: 735492 - RNA, 18 nt, Leptospira interrogans serovar lai str. 56601
cagcaaaaccuucgugaa

SEQ ID NO: 735493 - RNA, 15 nt, Leptospira interrogans serovar lai str. 56601
cucuuugagaaccga

SEQ ID NO: 735494 - RNA, 15 nt, Leptospira interrogans serovar lai str. 56601
cucuacggaucgcgu

SEQ ID NO: 735495 - RNA, 21 nt, Leptospira interrogans serovar lai str. 56601
cugaucaaagcgggaauuccg

SEQ ID NO: 735496 - RNA, 16 nt, Leptospira interrogans serovar lai str. 56601
cugcaucaaccaagaa

SEQ ID NO: 735497 - RNA, 18 nt, Leptospira interrogans serovar lai str. 56601
cucacaaaucgugaauuu

SEQ ID NO: 735498 - RNA, 16 nt, Leptospira interrogans serovar lai str. 56601
cuaucaacaagaauga

SEQ ID NO: 735499 - RNA, 14 nt, Leptospira interrogans serovar lai str. 56601
cuauggaucgccgu

SEQ ID NO: 735500 - RNA, 18 nt, Leptospira interrogans serovar lai str. 56601
cucaagauuaaucugguc

SEQ ID NO: 735501 - RNA, 14 nt, Leptospira interrogans serovar lai str. 56601
cucaaaucuacaaa

SEQ ID NO: 735502 - RNA, 22 nt, Leptospira interrogans serovar lai str. 56601
cuacauuagaguuguugaacau

SEQ ID NO: 735503 - RNA, 19 nt, Leptospira interrogans serovar lai str. 56601
cguugaagcggaguuccua

SEQ ID NO: 735504 - RNA, 17 nt, Leptospira interrogans serovar lai str. 56601
cuagauauuucaagaau

SEQ ID NO: 735505 - RNA, 15 nt, Leptospira interrogans serovar lai str. 56601
cuacuaggaaaauuu

SEQ ID NO: 735506 - RNA, 14 nt, Leptospira interrogans serovar lai str. 56601
cucgaaaaucucag

SEQ ID NO: 735507 - RNA, 22 nt, Leptospira interrogans serovar lai str. 56601
cguuaucgaucgagacuucgaa

SEQ ID NO: 735508 - RNA, 22 nt, Leptospira interrogans serovar lai str. 56601
cguuauaaacaauaugaaagga

SEQ ID NO: 735509 - RNA, 17 nt, Leptospira interrogans serovar lai str. 56601
cguucugcuaaguuccc

SEQ ID NO: 735510 - RNA, 13 nt, Leptospira interrogans serovar lai str. 56601
gaaucuaauuuca

SEQ ID NO: 735511 - RNA, 17 nt, Leptospira interrogans serovar lai str. 56601
gaacucuuacaauuuca

SEQ ID NO: 735512 - RNA, 20 nt, Leptospira interrogans serovar lai str. 56601
gaauuuuuuaacaacucuaa

SEQ ID NO: 735513 - RNA, 20 nt, Leptospira interrogans serovar lai str. 56601
gaauuuuucaacaacucuaa

SEQ ID NO: 735514 - RNA, 16 nt, Leptospira interrogans serovar lai str. 56601
gaauuuuguuugaauc

SEQ ID NO: 735515 - RNA, 21 nt, Leptospira interrogans serovar lai str. 56601
gaauuuguuuuaaaauuuaug

SEQ ID NO: 735516 - RNA, 16 nt, Leptospira interrogans serovar lai str. 56601
gaauuguuugaucucg

SEQ ID NO: 735517 - RNA, 16 nt, Leptospira interrogans serovar lai str. 56601
gaauuuaacuaguucc

SEQ ID NO: 735518 - RNA, 23 nt, Leptospira interrogans serovar lai str. 56601
gaaugucaacaggggcuuugauu

SEQ ID NO: 735519 - RNA, 16 nt, Leptospira interrogans serovar lai str. 56601
gacaaugcuuuccaaa

SEQ ID NO: 735520 - RNA, 14 nt, Leptospira interrogans serovar lai str. 56601
gacaauuucuguag

SEQ ID NO: 735521 - RNA, 23 nt, Leptospira interrogans serovar lai str. 56601
gaccagcguuuugcugaguuuga

SEQ ID NO: 735522 - RNA, 15 nt, Leptospira interrogans serovar lai str. 56601
gaccgcgcuugaacu

SEQ ID NO: 735523 - RNA, 16 nt, Leptospira interrogans serovar lai str. 56601
gaccuuguguuucaga

SEQ ID NO: 735524 - RNA, 13 nt, Leptospira interrogans serovar lai str. 56601
gacucuucuccca

SEQ ID NO: 735525 - RNA, 16 nt, Leptospira interrogans serovar lai str. 56601
gagaugugggaacuac

SEQ ID NO: 735526 - RNA, 16 nt, Leptospira interrogans serovar lai str. 56601
gagagcgggguuugua

SEQ ID NO: 735527 - RNA, 11 nt, Leptospira interrogans serovar lai str. 56601
gagauaggaau

SEQ ID NO: 735528 - RNA, 17 nt, Leptospira interrogans serovar lai str. 56601
gagaguucgugaagaaa

SEQ ID NO: 735529 - RNA, 15 nt, Leptospira interrogans serovar lai str. 56601
gacguaaguaaucca

SEQ ID NO: 735530 - RNA, 16 nt, Leptospira interrogans serovar lai str. 56601
gaaccuuuaguuucca

SEQ ID NO: 735531 - RNA, 17 nt, Leptospira interrogans serovar lai str. 56601
gaacuauuuuuuguaug

SEQ ID NO: 735532 - RNA, 23 nt, Leptospira interrogans serovar lai str. 56601
gaaauuuauaauauucuuuuaua

SEQ ID NO: 735533 - RNA, 16 nt, Leptospira interrogans serovar lai str. 56601
gaaauuguaggaacuc

SEQ ID NO: 735534 - RNA, 15 nt, Leptospira interrogans serovar lai str. 56601
gaaaugugggaacuc

SEQ ID NO: 735535 - RNA, 15 nt, Leptospira interrogans serovar lai str. 56601
gaaauguaggaacuc

SEQ ID NO: 735536 - RNA, 22 nt, Leptospira interrogans serovar lai str. 56601
gaaaucugaacauaaaaucgau

SEQ ID NO: 735537 - RNA, 14 nt, Leptospira interrogans serovar lai str. 56601
gaaauuuuguuauc

SEQ ID NO: 735538 - RNA, 18 nt, Leptospira interrogans serovar lai str. 56601
gaaauaacuuagaaucua

SEQ ID NO: 735539 - RNA, 21 nt, Leptospira interrogans serovar lai str. 56601
gaaacaauuuugccaauucca

SEQ ID NO: 735540 - RNA, 10 nt, Leptospira interrogans serovar lai str. 56601
gaaagaacuc

SEQ ID NO: 735541 - RNA, 13 nt, Leptospira interrogans serovar lai str. 56601
gaaagaauuuccu

SEQ ID NO: 735542 - RNA, 18 nt, Leptospira interrogans serovar lai str. 56601
gaaagccgccuuuccaac

SEQ ID NO: 735543 - RNA, 19 nt, Leptospira interrogans serovar lai str. 56601
cuuuugcauugaaaucaga

SEQ ID NO: 735544 - RNA, 14 nt, Leptospira interrogans serovar lai str. 56601
cuuuucuucuggaa

SEQ ID NO: 735545 - RNA, 15 nt, Leptospira interrogans serovar lai str. 56601
cuuuauuaagaauuu

SEQ ID NO: 735546 - RNA, 19 nt, Leptospira interrogans serovar lai str. 56601
cuuuuaucgaauggaauuu

SEQ ID NO: 735547 - RNA, 18 nt, Leptospira interrogans serovar lai str. 56601
cuuuuauggucaucucua

SEQ ID NO: 735548 - RNA, 15 nt, Leptospira interrogans serovar lai str. 56601
gaaaauuuuuuugua

SEQ ID NO: 735549 - RNA, 23 nt, Leptospira interrogans serovar lai str. 56601
gaaaauuuaacaacauuagaauu

SEQ ID NO: 735550 - RNA, 21 nt, Leptospira interrogans serovar lai str. 56601
gaaaagaauugaaaucugaac

SEQ ID NO: 735551 - RNA, 22 nt, Leptospira interrogans serovar lai str. 56601
gaaaacucaacacaacgcucuc

SEQ ID NO: 735552 - RNA, 21 nt, Leptospira interrogans serovar lai str. 56601
cuuuuuucucagucaccucua

SEQ ID NO: 735553 - RNA, 16 nt, Leptospira interrogans serovar lai str. 56601
cuuuacacgauaauuu

SEQ ID NO: 735554 - RNA, 19 nt, Leptospira interrogans serovar lai str. 56601
cuuuaaauguagaaacuac

SEQ ID NO: 735555 - RNA, 19 nt, Leptospira interrogans serovar lai str. 56601
cuuuaaaugugggaacuac

SEQ ID NO: 735556 - RNA, 22 nt, Leptospira interrogans serovar lai str. 56601
cuuguuaaaauaaaaaaauuga

SEQ ID NO: 735557 - RNA, 14 nt, Leptospira interrogans serovar lai str. 56601
cuugugggaacuac

SEQ ID NO: 735558 - RNA, 21 nt, Leptospira interrogans serovar lai str. 56601
cuucaucuauuccguacuguu

SEQ ID NO: 735559 - RNA, 19 nt, Leptospira interrogans serovar lai str. 56601
cuuaaaaguauccaucgua

SEQ ID NO: 735560 - RNA, 19 nt, Leptospira interrogans serovar lai str. 56601
cuuaaaauguaggaacuac

SEQ ID NO: 735561 - RNA, 19 nt, Leptospira interrogans serovar lai str. 56601
cuguuuuguggucaacauc

SEQ ID NO: 735562 - RNA, 22 nt, Leptospira interrogans serovar lai str. 56601
cuguaacauccaaacucuuaau

SEQ ID NO: 735563 - RNA, 22 nt, Leptospira interrogans serovar lai str. 56601
cuguaaaaugaugugggaacuc

SEQ ID NO: 735564 - RNA, 20 nt, Leptospira interrogans serovar lai str. 56601
cuggaugaagcuaugaagag

SEQ ID NO: 735565 - RNA, 18 nt, Leptospira interrogans serovar lai str. 56601
gcauaacgucuugauuau

SEQ ID NO: 735566 - RNA, 21 nt, Leptospira interrogans serovar lai str. 56601
gcauucaauuuaggaagcguu

SEQ ID NO: 735567 - RNA, 23 nt, Leptospira interrogans serovar lai str. 56601
gcauugaguuuaagaaacucagu

SEQ ID NO: 735568 - RNA, 14 nt, Leptospira interrogans serovar lai str. 56601
gcaugaauggauuu

SEQ ID NO: 735569 - RNA, 15 nt, Leptospira interrogans serovar lai str. 56601
gaucagaauuucuuu

SEQ ID NO: 735570 - RNA, 15 nt, Leptospira interrogans serovar lai str. 56601
gauaaagaaucgaua

SEQ ID NO: 735571 - RNA, 19 nt, Leptospira interrogans serovar lai str. 56601
gauacuuucggacuuuccg

SEQ ID NO: 735572 - RNA, 16 nt, Leptospira interrogans serovar lai str. 56601
gauacugucaccguuu

SEQ ID NO: 735573 - RNA, 17 nt, Leptospira interrogans serovar lai str. 56601
gauagaaauauuuagaa

SEQ ID NO: 735574 - RNA, 23 nt, Leptospira interrogans serovar lai str. 56601
gaguuuacgugaguucgguguaa

SEQ ID NO: 735575 - RNA, 21 nt, Leptospira interrogans serovar lai str. 56601
gaguucccacauuuuaaagau

SEQ ID NO: 735576 - RNA, 21 nt, Leptospira interrogans serovar lai str. 56601
gaguucccacguuuuaaaggu

SEQ ID NO: 735577 - RNA, 12 nt, Leptospira interrogans serovar lai str. 56601
gaguuagacguu

SEQ ID NO: 735578 - RNA, 19 nt, Leptospira interrogans serovar lai str. 56601
gaguuauugaaaaauuuca

SEQ ID NO: 735579 - RNA, 13 nt, Leptospira interrogans serovar lai str. 56601
gagugcagauuaa

SEQ ID NO: 735580 - RNA, 18 nt, Leptospira interrogans serovar lai str. 56601
gauccaauuguuccgaau

SEQ ID NO: 735581 - RNA, 22 nt, Leptospira interrogans serovar lai str. 56601
gaucgcagcauaauaaucgcuu

SEQ ID NO: 735582 - RNA, 18 nt, Leptospira interrogans serovar lai str. 56601
gaucugacuuggugauaa

SEQ ID NO: 735583 - RNA, 15 nt, Leptospira interrogans serovar lai str. 56601
gauguugaguuucuu

SEQ ID NO: 735584 - RNA, 14 nt, Leptospira interrogans serovar lai str. 56601
gaugugggaacucu

SEQ ID NO: 735585 - RNA, 17 nt, Leptospira interrogans serovar lai str. 56601
gcaaagauuaaguauug

SEQ ID NO: 735586 - RNA, 15 nt, Leptospira interrogans serovar lai str. 56601
gauuuauaauucccg

SEQ ID NO: 735587 - RNA, 19 nt, Leptospira interrogans serovar lai str. 56601
cggauugccuaaauuccuu

SEQ ID NO: 735588 - RNA, 17 nt, Leptospira interrogans serovar lai str. 56601
cggucuuucuucuguaa

SEQ ID NO: 735589 - RNA, 20 nt, Leptospira interrogans serovar lai str. 56601
cgccuacacuguguucuuuu

SEQ ID NO: 735590 - RNA, 21 nt, Leptospira interrogans serovar lai str. 56601
cgccguaaaaaauccaugauu

SEQ ID NO: 735591 - RNA, 22 nt, Leptospira interrogans serovar lai str. 56601
cggaaaauuuuuuugauucaaa

SEQ ID NO: 735592 - RNA, 16 nt, Leptospira interrogans serovar lai str. 56601
ccuuuggacgaaucga

SEQ ID NO: 735593 - RNA, 17 nt, Leptospira interrogans serovar lai str. 56601
ccuuuggacgaaucgaa

SEQ ID NO: 735594 - RNA, 12 nt, Leptospira interrogans serovar lai str. 56601
ccuucugaaagu

SEQ ID NO: 735595 - RNA, 17 nt, Leptospira interrogans serovar lai str. 56601
cgaaagaauuuuuggaa

SEQ ID NO: 735596 - RNA, 17 nt, Leptospira interrogans serovar lai str. 56601
cgagauugauauuucuu

SEQ ID NO: 735597 - RNA, 15 nt, Leptospira interrogans serovar lai str. 56601
cgagagacgcugagu

SEQ ID NO: 735598 - RNA, 16 nt, Leptospira interrogans serovar lai str. 56601
cgcauuuuuauuugca

SEQ ID NO: 735599 - RNA, 14 nt, Leptospira interrogans serovar lai str. 56601
cgauuuuuccgaug

SEQ ID NO: 735600 - RNA, 21 nt, Leptospira interrogans serovar lai str. 56601
cgauagccaucggaauuccuc

SEQ ID NO: 735601 - RNA, 12 nt, Leptospira interrogans serovar lai str. 56601
cgauagauucaa

SEQ ID NO: 735602 - RNA, 13 nt, Leptospira interrogans serovar lai str. 56601
cgauagauucaau

SEQ ID NO: 735603 - RNA, 23 nt, Leptospira interrogans serovar lai str. 56601
cgauaagucucucuugaacguga

SEQ ID NO: 735604 - RNA, 17 nt, Leptospira interrogans serovar lai str. 56601
cgauaagaauauaagau

SEQ ID NO: 735605 - RNA, 22 nt, Leptospira interrogans serovar lai str. 56601
cgaucgacauuccccaaguaaa

SEQ ID NO: 735606 - RNA, 11 nt, Leptospira interrogans serovar lai str. 56601
ccgauugaagc

SEQ ID NO: 735607 - RNA, 22 nt, Leptospira interrogans serovar lai str. 56601
ccgcagacuguaucauagaaua

SEQ ID NO: 735608 - RNA, 18 nt, Leptospira interrogans serovar lai str. 56601
ccuaaaaugugggaacuc

SEQ ID NO: 735609 - RNA, 19 nt, Leptospira interrogans serovar lai str. 56601
ccuacaaaucaaaucgcau

SEQ ID NO: 735610 - RNA, 18 nt, Leptospira interrogans serovar lai str. 56601
ccuacaauuuuagaauuu

SEQ ID NO: 735611 - RNA, 22 nt, Leptospira interrogans serovar lai str. 56601
aaaguuuccccaagacuuugaa

SEQ ID NO: 735612 - RNA, 17 nt, Leptospira interrogans serovar lai str. 56601
aaaacaaacuuuuguaa

SEQ ID NO: 735613 - RNA, 20 nt, Leptospira interrogans serovar lai str. 56601
aaaucaucuaucuuuucaaa

SEQ ID NO: 735614 - RNA, 17 nt, Leptospira interrogans serovar lai str. 56601
aaaucauggauuuacag

SEQ ID NO: 735615 - RNA, 19 nt, Leptospira interrogans serovar lai str. 56601
aaaaauuuuacccugguuu

SEQ ID NO: 735616 - RNA, 22 nt, Leptospira interrogans serovar lai str. 56601
aaaacaccgugaucuccuaaaa

SEQ ID NO: 735617 - RNA, 13 nt, Leptospira interrogans serovar lai str. 56601
aaaaccaaucgau

SEQ ID NO: 735618 - RNA, 16 nt, Leptospira interrogans serovar lai str. 56601
aaaaccaucuuugaua

SEQ ID NO: 735619 - RNA, 15 nt, Leptospira interrogans serovar lai str. 56601
aaaaccgaaaaucgu

SEQ ID NO: 735620 - RNA, 16 nt, Leptospira interrogans serovar lai str. 56601
aaaaccuaaaauagau

SEQ ID NO: 735621 - RNA, 20 nt, Leptospira interrogans serovar lai str. 56601
aaaaccucuguuuugcgauu

SEQ ID NO: 735622 - RNA, 20 nt, Leptospira interrogans serovar lai str. 56601
aaaaccugauuuuucuguaa

SEQ ID NO: 735623 - RNA, 24 nt, Leptospira interrogans serovar lai str. 56601
aaaugcagcaaaaccuucgugaaa

SEQ ID NO: 735624 - RNA, 23 nt, Leptospira interrogans serovar lai str. 56601
aaaugcaguaaugccuacaaauc

SEQ ID NO: 735625 - RNA, 18 nt, Leptospira interrogans serovar lai str. 56601
aaaugccgccccauagga

SEQ ID NO: 735626 - RNA, 15 nt, Leptospira interrogans serovar lai str. 56601
aaaugugagaguucc

SEQ ID NO: 735627 - RNA, 16 nt, Leptospira interrogans serovar lai str. 56601
aaaugugcgggaacuc

SEQ ID NO: 735628 - RNA, 20 nt, Leptospira interrogans serovar lai str. 56601
aaaugugggaacuaccacaa

SEQ ID NO: 735629 - RNA, 14 nt, Leptospira interrogans serovar lai str. 56601
aaaugugggaacuc

SEQ ID NO: 735630 - RNA, 15 nt, Leptospira interrogans serovar lai str. 56601
aaaugugggaacucc

SEQ ID NO: 735631 - RNA, 20 nt, Leptospira interrogans serovar lai str. 56601
aaaucgacuuuucugauuuu

SEQ ID NO: 735632 - RNA, 15 nt, Leptospira interrogans serovar lai str. 56601
aacaaacucuugaac

SEQ ID NO: 735633 - RNA, 21 nt, Leptospira interrogans serovar lai str. 56601
aacaaaacgugguaguuccca

SEQ ID NO: 735634 - RNA, 16 nt, Leptospira interrogans serovar lai str. 56601
aaauuuuuuagaaauc

SEQ ID NO: 735635 - RNA, 19 nt, Leptospira interrogans serovar lai str. 56601
aaauuuuuuggaaaucgaa

SEQ ID NO: 735636 - RNA, 14 nt, Leptospira interrogans serovar lai str. 56601
aaauuaccgcuaga

SEQ ID NO: 735637 - RNA, 12 nt, Leptospira interrogans serovar lai str. 56601
aaauuagaaaug

SEQ ID NO: 735638 - RNA, 12 nt, Leptospira interrogans serovar lai str. 56601
aaauuagaaucu

SEQ ID NO: 735639 - RNA, 23 nt, Leptospira interrogans serovar lai str. 56601
aaauuaacuuucuucgauuucuu

SEQ ID NO: 735640 - RNA, 19 nt, Leptospira interrogans serovar lai str. 56601
aaaacguuuuguugaguuu

SEQ ID NO: 735641 - RNA, 21 nt, Leptospira interrogans serovar lai str. 56601
aaaacguuuuguugaguuuga

SEQ ID NO: 735642 - RNA, 16 nt, Leptospira interrogans serovar lai str. 56601
aaaacugaaacuugaa

SEQ ID NO: 735643 - RNA, 17 nt, Leptospira interrogans serovar lai str. 56601
aaaacgcgauccguaga

SEQ ID NO: 735644 - RNA, 21 nt, Leptospira interrogans serovar lai str. 56601
aaauuuuacccugguuucaaa

SEQ ID NO: 735645 - RNA, 21 nt, Leptospira interrogans serovar lai str. 56601
aaauuuucguuuuaguuccca

SEQ ID NO: 735646 - RNA, 12 nt, Leptospira interrogans serovar lai str. 56601
aaauuuucuaaa

SEQ ID NO: 735647 - RNA, 20 nt, Leptospira interrogans serovar lai str. 56601
aaauuuucuuagaaaacuug

SEQ ID NO: 735648 - RNA, 22 nt, Leptospira interrogans serovar lai str. 56601
aaauuuuuauacuuuuuugaua

SEQ ID NO: 735649 - RNA, 22 nt, Leptospira interrogans serovar lai str. 56601
aaauuuugcuucugaacaagaa

SEQ ID NO: 735650 - RNA, 12 nt, Leptospira interrogans serovar lai str. 56601
aaauuucggaac

SEQ ID NO: 735651 - RNA, 17 nt, Leptospira interrogans serovar lai str. 56601
aaauuucccuaguucca

SEQ ID NO: 735652 - RNA, 13 nt, Leptospira interrogans serovar lai str. 56601
aaaagacucacac

SEQ ID NO: 735653 - RNA, 13 nt, Leptospira interrogans serovar lai str. 56601
aaauuuaacgaca

SEQ ID NO: 735654 - RNA, 15 nt, Leptospira interrogans serovar lai str. 56601
aaauuuacuauuuug

SEQ ID NO: 735655 - RNA, 20 nt, Leptospira interrogans serovar lai str. 56601
aaauuuauaauauucuuuua

SEQ ID NO: 735656 - RNA, 18 nt, Leptospira interrogans serovar lai str. 56601
aaaacuuggguuucuuaa

SEQ ID NO: 735657 - RNA, 14 nt, Leptospira interrogans serovar lai str. 56601
aaaagaaaaaucuu

SEQ ID NO: 735658 - RNA, 18 nt, Leptospira interrogans serovar lai str. 56601
aaaagaaaaaucuucagu

SEQ ID NO: 735659 - RNA, 17 nt, Leptospira interrogans serovar lai str. 56601
aaaagaauauuucuaaa

SEQ ID NO: 735660 - RNA, 21 nt, Leptospira interrogans serovar lai str. 56601
aaacuuugaccauucuuuguu

SEQ ID NO: 735661 - RNA, 16 nt, Leptospira interrogans serovar lai str. 56601
aaacgcuuucguaaaa

SEQ ID NO: 735662 - RNA, 17 nt, Leptospira interrogans serovar lai str. 56601
aaaccuuuauagaauuc

SEQ ID NO: 735663 - RNA, 13 nt, Leptospira interrogans serovar lai str. 56601
aaagacuaaucgc

SEQ ID NO: 735664 - RNA, 21 nt, Leptospira interrogans serovar lai str. 56601
aaagagcguuguguugaguuu

SEQ ID NO: 735665 - RNA, 20 nt, Leptospira interrogans serovar lai str. 56601
aaagaaaaacagguaaaccu

SEQ ID NO: 735666 - RNA, 18 nt, Leptospira interrogans serovar lai str. 56601
aaagaaaugugggaacuc

SEQ ID NO: 735667 - RNA, 19 nt, Leptospira interrogans serovar lai str. 56601
aaagaauuaucauguaaaa

SEQ ID NO: 735668 - RNA, 22 nt, Leptospira interrogans serovar lai str. 56601
aaagaauuucggcuugauaccu

SEQ ID NO: 735669 - RNA, 19 nt, Leptospira interrogans serovar lai str. 56601
aaaguaaagguuucacaaa

SEQ ID NO: 735670 - RNA, 22 nt, Leptospira interrogans serovar lai str. 56601
aaagguugagcaguaaaaucuu

SEQ ID NO: 735671 - RNA, 14 nt, Leptospira interrogans serovar lai str. 56601
aaaguacuaauuca

SEQ ID NO: 735672 - RNA, 16 nt, Leptospira interrogans serovar lai str. 56601
aaaguacuaauucaau

SEQ ID NO: 735673 - RNA, 22 nt, Leptospira interrogans serovar lai str. 56601
aaaguagacauuuaaaugucua

SEQ ID NO: 735674 - RNA, 18 nt, Leptospira interrogans serovar lai str. 56601
aaaguauaauuuaaaauc

SEQ ID NO: 735675 - RNA, 23 nt, Leptospira interrogans serovar lai str. 56601
aaaguauaauuuaaaaucguaaa

SEQ ID NO: 735676 - RNA, 22 nt, Leptospira interrogans serovar lai str. 56601
aaaguaucaccguaauucuuaa

SEQ ID NO: 735677 - RNA, 22 nt, Leptospira interrogans serovar lai str. 56601
aaaguaucuuagaauuguugaa

SEQ ID NO: 735678 - RNA, 19 nt, Leptospira interrogans serovar lai str. 56601
aaagcgucucauuucuuga

SEQ ID NO: 735679 - RNA, 22 nt, Leptospira interrogans serovar lai str. 56601
aaacauacuuuuugcaaguaaa

SEQ ID NO: 735680 - RNA, 12 nt, Leptospira interrogans serovar lai str. 56601
aaacaugaagaa

SEQ ID NO: 735681 - RNA, 17 nt, Leptospira interrogans serovar lai str. 56601
aaacaguauuuguaaaa

SEQ ID NO: 735682 - RNA, 14 nt, Leptospira interrogans serovar lai str. 56601
aaacagucaaaagg

SEQ ID NO: 735683 - RNA, 19 nt, Leptospira interrogans serovar lai str. 56601
aaaauugaauaucauaaau

SEQ ID NO: 735684 - RNA, 17 nt, Leptospira interrogans serovar lai str. 56601
aaaauugaguaccauaa

SEQ ID NO: 735685 - RNA, 17 nt, Leptospira interrogans serovar lai str. 56601
aaaauugcauauuccuu

SEQ ID NO: 735686 - RNA, 22 nt, Leptospira interrogans serovar lai str. 56601
aaaauuguguaugaguuccuac

SEQ ID NO: 735687 - RNA, 13 nt, Leptospira interrogans serovar lai str. 56601
aaaauuuaaauuc

SEQ ID NO: 735688 - RNA, 12 nt, Leptospira interrogans serovar lai str. 56601
aaaauuucuuaa

SEQ ID NO: 735689 - RNA, 14 nt, Leptospira interrogans serovar lai str. 56601
aaaauuucuuuguc

SEQ ID NO: 735690 - RNA, 17 nt, Leptospira interrogans serovar lai str. 56601
aaaauuucuuuuuugua

SEQ ID NO: 735691 - RNA, 18 nt, Leptospira interrogans serovar lai str. 56601
aaaauuuuccgaaccuua

SEQ ID NO: 735692 - RNA, 21 nt, Leptospira interrogans serovar lai str. 56601
aaaauuuuuaugacuucuuaa

SEQ ID NO: 735693 - RNA, 15 nt, Leptospira interrogans serovar lai str. 56601
aaaauuuuuguguaa

SEQ ID NO: 735694 - RNA, 15 nt, Leptospira interrogans serovar lai str. 56601
aaaauuuuuuuguaa

SEQ ID NO: 735695 - RNA, 16 nt, Leptospira interrogans serovar lai str. 56601
aaacaauugauugcuu

SEQ ID NO: 735696 - RNA, 19 nt, Leptospira interrogans serovar lai str. 56601
aaaccacgucccguauaaa

SEQ ID NO: 735697 - RNA, 12 nt, Leptospira interrogans serovar lai str. 56601
aaaccucgucua

SEQ ID NO: 735698 - RNA, 19 nt, Leptospira interrogans serovar lai str. 56601
aaaccugauuuuuccauaa

SEQ ID NO: 735699 - RNA, 16 nt, Leptospira interrogans serovar lai str. 56601
aaaaacucgguuucuu

SEQ ID NO: 735700 - RNA, 23 nt, Leptospira interrogans serovar lai str. 56601
aaaaacucuguucaguguaagau

SEQ ID NO: 735701 - RNA, 21 nt, Leptospira interrogans serovar lai str. 56601
aaaaagcguuucauugaguuu

SEQ ID NO: 735702 - RNA, 16 nt, Leptospira interrogans serovar lai str. 56601
aaaauuccuuuuugua

SEQ ID NO: 735703 - RNA, 20 nt, Leptospira interrogans serovar lai str. 56601
aaaauuaggcuuaucuguaa

SEQ ID NO: 735704 - RNA, 20 nt, Leptospira interrogans serovar lai str. 56601
aaaauuauaggaacucauac

SEQ ID NO: 735705 - RNA, 21 nt, Leptospira interrogans serovar lai str. 56601
aaaaaauucgauuucuacaau

SEQ ID NO: 735706 - RNA, 17 nt, Leptospira interrogans serovar lai str. 56601
aaaaaacuuucuuaaau

SEQ ID NO: 735707 - RNA, 13 nt, Leptospira interrogans serovar lai str. 56601
aaaauuaacagua

SEQ ID NO: 735708 - RNA, 19 nt, Leptospira interrogans serovar lai str. 56601
aaaaugcaguaguuccuac

SEQ ID NO: 735709 - RNA, 20 nt, Leptospira interrogans serovar lai str. 56601
aaaaugagaaagaauuucua

SEQ ID NO: 735710 - RNA, 14 nt, Leptospira interrogans serovar lai str. 56601
aaaaucucaaauuc

SEQ ID NO: 735711 - RNA, 17 nt, Leptospira interrogans serovar lai str. 56601
aaaaucuaaauuuguaa

SEQ ID NO: 735712 - RNA, 16 nt, Leptospira interrogans serovar lai str. 56601
aaaaucuuuucuauaa

SEQ ID NO: 735713 - RNA, 14 nt, Leptospira interrogans serovar lai str. 56601
aaaaugaacucaac

SEQ ID NO: 735714 - RNA, 20 nt, Leptospira interrogans serovar lai str. 56601
aaaaucugaauuuuaccaaa

SEQ ID NO: 735715 - RNA, 19 nt, Leptospira interrogans serovar lai str. 56601
aaaauauagugguuuguaa

SEQ ID NO: 735716 - RNA, 15 nt, Leptospira interrogans serovar lai str. 56601
aaaauagauccaaau

SEQ ID NO: 735717 - RNA, 18 nt, Leptospira interrogans serovar lai str. 56601
aaaauagggaaaacucaa

SEQ ID NO: 735718 - RNA, 19 nt, Leptospira interrogans serovar lai str. 56601
aaaauagggaaaacucauc

SEQ ID NO: 735719 - RNA, 14 nt, Leptospira interrogans serovar lai str. 56601
aaaauacuuuaccg

SEQ ID NO: 735720 - RNA, 18 nt, Leptospira interrogans serovar lai str. 56601
aaaauaacgauccuaaag

SEQ ID NO: 735721 - RNA, 18 nt, Leptospira interrogans serovar lai str. 56601
aaaauccaugauuuguaa

SEQ ID NO: 735722 - RNA, 15 nt, Leptospira interrogans serovar lai str. 56601
aaaaucagucauaaa

SEQ ID NO: 735723 - RNA, 13 nt, Leptospira interrogans serovar lai str. 56601
aaaaucauaucca

SEQ ID NO: 735724 - RNA, 21 nt, Leptospira interrogans serovar lai str. 56601
aaaaucggauaguuuaaauuc

SEQ ID NO: 735725 - RNA, 12 nt, Leptospira interrogans serovar lai str. 56601
aaaauauuugca

SEQ ID NO: 735726 - RNA, 17 nt, Leptospira interrogans serovar lai str. 56601
aaaaucaaguaccauaa

SEQ ID NO: 735727 - RNA, 20 nt, Leptospira interrogans serovar lai str. 56601
aaaaguuucaucuuugaacu

SEQ ID NO: 735728 - RNA, 15 nt, Leptospira interrogans serovar lai str. 56601
aaaaguuuuucuaaa

SEQ ID NO: 735729 - RNA, 22 nt, Leptospira interrogans serovar lai str. 56601
aaaaguaauuacuccuaggcau

SEQ ID NO: 735730 - RNA, 17 nt, Leptospira interrogans serovar lai str. 56601
aaaagucuauuucuaaa

SEQ ID NO: 735731 - RNA, 16 nt, Leptospira interrogans serovar lai str. 56601
aaaagucugucuuaaa

SEQ ID NO: 735732 - RNA, 19 nt, Leptospira interrogans serovar lai str. 56601
aaaaaugugccuuuuugag

SEQ ID NO: 735733 - RNA, 18 nt, Leptospira interrogans serovar lai str. 56601
aaaaaugugggaauucuu

SEQ ID NO: 735734 - RNA, 22 nt, Leptospira interrogans serovar lai str. 56601
aaaaauucguuuuacuucgucu

SEQ ID NO: 735735 - RNA, 13 nt, Leptospira interrogans serovar lai str. 56601
aaaaauucuuaau

SEQ ID NO: 735736 - RNA, 22 nt, Leptospira interrogans serovar lai str. 56601
aaaaauucuuucucguuuucuu

SEQ ID NO: 735737 - RNA, 24 nt, Leptospira interrogans serovar lai str. 56601
aaaaauugaucucgauucugauaa

SEQ ID NO: 735738 - RNA, 20 nt, Leptospira interrogans serovar lai str. 56601
aaaacccaauaccaaacgau

SEQ ID NO: 735739 - RNA, 16 nt, Leptospira interrogans serovar lai str. 56601
aaaacuguacaauaga

SEQ ID NO: 735740 - RNA, 14 nt, Leptospira interrogans serovar lai str. 56601
aaaacuuaaugaga

SEQ ID NO: 735741 - RNA, 20 nt, Leptospira interrogans serovar lai str. 56601
aaaacuugauauuucuguaa

SEQ ID NO: 735742 - RNA, 17 nt, Leptospira interrogans serovar lai str. 56601
aaaacuugguuggauuc

SEQ ID NO: 735743 - RNA, 17 nt, Leptospira interrogans serovar lai str. 56601
aaaacuuugguuuguaa

SEQ ID NO: 735744 - RNA, 15 nt, Leptospira interrogans serovar lai str. 56601
aaaagaguuuucaau

SEQ ID NO: 735745 - RNA, 21 nt, Leptospira interrogans serovar lai str. 56601
aaaagaauuucuaaaauucuu

SEQ ID NO: 735746 - RNA, 16 nt, Leptospira interrogans serovar lai str. 56601
aaaagacccgcuacua

SEQ ID NO: 735747 - RNA, 17 nt, Leptospira interrogans serovar lai str. 56601
aaaacucagugaaugcc

SEQ ID NO: 735748 - RNA, 16 nt, Leptospira interrogans serovar lai str. 56601
aaaacucuauuaaacu

SEQ ID NO: 735749 - RNA, 20 nt, Leptospira interrogans serovar lai str. 56601
aaaacguggauuuuauguaa

SEQ ID NO: 735750 - RNA, 21 nt, Leptospira interrogans serovar lai str. 56601
aaaaaccgucccaaaaucuua

SEQ ID NO: 735751 - RNA, 15 nt, Leptospira interrogans serovar lai str. 56601
aaaaaccugauuuuu

SEQ ID NO: 735752 - RNA, 21 nt, Leptospira interrogans serovar lai str. 56601
aaaaaguuggaaucugaauuu

SEQ ID NO: 735753 - RNA, 15 nt, Leptospira interrogans serovar lai str. 56601
aaaaagggauucuau

SEQ ID NO: 735754 - RNA, 17 nt, Leptospira interrogans serovar lai str. 56601
aaaaagggauucuauuc

SEQ ID NO: 735755 - RNA, 21 nt, Leptospira interrogans serovar lai str. 56601
aaaaaucgacuuuucugauuu

SEQ ID NO: 735756 - RNA, 21 nt, Leptospira interrogans serovar lai str. 56601
aaaaauacuuuauuuguauuc

SEQ ID NO: 735757 - RNA, 17 nt, Leptospira interrogans serovar lai str. 56601
aaaaauacuuugaacuu

SEQ ID NO: 735758 - RNA, 18 nt, Leptospira interrogans serovar lai str. 56601
aaaaauaucaccuaacuu

SEQ ID NO: 735759 - RNA, 21 nt, Leptospira interrogans serovar lai str. 56601
aaaaauauggaaacuacccau

SEQ ID NO: 735760 - RNA, 20 nt, Leptospira interrogans serovar lai str. 56601
aaaaacuuuagaauguaaaa

SEQ ID NO: 735761 - RNA, 19 nt, Leptospira interrogans serovar lai str. 56601
acacuguuaguuugcaauu

SEQ ID NO: 735762 - RNA, 23 nt, Leptospira interrogans serovar lai str. 56601
acacucuaaaucuuaggaacuuu

SEQ ID NO: 735763 - RNA, 19 nt, Leptospira interrogans serovar lai str. 56601
acacucaacgaagucucca

SEQ ID NO: 735764 - RNA, 15 nt, Leptospira interrogans serovar lai str. 56601
aaaaguucucuucau

SEQ ID NO: 735765 - RNA, 14 nt, Leptospira interrogans serovar lai str. 56601
aaaaguuuuugaaa

SEQ ID NO: 735766 - RNA, 17 nt, Leptospira interrogans serovar lai str. 56601
aaaauaaaaaaauucau

SEQ ID NO: 735767 - RNA, 21 nt, Leptospira interrogans serovar lai str. 56601
aaaaguaugaacucuuacaau

SEQ ID NO: 735768 - RNA, 14 nt, Leptospira interrogans serovar lai str. 56601
aaaaguaacguaaa

SEQ ID NO: 735769 - RNA, 16 nt, Leptospira interrogans serovar lai str. 56601
acacgaauuccucaau

SEQ ID NO: 735770 - RNA, 22 nt, Leptospira interrogans serovar lai str. 56601
acacgaucauucuuuagaaauu

SEQ ID NO: 735771 - RNA, 22 nt, Leptospira interrogans serovar lai str. 56601
aauuucuucauaucaaauucau

SEQ ID NO: 735772 - RNA, 14 nt, Leptospira interrogans serovar lai str. 56601
aauuuuuauagaau

SEQ ID NO: 735773 - RNA, 15 nt, Leptospira interrogans serovar lai str. 56601
aauuuuuacuuccca

SEQ ID NO: 735774 - RNA, 23 nt, Leptospira interrogans serovar lai str. 56601
aauuuuuagaagaaggucucaca

SEQ ID NO: 735775 - RNA, 21 nt, Leptospira interrogans serovar lai str. 56601
aauuuuuuacugauucugcau

SEQ ID NO: 735776 - RNA, 23 nt, Leptospira interrogans serovar lai str. 56601
acaaaaaauauacuuuucaaacg

SEQ ID NO: 735777 - RNA, 19 nt, Leptospira interrogans serovar lai str. 56601
acaaaacgccucaaucgac

SEQ ID NO: 735778 - RNA, 20 nt, Leptospira interrogans serovar lai str. 56601
acaaaacugcuugaaucgac

SEQ ID NO: 735779 - RNA, 11 nt, Leptospira interrogans serovar lai str. 56601
acaaauuccaa

SEQ ID NO: 735780 - RNA, 14 nt, Leptospira interrogans serovar lai str. 56601
acaacauugaguuu

SEQ ID NO: 735781 - RNA, 21 nt, Leptospira interrogans serovar lai str. 56601
acaacucuauuaaagaagucu

SEQ ID NO: 735782 - RNA, 22 nt, Leptospira interrogans serovar lai str. 56601
acaauuauacuauaaguuuaca

SEQ ID NO: 735783 - RNA, 16 nt, Leptospira interrogans serovar lai str. 56601
aauuaaaaauucaucu

SEQ ID NO: 735784 - RNA, 13 nt, Leptospira interrogans serovar lai str. 56601
aaugggaguucgu

SEQ ID NO: 735785 - RNA, 14 nt, Leptospira interrogans serovar lai str. 56601
aauucaguaaauua

SEQ ID NO: 735786 - RNA, 19 nt, Leptospira interrogans serovar lai str. 56601
aauuaaaguaaauucgauc

SEQ ID NO: 735787 - RNA, 17 nt, Leptospira interrogans serovar lai str. 56601
aauuaaaauucuagaaa

SEQ ID NO: 735788 - RNA, 18 nt, Leptospira interrogans serovar lai str. 56601
aauucaguuuuucggaug

SEQ ID NO: 735789 - RNA, 15 nt, Leptospira interrogans serovar lai str. 56601
aauucauugauagau

SEQ ID NO: 735790 - RNA, 13 nt, Leptospira interrogans serovar lai str. 56601
aauuccuucggaa

SEQ ID NO: 735791 - RNA, 17 nt, Leptospira interrogans serovar lai str. 56601
aauugcgguaguuccca

SEQ ID NO: 735792 - RNA, 17 nt, Leptospira interrogans serovar lai str. 56601
aauuuaaauguucaaau

SEQ ID NO: 735793 - RNA, 15 nt, Leptospira interrogans serovar lai str. 56601
aauuuccaaacucaa

SEQ ID NO: 735794 - RNA, 14 nt, Leptospira interrogans serovar lai str. 56601
aauuuccacuucaa

SEQ ID NO: 735795 - RNA, 22 nt, Leptospira interrogans serovar lai str. 56601
aauugugauuugcgacaguucc

SEQ ID NO: 735796 - RNA, 15 nt, Leptospira interrogans serovar lai str. 56601
aauugugggaacuac

SEQ ID NO: 735797 - RNA, 16 nt, Leptospira interrogans serovar lai str. 56601
aauuguaggaacuacu

SEQ ID NO: 735798 - RNA, 23 nt, Leptospira interrogans serovar lai str. 56601
aaucuuuucuauaaucugaaaua

SEQ ID NO: 735799 - RNA, 13 nt, Leptospira interrogans serovar lai str. 56601
aaugacuugcauu

SEQ ID NO: 735800 - RNA, 23 nt, Leptospira interrogans serovar lai str. 56601
aaugcagcaaaaccuucgugaaa

SEQ ID NO: 735801 - RNA, 14 nt, Leptospira interrogans serovar lai str. 56601
aaguucgucgucua

SEQ ID NO: 735802 - RNA, 22 nt, Leptospira interrogans serovar lai str. 56601
aaguucgucgucuauaaauuca

SEQ ID NO: 735803 - RNA, 18 nt, Leptospira interrogans serovar lai str. 56601
aaguucaaaaaaaggauu

SEQ ID NO: 735804 - RNA, 17 nt, Leptospira interrogans serovar lai str. 56601
aaguuauugaauagaau

SEQ ID NO: 735805 - RNA, 21 nt, Leptospira interrogans serovar lai str. 56601
aaguuaagaguuuguuccaaa

SEQ ID NO: 735806 - RNA, 16 nt, Leptospira interrogans serovar lai str. 56601
aagucuauucgcgauc

SEQ ID NO: 735807 - RNA, 22 nt, Leptospira interrogans serovar lai str. 56601
aagucuauuucccaaaauuuca

SEQ ID NO: 735808 - RNA, 22 nt, Leptospira interrogans serovar lai str. 56601
aagucuuuuuugacuucggaac

SEQ ID NO: 735809 - RNA, 20 nt, Leptospira interrogans serovar lai str. 56601
aauaacaaaaaaugcucaaa

SEQ ID NO: 735810 - RNA, 22 nt, Leptospira interrogans serovar lai str. 56601
aauaacaacgauuucuguagaa

SEQ ID NO: 735811 - RNA, 11 nt, Leptospira interrogans serovar lai str. 56601
aaguucucaag

SEQ ID NO: 735812 - RNA, 22 nt, Leptospira interrogans serovar lai str. 56601
aaguugagaauauaagaaagua

SEQ ID NO: 735813 - RNA, 16 nt, Leptospira interrogans serovar lai str. 56601
aaguugauuucagauc

SEQ ID NO: 735814 - RNA, 22 nt, Leptospira interrogans serovar lai str. 56601
aauauauuuucaggcauagaau

SEQ ID NO: 735815 - RNA, 20 nt, Leptospira interrogans serovar lai str. 56601
aauaucaguuucuccggcga

SEQ ID NO: 735816 - RNA, 21 nt, Leptospira interrogans serovar lai str. 56601
aauauuucguuuuuaguuuca

SEQ ID NO: 735817 - RNA, 16 nt, Leptospira interrogans serovar lai str. 56601
aauauuucucuuugua

SEQ ID NO: 735818 - RNA, 17 nt, Leptospira interrogans serovar lai str. 56601
aauauuuugagcagauu

SEQ ID NO: 735819 - RNA, 19 nt, Leptospira interrogans serovar lai str. 56601
aauauucagaaacuggaau

SEQ ID NO: 735820 - RNA, 20 nt, Leptospira interrogans serovar lai str. 56601
aaggaguaucaauagaaaua

SEQ ID NO: 735821 - RNA, 18 nt, Leptospira interrogans serovar lai str. 56601
aagacuuuauagucaaau

SEQ ID NO: 735822 - RNA, 13 nt, Leptospira interrogans serovar lai str. 56601
aagccaucguucu

SEQ ID NO: 735823 - RNA, 15 nt, Leptospira interrogans serovar lai str. 56601
aaccuaaaauuucca

SEQ ID NO: 735824 - RNA, 17 nt, Leptospira interrogans serovar lai str. 56601
aaccguuguuuuacagc

SEQ ID NO: 735825 - RNA, 17 nt, Leptospira interrogans serovar lai str. 56601
aacgcucucuacggauc

SEQ ID NO: 735826 - RNA, 17 nt, Leptospira interrogans serovar lai str. 56601
aacuuggguuucuuaaa

SEQ ID NO: 735827 - RNA, 14 nt, Leptospira interrogans serovar lai str. 56601
aacuucguuggaaa

SEQ ID NO: 735828 - RNA, 22 nt, Leptospira interrogans serovar lai str. 56601
aagaaucuugggguuuuuguaa

SEQ ID NO: 735829 - RNA, 22 nt, Leptospira interrogans serovar lai str. 56601
aagaauauuugggcgaaucgcu

SEQ ID NO: 735830 - RNA, 15 nt, Leptospira interrogans serovar lai str. 56601
aagaagccaauucca

SEQ ID NO: 735831 - RNA, 14 nt, Leptospira interrogans serovar lai str. 56601
aacuuucuucgauc

SEQ ID NO: 735832 - RNA, 18 nt, Leptospira interrogans serovar lai str. 56601
aacuuguuuuagaaucua

SEQ ID NO: 735833 - RNA, 17 nt, Leptospira interrogans serovar lai str. 56601
aacuuuuuauaaagauu

SEQ ID NO: 735834 - RNA, 23 nt, Leptospira interrogans serovar lai str. 56601
aacucccacaauuuauaaaguuu

SEQ ID NO: 735835 - RNA, 20 nt, Leptospira interrogans serovar lai str. 56601
aacggcgauccauagaaagc

SEQ ID NO: 735836 - RNA, 12 nt, Leptospira interrogans serovar lai str. 56601
aacugaaacuug

SEQ ID NO: 735837 - RNA, 14 nt, Leptospira interrogans serovar lai str. 56601
agacuuucuuugaa

SEQ ID NO: 735838 - RNA, 20 nt, Leptospira interrogans serovar lai str. 56601
agagguucugagucguucga

SEQ ID NO: 735839 - RNA, 17 nt, Leptospira interrogans serovar lai str. 56601
agaggauguaauuccag

SEQ ID NO: 735840 - RNA, 20 nt, Leptospira interrogans serovar lai str. 56601
agauauuaguaaaacuguuu

SEQ ID NO: 735841 - RNA, 17 nt, Leptospira interrogans serovar lai str. 56601
agauaaugagccagguu

SEQ ID NO: 735842 - RNA, 17 nt, Leptospira interrogans serovar lai str. 56601
agauacucaauuugaua

SEQ ID NO: 735843 - RNA, 21 nt, Leptospira interrogans serovar lai str. 56601
agaucaaagagaugauuucuu

SEQ ID NO: 735844 - RNA, 15 nt, Leptospira interrogans serovar lai str. 56601
agaauuuauuuguaa

SEQ ID NO: 735845 - RNA, 19 nt, Leptospira interrogans serovar lai str. 56601
agaauuguguuaguuccca

SEQ ID NO: 735846 - RNA, 21 nt, Leptospira interrogans serovar lai str. 56601
agaauuguuugaaaguuccca

SEQ ID NO: 735847 - RNA, 12 nt, Leptospira interrogans serovar lai str. 56601
agaaucagaaug

SEQ ID NO: 735848 - RNA, 21 nt, Leptospira interrogans serovar lai str. 56601
agaaucuugggguuuuuguaa

SEQ ID NO: 735849 - RNA, 16 nt, Leptospira interrogans serovar lai str. 56601
agaaugauaaaucuug

SEQ ID NO: 735850 - RNA, 15 nt, Leptospira interrogans serovar lai str. 56601
agaauaauaaucuua

SEQ ID NO: 735851 - RNA, 20 nt, Leptospira interrogans serovar lai str. 56601
agaauaaucuccuaccaacu

SEQ ID NO: 735852 - RNA, 18 nt, Leptospira interrogans serovar lai str. 56601
agaaguaguaguucccac

SEQ ID NO: 735853 - RNA, 14 nt, Leptospira interrogans serovar lai str. 56601
agaacgcaaucugu

SEQ ID NO: 735854 - RNA, 23 nt, Leptospira interrogans serovar lai str. 56601
agaagaugcucggcuucuucaau

SEQ ID NO: 735855 - RNA, 18 nt, Leptospira interrogans serovar lai str. 56601
agaacuauuaucuuucga

SEQ ID NO: 735856 - RNA, 15 nt, Leptospira interrogans serovar lai str. 56601
agaacuacuuuuaua

SEQ ID NO: 735857 - RNA, 23 nt, Leptospira interrogans serovar lai str. 56601
agaaacacucccccuuccgauuc

SEQ ID NO: 735858 - RNA, 17 nt, Leptospira interrogans serovar lai str. 56601
agaaacaaggcuuugua

SEQ ID NO: 735859 - RNA, 20 nt, Leptospira interrogans serovar lai str. 56601
agaaauugauuaaucuguaa

SEQ ID NO: 735860 - RNA, 19 nt, Leptospira interrogans serovar lai str. 56601
agaaauauggcaucuccga

SEQ ID NO: 735861 - RNA, 16 nt, Leptospira interrogans serovar lai str. 56601
agaaauaaguaaaucu

SEQ ID NO: 735862 - RNA, 14 nt, Leptospira interrogans serovar lai str. 56601
agaaauagaaaccu

SEQ ID NO: 735863 - RNA, 17 nt, Leptospira interrogans serovar lai str. 56601
agaaauagaaaccuuuc

SEQ ID NO: 735864 - RNA, 21 nt, Leptospira interrogans serovar lai str. 56601
acuuuugaaaauccauaugag

SEQ ID NO: 735865 - RNA, 18 nt, Leptospira interrogans serovar lai str. 56601
acuuugcucguacguuua

SEQ ID NO: 735866 - RNA, 17 nt, Leptospira interrogans serovar lai str. 56601
acuuuguaaaucuauuc

SEQ ID NO: 735867 - RNA, 18 nt, Leptospira interrogans serovar lai str. 56601
agaaaaacagguaaaccu

SEQ ID NO: 735868 - RNA, 14 nt, Leptospira interrogans serovar lai str. 56601
acuuuuuucagaaa

SEQ ID NO: 735869 - RNA, 15 nt, Leptospira interrogans serovar lai str. 56601
acucuuugagaaacg

SEQ ID NO: 735870 - RNA, 13 nt, Leptospira interrogans serovar lai str. 56601
acuauaauuuccg

SEQ ID NO: 735871 - RNA, 14 nt, Leptospira interrogans serovar lai str. 56601
acuauacaaauaga

SEQ ID NO: 735872 - RNA, 23 nt, Leptospira interrogans serovar lai str. 56601
acugcccguuucaauuuuugaaa

SEQ ID NO: 735873 - RNA, 21 nt, Leptospira interrogans serovar lai str. 56601
acuuaaucugugggaacucuc

SEQ ID NO: 735874 - RNA, 18 nt, Leptospira interrogans serovar lai str. 56601
acuuaauuuguaggaacu

SEQ ID NO: 735875 - RNA, 15 nt, Leptospira interrogans serovar lai str. 56601
acugugggaacuacu

SEQ ID NO: 735876 - RNA, 21 nt, Leptospira interrogans serovar lai str. 56601
acgcuucucuugcuugaacca

SEQ ID NO: 735877 - RNA, 14 nt, Leptospira interrogans serovar lai str. 56601
aaacacgaauuccu

SEQ ID NO: 735878 - RNA, 14 nt, Leptospira interrogans serovar lai str. 56601
aaacaucacuucca

SEQ ID NO: 735879 - RNA, 15 nt, Leptospira interrogans serovar lai str. 56601
aaacaucacuuccau

SEQ ID NO: 735880 - RNA, 18 nt, Leptospira interrogans serovar lai str. 56601
acuaacacaguuugaauu

SEQ ID NO: 735881 - RNA, 17 nt, Leptospira interrogans serovar lai str. 56601
acuacagcaaaucacga

SEQ ID NO: 735882 - RNA, 16 nt, Leptospira interrogans serovar lai str. 56601
acuaaugcaaguucug

SEQ ID NO: 735883 - RNA, 21 nt, Leptospira interrogans serovar lai str. 56601
acuacuaaaucucaauucagu

SEQ ID NO: 735884 - RNA, 16 nt, Leptospira interrogans serovar lai str. 56601
aaaauucaaaugucuu

SEQ ID NO: 735885 - RNA, 17 nt, Leptospira interrogans serovar lai str. 56601
aaaauuccuuacucguu

SEQ ID NO: 735886 - RNA, 20 nt, Leptospira interrogans serovar lai str. 56601
aaaauucgaaucauuuugua

SEQ ID NO: 735887 - RNA, 22 nt, Leptospira interrogans serovar lai str. 56601
aaaauuauccguuuauccuaau

SEQ ID NO: 735888 - RNA, 23 nt, Leptospira interrogans serovar lai str. 56601
aaaauugaucucgauucugauaa

SEQ ID NO: 735889 - RNA, 20 nt, Leptospira interrogans serovar lai str. 56601
aaaauuguagaaacuuauac

SEQ ID NO: 735890 - RNA, 14 nt, Leptospira interrogans serovar lai str. 56601
aaaauuuaaauguu

SEQ ID NO: 735891 - RNA, 20 nt, Leptospira interrogans serovar lai str. 56601
aaaauuuaaauguuuuugua

SEQ ID NO: 735892 - RNA, 15 nt, Leptospira interrogans serovar lai str. 56601
aaaauuuaucuguaa

SEQ ID NO: 735893 - RNA, 15 nt, Leptospira interrogans serovar lai str. 56601
aaaauugaauauuca

SEQ ID NO: 735894 - RNA, 13 nt, Leptospira interrogans serovar lai str. 56601
aaaaugaacucaa

SEQ ID NO: 735895 - RNA, 13 nt, Leptospira interrogans serovar lai str. 56601
aaaaucucuuuua

SEQ ID NO: 735896 - RNA, 17 nt, Leptospira interrogans serovar lai str. 56601
aaaaucuuaauuuguaa

SEQ ID NO: 735897 - RNA, 22 nt, Leptospira interrogans serovar lai str. 56601
aaaaugcaguaguuccuacaau

SEQ ID NO: 735898 - RNA, 18 nt, Leptospira interrogans serovar lai str. 56601
aaaauauccguaaaaccu

SEQ ID NO: 735899 - RNA, 17 nt, Leptospira interrogans serovar lai str. 56601
aaaauagaauuuuugua

SEQ ID NO: 735900 - RNA, 15 nt, Leptospira interrogans serovar lai str. 56601
aaaauagccuucaau

SEQ ID NO: 735901 - RNA, 19 nt, Leptospira interrogans serovar lai str. 56601
aaaauagggaaaacucaac

SEQ ID NO: 735902 - RNA, 12 nt, Leptospira interrogans serovar lai str. 56601
aaaauauucgug

SEQ ID NO: 735903 - RNA, 13 nt, Leptospira interrogans serovar lai str. 56601
aaaaucaugauuc

SEQ ID NO: 735904 - RNA, 19 nt, Leptospira interrogans serovar lai str. 56601
accaucuuugauauuugga

SEQ ID NO: 735905 - RNA, 17 nt, Leptospira interrogans serovar lai str. 56601
accuaaaaauauggaag

SEQ ID NO: 735906 - RNA, 14 nt, Leptospira interrogans serovar lai str. 56601
accuaaaauuucca

SEQ ID NO: 735907 - RNA, 14 nt, Leptospira interrogans serovar lai str. 56601
accucaaagaaauu

SEQ ID NO: 735908 - RNA, 20 nt, Leptospira interrogans serovar lai str. 56601
acgaaucuguucgucguuua

SEQ ID NO: 735909 - RNA, 13 nt, Leptospira interrogans serovar lai str. 56601
acgaaguuccaac

SEQ ID NO: 735910 - RNA, 17 nt, Leptospira interrogans serovar lai str. 56601
aaaauuuugcuucugaa

SEQ ID NO: 735911 - RNA, 17 nt, Leptospira interrogans serovar lai str. 56601
aaaauuuuuucuuuuua

SEQ ID NO: 735912 - RNA, 14 nt, Leptospira interrogans serovar lai str. 56601
aaaauuuuuuugua

SEQ ID NO: 735913 - RNA, 16 nt, Leptospira interrogans serovar lai str. 56601
aaacaaacuuuuguaa

SEQ ID NO: 735914 - RNA, 20 nt, Leptospira interrogans serovar lai str. 56601
aaaauuucauuuuacugcuu

SEQ ID NO: 735915 - RNA, 15 nt, Leptospira interrogans serovar lai str. 56601
aaacaaauagaaaua

SEQ ID NO: 735916 - RNA, 22 nt, Leptospira interrogans serovar lai str. 56601
aaacaauugauugcuuuuugag

SEQ ID NO: 735917 - RNA, 18 nt, Leptospira interrogans serovar lai str. 56601
acgauuuuuugauucauu

SEQ ID NO: 735918 - RNA, 18 nt, Leptospira interrogans serovar lai str. 56601
acgauuucuauccauucu

SEQ ID NO: 735919 - RNA, 13 nt, Leptospira interrogans serovar lai str. 56601
acgcaaguuccgc

SEQ ID NO: 735920 - RNA, 19 nt, Leptospira interrogans serovar lai str. 56601
acgcaaguuccgcgauuga

SEQ ID NO: 735921 - RNA, 11 nt, Leptospira interrogans serovar lai str. 56601
acgauccuuuu

SEQ ID NO: 735922 - RNA, 14 nt, Leptospira interrogans serovar lai str. 56601
cucgacaaaacacu

SEQ ID NO: 735923 - RNA, 17 nt, Leptospira interrogans serovar lai str. 56601
cucgacaaucaaaacuu

SEQ ID NO: 735924 - RNA, 16 nt, Leptospira interrogans serovar lai str. 56601
cuccuccugaaaauuu

SEQ ID NO: 735925 - RNA, 15 nt, Leptospira interrogans serovar lai str. 56601
cucauuaccaauuga

SEQ ID NO: 735926 - RNA, 14 nt, Leptospira interrogans serovar lai str. 56601
cucagcucugguua

SEQ ID NO: 735927 - RNA, 14 nt, Leptospira interrogans serovar lai str. 56601
cucagcugaacuca

SEQ ID NO: 735928 - RNA, 22 nt, Leptospira interrogans serovar lai str. 56601
cucacuucuugaacucaaugca

SEQ ID NO: 735929 - RNA, 21 nt, Leptospira interrogans serovar lai str. 56601
cucaauuuugaagacuauaaa

SEQ ID NO: 735930 - RNA, 14 nt, Leptospira interrogans serovar lai str. 56601
cuaguuuguuuauc

SEQ ID NO: 735931 - RNA, 23 nt, Leptospira interrogans serovar lai str. 56601
cuauaaaauucaaaaagaaucgu

SEQ ID NO: 735932 - RNA, 12 nt, Leptospira interrogans serovar lai str. 56601
cuauauauccuu

SEQ ID NO: 735933 - RNA, 17 nt, Leptospira interrogans serovar lai str. 56601
cuacuccccgaacuaua

SEQ ID NO: 735934 - RNA, 18 nt, Leptospira interrogans serovar lai str. 56601
cuaugauauggaauuccg

SEQ ID NO: 735935 - RNA, 20 nt, Leptospira interrogans serovar lai str. 56601
cuauggaaggucucaacaac

SEQ ID NO: 735936 - RNA, 20 nt, Leptospira interrogans serovar lai str. 56601
cuauggaauuuuucaacaac

SEQ ID NO: 735937 - RNA, 17 nt, Leptospira interrogans serovar lai str. 56601
cuauucaguuuccacuc

SEQ ID NO: 735938 - RNA, 22 nt, Leptospira interrogans serovar lai str. 56601
cuaugucgaaaugguuccgaua

SEQ ID NO: 735939 - RNA, 22 nt, Leptospira interrogans serovar lai str. 56601
cuauuuuuuuaaaaaauuucuu

SEQ ID NO: 735940 - RNA, 13 nt, Leptospira interrogans serovar lai str. 56601
cucaaaaauacuu

SEQ ID NO: 735941 - RNA, 16 nt, Leptospira interrogans serovar lai str. 56601
cuauuuuaauggaaau

SEQ ID NO: 735942 - RNA, 16 nt, Leptospira interrogans serovar lai str. 56601
cuauuucuuccagaga

SEQ ID NO: 735943 - RNA, 19 nt, Leptospira interrogans serovar lai str. 56601
cucaagauuuaauuuagaa

SEQ ID NO: 735944 - RNA, 14 nt, Leptospira interrogans serovar lai str. 56601
cucaacucugguua

SEQ ID NO: 735945 - RNA, 18 nt, Leptospira interrogans serovar lai str. 56601
cucuaauguaggaacuau

SEQ ID NO: 735946 - RNA, 17 nt, Leptospira interrogans serovar lai str. 56601
cucuauuucaguucauu

SEQ ID NO: 735947 - RNA, 17 nt, Leptospira interrogans serovar lai str. 56601
cucuaguaaagaaacuc

SEQ ID NO: 735948 - RNA, 18 nt, Leptospira interrogans serovar lai str. 56601
cucuuaaguugaguucuu

SEQ ID NO: 735949 - RNA, 18 nt, Leptospira interrogans serovar lai str. 56601
cugcauuuuauuaaagaa

SEQ ID NO: 735950 - RNA, 22 nt, Leptospira interrogans serovar lai str. 56601
cgucuucuuuuuuuaccgaaga

SEQ ID NO: 735951 - RNA, 19 nt, Leptospira interrogans serovar lai str. 56601
cgugaguucgguauacgaa

SEQ ID NO: 735952 - RNA, 15 nt, Leptospira interrogans serovar lai str. 56601
cguguuugagauuaa

SEQ ID NO: 735953 - RNA, 22 nt, Leptospira interrogans serovar lai str. 56601
cguacggauugccuaaauuccu

SEQ ID NO: 735954 - RNA, 17 nt, Leptospira interrogans serovar lai str. 56601
cguaugauuugcggauc

SEQ ID NO: 735955 - RNA, 13 nt, Leptospira interrogans serovar lai str. 56601
aacgugaguucga

SEQ ID NO: 735956 - RNA, 22 nt, Leptospira interrogans serovar lai str. 56601
aacgugaguucguggagaaauc

SEQ ID NO: 735957 - RNA, 18 nt, Leptospira interrogans serovar lai str. 56601
aacgauucucguucaacu

SEQ ID NO: 735958 - RNA, 14 nt, Leptospira interrogans serovar lai str. 56601
gaccauucuuuguu

SEQ ID NO: 735959 - RNA, 17 nt, Leptospira interrogans serovar lai str. 56601
gaauaaagagaagauug

SEQ ID NO: 735960 - RNA, 19 nt, Leptospira interrogans serovar lai str. 56601
gaauaucggaauaacuuuc

SEQ ID NO: 735961 - RNA, 18 nt, Leptospira interrogans serovar lai str. 56601
gaauaucaggauaaccua

SEQ ID NO: 735962 - RNA, 16 nt, Leptospira interrogans serovar lai str. 56601
gaaucaagagaacuca

SEQ ID NO: 735963 - RNA, 16 nt, Leptospira interrogans serovar lai str. 56601
gaauuuccaaacucaa

SEQ ID NO: 735964 - RNA, 19 nt, Leptospira interrogans serovar lai str. 56601
gaauuguugaaaaauuuca

SEQ ID NO: 735965 - RNA, 18 nt, Leptospira interrogans serovar lai str. 56601
gaauuguuugaaaguucc

SEQ ID NO: 735966 - RNA, 21 nt, Leptospira interrogans serovar lai str. 56601
gaauuugacguaaaggaaucc

SEQ ID NO: 735967 - RNA, 21 nt, Leptospira interrogans serovar lai str. 56601
gaauuuguuuuuaaaauugug

SEQ ID NO: 735968 - RNA, 14 nt, Leptospira interrogans serovar lai str. 56601
gaauuuuaccagau

SEQ ID NO: 735969 - RNA, 22 nt, Leptospira interrogans serovar lai str. 56601
gaauuuuaguucucucgaaaug

SEQ ID NO: 735970 - RNA, 22 nt, Leptospira interrogans serovar lai str. 56601
gaauuuuucgguaggauccuga

SEQ ID NO: 735971 - RNA, 22 nt, Leptospira interrogans serovar lai str. 56601
gaauuuuuuauuaagaacuuuc

SEQ ID NO: 735972 - RNA, 15 nt, Leptospira interrogans serovar lai str. 56601
gaauucuaauuugcg

SEQ ID NO: 735973 - RNA, 22 nt, Leptospira interrogans serovar lai str. 56601
gaauucuuucuauuuuuuccga

SEQ ID NO: 735974 - RNA, 22 nt, Leptospira interrogans serovar lai str. 56601
gaauucuuugaaccacaguucc

SEQ ID NO: 735975 - RNA, 18 nt, Leptospira interrogans serovar lai str. 56601
gaaugccucucuaaggau

SEQ ID NO: 735976 - RNA, 17 nt, Leptospira interrogans serovar lai str. 56601
gacaagaagagauaacu

SEQ ID NO: 735977 - RNA, 17 nt, Leptospira interrogans serovar lai str. 56601
gaaauuaacucuuugga

SEQ ID NO: 735978 - RNA, 19 nt, Leptospira interrogans serovar lai str. 56601
gaaauucaucaaauuugcu

SEQ ID NO: 735979 - RNA, 23 nt, Leptospira interrogans serovar lai str. 56601
gaaaacuuguuuuagaaucuaga

SEQ ID NO: 735980 - RNA, 15 nt, Leptospira interrogans serovar lai str. 56601
gaaaagaaaccaauc

SEQ ID NO: 735981 - RNA, 23 nt, Leptospira interrogans serovar lai str. 56601
gaaaaggcugucuucagcagucu

SEQ ID NO: 735982 - RNA, 16 nt, Leptospira interrogans serovar lai str. 56601
gaaaauacuucucuaa

SEQ ID NO: 735983 - RNA, 16 nt, Leptospira interrogans serovar lai str. 56601
aaccucaaagaaauuu

SEQ ID NO: 735984 - RNA, 11 nt, Leptospira interrogans serovar lai str. 56601
aaccucucacu

SEQ ID NO: 735985 - RNA, 19 nt, Leptospira interrogans serovar lai str. 56601
gaaaauuuggacgaauccg

SEQ ID NO: 735986 - RNA, 16 nt, Leptospira interrogans serovar lai str. 56601
gaaaauuuuuuuguaa

SEQ ID NO: 735987 - RNA, 19 nt, Leptospira interrogans serovar lai str. 56601
gaaacaacauugaguuuga

SEQ ID NO: 735988 - RNA, 12 nt, Leptospira interrogans serovar lai str. 56601
gaaaauucugaa

SEQ ID NO: 735989 - RNA, 18 nt, Leptospira interrogans serovar lai str. 56601
gaaccagagauuccgauu

SEQ ID NO: 735990 - RNA, 11 nt, Leptospira interrogans serovar lai str. 56601
cuuucuaaucc

SEQ ID NO: 735991 - RNA, 16 nt, Leptospira interrogans serovar lai str. 56601
cuuuggaauuggcuuc

SEQ ID NO: 735992 - RNA, 18 nt, Leptospira interrogans serovar lai str. 56601
cuuugcgauugagaauuc

SEQ ID NO: 735993 - RNA, 22 nt, Leptospira interrogans serovar lai str. 56601
gaaaaaaguuagaaucuaaacu

SEQ ID NO: 735994 - RNA, 22 nt, Leptospira interrogans serovar lai str. 56601
gaaaaacggugcuuuguucaaa

SEQ ID NO: 735995 - RNA, 23 nt, Leptospira interrogans serovar lai str. 56601
cuuuuuuaauuauguuugccauu

SEQ ID NO: 735996 - RNA, 20 nt, Leptospira interrogans serovar lai str. 56601
cuuuuuugacuucggaacau

SEQ ID NO: 735997 - RNA, 16 nt, Leptospira interrogans serovar lai str. 56601
gaaaaccuaaaauaga

SEQ ID NO: 735998 - RNA, 17 nt, Leptospira interrogans serovar lai str. 56601
cuuuugcuuuuaaaggu

SEQ ID NO: 735999 - RNA, 20 nt, Leptospira interrogans serovar lai str. 56601
cuuuuucaaaauaagaauuu

SEQ ID NO: 736000 - RNA, 15 nt, Leptospira interrogans serovar lai str. 56601
cuuuuauaaaaucua

SEQ ID NO: 736001 - RNA, 21 nt, Leptospira interrogans serovar lai str. 56601
cuuuuacggauucucgcauuu

SEQ ID NO: 736002 - RNA, 23 nt, Leptospira interrogans serovar lai str. 56601
cuuuuccaaauauacgaaucuga

SEQ ID NO: 736003 - RNA, 20 nt, Leptospira interrogans serovar lai str. 56601
cuuuauuuuauaauucugaa

SEQ ID NO: 736004 - RNA, 13 nt, Leptospira interrogans serovar lai str. 56601
cuuucaagaauuu

SEQ ID NO: 736005 - RNA, 12 nt, Leptospira interrogans serovar lai str. 56601
cuuuagaaauuu

SEQ ID NO: 736006 - RNA, 19 nt, Leptospira interrogans serovar lai str. 56601
cuuauuucuauaaaauuga

SEQ ID NO: 736007 - RNA, 14 nt, Leptospira interrogans serovar lai str. 56601
cuuauaaugaagac

SEQ ID NO: 736008 - RNA, 19 nt, Leptospira interrogans serovar lai str. 56601
cuuaaaaugugggaauuac

SEQ ID NO: 736009 - RNA, 17 nt, Leptospira interrogans serovar lai str. 56601
cugucauaaaccgauuu

SEQ ID NO: 736010 - RNA, 22 nt, Leptospira interrogans serovar lai str. 56601
aagauuauauuauauuucguaa

SEQ ID NO: 736011 - RNA, 20 nt, Leptospira interrogans serovar lai str. 56601
aagauuaugguaaaauuuca

SEQ ID NO: 736012 - RNA, 21 nt, Leptospira interrogans serovar lai str. 56601
aagauuaugguaaaauuucau

SEQ ID NO: 736013 - RNA, 22 nt, Leptospira interrogans serovar lai str. 56601
aagaugguggaauaacaacgau

SEQ ID NO: 736014 - RNA, 17 nt, Leptospira interrogans serovar lai str. 56601
aacuugucccaaaacuu

SEQ ID NO: 736015 - RNA, 13 nt, Leptospira interrogans serovar lai str. 56601
aacuuguuccaaa

SEQ ID NO: 736016 - RNA, 11 nt, Leptospira interrogans serovar lai str. 56601
aagaaauucua

SEQ ID NO: 736017 - RNA, 16 nt, Leptospira interrogans serovar lai str. 56601
aagaagagguucugag

SEQ ID NO: 736018 - RNA, 18 nt, Leptospira interrogans serovar lai str. 56601
aacucuuaaauuucggac

SEQ ID NO: 736019 - RNA, 13 nt, Leptospira interrogans serovar lai str. 56601
aacucuuacaauu

SEQ ID NO: 736020 - RNA, 17 nt, Leptospira interrogans serovar lai str. 56601
aacugcaguaguucccg

SEQ ID NO: 736021 - RNA, 20 nt, Leptospira interrogans serovar lai str. 56601
gauacuauacaacucaguuu

SEQ ID NO: 736022 - RNA, 17 nt, Leptospira interrogans serovar lai str. 56601
gauccuuauacuuuccg

SEQ ID NO: 736023 - RNA, 17 nt, Leptospira interrogans serovar lai str. 56601
aacuucagccgcuucau

SEQ ID NO: 736024 - RNA, 16 nt, Leptospira interrogans serovar lai str. 56601
gauuuuacgaacaaau

SEQ ID NO: 736025 - RNA, 21 nt, Leptospira interrogans serovar lai str. 56601
gauuuuacgaacaaauucuaa

SEQ ID NO: 736026 - RNA, 16 nt, Leptospira interrogans serovar lai str. 56601
gauuuguaauaguucc

SEQ ID NO: 736027 - RNA, 22 nt, Leptospira interrogans serovar lai str. 56601
gauuuuuauaauuuagaguugu

SEQ ID NO: 736028 - RNA, 21 nt, Leptospira interrogans serovar lai str. 56601
gauuuuuauguaauauuucuu

SEQ ID NO: 736029 - RNA, 19 nt, Leptospira interrogans serovar lai str. 56601
gauuuuggaaagaauacga

SEQ ID NO: 736030 - RNA, 15 nt, Leptospira interrogans serovar lai str. 56601
gauugccuucggcua

SEQ ID NO: 736031 - RNA, 14 nt, Leptospira interrogans serovar lai str. 56601
gauucacuuagaaa

SEQ ID NO: 736032 - RNA, 19 nt, Leptospira interrogans serovar lai str. 56601
gauucauaaagagcguugu

SEQ ID NO: 736033 - RNA, 23 nt, Leptospira interrogans serovar lai str. 56601
gauuaaaaucagggccggagaaa

SEQ ID NO: 736034 - RNA, 18 nt, Leptospira interrogans serovar lai str. 56601
aacuguuuaauaaagauu

SEQ ID NO: 736035 - RNA, 21 nt, Leptospira interrogans serovar lai str. 56601
aacuguuugauacuuucggac

SEQ ID NO: 736036 - RNA, 21 nt, Leptospira interrogans serovar lai str. 56601
aacuuacggcugaguuccaaa

SEQ ID NO: 736037 - RNA, 21 nt, Leptospira interrogans serovar lai str. 56601
aagccaaugugccuucguuua

SEQ ID NO: 736038 - RNA, 20 nt, Leptospira interrogans serovar lai str. 56601
gcgagugcgacuacgauuuc

SEQ ID NO: 736039 - RNA, 23 nt, Leptospira interrogans serovar lai str. 56601
gccuuguguucaucguuccaaac

SEQ ID NO: 736040 - RNA, 14 nt, Leptospira interrogans serovar lai str. 56601
aagcguuuucuuaa

SEQ ID NO: 736041 - RNA, 14 nt, Leptospira interrogans serovar lai str. 56601
gcguaagaaaguuu

SEQ ID NO: 736042 - RNA, 15 nt, Leptospira interrogans serovar lai str. 56601
ggaaagaaggauuga

SEQ ID NO: 736043 - RNA, 18 nt, Leptospira interrogans serovar lai str. 56601
gcuuucguaaaaagcguu

SEQ ID NO: 736044 - RNA, 23 nt, Leptospira interrogans serovar lai str. 56601
gcucuaauauuuuaaagaaacuc

SEQ ID NO: 736045 - RNA, 17 nt, Leptospira interrogans serovar lai str. 56601
gcugaugcauccaauca

SEQ ID NO: 736046 - RNA, 16 nt, Leptospira interrogans serovar lai str. 56601
gugaacagucuuuuua

SEQ ID NO: 736047 - RNA, 18 nt, Leptospira interrogans serovar lai str. 56601
gucguauauuagauuuau

SEQ ID NO: 736048 - RNA, 17 nt, Leptospira interrogans serovar lai str. 56601
guccggguuagaaucaa

SEQ ID NO: 736049 - RNA, 19 nt, Leptospira interrogans serovar lai str. 56601
guccgcaauaucccaaauu

SEQ ID NO: 736050 - RNA, 19 nt, Leptospira interrogans serovar lai str. 56601
guaguuuauuuuucuuuua

SEQ ID NO: 736051 - RNA, 21 nt, Leptospira interrogans serovar lai str. 56601
guaggauguugcucuaagaga

SEQ ID NO: 736052 - RNA, 19 nt, Leptospira interrogans serovar lai str. 56601
guagaaccuggauuuguaa

SEQ ID NO: 736053 - RNA, 12 nt, Leptospira interrogans serovar lai str. 56601
guagagaaacuu

SEQ ID NO: 736054 - RNA, 15 nt, Leptospira interrogans serovar lai str. 56601
guaauucguuccaaa

SEQ ID NO: 736055 - RNA, 24 nt, Leptospira interrogans serovar lai str. 56601
guaauuggccguaauaucuccaaa

SEQ ID NO: 736056 - RNA, 18 nt, Leptospira interrogans serovar lai str. 56601
guaaucugugggaacuac

SEQ ID NO: 736057 - RNA, 14 nt, Leptospira interrogans serovar lai str. 56601
guaaacuugauuaa

SEQ ID NO: 736058 - RNA, 17 nt, Leptospira interrogans serovar lai str. 56601
ggcuaaagaauacauuu

SEQ ID NO: 736059 - RNA, 21 nt, Leptospira interrogans serovar lai str. 56601
ggaucgcguuugaaacucagu

SEQ ID NO: 736060 - RNA, 23 nt, Leptospira interrogans serovar lai str. 56601
ggaucucgagugagguuuuggaa

SEQ ID NO: 736061 - RNA, 13 nt, Leptospira interrogans serovar lai str. 56601
ggaugaauugauu

SEQ ID NO: 736062 - RNA, 20 nt, Leptospira interrogans serovar lai str. 56601
aacauaauguuucaauuccu

SEQ ID NO: 736063 - RNA, 19 nt, Leptospira interrogans serovar lai str. 56601
aacauauuggauaauucca

SEQ ID NO: 736064 - RNA, 15 nt, Leptospira interrogans serovar lai str. 56601
aacauccuucaaacu

SEQ ID NO: 736065 - RNA, 20 nt, Leptospira interrogans serovar lai str. 56601
aacaucguuuauaaaucgaa

SEQ ID NO: 736066 - RNA, 14 nt, Leptospira interrogans serovar lai str. 56601
cggguuagaaucaa

SEQ ID NO: 736067 - RNA, 22 nt, Leptospira interrogans serovar lai str. 56601
aaccaucuuugauauuuggauc

SEQ ID NO: 736068 - RNA, 14 nt, Leptospira interrogans serovar lai str. 56601
aaccauuucaaguu

SEQ ID NO: 736069 - RNA, 20 nt, Leptospira interrogans serovar lai str. 56601
cgcgaucuauagagagcguu

SEQ ID NO: 736070 - RNA, 19 nt, Leptospira interrogans serovar lai str. 56601
cgcgauucauaaagagcgu

SEQ ID NO: 736071 - RNA, 22 nt, Leptospira interrogans serovar lai str. 56601
cggaauuuucgcuacaaucgcu

SEQ ID NO: 736072 - RNA, 14 nt, Leptospira interrogans serovar lai str. 56601
cgcuuuuaguuuuu

SEQ ID NO: 736073 - RNA, 18 nt, Leptospira interrogans serovar lai str. 56601
aaaugaugugggaacucu

SEQ ID NO: 736074 - RNA, 22 nt, Leptospira interrogans serovar lai str. 56601
aaaugcucaaaaauuauaaauc

SEQ ID NO: 736075 - RNA, 12 nt, Leptospira interrogans serovar lai str. 56601
ccgccuuuccaa

SEQ ID NO: 736076 - RNA, 23 nt, Leptospira interrogans serovar lai str. 56601
aaauuuaagucccgcagaacuau

SEQ ID NO: 736077 - RNA, 18 nt, Leptospira interrogans serovar lai str. 56601
aaauuucccgauucucaa

SEQ ID NO: 736078 - RNA, 12 nt, Leptospira interrogans serovar lai str. 56601
aaauuuccggaa

SEQ ID NO: 736079 - RNA, 13 nt, Leptospira interrogans serovar lai str. 56601
aaauuuccggaaa

SEQ ID NO: 736080 - RNA, 14 nt, Leptospira interrogans serovar lai str. 56601
aaauuuccggaaaa

SEQ ID NO: 736081 - RNA, 19 nt, Leptospira interrogans serovar lai str. 56601
aaauuuguaauaguuccca

SEQ ID NO: 736082 - RNA, 15 nt, Leptospira interrogans serovar lai str. 56601
aaauuguguaugagu

SEQ ID NO: 736083 - RNA, 16 nt, Leptospira interrogans serovar lai str. 56601
ccugagacgcugaguu

SEQ ID NO: 736084 - RNA, 19 nt, Leptospira interrogans serovar lai str. 56601
ccugaaaauuuuccuuuaa

SEQ ID NO: 736085 - RNA, 14 nt, Leptospira interrogans serovar lai str. 56601
ccuccuuuuucaaa

SEQ ID NO: 736086 - RNA, 21 nt, Leptospira interrogans serovar lai str. 56601
cgauuguaacgaaaauuccga

SEQ ID NO: 736087 - RNA, 14 nt, Leptospira interrogans serovar lai str. 56601
cgauugauugaagc

SEQ ID NO: 736088 - RNA, 14 nt, Leptospira interrogans serovar lai str. 56601
cgauuuuucaaacg

SEQ ID NO: 736089 - RNA, 19 nt, Leptospira interrogans serovar lai str. 56601
cgauucagagugguuucuu

SEQ ID NO: 736090 - RNA, 19 nt, Leptospira interrogans serovar lai str. 56601
cgaucuguaaaauguagau

SEQ ID NO: 736091 - RNA, 17 nt, Leptospira interrogans serovar lai str. 56601
cgagcucacguugaagu

SEQ ID NO: 736092 - RNA, 15 nt, Leptospira interrogans serovar lai str. 56601
aacaacauugaguuu

SEQ ID NO: 736093 - RNA, 15 nt, Leptospira interrogans serovar lai str. 56601
aacaaauucuacaau

SEQ ID NO: 736094 - RNA, 20 nt, Leptospira interrogans serovar lai str. 56601
cgaauucacguuauuuagau

SEQ ID NO: 736095 - RNA, 17 nt, Leptospira interrogans serovar lai str. 56601
cgaagauaccaaauaaa

SEQ ID NO: 736096 - RNA, 24 nt, Leptospira interrogans serovar lai str. 56601
aaaucuuuagaauuuuucgaaaca

SEQ ID NO: 736097 - RNA, 18 nt, Leptospira interrogans serovar lai str. 56601
aaaugaaaacgaugucuu

SEQ ID NO: 736098 - RNA, 15 nt, Leptospira interrogans serovar lai str. 56601
cccuaagcguucuaa

SEQ ID NO: 736099 - RNA, 17 nt, Leptospira interrogans serovar lai str. 56601
aaaucucaauucaguaa

SEQ ID NO: 736100 - RNA, 20 nt, Leptospira interrogans serovar lai str. 56601
ccauucaacuuagaacuugu

SEQ ID NO: 736101 - RNA, 17 nt, Leptospira interrogans serovar lai str. 56601
aaaucgaguuucacaaa

SEQ ID NO: 736102 - RNA, 15 nt, Leptospira interrogans serovar lai str. 56601
aaaucgauuucuaaa

SEQ ID NO: 736103 - RNA, 20 nt, Leptospira interrogans serovar lai str. 56601
ccauucucacucgaacuucg

SEQ ID NO: 736104 - RNA, 20 nt, Leptospira interrogans serovar lai str. 56601
ccccaagacgucuacagaua

SEQ ID NO: 736105 - RNA, 16 nt, Leptospira interrogans serovar lai str. 56601
aaaucauauuuucaaa

SEQ ID NO: 736106 - RNA, 13 nt, Leptospira interrogans serovar lai str. 56601
ccagcauuuagaa

SEQ ID NO: 736107 - RNA, 20 nt, Leptospira interrogans serovar lai str. 56601
aaagguugagcaguaaaauc

SEQ ID NO: 736108 - RNA, 20 nt, Leptospira interrogans serovar lai str. 56601
aaagguugaguaguaaaauc

SEQ ID NO: 736109 - RNA, 22 nt, Leptospira interrogans serovar lai str. 56601
aaagguugaguaguaaaaucuu

SEQ ID NO: 736110 - RNA, 18 nt, Leptospira interrogans serovar lai str. 56601
aaaggcccuuuguagaaa

SEQ ID NO: 736111 - RNA, 18 nt, Leptospira interrogans serovar lai str. 56601
aaaguaauuuaucuguaa

SEQ ID NO: 736112 - RNA, 18 nt, Leptospira interrogans serovar lai str. 56601
aaaguacgaaauuccuac

SEQ ID NO: 736113 - RNA, 17 nt, Leptospira interrogans serovar lai str. 56601
aaagucaaaaaaugguu

SEQ ID NO: 736114 - RNA, 21 nt, Leptospira interrogans serovar lai str. 56601
aaaguaguaugcgaaauuccu

SEQ ID NO: 736115 - RNA, 12 nt, Leptospira interrogans serovar lai str. 56601
aaagucuugaac

SEQ ID NO: 736116 - RNA, 22 nt, Leptospira interrogans serovar lai str. 56601
aaaguucucuucauccagauuc

SEQ ID NO: 736117 - RNA, 11 nt, Leptospira interrogans serovar lai str. 56601
aaaguugaaag

SEQ ID NO: 736118 - RNA, 20 nt, Leptospira interrogans serovar lai str. 56601
aaaguucccgccaaaugcug

SEQ ID NO: 736119 - RNA, 19 nt, Leptospira interrogans serovar lai str. 56601
aaaguuuaugaauuuccau

SEQ ID NO: 736120 - RNA, 16 nt, Leptospira interrogans serovar lai str. 56601
aaaguuaauucuaaau

SEQ ID NO: 736121 - RNA, 16 nt, Leptospira interrogans serovar lai str. 56601
aaaguuucaucuuuga

SEQ ID NO: 736122 - RNA, 16 nt, Leptospira interrogans serovar lai str. 56601
ccagauucccuuuuga

SEQ ID NO: 736123 - RNA, 14 nt, Leptospira interrogans serovar lai str. 56601
ccagcaaaacacuu

SEQ ID NO: 736124 - RNA, 13 nt, Leptospira interrogans serovar lai str. 56601
aaaggaauccaug

SEQ ID NO: 736125 - RNA, 18 nt, Leptospira interrogans serovar lai str. 56601
aaaggaauucgaauuccu

SEQ ID NO: 736126 - RNA, 13 nt, Leptospira interrogans serovar lai str. 56601
aaaggaaaacgau

SEQ ID NO: 736127 - RNA, 20 nt, Leptospira interrogans serovar lai str. 56601
aaagcuugauuauuauuuug

SEQ ID NO: 736128 - RNA, 15 nt, Leptospira interrogans serovar lai str. 56601
ccacauuuuagaaau

SEQ ID NO: 736129 - RNA, 16 nt, Leptospira interrogans serovar lai str. 56601
ccacauuuugaagguu

SEQ ID NO: 736130 - RNA, 20 nt, Leptospira interrogans serovar lai str. 56601
ccaaauauacgaaucugacc

SEQ ID NO: 736131 - RNA, 16 nt, Leptospira interrogans serovar lai str. 56601
ccaacgaaguuccaac

SEQ ID NO: 736132 - RNA, 20 nt, Leptospira interrogans serovar lai str. 56601
caucucaaaaauaucuuaga

SEQ ID NO: 736133 - RNA, 16 nt, Leptospira interrogans serovar lai str. 56601
caucgcuucuaugguc

SEQ ID NO: 736134 - RNA, 12 nt, Leptospira interrogans serovar lai str. 56601
caguuaaauuca

SEQ ID NO: 736135 - RNA, 19 nt, Leptospira interrogans serovar lai str. 56601
caguguccauuucaauaca

SEQ ID NO: 736136 - RNA, 12 nt, Leptospira interrogans serovar lai str. 56601
cauaaugaagau

SEQ ID NO: 736137 - RNA, 16 nt, Leptospira interrogans serovar lai str. 56601
aaagauuaaauucuau

SEQ ID NO: 736138 - RNA, 17 nt, Leptospira interrogans serovar lai str. 56601
caggacggaaucggcuu

SEQ ID NO: 736139 - RNA, 20 nt, Leptospira interrogans serovar lai str. 56601
cagauuuauuuuagaaugug

SEQ ID NO: 736140 - RNA, 23 nt, Leptospira interrogans serovar lai str. 56601
cagauuuuauuuugauuccaaag

SEQ ID NO: 736141 - RNA, 20 nt, Leptospira interrogans serovar lai str. 56601
cagcaaaacacuuuccuuaa

SEQ ID NO: 736142 - RNA, 19 nt, Leptospira interrogans serovar lai str. 56601
aaagagaugauuucuugag

SEQ ID NO: 736143 - RNA, 16 nt, Leptospira interrogans serovar lai str. 56601
aaagagacauugaaga

SEQ ID NO: 736144 - RNA, 18 nt, Leptospira interrogans serovar lai str. 56601
aaagacaauauucuugau

SEQ ID NO: 736145 - RNA, 22 nt, Leptospira interrogans serovar lai str. 56601
cagauaaaaauaguauccaaaa

SEQ ID NO: 736146 - RNA, 13 nt, Leptospira interrogans serovar lai str. 56601
cagaucaagaauu

SEQ ID NO: 736147 - RNA, 20 nt, Leptospira interrogans serovar lai str. 56601
cacgauuuauagagagcguu

SEQ ID NO: 736148 - RNA, 16 nt, Leptospira interrogans serovar lai str. 56601
caccuucucuuuuaaa

SEQ ID NO: 736149 - RNA, 19 nt, Leptospira interrogans serovar lai str. 56601
caauacaucgcuuccugaa

SEQ ID NO: 736150 - RNA, 14 nt, Leptospira interrogans serovar lai str. 56601
caauuguuggcuuu

SEQ ID NO: 736151 - RNA, 16 nt, Leptospira interrogans serovar lai str. 56601
caauuguccauuucca

SEQ ID NO: 736152 - RNA, 17 nt, Leptospira interrogans serovar lai str. 56601
caacuuaaggaaauuca

SEQ ID NO: 736153 - RNA, 23 nt, Leptospira interrogans serovar lai str. 56601
caagauucauuucguaaaaucca

SEQ ID NO: 736154 - RNA, 17 nt, Leptospira interrogans serovar lai str. 56601
caaguuaauagaguugu

SEQ ID NO: 736155 - RNA, 20 nt, Leptospira interrogans serovar lai str. 56601
caaguuugugagaguuccca

SEQ ID NO: 736156 - RNA, 18 nt, Leptospira interrogans serovar lai str. 56601
caaguugaauaggauuuu

SEQ ID NO: 736157 - RNA, 13 nt, Leptospira interrogans serovar lai str. 56601
caaguguuccgac

SEQ ID NO: 736158 - RNA, 20 nt, Leptospira interrogans serovar lai str. 56601
caaguuauuguaaaacucca

SEQ ID NO: 736159 - RNA, 12 nt, Leptospira interrogans serovar lai str. 56601
caaguuccaaau

SEQ ID NO: 736160 - RNA, 15 nt, Leptospira interrogans serovar lai str. 56601
auuuguaaaauucag

SEQ ID NO: 736161 - RNA, 17 nt, Leptospira interrogans serovar lai str. 56601
auuuguaaauucuccgu

SEQ ID NO: 736162 - RNA, 23 nt, Leptospira interrogans serovar lai str. 56601
auuugaaaaagggauucuauucu

SEQ ID NO: 736163 - RNA, 19 nt, Leptospira interrogans serovar lai str. 56601
auuucugcaaaaaccguuc

SEQ ID NO: 736164 - RNA, 22 nt, Leptospira interrogans serovar lai str. 56601
auuucuucauaucaaauucaug

SEQ ID NO: 736165 - RNA, 18 nt, Leptospira interrogans serovar lai str. 56601
auuucuguagaaauucua

SEQ ID NO: 736166 - RNA, 16 nt, Leptospira interrogans serovar lai str. 56601
auuucuggaaauucug

SEQ ID NO: 736167 - RNA, 19 nt, Leptospira interrogans serovar lai str. 56601
auuuuauguaaaucggcaa

SEQ ID NO: 736168 - RNA, 14 nt, Leptospira interrogans serovar lai str. 56601
auuuucaaaaucua

SEQ ID NO: 736169 - RNA, 18 nt, Leptospira interrogans serovar lai str. 56601
auuuuaguucucucgaaa

SEQ ID NO: 736170 - RNA, 14 nt, Leptospira interrogans serovar lai str. 56601
auuuuauaaucgaa

SEQ ID NO: 736171 - RNA, 13 nt, Leptospira interrogans serovar lai str. 56601
auuuuaccaaauu

SEQ ID NO: 736172 - RNA, 20 nt, Leptospira interrogans serovar lai str. 56601
auuuuaagaaucgaucugca

SEQ ID NO: 736173 - RNA, 21 nt, Leptospira interrogans serovar lai str. 56601
auuuuacgaacaaauucuaca

SEQ ID NO: 736174 - RNA, 21 nt, Leptospira interrogans serovar lai str. 56601
auuuuacgaaccaauucuaaa

SEQ ID NO: 736175 - RNA, 15 nt, Leptospira interrogans serovar lai str. 56601
auuuuaggaaucgau

SEQ ID NO: 736176 - RNA, 16 nt, Leptospira interrogans serovar lai str. 56601
auuuuagguauuucua

SEQ ID NO: 736177 - RNA, 17 nt, Leptospira interrogans serovar lai str. 56601
auuuucaaguaaaucug

SEQ ID NO: 736178 - RNA, 23 nt, Leptospira interrogans serovar lai str. 56601
auuuucagguuuuaaaacggaau

SEQ ID NO: 736179 - RNA, 19 nt, Leptospira interrogans serovar lai str. 56601
auuuuccuuuuuccggaau

SEQ ID NO: 736180 - RNA, 15 nt, Leptospira interrogans serovar lai str. 56601
auuuucuaaagauuc

SEQ ID NO: 736181 - RNA, 15 nt, Leptospira interrogans serovar lai str. 56601
auuuugaaaauacgc

SEQ ID NO: 736182 - RNA, 18 nt, Leptospira interrogans serovar lai str. 56601
caaaaaugugggaacuau

SEQ ID NO: 736183 - RNA, 19 nt, Leptospira interrogans serovar lai str. 56601
caaaacaaucuuagaaugu

SEQ ID NO: 736184 - RNA, 17 nt, Leptospira interrogans serovar lai str. 56601
caaaacugcuucaauug

SEQ ID NO: 736185 - RNA, 16 nt, Leptospira interrogans serovar lai str. 56601
caaaagucauugaagg

SEQ ID NO: 736186 - RNA, 12 nt, Leptospira interrogans serovar lai str. 56601
caaaagcaaaau

SEQ ID NO: 736187 - RNA, 14 nt, Leptospira interrogans serovar lai str. 56601
caaaaccuucguga

SEQ ID NO: 736188 - RNA, 13 nt, Leptospira interrogans serovar lai str. 56601
caaaacgguaauu

SEQ ID NO: 736189 - RNA, 16 nt, Leptospira interrogans serovar lai str. 56601
auuuuuuuaagaauuu

SEQ ID NO: 736190 - RNA, 19 nt, Leptospira interrogans serovar lai str. 56601
auuuuuuucgcaaauucua

SEQ ID NO: 736191 - RNA, 17 nt, Leptospira interrogans serovar lai str. 56601
auuuuuuaauaacucua

SEQ ID NO: 736192 - RNA, 15 nt, Leptospira interrogans serovar lai str. 56601
auuuuucuucuuugu

SEQ ID NO: 736193 - RNA, 18 nt, Leptospira interrogans serovar lai str. 56601
auuuuuuauuuuugucua

SEQ ID NO: 736194 - RNA, 18 nt, Leptospira interrogans serovar lai str. 56601
auuuuucaacaacucuau

SEQ ID NO: 736195 - RNA, 19 nt, Leptospira interrogans serovar lai str. 56601
auuuuucugaaaaaguugg

SEQ ID NO: 736196 - RNA, 14 nt, Leptospira interrogans serovar lai str. 56601
auuuugauuccaaa

SEQ ID NO: 736197 - RNA, 17 nt, Leptospira interrogans serovar lai str. 56601
auuuuuaaaaagaauug

SEQ ID NO: 736198 - RNA, 19 nt, Leptospira interrogans serovar lai str. 56601
auuuuuacucaaagaaucg

SEQ ID NO: 736199 - RNA, 15 nt, Leptospira interrogans serovar lai str. 56601
caaaaugaacucaac

SEQ ID NO: 736200 - RNA, 21 nt, Leptospira interrogans serovar lai str. 56601
caaaauuuuuuccuuuaaacu

SEQ ID NO: 736201 - RNA, 20 nt, Leptospira interrogans serovar lai str. 56601
caaacggucuuucuucugua

SEQ ID NO: 736202 - RNA, 19 nt, Leptospira interrogans serovar lai str. 56601
caaagaauuucggcuugau

SEQ ID NO: 736203 - RNA, 18 nt, Leptospira interrogans serovar lai str. 56601
caaauuguaggaguucau

SEQ ID NO: 736204 - RNA, 15 nt, Leptospira interrogans serovar lai str. 56601
caaauugaguuucuu

SEQ ID NO: 736205 - RNA, 18 nt, Leptospira interrogans serovar lai str. 56601
caaauucaucacuucuac

SEQ ID NO: 736206 - RNA, 20 nt, Leptospira interrogans serovar lai str. 56601
caaauucacauaaaguuaau

SEQ ID NO: 736207 - RNA, 13 nt, Leptospira interrogans serovar lai str. 56601
caaaucgauuucu

SEQ ID NO: 736208 - RNA, 19 nt, Leptospira interrogans serovar lai str. 56601
caaaucgcauuguuuaaau

SEQ ID NO: 736209 - RNA, 18 nt, Leptospira interrogans serovar lai str. 56601
auucuagaauauaaccgu

SEQ ID NO: 736210 - RNA, 18 nt, Leptospira interrogans serovar lai str. 56601
auucuaauugugggaacu

SEQ ID NO: 736211 - RNA, 23 nt, Leptospira interrogans serovar lai str. 56601
auucuaauuuaaaaaagaagaau

SEQ ID NO: 736212 - RNA, 23 nt, Leptospira interrogans serovar lai str. 56601
auucuacauuuguagagauugau

SEQ ID NO: 736213 - RNA, 20 nt, Leptospira interrogans serovar lai str. 56601
auucuaaaauuauaggaacu

SEQ ID NO: 736214 - RNA, 20 nt, Leptospira interrogans serovar lai str. 56601
auucuaaaauuguagaaacu

SEQ ID NO: 736215 - RNA, 20 nt, Leptospira interrogans serovar lai str. 56601
auucuaaaauuguaggaacu

SEQ ID NO: 736216 - RNA, 20 nt, Leptospira interrogans serovar lai str. 56601
auucguaaaaaccgcaaauu

SEQ ID NO: 736217 - RNA, 21 nt, Leptospira interrogans serovar lai str. 56601
auuuaaguauuauaaauuuug

SEQ ID NO: 736218 - RNA, 17 nt, Leptospira interrogans serovar lai str. 56601
auuuaaaugugggaacu

SEQ ID NO: 736219 - RNA, 19 nt, Leptospira interrogans serovar lai str. 56601
auuuaacgacauuagaacu

SEQ ID NO: 736220 - RNA, 19 nt, Leptospira interrogans serovar lai str. 56601
auuuaacgauauuagaacu

SEQ ID NO: 736221 - RNA, 23 nt, Leptospira interrogans serovar lai str. 56601
auuuauuuucauaggaaauucuu

SEQ ID NO: 736222 - RNA, 12 nt, Leptospira interrogans serovar lai str. 56601
auuucaaugcaa

SEQ ID NO: 736223 - RNA, 19 nt, Leptospira interrogans serovar lai str. 56601
auuucacgacgucuaugac

SEQ ID NO: 736224 - RNA, 21 nt, Leptospira interrogans serovar lai str. 56601
auuuauucuacaugauucauu

SEQ ID NO: 736225 - RNA, 17 nt, Leptospira interrogans serovar lai str. 56601
auuuauguucguuccca

SEQ ID NO: 736226 - RNA, 14 nt, Leptospira interrogans serovar lai str. 56601
auuucuaaauugug

SEQ ID NO: 736227 - RNA, 23 nt, Leptospira interrogans serovar lai str. 56601
auuucuauaaaauugaguuucua

SEQ ID NO: 736228 - RNA, 18 nt, Leptospira interrogans serovar lai str. 56601
auuuccaacgaaguucca

SEQ ID NO: 736229 - RNA, 15 nt, Leptospira interrogans serovar lai str. 56601
auuucauuucuauga

SEQ ID NO: 736230 - RNA, 20 nt, Leptospira interrogans serovar lai str. 56601
auuucccaaaauuucagaua

SEQ ID NO: 736231 - RNA, 19 nt, Leptospira interrogans serovar lai str. 56601
auuuccgucguuugcaucc

SEQ ID NO: 736232 - RNA, 20 nt, Leptospira interrogans serovar lai str. 56601
auuucagcuagaagaguuaa

SEQ ID NO: 736233 - RNA, 19 nt, Leptospira interrogans serovar lai str. 56601
auuacguagcgaagaauau

SEQ ID NO: 736234 - RNA, 13 nt, Leptospira interrogans serovar lai str. 56601
auuacucuuugag

SEQ ID NO: 736235 - RNA, 16 nt, Leptospira interrogans serovar lai str. 56601
auuagaguuguugaaa

SEQ ID NO: 736236 - RNA, 14 nt, Leptospira interrogans serovar lai str. 56601
auuaugaagaauga

SEQ ID NO: 736237 - RNA, 15 nt, Leptospira interrogans serovar lai str. 56601
auuaucuauuccaau

SEQ ID NO: 736238 - RNA, 13 nt, Leptospira interrogans serovar lai str. 56601
aaacucaagcgaa

SEQ ID NO: 736239 - RNA, 15 nt, Leptospira interrogans serovar lai str. 56601
aaacugauuaaaauc

SEQ ID NO: 736240 - RNA, 13 nt, Leptospira interrogans serovar lai str. 56601
aaacuaggaucuc

SEQ ID NO: 736241 - RNA, 22 nt, Leptospira interrogans serovar lai str. 56601
aaacuacuuccgucuuuuguaa

SEQ ID NO: 736242 - RNA, 17 nt, Leptospira interrogans serovar lai str. 56601
aaacuaauuuguaggaa

SEQ ID NO: 736243 - RNA, 14 nt, Leptospira interrogans serovar lai str. 56601
auuccaagcaauuc

SEQ ID NO: 736244 - RNA, 15 nt, Leptospira interrogans serovar lai str. 56601
auguaagaaaaucug

SEQ ID NO: 736245 - RNA, 15 nt, Leptospira interrogans serovar lai str. 56601
augaaauuuucuuag

SEQ ID NO: 736246 - RNA, 14 nt, Leptospira interrogans serovar lai str. 56601
augaaaaagaauuu

SEQ ID NO: 736247 - RNA, 16 nt, Leptospira interrogans serovar lai str. 56601
augauucauuuuucug

SEQ ID NO: 736248 - RNA, 13 nt, Leptospira interrogans serovar lai str. 56601
augauuucuugau

SEQ ID NO: 736249 - RNA, 13 nt, Leptospira interrogans serovar lai str. 56601
augagaguuccca

SEQ ID NO: 736250 - RNA, 21 nt, Leptospira interrogans serovar lai str. 56601
augagauuuuuggaaauucca

SEQ ID NO: 736251 - RNA, 20 nt, Leptospira interrogans serovar lai str. 56601
aucguacgaaucagauccuu

SEQ ID NO: 736252 - RNA, 22 nt, Leptospira interrogans serovar lai str. 56601
aucgguuuucguuguauggaaa

SEQ ID NO: 736253 - RNA, 20 nt, Leptospira interrogans serovar lai str. 56601
aucgaacccagucuucuugu

SEQ ID NO: 736254 - RNA, 16 nt, Leptospira interrogans serovar lai str. 56601
aucgaauuucuucaua

SEQ ID NO: 736255 - RNA, 13 nt, Leptospira interrogans serovar lai str. 56601
aucguuagguuau

SEQ ID NO: 736256 - RNA, 21 nt, Leptospira interrogans serovar lai str. 56601
aucgaaaauuaacaaucgauu

SEQ ID NO: 736257 - RNA, 20 nt, Leptospira interrogans serovar lai str. 56601
auccuuucauguuauaucga

SEQ ID NO: 736258 - RNA, 20 nt, Leptospira interrogans serovar lai str. 56601
auccuuccuccaaaauauga

SEQ ID NO: 736259 - RNA, 14 nt, Leptospira interrogans serovar lai str. 56601
auccaaaacaaucu

SEQ ID NO: 736260 - RNA, 22 nt, Leptospira interrogans serovar lai str. 56601
aucauuuaaagcaaauaccaaa

SEQ ID NO: 736261 - RNA, 19 nt, Leptospira interrogans serovar lai str. 56601
aucauuacguaaagaacuu

SEQ ID NO: 736262 - RNA, 22 nt, Leptospira interrogans serovar lai str. 56601
aucauggguucuuuacgucaaa

SEQ ID NO: 736263 - RNA, 17 nt, Leptospira interrogans serovar lai str. 56601
auccauacaacuuucag

SEQ ID NO: 736264 - RNA, 13 nt, Leptospira interrogans serovar lai str. 56601
auccauaaaucga

SEQ ID NO: 736265 - RNA, 22 nt, Leptospira interrogans serovar lai str. 56601
aucccaugauagaguucugaaa

SEQ ID NO: 736266 - RNA, 15 nt, Leptospira interrogans serovar lai str. 56601
aucauagaguuucuu

SEQ ID NO: 736267 - RNA, 16 nt, Leptospira interrogans serovar lai str. 56601
aucaauagaaauacca

SEQ ID NO: 736268 - RNA, 18 nt, Leptospira interrogans serovar lai str. 56601
aucacgccgaaauuacga

SEQ ID NO: 736269 - RNA, 15 nt, Leptospira interrogans serovar lai str. 56601
aucacgauuuuacga

SEQ ID NO: 736270 - RNA, 14 nt, Leptospira interrogans serovar lai str. 56601
auaucuuaagaauu

SEQ ID NO: 736271 - RNA, 18 nt, Leptospira interrogans serovar lai str. 56601
auaugaauuaauuuguaa

SEQ ID NO: 736272 - RNA, 20 nt, Leptospira interrogans serovar lai str. 56601
auaugaacguauucuuuaau

SEQ ID NO: 736273 - RNA, 13 nt, Leptospira interrogans serovar lai str. 56601
aucaaaauccguu

SEQ ID NO: 736274 - RNA, 14 nt, Leptospira interrogans serovar lai str. 56601
auauuuuuuccaaa

SEQ ID NO: 736275 - RNA, 15 nt, Leptospira interrogans serovar lai str. 56601
aucaaaaaauugcau

SEQ ID NO: 736276 - RNA, 22 nt, Leptospira interrogans serovar lai str. 56601
auauuugcauaaacuucaucua

SEQ ID NO: 736277 - RNA, 17 nt, Leptospira interrogans serovar lai str. 56601
auagguuccaauuccau

SEQ ID NO: 736278 - RNA, 22 nt, Leptospira interrogans serovar lai str. 56601
auagcuguuuuaguuguuccua

SEQ ID NO: 736279 - RNA, 19 nt, Leptospira interrogans serovar lai str. 56601
auaaauagggaauauucca

SEQ ID NO: 736280 - RNA, 11 nt, Leptospira interrogans serovar lai str. 56601
auaaagaaucg

SEQ ID NO: 736281 - RNA, 16 nt, Leptospira interrogans serovar lai str. 56601
auaaacuguaaacuug

SEQ ID NO: 736282 - RNA, 21 nt, Leptospira interrogans serovar lai str. 56601
auaaaauauagugguuuguaa

SEQ ID NO: 736283 - RNA, 16 nt, Leptospira interrogans serovar lai str. 56601
auaaaauguaggaacu

SEQ ID NO: 736284 - RNA, 20 nt, Leptospira interrogans serovar lai str. 56601
auaaaauugaguuucuauaa

SEQ ID NO: 736285 - RNA, 16 nt, Leptospira interrogans serovar lai str. 56601
auaaaauuuuccggac

SEQ ID NO: 736286 - RNA, 20 nt, Leptospira interrogans serovar lai str. 56601
aguuaugacccaagauucaa

SEQ ID NO: 736287 - RNA, 15 nt, Leptospira interrogans serovar lai str. 56601
aguucaauguaagaa

SEQ ID NO: 736288 - RNA, 13 nt, Leptospira interrogans serovar lai str. 56601
aguucagauucga

SEQ ID NO: 736289 - RNA, 20 nt, Leptospira interrogans serovar lai str. 56601
aguuguugaaaaauuccaua

SEQ ID NO: 736290 - RNA, 19 nt, Leptospira interrogans serovar lai str. 56601
aguuguugaacauuccaua

SEQ ID NO: 736291 - RNA, 17 nt, Leptospira interrogans serovar lai str. 56601
auaaaaauaaagaaacu

SEQ ID NO: 736292 - RNA, 21 nt, Leptospira interrogans serovar lai str. 56601
auaaaaccugauuuuucugua

SEQ ID NO: 736293 - RNA, 22 nt, Leptospira interrogans serovar lai str. 56601
auaaaacguggauuuuauguaa

SEQ ID NO: 736294 - RNA, 16 nt, Leptospira interrogans serovar lai str. 56601
auaaggcaaaagacuc

SEQ ID NO: 736295 - RNA, 20 nt, Leptospira interrogans serovar lai str. 56601
auaaucauggccuucuggaa

SEQ ID NO: 736296 - RNA, 14 nt, Leptospira interrogans serovar lai str. 56601
auacaauauuucgu

SEQ ID NO: 736297 - RNA, 14 nt, Leptospira interrogans serovar lai str. 56601
auacaauuugaucu

SEQ ID NO: 736298 - RNA, 14 nt, Leptospira interrogans serovar lai str. 56601
auaaugaaaacuug

SEQ ID NO: 736299 - RNA, 15 nt, Leptospira interrogans serovar lai str. 56601
agucuauuucccaaa

SEQ ID NO: 736300 - RNA, 14 nt, Leptospira interrogans serovar lai str. 56601
aggugcuacugcaa

SEQ ID NO: 736301 - RNA, 14 nt, Leptospira interrogans serovar lai str. 56601
agguauaaccuuug

SEQ ID NO: 736302 - RNA, 22 nt, Leptospira interrogans serovar lai str. 56601
agucccaauuccaccuuggaaa

SEQ ID NO: 736303 - RNA, 19 nt, Leptospira interrogans serovar lai str. 56601
agucccacauuuuugugaa

SEQ ID NO: 736304 - RNA, 20 nt, Leptospira interrogans serovar lai str. 56601
aggcuggcaaaauccgaaac

SEQ ID NO: 736305 - RNA, 22 nt, Leptospira interrogans serovar lai str. 56601
aggcugccgcucuuucuuccgg

SEQ ID NO: 736306 - RNA, 18 nt, Leptospira interrogans serovar lai str. 56601
agauuacauuuuucuaaa

SEQ ID NO: 736307 - RNA, 17 nt, Leptospira interrogans serovar lai str. 56601
agauuuaugacagcuug

SEQ ID NO: 736308 - RNA, 17 nt, Leptospira interrogans serovar lai str. 56601
agauuucuauauucaaa

SEQ ID NO: 736309 - RNA, 20 nt, Leptospira interrogans serovar lai str. 56601
agauuucggauucuucccca

SEQ ID NO: 736310 - RNA, 14 nt, Leptospira interrogans serovar lai str. 56601
agauuuguugaaaa

SEQ ID NO: 736311 - RNA, 16 nt, Leptospira interrogans serovar lai str. 56601
agcuaauaaucgauuu

SEQ ID NO: 736312 - RNA, 16 nt, Leptospira interrogans serovar lai str. 56601
aggauuccuuuccgau

SEQ ID NO: 736313 - RNA, 20 nt, Leptospira interrogans serovar lai str. 56601
aggauaaccuaaaauuucca

SEQ ID NO: 736314 - RNA, 19 nt, Leptospira interrogans serovar lai str. 56601
aggaacucaugauucugaa

SEQ ID NO: 736315 - RNA, 19 nt, Leptospira interrogans serovar lai str. 56601
aggaacuuuuauaauucaa

SEQ ID NO: 736316 - RNA, 19 nt, Leptospira interrogans serovar lai str. 56601
aggaauucauaauucugaa

SEQ ID NO: 736317 - RNA, 15 nt, Leptospira interrogans serovar lai str. 56601
aggaaucguuuguaa

SEQ ID NO: 736318 - RNA, 19 nt, Leptospira interrogans serovar lai str. 56601
aggaauccaugauucugaa

SEQ ID NO: 736319 - RNA, 20 nt, Leptospira interrogans serovar lai str. 56601
uuuuuuuaugaaaaaauuca

SEQ ID NO: 736320 - RNA, 18 nt, Leptospira interrogans serovar lai str. 56601
uuuuuccaaaaagaaaaa

SEQ ID NO: 736321 - RNA, 12 nt, Leptospira interrogans serovar lai str. 56601
uuuuuucuaaau

SEQ ID NO: 736322 - RNA, 11 nt, Leptospira interrogans serovar lai str. 56601
uuuuuuccuuu

SEQ ID NO: 736323 - RNA, 16 nt, Leptospira interrogans serovar lai str. 56601
uuuuuucuaaaauauu

SEQ ID NO: 736324 - RNA, 12 nt, Leptospira interrogans serovar lai str. 56601
uuuuuuguaauc

SEQ ID NO: 736325 - RNA, 15 nt, Leptospira interrogans serovar lai str. 56601
uuuuggaaauuccaa

SEQ ID NO: 736326 - RNA, 23 nt, Leptospira interrogans serovar lai str. 56601
uuuuggcccuccucuaaaaugcu

SEQ ID NO: 736327 - RNA, 20 nt, Leptospira interrogans serovar lai str. 56601
uuuuguaaguuuuccauucu

SEQ ID NO: 736328 - RNA, 14 nt, Leptospira interrogans serovar lai str. 56601
uuuuguaaugaaau

SEQ ID NO: 736329 - RNA, 15 nt, Leptospira interrogans serovar lai str. 56601
uuuuguaaugaaauc

SEQ ID NO: 736330 - RNA, 20 nt, Leptospira interrogans serovar lai str. 56601
uuuuggguuuggaguauuuu

SEQ ID NO: 736331 - RNA, 23 nt, Leptospira interrogans serovar lai str. 56601
uuuuggguuuggaguauuuuuuc

SEQ ID NO: 736332 - RNA, 14 nt, Leptospira interrogans serovar lai str. 56601
uuuugggaauuuuu

SEQ ID NO: 736333 - RNA, 13 nt, Leptospira interrogans serovar lai str. 56601
uuuugggacaaac

SEQ ID NO: 736334 - RNA, 18 nt, Leptospira interrogans serovar lai str. 56601
uuuugcugguuguaagua

SEQ ID NO: 736335 - RNA, 16 nt, Leptospira interrogans serovar lai str. 56601
uuuugcuguaaaauuu

SEQ ID NO: 736336 - RNA, 21 nt, Leptospira interrogans serovar lai str. 56601
uuuugcuguaaaauuuagauu

SEQ ID NO: 736337 - RNA, 14 nt, Leptospira interrogans serovar lai str. 56601
uuuugcucuaaaau

SEQ ID NO: 736338 - RNA, 19 nt, Leptospira interrogans serovar lai str. 56601
uuuugcucuaaaauaauuu

SEQ ID NO: 736339 - RNA, 13 nt, Leptospira interrogans serovar lai str. 56601
uuuugcugaguuu

SEQ ID NO: 736340 - RNA, 13 nt, Leptospira interrogans serovar lai str. 56601
uuuugccuuguuc

SEQ ID NO: 736341 - RNA, 19 nt, Leptospira interrogans serovar lai str. 56601
uuuugugaaguuaaaacau

SEQ ID NO: 736342 - RNA, 14 nt, Leptospira interrogans serovar lai str. 56601
uuuugucuuuaaaa

SEQ ID NO: 736343 - RNA, 16 nt, Leptospira interrogans serovar lai str. 56601
uuuugugaaacucaau

SEQ ID NO: 736344 - RNA, 13 nt, Leptospira interrogans serovar lai str. 56601
uuuuguauugaaa

SEQ ID NO: 736345 - RNA, 16 nt, Leptospira interrogans serovar lai str. 56601
uuuuguuagauucuau

SEQ ID NO: 736346 - RNA, 18 nt, Leptospira interrogans serovar lai str. 56601
uuuuguuaauugccacua

SEQ ID NO: 736347 - RNA, 21 nt, Leptospira interrogans serovar lai str. 56601
uuuuguucuggagaaagauuu

SEQ ID NO: 736348 - RNA, 21 nt, Leptospira interrogans serovar lai str. 56601
uuuuguuugaauccaaaaguu

SEQ ID NO: 736349 - RNA, 13 nt, Leptospira interrogans serovar lai str. 56601
uuuuguuugaaug

SEQ ID NO: 736350 - RNA, 17 nt, Leptospira interrogans serovar lai str. 56601
uuuuguuuguaaaauuu

SEQ ID NO: 736351 - RNA, 17 nt, Leptospira interrogans serovar lai str. 56601
uuuuguuuuauagaaac

SEQ ID NO: 736352 - RNA, 21 nt, Leptospira interrogans serovar lai str. 56601
uuuuuaaaaauauaguuccua

SEQ ID NO: 736353 - RNA, 19 nt, Leptospira interrogans serovar lai str. 56601
uuuuuaaaaauuuuauuaa

SEQ ID NO: 736354 - RNA, 21 nt, Leptospira interrogans serovar lai str. 56601
uuuuuaaaaauuuuauuaaau

SEQ ID NO: 736355 - RNA, 14 nt, Leptospira interrogans serovar lai str. 56601
uuuuuaguuuuaau

SEQ ID NO: 736356 - RNA, 18 nt, Leptospira interrogans serovar lai str. 56601
uuuuuauaaaaauacagu

SEQ ID NO: 736357 - RNA, 22 nt, Leptospira interrogans serovar lai str. 56601
uuuuuauaaaauaccaauaacu

SEQ ID NO: 736358 - RNA, 13 nt, Leptospira interrogans serovar lai str. 56601
uuuuuaucauaaa

SEQ ID NO: 736359 - RNA, 12 nt, Leptospira interrogans serovar lai str. 56601
uuuuuaugaaaa

SEQ ID NO: 736360 - RNA, 12 nt, Leptospira interrogans serovar lai str. 56601
uuuuuauuucua

SEQ ID NO: 736361 - RNA, 22 nt, Leptospira interrogans serovar lai str. 56601
uuuuucaaaaacucuauuagaa

SEQ ID NO: 736362 - RNA, 20 nt, Leptospira interrogans serovar lai str. 56601
uuuuucaaaaauuccaauaa

SEQ ID NO: 736363 - RNA, 15 nt, Leptospira interrogans serovar lai str. 56601
uuuuuauuugcauuc

SEQ ID NO: 736364 - RNA, 22 nt, Leptospira interrogans serovar lai str. 56601
uuuuucaagagugguuuucaaa

SEQ ID NO: 736365 - RNA, 24 nt, Leptospira interrogans serovar lai str. 56601
uuuuucaacaacucuauuacuaaa

SEQ ID NO: 736366 - RNA, 17 nt, Leptospira interrogans serovar lai str. 56601
uuuuucaacaacucucu

SEQ ID NO: 736367 - RNA, 16 nt, Leptospira interrogans serovar lai str. 56601
uuuuucaacaauucua

SEQ ID NO: 736368 - RNA, 16 nt, Leptospira interrogans serovar lai str. 56601
uuuuucagaaaaauga

SEQ ID NO: 736369 - RNA, 14 nt, Leptospira interrogans serovar lai str. 56601
uuuuuaaauacacu

SEQ ID NO: 736370 - RNA, 19 nt, Leptospira interrogans serovar lai str. 56601
uuuuuaaauuaauauuuau

SEQ ID NO: 736371 - RNA, 20 nt, Leptospira interrogans serovar lai str. 56601
uuuuuaaacgaucagaaaaa

SEQ ID NO: 736372 - RNA, 12 nt, Leptospira interrogans serovar lai str. 56601
uuuuuaaacauu

SEQ ID NO: 736373 - RNA, 11 nt, Leptospira interrogans serovar lai str. 56601
uuuuuaaaauu

SEQ ID NO: 736374 - RNA, 12 nt, Leptospira interrogans serovar lai str. 56601
uuuuuaaaaguu

SEQ ID NO: 736375 - RNA, 13 nt, Leptospira interrogans serovar lai str. 56601
uuuuuaaaaguuu

SEQ ID NO: 736376 - RNA, 18 nt, Leptospira interrogans serovar lai str. 56601
uuuuuaaucauccaauaa

SEQ ID NO: 736377 - RNA, 21 nt, Leptospira interrogans serovar lai str. 56601
uuuuuaauauuacauucaaua

SEQ ID NO: 736378 - RNA, 18 nt, Leptospira interrogans serovar lai str. 56601
uuuuuaauaaaaugcaau

SEQ ID NO: 736379 - RNA, 15 nt, Leptospira interrogans serovar lai str. 56601
uuuuuaaguucaaaa

SEQ ID NO: 736380 - RNA, 11 nt, Leptospira interrogans serovar lai str. 56601
uuuuuaacaau

SEQ ID NO: 736381 - RNA, 14 nt, Leptospira interrogans serovar lai str. 56601
uuuuuacagaaaaa

SEQ ID NO: 736382 - RNA, 24 nt, Leptospira interrogans serovar lai str. 56601
uuuuuacagaaaaccaaauaauaa

SEQ ID NO: 736383 - RNA, 22 nt, Leptospira interrogans serovar lai str. 56601
uuuuuacauaagaccauauuga

SEQ ID NO: 736384 - RNA, 13 nt, Leptospira interrogans serovar lai str. 56601
uuuuuacgaaaaa

SEQ ID NO: 736385 - RNA, 21 nt, Leptospira interrogans serovar lai str. 56601
uuuuuacgcaaguaauacuua

SEQ ID NO: 736386 - RNA, 14 nt, Leptospira interrogans serovar lai str. 56601
uuuuuagaaaauuu

SEQ ID NO: 736387 - RNA, 22 nt, Leptospira interrogans serovar lai str. 56601
uuuuuagaagcacggacauugu

SEQ ID NO: 736388 - RNA, 14 nt, Leptospira interrogans serovar lai str. 56601
uuuuuagaauccca

SEQ ID NO: 736389 - RNA, 17 nt, Leptospira interrogans serovar lai str. 56601
uuuuccuucuuuacagu

SEQ ID NO: 736390 - RNA, 19 nt, Leptospira interrogans serovar lai str. 56601
uuuuccuggccucuuaaau

SEQ ID NO: 736391 - RNA, 22 nt, Leptospira interrogans serovar lai str. 56601
uuuuccuggcugagaaccauuu

SEQ ID NO: 736392 - RNA, 18 nt, Leptospira interrogans serovar lai str. 56601
uuuuccuuaagacccuaa

SEQ ID NO: 736393 - RNA, 21 nt, Leptospira interrogans serovar lai str. 56601
uuuuccuuaagacccuaaaaa

SEQ ID NO: 736394 - RNA, 12 nt, Leptospira interrogans serovar lai str. 56601
uuuuccuuuuac

SEQ ID NO: 736395 - RNA, 18 nt, Leptospira interrogans serovar lai str. 56601
uuuucgaauucuuucuau

SEQ ID NO: 736396 - RNA, 13 nt, Leptospira interrogans serovar lai str. 56601
uuuuccuaaaauu

SEQ ID NO: 736397 - RNA, 14 nt, Leptospira interrogans serovar lai str. 56601
uuuuccuaaaauuu

SEQ ID NO: 736398 - RNA, 15 nt, Leptospira interrogans serovar lai str. 56601
uuuuccuaaaauuuu

SEQ ID NO: 736399 - RNA, 19 nt, Leptospira interrogans serovar lai str. 56601
uuuucaugaauuaaagaag

SEQ ID NO: 736400 - RNA, 20 nt, Leptospira interrogans serovar lai str. 56601
uuuucauacguagcaagaac

SEQ ID NO: 736401 - RNA, 18 nt, Leptospira interrogans serovar lai str. 56601
uuuaccuccuccuucucu

SEQ ID NO: 736402 - RNA, 16 nt, Leptospira interrogans serovar lai str. 56601
uuuaccggguuccauu

SEQ ID NO: 736403 - RNA, 23 nt, Leptospira interrogans serovar lai str. 56601
uuuucaaaaucuaacuguagaac

SEQ ID NO: 736404 - RNA, 17 nt, Leptospira interrogans serovar lai str. 56601
uuuacgaaaauuuuuua

SEQ ID NO: 736405 - RNA, 16 nt, Leptospira interrogans serovar lai str. 56601
uuuucaaaaguauuuu

SEQ ID NO: 736406 - RNA, 13 nt, Leptospira interrogans serovar lai str. 56601
uuuucaaaauaag

SEQ ID NO: 736407 - RNA, 13 nt, Leptospira interrogans serovar lai str. 56601
uuuucaaauauuu

SEQ ID NO: 736408 - RNA, 12 nt, Leptospira interrogans serovar lai str. 56601
uuuucaaauuug

SEQ ID NO: 736409 - RNA, 17 nt, Leptospira interrogans serovar lai str. 56601
uuuucaacaacucucuu

SEQ ID NO: 736410 - RNA, 15 nt, Leptospira interrogans serovar lai str. 56601
uuuucagaaaaauga

SEQ ID NO: 736411 - RNA, 17 nt, Leptospira interrogans serovar lai str. 56601
uuuucagaaaaaugaau

SEQ ID NO: 736412 - RNA, 14 nt, Leptospira interrogans serovar lai str. 56601
uuuucucuaucaga

SEQ ID NO: 736413 - RNA, 13 nt, Leptospira interrogans serovar lai str. 56601
uuuucugaaaaaa

SEQ ID NO: 736414 - RNA, 14 nt, Leptospira interrogans serovar lai str. 56601
uuuucugaaaaaag

SEQ ID NO: 736415 - RNA, 13 nt, Leptospira interrogans serovar lai str. 56601
uuuucugaaaaac

SEQ ID NO: 736416 - RNA, 15 nt, Leptospira interrogans serovar lai str. 56601
uuuucugaaaaaguu

SEQ ID NO: 736417 - RNA, 17 nt, Leptospira interrogans serovar lai str. 56601
uuuucuccuuuuuuacu

SEQ ID NO: 736418 - RNA, 15 nt, Leptospira interrogans serovar lai str. 56601
uuuucggaacaagau

SEQ ID NO: 736419 - RNA, 15 nt, Leptospira interrogans serovar lai str. 56601
uuuucuuuaucagaa

SEQ ID NO: 736420 - RNA, 15 nt, Leptospira interrogans serovar lai str. 56601
uuuucuucuuuguaa

SEQ ID NO: 736421 - RNA, 19 nt, Leptospira interrogans serovar lai str. 56601
uuuucugaauaaaaauacu

SEQ ID NO: 736422 - RNA, 22 nt, Leptospira interrogans serovar lai str. 56601
uuuucugauaaagaaaaccuuu

SEQ ID NO: 736423 - RNA, 15 nt, Leptospira interrogans serovar lai str. 56601
uuuucugaaaaguuu

SEQ ID NO: 736424 - RNA, 21 nt, Leptospira interrogans serovar lai str. 56601
uuuucugauagagaaaaauuu

SEQ ID NO: 736425 - RNA, 17 nt, Leptospira interrogans serovar lai str. 56601
uuuucugguuccauaaa

SEQ ID NO: 736426 - RNA, 11 nt, Leptospira interrogans serovar lai str. 56601
uuuucuucuuc

SEQ ID NO: 736427 - RNA, 13 nt, Leptospira interrogans serovar lai str. 56601
uuuugcauaaaau

SEQ ID NO: 736428 - RNA, 14 nt, Leptospira interrogans serovar lai str. 56601
uuuugccaauucag

SEQ ID NO: 736429 - RNA, 22 nt, Leptospira interrogans serovar lai str. 56601
uuuugccccuccguuuacaaaa

SEQ ID NO: 736430 - RNA, 17 nt, Leptospira interrogans serovar lai str. 56601
uuuugcaaguaaaaaga

SEQ ID NO: 736431 - RNA, 19 nt, Leptospira interrogans serovar lai str. 56601
uuuugcaaguaaaaagacu

SEQ ID NO: 736432 - RNA, 17 nt, Leptospira interrogans serovar lai str. 56601
uuuugcagauagugcac

SEQ ID NO: 736433 - RNA, 14 nt, Leptospira interrogans serovar lai str. 56601
uuuucuuuuuaaau

SEQ ID NO: 736434 - RNA, 13 nt, Leptospira interrogans serovar lai str. 56601
uuuugaauuuuag

SEQ ID NO: 736435 - RNA, 12 nt, Leptospira interrogans serovar lai str. 56601
uuuugaauuuuu

SEQ ID NO: 736436 - RNA, 15 nt, Leptospira interrogans serovar lai str. 56601
uuuugagaaaaucca

SEQ ID NO: 736437 - RNA, 19 nt, Leptospira interrogans serovar lai str. 56601
uuuugagaaaccuuuucua

SEQ ID NO: 736438 - RNA, 17 nt, Leptospira interrogans serovar lai str. 56601
uuuugaguaguagaaaa

SEQ ID NO: 736439 - RNA, 22 nt, Leptospira interrogans serovar lai str. 56601
uuuugaguccacagguuuuaaa

SEQ ID NO: 736440 - RNA, 18 nt, Leptospira interrogans serovar lai str. 56601
uuuugagcacaauauauu

SEQ ID NO: 736441 - RNA, 20 nt, Leptospira interrogans serovar lai str. 56601
ugaaaucagagucuauuuaa

SEQ ID NO: 736442 - RNA, 23 nt, Leptospira interrogans serovar lai str. 56601
ugaaaucagagucuauuuaauua

SEQ ID NO: 736443 - RNA, 16 nt, Leptospira interrogans serovar lai str. 56601
ugaaaucugaauuuaa

SEQ ID NO: 736444 - RNA, 14 nt, Leptospira interrogans serovar lai str. 56601
ugaaaucuaaauuu

SEQ ID NO: 736445 - RNA, 16 nt, Leptospira interrogans serovar lai str. 56601
ugaaauagucaauuga

SEQ ID NO: 736446 - RNA, 18 nt, Leptospira interrogans serovar lai str. 56601
ugaaauauuauaaauuua

SEQ ID NO: 736447 - RNA, 17 nt, Leptospira interrogans serovar lai str. 56601
ugaaauagaauuuugca

SEQ ID NO: 736448 - RNA, 18 nt, Leptospira interrogans serovar lai str. 56601
ugaaauagauucuaauuu

SEQ ID NO: 736449 - RNA, 14 nt, Leptospira interrogans serovar lai str. 56601
ugaaauacaaaaag

SEQ ID NO: 736450 - RNA, 17 nt, Leptospira interrogans serovar lai str. 56601
ugaaauacaaaaagaau

SEQ ID NO: 736451 - RNA, 18 nt, Leptospira interrogans serovar lai str. 56601
ugaaauuuuuguacaaaa

SEQ ID NO: 736452 - RNA, 13 nt, Leptospira interrogans serovar lai str. 56601
ugaaauuuuucaa

SEQ ID NO: 736453 - RNA, 17 nt, Leptospira interrogans serovar lai str. 56601
ugaaauuuuucaauaac

SEQ ID NO: 736454 - RNA, 14 nt, Leptospira interrogans serovar lai str. 56601
ugaaauuuuaaaac

SEQ ID NO: 736455 - RNA, 21 nt, Leptospira interrogans serovar lai str. 56601
ugaaauuuucuuagaaaacuu

SEQ ID NO: 736456 - RNA, 14 nt, Leptospira interrogans serovar lai str. 56601
ugaaauuuccacuu

SEQ ID NO: 736457 - RNA, 16 nt, Leptospira interrogans serovar lai str. 56601
ugaaauugauguuuug

SEQ ID NO: 736458 - RNA, 14 nt, Leptospira interrogans serovar lai str. 56601
ugaaauuguuuuaa

SEQ ID NO: 736459 - RNA, 18 nt, Leptospira interrogans serovar lai str. 56601
ugaaauggaaaauugaaa

SEQ ID NO: 736460 - RNA, 15 nt, Leptospira interrogans serovar lai str. 56601
ugaacaagaauuuau

SEQ ID NO: 736461 - RNA, 15 nt, Leptospira interrogans serovar lai str. 56601
ugaacaaacucuuga

SEQ ID NO: 736462 - RNA, 15 nt, Leptospira interrogans serovar lai str. 56601
ugaaccucuguaaau

SEQ ID NO: 736463 - RNA, 15 nt, Leptospira interrogans serovar lai str. 56601
ugaacgaauuuuuca

SEQ ID NO: 736464 - RNA, 22 nt, Leptospira interrogans serovar lai str. 56601
ugaacccgaacgcuaaacuucu

SEQ ID NO: 736465 - RNA, 18 nt, Leptospira interrogans serovar lai str. 56601
ugaaaaagaauuuuuaaa

SEQ ID NO: 736466 - RNA, 22 nt, Leptospira interrogans serovar lai str. 56601
ugaaaaagaauuuuuaaaaaua

SEQ ID NO: 736467 - RNA, 12 nt, Leptospira interrogans serovar lai str. 56601
ugaaaaaguugg

SEQ ID NO: 736468 - RNA, 19 nt, Leptospira interrogans serovar lai str. 56601
ugaaaaaguuggaaucuaa

SEQ ID NO: 736469 - RNA, 19 nt, Leptospira interrogans serovar lai str. 56601
ugaaaaaguugggaucuaa

SEQ ID NO: 736470 - RNA, 13 nt, Leptospira interrogans serovar lai str. 56601
ugaaaaacuccau

SEQ ID NO: 736471 - RNA, 22 nt, Leptospira interrogans serovar lai str. 56601
ugaaaaagaaacggaagaaaau

SEQ ID NO: 736472 - RNA, 16 nt, Leptospira interrogans serovar lai str. 56601
ugaaaaagagcaaagg

SEQ ID NO: 736473 - RNA, 20 nt, Leptospira interrogans serovar lai str. 56601
ugaaaaauuucuuugucuuu

SEQ ID NO: 736474 - RNA, 22 nt, Leptospira interrogans serovar lai str. 56601
ugaaaaauuuuauaguagauau

SEQ ID NO: 736475 - RNA, 23 nt, Leptospira interrogans serovar lai str. 56601
ugaaaaauagaauuguugaaaaa

SEQ ID NO: 736476 - RNA, 15 nt, Leptospira interrogans serovar lai str. 56601
ugaaaacuaggaacu

SEQ ID NO: 736477 - RNA, 18 nt, Leptospira interrogans serovar lai str. 56601
ugaaaaguuuaugaauuu

SEQ ID NO: 736478 - RNA, 20 nt, Leptospira interrogans serovar lai str. 56601
ugaaaaguuuaugaauuucc

SEQ ID NO: 736479 - RNA, 14 nt, Leptospira interrogans serovar lai str. 56601
ugaaaauaaaaauc

SEQ ID NO: 736480 - RNA, 11 nt, Leptospira interrogans serovar lai str. 56601
ugaaaagugag

SEQ ID NO: 736481 - RNA, 18 nt, Leptospira interrogans serovar lai str. 56601
ugaaaagugaguuuucuu

SEQ ID NO: 736482 - RNA, 12 nt, Leptospira interrogans serovar lai str. 56601
ugaaaauucuuu

SEQ ID NO: 736483 - RNA, 22 nt, Leptospira interrogans serovar lai str. 56601
ugaaaauucuauaguaaagauu

SEQ ID NO: 736484 - RNA, 15 nt, Leptospira interrogans serovar lai str. 56601
ugaaacaauuuugcc

SEQ ID NO: 736485 - RNA, 16 nt, Leptospira interrogans serovar lai str. 56601
ugaaaauugugggaac

SEQ ID NO: 736486 - RNA, 11 nt, Leptospira interrogans serovar lai str. 56601
ugaaaauuuaa

SEQ ID NO: 736487 - RNA, 15 nt, Leptospira interrogans serovar lai str. 56601
ugaaaauuuuccuuu

SEQ ID NO: 736488 - RNA, 19 nt, Leptospira interrogans serovar lai str. 56601
ugaaacaucacuuccauuu

SEQ ID NO: 736489 - RNA, 20 nt, Leptospira interrogans serovar lai str. 56601
ugaaacaucacuuccauuuu

SEQ ID NO: 736490 - RNA, 20 nt, Leptospira interrogans serovar lai str. 56601
ugaaacuugaacuguuuaau

SEQ ID NO: 736491 - RNA, 21 nt, Leptospira interrogans serovar lai str. 56601
ugaaacuuuccacuuuucuca

SEQ ID NO: 736492 - RNA, 23 nt, Leptospira interrogans serovar lai str. 56601
ugaaacguuuucaaaaaauuucu

SEQ ID NO: 736493 - RNA, 13 nt, Leptospira interrogans serovar lai str. 56601
ugaaacucaguaa

SEQ ID NO: 736494 - RNA, 19 nt, Leptospira interrogans serovar lai str. 56601
ugaaacucaguaaaacgcu

SEQ ID NO: 736495 - RNA, 15 nt, Leptospira interrogans serovar lai str. 56601
ugaaacauuucuaaa

SEQ ID NO: 736496 - RNA, 18 nt, Leptospira interrogans serovar lai str. 56601
ugaaacauuucuaaaaua

SEQ ID NO: 736497 - RNA, 15 nt, Leptospira interrogans serovar lai str. 56601
ugaaaccagauuucc

SEQ ID NO: 736498 - RNA, 19 nt, Leptospira interrogans serovar lai str. 56601
ugaaaccaucgauuuacuu

SEQ ID NO: 736499 - RNA, 17 nt, Leptospira interrogans serovar lai str. 56601
ugaaaccaucuacagaa

SEQ ID NO: 736500 - RNA, 14 nt, Leptospira interrogans serovar lai str. 56601
ugaaaguuuuucaa

SEQ ID NO: 736501 - RNA, 19 nt, Leptospira interrogans serovar lai str. 56601
ugaaaguuuuuuuauaaaa

SEQ ID NO: 736502 - RNA, 21 nt, Leptospira interrogans serovar lai str. 56601
ugaaaguuuuuuuauaaaauu

SEQ ID NO: 736503 - RNA, 14 nt, Leptospira interrogans serovar lai str. 56601
ugaaauaaauuuaa

SEQ ID NO: 736504 - RNA, 20 nt, Leptospira interrogans serovar lai str. 56601
ugaaaguucccaaauugcca

SEQ ID NO: 736505 - RNA, 16 nt, Leptospira interrogans serovar lai str. 56601
ugaaaguaaaaaagag

SEQ ID NO: 736506 - RNA, 11 nt, Leptospira interrogans serovar lai str. 56601
ugaaagucuuu

SEQ ID NO: 736507 - RNA, 14 nt, Leptospira interrogans serovar lai str. 56601
ugaaagugaaagua

SEQ ID NO: 736508 - RNA, 19 nt, Leptospira interrogans serovar lai str. 56601
ugaaagugaaaguaaucuu

SEQ ID NO: 736509 - RNA, 23 nt, Leptospira interrogans serovar lai str. 56601
ugaaagcaauccauucaaaaaau

SEQ ID NO: 736510 - RNA, 19 nt, Leptospira interrogans serovar lai str. 56601
ucuuuuccccuuuuuuaau

SEQ ID NO: 736511 - RNA, 19 nt, Leptospira interrogans serovar lai str. 56601
ucuuuucccgcuaaaagua

SEQ ID NO: 736512 - RNA, 12 nt, Leptospira interrogans serovar lai str. 56601
ucuuuucuucuu

SEQ ID NO: 736513 - RNA, 22 nt, Leptospira interrogans serovar lai str. 56601
ucuuuugaccaaaagaggucua

SEQ ID NO: 736514 - RNA, 17 nt, Leptospira interrogans serovar lai str. 56601
ucuuuuguuuuuauaaa

SEQ ID NO: 736515 - RNA, 18 nt, Leptospira interrogans serovar lai str. 56601
ucuuuugggacagguucu

SEQ ID NO: 736516 - RNA, 12 nt, Leptospira interrogans serovar lai str. 56601
ucuuuuguaaaa

SEQ ID NO: 736517 - RNA, 22 nt, Leptospira interrogans serovar lai str. 56601
ucuuuuguaaguuuuccauucu

SEQ ID NO: 736518 - RNA, 14 nt, Leptospira interrogans serovar lai str. 56601
ucuuuuuaagaaaa

SEQ ID NO: 736519 - RNA, 12 nt, Leptospira interrogans serovar lai str. 56601
ucuuuuuaaaag

SEQ ID NO: 736520 - RNA, 15 nt, Leptospira interrogans serovar lai str. 56601
ucuuuuuaaaaguau

SEQ ID NO: 736521 - RNA, 16 nt, Leptospira interrogans serovar lai str. 56601
ucuuuuuaaaaguuug

SEQ ID NO: 736522 - RNA, 14 nt, Leptospira interrogans serovar lai str. 56601
ucuuuuuaaguaau

SEQ ID NO: 736523 - RNA, 23 nt, Leptospira interrogans serovar lai str. 56601
ucuuuuuaaguaauauuucucuc

SEQ ID NO: 736524 - RNA, 12 nt, Leptospira interrogans serovar lai str. 56601
ucuuuuuacuug

SEQ ID NO: 736525 - RNA, 23 nt, Leptospira interrogans serovar lai str. 56601
ucuuuuuagacaaaaauacuaaa

SEQ ID NO: 736526 - RNA, 12 nt, Leptospira interrogans serovar lai str. 56601
ucuuuuucucuu

SEQ ID NO: 736527 - RNA, 16 nt, Leptospira interrogans serovar lai str. 56601
ucuuuuugauaaaaua

SEQ ID NO: 736528 - RNA, 13 nt, Leptospira interrogans serovar lai str. 56601
ucuuuuuuuaaac

SEQ ID NO: 736529 - RNA, 14 nt, Leptospira interrogans serovar lai str. 56601
ucuuuuuuuaaaca

SEQ ID NO: 736530 - RNA, 13 nt, Leptospira interrogans serovar lai str. 56601
ucuuuuuuccuuc

SEQ ID NO: 736531 - RNA, 14 nt, Leptospira interrogans serovar lai str. 56601
ucuuuuuuccuucu

SEQ ID NO: 736532 - RNA, 12 nt, Leptospira interrogans serovar lai str. 56601
ucuuuuuuaauu

SEQ ID NO: 736533 - RNA, 12 nt, Leptospira interrogans serovar lai str. 56601
ucuuuuuuaaag

SEQ ID NO: 736534 - RNA, 14 nt, Leptospira interrogans serovar lai str. 56601
ugaaaaaacuuuuu

SEQ ID NO: 736535 - RNA, 10 nt, Leptospira interrogans serovar lai str. 56601
ugaaaaaagu

SEQ ID NO: 736536 - RNA, 12 nt, Leptospira interrogans serovar lai str. 56601
ugaaaaaauuuu

SEQ ID NO: 736537 - RNA, 21 nt, Leptospira interrogans serovar lai str. 56601
ugaaaaaaguugaaaucugaa

SEQ ID NO: 736538 - RNA, 24 nt, Leptospira interrogans serovar lai str. 56601
ugaaaaaaauuagaaucugaaccu

SEQ ID NO: 736539 - RNA, 20 nt, Leptospira interrogans serovar lai str. 56601
ucuuuuuuuacgcggaacau

SEQ ID NO: 736540 - RNA, 19 nt, Leptospira interrogans serovar lai str. 56601
ugaaaaaaacgucuuuauc

SEQ ID NO: 736541 - RNA, 19 nt, Leptospira interrogans serovar lai str. 56601
ugaaaaaaaaauugucuuu

SEQ ID NO: 736542 - RNA, 12 nt, Leptospira interrogans serovar lai str. 56601
ugaaaaaaaaca

SEQ ID NO: 736543 - RNA, 13 nt, Leptospira interrogans serovar lai str. 56601
ugaaaaaaaacaa

SEQ ID NO: 736544 - RNA, 15 nt, Leptospira interrogans serovar lai str. 56601
ucuuuuuuuucuaaa

SEQ ID NO: 736545 - RNA, 18 nt, Leptospira interrogans serovar lai str. 56601
ucuuuuuuuucuaaaaua

SEQ ID NO: 736546 - RNA, 19 nt, Leptospira interrogans serovar lai str. 56601
ucuuuuuuuucuaaaauau

SEQ ID NO: 736547 - RNA, 14 nt, Leptospira interrogans serovar lai str. 56601
ucuuuuuuucauuu

SEQ ID NO: 736548 - RNA, 17 nt, Leptospira interrogans serovar lai str. 56601
ucuuuuaccuuaccacc

SEQ ID NO: 736549 - RNA, 24 nt, Leptospira interrogans serovar lai str. 56601
ucuuuuagaguucguuaagaauaa

SEQ ID NO: 736550 - RNA, 24 nt, Leptospira interrogans serovar lai str. 56601
ucuuuuagauauuuauaaugaauu

SEQ ID NO: 736551 - RNA, 13 nt, Leptospira interrogans serovar lai str. 56601
ucuuuuauauaau

SEQ ID NO: 736552 - RNA, 14 nt, Leptospira interrogans serovar lai str. 56601
ucuuuuauauaauu

SEQ ID NO: 736553 - RNA, 14 nt, Leptospira interrogans serovar lai str. 56601
ucuuuuaauuucag

SEQ ID NO: 736554 - RNA, 11 nt, Leptospira interrogans serovar lai str. 56601
ucuuuuaaaaa

SEQ ID NO: 736555 - RNA, 18 nt, Leptospira interrogans serovar lai str. 56601
ucuuuguaugaguuccca

SEQ ID NO: 736556 - RNA, 20 nt, Leptospira interrogans serovar lai str. 56601
ucuuugacccauaaaaauac

SEQ ID NO: 736557 - RNA, 23 nt, Leptospira interrogans serovar lai str. 56601
ucuuugacccauaaaaauacuuu

SEQ ID NO: 736558 - RNA, 12 nt, Leptospira interrogans serovar lai str. 56601
ucuuugaaauuc

SEQ ID NO: 736559 - RNA, 19 nt, Leptospira interrogans serovar lai str. 56601
ucuuugaagaauaaaagug

SEQ ID NO: 736560 - RNA, 17 nt, Leptospira interrogans serovar lai str. 56601
ucuuugaacuuuuucaa

SEQ ID NO: 736561 - RNA, 11 nt, Leptospira interrogans serovar lai str. 56601
ucuuugaagaa

SEQ ID NO: 736562 - RNA, 16 nt, Leptospira interrogans serovar lai str. 56601
ucuuguuaaaauaaaa

SEQ ID NO: 736563 - RNA, 16 nt, Leptospira interrogans serovar lai str. 56601
ucuugugucaagcccu

SEQ ID NO: 736564 - RNA, 22 nt, Leptospira interrogans serovar lai str. 56601
ucuuuaagagucauuuuuaaau

SEQ ID NO: 736565 - RNA, 21 nt, Leptospira interrogans serovar lai str. 56601
ucuuuaagauauugagcaaga

SEQ ID NO: 736566 - RNA, 15 nt, Leptospira interrogans serovar lai str. 56601
ucuuuaaaaaauuag

SEQ ID NO: 736567 - RNA, 18 nt, Leptospira interrogans serovar lai str. 56601
ucuuuaugcgguuuuacu

SEQ ID NO: 736568 - RNA, 19 nt, Leptospira interrogans serovar lai str. 56601
ucuuuaugcgguuuuacuu

SEQ ID NO: 736569 - RNA, 21 nt, Leptospira interrogans serovar lai str. 56601
ucuuuaugcgguuuuacuucu

SEQ ID NO: 736570 - RNA, 20 nt, Leptospira interrogans serovar lai str. 56601
ucuuuaaguuugugagaguu

SEQ ID NO: 736571 - RNA, 16 nt, Leptospira interrogans serovar lai str. 56601
ucuuuaauuucaauaa

SEQ ID NO: 736572 - RNA, 19 nt, Leptospira interrogans serovar lai str. 56601
ucuuuacaauuugcuaaaa

SEQ ID NO: 736573 - RNA, 22 nt, Leptospira interrogans serovar lai str. 56601
ucuuuacaauuugcuaaaauaa

SEQ ID NO: 736574 - RNA, 17 nt, Leptospira interrogans serovar lai str. 56601
ucuuuacaguuuuuaau

SEQ ID NO: 736575 - RNA, 13 nt, Leptospira interrogans serovar lai str. 56601
ucuuuaucagaaa

SEQ ID NO: 736576 - RNA, 18 nt, Leptospira interrogans serovar lai str. 56601
ucuuuaucagaaaaacau

SEQ ID NO: 736577 - RNA, 19 nt, Leptospira interrogans serovar lai str. 56601
ucuuuccaaccauuuaaua

SEQ ID NO: 736578 - RNA, 23 nt, Leptospira interrogans serovar lai str. 56601
ucuuucgcgguuuucuuuuuucu

SEQ ID NO: 736579 - RNA, 18 nt, Leptospira interrogans serovar lai str. 56601
ucuuucgauuuuaaauaa

SEQ ID NO: 736580 - RNA, 15 nt, Leptospira interrogans serovar lai str. 56601
ucuuucgauuuuucg

SEQ ID NO: 736581 - RNA, 19 nt, Leptospira interrogans serovar lai str. 56601
ucuuucgacuucuuuuuug

SEQ ID NO: 736582 - RNA, 24 nt, Leptospira interrogans serovar lai str. 56601
ucuuuccccaagacgucuacagau

SEQ ID NO: 736583 - RNA, 19 nt, Leptospira interrogans serovar lai str. 56601
ucuuucguuuuuuucauga

SEQ ID NO: 736584 - RNA, 15 nt, Leptospira interrogans serovar lai str. 56601
ucuuucuauuuuuuc

SEQ ID NO: 736585 - RNA, 14 nt, Leptospira interrogans serovar lai str. 56601
ucuuucuuaaauuu

SEQ ID NO: 736586 - RNA, 18 nt, Leptospira interrogans serovar lai str. 56601
ucuuucuuaaauuuuuuu

SEQ ID NO: 736587 - RNA, 21 nt, Leptospira interrogans serovar lai str. 56601
ucuuucuuaaauuuuuuuuca

SEQ ID NO: 736588 - RNA, 22 nt, Leptospira interrogans serovar lai str. 56601
ucuuucuuccggauuaaaaagg

SEQ ID NO: 736589 - RNA, 12 nt, Leptospira interrogans serovar lai str. 56601
ucuuucugaaau

SEQ ID NO: 736590 - RNA, 13 nt, Leptospira interrogans serovar lai str. 56601
ucuuucucucgaa

SEQ ID NO: 736591 - RNA, 20 nt, Leptospira interrogans serovar lai str. 56601
ucuuacauugaguccuuucg

SEQ ID NO: 736592 - RNA, 20 nt, Leptospira interrogans serovar lai str. 56601
ucuguuccgcuguaguaucu

SEQ ID NO: 736593 - RNA, 13 nt, Leptospira interrogans serovar lai str. 56601
ucuuacuccaucu

SEQ ID NO: 736594 - RNA, 22 nt, Leptospira interrogans serovar lai str. 56601
ucuuacucgacaaaacacuucu

SEQ ID NO: 736595 - RNA, 19 nt, Leptospira interrogans serovar lai str. 56601
ucuuagaguuguccuaaaa

SEQ ID NO: 736596 - RNA, 20 nt, Leptospira interrogans serovar lai str. 56601
ucuuagaaugugggaacuac

SEQ ID NO: 736597 - RNA, 21 nt, Leptospira interrogans serovar lai str. 56601
ucuuagaauuuuguuucuaaa

SEQ ID NO: 736598 - RNA, 20 nt, Leptospira interrogans serovar lai str. 56601
ucuuacuuugagaaaauuuu

SEQ ID NO: 736599 - RNA, 12 nt, Leptospira interrogans serovar lai str. 56601
ucuuacuuuuug

SEQ ID NO: 736600 - RNA, 19 nt, Leptospira interrogans serovar lai str. 56601
ucuuagaaaaccauuuugu

SEQ ID NO: 736601 - RNA, 21 nt, Leptospira interrogans serovar lai str. 56601
ucuuagucuaaaaacaacuca

SEQ ID NO: 736602 - RNA, 14 nt, Leptospira interrogans serovar lai str. 56601
ucuuauaaaauuuu

SEQ ID NO: 736603 - RNA, 18 nt, Leptospira interrogans serovar lai str. 56601
ucuuauaaaauuuuagau

SEQ ID NO: 736604 - RNA, 21 nt, Leptospira interrogans serovar lai str. 56601
ucuuagccccaguaaauaaac

SEQ ID NO: 736605 - RNA, 15 nt, Leptospira interrogans serovar lai str. 56601
ucuuagguaauuuag

SEQ ID NO: 736606 - RNA, 15 nt, Leptospira interrogans serovar lai str. 56601
ucuuauacucuuaaa

SEQ ID NO: 736607 - RNA, 19 nt, Leptospira interrogans serovar lai str. 56601
ucuuauacucuuaaaauua

SEQ ID NO: 736608 - RNA, 16 nt, Leptospira interrogans serovar lai str. 56601
ucuuauucaauaaaau

SEQ ID NO: 736609 - RNA, 18 nt, Leptospira interrogans serovar lai str. 56601
ucuucaaguuugugagag

SEQ ID NO: 736610 - RNA, 16 nt, Leptospira interrogans serovar lai str. 56601
ucuucaaauaacauuu

SEQ ID NO: 736611 - RNA, 17 nt, Leptospira interrogans serovar lai str. 56601
ucuucaaauaacauuuu

SEQ ID NO: 736612 - RNA, 11 nt, Leptospira interrogans serovar lai str. 56601
ucuucaaauuc

SEQ ID NO: 736613 - RNA, 20 nt, Leptospira interrogans serovar lai str. 56601
ucuuauuuuuacagaaaaau

SEQ ID NO: 736614 - RNA, 23 nt, Leptospira interrogans serovar lai str. 56601
ucuuauuuauauuucuaaaagaa

SEQ ID NO: 736615 - RNA, 21 nt, Leptospira interrogans serovar lai str. 56601
ucuuauucuaggcauuucauu

SEQ ID NO: 736616 - RNA, 22 nt, Leptospira interrogans serovar lai str. 56601
ucuuauucuaggcauuucauuu

SEQ ID NO: 736617 - RNA, 21 nt, Leptospira interrogans serovar lai str. 56601
ucuuccacaucuuuuuucguu

SEQ ID NO: 736618 - RNA, 13 nt, Leptospira interrogans serovar lai str. 56601
ucugucccaaaau

SEQ ID NO: 736619 - RNA, 13 nt, Leptospira interrogans serovar lai str. 56601
ucugucguuugca

SEQ ID NO: 736620 - RNA, 19 nt, Leptospira interrogans serovar lai str. 56601
ucuguaaaagaaaaauuaa

SEQ ID NO: 736621 - RNA, 14 nt, Leptospira interrogans serovar lai str. 56601
ucuguaaaaaauaa

SEQ ID NO: 736622 - RNA, 13 nt, Leptospira interrogans serovar lai str. 56601
ucuguaaaaauaa

SEQ ID NO: 736623 - RNA, 16 nt, Leptospira interrogans serovar lai str. 56601
ucuguaaaauaaauuu

SEQ ID NO: 736624 - RNA, 22 nt, Leptospira interrogans serovar lai str. 56601
ucuguaaaauaaauuuauaauu

SEQ ID NO: 736625 - RNA, 14 nt, Leptospira interrogans serovar lai str. 56601
ucuguaaaauucag

SEQ ID NO: 736626 - RNA, 15 nt, Leptospira interrogans serovar lai str. 56601
ucuguaaaauucaga

SEQ ID NO: 736627 - RNA, 14 nt, Leptospira interrogans serovar lai str. 56601
ucuguaaaauuugg

SEQ ID NO: 736628 - RNA, 18 nt, Leptospira interrogans serovar lai str. 56601
ucuguaacauccaaacuc

SEQ ID NO: 736629 - RNA, 21 nt, Leptospira interrogans serovar lai str. 56601
ucuguaaucuuccgcauuuuu

SEQ ID NO: 736630 - RNA, 17 nt, Leptospira interrogans serovar lai str. 56601
ucugguggaauucguua

SEQ ID NO: 736631 - RNA, 14 nt, Leptospira interrogans serovar lai str. 56601
ucugcucuucuaau

SEQ ID NO: 736632 - RNA, 16 nt, Leptospira interrogans serovar lai str. 56601
ucugcugaauuuaccu

SEQ ID NO: 736633 - RNA, 14 nt, Leptospira interrogans serovar lai str. 56601
ucugcuuuuuuaaa

SEQ ID NO: 736634 - RNA, 22 nt, Leptospira interrogans serovar lai str. 56601
ucuggaaaaauuccuaaaacac

SEQ ID NO: 736635 - RNA, 15 nt, Leptospira interrogans serovar lai str. 56601
ucugcaauucgcauu

SEQ ID NO: 736636 - RNA, 19 nt, Leptospira interrogans serovar lai str. 56601
ucugcguagaaucucgcuu

SEQ ID NO: 736637 - RNA, 18 nt, Leptospira interrogans serovar lai str. 56601
ucucuaacaaaaaguguu

SEQ ID NO: 736638 - RNA, 21 nt, Leptospira interrogans serovar lai str. 56601
ucucuagaaauuuauaauauu

SEQ ID NO: 736639 - RNA, 23 nt, Leptospira interrogans serovar lai str. 56601
ucucuacucuugaaguuaagaag

SEQ ID NO: 736640 - RNA, 12 nt, Leptospira interrogans serovar lai str. 56601
ucucuauaaaag

SEQ ID NO: 736641 - RNA, 13 nt, Leptospira interrogans serovar lai str. 56601
ucucuaucagaaa

SEQ ID NO: 736642 - RNA, 18 nt, Leptospira interrogans serovar lai str. 56601
ucucuaucagaaaaacau

SEQ ID NO: 736643 - RNA, 20 nt, Leptospira interrogans serovar lai str. 56601
ucucuaucagaaaaacauac

SEQ ID NO: 736644 - RNA, 17 nt, Leptospira interrogans serovar lai str. 56601
ucucguaauaucuaaaa

SEQ ID NO: 736645 - RNA, 18 nt, Leptospira interrogans serovar lai str. 56601
ucucguucaacuuuccuu

SEQ ID NO: 736646 - RNA, 22 nt, Leptospira interrogans serovar lai str. 56601
ucucggaauauuuuuuccaaaa

SEQ ID NO: 736647 - RNA, 22 nt, Leptospira interrogans serovar lai str. 56601
ucucgcaacggauuccuccagu

SEQ ID NO: 736648 - RNA, 14 nt, Leptospira interrogans serovar lai str. 56601
ucucgauuucuaaa

SEQ ID NO: 736649 - RNA, 17 nt, Leptospira interrogans serovar lai str. 56601
ucucgauuucuaaaaug

SEQ ID NO: 736650 - RNA, 18 nt, Leptospira interrogans serovar lai str. 56601
ucucgacaaucaaaacuu

SEQ ID NO: 736651 - RNA, 18 nt, Leptospira interrogans serovar lai str. 56601
ucucgaauuguuuuuaaa

SEQ ID NO: 736652 - RNA, 18 nt, Leptospira interrogans serovar lai str. 56601
ucuacauuggaaggacga

SEQ ID NO: 736653 - RNA, 23 nt, Leptospira interrogans serovar lai str. 56601
ucuacauuggaaggacgaacuac

SEQ ID NO: 736654 - RNA, 23 nt, Leptospira interrogans serovar lai str. 56601
ucuacauucugaaacuuuucaaa

SEQ ID NO: 736655 - RNA, 19 nt, Leptospira interrogans serovar lai str. 56601
ucucauuagaguuauugaa

SEQ ID NO: 736656 - RNA, 13 nt, Leptospira interrogans serovar lai str. 56601
ucuccacuugaau

SEQ ID NO: 736657 - RNA, 12 nt, Leptospira interrogans serovar lai str. 56601
ucucauuuagag

SEQ ID NO: 736658 - RNA, 20 nt, Leptospira interrogans serovar lai str. 56601
ucuccgauuugguuuucauu

SEQ ID NO: 736659 - RNA, 19 nt, Leptospira interrogans serovar lai str. 56601
ucucccuuaccuccuuuuu

SEQ ID NO: 736660 - RNA, 20 nt, Leptospira interrogans serovar lai str. 56601
ucuccggcgaccuuucuaaa

SEQ ID NO: 736661 - RNA, 22 nt, Leptospira interrogans serovar lai str. 56601
ucuccggcgaccuuucuaaaaa

SEQ ID NO: 736662 - RNA, 12 nt, Leptospira interrogans serovar lai str. 56601
ucuccuccgaaa

SEQ ID NO: 736663 - RNA, 18 nt, Leptospira interrogans serovar lai str. 56601
ucuccuccugaaaauuuu

SEQ ID NO: 736664 - RNA, 22 nt, Leptospira interrogans serovar lai str. 56601
ucuccuccugaaaauuuuccuu

SEQ ID NO: 736665 - RNA, 15 nt, Leptospira interrogans serovar lai str. 56601
ucucuuauuagaacu

SEQ ID NO: 736666 - RNA, 15 nt, Leptospira interrogans serovar lai str. 56601
ucucuugucagaccu

SEQ ID NO: 736667 - RNA, 19 nt, Leptospira interrogans serovar lai str. 56601
ucucuugucagaccuaaaa

SEQ ID NO: 736668 - RNA, 20 nt, Leptospira interrogans serovar lai str. 56601
ucucuucuuuauuuucuauu

SEQ ID NO: 736669 - RNA, 21 nt, Leptospira interrogans serovar lai str. 56601
ucucuugcgguucuugcuuca

SEQ ID NO: 736670 - RNA, 13 nt, Leptospira interrogans serovar lai str. 56601
ucucucaaauucu

SEQ ID NO: 736671 - RNA, 22 nt, Leptospira interrogans serovar lai str. 56601
ucucuuuuacgacuuuauucaa

SEQ ID NO: 736672 - RNA, 21 nt, Leptospira interrogans serovar lai str. 56601
ucucuuuucgaaaauucugcu

SEQ ID NO: 736673 - RNA, 13 nt, Leptospira interrogans serovar lai str. 56601
ucucuuuuaaaaa

SEQ ID NO: 736674 - RNA, 14 nt, Leptospira interrogans serovar lai str. 56601
ucucuuuuaaaaac

SEQ ID NO: 736675 - RNA, 16 nt, Leptospira interrogans serovar lai str. 56601
ucucuuuauauaaaau

SEQ ID NO: 736676 - RNA, 14 nt, Leptospira interrogans serovar lai str. 56601
ucucuuuuucucuu

SEQ ID NO: 736677 - RNA, 13 nt, Leptospira interrogans serovar lai str. 56601
ucucuuuuuuaaa

SEQ ID NO: 736678 - RNA, 19 nt, Leptospira interrogans serovar lai str. 56601
ucucuuuuuagacaaaaau

SEQ ID NO: 736679 - RNA, 21 nt, Leptospira interrogans serovar lai str. 56601
ucugaaaaaagcugaacuuaa

SEQ ID NO: 736680 - RNA, 19 nt, Leptospira interrogans serovar lai str. 56601
ucucuuuuuuauaauaguu

SEQ ID NO: 736681 - RNA, 12 nt, Leptospira interrogans serovar lai str. 56601
ucugaaaaagag

SEQ ID NO: 736682 - RNA, 14 nt, Leptospira interrogans serovar lai str. 56601
ucugaauaaaaaua

SEQ ID NO: 736683 - RNA, 17 nt, Leptospira interrogans serovar lai str. 56601
ucugaauaaaaauacua

SEQ ID NO: 736684 - RNA, 12 nt, Leptospira interrogans serovar lai str. 56601
ucugaauauuuu

SEQ ID NO: 736685 - RNA, 23 nt, Leptospira interrogans serovar lai str. 56601
ucugaccucuauccacuaaaaua

SEQ ID NO: 736686 - RNA, 17 nt, Leptospira interrogans serovar lai str. 56601
ucugaaucucuuuuucu

SEQ ID NO: 736687 - RNA, 13 nt, Leptospira interrogans serovar lai str. 56601
ucugaaaaguuua

SEQ ID NO: 736688 - RNA, 19 nt, Leptospira interrogans serovar lai str. 56601
ucugauagagaaaaauuuu

SEQ ID NO: 736689 - RNA, 16 nt, Leptospira interrogans serovar lai str. 56601
ucugauauuuuaaauu

SEQ ID NO: 736690 - RNA, 19 nt, Leptospira interrogans serovar lai str. 56601
ucugauauuuuaaauugaa

SEQ ID NO: 736691 - RNA, 20 nt, Leptospira interrogans serovar lai str. 56601
ucugauuuuuauaauuuaga

SEQ ID NO: 736692 - RNA, 19 nt, Leptospira interrogans serovar lai str. 56601
ucugcaaagcucagauucc

SEQ ID NO: 736693 - RNA, 18 nt, Leptospira interrogans serovar lai str. 56601
ucguuaagaauaaauaau

SEQ ID NO: 736694 - RNA, 21 nt, Leptospira interrogans serovar lai str. 56601
ucguuauaaacaauaugaaag

SEQ ID NO: 736695 - RNA, 16 nt, Leptospira interrogans serovar lai str. 56601
ucguucaacuuuccuu

SEQ ID NO: 736696 - RNA, 17 nt, Leptospira interrogans serovar lai str. 56601
ucguucaacuuuccuuu

SEQ ID NO: 736697 - RNA, 22 nt, Leptospira interrogans serovar lai str. 56601
ucguuauuuuuauaaagauaaa

SEQ ID NO: 736698 - RNA, 18 nt, Leptospira interrogans serovar lai str. 56601
ucgugauaacaaacuuuu

SEQ ID NO: 736699 - RNA, 17 nt, Leptospira interrogans serovar lai str. 56601
ucguuucccauauaauu

SEQ ID NO: 736700 - RNA, 22 nt, Leptospira interrogans serovar lai str. 56601
ucguuuuuuagaaacuaaaaaa

SEQ ID NO: 736701 - RNA, 19 nt, Leptospira interrogans serovar lai str. 56601
ucguuggccucgaaaguuu

SEQ ID NO: 736702 - RNA, 15 nt, Leptospira interrogans serovar lai str. 56601
ucguuguauuuuaaa

SEQ ID NO: 736703 - RNA, 12 nt, Leptospira interrogans serovar lai str. 56601
ucguuuaaaaaa

SEQ ID NO: 736704 - RNA, 21 nt, Leptospira interrogans serovar lai str. 56601
ucguuuaagaauuuuaaaaaa

SEQ ID NO: 736705 - RNA, 17 nt, Leptospira interrogans serovar lai str. 56601
ucguucgacaauuguaa

SEQ ID NO: 736706 - RNA, 19 nt, Leptospira interrogans serovar lai str. 56601
ucguucccguuuagaaauu

SEQ ID NO: 736707 - RNA, 22 nt, Leptospira interrogans serovar lai str. 56601
ucuaaaaaugaaaucuacaaaa

SEQ ID NO: 736708 - RNA, 18 nt, Leptospira interrogans serovar lai str. 56601
ucuaaaaaauucuuucuc

SEQ ID NO: 736709 - RNA, 18 nt, Leptospira interrogans serovar lai str. 56601
ucuaaaaacaacucagca

SEQ ID NO: 736710 - RNA, 23 nt, Leptospira interrogans serovar lai str. 56601
ucuaaaaagauuaucuucuaauu

SEQ ID NO: 736711 - RNA, 22 nt, Leptospira interrogans serovar lai str. 56601
ucuaagaguagaguaagaaaca

SEQ ID NO: 736712 - RNA, 23 nt, Leptospira interrogans serovar lai str. 56601
ucuaagaguagaguaagaaacau

SEQ ID NO: 736713 - RNA, 14 nt, Leptospira interrogans serovar lai str. 56601
ucuaacuuauaaga

SEQ ID NO: 736714 - RNA, 16 nt, Leptospira interrogans serovar lai str. 56601
ucuaacugguuuuucu

SEQ ID NO: 736715 - RNA, 21 nt, Leptospira interrogans serovar lai str. 56601
ucuaacugguuuuucuuuaau

SEQ ID NO: 736716 - RNA, 18 nt, Leptospira interrogans serovar lai str. 56601
ucuaaaugacuugcauuu

SEQ ID NO: 736717 - RNA, 15 nt, Leptospira interrogans serovar lai str. 56601
ucuaaaucugaauuu

SEQ ID NO: 736718 - RNA, 19 nt, Leptospira interrogans serovar lai str. 56601
ucuaaauucagaaaaaaaa

SEQ ID NO: 736719 - RNA, 15 nt, Leptospira interrogans serovar lai str. 56601
ucuaauuuuauaaau

SEQ ID NO: 736720 - RNA, 19 nt, Leptospira interrogans serovar lai str. 56601
ucuaauuuuauaaauuauu

SEQ ID NO: 736721 - RNA, 22 nt, Leptospira interrogans serovar lai str. 56601
ucuaauuucauugaguuuuuua

SEQ ID NO: 736722 - RNA, 19 nt, Leptospira interrogans serovar lai str. 56601
ucuaauuuaaaaaagaaga

SEQ ID NO: 736723 - RNA, 16 nt, Leptospira interrogans serovar lai str. 56601
ucuacaaaauuuagaa

SEQ ID NO: 736724 - RNA, 13 nt, Leptospira interrogans serovar lai str. 56601
ucuacaaaacugu

SEQ ID NO: 736725 - RNA, 12 nt, Leptospira interrogans serovar lai str. 56601
ucuacauaaaaa

SEQ ID NO: 736726 - RNA, 20 nt, Leptospira interrogans serovar lai str. 56601
ucuacauaaaaaaggaagca

SEQ ID NO: 736727 - RNA, 19 nt, Leptospira interrogans serovar lai str. 56601
ucuacaaauucuucuuccu

SEQ ID NO: 736728 - RNA, 19 nt, Leptospira interrogans serovar lai str. 56601
ucuaaguaauuuaaaaaaa

SEQ ID NO: 736729 - RNA, 14 nt, Leptospira interrogans serovar lai str. 56601
ucuaagguuugucu

SEQ ID NO: 736730 - RNA, 19 nt, Leptospira interrogans serovar lai str. 56601
ucuaagcuuuagaaaauaa

SEQ ID NO: 736731 - RNA, 20 nt, Leptospira interrogans serovar lai str. 56601
ucuaagcuuuagaaaauaau

SEQ ID NO: 736732 - RNA, 15 nt, Leptospira interrogans serovar lai str. 56601
ucuaauacaaaaaau

SEQ ID NO: 736733 - RNA, 17 nt, Leptospira interrogans serovar lai str. 56601
ucuaauugugggaacuc

SEQ ID NO: 736734 - RNA, 22 nt, Leptospira interrogans serovar lai str. 56601
ucuaaguuuuuaaauaagcuaa

SEQ ID NO: 736735 - RNA, 17 nt, Leptospira interrogans serovar lai str. 56601
ucuaaguguaaaauuaa

SEQ ID NO: 736736 - RNA, 21 nt, Leptospira interrogans serovar lai str. 56601
ucuaaguguaaaauuaaaauc

SEQ ID NO: 736737 - RNA, 20 nt, Leptospira interrogans serovar lai str. 56601
ucgucuaucuuuuuuaaaac

SEQ ID NO: 736738 - RNA, 17 nt, Leptospira interrogans serovar lai str. 56601
ucguccaaucucuuucg

SEQ ID NO: 736739 - RNA, 20 nt, Leptospira interrogans serovar lai str. 56601
ucguauaacgaaacuuuaau

SEQ ID NO: 736740 - RNA, 19 nt, Leptospira interrogans serovar lai str. 56601
ucguacuaauucuuuugca

SEQ ID NO: 736741 - RNA, 15 nt, Leptospira interrogans serovar lai str. 56601
ucguaauuaaauuuu

SEQ ID NO: 736742 - RNA, 19 nt, Leptospira interrogans serovar lai str. 56601
ucggguuugucuucgaucc

SEQ ID NO: 736743 - RNA, 15 nt, Leptospira interrogans serovar lai str. 56601
ucguaagaaaaaauu

SEQ ID NO: 736744 - RNA, 22 nt, Leptospira interrogans serovar lai str. 56601
ucgguguaaaaaaucaugauuc

SEQ ID NO: 736745 - RNA, 21 nt, Leptospira interrogans serovar lai str. 56601
ucgguuuucguuguauggaaa

SEQ ID NO: 736746 - RNA, 15 nt, Leptospira interrogans serovar lai str. 56601
ucguaaaaaaauauu

SEQ ID NO: 736747 - RNA, 14 nt, Leptospira interrogans serovar lai str. 56601
ucguaaaaaagaua

SEQ ID NO: 736748 - RNA, 20 nt, Leptospira interrogans serovar lai str. 56601
ucguaaaaaagauaaaaaga

SEQ ID NO: 736749 - RNA, 15 nt, Leptospira interrogans serovar lai str. 56601
ucgguggaaacucag

SEQ ID NO: 736750 - RNA, 13 nt, Leptospira interrogans serovar lai str. 56601
ucggcuuuaagug

SEQ ID NO: 736751 - RNA, 21 nt, Leptospira interrogans serovar lai str. 56601
ucgcugguuuuauuucugcug

SEQ ID NO: 736752 - RNA, 14 nt, Leptospira interrogans serovar lai str. 56601
ucggauaguuuaaa

SEQ ID NO: 736753 - RNA, 16 nt, Leptospira interrogans serovar lai str. 56601
ucggagucauacauuu

SEQ ID NO: 736754 - RNA, 15 nt, Leptospira interrogans serovar lai str. 56601
ucgcuuuuaauaauu

SEQ ID NO: 736755 - RNA, 22 nt, Leptospira interrogans serovar lai str. 56601
ucgcuguuuuguggucaacauc

SEQ ID NO: 736756 - RNA, 20 nt, Leptospira interrogans serovar lai str. 56601
ucgccguucugggcucaaaa

SEQ ID NO: 736757 - RNA, 22 nt, Leptospira interrogans serovar lai str. 56601
ucgccguucugggcucaaaaag

SEQ ID NO: 736758 - RNA, 15 nt, Leptospira interrogans serovar lai str. 56601
ucgcauaacaaaaau

SEQ ID NO: 736759 - RNA, 21 nt, Leptospira interrogans serovar lai str. 56601
ucgccccaugcgccccagccc

SEQ ID NO: 736760 - RNA, 18 nt, Leptospira interrogans serovar lai str. 56601
ucgaucugcaaaguucug

SEQ ID NO: 736761 - RNA, 20 nt, Leptospira interrogans serovar lai str. 56601
ucgaucuguaaaauguagau

SEQ ID NO: 736762 - RNA, 23 nt, Leptospira interrogans serovar lai str. 56601
ucgauugcucucguuuuuaggau

SEQ ID NO: 736763 - RNA, 15 nt, Leptospira interrogans serovar lai str. 56601
ucgauuuacuuuaaa

SEQ ID NO: 736764 - RNA, 16 nt, Leptospira interrogans serovar lai str. 56601
ucgauuucuaaaaugu

SEQ ID NO: 736765 - RNA, 13 nt, Leptospira interrogans serovar lai str. 56601
ucgauuucuaaau

SEQ ID NO: 736766 - RNA, 19 nt, Leptospira interrogans serovar lai str. 56601
ucgauuucuaauauuaaaa

SEQ ID NO: 736767 - RNA, 12 nt, Leptospira interrogans serovar lai str. 56601
ucgauuuuaaau

SEQ ID NO: 736768 - RNA, 11 nt, Leptospira interrogans serovar lai str. 56601
ucgauuuugau

SEQ ID NO: 736769 - RNA, 14 nt, Leptospira interrogans serovar lai str. 56601
ucgauuuguaaaau

SEQ ID NO: 736770 - RNA, 19 nt, Leptospira interrogans serovar lai str. 56601
ucgcaacggauuccuccag

SEQ ID NO: 736771 - RNA, 22 nt, Leptospira interrogans serovar lai str. 56601
ucgcaacacacacuuuauaaaa

SEQ ID NO: 736772 - RNA, 13 nt, Leptospira interrogans serovar lai str. 56601
ucgcaacauaaug

SEQ ID NO: 736773 - RNA, 22 nt, Leptospira interrogans serovar lai str. 56601
ucgagucgcgugccuucacaua

SEQ ID NO: 736774 - RNA, 15 nt, Leptospira interrogans serovar lai str. 56601
ucgauaaaguaaaau

SEQ ID NO: 736775 - RNA, 21 nt, Leptospira interrogans serovar lai str. 56601
ucgacgauuuuacgaacaaau

SEQ ID NO: 736776 - RNA, 20 nt, Leptospira interrogans serovar lai str. 56601
ucgaauaaaaacaaacuuuu

SEQ ID NO: 736777 - RNA, 14 nt, Leptospira interrogans serovar lai str. 56601
ucgaauaagaaauu

SEQ ID NO: 736778 - RNA, 16 nt, Leptospira interrogans serovar lai str. 56601
ucgaauaagaaauuca

SEQ ID NO: 736779 - RNA, 15 nt, Leptospira interrogans serovar lai str. 56601
ucgaacguauaaaaa

SEQ ID NO: 736780 - RNA, 20 nt, Leptospira interrogans serovar lai str. 56601
ucgaagucacguauuccaag

SEQ ID NO: 736781 - RNA, 20 nt, Leptospira interrogans serovar lai str. 56601
ucgaacucacauuauuuaau

SEQ ID NO: 736782 - RNA, 16 nt, Leptospira interrogans serovar lai str. 56601
ucgaacggauucuaau

SEQ ID NO: 736783 - RNA, 22 nt, Leptospira interrogans serovar lai str. 56601
ucgaacgaccccgucauuuacu

SEQ ID NO: 736784 - RNA, 14 nt, Leptospira interrogans serovar lai str. 56601
ucgaaaucugaccu

SEQ ID NO: 736785 - RNA, 19 nt, Leptospira interrogans serovar lai str. 56601
ucgaaauuaaaauaaaggc

SEQ ID NO: 736786 - RNA, 22 nt, Leptospira interrogans serovar lai str. 56601
ucgaaucgcuaaacuaucuauu

SEQ ID NO: 736787 - RNA, 19 nt, Leptospira interrogans serovar lai str. 56601
ucgaauacgacagauucaa

SEQ ID NO: 736788 - RNA, 13 nt, Leptospira interrogans serovar lai str. 56601
uccuuucaagaau

SEQ ID NO: 736789 - RNA, 17 nt, Leptospira interrogans serovar lai str. 56601
uccuuuccgauuucuuu

SEQ ID NO: 736790 - RNA, 20 nt, Leptospira interrogans serovar lai str. 56601
uccuuuccgauuucuuucaa

SEQ ID NO: 736791 - RNA, 15 nt, Leptospira interrogans serovar lai str. 56601
uccuuuccuugaaaa

SEQ ID NO: 736792 - RNA, 17 nt, Leptospira interrogans serovar lai str. 56601
uccuuugaauaaaaccg

SEQ ID NO: 736793 - RNA, 16 nt, Leptospira interrogans serovar lai str. 56601
uccuugggauaaauau

SEQ ID NO: 736794 - RNA, 23 nt, Leptospira interrogans serovar lai str. 56601
uccuugggauaaauauucucuau

SEQ ID NO: 736795 - RNA, 17 nt, Leptospira interrogans serovar lai str. 56601
uccuuuaaacuuagauu

SEQ ID NO: 736796 - RNA, 17 nt, Leptospira interrogans serovar lai str. 56601
uccuugugcaauaauuu

SEQ ID NO: 736797 - RNA, 18 nt, Leptospira interrogans serovar lai str. 56601
uccuugugcaauaauuuu

SEQ ID NO: 736798 - RNA, 18 nt, Leptospira interrogans serovar lai str. 56601
uccuuuucgaauuuccuu

SEQ ID NO: 736799 - RNA, 11 nt, Leptospira interrogans serovar lai str. 56601
uccuuuuacuu

SEQ ID NO: 736800 - RNA, 13 nt, Leptospira interrogans serovar lai str. 56601
uccuuuuaagaau

SEQ ID NO: 736801 - RNA, 15 nt, Leptospira interrogans serovar lai str. 56601
uccuuuuguuuuucu

SEQ ID NO: 736802 - RNA, 17 nt, Leptospira interrogans serovar lai str. 56601
uccuuuuuaaaaccaaa

SEQ ID NO: 736803 - RNA, 11 nt, Leptospira interrogans serovar lai str. 56601
ucgaaaaguuu

SEQ ID NO: 736804 - RNA, 17 nt, Leptospira interrogans serovar lai str. 56601
ucgaaaacgauuuuuca

SEQ ID NO: 736805 - RNA, 18 nt, Leptospira interrogans serovar lai str. 56601
ucgaaaacgauuuuucaa

SEQ ID NO: 736806 - RNA, 21 nt, Leptospira interrogans serovar lai str. 56601
ucgaaaagaaauauuaaaaaa

SEQ ID NO: 736807 - RNA, 12 nt, Leptospira interrogans serovar lai str. 56601
ucgaaaaaauac

SEQ ID NO: 736808 - RNA, 14 nt, Leptospira interrogans serovar lai str. 56601
ucgaaaaaacaaau

SEQ ID NO: 736809 - RNA, 15 nt, Leptospira interrogans serovar lai str. 56601
ucgaaaaaacaaaua

SEQ ID NO: 736810 - RNA, 17 nt, Leptospira interrogans serovar lai str. 56601
uccuuuuuuauuuuaac

SEQ ID NO: 736811 - RNA, 15 nt, Leptospira interrogans serovar lai str. 56601
uccuuuuucuaaucc

SEQ ID NO: 736812 - RNA, 17 nt, Leptospira interrogans serovar lai str. 56601
ucgaaaaucucagaaaa

SEQ ID NO: 736813 - RNA, 16 nt, Leptospira interrogans serovar lai str. 56601
ucgaaacaaaaucaaa

SEQ ID NO: 736814 - RNA, 21 nt, Leptospira interrogans serovar lai str. 56601
ucgaaacccaaaaauguagua

SEQ ID NO: 736815 - RNA, 17 nt, Leptospira interrogans serovar lai str. 56601
ucgaaaguuuaccacga

SEQ ID NO: 736816 - RNA, 15 nt, Leptospira interrogans serovar lai str. 56601
ucgaaagauuuuuca

SEQ ID NO: 736817 - RNA, 17 nt, Leptospira interrogans serovar lai str. 56601
ucgaaagauuuuucauu

SEQ ID NO: 736818 - RNA, 16 nt, Leptospira interrogans serovar lai str. 56601
ucgaaagaauuuuugg

SEQ ID NO: 736819 - RNA, 17 nt, Leptospira interrogans serovar lai str. 56601
uccuugaaaaaaaacag

SEQ ID NO: 736820 - RNA, 20 nt, Leptospira interrogans serovar lai str. 56601
uccuugcugucgcaacauaa

SEQ ID NO: 736821 - RNA, 16 nt, Leptospira interrogans serovar lai str. 56601
uccuucuugaaauaau

SEQ ID NO: 736822 - RNA, 15 nt, Leptospira interrogans serovar lai str. 56601
uccuuacucguuuuu

SEQ ID NO: 736823 - RNA, 18 nt, Leptospira interrogans serovar lai str. 56601
uccuuacucguuuuuagu

SEQ ID NO: 736824 - RNA, 17 nt, Leptospira interrogans serovar lai str. 56601
uccuuacuuaccucuau

SEQ ID NO: 736825 - RNA, 15 nt, Leptospira interrogans serovar lai str. 56601
uccuuacgaucuaaa

SEQ ID NO: 736826 - RNA, 16 nt, Leptospira interrogans serovar lai str. 56601
uccuuacgaucuaaaa

SEQ ID NO: 736827 - RNA, 15 nt, Leptospira interrogans serovar lai str. 56601
uccuuccgaucccaa

SEQ ID NO: 736828 - RNA, 21 nt, Leptospira interrogans serovar lai str. 56601
uccuuccgaucccaacugcug

SEQ ID NO: 736829 - RNA, 18 nt, Leptospira interrogans serovar lai str. 56601
ugaauaggcgauuuuaca

SEQ ID NO: 736830 - RNA, 18 nt, Leptospira interrogans serovar lai str. 56601
ugaauauaauaaaauuau

SEQ ID NO: 736831 - RNA, 15 nt, Leptospira interrogans serovar lai str. 56601
ugaauauaaaauuuu

SEQ ID NO: 736832 - RNA, 13 nt, Leptospira interrogans serovar lai str. 56601
ugaauauuuucca

SEQ ID NO: 736833 - RNA, 16 nt, Leptospira interrogans serovar lai str. 56601
ugaauauuuuccaaaa

SEQ ID NO: 736834 - RNA, 18 nt, Leptospira interrogans serovar lai str. 56601
ugaauaaagagaaaacaa

SEQ ID NO: 736835 - RNA, 18 nt, Leptospira interrogans serovar lai str. 56601
ugaauacguuuacuccaa

SEQ ID NO: 736836 - RNA, 18 nt, Leptospira interrogans serovar lai str. 56601
ugaauaacuuuacaaaaa

SEQ ID NO: 736837 - RNA, 17 nt, Leptospira interrogans serovar lai str. 56601
ugaauaagauuuuagaa

SEQ ID NO: 736838 - RNA, 20 nt, Leptospira interrogans serovar lai str. 56601
ugaaguuuuacuaaaaguaa

SEQ ID NO: 736839 - RNA, 19 nt, Leptospira interrogans serovar lai str. 56601
ugaaguuuccgaaagacua

SEQ ID NO: 736840 - RNA, 19 nt, Leptospira interrogans serovar lai str. 56601
ugaauaaacaauaaaauaa

SEQ ID NO: 736841 - RNA, 18 nt, Leptospira interrogans serovar lai str. 56601
ugaauaaaauaaaaaaau

SEQ ID NO: 736842 - RNA, 21 nt, Leptospira interrogans serovar lai str. 56601
ugaaguuaagaagauaaauau

SEQ ID NO: 736843 - RNA, 16 nt, Leptospira interrogans serovar lai str. 56601
ugaaguagauacaauu

SEQ ID NO: 736844 - RNA, 22 nt, Leptospira interrogans serovar lai str. 56601
ugaaguaggugguugggaacaa

SEQ ID NO: 736845 - RNA, 22 nt, Leptospira interrogans serovar lai str. 56601
ugaaguauuuuacgauucaauu

SEQ ID NO: 736846 - RNA, 14 nt, Leptospira interrogans serovar lai str. 56601
ugaauccuuuaaac

SEQ ID NO: 736847 - RNA, 16 nt, Leptospira interrogans serovar lai str. 56601
ugaaucgaauaaaaaa

SEQ ID NO: 736848 - RNA, 14 nt, Leptospira interrogans serovar lai str. 56601
ugaaucgaaucuuu

SEQ ID NO: 736849 - RNA, 16 nt, Leptospira interrogans serovar lai str. 56601
ugaaucgaaucuuuug

SEQ ID NO: 736850 - RNA, 14 nt, Leptospira interrogans serovar lai str. 56601
ugaauccuuccucc

SEQ ID NO: 736851 - RNA, 12 nt, Leptospira interrogans serovar lai str. 56601
ugaauccaaaag

SEQ ID NO: 736852 - RNA, 16 nt, Leptospira interrogans serovar lai str. 56601
ugaaucaugaauuccu

SEQ ID NO: 736853 - RNA, 18 nt, Leptospira interrogans serovar lai str. 56601
ugaauccaucugagaauu

SEQ ID NO: 736854 - RNA, 13 nt, Leptospira interrogans serovar lai str. 56601
ugaauguauauuu

SEQ ID NO: 736855 - RNA, 14 nt, Leptospira interrogans serovar lai str. 56601
ugaauguuuaaaau

SEQ ID NO: 736856 - RNA, 15 nt, Leptospira interrogans serovar lai str. 56601
ugaauuaaaaaacuu

SEQ ID NO: 736857 - RNA, 20 nt, Leptospira interrogans serovar lai str. 56601
ugaauuuuaccaaauuguuu

SEQ ID NO: 736858 - RNA, 18 nt, Leptospira interrogans serovar lai str. 56601
ugaauuuuacuaaaaauu

SEQ ID NO: 736859 - RNA, 17 nt, Leptospira interrogans serovar lai str. 56601
ugaauuuguaauucuuc

SEQ ID NO: 736860 - RNA, 16 nt, Leptospira interrogans serovar lai str. 56601
ugaauuuguuuuucuu

SEQ ID NO: 736861 - RNA, 20 nt, Leptospira interrogans serovar lai str. 56601
ugaauuuuaagaucuauucc

SEQ ID NO: 736862 - RNA, 15 nt, Leptospira interrogans serovar lai str. 56601
ugaauuugaggagaa

SEQ ID NO: 736863 - RNA, 17 nt, Leptospira interrogans serovar lai str. 56601
ugaauuugcaguaaaag

SEQ ID NO: 736864 - RNA, 20 nt, Leptospira interrogans serovar lai str. 56601
ugaauuuuuaagaauaauuu

SEQ ID NO: 736865 - RNA, 14 nt, Leptospira interrogans serovar lai str. 56601
ugaauuuuauagau

SEQ ID NO: 736866 - RNA, 13 nt, Leptospira interrogans serovar lai str. 56601
ugaagauuuaggu

SEQ ID NO: 736867 - RNA, 15 nt, Leptospira interrogans serovar lai str. 56601
ugaagauuuguaaaa

SEQ ID NO: 736868 - RNA, 16 nt, Leptospira interrogans serovar lai str. 56601
ugaagagguacagaaa

SEQ ID NO: 736869 - RNA, 14 nt, Leptospira interrogans serovar lai str. 56601
ugaagagaaaguaa

SEQ ID NO: 736870 - RNA, 18 nt, Leptospira interrogans serovar lai str. 56601
ugaagaaugauaaaucuu

SEQ ID NO: 736871 - RNA, 19 nt, Leptospira interrogans serovar lai str. 56601
ugaagaaugauaaaucuug

SEQ ID NO: 736872 - RNA, 19 nt, Leptospira interrogans serovar lai str. 56601
ugaagaauuaauucuccau

SEQ ID NO: 736873 - RNA, 12 nt, Leptospira interrogans serovar lai str. 56601
ugaagaaaaaaa

SEQ ID NO: 736874 - RNA, 17 nt, Leptospira interrogans serovar lai str. 56601
ugaacuugucccaaaac

SEQ ID NO: 736875 - RNA, 18 nt, Leptospira interrogans serovar lai str. 56601
ugaacuuguccuaaaauu

SEQ ID NO: 736876 - RNA, 21 nt, Leptospira interrogans serovar lai str. 56601
ugaacuuguuccaaaacuaaa

SEQ ID NO: 736877 - RNA, 16 nt, Leptospira interrogans serovar lai str. 56601
ugaagaagcuaaaauu

SEQ ID NO: 736878 - RNA, 22 nt, Leptospira interrogans serovar lai str. 56601
ugaacgguaaaaucuuuaaguu

SEQ ID NO: 736879 - RNA, 21 nt, Leptospira interrogans serovar lai str. 56601
ugaacguaaguuaaauauaaa

SEQ ID NO: 736880 - RNA, 21 nt, Leptospira interrogans serovar lai str. 56601
ugaacuacuacuuuaacguga

SEQ ID NO: 736881 - RNA, 15 nt, Leptospira interrogans serovar lai str. 56601
ugaacuguuuaauuu

SEQ ID NO: 736882 - RNA, 17 nt, Leptospira interrogans serovar lai str. 56601
ugaacucggcucauaaa

SEQ ID NO: 736883 - RNA, 18 nt, Leptospira interrogans serovar lai str. 56601
ugaccaggaauacuugcc

SEQ ID NO: 736884 - RNA, 15 nt, Leptospira interrogans serovar lai str. 56601
ugacauucuaaacau

SEQ ID NO: 736885 - RNA, 22 nt, Leptospira interrogans serovar lai str. 56601
ugacaauuuaucuaaaacacau

SEQ ID NO: 736886 - RNA, 20 nt, Leptospira interrogans serovar lai str. 56601
ugagcacaauauauucagua

SEQ ID NO: 736887 - RNA, 14 nt, Leptospira interrogans serovar lai str. 56601
ugagaguucccacg

SEQ ID NO: 736888 - RNA, 23 nt, Leptospira interrogans serovar lai str. 56601
ugagaguucccacguuuuaaagg

SEQ ID NO: 736889 - RNA, 22 nt, Leptospira interrogans serovar lai str. 56601
ugagagccuuuuuauuucuaag

SEQ ID NO: 736890 - RNA, 22 nt, Leptospira interrogans serovar lai str. 56601
ugagaaagaauuucuaaaagua

SEQ ID NO: 736891 - RNA, 16 nt, Leptospira interrogans serovar lai str. 56601
ugagaaaccuuuucua

SEQ ID NO: 736892 - RNA, 17 nt, Leptospira interrogans serovar lai str. 56601
ugagaaacgauacaaau

SEQ ID NO: 736893 - RNA, 12 nt, Leptospira interrogans serovar lai str. 56601
ugagaaaauuuu

SEQ ID NO: 736894 - RNA, 18 nt, Leptospira interrogans serovar lai str. 56601
ugagaaauacuuugauua

SEQ ID NO: 736895 - RNA, 19 nt, Leptospira interrogans serovar lai str. 56601
ugagaaaggagaacucauu

SEQ ID NO: 736896 - RNA, 16 nt, Leptospira interrogans serovar lai str. 56601
ugagaaccauuucaag

SEQ ID NO: 736897 - RNA, 14 nt, Leptospira interrogans serovar lai str. 56601
ugacuuaagaaaua

SEQ ID NO: 736898 - RNA, 20 nt, Leptospira interrogans serovar lai str. 56601
ugacuuaagaaauagaucug

SEQ ID NO: 736899 - RNA, 12 nt, Leptospira interrogans serovar lai str. 56601
ugacuaaaauug

SEQ ID NO: 736900 - RNA, 17 nt, Leptospira interrogans serovar lai str. 56601
ugcaacgaaaucaaugu

SEQ ID NO: 736901 - RNA, 19 nt, Leptospira interrogans serovar lai str. 56601
ugcaaauuuuuuucuaaaa

SEQ ID NO: 736902 - RNA, 19 nt, Leptospira interrogans serovar lai str. 56601
ugcaaauuacggguauuuu

SEQ ID NO: 736903 - RNA, 22 nt, Leptospira interrogans serovar lai str. 56601
ugcaacuuugguuaucauaaaa

SEQ ID NO: 736904 - RNA, 17 nt, Leptospira interrogans serovar lai str. 56601
ugcaauacauucuuaua

SEQ ID NO: 736905 - RNA, 19 nt, Leptospira interrogans serovar lai str. 56601
ugcaauacauucuuauaaa

SEQ ID NO: 736906 - RNA, 20 nt, Leptospira interrogans serovar lai str. 56601
ugcaauuguuggcuuuuuua

SEQ ID NO: 736907 - RNA, 22 nt, Leptospira interrogans serovar lai str. 56601
ugcaauucgcauuaaaauuuuc

SEQ ID NO: 736908 - RNA, 22 nt, Leptospira interrogans serovar lai str. 56601
ugauuaaaccgguaaaaaguaa

SEQ ID NO: 736909 - RNA, 16 nt, Leptospira interrogans serovar lai str. 56601
ugauuagaguuaaauu

SEQ ID NO: 736910 - RNA, 19 nt, Leptospira interrogans serovar lai str. 56601
ugauugagaaaauaaaaaa

SEQ ID NO: 736911 - RNA, 14 nt, Leptospira interrogans serovar lai str. 56601
ugauucauuuuuug

SEQ ID NO: 736912 - RNA, 19 nt, Leptospira interrogans serovar lai str. 56601
ugauuccaaagauaaaaaa

SEQ ID NO: 736913 - RNA, 23 nt, Leptospira interrogans serovar lai str. 56601
ugauuccaaagauaaaaaagaaa

SEQ ID NO: 736914 - RNA, 23 nt, Leptospira interrogans serovar lai str. 56601
ugauucugcucauuuuuucuucc

SEQ ID NO: 736915 - RNA, 18 nt, Leptospira interrogans serovar lai str. 56601
ugauucagaguaaggaaa

SEQ ID NO: 736916 - RNA, 17 nt, Leptospira interrogans serovar lai str. 56601
ugcaaauacaacuuuuu

SEQ ID NO: 736917 - RNA, 23 nt, Leptospira interrogans serovar lai str. 56601
ugcaaaaaguauguuuuucuaau

SEQ ID NO: 736918 - RNA, 21 nt, Leptospira interrogans serovar lai str. 56601
ugcaaaaaguauguuuuucug

SEQ ID NO: 736919 - RNA, 13 nt, Leptospira interrogans serovar lai str. 56601
ugcaaaaauagaa

SEQ ID NO: 736920 - RNA, 15 nt, Leptospira interrogans serovar lai str. 56601
ugauuuaguaaaauu

SEQ ID NO: 736921 - RNA, 18 nt, Leptospira interrogans serovar lai str. 56601
ugauuuaguaaaauuuaa

SEQ ID NO: 736922 - RNA, 23 nt, Leptospira interrogans serovar lai str. 56601
ugauuuagagagucaaaucaauu

SEQ ID NO: 736923 - RNA, 22 nt, Leptospira interrogans serovar lai str. 56601
ugauuuacuacgucuucuaaau

SEQ ID NO: 736924 - RNA, 14 nt, Leptospira interrogans serovar lai str. 56601
ugauuuuguuaauu

SEQ ID NO: 736925 - RNA, 14 nt, Leptospira interrogans serovar lai str. 56601
ugauuuucuuuucc

SEQ ID NO: 736926 - RNA, 19 nt, Leptospira interrogans serovar lai str. 56601
ugauuucaugcaaaaauuu

SEQ ID NO: 736927 - RNA, 20 nt, Leptospira interrogans serovar lai str. 56601
ugaucauauccgaaagauaa

SEQ ID NO: 736928 - RNA, 21 nt, Leptospira interrogans serovar lai str. 56601
ugauccaaacccaaugauucu

SEQ ID NO: 736929 - RNA, 15 nt, Leptospira interrogans serovar lai str. 56601
ugaucgguuuaaaac

SEQ ID NO: 736930 - RNA, 19 nt, Leptospira interrogans serovar lai str. 56601
ugaucguaacuuucuuuua

SEQ ID NO: 736931 - RNA, 22 nt, Leptospira interrogans serovar lai str. 56601
ugaucguaacuuucuuuuagaa

SEQ ID NO: 736932 - RNA, 18 nt, Leptospira interrogans serovar lai str. 56601
ugaucgucaaucaauuga

SEQ ID NO: 736933 - RNA, 20 nt, Leptospira interrogans serovar lai str. 56601
ugaucguuggccucgaaagu

SEQ ID NO: 736934 - RNA, 13 nt, Leptospira interrogans serovar lai str. 56601
ugaucucuauaaa

SEQ ID NO: 736935 - RNA, 22 nt, Leptospira interrogans serovar lai str. 56601
ugaucuuagaaaaccauuuugu

SEQ ID NO: 736936 - RNA, 15 nt, Leptospira interrogans serovar lai str. 56601
ugaucuuauacucuu

SEQ ID NO: 736937 - RNA, 20 nt, Leptospira interrogans serovar lai str. 56601
ugaucuaauaauauacuaaa

SEQ ID NO: 736938 - RNA, 22 nt, Leptospira interrogans serovar lai str. 56601
ugaucuaauaauauacuaaauu

SEQ ID NO: 736939 - RNA, 16 nt, Leptospira interrogans serovar lai str. 56601
ugaucuauguuauaga

SEQ ID NO: 736940 - RNA, 15 nt, Leptospira interrogans serovar lai str. 56601
ugaucucaauauaaa

SEQ ID NO: 736941 - RNA, 16 nt, Leptospira interrogans serovar lai str. 56601
ugaucuccuaaaauaa

SEQ ID NO: 736942 - RNA, 22 nt, Leptospira interrogans serovar lai str. 56601
ugaucucgauuccuaaaaugug

SEQ ID NO: 736943 - RNA, 16 nt, Leptospira interrogans serovar lai str. 56601
ugaucucgauucugau

SEQ ID NO: 736944 - RNA, 11 nt, Leptospira interrogans serovar lai str. 56601
ugaucuuuuug

SEQ ID NO: 736945 - RNA, 13 nt, Leptospira interrogans serovar lai str. 56601
ugaucuuuaaaag

SEQ ID NO: 736946 - RNA, 21 nt, Leptospira interrogans serovar lai str. 56601
ugaucaaauucacauaaaguu

SEQ ID NO: 736947 - RNA, 19 nt, Leptospira interrogans serovar lai str. 56601
ugauauguuauauaaaguu

SEQ ID NO: 736948 - RNA, 19 nt, Leptospira interrogans serovar lai str. 56601
ugauaguuaauuuuaucuu

SEQ ID NO: 736949 - RNA, 15 nt, Leptospira interrogans serovar lai str. 56601
ugauagaaauauuua

SEQ ID NO: 736950 - RNA, 16 nt, Leptospira interrogans serovar lai str. 56601
ugauagaacucuuuua

SEQ ID NO: 736951 - RNA, 14 nt, Leptospira interrogans serovar lai str. 56601
ugauagagaaaaau

SEQ ID NO: 736952 - RNA, 19 nt, Leptospira interrogans serovar lai str. 56601
ugauagagaaaaauuuucc

SEQ ID NO: 736953 - RNA, 23 nt, Leptospira interrogans serovar lai str. 56601
ugauaauuauccuuaaaaugaaa

SEQ ID NO: 736954 - RNA, 15 nt, Leptospira interrogans serovar lai str. 56601
ugauaauucuuuaga

SEQ ID NO: 736955 - RNA, 21 nt, Leptospira interrogans serovar lai str. 56601
ugauaauuucuaguuugaauu

SEQ ID NO: 736956 - RNA, 11 nt, Leptospira interrogans serovar lai str. 56601
ugauaauuugu

SEQ ID NO: 736957 - RNA, 15 nt, Leptospira interrogans serovar lai str. 56601
ugauaauuugugaac

SEQ ID NO: 736958 - RNA, 15 nt, Leptospira interrogans serovar lai str. 56601
ugauaccuaaugcua

SEQ ID NO: 736959 - RNA, 22 nt, Leptospira interrogans serovar lai str. 56601
ugauaccgggauuuuaaaaauu

SEQ ID NO: 736960 - RNA, 18 nt, Leptospira interrogans serovar lai str. 56601
ugauaauuuuuuaaaaaa

SEQ ID NO: 736961 - RNA, 16 nt, Leptospira interrogans serovar lai str. 56601
ugauaacaaacuuuua

SEQ ID NO: 736962 - RNA, 22 nt, Leptospira interrogans serovar lai str. 56601
ugauaaauuucauaucuaaaau

SEQ ID NO: 736963 - RNA, 11 nt, Leptospira interrogans serovar lai str. 56601
ugauaauaauu

SEQ ID NO: 736964 - RNA, 16 nt, Leptospira interrogans serovar lai str. 56601
ugauaaucaucaaaau

SEQ ID NO: 736965 - RNA, 20 nt, Leptospira interrogans serovar lai str. 56601
ugaguucgauguaagaaaau

SEQ ID NO: 736966 - RNA, 23 nt, Leptospira interrogans serovar lai str. 56601
ugaguuucuccacuuaaaaaguu

SEQ ID NO: 736967 - RNA, 19 nt, Leptospira interrogans serovar lai str. 56601
ugaguuucuugaacucaau

SEQ ID NO: 736968 - RNA, 17 nt, Leptospira interrogans serovar lai str. 56601
ugaguuugagaaaucau

SEQ ID NO: 736969 - RNA, 12 nt, Leptospira interrogans serovar lai str. 56601
ugaguuuaaaga

SEQ ID NO: 736970 - RNA, 16 nt, Leptospira interrogans serovar lai str. 56601
ugaguuuuagaauauu

SEQ ID NO: 736971 - RNA, 13 nt, Leptospira interrogans serovar lai str. 56601
ugauaaagaaaac

SEQ ID NO: 736972 - RNA, 21 nt, Leptospira interrogans serovar lai str. 56601
ugauaaaauauaguuaaauuu

SEQ ID NO: 736973 - RNA, 17 nt, Leptospira interrogans serovar lai str. 56601
ugaguuuucccuauuuu

SEQ ID NO: 736974 - RNA, 13 nt, Leptospira interrogans serovar lai str. 56601
ugaguuuuuccua

SEQ ID NO: 736975 - RNA, 17 nt, Leptospira interrogans serovar lai str. 56601
ugaguuuuuccuauuuu

SEQ ID NO: 736976 - RNA, 18 nt, Leptospira interrogans serovar lai str. 56601
ugaguucccacaaauucc

SEQ ID NO: 736977 - RNA, 22 nt, Leptospira interrogans serovar lai str. 56601
ugaguucccacauuuuaaaguu

SEQ ID NO: 736978 - RNA, 17 nt, Leptospira interrogans serovar lai str. 56601
ugaguucauucauccua

SEQ ID NO: 736979 - RNA, 21 nt, Leptospira interrogans serovar lai str. 56601
ugaguucauucugauucuaaa

SEQ ID NO: 736980 - RNA, 17 nt, Leptospira interrogans serovar lai str. 56601
ugaguuccaaaacucau

SEQ ID NO: 736981 - RNA, 15 nt, Leptospira interrogans serovar lai str. 56601
ugaguuauaaacauu

SEQ ID NO: 736982 - RNA, 17 nt, Leptospira interrogans serovar lai str. 56601
ugaguuauaaacauuaa

SEQ ID NO: 736983 - RNA, 19 nt, Leptospira interrogans serovar lai str. 56601
ugaguuauaguaaaagaaa

SEQ ID NO: 736984 - RNA, 20 nt, Leptospira interrogans serovar lai str. 56601
ugaguguuuuuaguuuucau

SEQ ID NO: 736985 - RNA, 18 nt, Leptospira interrogans serovar lai str. 56601
ugagucccuacaauuuua

SEQ ID NO: 736986 - RNA, 21 nt, Leptospira interrogans serovar lai str. 56601
ugagucccuacaauuuuagaa

SEQ ID NO: 736987 - RNA, 19 nt, Leptospira interrogans serovar lai str. 56601
ugaguccuuucgacuuuag

SEQ ID NO: 736988 - RNA, 16 nt, Leptospira interrogans serovar lai str. 56601
ugagucugucccaaaa

SEQ ID NO: 736989 - RNA, 17 nt, Leptospira interrogans serovar lai str. 56601
ugagucuagaauucuuu

SEQ ID NO: 736990 - RNA, 15 nt, Leptospira interrogans serovar lai str. 56601
ugagucaacaaauau

SEQ ID NO: 736991 - RNA, 20 nt, Leptospira interrogans serovar lai str. 56601
ugagcaguucuaaucucguu

SEQ ID NO: 736992 - RNA, 13 nt, Leptospira interrogans serovar lai str. 56601
ugagcaguaaaau

SEQ ID NO: 736993 - RNA, 19 nt, Leptospira interrogans serovar lai str. 56601
ugagcaguaaaaucuuuaa

SEQ ID NO: 736994 - RNA, 22 nt, Leptospira interrogans serovar lai str. 56601
ugagcaguaaaaucuuuaaguu

SEQ ID NO: 736995 - RNA, 16 nt, Leptospira interrogans serovar lai str. 56601
ugcuucaaaaagagaa

SEQ ID NO: 736996 - RNA, 16 nt, Leptospira interrogans serovar lai str. 56601
ugcuucauauaauaaa

SEQ ID NO: 736997 - RNA, 14 nt, Leptospira interrogans serovar lai str. 56601
ugcuucuuuuaaac

SEQ ID NO: 736998 - RNA, 15 nt, Leptospira interrogans serovar lai str. 56601
ugcuucuuuuaaaca

SEQ ID NO: 736999 - RNA, 17 nt, Leptospira interrogans serovar lai str. 56601
ugcuuuguucaaagaaa

SEQ ID NO: 737000 - RNA, 16 nt, Leptospira interrogans serovar lai str. 56601
ugcuuugguuuucaua

SEQ ID NO: 737001 - RNA, 20 nt, Leptospira interrogans serovar lai str. 56601
ugcuguaacucauauagaaa

SEQ ID NO: 737002 - RNA, 16 nt, Leptospira interrogans serovar lai str. 56601
ugcuguaaaauuuaga

SEQ ID NO: 737003 - RNA, 12 nt, Leptospira interrogans serovar lai str. 56601
ugcguuuaaaaa

SEQ ID NO: 737004 - RNA, 15 nt, Leptospira interrogans serovar lai str. 56601
ugcguuuaaaaacag

SEQ ID NO: 737005 - RNA, 13 nt, Leptospira interrogans serovar lai str. 56601
ugcucauuuuuuc

SEQ ID NO: 737006 - RNA, 17 nt, Leptospira interrogans serovar lai str. 56601
ugcggaaacuuuuucgu

SEQ ID NO: 737007 - RNA, 20 nt, Leptospira interrogans serovar lai str. 56601
ugcggauuccauucuucaaa

SEQ ID NO: 737008 - RNA, 18 nt, Leptospira interrogans serovar lai str. 56601
ugcggaucguuuuuauuc

SEQ ID NO: 737009 - RNA, 11 nt, Leptospira interrogans serovar lai str. 56601
ugccuacaaau

SEQ ID NO: 737010 - RNA, 14 nt, Leptospira interrogans serovar lai str. 56601
ugccuaaauuccuu

SEQ ID NO: 737011 - RNA, 16 nt, Leptospira interrogans serovar lai str. 56601
ugccuaaauuccuucc

SEQ ID NO: 737012 - RNA, 20 nt, Leptospira interrogans serovar lai str. 56601
ugccuaaauuccuuccaagu

SEQ ID NO: 737013 - RNA, 14 nt, Leptospira interrogans serovar lai str. 56601
ugccgcacuuucag

SEQ ID NO: 737014 - RNA, 19 nt, Leptospira interrogans serovar lai str. 56601
ugccauuuccaauuuugcu

SEQ ID NO: 737015 - RNA, 19 nt, Leptospira interrogans serovar lai str. 56601
ugccauuauccaaaacucu

SEQ ID NO: 737016 - RNA, 15 nt, Leptospira interrogans serovar lai str. 56601
ugccccauucuuuuu

SEQ ID NO: 737017 - RNA, 15 nt, Leptospira interrogans serovar lai str. 56601
ugccauuuuucuucu

SEQ ID NO: 737018 - RNA, 20 nt, Leptospira interrogans serovar lai str. 56601
ugcccgcgccuuuggacgaa

SEQ ID NO: 737019 - RNA, 14 nt, Leptospira interrogans serovar lai str. 56601
ugcauugaaaucag

SEQ ID NO: 737020 - RNA, 15 nt, Leptospira interrogans serovar lai str. 56601
ugcauugaaaucaga

SEQ ID NO: 737021 - RNA, 13 nt, Leptospira interrogans serovar lai str. 56601
ugcauuuaaaaaa

SEQ ID NO: 737022 - RNA, 14 nt, Leptospira interrogans serovar lai str. 56601
ugcauuuaauauau

SEQ ID NO: 737023 - RNA, 15 nt, Leptospira interrogans serovar lai str. 56601
ugcauuuaauauauu

SEQ ID NO: 737024 - RNA, 14 nt, Leptospira interrogans serovar lai str. 56601
ugccaaaaucccag

SEQ ID NO: 737025 - RNA, 13 nt, Leptospira interrogans serovar lai str. 56601
ugcauucaaaaag

SEQ ID NO: 737026 - RNA, 22 nt, Leptospira interrogans serovar lai str. 56601
ugcauucaaaaaguuuuauaaa

SEQ ID NO: 737027 - RNA, 12 nt, Leptospira interrogans serovar lai str. 56601
ugcauccacaaa

SEQ ID NO: 737028 - RNA, 18 nt, Leptospira interrogans serovar lai str. 56601
ugcauaaaagaaacauua

SEQ ID NO: 737029 - RNA, 15 nt, Leptospira interrogans serovar lai str. 56601
ugcaguuccuugaac

SEQ ID NO: 737030 - RNA, 18 nt, Leptospira interrogans serovar lai str. 56601
ugcauacauagauaaauc

SEQ ID NO: 737031 - RNA, 20 nt, Leptospira interrogans serovar lai str. 56601
ugcauacauagauaaauccg

SEQ ID NO: 737032 - RNA, 19 nt, Leptospira interrogans serovar lai str. 56601
ugcauaguuuuaugugggu

SEQ ID NO: 737033 - RNA, 13 nt, Leptospira interrogans serovar lai str. 56601
ugcaucaaagaaa

SEQ ID NO: 737034 - RNA, 23 nt, Leptospira interrogans serovar lai str. 56601
ugcaucaaagaaacguuauacaa

SEQ ID NO: 737035 - RNA, 12 nt, Leptospira interrogans serovar lai str. 56601
ugcaucaaaucg

SEQ ID NO: 737036 - RNA, 13 nt, Leptospira interrogans serovar lai str. 56601
uuauugugaguuu

SEQ ID NO: 737037 - RNA, 14 nt, Leptospira interrogans serovar lai str. 56601
uuauugugaauauu

SEQ ID NO: 737038 - RNA, 18 nt, Leptospira interrogans serovar lai str. 56601
uuauugugaauauuucuu

SEQ ID NO: 737039 - RNA, 15 nt, Leptospira interrogans serovar lai str. 56601
uuauuuaauaaaauu

SEQ ID NO: 737040 - RNA, 17 nt, Leptospira interrogans serovar lai str. 56601
uuauuuauauuucuaaa

SEQ ID NO: 737041 - RNA, 16 nt, Leptospira interrogans serovar lai str. 56601
uuauuuacuuuuucca

SEQ ID NO: 737042 - RNA, 21 nt, Leptospira interrogans serovar lai str. 56601
uuauuuaguccguccacaaau

SEQ ID NO: 737043 - RNA, 16 nt, Leptospira interrogans serovar lai str. 56601
uuauuuacauauauaa

SEQ ID NO: 737044 - RNA, 16 nt, Leptospira interrogans serovar lai str. 56601
uuauuguuuauaaaac

SEQ ID NO: 737045 - RNA, 14 nt, Leptospira interrogans serovar lai str. 56601
uuauuucaaaaauu

SEQ ID NO: 737046 - RNA, 17 nt, Leptospira interrogans serovar lai str. 56601
uuauuucaaaaauuuaa

SEQ ID NO: 737047 - RNA, 22 nt, Leptospira interrogans serovar lai str. 56601
uuauuucaaaaauuuaaauguu

SEQ ID NO: 737048 - RNA, 15 nt, Leptospira interrogans serovar lai str. 56601
uuauuucaaaauuua

SEQ ID NO: 737049 - RNA, 12 nt, Leptospira interrogans serovar lai str. 56601
uuauuucuaaac

SEQ ID NO: 737050 - RNA, 15 nt, Leptospira interrogans serovar lai str. 56601
uuauuuuaaaaaaau

SEQ ID NO: 737051 - RNA, 22 nt, Leptospira interrogans serovar lai str. 56601
uuauuuuaacagauuaaaugua

SEQ ID NO: 737052 - RNA, 13 nt, Leptospira interrogans serovar lai str. 56601
uuauuuucaagua

SEQ ID NO: 737053 - RNA, 16 nt, Leptospira interrogans serovar lai str. 56601
uuauuuucaaguaaau

SEQ ID NO: 737054 - RNA, 16 nt, Leptospira interrogans serovar lai str. 56601
uuauuuucauaggaaa

SEQ ID NO: 737055 - RNA, 20 nt, Leptospira interrogans serovar lai str. 56601
uuauucaaaauagaauaaau

SEQ ID NO: 737056 - RNA, 15 nt, Leptospira interrogans serovar lai str. 56601
uuauucaauuuuagu

SEQ ID NO: 737057 - RNA, 19 nt, Leptospira interrogans serovar lai str. 56601
uuauucaauuuuaguaaac

SEQ ID NO: 737058 - RNA, 15 nt, Leptospira interrogans serovar lai str. 56601
uuauucuccauucuu

SEQ ID NO: 737059 - RNA, 22 nt, Leptospira interrogans serovar lai str. 56601
uuauucuaugaaacgaaauaua

SEQ ID NO: 737060 - RNA, 17 nt, Leptospira interrogans serovar lai str. 56601
uuauugaaaaauagaau

SEQ ID NO: 737061 - RNA, 11 nt, Leptospira interrogans serovar lai str. 56601
uuauucuuccg

SEQ ID NO: 737062 - RNA, 20 nt, Leptospira interrogans serovar lai str. 56601
uuauugagucaagauuauuu

SEQ ID NO: 737063 - RNA, 21 nt, Leptospira interrogans serovar lai str. 56601
uuauuacauaccuguuuuagu

SEQ ID NO: 737064 - RNA, 23 nt, Leptospira interrogans serovar lai str. 56601
uuauuauaaauuuauaaauguag

SEQ ID NO: 737065 - RNA, 17 nt, Leptospira interrogans serovar lai str. 56601
uuauuaucaaaauuuaa

SEQ ID NO: 737066 - RNA, 22 nt, Leptospira interrogans serovar lai str. 56601
uuauuagaacucacguuaaaua

SEQ ID NO: 737067 - RNA, 19 nt, Leptospira interrogans serovar lai str. 56601
uuauuuuguuuaaguuuuc

SEQ ID NO: 737068 - RNA, 11 nt, Leptospira interrogans serovar lai str. 56601
uuauuuuuaag

SEQ ID NO: 737069 - RNA, 17 nt, Leptospira interrogans serovar lai str. 56601
uuauuuuguauaaagua

SEQ ID NO: 737070 - RNA, 12 nt, Leptospira interrogans serovar lai str. 56601
uuauuuuccuuu

SEQ ID NO: 737071 - RNA, 14 nt, Leptospira interrogans serovar lai str. 56601
uuauuuuuacagaa

SEQ ID NO: 737072 - RNA, 19 nt, Leptospira interrogans serovar lai str. 56601
uuauuuuuacagaaaaauc

SEQ ID NO: 737073 - RNA, 14 nt, Leptospira interrogans serovar lai str. 56601
uuauuuuuuuauuu

SEQ ID NO: 737074 - RNA, 16 nt, Leptospira interrogans serovar lai str. 56601
uucaaaaagacuauau

SEQ ID NO: 737075 - RNA, 19 nt, Leptospira interrogans serovar lai str. 56601
uucaaaaaguuuuauaaac

SEQ ID NO: 737076 - RNA, 12 nt, Leptospira interrogans serovar lai str. 56601
uucaaaaauaaa

SEQ ID NO: 737077 - RNA, 20 nt, Leptospira interrogans serovar lai str. 56601
uucaaaaauauauuauaaua

SEQ ID NO: 737078 - RNA, 21 nt, Leptospira interrogans serovar lai str. 56601
uucaaaaauauauuauaauaa

SEQ ID NO: 737079 - RNA, 14 nt, Leptospira interrogans serovar lai str. 56601
uuauuuuuuuuaau

SEQ ID NO: 737080 - RNA, 22 nt, Leptospira interrogans serovar lai str. 56601
uucaaaaaagaaaaaucuucag

SEQ ID NO: 737081 - RNA, 19 nt, Leptospira interrogans serovar lai str. 56601
uucaaaaaccgaaauagaa

SEQ ID NO: 737082 - RNA, 16 nt, Leptospira interrogans serovar lai str. 56601
uucaaaaacuaaaaua

SEQ ID NO: 737083 - RNA, 18 nt, Leptospira interrogans serovar lai str. 56601
uucaaaaacuaaaauaca

SEQ ID NO: 737084 - RNA, 21 nt, Leptospira interrogans serovar lai str. 56601
uucaaaaacuaaaauacaaaa

SEQ ID NO: 737085 - RNA, 20 nt, Leptospira interrogans serovar lai str. 56601
uucaaaaaaucaaauauaca

SEQ ID NO: 737086 - RNA, 11 nt, Leptospira interrogans serovar lai str. 56601
uucaaaaacau

SEQ ID NO: 737087 - RNA, 14 nt, Leptospira interrogans serovar lai str. 56601
uucaaaauaagaaa

SEQ ID NO: 737088 - RNA, 15 nt, Leptospira interrogans serovar lai str. 56601
uucaaaauaagaaaa

SEQ ID NO: 737089 - RNA, 18 nt, Leptospira interrogans serovar lai str. 56601
uucaaaauaagaaaauaa

SEQ ID NO: 737090 - RNA, 18 nt, Leptospira interrogans serovar lai str. 56601
uucaaaaucguuuuaaaa

SEQ ID NO: 737091 - RNA, 19 nt, Leptospira interrogans serovar lai str. 56601
uucaaaaucguuuuaaaaa

SEQ ID NO: 737092 - RNA, 20 nt, Leptospira interrogans serovar lai str. 56601
uucaaaaucguuuuaaaaac

SEQ ID NO: 737093 - RNA, 14 nt, Leptospira interrogans serovar lai str. 56601
uucaaacaacaaaa

SEQ ID NO: 737094 - RNA, 20 nt, Leptospira interrogans serovar lai str. 56601
uucaaacaacaaaaaauaua

SEQ ID NO: 737095 - RNA, 21 nt, Leptospira interrogans serovar lai str. 56601
uucaaacaacaaaaaauauac

SEQ ID NO: 737096 - RNA, 23 nt, Leptospira interrogans serovar lai str. 56601
uucaaaauuaccuuucauuuuuc

SEQ ID NO: 737097 - RNA, 19 nt, Leptospira interrogans serovar lai str. 56601
uucaaaauuugauccucua

SEQ ID NO: 737098 - RNA, 18 nt, Leptospira interrogans serovar lai str. 56601
uucaaacgcuuucguaaa

SEQ ID NO: 737099 - RNA, 14 nt, Leptospira interrogans serovar lai str. 56601
uucaaagauaaaau

SEQ ID NO: 737100 - RNA, 15 nt, Leptospira interrogans serovar lai str. 56601
uucaaagauaaaaua

SEQ ID NO: 737101 - RNA, 18 nt, Leptospira interrogans serovar lai str. 56601
uucaaagauaaaauauag

SEQ ID NO: 737102 - RNA, 19 nt, Leptospira interrogans serovar lai str. 56601
uucaaacguucguaguuuu

SEQ ID NO: 737103 - RNA, 22 nt, Leptospira interrogans serovar lai str. 56601
uucaaaggccgcuucuuuauuu

SEQ ID NO: 737104 - RNA, 15 nt, Leptospira interrogans serovar lai str. 56601
uucaaaguuuucaca

SEQ ID NO: 737105 - RNA, 19 nt, Leptospira interrogans serovar lai str. 56601
uucaaaguuuucacaaaaa

SEQ ID NO: 737106 - RNA, 21 nt, Leptospira interrogans serovar lai str. 56601
uucaaaguuuucacaaaaaaa

SEQ ID NO: 737107 - RNA, 14 nt, Leptospira interrogans serovar lai str. 56601
uucaaauaaagaaa

SEQ ID NO: 737108 - RNA, 16 nt, Leptospira interrogans serovar lai str. 56601
uucaaauaaagaaaag

SEQ ID NO: 737109 - RNA, 19 nt, Leptospira interrogans serovar lai str. 56601
uucaaauaaagaaaaggaa

SEQ ID NO: 737110 - RNA, 20 nt, Leptospira interrogans serovar lai str. 56601
uucaaauuuacucuuauaaa

SEQ ID NO: 737111 - RNA, 21 nt, Leptospira interrogans serovar lai str. 56601
uucaaauuuacucuuauaaaa

SEQ ID NO: 737112 - RNA, 22 nt, Leptospira interrogans serovar lai str. 56601
uucaaauuuacucuuauaaaau

SEQ ID NO: 737113 - RNA, 16 nt, Leptospira interrogans serovar lai str. 56601
uucaaauuuauguacu

SEQ ID NO: 737114 - RNA, 19 nt, Leptospira interrogans serovar lai str. 56601
uucaaauucaucaauuuug

SEQ ID NO: 737115 - RNA, 22 nt, Leptospira interrogans serovar lai str. 56601
uucaacaacucuaauacaaaaa

SEQ ID NO: 737116 - RNA, 21 nt, Leptospira interrogans serovar lai str. 56601
uucaacaacucuauuuuauuu

SEQ ID NO: 737117 - RNA, 15 nt, Leptospira interrogans serovar lai str. 56601
uucaacaaacaaaua

SEQ ID NO: 737118 - RNA, 18 nt, Leptospira interrogans serovar lai str. 56601
uucaacaaacaaauagaa

SEQ ID NO: 737119 - RNA, 20 nt, Leptospira interrogans serovar lai str. 56601
uucaagacuuuauagucaaa

SEQ ID NO: 737120 - RNA, 18 nt, Leptospira interrogans serovar lai str. 56601
uucaacuuuuuucagaaa

SEQ ID NO: 737121 - RNA, 20 nt, Leptospira interrogans serovar lai str. 56601
uucaacuuuuuucagaaaaa

SEQ ID NO: 737122 - RNA, 21 nt, Leptospira interrogans serovar lai str. 56601
uucaacuuuuuucagaaaaag

SEQ ID NO: 737123 - RNA, 14 nt, Leptospira interrogans serovar lai str. 56601
uucaacuuuagaaa

SEQ ID NO: 737124 - RNA, 15 nt, Leptospira interrogans serovar lai str. 56601
uucaacuuuagaaaa

SEQ ID NO: 737125 - RNA, 14 nt, Leptospira interrogans serovar lai str. 56601
uucaacuuuccuuu

SEQ ID NO: 737126 - RNA, 14 nt, Leptospira interrogans serovar lai str. 56601
uucaacuuguaaaa

SEQ ID NO: 737127 - RNA, 18 nt, Leptospira interrogans serovar lai str. 56601
uucaacuuaaggaaauuc

SEQ ID NO: 737128 - RNA, 16 nt, Leptospira interrogans serovar lai str. 56601
uucaacuauuauaaua

SEQ ID NO: 737129 - RNA, 19 nt, Leptospira interrogans serovar lai str. 56601
uuauauauauucacaaaaa

SEQ ID NO: 737130 - RNA, 21 nt, Leptospira interrogans serovar lai str. 56601
uuauauauauucacaaaaaaa

SEQ ID NO: 737131 - RNA, 19 nt, Leptospira interrogans serovar lai str. 56601
uuauauagcucuugaauaa

SEQ ID NO: 737132 - RNA, 17 nt, Leptospira interrogans serovar lai str. 56601
uuauaucgaauacauuu

SEQ ID NO: 737133 - RNA, 22 nt, Leptospira interrogans serovar lai str. 56601
uuauauauuuuuaauuugcuua

SEQ ID NO: 737134 - RNA, 12 nt, Leptospira interrogans serovar lai str. 56601
uuaucauaaaaa

SEQ ID NO: 737135 - RNA, 14 nt, Leptospira interrogans serovar lai str. 56601
uuaucauaaaaaua

SEQ ID NO: 737136 - RNA, 15 nt, Leptospira interrogans serovar lai str. 56601
uuaucaguuaaacuu

SEQ ID NO: 737137 - RNA, 17 nt, Leptospira interrogans serovar lai str. 56601
uuaucaacuuuuggaac

SEQ ID NO: 737138 - RNA, 16 nt, Leptospira interrogans serovar lai str. 56601
uuaucauguaaaauuu

SEQ ID NO: 737139 - RNA, 18 nt, Leptospira interrogans serovar lai str. 56601
uuaucauguuuuauauaa

SEQ ID NO: 737140 - RNA, 20 nt, Leptospira interrogans serovar lai str. 56601
uuauccauaaguuccuuaaa

SEQ ID NO: 737141 - RNA, 19 nt, Leptospira interrogans serovar lai str. 56601
uuauccgcuuuauauuuca

SEQ ID NO: 737142 - RNA, 15 nt, Leptospira interrogans serovar lai str. 56601
uuauaauuuuaaaua

SEQ ID NO: 737143 - RNA, 16 nt, Leptospira interrogans serovar lai str. 56601
uuauaauuuuaaauaa

SEQ ID NO: 737144 - RNA, 18 nt, Leptospira interrogans serovar lai str. 56601
uuauaauuuucuuaauaa

SEQ ID NO: 737145 - RNA, 14 nt, Leptospira interrogans serovar lai str. 56601
uuauacaauauuuc

SEQ ID NO: 737146 - RNA, 22 nt, Leptospira interrogans serovar lai str. 56601
uuauaaugauaaaguagacaac

SEQ ID NO: 737147 - RNA, 19 nt, Leptospira interrogans serovar lai str. 56601
uuauaauucguuuuuuaaa

SEQ ID NO: 737148 - RNA, 22 nt, Leptospira interrogans serovar lai str. 56601
uuauaauucugaauaauugaau

SEQ ID NO: 737149 - RNA, 22 nt, Leptospira interrogans serovar lai str. 56601
uuauaauugaacauuuuuaaaa

SEQ ID NO: 737150 - RNA, 12 nt, Leptospira interrogans serovar lai str. 56601
uuauaaguuuuu

SEQ ID NO: 737151 - RNA, 21 nt, Leptospira interrogans serovar lai str. 56601
uuauaaguuuuuauuauaaaa

SEQ ID NO: 737152 - RNA, 22 nt, Leptospira interrogans serovar lai str. 56601
uuauaauagaguuacagaaaaa

SEQ ID NO: 737153 - RNA, 18 nt, Leptospira interrogans serovar lai str. 56601
uuauaauauauauaaauu

SEQ ID NO: 737154 - RNA, 11 nt, Leptospira interrogans serovar lai str. 56601
uuauagauaua

SEQ ID NO: 737155 - RNA, 19 nt, Leptospira interrogans serovar lai str. 56601
uuagagugaauuuguaauu

SEQ ID NO: 737156 - RNA, 18 nt, Leptospira interrogans serovar lai str. 56601
uuagaguguugacucuuu

SEQ ID NO: 737157 - RNA, 16 nt, Leptospira interrogans serovar lai str. 56601
uuagaguuaagagaau

SEQ ID NO: 737158 - RNA, 18 nt, Leptospira interrogans serovar lai str. 56601
uuagaguuaagagaauuu

SEQ ID NO: 737159 - RNA, 15 nt, Leptospira interrogans serovar lai str. 56601
uuagaguuauugaaa

SEQ ID NO: 737160 - RNA, 16 nt, Leptospira interrogans serovar lai str. 56601
uuagaguuauugaaaa

SEQ ID NO: 737161 - RNA, 21 nt, Leptospira interrogans serovar lai str. 56601
uuagaguucguuaagaauaaa

SEQ ID NO: 737162 - RNA, 19 nt, Leptospira interrogans serovar lai str. 56601
uuauaaaacgaaauuauac

SEQ ID NO: 737163 - RNA, 17 nt, Leptospira interrogans serovar lai str. 56601
uuauaaaacuguaaauu

SEQ ID NO: 737164 - RNA, 22 nt, Leptospira interrogans serovar lai str. 56601
uuauaaaaaguuuguuuguaaa

SEQ ID NO: 737165 - RNA, 12 nt, Leptospira interrogans serovar lai str. 56601
uuauaaaaauac

SEQ ID NO: 737166 - RNA, 15 nt, Leptospira interrogans serovar lai str. 56601
uuagaguuucuaaaa

SEQ ID NO: 737167 - RNA, 18 nt, Leptospira interrogans serovar lai str. 56601
uuagaguuucuaaaaaaa

SEQ ID NO: 737168 - RNA, 14 nt, Leptospira interrogans serovar lai str. 56601
uuagaguauuauaa

SEQ ID NO: 737169 - RNA, 12 nt, Leptospira interrogans serovar lai str. 56601
uuauaaaaacuu

SEQ ID NO: 737170 - RNA, 15 nt, Leptospira interrogans serovar lai str. 56601
uuagaaucugaacuu

SEQ ID NO: 737171 - RNA, 19 nt, Leptospira interrogans serovar lai str. 56601
uuagagaaacuuuaaauac

SEQ ID NO: 737172 - RNA, 11 nt, Leptospira interrogans serovar lai str. 56601
uuauaaaaucu

SEQ ID NO: 737173 - RNA, 15 nt, Leptospira interrogans serovar lai str. 56601
uuauaaaaucuaaaa

SEQ ID NO: 737174 - RNA, 22 nt, Leptospira interrogans serovar lai str. 56601
uuauaaaauugaguaccauaaa

SEQ ID NO: 737175 - RNA, 17 nt, Leptospira interrogans serovar lai str. 56601
uuauaaaauaaaaaaau

SEQ ID NO: 737176 - RNA, 13 nt, Leptospira interrogans serovar lai str. 56601
uuauaaaauacca

SEQ ID NO: 737177 - RNA, 22 nt, Leptospira interrogans serovar lai str. 56601
uuauaagccaaaccaaauagaa

SEQ ID NO: 737178 - RNA, 23 nt, Leptospira interrogans serovar lai str. 56601
uuauaaauacaaaaauucuaaua

SEQ ID NO: 737179 - RNA, 11 nt, Leptospira interrogans serovar lai str. 56601
uuauaagacau

SEQ ID NO: 737180 - RNA, 14 nt, Leptospira interrogans serovar lai str. 56601
uuaugaaagucuuu

SEQ ID NO: 737181 - RNA, 18 nt, Leptospira interrogans serovar lai str. 56601
uuaugaaauaaagaagag

SEQ ID NO: 737182 - RNA, 18 nt, Leptospira interrogans serovar lai str. 56601
uuaugacagcuugaagau

SEQ ID NO: 737183 - RNA, 23 nt, Leptospira interrogans serovar lai str. 56601
uuaugacagcuugaagauuagac

SEQ ID NO: 737184 - RNA, 23 nt, Leptospira interrogans serovar lai str. 56601
uuaugacccaagauucaaagaua

SEQ ID NO: 737185 - RNA, 20 nt, Leptospira interrogans serovar lai str. 56601
uuaugauaugaacguauucu

SEQ ID NO: 737186 - RNA, 13 nt, Leptospira interrogans serovar lai str. 56601
uuaugauuuuuuu

SEQ ID NO: 737187 - RNA, 17 nt, Leptospira interrogans serovar lai str. 56601
uuaugauuucacgaaca

SEQ ID NO: 737188 - RNA, 19 nt, Leptospira interrogans serovar lai str. 56601
uuaugauuucacgaacaca

SEQ ID NO: 737189 - RNA, 20 nt, Leptospira interrogans serovar lai str. 56601
uuaugcaugaauuuguuuuu

SEQ ID NO: 737190 - RNA, 18 nt, Leptospira interrogans serovar lai str. 56601
uuaugcaauuuauugacu

SEQ ID NO: 737191 - RNA, 16 nt, Leptospira interrogans serovar lai str. 56601
uuaugcaguauuuugu

SEQ ID NO: 737192 - RNA, 17 nt, Leptospira interrogans serovar lai str. 56601
uuaugguuuuuuaauau

SEQ ID NO: 737193 - RNA, 16 nt, Leptospira interrogans serovar lai str. 56601
uuaugguaaaauuuca

SEQ ID NO: 737194 - RNA, 21 nt, Leptospira interrogans serovar lai str. 56601
uuaugguaguucccacaaguu

SEQ ID NO: 737195 - RNA, 17 nt, Leptospira interrogans serovar lai str. 56601
uuauggacuauuuuauu

SEQ ID NO: 737196 - RNA, 15 nt, Leptospira interrogans serovar lai str. 56601
uuauggcacuuauuc

SEQ ID NO: 737197 - RNA, 16 nt, Leptospira interrogans serovar lai str. 56601
uuauggaauuuuucaa

SEQ ID NO: 737198 - RNA, 15 nt, Leptospira interrogans serovar lai str. 56601
uuaugugaguuccca

SEQ ID NO: 737199 - RNA, 21 nt, Leptospira interrogans serovar lai str. 56601
uuauguaauauacaauaaaua

SEQ ID NO: 737200 - RNA, 14 nt, Leptospira interrogans serovar lai str. 56601
uuauguaagaaaaa

SEQ ID NO: 737201 - RNA, 16 nt, Leptospira interrogans serovar lai str. 56601
uuauguagaaauuuga

SEQ ID NO: 737202 - RNA, 13 nt, Leptospira interrogans serovar lai str. 56601
uuauuaaaauuuc

SEQ ID NO: 737203 - RNA, 21 nt, Leptospira interrogans serovar lai str. 56601
uuauuaaaauuucccgauucu

SEQ ID NO: 737204 - RNA, 17 nt, Leptospira interrogans serovar lai str. 56601
uuaucuugauccauuaa

SEQ ID NO: 737205 - RNA, 21 nt, Leptospira interrogans serovar lai str. 56601
uuaucuucucuagaaacugca

SEQ ID NO: 737206 - RNA, 17 nt, Leptospira interrogans serovar lai str. 56601
uuaucuuagaucaauuu

SEQ ID NO: 737207 - RNA, 19 nt, Leptospira interrogans serovar lai str. 56601
uuaucuguaaaauuuggau

SEQ ID NO: 737208 - RNA, 20 nt, Leptospira interrogans serovar lai str. 56601
uuaucugagcacaaaauauu

SEQ ID NO: 737209 - RNA, 15 nt, Leptospira interrogans serovar lai str. 56601
uuaucuaaaauuuca

SEQ ID NO: 737210 - RNA, 21 nt, Leptospira interrogans serovar lai str. 56601
uuaucgggauacucauaaaau

SEQ ID NO: 737211 - RNA, 15 nt, Leptospira interrogans serovar lai str. 56601
uuaucgucaaaauuu

SEQ ID NO: 737212 - RNA, 20 nt, Leptospira interrogans serovar lai str. 56601
uuaucggcguucuacaaaau

SEQ ID NO: 737213 - RNA, 16 nt, Leptospira interrogans serovar lai str. 56601
uuaucgcuaauacaaa

SEQ ID NO: 737214 - RNA, 18 nt, Leptospira interrogans serovar lai str. 56601
uuauccguuuauccuaau

SEQ ID NO: 737215 - RNA, 19 nt, Leptospira interrogans serovar lai str. 56601
uuauccuaaugaaaaagaa

SEQ ID NO: 737216 - RNA, 20 nt, Leptospira interrogans serovar lai str. 56601
uuauccuaaugaaaaagaaa

SEQ ID NO: 737217 - RNA, 15 nt, Leptospira interrogans serovar lai str. 56601
uuaucgacuuuugaa

SEQ ID NO: 737218 - RNA, 20 nt, Leptospira interrogans serovar lai str. 56601
uuaucgacuuuugaaaaucc

SEQ ID NO: 737219 - RNA, 18 nt, Leptospira interrogans serovar lai str. 56601
uuaaguuugugagaguuc

SEQ ID NO: 737220 - RNA, 21 nt, Leptospira interrogans serovar lai str. 56601
uuaaguuugugagaguuccca

SEQ ID NO: 737221 - RNA, 15 nt, Leptospira interrogans serovar lai str. 56601
uuaauaaaauacagu

SEQ ID NO: 737222 - RNA, 17 nt, Leptospira interrogans serovar lai str. 56601
uuaauaaaaaaaugaau

SEQ ID NO: 737223 - RNA, 18 nt, Leptospira interrogans serovar lai str. 56601
uuaauaaaauuuuuaaaa

SEQ ID NO: 737224 - RNA, 18 nt, Leptospira interrogans serovar lai str. 56601
uuaagcucgaauaaaaac

SEQ ID NO: 737225 - RNA, 15 nt, Leptospira interrogans serovar lai str. 56601
uuaaguucuuuaguu

SEQ ID NO: 737226 - RNA, 18 nt, Leptospira interrogans serovar lai str. 56601
uuaaguucuuuaguuguu

SEQ ID NO: 737227 - RNA, 13 nt, Leptospira interrogans serovar lai str. 56601
uuaauaacucuau

SEQ ID NO: 737228 - RNA, 20 nt, Leptospira interrogans serovar lai str. 56601
uuaauaaauugcauaaaaga

SEQ ID NO: 737229 - RNA, 21 nt, Leptospira interrogans serovar lai str. 56601
uuaauaaauugcauaaaagaa

SEQ ID NO: 737230 - RNA, 14 nt, Leptospira interrogans serovar lai str. 56601
uuaauaaauuguau

SEQ ID NO: 737231 - RNA, 15 nt, Leptospira interrogans serovar lai str. 56601
uuaacucaucuaauc

SEQ ID NO: 737232 - RNA, 14 nt, Leptospira interrogans serovar lai str. 56601
uuaagaaagacuuu

SEQ ID NO: 737233 - RNA, 17 nt, Leptospira interrogans serovar lai str. 56601
uuaagagccuacaaauc

SEQ ID NO: 737234 - RNA, 18 nt, Leptospira interrogans serovar lai str. 56601
uuaagaaauagaucugau

SEQ ID NO: 737235 - RNA, 16 nt, Leptospira interrogans serovar lai str. 56601
uuaacuuuuauucucu

SEQ ID NO: 737236 - RNA, 22 nt, Leptospira interrogans serovar lai str. 56601
uuaacuuuuuuuaaaaaauuca

SEQ ID NO: 737237 - RNA, 23 nt, Leptospira interrogans serovar lai str. 56601
uuaagaaaacucaaaucuacaaa

SEQ ID NO: 737238 - RNA, 17 nt, Leptospira interrogans serovar lai str. 56601
uuaagauaaauuuagua

SEQ ID NO: 737239 - RNA, 20 nt, Leptospira interrogans serovar lai str. 56601
uuaagagucauuuuuaaaua

SEQ ID NO: 737240 - RNA, 23 nt, Leptospira interrogans serovar lai str. 56601
uuaagauuacauuuuucuaaauu

SEQ ID NO: 737241 - RNA, 19 nt, Leptospira interrogans serovar lai str. 56601
uuaagcccuugcguaucaa

SEQ ID NO: 737242 - RNA, 20 nt, Leptospira interrogans serovar lai str. 56601
uuaagcccuugcguaucaaa

SEQ ID NO: 737243 - RNA, 17 nt, Leptospira interrogans serovar lai str. 56601
uuaacgugaguucgaug

SEQ ID NO: 737244 - RNA, 21 nt, Leptospira interrogans serovar lai str. 56601
uuaacgguacucaauuuuaca

SEQ ID NO: 737245 - RNA, 22 nt, Leptospira interrogans serovar lai str. 56601
uuaacuacacgagagcugcuug

SEQ ID NO: 737246 - RNA, 13 nt, Leptospira interrogans serovar lai str. 56601
uuaacaguauuca

SEQ ID NO: 737247 - RNA, 15 nt, Leptospira interrogans serovar lai str. 56601
uuaacaguauucaau

SEQ ID NO: 737248 - RNA, 13 nt, Leptospira interrogans serovar lai str. 56601
uuaacaacauuag

SEQ ID NO: 737249 - RNA, 18 nt, Leptospira interrogans serovar lai str. 56601
uuaacaauucuagcaaaa

SEQ ID NO: 737250 - RNA, 22 nt, Leptospira interrogans serovar lai str. 56601
uuaaauuuugaaaaauuccaua

SEQ ID NO: 737251 - RNA, 15 nt, Leptospira interrogans serovar lai str. 56601
uuaaauuuauaauga

SEQ ID NO: 737252 - RNA, 18 nt, Leptospira interrogans serovar lai str. 56601
uuaaauuuaucuauaaaa

SEQ ID NO: 737253 - RNA, 13 nt, Leptospira interrogans serovar lai str. 56601
uuaacaaaacugc

SEQ ID NO: 737254 - RNA, 18 nt, Leptospira interrogans serovar lai str. 56601
uuaaauuuuuugcaaaaa

SEQ ID NO: 737255 - RNA, 19 nt, Leptospira interrogans serovar lai str. 56601
uuaaauuuuuugcaaaaaa

SEQ ID NO: 737256 - RNA, 20 nt, Leptospira interrogans serovar lai str. 56601
uuaaauuuuuugcaaaaaaa

SEQ ID NO: 737257 - RNA, 22 nt, Leptospira interrogans serovar lai str. 56601
uuaaauucuagcgucuaaaaaa

SEQ ID NO: 737258 - RNA, 15 nt, Leptospira interrogans serovar lai str. 56601
uuaaauucuacauuu

SEQ ID NO: 737259 - RNA, 12 nt, Leptospira interrogans serovar lai str. 56601
uuaaauugaaac

SEQ ID NO: 737260 - RNA, 16 nt, Leptospira interrogans serovar lai str. 56601
uuaaauuguaugcagu

SEQ ID NO: 737261 - RNA, 18 nt, Leptospira interrogans serovar lai str. 56601
uuaaauuagcuuaagaau

SEQ ID NO: 737262 - RNA, 20 nt, Leptospira interrogans serovar lai str. 56601
uuaaauuagcuuaagaauuu

SEQ ID NO: 737263 - RNA, 22 nt, Leptospira interrogans serovar lai str. 56601
uuaaauuagcuuaagaauuucc

SEQ ID NO: 737264 - RNA, 14 nt, Leptospira interrogans serovar lai str. 56601
uuaaauuagauauu

SEQ ID NO: 737265 - RNA, 11 nt, Leptospira interrogans serovar lai str. 56601
uuaaauuaaua

SEQ ID NO: 737266 - RNA, 19 nt, Leptospira interrogans serovar lai str. 56601
uuaaaucaccuuuuacuuc

SEQ ID NO: 737267 - RNA, 23 nt, Leptospira interrogans serovar lai str. 56601
uuaaauagagcuuuguaauaaaa

SEQ ID NO: 737268 - RNA, 13 nt, Leptospira interrogans serovar lai str. 56601
uuaaauacauuaa

SEQ ID NO: 737269 - RNA, 23 nt, Leptospira interrogans serovar lai str. 56601
uuaaauacauuaagauuauauua

SEQ ID NO: 737270 - RNA, 15 nt, Leptospira interrogans serovar lai str. 56601
uuaaauacuuaaaaa

SEQ ID NO: 737271 - RNA, 19 nt, Leptospira interrogans serovar lai str. 56601
uuaaauacuuaaaaacccc

SEQ ID NO: 737272 - RNA, 18 nt, Leptospira interrogans serovar lai str. 56601
uuaaauauuaauuauaug

SEQ ID NO: 737273 - RNA, 20 nt, Leptospira interrogans serovar lai str. 56601
uuaaagaauuuuuacagaaa

SEQ ID NO: 737274 - RNA, 22 nt, Leptospira interrogans serovar lai str. 56601
uuaaagacgauuccuaaaaauu

SEQ ID NO: 737275 - RNA, 18 nt, Leptospira interrogans serovar lai str. 56601
uuaaagacgauugauucu

SEQ ID NO: 737276 - RNA, 18 nt, Leptospira interrogans serovar lai str. 56601
uuaaacuuugaaaauugu

SEQ ID NO: 737277 - RNA, 18 nt, Leptospira interrogans serovar lai str. 56601
uuaaacuuuuauaaaauc

SEQ ID NO: 737278 - RNA, 21 nt, Leptospira interrogans serovar lai str. 56601
uuaaacuuuuauaaaaucuaa

SEQ ID NO: 737279 - RNA, 19 nt, Leptospira interrogans serovar lai str. 56601
uuaaaguaguuucgccaau

SEQ ID NO: 737280 - RNA, 15 nt, Leptospira interrogans serovar lai str. 56601
uuaaaccuuccuuug

SEQ ID NO: 737281 - RNA, 17 nt, Leptospira interrogans serovar lai str. 56601
uuaaacgaucagaaaaa

SEQ ID NO: 737282 - RNA, 20 nt, Leptospira interrogans serovar lai str. 56601
uuaaacgaucagaaaaacaa

SEQ ID NO: 737283 - RNA, 15 nt, Leptospira interrogans serovar lai str. 56601
uuaaacgauuuaaaa

SEQ ID NO: 737284 - RNA, 22 nt, Leptospira interrogans serovar lai str. 56601
uuaaacauuuauuuuucguaau

SEQ ID NO: 737285 - RNA, 18 nt, Leptospira interrogans serovar lai str. 56601
uuaaacagagauaggaau

SEQ ID NO: 737286 - RNA, 14 nt, Leptospira interrogans serovar lai str. 56601
uuaaacaauuuuuc

SEQ ID NO: 737287 - RNA, 15 nt, Leptospira interrogans serovar lai str. 56601
uuaaacaauuuuuca

SEQ ID NO: 737288 - RNA, 22 nt, Leptospira interrogans serovar lai str. 56601
uguugcuauggaauuuuucaac

SEQ ID NO: 737289 - RNA, 17 nt, Leptospira interrogans serovar lai str. 56601
uuaaaauuuuuaauaaa

SEQ ID NO: 737290 - RNA, 13 nt, Leptospira interrogans serovar lai str. 56601
uuaaucuuuuuua

SEQ ID NO: 737291 - RNA, 22 nt, Leptospira interrogans serovar lai str. 56601
uuaaugagucugucccaaaauc

SEQ ID NO: 737292 - RNA, 12 nt, Leptospira interrogans serovar lai str. 56601
uuaaucuguaaa

SEQ ID NO: 737293 - RNA, 17 nt, Leptospira interrogans serovar lai str. 56601
uuaauacgaauuuaacu

SEQ ID NO: 737294 - RNA, 13 nt, Leptospira interrogans serovar lai str. 56601
uuaauuauggcac

SEQ ID NO: 737295 - RNA, 18 nt, Leptospira interrogans serovar lai str. 56601
uuaauuaugucucuaauc

SEQ ID NO: 737296 - RNA, 22 nt, Leptospira interrogans serovar lai str. 56601
uuaauuauguuugccauuuuuu

SEQ ID NO: 737297 - RNA, 23 nt, Leptospira interrogans serovar lai str. 56601
uuaauguaaaguucuuuucuuaa

SEQ ID NO: 737298 - RNA, 16 nt, Leptospira interrogans serovar lai str. 56601
uuaaugcgaaaauuua

SEQ ID NO: 737299 - RNA, 16 nt, Leptospira interrogans serovar lai str. 56601
uuaaugcugauuuuuc

SEQ ID NO: 737300 - RNA, 19 nt, Leptospira interrogans serovar lai str. 56601
uuaauuuaaucaaaauuuc

SEQ ID NO: 737301 - RNA, 17 nt, Leptospira interrogans serovar lai str. 56601
uuaauuuagaauaaaaa

SEQ ID NO: 737302 - RNA, 15 nt, Leptospira interrogans serovar lai str. 56601
uuaauuguuauaaac

SEQ ID NO: 737303 - RNA, 13 nt, Leptospira interrogans serovar lai str. 56601
uuaauuuaaaaac

SEQ ID NO: 737304 - RNA, 15 nt, Leptospira interrogans serovar lai str. 56601
uuaauuuaaaaacaa

SEQ ID NO: 737305 - RNA, 13 nt, Leptospira interrogans serovar lai str. 56601
uuacaaagugaug

SEQ ID NO: 737306 - RNA, 14 nt, Leptospira interrogans serovar lai str. 56601
uuacaaaaucugaa

SEQ ID NO: 737307 - RNA, 15 nt, Leptospira interrogans serovar lai str. 56601
uuacaaaaucugaau

SEQ ID NO: 737308 - RNA, 12 nt, Leptospira interrogans serovar lai str. 56601
uuacaacuuuug

SEQ ID NO: 737309 - RNA, 17 nt, Leptospira interrogans serovar lai str. 56601
uuacaaauuaguauuuu

SEQ ID NO: 737310 - RNA, 20 nt, Leptospira interrogans serovar lai str. 56601
uuacaaagacucggaaauuc

SEQ ID NO: 737311 - RNA, 21 nt, Leptospira interrogans serovar lai str. 56601
uuacaaagcacuuuuuuccuc

SEQ ID NO: 737312 - RNA, 13 nt, Leptospira interrogans serovar lai str. 56601
uuacaauaaaaac

SEQ ID NO: 737313 - RNA, 12 nt, Leptospira interrogans serovar lai str. 56601
uuacagaaaaau

SEQ ID NO: 737314 - RNA, 14 nt, Leptospira interrogans serovar lai str. 56601
uuacagaaaaauca

SEQ ID NO: 737315 - RNA, 21 nt, Leptospira interrogans serovar lai str. 56601
uuacagaaaaccaaauaauaa

SEQ ID NO: 737316 - RNA, 16 nt, Leptospira interrogans serovar lai str. 56601
uuacagaagauuuugu

SEQ ID NO: 737317 - RNA, 15 nt, Leptospira interrogans serovar lai str. 56601
uuacauuuuuaaauu

SEQ ID NO: 737318 - RNA, 23 nt, Leptospira interrogans serovar lai str. 56601
uuacauuuuucuaaauuaauauu

SEQ ID NO: 737319 - RNA, 23 nt, Leptospira interrogans serovar lai str. 56601
uuaccaaggauguggaaguuuuc

SEQ ID NO: 737320 - RNA, 15 nt, Leptospira interrogans serovar lai str. 56601
uuacauauauaauuu

SEQ ID NO: 737321 - RNA, 18 nt, Leptospira interrogans serovar lai str. 56601
uuacauauauaauuuauu

SEQ ID NO: 737322 - RNA, 17 nt, Leptospira interrogans serovar lai str. 56601
uuacaucgaauucauuu

SEQ ID NO: 737323 - RNA, 14 nt, Leptospira interrogans serovar lai str. 56601
uuacuaaaaaacau

SEQ ID NO: 737324 - RNA, 20 nt, Leptospira interrogans serovar lai str. 56601
uuacgugauaauucuuuaga

SEQ ID NO: 737325 - RNA, 17 nt, Leptospira interrogans serovar lai str. 56601
uuacguaaugugaguuc

SEQ ID NO: 737326 - RNA, 23 nt, Leptospira interrogans serovar lai str. 56601
uuacggggaauuuuuacauuuuc

SEQ ID NO: 737327 - RNA, 15 nt, Leptospira interrogans serovar lai str. 56601
uuacgcggaacaucg

SEQ ID NO: 737328 - RNA, 19 nt, Leptospira interrogans serovar lai str. 56601
uuacggaucaauucugaaa

SEQ ID NO: 737329 - RNA, 17 nt, Leptospira interrogans serovar lai str. 56601
uuacggcauuuuuuaaa

SEQ ID NO: 737330 - RNA, 17 nt, Leptospira interrogans serovar lai str. 56601
uuacgcugaguuugaga

SEQ ID NO: 737331 - RNA, 15 nt, Leptospira interrogans serovar lai str. 56601
uuaccccgaaauaca

SEQ ID NO: 737332 - RNA, 20 nt, Leptospira interrogans serovar lai str. 56601
uuacgacuuuauucaaaaua

SEQ ID NO: 737333 - RNA, 22 nt, Leptospira interrogans serovar lai str. 56601
uuacgcaugauaaaaauuguua

SEQ ID NO: 737334 - RNA, 17 nt, Leptospira interrogans serovar lai str. 56601
uuacucagaguuauaua

SEQ ID NO: 737335 - RNA, 20 nt, Leptospira interrogans serovar lai str. 56601
uuacuauaaacauauuauuu

SEQ ID NO: 737336 - RNA, 21 nt, Leptospira interrogans serovar lai str. 56601
uuacuacccgacguauaaaaa

SEQ ID NO: 737337 - RNA, 22 nt, Leptospira interrogans serovar lai str. 56601
uuacuacucggaugcauaaaua

SEQ ID NO: 737338 - RNA, 23 nt, Leptospira interrogans serovar lai str. 56601
uuacuaugaagacgcuuaaaaau

SEQ ID NO: 737339 - RNA, 16 nt, Leptospira interrogans serovar lai str. 56601
uuacucgacaaaacac

SEQ ID NO: 737340 - RNA, 22 nt, Leptospira interrogans serovar lai str. 56601
uuacucuacuauaaacuucucu

SEQ ID NO: 737341 - RNA, 17 nt, Leptospira interrogans serovar lai str. 56601
uuacucuuauaaaauuu

SEQ ID NO: 737342 - RNA, 18 nt, Leptospira interrogans serovar lai str. 56601
uuacugauuucaaaaaua

SEQ ID NO: 737343 - RNA, 13 nt, Leptospira interrogans serovar lai str. 56601
uuacugauuuuca

SEQ ID NO: 737344 - RNA, 23 nt, Leptospira interrogans serovar lai str. 56601
uuagaaguugaucuuauacucuu

SEQ ID NO: 737345 - RNA, 20 nt, Leptospira interrogans serovar lai str. 56601
uuagaaugugggaacuacua

SEQ ID NO: 737346 - RNA, 13 nt, Leptospira interrogans serovar lai str. 56601
uuagaaucagaau

SEQ ID NO: 737347 - RNA, 17 nt, Leptospira interrogans serovar lai str. 56601
uuagaaucagaaugaac

SEQ ID NO: 737348 - RNA, 13 nt, Leptospira interrogans serovar lai str. 56601
uuagaauauuaag

SEQ ID NO: 737349 - RNA, 21 nt, Leptospira interrogans serovar lai str. 56601
uuagaauauuuucucaguaaa

SEQ ID NO: 737350 - RNA, 23 nt, Leptospira interrogans serovar lai str. 56601
uuagaauaguaguuuucacuaau

SEQ ID NO: 737351 - RNA, 15 nt, Leptospira interrogans serovar lai str. 56601
uuagaauaaagagaa

SEQ ID NO: 737352 - RNA, 18 nt, Leptospira interrogans serovar lai str. 56601
uuagaaaauuagaaagaa

SEQ ID NO: 737353 - RNA, 14 nt, Leptospira interrogans serovar lai str. 56601
uuagaaaauuauac

SEQ ID NO: 737354 - RNA, 20 nt, Leptospira interrogans serovar lai str. 56601
uuagaaaaauugaauuucuu

SEQ ID NO: 737355 - RNA, 15 nt, Leptospira interrogans serovar lai str. 56601
uuacuuuuucugguu

SEQ ID NO: 737356 - RNA, 17 nt, Leptospira interrogans serovar lai str. 56601
uuagaaaaaauuuuucu

SEQ ID NO: 737357 - RNA, 20 nt, Leptospira interrogans serovar lai str. 56601
uuagaaaaaauuuuucuuaa

SEQ ID NO: 737358 - RNA, 21 nt, Leptospira interrogans serovar lai str. 56601
uguuccaaaaccucaaaaaau

SEQ ID NO: 737359 - RNA, 13 nt, Leptospira interrogans serovar lai str. 56601
uguuccaaagcca

SEQ ID NO: 737360 - RNA, 21 nt, Leptospira interrogans serovar lai str. 56601
uguucauucuuuaaaauagaa

SEQ ID NO: 737361 - RNA, 18 nt, Leptospira interrogans serovar lai str. 56601
uguucaucguuccaaacc

SEQ ID NO: 737362 - RNA, 14 nt, Leptospira interrogans serovar lai str. 56601
uguucuuagacuca

SEQ ID NO: 737363 - RNA, 18 nt, Leptospira interrogans serovar lai str. 56601
uguucuuaaaauugugau

SEQ ID NO: 737364 - RNA, 14 nt, Leptospira interrogans serovar lai str. 56601
uguucuugugggaa

SEQ ID NO: 737365 - RNA, 15 nt, Leptospira interrogans serovar lai str. 56601
uguucuuuuauauaa

SEQ ID NO: 737366 - RNA, 18 nt, Leptospira interrogans serovar lai str. 56601
uguugaauaucuaauauu

SEQ ID NO: 737367 - RNA, 16 nt, Leptospira interrogans serovar lai str. 56601
uguugaguuuuuccua

SEQ ID NO: 737368 - RNA, 16 nt, Leptospira interrogans serovar lai str. 56601
uguguugaaucuuaaa

SEQ ID NO: 737369 - RNA, 15 nt, Leptospira interrogans serovar lai str. 56601
uguuaauuuugaacu

SEQ ID NO: 737370 - RNA, 22 nt, Leptospira interrogans serovar lai str. 56601
uguuaauuuuuauuggaaaaag

SEQ ID NO: 737371 - RNA, 21 nt, Leptospira interrogans serovar lai str. 56601
uguuacgguaauauauucaau

SEQ ID NO: 737372 - RNA, 18 nt, Leptospira interrogans serovar lai str. 56601
uguucaguguaagauuaa

SEQ ID NO: 737373 - RNA, 16 nt, Leptospira interrogans serovar lai str. 56601
uguucauaaaaacguc

SEQ ID NO: 737374 - RNA, 13 nt, Leptospira interrogans serovar lai str. 56601
uguucaaaauuua

SEQ ID NO: 737375 - RNA, 14 nt, Leptospira interrogans serovar lai str. 56601
uguucaaaauuuau

SEQ ID NO: 737376 - RNA, 16 nt, Leptospira interrogans serovar lai str. 56601
uguucaaagaaaugug

SEQ ID NO: 737377 - RNA, 17 nt, Leptospira interrogans serovar lai str. 56601
uguuaucaacuuuugga

SEQ ID NO: 737378 - RNA, 15 nt, Leptospira interrogans serovar lai str. 56601
uguuauuuuguauaa

SEQ ID NO: 737379 - RNA, 14 nt, Leptospira interrogans serovar lai str. 56601
uguuauuuuuauua

SEQ ID NO: 737380 - RNA, 16 nt, Leptospira interrogans serovar lai str. 56601
uguuauagaugaaauu

SEQ ID NO: 737381 - RNA, 12 nt, Leptospira interrogans serovar lai str. 56601
uguuaguuccca

SEQ ID NO: 737382 - RNA, 14 nt, Leptospira interrogans serovar lai str. 56601
uguuaguuugcaau

SEQ ID NO: 737383 - RNA, 13 nt, Leptospira interrogans serovar lai str. 56601
uguuauaaaaugu

SEQ ID NO: 737384 - RNA, 14 nt, Leptospira interrogans serovar lai str. 56601
uguuauaaaaugua

SEQ ID NO: 737385 - RNA, 17 nt, Leptospira interrogans serovar lai str. 56601
uguuauaaaauguauua

SEQ ID NO: 737386 - RNA, 16 nt, Leptospira interrogans serovar lai str. 56601
uguuauaaaccaauaa

SEQ ID NO: 737387 - RNA, 17 nt, Leptospira interrogans serovar lai str. 56601
ugugcaaaaauuuuuua

SEQ ID NO: 737388 - RNA, 16 nt, Leptospira interrogans serovar lai str. 56601
uguggauaccuuuagu

SEQ ID NO: 737389 - RNA, 22 nt, Leptospira interrogans serovar lai str. 56601
uguggauaccuuuaguuuuuua

SEQ ID NO: 737390 - RNA, 15 nt, Leptospira interrogans serovar lai str. 56601
uguggaugauuuuuc

SEQ ID NO: 737391 - RNA, 23 nt, Leptospira interrogans serovar lai str. 56601
uguggcaagaggaacaauuugua

SEQ ID NO: 737392 - RNA, 12 nt, Leptospira interrogans serovar lai str. 56601
ugucuuaaaauu

SEQ ID NO: 737393 - RNA, 13 nt, Leptospira interrogans serovar lai str. 56601
ugucuuuuuagag

SEQ ID NO: 737394 - RNA, 12 nt, Leptospira interrogans serovar lai str. 56601
ugucuuuuucua

SEQ ID NO: 737395 - RNA, 14 nt, Leptospira interrogans serovar lai str. 56601
ugucuuuaaaauug

SEQ ID NO: 737396 - RNA, 23 nt, Leptospira interrogans serovar lai str. 56601
ugucuucuaaaucuaauucuucu

SEQ ID NO: 737397 - RNA, 21 nt, Leptospira interrogans serovar lai str. 56601
ugucuucgauccgagucgaau

SEQ ID NO: 737398 - RNA, 14 nt, Leptospira interrogans serovar lai str. 56601
ugucuugaaauucu

SEQ ID NO: 737399 - RNA, 19 nt, Leptospira interrogans serovar lai str. 56601
ugucuugaauuacaauuga

SEQ ID NO: 737400 - RNA, 21 nt, Leptospira interrogans serovar lai str. 56601
ugugauaaagagucgauuagc

SEQ ID NO: 737401 - RNA, 20 nt, Leptospira interrogans serovar lai str. 56601
ugugaucagaauuaaaaauu

SEQ ID NO: 737402 - RNA, 13 nt, Leptospira interrogans serovar lai str. 56601
ugugauaguuuuu

SEQ ID NO: 737403 - RNA, 22 nt, Leptospira interrogans serovar lai str. 56601
ugugaguucccacauuuuaaag

SEQ ID NO: 737404 - RNA, 20 nt, Leptospira interrogans serovar lai str. 56601
ugugaauguauauuuuuuua

SEQ ID NO: 737405 - RNA, 14 nt, Leptospira interrogans serovar lai str. 56601
ugugaauauuucuu

SEQ ID NO: 737406 - RNA, 20 nt, Leptospira interrogans serovar lai str. 56601
ugugaaucaaaagguauaaa

SEQ ID NO: 737407 - RNA, 23 nt, Leptospira interrogans serovar lai str. 56601
ugugaaucaaaagguauaaaaua

SEQ ID NO: 737408 - RNA, 15 nt, Leptospira interrogans serovar lai str. 56601
ugugaauucagaaaa

SEQ ID NO: 737409 - RNA, 20 nt, Leptospira interrogans serovar lai str. 56601
ugugaacucggcguaagaaa

SEQ ID NO: 737410 - RNA, 15 nt, Leptospira interrogans serovar lai str. 56601
ugucguuuaacaaaa

SEQ ID NO: 737411 - RNA, 21 nt, Leptospira interrogans serovar lai str. 56601
ugucuacgaucgcaacauaau

SEQ ID NO: 737412 - RNA, 15 nt, Leptospira interrogans serovar lai str. 56601
ugucucaaaauuuaa

SEQ ID NO: 737413 - RNA, 13 nt, Leptospira interrogans serovar lai str. 56601
ugucucuuuauau

SEQ ID NO: 737414 - RNA, 19 nt, Leptospira interrogans serovar lai str. 56601
ugucucuuuauauaaaauu

SEQ ID NO: 737415 - RNA, 21 nt, Leptospira interrogans serovar lai str. 56601
ugucucuuuauauaaaauuug

SEQ ID NO: 737416 - RNA, 19 nt, Leptospira interrogans serovar lai str. 56601
ugucuccugucaauuuucc

SEQ ID NO: 737417 - RNA, 15 nt, Leptospira interrogans serovar lai str. 56601
ugucucuaauacaug

SEQ ID NO: 737418 - RNA, 21 nt, Leptospira interrogans serovar lai str. 56601
uguccuaaaaccucaaaaaau

SEQ ID NO: 737419 - RNA, 22 nt, Leptospira interrogans serovar lai str. 56601
uguccuaaaaccucaaaaaauu

SEQ ID NO: 737420 - RNA, 22 nt, Leptospira interrogans serovar lai str. 56601
uguccuaaaauuuuaaaaaauu

SEQ ID NO: 737421 - RNA, 13 nt, Leptospira interrogans serovar lai str. 56601
ugucauguuuuaa

SEQ ID NO: 737422 - RNA, 21 nt, Leptospira interrogans serovar lai str. 56601
ugucauguuuuaaugaaaaau

SEQ ID NO: 737423 - RNA, 19 nt, Leptospira interrogans serovar lai str. 56601
ugucccaaaauuucuaaag

SEQ ID NO: 737424 - RNA, 15 nt, Leptospira interrogans serovar lai str. 56601
ugucccaaaacuuca

SEQ ID NO: 737425 - RNA, 22 nt, Leptospira interrogans serovar lai str. 56601
ugucccgaaaccucaaaaaauu

SEQ ID NO: 737426 - RNA, 18 nt, Leptospira interrogans serovar lai str. 56601
ugucauaaaccgauuuuc

SEQ ID NO: 737427 - RNA, 22 nt, Leptospira interrogans serovar lai str. 56601
ugucauaaaccgauuuucccaa

SEQ ID NO: 737428 - RNA, 16 nt, Leptospira interrogans serovar lai str. 56601
ugucaagcccucccgu

SEQ ID NO: 737429 - RNA, 20 nt, Leptospira interrogans serovar lai str. 56601
ugucaagcgacgauagaagc

SEQ ID NO: 737430 - RNA, 18 nt, Leptospira interrogans serovar lai str. 56601
ugucaaaugcgacuuaau

SEQ ID NO: 737431 - RNA, 20 nt, Leptospira interrogans serovar lai str. 56601
uguaugaguuccuacauguu

SEQ ID NO: 737432 - RNA, 19 nt, Leptospira interrogans serovar lai str. 56601
uguaugauuuauaguuuuu

SEQ ID NO: 737433 - RNA, 20 nt, Leptospira interrogans serovar lai str. 56601
uguaugcaggaaacauaaua

SEQ ID NO: 737434 - RNA, 16 nt, Leptospira interrogans serovar lai str. 56601
uguauucuauaaaauu

SEQ ID NO: 737435 - RNA, 15 nt, Leptospira interrogans serovar lai str. 56601
uguaaguuuugaauu

SEQ ID NO: 737436 - RNA, 16 nt, Leptospira interrogans serovar lai str. 56601
uguaaguuuugaauuu

SEQ ID NO: 737437 - RNA, 21 nt, Leptospira interrogans serovar lai str. 56601
uguaaugacacuuaucaaaua

SEQ ID NO: 737438 - RNA, 13 nt, Leptospira interrogans serovar lai str. 56601
uguaaugaaaucu

SEQ ID NO: 737439 - RNA, 16 nt, Leptospira interrogans serovar lai str. 56601
uguaaucuguggacuu

SEQ ID NO: 737440 - RNA, 22 nt, Leptospira interrogans serovar lai str. 56601
uguaaucuguggacuuaugaga

SEQ ID NO: 737441 - RNA, 17 nt, Leptospira interrogans serovar lai str. 56601
uguaaucuuauuuuuua

SEQ ID NO: 737442 - RNA, 23 nt, Leptospira interrogans serovar lai str. 56601
uguaaucuuccgcauuuuuauuu

SEQ ID NO: 737443 - RNA, 20 nt, Leptospira interrogans serovar lai str. 56601
uguaauucuucaauaucuuu

SEQ ID NO: 737444 - RNA, 14 nt, Leptospira interrogans serovar lai str. 56601
uguaaugauuucag

SEQ ID NO: 737445 - RNA, 19 nt, Leptospira interrogans serovar lai str. 56601
uguaauuaguguuuaccuu

SEQ ID NO: 737446 - RNA, 20 nt, Leptospira interrogans serovar lai str. 56601
uguaauuaguguuuaccuuu

SEQ ID NO: 737447 - RNA, 18 nt, Leptospira interrogans serovar lai str. 56601
uguaauuagaggauaaac

SEQ ID NO: 737448 - RNA, 13 nt, Leptospira interrogans serovar lai str. 56601
uguaauuaauuca

SEQ ID NO: 737449 - RNA, 20 nt, Leptospira interrogans serovar lai str. 56601
uguaaaaaaacaugaagaag

SEQ ID NO: 737450 - RNA, 14 nt, Leptospira interrogans serovar lai str. 56601
uguaaaaacuacca

SEQ ID NO: 737451 - RNA, 23 nt, Leptospira interrogans serovar lai str. 56601
uguaaaaacuaccacaaaucuaa

SEQ ID NO: 737452 - RNA, 23 nt, Leptospira interrogans serovar lai str. 56601
uguaaauuagauuauuuacauau

SEQ ID NO: 737453 - RNA, 20 nt, Leptospira interrogans serovar lai str. 56601
uguaaaugaauuggaaagaa

SEQ ID NO: 737454 - RNA, 18 nt, Leptospira interrogans serovar lai str. 56601
uguaaaaaaauagaugga

SEQ ID NO: 737455 - RNA, 21 nt, Leptospira interrogans serovar lai str. 56601
uguaagggaaaguuauuucuu

SEQ ID NO: 737456 - RNA, 23 nt, Leptospira interrogans serovar lai str. 56601
uguaagacucauauuuuuagaaa

SEQ ID NO: 737457 - RNA, 22 nt, Leptospira interrogans serovar lai str. 56601
ugguugaguuuuuuaaaacgaa

SEQ ID NO: 737458 - RNA, 16 nt, Leptospira interrogans serovar lai str. 56601
ugguuuagaaaacgga

SEQ ID NO: 737459 - RNA, 21 nt, Leptospira interrogans serovar lai str. 56601
ugguuguggaugauuuuucua

SEQ ID NO: 737460 - RNA, 14 nt, Leptospira interrogans serovar lai str. 56601
ugguugggaacaau

SEQ ID NO: 737461 - RNA, 14 nt, Leptospira interrogans serovar lai str. 56601
ugguuucaauuuaa

SEQ ID NO: 737462 - RNA, 16 nt, Leptospira interrogans serovar lai str. 56601
ugguuucaauuuaaaa

SEQ ID NO: 737463 - RNA, 20 nt, Leptospira interrogans serovar lai str. 56601
ugguuucaauuuaaaauauc

SEQ ID NO: 737464 - RNA, 20 nt, Leptospira interrogans serovar lai str. 56601
ugguagauugcuuuuuaaaa

SEQ ID NO: 737465 - RNA, 22 nt, Leptospira interrogans serovar lai str. 56601
ugguagauugcuuuuuaaaaga

SEQ ID NO: 737466 - RNA, 13 nt, Leptospira interrogans serovar lai str. 56601
ugggguuguuuca

SEQ ID NO: 737467 - RNA, 18 nt, Leptospira interrogans serovar lai str. 56601
uggucaacaucucaauca

SEQ ID NO: 737468 - RNA, 21 nt, Leptospira interrogans serovar lai str. 56601
uggugaacuauuuauaaaaua

SEQ ID NO: 737469 - RNA, 14 nt, Leptospira interrogans serovar lai str. 56601
uggugauuuaaaaa

SEQ ID NO: 737470 - RNA, 22 nt, Leptospira interrogans serovar lai str. 56601
ugggcgugccucucgccaaaau

SEQ ID NO: 737471 - RNA, 18 nt, Leptospira interrogans serovar lai str. 56601
ugggaauuuuuuuguaua

SEQ ID NO: 737472 - RNA, 15 nt, Leptospira interrogans serovar lai str. 56601
ugggacaaacucuuu

SEQ ID NO: 737473 - RNA, 18 nt, Leptospira interrogans serovar lai str. 56601
ugggacaaacucuuuauu

SEQ ID NO: 737474 - RNA, 21 nt, Leptospira interrogans serovar lai str. 56601
ugggaguuuucacauuuuagg

SEQ ID NO: 737475 - RNA, 20 nt, Leptospira interrogans serovar lai str. 56601
uggcuguaguuaugacccaa

SEQ ID NO: 737476 - RNA, 17 nt, Leptospira interrogans serovar lai str. 56601
ugggaacuaccacaaaa

SEQ ID NO: 737477 - RNA, 12 nt, Leptospira interrogans serovar lai str. 56601
ugggaacuacua

SEQ ID NO: 737478 - RNA, 18 nt, Leptospira interrogans serovar lai str. 56601
ugggaacuacuauaaauu

SEQ ID NO: 737479 - RNA, 12 nt, Leptospira interrogans serovar lai str. 56601
ugggaaggaauu

SEQ ID NO: 737480 - RNA, 18 nt, Leptospira interrogans serovar lai str. 56601
ugggaacuauuacaaaau

SEQ ID NO: 737481 - RNA, 13 nt, Leptospira interrogans serovar lai str. 56601
uggaaaaugaauu

SEQ ID NO: 737482 - RNA, 17 nt, Leptospira interrogans serovar lai str. 56601
uggaaaacuuucuuuua

SEQ ID NO: 737483 - RNA, 13 nt, Leptospira interrogans serovar lai str. 56601
uggaaaaaugaaa

SEQ ID NO: 737484 - RNA, 12 nt, Leptospira interrogans serovar lai str. 56601
uggaaaagaauc

SEQ ID NO: 737485 - RNA, 12 nt, Leptospira interrogans serovar lai str. 56601
uggaaaaguuuu

SEQ ID NO: 737486 - RNA, 18 nt, Leptospira interrogans serovar lai str. 56601
uggaaaaguuuuuaaaaa

SEQ ID NO: 737487 - RNA, 20 nt, Leptospira interrogans serovar lai str. 56601
uggaaaaguuuuuaaaaauu

SEQ ID NO: 737488 - RNA, 15 nt, Leptospira interrogans serovar lai str. 56601
uggcucauuuuucuu

SEQ ID NO: 737489 - RNA, 15 nt, Leptospira interrogans serovar lai str. 56601
uggcucaacuuuucc

SEQ ID NO: 737490 - RNA, 16 nt, Leptospira interrogans serovar lai str. 56601
uggcucagauuuccuu

SEQ ID NO: 737491 - RNA, 19 nt, Leptospira interrogans serovar lai str. 56601
uucagacugacugaaaaaa

SEQ ID NO: 737492 - RNA, 15 nt, Leptospira interrogans serovar lai str. 56601
uucagaaaaaugaau

SEQ ID NO: 737493 - RNA, 22 nt, Leptospira interrogans serovar lai str. 56601
uucagaaacuggaauauucuuu

SEQ ID NO: 737494 - RNA, 18 nt, Leptospira interrogans serovar lai str. 56601
uucacuuuuccaaauaua

SEQ ID NO: 737495 - RNA, 14 nt, Leptospira interrogans serovar lai str. 56601
uucacuuuaaaaca

SEQ ID NO: 737496 - RNA, 15 nt, Leptospira interrogans serovar lai str. 56601
uucagauuucaacuu

SEQ ID NO: 737497 - RNA, 22 nt, Leptospira interrogans serovar lai str. 56601
uucagaugaauugaauuuuuua

SEQ ID NO: 737498 - RNA, 17 nt, Leptospira interrogans serovar lai str. 56601
uucagagugguuucuua

SEQ ID NO: 737499 - RNA, 22 nt, Leptospira interrogans serovar lai str. 56601
uucagcacaucguaucuugaau

SEQ ID NO: 737500 - RNA, 20 nt, Leptospira interrogans serovar lai str. 56601
uucacgaacacaaauucuaa

SEQ ID NO: 737501 - RNA, 17 nt, Leptospira interrogans serovar lai str. 56601
uucacccaccaaaaaua

SEQ ID NO: 737502 - RNA, 15 nt, Leptospira interrogans serovar lai str. 56601
uucacuguuaaaaga

SEQ ID NO: 737503 - RNA, 20 nt, Leptospira interrogans serovar lai str. 56601
uucacuguuaaaagauuugu

SEQ ID NO: 737504 - RNA, 23 nt, Leptospira interrogans serovar lai str. 56601
uucacuuccauuggauucugcuc

SEQ ID NO: 737505 - RNA, 13 nt, Leptospira interrogans serovar lai str. 56601
uucacucaaaaua

SEQ ID NO: 737506 - RNA, 15 nt, Leptospira interrogans serovar lai str. 56601
uucacucuuaaauac

SEQ ID NO: 737507 - RNA, 13 nt, Leptospira interrogans serovar lai str. 56601
uucacugaaaauu

SEQ ID NO: 737508 - RNA, 22 nt, Leptospira interrogans serovar lai str. 56601
uucaaguuugugagaguuccca

SEQ ID NO: 737509 - RNA, 16 nt, Leptospira interrogans serovar lai str. 56601
uucaauaaaacguuuc

SEQ ID NO: 737510 - RNA, 21 nt, Leptospira interrogans serovar lai str. 56601
uucaagugauucauucuaaga

SEQ ID NO: 737511 - RNA, 14 nt, Leptospira interrogans serovar lai str. 56601
uucaaguuaauaca

SEQ ID NO: 737512 - RNA, 16 nt, Leptospira interrogans serovar lai str. 56601
uucaagguaauuuaua

SEQ ID NO: 737513 - RNA, 15 nt, Leptospira interrogans serovar lai str. 56601
uucaauaaaauacca

SEQ ID NO: 737514 - RNA, 19 nt, Leptospira interrogans serovar lai str. 56601
uucaauaaaauaccauaaa

SEQ ID NO: 737515 - RNA, 16 nt, Leptospira interrogans serovar lai str. 56601
uucaauaauuuuaaua

SEQ ID NO: 737516 - RNA, 17 nt, Leptospira interrogans serovar lai str. 56601
uucaauaauuuuaauau

SEQ ID NO: 737517 - RNA, 22 nt, Leptospira interrogans serovar lai str. 56601
uucaauacaaccgaaaagguua

SEQ ID NO: 737518 - RNA, 22 nt, Leptospira interrogans serovar lai str. 56601
uucaaucaauaccgauuucuau

SEQ ID NO: 737519 - RNA, 17 nt, Leptospira interrogans serovar lai str. 56601
uucaauauaaaaauuaa

SEQ ID NO: 737520 - RNA, 18 nt, Leptospira interrogans serovar lai str. 56601
uucaaucacguucaacgu

SEQ ID NO: 737521 - RNA, 13 nt, Leptospira interrogans serovar lai str. 56601
uucaaucuaaccc

SEQ ID NO: 737522 - RNA, 19 nt, Leptospira interrogans serovar lai str. 56601
uucaaucuauuaacuuuac

SEQ ID NO: 737523 - RNA, 15 nt, Leptospira interrogans serovar lai str. 56601
uucaaugcaaaaaau

SEQ ID NO: 737524 - RNA, 18 nt, Leptospira interrogans serovar lai str. 56601
uucaauuuauuauagaac

SEQ ID NO: 737525 - RNA, 21 nt, Leptospira interrogans serovar lai str. 56601
uucaauucuacgaauuucaga

SEQ ID NO: 737526 - RNA, 12 nt, Leptospira interrogans serovar lai str. 56601
uucaauuuaaaa

SEQ ID NO: 737527 - RNA, 14 nt, Leptospira interrogans serovar lai str. 56601
uucaauuuauaaac

SEQ ID NO: 737528 - RNA, 24 nt, Leptospira interrogans serovar lai str. 56601
uucaauuaacaaaacuacuucaau

SEQ ID NO: 737529 - RNA, 14 nt, Leptospira interrogans serovar lai str. 56601
uucaauguuauaaa

SEQ ID NO: 737530 - RNA, 15 nt, Leptospira interrogans serovar lai str. 56601
uucaauguuauaaaa

SEQ ID NO: 737531 - RNA, 16 nt, Leptospira interrogans serovar lai str. 56601
uucaauguuauaaaau

SEQ ID NO: 737532 - RNA, 18 nt, Leptospira interrogans serovar lai str. 56601
uucaauguuauaaaaugu

SEQ ID NO: 737533 - RNA, 22 nt, Leptospira interrogans serovar lai str. 56601
uucacagaaacccucuccuuga

SEQ ID NO: 737534 - RNA, 21 nt, Leptospira interrogans serovar lai str. 56601
uucacaaaaaaauucauaaua

SEQ ID NO: 737535 - RNA, 18 nt, Leptospira interrogans serovar lai str. 56601
uucacaaaaaaauucucc

SEQ ID NO: 737536 - RNA, 16 nt, Leptospira interrogans serovar lai str. 56601
uucaauuuucucaaaa

SEQ ID NO: 737537 - RNA, 15 nt, Leptospira interrogans serovar lai str. 56601
uucaauuuuuauaaa

SEQ ID NO: 737538 - RNA, 14 nt, Leptospira interrogans serovar lai str. 56601
uucaauuuuuauca

SEQ ID NO: 737539 - RNA, 14 nt, Leptospira interrogans serovar lai str. 56601
uucacauaaaguua

SEQ ID NO: 737540 - RNA, 18 nt, Leptospira interrogans serovar lai str. 56601
uucacaugguuaaagugu

SEQ ID NO: 737541 - RNA, 14 nt, Leptospira interrogans serovar lai str. 56601
uucacaucuccacu

SEQ ID NO: 737542 - RNA, 21 nt, Leptospira interrogans serovar lai str. 56601
uucaugauaguuaauuuuauc

SEQ ID NO: 737543 - RNA, 15 nt, Leptospira interrogans serovar lai str. 56601
uucaucuuuuccauu

SEQ ID NO: 737544 - RNA, 22 nt, Leptospira interrogans serovar lai str. 56601
uucaugaacgaauuuuucaaca

SEQ ID NO: 737545 - RNA, 16 nt, Leptospira interrogans serovar lai str. 56601
uucaugaauuaaagaa

SEQ ID NO: 737546 - RNA, 20 nt, Leptospira interrogans serovar lai str. 56601
uucaugaauuaaagaagagc

SEQ ID NO: 737547 - RNA, 15 nt, Leptospira interrogans serovar lai str. 56601
uucaugaaaacgaau

SEQ ID NO: 737548 - RNA, 14 nt, Leptospira interrogans serovar lai str. 56601
uucaucguuccaaa

SEQ ID NO: 737549 - RNA, 21 nt, Leptospira interrogans serovar lai str. 56601
uucaucuccuccgauucugaa

SEQ ID NO: 737550 - RNA, 20 nt, Leptospira interrogans serovar lai str. 56601
uucaucuacauaaaaaagga

SEQ ID NO: 737551 - RNA, 18 nt, Leptospira interrogans serovar lai str. 56601
uucaucuacguuucaauu

SEQ ID NO: 737552 - RNA, 16 nt, Leptospira interrogans serovar lai str. 56601
uucaucauuauuugaa

SEQ ID NO: 737553 - RNA, 20 nt, Leptospira interrogans serovar lai str. 56601
uucaucaccaaccccacaag

SEQ ID NO: 737554 - RNA, 14 nt, Leptospira interrogans serovar lai str. 56601
uucauuaaacaauu

SEQ ID NO: 737555 - RNA, 16 nt, Leptospira interrogans serovar lai str. 56601
uucauucuaaagaagg

SEQ ID NO: 737556 - RNA, 15 nt, Leptospira interrogans serovar lai str. 56601
uucauucuuuaaaau

SEQ ID NO: 737557 - RNA, 19 nt, Leptospira interrogans serovar lai str. 56601
uucauucaaaauaaauaau

SEQ ID NO: 737558 - RNA, 22 nt, Leptospira interrogans serovar lai str. 56601
uucauucaggauuacuaaugca

SEQ ID NO: 737559 - RNA, 22 nt, Leptospira interrogans serovar lai str. 56601
uucauucccuuaaucauuuuuu

SEQ ID NO: 737560 - RNA, 13 nt, Leptospira interrogans serovar lai str. 56601
uucauuuucuaua

SEQ ID NO: 737561 - RNA, 16 nt, Leptospira interrogans serovar lai str. 56601
uucauuugaauuuaua

SEQ ID NO: 737562 - RNA, 13 nt, Leptospira interrogans serovar lai str. 56601
uucauuucgaaaa

SEQ ID NO: 737563 - RNA, 16 nt, Leptospira interrogans serovar lai str. 56601
uucauuucgaaaacga

SEQ ID NO: 737564 - RNA, 13 nt, Leptospira interrogans serovar lai str. 56601
uucauuuaaaaau

SEQ ID NO: 737565 - RNA, 14 nt, Leptospira interrogans serovar lai str. 56601
uucauuuaaaaauu

SEQ ID NO: 737566 - RNA, 15 nt, Leptospira interrogans serovar lai str. 56601
uucauuuaccuaaaa

SEQ ID NO: 737567 - RNA, 20 nt, Leptospira interrogans serovar lai str. 56601
uucauuuaccuaaaauucag

SEQ ID NO: 737568 - RNA, 13 nt, Leptospira interrogans serovar lai str. 56601
uucaguucugaac

SEQ ID NO: 737569 - RNA, 14 nt, Leptospira interrogans serovar lai str. 56601
uucaguuucaaacu

SEQ ID NO: 737570 - RNA, 16 nt, Leptospira interrogans serovar lai str. 56601
uucaguuucaaacuga

SEQ ID NO: 737571 - RNA, 17 nt, Leptospira interrogans serovar lai str. 56601
uucagucucauugugaa

SEQ ID NO: 737572 - RNA, 14 nt, Leptospira interrogans serovar lai str. 56601
uucaguuuuacugu

SEQ ID NO: 737573 - RNA, 13 nt, Leptospira interrogans serovar lai str. 56601
uucaguuuccacu

SEQ ID NO: 737574 - RNA, 14 nt, Leptospira interrogans serovar lai str. 56601
uucaguuuccacuc

SEQ ID NO: 737575 - RNA, 14 nt, Leptospira interrogans serovar lai str. 56601
uucauaacuuugcu

SEQ ID NO: 737576 - RNA, 15 nt, Leptospira interrogans serovar lai str. 56601
uucauaauaaaacua

SEQ ID NO: 737577 - RNA, 21 nt, Leptospira interrogans serovar lai str. 56601
uucauagccguagggaugaac

SEQ ID NO: 737578 - RNA, 12 nt, Leptospira interrogans serovar lai str. 56601
uucauaggauga

SEQ ID NO: 737579 - RNA, 14 nt, Leptospira interrogans serovar lai str. 56601
uucauaguucaauu

SEQ ID NO: 737580 - RNA, 21 nt, Leptospira interrogans serovar lai str. 56601
uucauauauaguuuugagcau

SEQ ID NO: 737581 - RNA, 15 nt, Leptospira interrogans serovar lai str. 56601
uucauaucaaauuca

SEQ ID NO: 737582 - RNA, 15 nt, Leptospira interrogans serovar lai str. 56601
uucaguauucuagaa

SEQ ID NO: 737583 - RNA, 20 nt, Leptospira interrogans serovar lai str. 56601
uucagguuuuaaaacggaau

SEQ ID NO: 737584 - RNA, 18 nt, Leptospira interrogans serovar lai str. 56601
uucaggauagguuccaau

SEQ ID NO: 737585 - RNA, 18 nt, Leptospira interrogans serovar lai str. 56601
uucagccgcgcuuuccuu

SEQ ID NO: 737586 - RNA, 21 nt, Leptospira interrogans serovar lai str. 56601
uucagcuacaaucaauaaauu

SEQ ID NO: 737587 - RNA, 16 nt, Leptospira interrogans serovar lai str. 56601
uucagcuccaaaaaaa

SEQ ID NO: 737588 - RNA, 17 nt, Leptospira interrogans serovar lai str. 56601
uucagcuccaaaaaaau

SEQ ID NO: 737589 - RNA, 16 nt, Leptospira interrogans serovar lai str. 56601
uucagcucuagucaau

SEQ ID NO: 737590 - RNA, 19 nt, Leptospira interrogans serovar lai str. 56601
uuccaaacccugccaaaau

SEQ ID NO: 737591 - RNA, 13 nt, Leptospira interrogans serovar lai str. 56601
uuccaaaaccuca

SEQ ID NO: 737592 - RNA, 18 nt, Leptospira interrogans serovar lai str. 56601
uuccaaaaccucaaaaaa

SEQ ID NO: 737593 - RNA, 20 nt, Leptospira interrogans serovar lai str. 56601
uuccaaaaccucaaaaaauu

SEQ ID NO: 737594 - RNA, 16 nt, Leptospira interrogans serovar lai str. 56601
uuccaaagauaaaaaa

SEQ ID NO: 737595 - RNA, 14 nt, Leptospira interrogans serovar lai str. 56601
uuccaaaucugaau

SEQ ID NO: 737596 - RNA, 22 nt, Leptospira interrogans serovar lai str. 56601
uuccaaaucugaaucucuuuuu

SEQ ID NO: 737597 - RNA, 13 nt, Leptospira interrogans serovar lai str. 56601
uuccaaacucaau

SEQ ID NO: 737598 - RNA, 19 nt, Leptospira interrogans serovar lai str. 56601
uucauuuuucuaaaaaaac

SEQ ID NO: 737599 - RNA, 14 nt, Leptospira interrogans serovar lai str. 56601
uucauuuuucugaa

SEQ ID NO: 737600 - RNA, 16 nt, Leptospira interrogans serovar lai str. 56601
uucauuuugcuaaggu

SEQ ID NO: 737601 - RNA, 13 nt, Leptospira interrogans serovar lai str. 56601
uucauuuuuauuu

SEQ ID NO: 737602 - RNA, 13 nt, Leptospira interrogans serovar lai str. 56601
uucauuuuuccau

SEQ ID NO: 737603 - RNA, 19 nt, Leptospira interrogans serovar lai str. 56601
uucauuuuuccauaaaaaa

SEQ ID NO: 737604 - RNA, 20 nt, Leptospira interrogans serovar lai str. 56601
uucauuuuuccauaaaaaac

SEQ ID NO: 737605 - RNA, 23 nt, Leptospira interrogans serovar lai str. 56601
uucauuuuuugaaaaaguuggga

SEQ ID NO: 737606 - RNA, 15 nt, Leptospira interrogans serovar lai str. 56601
uuccaaaaagaaaaa

SEQ ID NO: 737607 - RNA, 16 nt, Leptospira interrogans serovar lai str. 56601
uuccaaaaagaaaaac

SEQ ID NO: 737608 - RNA, 22 nt, Leptospira interrogans serovar lai str. 56601
uuccaagggaagguuuuguaaa

SEQ ID NO: 737609 - RNA, 20 nt, Leptospira interrogans serovar lai str. 56601
uuccaaauuguaugaagaaa

SEQ ID NO: 737610 - RNA, 22 nt, Leptospira interrogans serovar lai str. 56601
uuccaaauuguaugaagaaaac

SEQ ID NO: 737611 - RNA, 18 nt, Leptospira interrogans serovar lai str. 56601
uuccaagaccucaaauaa

SEQ ID NO: 737612 - RNA, 21 nt, Leptospira interrogans serovar lai str. 56601
uuccaacguaccaaaacccau

SEQ ID NO: 737613 - RNA, 20 nt, Leptospira interrogans serovar lai str. 56601
uuccaauuuaggguauaauu

SEQ ID NO: 737614 - RNA, 12 nt, Leptospira interrogans serovar lai str. 56601
uuccaauuuccu

SEQ ID NO: 737615 - RNA, 13 nt, Leptospira interrogans serovar lai str. 56601
uuccacaucuuuu

SEQ ID NO: 737616 - RNA, 21 nt, Leptospira interrogans serovar lai str. 56601
uuccaaguuuuugugacuucc

SEQ ID NO: 737617 - RNA, 18 nt, Leptospira interrogans serovar lai str. 56601
uuccagaaaccauaaaau

SEQ ID NO: 737618 - RNA, 20 nt, Leptospira interrogans serovar lai str. 56601
uuccagaaaccauaaaauaa

SEQ ID NO: 737619 - RNA, 17 nt, Leptospira interrogans serovar lai str. 56601
uuccacuucaaaaagac

SEQ ID NO: 737620 - RNA, 19 nt, Leptospira interrogans serovar lai str. 56601
uuccagcccauucuuuccc

SEQ ID NO: 737621 - RNA, 20 nt, Leptospira interrogans serovar lai str. 56601
uuccauaaaauagaaacaga

SEQ ID NO: 737622 - RNA, 18 nt, Leptospira interrogans serovar lai str. 56601
uuccauaaagaccacagu

SEQ ID NO: 737623 - RNA, 13 nt, Leptospira interrogans serovar lai str. 56601
uuccauaaugaag

SEQ ID NO: 737624 - RNA, 19 nt, Leptospira interrogans serovar lai str. 56601
uuccauagugaagauuugu

SEQ ID NO: 737625 - RNA, 23 nt, Leptospira interrogans serovar lai str. 56601
uuccaucguuuauuuuucuaaaa

SEQ ID NO: 737626 - RNA, 16 nt, Leptospira interrogans serovar lai str. 56601
uucccuaguuccaauu

SEQ ID NO: 737627 - RNA, 22 nt, Leptospira interrogans serovar lai str. 56601
uucccuaguuccaauuaacaaa

SEQ ID NO: 737628 - RNA, 15 nt, Leptospira interrogans serovar lai str. 56601
uucccucaauaaucc

SEQ ID NO: 737629 - RNA, 22 nt, Leptospira interrogans serovar lai str. 56601
uucccuuuugaucuuuaaaaga

SEQ ID NO: 737630 - RNA, 14 nt, Leptospira interrogans serovar lai str. 56601
uucccgcuaaaagu

SEQ ID NO: 737631 - RNA, 21 nt, Leptospira interrogans serovar lai str. 56601
uuccggaauacuuuucuuccc

SEQ ID NO: 737632 - RNA, 19 nt, Leptospira interrogans serovar lai str. 56601
uuccgcgauugaaaauuau

SEQ ID NO: 737633 - RNA, 20 nt, Leptospira interrogans serovar lai str. 56601
uuccgauacgaguaaaaauu

SEQ ID NO: 737634 - RNA, 15 nt, Leptospira interrogans serovar lai str. 56601
uuccgaauuaaaaau

SEQ ID NO: 737635 - RNA, 21 nt, Leptospira interrogans serovar lai str. 56601
uuccgcauuuuuauuugcauu

SEQ ID NO: 737636 - RNA, 16 nt, Leptospira interrogans serovar lai str. 56601
uuccccaagacgucua

SEQ ID NO: 737637 - RNA, 14 nt, Leptospira interrogans serovar lai str. 56601
uucccagauucccu

SEQ ID NO: 737638 - RNA, 19 nt, Leptospira interrogans serovar lai str. 56601
uucccagacguaucaaaau

SEQ ID NO: 737639 - RNA, 13 nt, Leptospira interrogans serovar lai str. 56601
uucccauccgaaa

SEQ ID NO: 737640 - RNA, 20 nt, Leptospira interrogans serovar lai str. 56601
uucccauccgaaaucccaaa

SEQ ID NO: 737641 - RNA, 12 nt, Leptospira interrogans serovar lai str. 56601
uucccgauucuc

SEQ ID NO: 737642 - RNA, 21 nt, Leptospira interrogans serovar lai str. 56601
uucccacauuuuaaaguuuug

SEQ ID NO: 737643 - RNA, 17 nt, Leptospira interrogans serovar lai str. 56601
uucccacauuuugugaa

SEQ ID NO: 737644 - RNA, 19 nt, Leptospira interrogans serovar lai str. 56601
uucccacauuuugugaaac

SEQ ID NO: 737645 - RNA, 15 nt, Leptospira interrogans serovar lai str. 56601
uucccacauuuuuca

SEQ ID NO: 737646 - RNA, 19 nt, Leptospira interrogans serovar lai str. 56601
uucccacauuuuucaaauu

SEQ ID NO: 737647 - RNA, 12 nt, Leptospira interrogans serovar lai str. 56601
uucccacagauu

SEQ ID NO: 737648 - RNA, 20 nt, Leptospira interrogans serovar lai str. 56601
uucccacguuuuaaagguug

SEQ ID NO: 737649 - RNA, 20 nt, Leptospira interrogans serovar lai str. 56601
uucccacguuuugaagguug

SEQ ID NO: 737650 - RNA, 23 nt, Leptospira interrogans serovar lai str. 56601
uucccacguuuugaagguugagc

SEQ ID NO: 737651 - RNA, 13 nt, Leptospira interrogans serovar lai str. 56601
uucccacaucuua

SEQ ID NO: 737652 - RNA, 21 nt, Leptospira interrogans serovar lai str. 56601
uuccauuuuuuagaaucccau

SEQ ID NO: 737653 - RNA, 23 nt, Leptospira interrogans serovar lai str. 56601
uuccauuuucauaauaaauuuuu

SEQ ID NO: 737654 - RNA, 13 nt, Leptospira interrogans serovar lai str. 56601
uuccauucuucaa

SEQ ID NO: 737655 - RNA, 15 nt, Leptospira interrogans serovar lai str. 56601
uuccauugauuuuca

SEQ ID NO: 737656 - RNA, 17 nt, Leptospira interrogans serovar lai str. 56601
uuccauugccucuacaa

SEQ ID NO: 737657 - RNA, 22 nt, Leptospira interrogans serovar lai str. 56601
uuccauuggauucugcucuucu

SEQ ID NO: 737658 - RNA, 13 nt, Leptospira interrogans serovar lai str. 56601
uuccauuaauuac

SEQ ID NO: 737659 - RNA, 14 nt, Leptospira interrogans serovar lai str. 56601
uucgagauuaaaau

SEQ ID NO: 737660 - RNA, 14 nt, Leptospira interrogans serovar lai str. 56601
uucgacguaaaaau

SEQ ID NO: 737661 - RNA, 14 nt, Leptospira interrogans serovar lai str. 56601
uucgacuauuucuu

SEQ ID NO: 737662 - RNA, 16 nt, Leptospira interrogans serovar lai str. 56601
uucgaauucuuucuau

SEQ ID NO: 737663 - RNA, 16 nt, Leptospira interrogans serovar lai str. 56601
uucgaauuuuaguucu

SEQ ID NO: 737664 - RNA, 21 nt, Leptospira interrogans serovar lai str. 56601
uucgaaauuuuacaguaaaau

SEQ ID NO: 737665 - RNA, 12 nt, Leptospira interrogans serovar lai str. 56601
uucgaacuuuuu

SEQ ID NO: 737666 - RNA, 13 nt, Leptospira interrogans serovar lai str. 56601
uucgauuuuaaau

SEQ ID NO: 737667 - RNA, 16 nt, Leptospira interrogans serovar lai str. 56601
uucgauuuuaaauaaa

SEQ ID NO: 737668 - RNA, 13 nt, Leptospira interrogans serovar lai str. 56601
uucgcacauucua

SEQ ID NO: 737669 - RNA, 20 nt, Leptospira interrogans serovar lai str. 56601
uucgcacauucuauaaaguu

SEQ ID NO: 737670 - RNA, 23 nt, Leptospira interrogans serovar lai str. 56601
uucgauguauggcucauuuuucu

SEQ ID NO: 737671 - RNA, 14 nt, Leptospira interrogans serovar lai str. 56601
uucgccgaaacauu

SEQ ID NO: 737672 - RNA, 15 nt, Leptospira interrogans serovar lai str. 56601
uucgccgaacucacg

SEQ ID NO: 737673 - RNA, 18 nt, Leptospira interrogans serovar lai str. 56601
uuccuuuuuaaaaccaaa

SEQ ID NO: 737674 - RNA, 19 nt, Leptospira interrogans serovar lai str. 56601
uuccuuuccgauuucuuuc

SEQ ID NO: 737675 - RNA, 23 nt, Leptospira interrogans serovar lai str. 56601
uuccuuucaagaauuuauuuaca

SEQ ID NO: 737676 - RNA, 15 nt, Leptospira interrogans serovar lai str. 56601
uucgaaagauuuuuc

SEQ ID NO: 737677 - RNA, 17 nt, Leptospira interrogans serovar lai str. 56601
uucgaaaacgauuuuuc

SEQ ID NO: 737678 - RNA, 20 nt, Leptospira interrogans serovar lai str. 56601
uucgaaaacgauuuuucaaa

SEQ ID NO: 737679 - RNA, 16 nt, Leptospira interrogans serovar lai str. 56601
uuccuucuagauaagg

SEQ ID NO: 737680 - RNA, 15 nt, Leptospira interrogans serovar lai str. 56601
uuccuuccaaguuuu

SEQ ID NO: 737681 - RNA, 22 nt, Leptospira interrogans serovar lai str. 56601
uuccuuccaaguuuuugugacu

SEQ ID NO: 737682 - RNA, 17 nt, Leptospira interrogans serovar lai str. 56601
uuccuuccgaucccaac

SEQ ID NO: 737683 - RNA, 13 nt, Leptospira interrogans serovar lai str. 56601
uuccuucuugaaa

SEQ ID NO: 737684 - RNA, 19 nt, Leptospira interrogans serovar lai str. 56601
uuccuucuuuacaguuuuu

SEQ ID NO: 737685 - RNA, 17 nt, Leptospira interrogans serovar lai str. 56601
uuccuguaguauuucca

SEQ ID NO: 737686 - RNA, 18 nt, Leptospira interrogans serovar lai str. 56601
uuccuuaaauauaucuuc

SEQ ID NO: 737687 - RNA, 21 nt, Leptospira interrogans serovar lai str. 56601
uuccuuaaauauaucuucuuu

SEQ ID NO: 737688 - RNA, 18 nt, Leptospira interrogans serovar lai str. 56601
uuccuuaagacccuaaaa

SEQ ID NO: 737689 - RNA, 22 nt, Leptospira interrogans serovar lai str. 56601
uuccuuaagacccuaaaaaauu

SEQ ID NO: 737690 - RNA, 18 nt, Leptospira interrogans serovar lai str. 56601
uuccuuauuaaaaccauc

SEQ ID NO: 737691 - RNA, 23 nt, Leptospira interrogans serovar lai str. 56601
uuccuuauuaaaaccaucuuuga

SEQ ID NO: 737692 - RNA, 15 nt, Leptospira interrogans serovar lai str. 56601
uuccugauuuggaau

SEQ ID NO: 737693 - RNA, 21 nt, Leptospira interrogans serovar lai str. 56601
uuccugauuuggaaucugcau

SEQ ID NO: 737694 - RNA, 15 nt, Leptospira interrogans serovar lai str. 56601
uuccuauuuuugggu

SEQ ID NO: 737695 - RNA, 21 nt, Leptospira interrogans serovar lai str. 56601
uuccuauucaguuuccacucu

SEQ ID NO: 737696 - RNA, 24 nt, Leptospira interrogans serovar lai str. 56601
uuccuauucaguuuccacucuuug

SEQ ID NO: 737697 - RNA, 16 nt, Leptospira interrogans serovar lai str. 56601
uuccuauaaauaaauu

SEQ ID NO: 737698 - RNA, 23 nt, Leptospira interrogans serovar lai str. 56601
uuccuccagugcaauacauuaga

SEQ ID NO: 737699 - RNA, 18 nt, Leptospira interrogans serovar lai str. 56601
uuccuacauguucaaaau

SEQ ID NO: 737700 - RNA, 19 nt, Leptospira interrogans serovar lai str. 56601
uuccuacauuuuaaaaauu

SEQ ID NO: 737701 - RNA, 16 nt, Leptospira interrogans serovar lai str. 56601
uuccuagcaguauuuu

SEQ ID NO: 737702 - RNA, 21 nt, Leptospira interrogans serovar lai str. 56601
uuccuacuuauuucuauaaaa

SEQ ID NO: 737703 - RNA, 14 nt, Leptospira interrogans serovar lai str. 56601
uuccucuugaagau

SEQ ID NO: 737704 - RNA, 23 nt, Leptospira interrogans serovar lai str. 56601
uuccuaaaaaauaaaugugggaa

SEQ ID NO: 737705 - RNA, 12 nt, Leptospira interrogans serovar lai str. 56601
uuccuaaaaauu

SEQ ID NO: 737706 - RNA, 11 nt, Leptospira interrogans serovar lai str. 56601
uuccuaaaaug

SEQ ID NO: 737707 - RNA, 20 nt, Leptospira interrogans serovar lai str. 56601
uuccuaaugcagcuucuucc

SEQ ID NO: 737708 - RNA, 22 nt, Leptospira interrogans serovar lai str. 56601
uuccuaaugcagcuucuuccaa

SEQ ID NO: 737709 - RNA, 14 nt, Leptospira interrogans serovar lai str. 56601
uuccgucguuugca

SEQ ID NO: 737710 - RNA, 15 nt, Leptospira interrogans serovar lai str. 56601
uuccguaccccaaag

SEQ ID NO: 737711 - RNA, 17 nt, Leptospira interrogans serovar lai str. 56601
uuguuugaaaguuccca

SEQ ID NO: 737712 - RNA, 19 nt, Leptospira interrogans serovar lai str. 56601
uuuaaaaaaauuuuuauga

SEQ ID NO: 737713 - RNA, 16 nt, Leptospira interrogans serovar lai str. 56601
uuuaaaaaaaucacua

SEQ ID NO: 737714 - RNA, 18 nt, Leptospira interrogans serovar lai str. 56601
uuuaaaaaaaucacuaau

SEQ ID NO: 737715 - RNA, 23 nt, Leptospira interrogans serovar lai str. 56601
uuuaaaaaauaggaguuccuaca

SEQ ID NO: 737716 - RNA, 12 nt, Leptospira interrogans serovar lai str. 56601
uuuaaaaacuuu

SEQ ID NO: 737717 - RNA, 11 nt, Leptospira interrogans serovar lai str. 56601
uuuaaaaagua

SEQ ID NO: 737718 - RNA, 12 nt, Leptospira interrogans serovar lai str. 56601
uuuaaaaauuuu

SEQ ID NO: 737719 - RNA, 22 nt, Leptospira interrogans serovar lai str. 56601
uuuaaagaaacucauaaaauaa

SEQ ID NO: 737720 - RNA, 20 nt, Leptospira interrogans serovar lai str. 56601
uuuaaacuuucuuccaauug

SEQ ID NO: 737721 - RNA, 12 nt, Leptospira interrogans serovar lai str. 56601
uuuaaacuuuuc

SEQ ID NO: 737722 - RNA, 19 nt, Leptospira interrogans serovar lai str. 56601
uuuaaacauccaauuauaa

SEQ ID NO: 737723 - RNA, 12 nt, Leptospira interrogans serovar lai str. 56601
uuuaaacauuua

SEQ ID NO: 737724 - RNA, 23 nt, Leptospira interrogans serovar lai str. 56601
uuuaaacauuuauuuuucguaau

SEQ ID NO: 737725 - RNA, 17 nt, Leptospira interrogans serovar lai str. 56601
uuuaaaccaguuuguuu

SEQ ID NO: 737726 - RNA, 15 nt, Leptospira interrogans serovar lai str. 56601
uuuaaacguuuauuu

SEQ ID NO: 737727 - RNA, 18 nt, Leptospira interrogans serovar lai str. 56601
uuuaaaauuaaugaauaa

SEQ ID NO: 737728 - RNA, 17 nt, Leptospira interrogans serovar lai str. 56601
uuuaaaauucuaauauu

SEQ ID NO: 737729 - RNA, 13 nt, Leptospira interrogans serovar lai str. 56601
uuuaaaauuguga

SEQ ID NO: 737730 - RNA, 13 nt, Leptospira interrogans serovar lai str. 56601
uuuaaaauugugu

SEQ ID NO: 737731 - RNA, 19 nt, Leptospira interrogans serovar lai str. 56601
uuuaaaauuguguaugagu

SEQ ID NO: 737732 - RNA, 23 nt, Leptospira interrogans serovar lai str. 56601
uuuaaacaaagacaaaguauuuu

SEQ ID NO: 737733 - RNA, 20 nt, Leptospira interrogans serovar lai str. 56601
uuuaaauuaauauuuauaau

SEQ ID NO: 737734 - RNA, 13 nt, Leptospira interrogans serovar lai str. 56601
uuuaaauucccuc

SEQ ID NO: 737735 - RNA, 21 nt, Leptospira interrogans serovar lai str. 56601
uuuaaauucuuucguuuuuug

SEQ ID NO: 737736 - RNA, 16 nt, Leptospira interrogans serovar lai str. 56601
uuuaaauugaauucuu

SEQ ID NO: 737737 - RNA, 12 nt, Leptospira interrogans serovar lai str. 56601
uuuaaauuugug

SEQ ID NO: 737738 - RNA, 11 nt, Leptospira interrogans serovar lai str. 56601
uuuaaagguaa

SEQ ID NO: 737739 - RNA, 22 nt, Leptospira interrogans serovar lai str. 56601
uuuaaagacgauugauucuaag

SEQ ID NO: 737740 - RNA, 21 nt, Leptospira interrogans serovar lai str. 56601
uuuaagaacaauuuaaaauaa

SEQ ID NO: 737741 - RNA, 19 nt, Leptospira interrogans serovar lai str. 56601
uuuaagaaucucaaaauaa

SEQ ID NO: 737742 - RNA, 23 nt, Leptospira interrogans serovar lai str. 56601
uuuaagaauuuguuugucuuuuu

SEQ ID NO: 737743 - RNA, 18 nt, Leptospira interrogans serovar lai str. 56601
uuuaagaauuuuaaaaaa

SEQ ID NO: 737744 - RNA, 15 nt, Leptospira interrogans serovar lai str. 56601
uuuaagacaaacuuu

SEQ ID NO: 737745 - RNA, 20 nt, Leptospira interrogans serovar lai str. 56601
uuuaacuuuuuuuaaaaaau

SEQ ID NO: 737746 - RNA, 15 nt, Leptospira interrogans serovar lai str. 56601
uuuaagaaaauuuaa

SEQ ID NO: 737747 - RNA, 17 nt, Leptospira interrogans serovar lai str. 56601
uuuaagaaacucaguaa

SEQ ID NO: 737748 - RNA, 20 nt, Leptospira interrogans serovar lai str. 56601
uuuaacuugccguuuuucua

SEQ ID NO: 737749 - RNA, 11 nt, Leptospira interrogans serovar lai str. 56601
uuuaacuugag

SEQ ID NO: 737750 - RNA, 19 nt, Leptospira interrogans serovar lai str. 56601
uuuaacaacaucugaaguu

SEQ ID NO: 737751 - RNA, 12 nt, Leptospira interrogans serovar lai str. 56601
uuuaauauauuc

SEQ ID NO: 737752 - RNA, 18 nt, Leptospira interrogans serovar lai str. 56601
uuuaauauacaaaacauu

SEQ ID NO: 737753 - RNA, 19 nt, Leptospira interrogans serovar lai str. 56601
uuuaauauacaaaacauuc

SEQ ID NO: 737754 - RNA, 15 nt, Leptospira interrogans serovar lai str. 56601
uuuaagcgauuugag

SEQ ID NO: 737755 - RNA, 12 nt, Leptospira interrogans serovar lai str. 56601
uuuaaugaaaaa

SEQ ID NO: 737756 - RNA, 18 nt, Leptospira interrogans serovar lai str. 56601
uuuaaucaaaauuucuuu

SEQ ID NO: 737757 - RNA, 20 nt, Leptospira interrogans serovar lai str. 56601
uuuaaucaugugaauucaga

SEQ ID NO: 737758 - RNA, 13 nt, Leptospira interrogans serovar lai str. 56601
uuuaauauuucga

SEQ ID NO: 737759 - RNA, 14 nt, Leptospira interrogans serovar lai str. 56601
uuuaauauuucgau

SEQ ID NO: 737760 - RNA, 17 nt, Leptospira interrogans serovar lai str. 56601
uuuacaauaaaaauuag

SEQ ID NO: 737761 - RNA, 23 nt, Leptospira interrogans serovar lai str. 56601
uuuacaaagacucggaaauucuc

SEQ ID NO: 737762 - RNA, 20 nt, Leptospira interrogans serovar lai str. 56601
uuuacaauggaaaguguuag

SEQ ID NO: 737763 - RNA, 21 nt, Leptospira interrogans serovar lai str. 56601
uuuacaauuaaacuucaaaaa

SEQ ID NO: 737764 - RNA, 13 nt, Leptospira interrogans serovar lai str. 56601
uuuacaauuugcu

SEQ ID NO: 737765 - RNA, 20 nt, Leptospira interrogans serovar lai str. 56601
uuuacaauuugcuaaaauaa

SEQ ID NO: 737766 - RNA, 17 nt, Leptospira interrogans serovar lai str. 56601
uuuacaaacaaauucua

SEQ ID NO: 737767 - RNA, 15 nt, Leptospira interrogans serovar lai str. 56601
uuuacaaacuuacau

SEQ ID NO: 737768 - RNA, 16 nt, Leptospira interrogans serovar lai str. 56601
uuuacaaacuuacauu

SEQ ID NO: 737769 - RNA, 19 nt, Leptospira interrogans serovar lai str. 56601
uuuacaucauguaauauaa

SEQ ID NO: 737770 - RNA, 18 nt, Leptospira interrogans serovar lai str. 56601
uuuaccaaggauguggaa

SEQ ID NO: 737771 - RNA, 21 nt, Leptospira interrogans serovar lai str. 56601
uuuaccagaucaauucuuaaa

SEQ ID NO: 737772 - RNA, 15 nt, Leptospira interrogans serovar lai str. 56601
uuuacccgaucuuuu

SEQ ID NO: 737773 - RNA, 22 nt, Leptospira interrogans serovar lai str. 56601
uuuaccgaagacgcauacuuuu

SEQ ID NO: 737774 - RNA, 17 nt, Leptospira interrogans serovar lai str. 56601
uuuaccaguuaaacuuu

SEQ ID NO: 737775 - RNA, 13 nt, Leptospira interrogans serovar lai str. 56601
uugugauaaaauu

SEQ ID NO: 737776 - RNA, 22 nt, Leptospira interrogans serovar lai str. 56601
uugugacuaauuuugugaauca

SEQ ID NO: 737777 - RNA, 19 nt, Leptospira interrogans serovar lai str. 56601
uugugaucagugauucgaa

SEQ ID NO: 737778 - RNA, 16 nt, Leptospira interrogans serovar lai str. 56601
uugugagaaauacuuu

SEQ ID NO: 737779 - RNA, 22 nt, Leptospira interrogans serovar lai str. 56601
uugugagaaauacuuugauuau

SEQ ID NO: 737780 - RNA, 12 nt, Leptospira interrogans serovar lai str. 56601
uugugaaacuca

SEQ ID NO: 737781 - RNA, 22 nt, Leptospira interrogans serovar lai str. 56601
uugugaaacuuaaucucaugag

SEQ ID NO: 737782 - RNA, 16 nt, Leptospira interrogans serovar lai str. 56601
uugugaauauuucuuc

SEQ ID NO: 737783 - RNA, 23 nt, Leptospira interrogans serovar lai str. 56601
uugugaaucaaaagguauaaaau

SEQ ID NO: 737784 - RNA, 18 nt, Leptospira interrogans serovar lai str. 56601
uuguguugaguuuuuccu

SEQ ID NO: 737785 - RNA, 17 nt, Leptospira interrogans serovar lai str. 56601
uuguguuaguucccaca

SEQ ID NO: 737786 - RNA, 19 nt, Leptospira interrogans serovar lai str. 56601
uuguguucaucguuccaaa

SEQ ID NO: 737787 - RNA, 21 nt, Leptospira interrogans serovar lai str. 56601
uugugguccggaugcgaguaa

SEQ ID NO: 737788 - RNA, 14 nt, Leptospira interrogans serovar lai str. 56601
uugugucaagcccu

SEQ ID NO: 737789 - RNA, 15 nt, Leptospira interrogans serovar lai str. 56601
uugugucaagcccuc

SEQ ID NO: 737790 - RNA, 24 nt, Leptospira interrogans serovar lai str. 56601
uugugucaagcccuccuauguuuc

SEQ ID NO: 737791 - RNA, 23 nt, Leptospira interrogans serovar lai str. 56601
uuguugaaaaauuaauucucuau

SEQ ID NO: 737792 - RNA, 16 nt, Leptospira interrogans serovar lai str. 56601
uuguugaaaagugagu

SEQ ID NO: 737793 - RNA, 14 nt, Leptospira interrogans serovar lai str. 56601
uuguuauggaauuu

SEQ ID NO: 737794 - RNA, 20 nt, Leptospira interrogans serovar lai str. 56601
uuguuucuaauucauuugga

SEQ ID NO: 737795 - RNA, 16 nt, Leptospira interrogans serovar lai str. 56601
uuguuucauaaaauuc

SEQ ID NO: 737796 - RNA, 14 nt, Leptospira interrogans serovar lai str. 56601
uuguaaaauagugg

SEQ ID NO: 737797 - RNA, 14 nt, Leptospira interrogans serovar lai str. 56601
uuguaaaauugugg

SEQ ID NO: 737798 - RNA, 19 nt, Leptospira interrogans serovar lai str. 56601
uuguaaaauuuaaagauuu

SEQ ID NO: 737799 - RNA, 13 nt, Leptospira interrogans serovar lai str. 56601
uuguaaacuucug

SEQ ID NO: 737800 - RNA, 15 nt, Leptospira interrogans serovar lai str. 56601
uuguaacucaaaauu

SEQ ID NO: 737801 - RNA, 17 nt, Leptospira interrogans serovar lai str. 56601
uuguaacucaaaauuuc

SEQ ID NO: 737802 - RNA, 19 nt, Leptospira interrogans serovar lai str. 56601
uuguaaaucuauucuuaaa

SEQ ID NO: 737803 - RNA, 18 nt, Leptospira interrogans serovar lai str. 56601
uugucuuugagaaaauuc

SEQ ID NO: 737804 - RNA, 21 nt, Leptospira interrogans serovar lai str. 56601
uuguauuugcaccagaugucu

SEQ ID NO: 737805 - RNA, 14 nt, Leptospira interrogans serovar lai str. 56601
uuggguuucuuaaa

SEQ ID NO: 737806 - RNA, 20 nt, Leptospira interrogans serovar lai str. 56601
uugguuuguaauaguuccca

SEQ ID NO: 737807 - RNA, 21 nt, Leptospira interrogans serovar lai str. 56601
uuguaaaaggagaauucaauu

SEQ ID NO: 737808 - RNA, 15 nt, Leptospira interrogans serovar lai str. 56601
uuguaaaaaaacaug

SEQ ID NO: 737809 - RNA, 14 nt, Leptospira interrogans serovar lai str. 56601
uuguaaaaaaauag

SEQ ID NO: 737810 - RNA, 12 nt, Leptospira interrogans serovar lai str. 56601
uuguaaaaaacc

SEQ ID NO: 737811 - RNA, 14 nt, Leptospira interrogans serovar lai str. 56601
uuguaaaaauucuc

SEQ ID NO: 737812 - RNA, 22 nt, Leptospira interrogans serovar lai str. 56601
uuguaaaacccuaguuuaugug

SEQ ID NO: 737813 - RNA, 18 nt, Leptospira interrogans serovar lai str. 56601
uugguuuucauaaauaca

SEQ ID NO: 737814 - RNA, 13 nt, Leptospira interrogans serovar lai str. 56601
uuggugauuuaaa

SEQ ID NO: 737815 - RNA, 18 nt, Leptospira interrogans serovar lai str. 56601
uuggugauuuaaaaauag

SEQ ID NO: 737816 - RNA, 23 nt, Leptospira interrogans serovar lai str. 56601
uuggggcuuacggggaauuuuua

SEQ ID NO: 737817 - RNA, 23 nt, Leptospira interrogans serovar lai str. 56601
uugggaacaauccgcggauguuu

SEQ ID NO: 737818 - RNA, 13 nt, Leptospira interrogans serovar lai str. 56601
uuggaaauuuuua

SEQ ID NO: 737819 - RNA, 18 nt, Leptospira interrogans serovar lai str. 56601
uuggaaauuuuuaauaaa

SEQ ID NO: 737820 - RNA, 19 nt, Leptospira interrogans serovar lai str. 56601
uuggaacaagcucaaaauu

SEQ ID NO: 737821 - RNA, 21 nt, Leptospira interrogans serovar lai str. 56601
uuggaucuacuaagauuucuu

SEQ ID NO: 737822 - RNA, 14 nt, Leptospira interrogans serovar lai str. 56601
uuggaaucugaauu

SEQ ID NO: 737823 - RNA, 20 nt, Leptospira interrogans serovar lai str. 56601
uuggaaucugcaucuuuucu

SEQ ID NO: 737824 - RNA, 16 nt, Leptospira interrogans serovar lai str. 56601
uuggaaucuuaaaaag

SEQ ID NO: 737825 - RNA, 22 nt, Leptospira interrogans serovar lai str. 56601
uuggauuuauguucguucccac

SEQ ID NO: 737826 - RNA, 21 nt, Leptospira interrogans serovar lai str. 56601
uuggauucugcucuucuaauu

SEQ ID NO: 737827 - RNA, 15 nt, Leptospira interrogans serovar lai str. 56601
uugcucuaaaauaau

SEQ ID NO: 737828 - RNA, 19 nt, Leptospira interrogans serovar lai str. 56601
uugcucuaaaauaauuuuu

SEQ ID NO: 737829 - RNA, 21 nt, Leptospira interrogans serovar lai str. 56601
uugcucucgcaaugaaaauuc

SEQ ID NO: 737830 - RNA, 14 nt, Leptospira interrogans serovar lai str. 56601
uugcuaagaaaaaa

SEQ ID NO: 737831 - RNA, 18 nt, Leptospira interrogans serovar lai str. 56601
uugcuauggaauuuuuca

SEQ ID NO: 737832 - RNA, 21 nt, Leptospira interrogans serovar lai str. 56601
uugcuauggaauuuuuucaaa

SEQ ID NO: 737833 - RNA, 21 nt, Leptospira interrogans serovar lai str. 56601
uugcggauuccauucuucaaa

SEQ ID NO: 737834 - RNA, 17 nt, Leptospira interrogans serovar lai str. 56601
uugccauggaaauuuuu

SEQ ID NO: 737835 - RNA, 12 nt, Leptospira interrogans serovar lai str. 56601
uugcauaaaauc

SEQ ID NO: 737836 - RNA, 20 nt, Leptospira interrogans serovar lai str. 56601
uugcauaaaaucguaguuuu

SEQ ID NO: 737837 - RNA, 18 nt, Leptospira interrogans serovar lai str. 56601
uugauuucagaucauaaa

SEQ ID NO: 737838 - RNA, 16 nt, Leptospira interrogans serovar lai str. 56601
uugauuuuggaaagaa

SEQ ID NO: 737839 - RNA, 17 nt, Leptospira interrogans serovar lai str. 56601
uugcaaguaaaaagacu

SEQ ID NO: 737840 - RNA, 14 nt, Leptospira interrogans serovar lai str. 56601
uugcaaaaauagaa

SEQ ID NO: 737841 - RNA, 14 nt, Leptospira interrogans serovar lai str. 56601
uugcaaaaaaauaa

SEQ ID NO: 737842 - RNA, 14 nt, Leptospira interrogans serovar lai str. 56601
uugcaaaaaagaaa

SEQ ID NO: 737843 - RNA, 13 nt, Leptospira interrogans serovar lai str. 56601
uugauuuuucgaa

SEQ ID NO: 737844 - RNA, 15 nt, Leptospira interrogans serovar lai str. 56601
uugauuuuugaagua

SEQ ID NO: 737845 - RNA, 22 nt, Leptospira interrogans serovar lai str. 56601
uugauuuuugaaguaguuccua

SEQ ID NO: 737846 - RNA, 14 nt, Leptospira interrogans serovar lai str. 56601
uugcaauuuuacuu

SEQ ID NO: 737847 - RNA, 20 nt, Leptospira interrogans serovar lai str. 56601
uugcaauacauucuuauaaa

SEQ ID NO: 737848 - RNA, 13 nt, Leptospira interrogans serovar lai str. 56601
uugauuccaaaga

SEQ ID NO: 737849 - RNA, 23 nt, Leptospira interrogans serovar lai str. 56601
uugauuccaaagauaaaaaagaa

SEQ ID NO: 737850 - RNA, 19 nt, Leptospira interrogans serovar lai str. 56601
uugauuccaagauuuuuua

SEQ ID NO: 737851 - RNA, 16 nt, Leptospira interrogans serovar lai str. 56601
uugauucuaagguuuu

SEQ ID NO: 737852 - RNA, 12 nt, Leptospira interrogans serovar lai str. 56601
uugauucugcuc

SEQ ID NO: 737853 - RNA, 20 nt, Leptospira interrogans serovar lai str. 56601
uugauuguggcaagaggaac

SEQ ID NO: 737854 - RNA, 13 nt, Leptospira interrogans serovar lai str. 56601
uugauuuaaaaac

SEQ ID NO: 737855 - RNA, 20 nt, Leptospira interrogans serovar lai str. 56601
uugagaauucuacauucuga

SEQ ID NO: 737856 - RNA, 17 nt, Leptospira interrogans serovar lai str. 56601
uugagaagggugaauuu

SEQ ID NO: 737857 - RNA, 14 nt, Leptospira interrogans serovar lai str. 56601
uugagacaagaaga

SEQ ID NO: 737858 - RNA, 15 nt, Leptospira interrogans serovar lai str. 56601
uugagacaagaagaa

SEQ ID NO: 737859 - RNA, 19 nt, Leptospira interrogans serovar lai str. 56601
uugaguuuaagaaacucag

SEQ ID NO: 737860 - RNA, 11 nt, Leptospira interrogans serovar lai str. 56601
uugaguuucaa

SEQ ID NO: 737861 - RNA, 14 nt, Leptospira interrogans serovar lai str. 56601
uugaguuucacaaa

SEQ ID NO: 737862 - RNA, 20 nt, Leptospira interrogans serovar lai str. 56601
uugaguuucacaaaaauaug

SEQ ID NO: 737863 - RNA, 16 nt, Leptospira interrogans serovar lai str. 56601
uugaguucuucugcaa

SEQ ID NO: 737864 - RNA, 14 nt, Leptospira interrogans serovar lai str. 56601
uugaguaauuccac

SEQ ID NO: 737865 - RNA, 22 nt, Leptospira interrogans serovar lai str. 56601
uugauauuucuguaaaaaauaa

SEQ ID NO: 737866 - RNA, 15 nt, Leptospira interrogans serovar lai str. 56601
uugauauuacuacuc

SEQ ID NO: 737867 - RNA, 23 nt, Leptospira interrogans serovar lai str. 56601
uugaucuacaaugucuaucaaag

SEQ ID NO: 737868 - RNA, 21 nt, Leptospira interrogans serovar lai str. 56601
uugauaaauagggaauauucc

SEQ ID NO: 737869 - RNA, 22 nt, Leptospira interrogans serovar lai str. 56601
uugauaaaauauaguuaaauuu

SEQ ID NO: 737870 - RNA, 19 nt, Leptospira interrogans serovar lai str. 56601
uugaguuucuuuuugauua

SEQ ID NO: 737871 - RNA, 14 nt, Leptospira interrogans serovar lai str. 56601
uugaguuuuuccua

SEQ ID NO: 737872 - RNA, 17 nt, Leptospira interrogans serovar lai str. 56601
uugaaacuuuuaauaaa

SEQ ID NO: 737873 - RNA, 18 nt, Leptospira interrogans serovar lai str. 56601
uugaaacuuuuaauaaaa

SEQ ID NO: 737874 - RNA, 12 nt, Leptospira interrogans serovar lai str. 56601
uugaaacucagu

SEQ ID NO: 737875 - RNA, 16 nt, Leptospira interrogans serovar lai str. 56601
uugaaaguaucagaau

SEQ ID NO: 737876 - RNA, 21 nt, Leptospira interrogans serovar lai str. 56601
uugaaaguaucagaaucaaag

SEQ ID NO: 737877 - RNA, 20 nt, Leptospira interrogans serovar lai str. 56601
uugaaagaaucuaauuucag

SEQ ID NO: 737878 - RNA, 15 nt, Leptospira interrogans serovar lai str. 56601
uugaaaguuuuuuua

SEQ ID NO: 737879 - RNA, 16 nt, Leptospira interrogans serovar lai str. 56601
uucuuuuuuccuucuu

SEQ ID NO: 737880 - RNA, 12 nt, Leptospira interrogans serovar lai str. 56601
uucuuuuuucuc

SEQ ID NO: 737881 - RNA, 14 nt, Leptospira interrogans serovar lai str. 56601
uugaaaaaaaacag

SEQ ID NO: 737882 - RNA, 23 nt, Leptospira interrogans serovar lai str. 56601
uugaaaaaaaacaggucccaaac

SEQ ID NO: 737883 - RNA, 18 nt, Leptospira interrogans serovar lai str. 56601
uucuuuuuccagacucuu

SEQ ID NO: 737884 - RNA, 23 nt, Leptospira interrogans serovar lai str. 56601
uugaaaaaguugggaucuaaacu

SEQ ID NO: 737885 - RNA, 23 nt, Leptospira interrogans serovar lai str. 56601
uugaaaaaauccauaucuacaaa

SEQ ID NO: 737886 - RNA, 23 nt, Leptospira interrogans serovar lai str. 56601
uugaaacaucacuuccauuuuuu

SEQ ID NO: 737887 - RNA, 16 nt, Leptospira interrogans serovar lai str. 56601
uugaaaauuauagaua

SEQ ID NO: 737888 - RNA, 12 nt, Leptospira interrogans serovar lai str. 56601
uugaaaauugug

SEQ ID NO: 737889 - RNA, 17 nt, Leptospira interrogans serovar lai str. 56601
uucuuuuaaacaauuga

SEQ ID NO: 737890 - RNA, 18 nt, Leptospira interrogans serovar lai str. 56601
uucuuuguaaccuuuguu

SEQ ID NO: 737891 - RNA, 22 nt, Leptospira interrogans serovar lai str. 56601
uucuuuguaaccuuuguuuccu

SEQ ID NO: 737892 - RNA, 18 nt, Leptospira interrogans serovar lai str. 56601
uucuuugcgauugagaau

SEQ ID NO: 737893 - RNA, 13 nt, Leptospira interrogans serovar lai str. 56601
uucuuucucguuu

SEQ ID NO: 737894 - RNA, 16 nt, Leptospira interrogans serovar lai str. 56601
uucuuugaacuuuuuc

SEQ ID NO: 737895 - RNA, 20 nt, Leptospira interrogans serovar lai str. 56601
uucuuugaacuuuuucaagu

SEQ ID NO: 737896 - RNA, 15 nt, Leptospira interrogans serovar lai str. 56601
uucuuguaaguugug

SEQ ID NO: 737897 - RNA, 15 nt, Leptospira interrogans serovar lai str. 56601
uucuugcaaaaauag

SEQ ID NO: 737898 - RNA, 18 nt, Leptospira interrogans serovar lai str. 56601
uucuugcaaaaauagaau

SEQ ID NO: 737899 - RNA, 18 nt, Leptospira interrogans serovar lai str. 56601
uugaauuuaggaaauuuu

SEQ ID NO: 737900 - RNA, 14 nt, Leptospira interrogans serovar lai str. 56601
uugaauuuuaguua

SEQ ID NO: 737901 - RNA, 13 nt, Leptospira interrogans serovar lai str. 56601
uugaauuuaaaac

SEQ ID NO: 737902 - RNA, 18 nt, Leptospira interrogans serovar lai str. 56601
uugaauuuaaaaguuucc

SEQ ID NO: 737903 - RNA, 17 nt, Leptospira interrogans serovar lai str. 56601
uugaccucauaucaaaa

SEQ ID NO: 737904 - RNA, 18 nt, Leptospira interrogans serovar lai str. 56601
uugaccucauaucaaaaa

SEQ ID NO: 737905 - RNA, 15 nt, Leptospira interrogans serovar lai str. 56601
uugaauuuuuaagaa

SEQ ID NO: 737906 - RNA, 12 nt, Leptospira interrogans serovar lai str. 56601
uugaauuuuuua

SEQ ID NO: 737907 - RNA, 15 nt, Leptospira interrogans serovar lai str. 56601
uugaauuuuuuaaau

SEQ ID NO: 737908 - RNA, 17 nt, Leptospira interrogans serovar lai str. 56601
uugacuuucccacuuau

SEQ ID NO: 737909 - RNA, 17 nt, Leptospira interrogans serovar lai str. 56601
uugagaaaauaaaaaau

SEQ ID NO: 737910 - RNA, 23 nt, Leptospira interrogans serovar lai str. 56601
uugagaaaccuuuucuagacuuu

SEQ ID NO: 737911 - RNA, 15 nt, Leptospira interrogans serovar lai str. 56601
uugaagacuauaaaa

SEQ ID NO: 737912 - RNA, 15 nt, Leptospira interrogans serovar lai str. 56601
uugaauguuuacaaa

SEQ ID NO: 737913 - RNA, 20 nt, Leptospira interrogans serovar lai str. 56601
uugaauguuuacaaagucuu

SEQ ID NO: 737914 - RNA, 21 nt, Leptospira interrogans serovar lai str. 56601
uugaauuacucccaaaccgau

SEQ ID NO: 737915 - RNA, 13 nt, Leptospira interrogans serovar lai str. 56601
uugaauucuuccu

SEQ ID NO: 737916 - RNA, 16 nt, Leptospira interrogans serovar lai str. 56601
uugaauucuuccuucu

SEQ ID NO: 737917 - RNA, 14 nt, Leptospira interrogans serovar lai str. 56601
uugaagaaaaaaag

SEQ ID NO: 737918 - RNA, 16 nt, Leptospira interrogans serovar lai str. 56601
uugaagaaaaaaagau

SEQ ID NO: 737919 - RNA, 19 nt, Leptospira interrogans serovar lai str. 56601
uugaacguaaguuaaauau

SEQ ID NO: 737920 - RNA, 21 nt, Leptospira interrogans serovar lai str. 56601
uugaacucggcucauaaaaaa

SEQ ID NO: 737921 - RNA, 17 nt, Leptospira interrogans serovar lai str. 56601
uucuuacuuuuugagua

SEQ ID NO: 737922 - RNA, 20 nt, Leptospira interrogans serovar lai str. 56601
uucuuacaauaaaaacuuau

SEQ ID NO: 737923 - RNA, 14 nt, Leptospira interrogans serovar lai str. 56601
uucuuaauuucucu

SEQ ID NO: 737924 - RNA, 16 nt, Leptospira interrogans serovar lai str. 56601
uucuuaauuuuacuau

SEQ ID NO: 737925 - RNA, 19 nt, Leptospira interrogans serovar lai str. 56601
uucugguuccauaaagacc

SEQ ID NO: 737926 - RNA, 18 nt, Leptospira interrogans serovar lai str. 56601
uucuucaauaucuuuauu

SEQ ID NO: 737927 - RNA, 14 nt, Leptospira interrogans serovar lai str. 56601
uucuucauaaaauc

SEQ ID NO: 737928 - RNA, 21 nt, Leptospira interrogans serovar lai str. 56601
uucuuccacaucuuuuuucgu

SEQ ID NO: 737929 - RNA, 15 nt, Leptospira interrogans serovar lai str. 56601
uucuucaugauuuuu

SEQ ID NO: 737930 - RNA, 12 nt, Leptospira interrogans serovar lai str. 56601
uucuuccuuuuu

SEQ ID NO: 737931 - RNA, 12 nt, Leptospira interrogans serovar lai str. 56601
uucuuccuucuu

SEQ ID NO: 737932 - RNA, 18 nt, Leptospira interrogans serovar lai str. 56601
uucuucccagauucccuu

SEQ ID NO: 737933 - RNA, 22 nt, Leptospira interrogans serovar lai str. 56601
uucuucccagauucccuuuuga

SEQ ID NO: 737934 - RNA, 22 nt, Leptospira interrogans serovar lai str. 56601
uucuuccccacacccuugaccu

SEQ ID NO: 737935 - RNA, 19 nt, Leptospira interrogans serovar lai str. 56601
uucuuccggauuaaaaagg

SEQ ID NO: 737936 - RNA, 16 nt, Leptospira interrogans serovar lai str. 56601
uucuggguaaaaaaaa

SEQ ID NO: 737937 - RNA, 19 nt, Leptospira interrogans serovar lai str. 56601
uucuggaaauucuguuuua

SEQ ID NO: 737938 - RNA, 16 nt, Leptospira interrogans serovar lai str. 56601
uucuggaaaaguuuuu

SEQ ID NO: 737939 - RNA, 22 nt, Leptospira interrogans serovar lai str. 56601
uucugcuuaagagaaccucuau

SEQ ID NO: 737940 - RNA, 14 nt, Leptospira interrogans serovar lai str. 56601
uucugauaaagaaa

SEQ ID NO: 737941 - RNA, 19 nt, Leptospira interrogans serovar lai str. 56601
uucugauaaagaaaaccuu

SEQ ID NO: 737942 - RNA, 14 nt, Leptospira interrogans serovar lai str. 56601
uucucguucaacuu

SEQ ID NO: 737943 - RNA, 15 nt, Leptospira interrogans serovar lai str. 56601
uucucgcauuuuccu

SEQ ID NO: 737944 - RNA, 16 nt, Leptospira interrogans serovar lai str. 56601
uucugaaauaaaaaag

SEQ ID NO: 737945 - RNA, 18 nt, Leptospira interrogans serovar lai str. 56601
uucugaacaagaauuuau

SEQ ID NO: 737946 - RNA, 20 nt, Leptospira interrogans serovar lai str. 56601
uucugacauucuaaacauuu

SEQ ID NO: 737947 - RNA, 17 nt, Leptospira interrogans serovar lai str. 56601
uucggagucauacauuu

SEQ ID NO: 737948 - RNA, 23 nt, Leptospira interrogans serovar lai str. 56601
uucggauggaaucgaauccuuuu

SEQ ID NO: 737949 - RNA, 18 nt, Leptospira interrogans serovar lai str. 56601
uucggauuucugaaaaaa

SEQ ID NO: 737950 - RNA, 15 nt, Leptospira interrogans serovar lai str. 56601
uucguaagaaaaaau

SEQ ID NO: 737951 - RNA, 16 nt, Leptospira interrogans serovar lai str. 56601
uucgguggaaacucag

SEQ ID NO: 737952 - RNA, 16 nt, Leptospira interrogans serovar lai str. 56601
uucgugauaacaaacu

SEQ ID NO: 737953 - RNA, 12 nt, Leptospira interrogans serovar lai str. 56601
uucgugaagaaa

SEQ ID NO: 737954 - RNA, 16 nt, Leptospira interrogans serovar lai str. 56601
uucguggagaaauucg

SEQ ID NO: 737955 - RNA, 15 nt, Leptospira interrogans serovar lai str. 56601
uucuaaauugaaacu

SEQ ID NO: 737956 - RNA, 18 nt, Leptospira interrogans serovar lai str. 56601
uucuaaauuuuauaaaau

SEQ ID NO: 737957 - RNA, 16 nt, Leptospira interrogans serovar lai str. 56601
uucuaaaucugaauuu

SEQ ID NO: 737958 - RNA, 23 nt, Leptospira interrogans serovar lai str. 56601
uucuaaaugaguuuuagaauauu

SEQ ID NO: 737959 - RNA, 15 nt, Leptospira interrogans serovar lai str. 56601
uucuaaccggaauuu

SEQ ID NO: 737960 - RNA, 17 nt, Leptospira interrogans serovar lai str. 56601
uucguuccuuugaauaa

SEQ ID NO: 737961 - RNA, 21 nt, Leptospira interrogans serovar lai str. 56601
uucguuccaaauacaauuuga

SEQ ID NO: 737962 - RNA, 18 nt, Leptospira interrogans serovar lai str. 56601
uucuaaguaauuuaaaaa

SEQ ID NO: 737963 - RNA, 19 nt, Leptospira interrogans serovar lai str. 56601
uucuaaguaauuuaaaaaa

SEQ ID NO: 737964 - RNA, 12 nt, Leptospira interrogans serovar lai str. 56601
uucuaacuuuug

SEQ ID NO: 737965 - RNA, 12 nt, Leptospira interrogans serovar lai str. 56601
uucuaacugguu

SEQ ID NO: 737966 - RNA, 21 nt, Leptospira interrogans serovar lai str. 56601
uucuaaucacgaaaaaugaau

SEQ ID NO: 737967 - RNA, 18 nt, Leptospira interrogans serovar lai str. 56601
uucuaaucccgccaaaaa

SEQ ID NO: 737968 - RNA, 11 nt, Leptospira interrogans serovar lai str. 56601
uucuaauauaa

SEQ ID NO: 737969 - RNA, 15 nt, Leptospira interrogans serovar lai str. 56601
uucuaauauuaaaaa

SEQ ID NO: 737970 - RNA, 23 nt, Leptospira interrogans serovar lai str. 56601
uucuaauguuguuaaauuuuucu

SEQ ID NO: 737971 - RNA, 18 nt, Leptospira interrogans serovar lai str. 56601
uucuagacuuucuuugaa

SEQ ID NO: 737972 - RNA, 17 nt, Leptospira interrogans serovar lai str. 56601
uucuagauagguucuua

SEQ ID NO: 737973 - RNA, 16 nt, Leptospira interrogans serovar lai str. 56601
uucuagcaccuaaaac

SEQ ID NO: 737974 - RNA, 18 nt, Leptospira interrogans serovar lai str. 56601
uucuagcgucuaaaaaau

SEQ ID NO: 737975 - RNA, 17 nt, Leptospira interrogans serovar lai str. 56601
uucuaguaguucccaca

SEQ ID NO: 737976 - RNA, 12 nt, Leptospira interrogans serovar lai str. 56601
uucuaguauuau

SEQ ID NO: 737977 - RNA, 14 nt, Leptospira interrogans serovar lai str. 56601
uucuaguauuauuu

SEQ ID NO: 737978 - RNA, 22 nt, Leptospira interrogans serovar lai str. 56601
uucuagugucuaaacuaaaaaa

SEQ ID NO: 737979 - RNA, 19 nt, Leptospira interrogans serovar lai str. 56601
uucuaguuugaauuuagga

SEQ ID NO: 737980 - RNA, 11 nt, Leptospira interrogans serovar lai str. 56601
uucuauaaaau

SEQ ID NO: 737981 - RNA, 14 nt, Leptospira interrogans serovar lai str. 56601
uucuauaaacucaa

SEQ ID NO: 737982 - RNA, 22 nt, Leptospira interrogans serovar lai str. 56601
uucuccuccugaaaauuuuccu

SEQ ID NO: 737983 - RNA, 18 nt, Leptospira interrogans serovar lai str. 56601
uucuccuucccucgaaau

SEQ ID NO: 737984 - RNA, 13 nt, Leptospira interrogans serovar lai str. 56601
gcacucaauuuua

SEQ ID NO: 737985 - RNA, 11 nt, Leptospira interrogans serovar lai str. 56601
gcaccugguuu

SEQ ID NO: 737986 - RNA, 16 nt, Leptospira interrogans serovar lai str. 56601
gcaaguaaaaagacuc

SEQ ID NO: 737987 - RNA, 18 nt, Leptospira interrogans serovar lai str. 56601
gcaaguaaaaagacucau

SEQ ID NO: 737988 - RNA, 22 nt, Leptospira interrogans serovar lai str. 56601
gcaaguaaaaagacucauucuu

SEQ ID NO: 737989 - RNA, 13 nt, Leptospira interrogans serovar lai str. 56601
gcaauaguuccug

SEQ ID NO: 737990 - RNA, 17 nt, Leptospira interrogans serovar lai str. 56601
gcaagcacauccgcauu

SEQ ID NO: 737991 - RNA, 19 nt, Leptospira interrogans serovar lai str. 56601
gcaaauuuacuucaauuau

SEQ ID NO: 737992 - RNA, 20 nt, Leptospira interrogans serovar lai str. 56601
gcaaauucuacuauuaauag

SEQ ID NO: 737993 - RNA, 20 nt, Leptospira interrogans serovar lai str. 56601
gcaaauucugauuuuacaga

SEQ ID NO: 737994 - RNA, 15 nt, Leptospira interrogans serovar lai str. 56601
gcaaauuuuacauug

SEQ ID NO: 737995 - RNA, 20 nt, Leptospira interrogans serovar lai str. 56601
gcacauaaaagaccuucgga

SEQ ID NO: 737996 - RNA, 17 nt, Leptospira interrogans serovar lai str. 56601
gcaaugugcaaaggagu

SEQ ID NO: 737997 - RNA, 20 nt, Leptospira interrogans serovar lai str. 56601
gcaauucgcauuaaaauuuu

SEQ ID NO: 737998 - RNA, 13 nt, Leptospira interrogans serovar lai str. 56601
gcacaaguuuuuu

SEQ ID NO: 737999 - RNA, 11 nt, Leptospira interrogans serovar lai str. 56601
gcauaaaacuc

SEQ ID NO: 738000 - RNA, 13 nt, Leptospira interrogans serovar lai str. 56601
gcauaaaaaaaua

SEQ ID NO: 738001 - RNA, 14 nt, Leptospira interrogans serovar lai str. 56601
gcauaaaaaaauau

SEQ ID NO: 738002 - RNA, 11 nt, Leptospira interrogans serovar lai str. 56601
gcauacuuuuc

SEQ ID NO: 738003 - RNA, 15 nt, Leptospira interrogans serovar lai str. 56601
gcauauaauuaaaaa

SEQ ID NO: 738004 - RNA, 12 nt, Leptospira interrogans serovar lai str. 56601
gcagauuaaaaa

SEQ ID NO: 738005 - RNA, 19 nt, Leptospira interrogans serovar lai str. 56601
gcagauuugauguaaagaa

SEQ ID NO: 738006 - RNA, 20 nt, Leptospira interrogans serovar lai str. 56601
gcagauuuucucaaaaaaag

SEQ ID NO: 738007 - RNA, 22 nt, Leptospira interrogans serovar lai str. 56601
gcagauuuucucaaaaaaagua

SEQ ID NO: 738008 - RNA, 21 nt, Leptospira interrogans serovar lai str. 56601
gcagcuucuuccaaagucaaa

SEQ ID NO: 738009 - RNA, 15 nt, Leptospira interrogans serovar lai str. 56601
gcaaaguuucuuaua

SEQ ID NO: 738010 - RNA, 18 nt, Leptospira interrogans serovar lai str. 56601
gcaaaguuucuuauauaa

SEQ ID NO: 738011 - RNA, 18 nt, Leptospira interrogans serovar lai str. 56601
gcaaacaucuagauuuua

SEQ ID NO: 738012 - RNA, 13 nt, Leptospira interrogans serovar lai str. 56601
gcaaaauuuaaaa

SEQ ID NO: 738013 - RNA, 22 nt, Leptospira interrogans serovar lai str. 56601
gcaaaaguuuucaaaaauguau

SEQ ID NO: 738014 - RNA, 16 nt, Leptospira interrogans serovar lai str. 56601
gcaaacuuuuuauaaa

SEQ ID NO: 738015 - RNA, 23 nt, Leptospira interrogans serovar lai str. 56601
gcaaacuuuuuauaaaaagcugu

SEQ ID NO: 738016 - RNA, 23 nt, Leptospira interrogans serovar lai str. 56601
gauuugauguaaagaaaaccaga

SEQ ID NO: 738017 - RNA, 11 nt, Leptospira interrogans serovar lai str. 56601
gauuuuagaau

SEQ ID NO: 738018 - RNA, 13 nt, Leptospira interrogans serovar lai str. 56601
gauuuuacaaaca

SEQ ID NO: 738019 - RNA, 17 nt, Leptospira interrogans serovar lai str. 56601
gauuuuacgaacaaauu

SEQ ID NO: 738020 - RNA, 22 nt, Leptospira interrogans serovar lai str. 56601
gauuuuacgaacaaauucuaaa

SEQ ID NO: 738021 - RNA, 21 nt, Leptospira interrogans serovar lai str. 56601
gauuuuacgaacacauucuaa

SEQ ID NO: 738022 - RNA, 22 nt, Leptospira interrogans serovar lai str. 56601
gauuuuacgaacgaauucuaaa

SEQ ID NO: 738023 - RNA, 21 nt, Leptospira interrogans serovar lai str. 56601
gauuuuaacuuuuuuuaaaaa

SEQ ID NO: 738024 - RNA, 15 nt, Leptospira interrogans serovar lai str. 56601
gauuuauuuuagaau

SEQ ID NO: 738025 - RNA, 14 nt, Leptospira interrogans serovar lai str. 56601
gauuuauugaaaaa

SEQ ID NO: 738026 - RNA, 20 nt, Leptospira interrogans serovar lai str. 56601
gauuuauugaaaaauagaau

SEQ ID NO: 738027 - RNA, 14 nt, Leptospira interrogans serovar lai str. 56601
gauuucaaaaauaa

SEQ ID NO: 738028 - RNA, 24 nt, Leptospira interrogans serovar lai str. 56601
gauuucacgacgucuaugacgaau

SEQ ID NO: 738029 - RNA, 12 nt, Leptospira interrogans serovar lai str. 56601
gauuucagauuc

SEQ ID NO: 738030 - RNA, 22 nt, Leptospira interrogans serovar lai str. 56601
gauuucagcuccaaaaaaauaa

SEQ ID NO: 738031 - RNA, 15 nt, Leptospira interrogans serovar lai str. 56601
gauuuuuauguaaua

SEQ ID NO: 738032 - RNA, 22 nt, Leptospira interrogans serovar lai str. 56601
gauuuuauguaagaaaaacuag

SEQ ID NO: 738033 - RNA, 12 nt, Leptospira interrogans serovar lai str. 56601
gauuuuauagag

SEQ ID NO: 738034 - RNA, 19 nt, Leptospira interrogans serovar lai str. 56601
gauuuucagggaaaaauaa

SEQ ID NO: 738035 - RNA, 10 nt, Leptospira interrogans serovar lai str. 56601
gcaaaaagua

SEQ ID NO: 738036 - RNA, 13 nt, Leptospira interrogans serovar lai str. 56601
gcaaaaauaaagu

SEQ ID NO: 738037 - RNA, 23 nt, Leptospira interrogans serovar lai str. 56601
gcaaaaaagaaagcagcaaagaa

SEQ ID NO: 738038 - RNA, 13 nt, Leptospira interrogans serovar lai str. 56601
gauuuuucuucuu

SEQ ID NO: 738039 - RNA, 19 nt, Leptospira interrogans serovar lai str. 56601
gauuuuucuguaaaaauaa

SEQ ID NO: 738040 - RNA, 23 nt, Leptospira interrogans serovar lai str. 56601
gauuuuucuguaaaaauaaaaug

SEQ ID NO: 738041 - RNA, 16 nt, Leptospira interrogans serovar lai str. 56601
gauuauucauaacuau

SEQ ID NO: 738042 - RNA, 16 nt, Leptospira interrogans serovar lai str. 56601
gauuauugaucucuau

SEQ ID NO: 738043 - RNA, 23 nt, Leptospira interrogans serovar lai str. 56601
gauuauuauuuugauuuguuucu

SEQ ID NO: 738044 - RNA, 15 nt, Leptospira interrogans serovar lai str. 56601
gauuauuuacauaua

SEQ ID NO: 738045 - RNA, 19 nt, Leptospira interrogans serovar lai str. 56601
gauuauuuacauauauaau

SEQ ID NO: 738046 - RNA, 15 nt, Leptospira interrogans serovar lai str. 56601
gauucucccacacau

SEQ ID NO: 738047 - RNA, 21 nt, Leptospira interrogans serovar lai str. 56601
gauucugaaaaaaguuagaau

SEQ ID NO: 738048 - RNA, 20 nt, Leptospira interrogans serovar lai str. 56601
gauucugauaacuauauaac

SEQ ID NO: 738049 - RNA, 23 nt, Leptospira interrogans serovar lai str. 56601
gauucuuuucccgcuaaaaguac

SEQ ID NO: 738050 - RNA, 17 nt, Leptospira interrogans serovar lai str. 56601
gauugaaaauuauagau

SEQ ID NO: 738051 - RNA, 20 nt, Leptospira interrogans serovar lai str. 56601
gauugaaacguuuucaaaaa

SEQ ID NO: 738052 - RNA, 22 nt, Leptospira interrogans serovar lai str. 56601
gauugaaacguuuucaaaaaau

SEQ ID NO: 738053 - RNA, 13 nt, Leptospira interrogans serovar lai str. 56601
gauugaauuaaaa

SEQ ID NO: 738054 - RNA, 19 nt, Leptospira interrogans serovar lai str. 56601
gauugauauuucuuaaauu

SEQ ID NO: 738055 - RNA, 16 nt, Leptospira interrogans serovar lai str. 56601
gauuggacuaaaccac

SEQ ID NO: 738056 - RNA, 14 nt, Leptospira interrogans serovar lai str. 56601
gauuggaagaauau

SEQ ID NO: 738057 - RNA, 13 nt, Leptospira interrogans serovar lai str. 56601
gauuuaaauuuug

SEQ ID NO: 738058 - RNA, 22 nt, Leptospira interrogans serovar lai str. 56601
gauuguuuucuaguuuuccuuc

SEQ ID NO: 738059 - RNA, 18 nt, Leptospira interrogans serovar lai str. 56601
gauguuugaauacauaca

SEQ ID NO: 738060 - RNA, 21 nt, Leptospira interrogans serovar lai str. 56601
gauuaaaaucggaaaauugaa

SEQ ID NO: 738061 - RNA, 16 nt, Leptospira interrogans serovar lai str. 56601
gauuaaauuuugaaaa

SEQ ID NO: 738062 - RNA, 18 nt, Leptospira interrogans serovar lai str. 56601
gauuaaauuuuuauaaaa

SEQ ID NO: 738063 - RNA, 20 nt, Leptospira interrogans serovar lai str. 56601
gauuaaauuuuuauaaaaua

SEQ ID NO: 738064 - RNA, 15 nt, Leptospira interrogans serovar lai str. 56601
gauuaaacaggacaa

SEQ ID NO: 738065 - RNA, 17 nt, Leptospira interrogans serovar lai str. 56601
gauuaaaccgguaaaaa

SEQ ID NO: 738066 - RNA, 13 nt, Leptospira interrogans serovar lai str. 56601
gauuaaaauaaac

SEQ ID NO: 738067 - RNA, 16 nt, Leptospira interrogans serovar lai str. 56601
gauuaaagauuuuucu

SEQ ID NO: 738068 - RNA, 13 nt, Leptospira interrogans serovar lai str. 56601
gauuaaaaauuuc

SEQ ID NO: 738069 - RNA, 23 nt, Leptospira interrogans serovar lai str. 56601
gauuaugaagaaugauaaaucuu

SEQ ID NO: 738070 - RNA, 14 nt, Leptospira interrogans serovar lai str. 56601
gauuaucuucuaau

SEQ ID NO: 738071 - RNA, 15 nt, Leptospira interrogans serovar lai str. 56601
gauuauguaauauac

SEQ ID NO: 738072 - RNA, 20 nt, Leptospira interrogans serovar lai str. 56601
gauuaaguauuguuaagaua

SEQ ID NO: 738073 - RNA, 19 nt, Leptospira interrogans serovar lai str. 56601
gauuacuaaugcaauccuc

SEQ ID NO: 738074 - RNA, 22 nt, Leptospira interrogans serovar lai str. 56601
gauuacucaacagugauuucau

SEQ ID NO: 738075 - RNA, 23 nt, Leptospira interrogans serovar lai str. 56601
gauguagaguaaauuuugaaaau

SEQ ID NO: 738076 - RNA, 21 nt, Leptospira interrogans serovar lai str. 56601
gauguauugaguuuaaggaag

SEQ ID NO: 738077 - RNA, 17 nt, Leptospira interrogans serovar lai str. 56601
gauguaagaaaauauug

SEQ ID NO: 738078 - RNA, 12 nt, Leptospira interrogans serovar lai str. 56601
gauguaaggagc

SEQ ID NO: 738079 - RNA, 15 nt, Leptospira interrogans serovar lai str. 56601
gauguaaggagccau

SEQ ID NO: 738080 - RNA, 14 nt, Leptospira interrogans serovar lai str. 56601
gaugguuucaauuu

SEQ ID NO: 738081 - RNA, 19 nt, Leptospira interrogans serovar lai str. 56601
gaugcgaguaauauuuuuu

SEQ ID NO: 738082 - RNA, 13 nt, Leptospira interrogans serovar lai str. 56601
gaugaauugaauu

SEQ ID NO: 738083 - RNA, 22 nt, Leptospira interrogans serovar lai str. 56601
gaucguaacuuucuuuuagaaa

SEQ ID NO: 738084 - RNA, 16 nt, Leptospira interrogans serovar lai str. 56601
gaucgguuuuagaauu

SEQ ID NO: 738085 - RNA, 20 nt, Leptospira interrogans serovar lai str. 56601
gaugcauugaguuacgcuga

SEQ ID NO: 738086 - RNA, 16 nt, Leptospira interrogans serovar lai str. 56601
gaucgcguuuuauaau

SEQ ID NO: 738087 - RNA, 19 nt, Leptospira interrogans serovar lai str. 56601
gaucgcagcauaauaaucg

SEQ ID NO: 738088 - RNA, 14 nt, Leptospira interrogans serovar lai str. 56601
gaucgccguucugg

SEQ ID NO: 738089 - RNA, 22 nt, Leptospira interrogans serovar lai str. 56601
gauccuuauacuuuccgucuuu

SEQ ID NO: 738090 - RNA, 13 nt, Leptospira interrogans serovar lai str. 56601
gauccaaauuuuu

SEQ ID NO: 738091 - RNA, 21 nt, Leptospira interrogans serovar lai str. 56601
gauccgaauuuuuacacacuc

SEQ ID NO: 738092 - RNA, 17 nt, Leptospira interrogans serovar lai str. 56601
gauccaaacccaaugau

SEQ ID NO: 738093 - RNA, 16 nt, Leptospira interrogans serovar lai str. 56601
gaucaaaucugaaauu

SEQ ID NO: 738094 - RNA, 16 nt, Leptospira interrogans serovar lai str. 56601
gaucaacaaaauuacu

SEQ ID NO: 738095 - RNA, 22 nt, Leptospira interrogans serovar lai str. 56601
gaucaacacaaauauuaagaau

SEQ ID NO: 738096 - RNA, 18 nt, Leptospira interrogans serovar lai str. 56601
gauaucacaaauuuuaaa

SEQ ID NO: 738097 - RNA, 12 nt, Leptospira interrogans serovar lai str. 56601
gauauuaaaaug

SEQ ID NO: 738098 - RNA, 13 nt, Leptospira interrogans serovar lai str. 56601
gauauuaacaaau

SEQ ID NO: 738099 - RNA, 21 nt, Leptospira interrogans serovar lai str. 56601
gauauuaacaaauuuaaaaua

SEQ ID NO: 738100 - RNA, 12 nt, Leptospira interrogans serovar lai str. 56601
gauauggaauuc

SEQ ID NO: 738101 - RNA, 18 nt, Leptospira interrogans serovar lai str. 56601
gauaauuguagaagcaac

SEQ ID NO: 738102 - RNA, 22 nt, Leptospira interrogans serovar lai str. 56601
gauaauuauccuuaaaaugaaa

SEQ ID NO: 738103 - RNA, 23 nt, Leptospira interrogans serovar lai str. 56601
gauaauuauccuuaaaaugaaaa

SEQ ID NO: 738104 - RNA, 19 nt, Leptospira interrogans serovar lai str. 56601
gauaauuuuuguuuguaaa

SEQ ID NO: 738105 - RNA, 20 nt, Leptospira interrogans serovar lai str. 56601
gauaauuuuuguuuguaaaa

SEQ ID NO: 738106 - RNA, 22 nt, Leptospira interrogans serovar lai str. 56601
gauaauuuuuuaaaaaaauuac

SEQ ID NO: 738107 - RNA, 13 nt, Leptospira interrogans serovar lai str. 56601
gauaauuugugaa

SEQ ID NO: 738108 - RNA, 15 nt, Leptospira interrogans serovar lai str. 56601
gauaaucuaccccau

SEQ ID NO: 738109 - RNA, 13 nt, Leptospira interrogans serovar lai str. 56601
gauaaugagccag

SEQ ID NO: 738110 - RNA, 19 nt, Leptospira interrogans serovar lai str. 56601
gauaaucaucaaaaucagu

SEQ ID NO: 738111 - RNA, 19 nt, Leptospira interrogans serovar lai str. 56601
gauaacggucuccuuagaa

SEQ ID NO: 738112 - RNA, 23 nt, Leptospira interrogans serovar lai str. 56601
gauaacggucuccuuagaaagcg

SEQ ID NO: 738113 - RNA, 13 nt, Leptospira interrogans serovar lai str. 56601
gauaacggcuaaa

SEQ ID NO: 738114 - RNA, 17 nt, Leptospira interrogans serovar lai str. 56601
gauaacgcguccucaaa

SEQ ID NO: 738115 - RNA, 14 nt, Leptospira interrogans serovar lai str. 56601
gauaaccuaaaauu

SEQ ID NO: 738116 - RNA, 23 nt, Leptospira interrogans serovar lai str. 56601
gauacauaaacugucaugaugau

SEQ ID NO: 738117 - RNA, 22 nt, Leptospira interrogans serovar lai str. 56601
gauacauuaugcgcaaucucaa

SEQ ID NO: 738118 - RNA, 14 nt, Leptospira interrogans serovar lai str. 56601
gauagcaaaaaaau

SEQ ID NO: 738119 - RNA, 20 nt, Leptospira interrogans serovar lai str. 56601
gauagauucaauuauuauaa

SEQ ID NO: 738120 - RNA, 15 nt, Leptospira interrogans serovar lai str. 56601
gauaaagucuauuuc

SEQ ID NO: 738121 - RNA, 11 nt, Leptospira interrogans serovar lai str. 56601
gauaaaguaaa

SEQ ID NO: 738122 - RNA, 14 nt, Leptospira interrogans serovar lai str. 56601
gauaaaaucacguu

SEQ ID NO: 738123 - RNA, 12 nt, Leptospira interrogans serovar lai str. 56601
gauaaaauauag

SEQ ID NO: 738124 - RNA, 21 nt, Leptospira interrogans serovar lai str. 56601
gauaaaaccguuuuauaaaua

SEQ ID NO: 738125 - RNA, 22 nt, Leptospira interrogans serovar lai str. 56601
gauaaaaccguuuuauaaauau

SEQ ID NO: 738126 - RNA, 19 nt, Leptospira interrogans serovar lai str. 56601
gauaaaacucaaaggaaaa

SEQ ID NO: 738127 - RNA, 17 nt, Leptospira interrogans serovar lai str. 56601
gaguucauucugauucu

SEQ ID NO: 738128 - RNA, 12 nt, Leptospira interrogans serovar lai str. 56601
gaguuccaaaac

SEQ ID NO: 738129 - RNA, 13 nt, Leptospira interrogans serovar lai str. 56601
gaguucccacaaa

SEQ ID NO: 738130 - RNA, 17 nt, Leptospira interrogans serovar lai str. 56601
gaguucccacauuuuua

SEQ ID NO: 738131 - RNA, 19 nt, Leptospira interrogans serovar lai str. 56601
gaguucgacauaagaaaga

SEQ ID NO: 738132 - RNA, 22 nt, Leptospira interrogans serovar lai str. 56601
gaguucgacguaagaauauuug

SEQ ID NO: 738133 - RNA, 21 nt, Leptospira interrogans serovar lai str. 56601
gaguucgauguaagaaaauau

SEQ ID NO: 738134 - RNA, 20 nt, Leptospira interrogans serovar lai str. 56601
gaguuccuaacuuugaaaau

SEQ ID NO: 738135 - RNA, 17 nt, Leptospira interrogans serovar lai str. 56601
gaguuauaguaaaagaa

SEQ ID NO: 738136 - RNA, 19 nt, Leptospira interrogans serovar lai str. 56601
gaguuauaguaaaagaaaa

SEQ ID NO: 738137 - RNA, 20 nt, Leptospira interrogans serovar lai str. 56601
gaguucguuaagaauaaaua

SEQ ID NO: 738138 - RNA, 21 nt, Leptospira interrogans serovar lai str. 56601
gauaaaaaaauguuuagacuu

SEQ ID NO: 738139 - RNA, 19 nt, Leptospira interrogans serovar lai str. 56601
gagucguugaaaaauuaau

SEQ ID NO: 738140 - RNA, 14 nt, Leptospira interrogans serovar lai str. 56601
gagucguugaaaau

SEQ ID NO: 738141 - RNA, 16 nt, Leptospira interrogans serovar lai str. 56601
gagugccuaaauuuuu

SEQ ID NO: 738142 - RNA, 19 nt, Leptospira interrogans serovar lai str. 56601
gaguauuuuuuccugauuu

SEQ ID NO: 738143 - RNA, 15 nt, Leptospira interrogans serovar lai str. 56601
gaguaucaauagaaa

SEQ ID NO: 738144 - RNA, 17 nt, Leptospira interrogans serovar lai str. 56601
gaguaucaauagaaaua

SEQ ID NO: 738145 - RNA, 17 nt, Leptospira interrogans serovar lai str. 56601
gaguauuaucuuuauau

SEQ ID NO: 738146 - RNA, 15 nt, Leptospira interrogans serovar lai str. 56601
gaauuugaggagaau

SEQ ID NO: 738147 - RNA, 15 nt, Leptospira interrogans serovar lai str. 56601
gaauuugcgaaaaaa

SEQ ID NO: 738148 - RNA, 13 nt, Leptospira interrogans serovar lai str. 56601
gaauuucuuucuc

SEQ ID NO: 738149 - RNA, 15 nt, Leptospira interrogans serovar lai str. 56601
gaauuuauagauaua

SEQ ID NO: 738150 - RNA, 11 nt, Leptospira interrogans serovar lai str. 56601
gaauuuccuuu

SEQ ID NO: 738151 - RNA, 17 nt, Leptospira interrogans serovar lai str. 56601
gaauuucuaaaauucuu

SEQ ID NO: 738152 - RNA, 19 nt, Leptospira interrogans serovar lai str. 56601
gaauuucuaaaauucuucc

SEQ ID NO: 738153 - RNA, 20 nt, Leptospira interrogans serovar lai str. 56601
gaauuucuaaaauucuuccg

SEQ ID NO: 738154 - RNA, 21 nt, Leptospira interrogans serovar lai str. 56601
gaauuucuaauagauuuauga

SEQ ID NO: 738155 - RNA, 20 nt, Leptospira interrogans serovar lai str. 56601
gccgcuauggaauuuuucaa

SEQ ID NO: 738156 - RNA, 13 nt, Leptospira interrogans serovar lai str. 56601
gccggagaaaauu

SEQ ID NO: 738157 - RNA, 13 nt, Leptospira interrogans serovar lai str. 56601
gccguaaauauuu

SEQ ID NO: 738158 - RNA, 20 nt, Leptospira interrogans serovar lai str. 56601
gcccugcuuucagccccagu

SEQ ID NO: 738159 - RNA, 18 nt, Leptospira interrogans serovar lai str. 56601
gccauggaaauuuuuccg

SEQ ID NO: 738160 - RNA, 11 nt, Leptospira interrogans serovar lai str. 56601
gccaucuuuuu

SEQ ID NO: 738161 - RNA, 12 nt, Leptospira interrogans serovar lai str. 56601
gcccaaauuguu

SEQ ID NO: 738162 - RNA, 14 nt, Leptospira interrogans serovar lai str. 56601
gccauuuuuuucuc

SEQ ID NO: 738163 - RNA, 22 nt, Leptospira interrogans serovar lai str. 56601
gccauuuagguuguaacucaaa

SEQ ID NO: 738164 - RNA, 20 nt, Leptospira interrogans serovar lai str. 56601
gccauuuccaauuuugcuuc

SEQ ID NO: 738165 - RNA, 18 nt, Leptospira interrogans serovar lai str. 56601
gccaaaaucccagaaagg

SEQ ID NO: 738166 - RNA, 17 nt, Leptospira interrogans serovar lai str. 56601
gccaaaaacgcaaaaag

SEQ ID NO: 738167 - RNA, 21 nt, Leptospira interrogans serovar lai str. 56601
gcauuuguuguaucgaacuca

SEQ ID NO: 738168 - RNA, 18 nt, Leptospira interrogans serovar lai str. 56601
gcauuuuauuaaaaauau

SEQ ID NO: 738169 - RNA, 20 nt, Leptospira interrogans serovar lai str. 56601
gcauuuuauuaaaaauuuuu

SEQ ID NO: 738170 - RNA, 17 nt, Leptospira interrogans serovar lai str. 56601
gcauuuuauuaaagaau

SEQ ID NO: 738171 - RNA, 11 nt, Leptospira interrogans serovar lai str. 56601
gcauuucauuu

SEQ ID NO: 738172 - RNA, 18 nt, Leptospira interrogans serovar lai str. 56601
gccaaaucugaaaaagag

SEQ ID NO: 738173 - RNA, 15 nt, Leptospira interrogans serovar lai str. 56601
gcauucccauaaaag

SEQ ID NO: 738174 - RNA, 18 nt, Leptospira interrogans serovar lai str. 56601
gcauucaaggaagugaaa

SEQ ID NO: 738175 - RNA, 16 nt, Leptospira interrogans serovar lai str. 56601
gcauucaaaaaguuuu

SEQ ID NO: 738176 - RNA, 15 nt, Leptospira interrogans serovar lai str. 56601
gcauuauaaguuuuu

SEQ ID NO: 738177 - RNA, 13 nt, Leptospira interrogans serovar lai str. 56601
gcauucucacaaa

SEQ ID NO: 738178 - RNA, 22 nt, Leptospira interrogans serovar lai str. 56601
gcauugaaaucagagucuauuu

SEQ ID NO: 738179 - RNA, 21 nt, Leptospira interrogans serovar lai str. 56601
gcauugaguuuaagaaacuca

SEQ ID NO: 738180 - RNA, 22 nt, Leptospira interrogans serovar lai str. 56601
gcaugaaauuuucuuagaaaac

SEQ ID NO: 738181 - RNA, 22 nt, Leptospira interrogans serovar lai str. 56601
gcaugaauggauuuuuugucuu

SEQ ID NO: 738182 - RNA, 18 nt, Leptospira interrogans serovar lai str. 56601
gcaugaauuuguuuuucu

SEQ ID NO: 738183 - RNA, 13 nt, Leptospira interrogans serovar lai str. 56601
gcaucuuuucuaa

SEQ ID NO: 738184 - RNA, 22 nt, Leptospira interrogans serovar lai str. 56601
gcucuaauauuuuaaagaaacu

SEQ ID NO: 738185 - RNA, 17 nt, Leptospira interrogans serovar lai str. 56601
gcucucagcucugguua

SEQ ID NO: 738186 - RNA, 14 nt, Leptospira interrogans serovar lai str. 56601
gcucucuccuaugu

SEQ ID NO: 738187 - RNA, 20 nt, Leptospira interrogans serovar lai str. 56601
gcucucuccuauguuucuug

SEQ ID NO: 738188 - RNA, 21 nt, Leptospira interrogans serovar lai str. 56601
gcucucguuuuuaggauuaau

SEQ ID NO: 738189 - RNA, 21 nt, Leptospira interrogans serovar lai str. 56601
gcucuccaucuuuuuuuucua

SEQ ID NO: 738190 - RNA, 19 nt, Leptospira interrogans serovar lai str. 56601
gcucugaaguaucucuucu

SEQ ID NO: 738191 - RNA, 15 nt, Leptospira interrogans serovar lai str. 56601
gcucugguuaauaaa

SEQ ID NO: 738192 - RNA, 19 nt, Leptospira interrogans serovar lai str. 56601
gcucuggucaauaaauugu

SEQ ID NO: 738193 - RNA, 14 nt, Leptospira interrogans serovar lai str. 56601
gcucugugaaacuc

SEQ ID NO: 738194 - RNA, 13 nt, Leptospira interrogans serovar lai str. 56601
gcugaaaauuuuc

SEQ ID NO: 738195 - RNA, 15 nt, Leptospira interrogans serovar lai str. 56601
gcugaaaauuuuccc

SEQ ID NO: 738196 - RNA, 14 nt, Leptospira interrogans serovar lai str. 56601
gcugaaaaaaaaau

SEQ ID NO: 738197 - RNA, 23 nt, Leptospira interrogans serovar lai str. 56601
gcucuuuaugaaucgcguugugg

SEQ ID NO: 738198 - RNA, 15 nt, Leptospira interrogans serovar lai str. 56601
gcucuugcuaaaauu

SEQ ID NO: 738199 - RNA, 20 nt, Leptospira interrogans serovar lai str. 56601
gcugaguuugaaagagcguu

SEQ ID NO: 738200 - RNA, 17 nt, Leptospira interrogans serovar lai str. 56601
gcucacuaccuuauaaa

SEQ ID NO: 738201 - RNA, 21 nt, Leptospira interrogans serovar lai str. 56601
gcuccuugcugucgcaacaua

SEQ ID NO: 738202 - RNA, 23 nt, Leptospira interrogans serovar lai str. 56601
gcuccuugcugucgcaacauaau

SEQ ID NO: 738203 - RNA, 21 nt, Leptospira interrogans serovar lai str. 56601
gcucaaaauucuuaaaaaaua

SEQ ID NO: 738204 - RNA, 12 nt, Leptospira interrogans serovar lai str. 56601
gcucaaagaagu

SEQ ID NO: 738205 - RNA, 24 nt, Leptospira interrogans serovar lai str. 56601
gcuauuuucagaaaaaugaauucc

SEQ ID NO: 738206 - RNA, 19 nt, Leptospira interrogans serovar lai str. 56601
gcgaauuucauagucaagg

SEQ ID NO: 738207 - RNA, 13 nt, Leptospira interrogans serovar lai str. 56601
gcgaccgcgcuug

SEQ ID NO: 738208 - RNA, 14 nt, Leptospira interrogans serovar lai str. 56601
gcgcuuuccuuauu

SEQ ID NO: 738209 - RNA, 15 nt, Leptospira interrogans serovar lai str. 56601
gcgccuucuuuucaa

SEQ ID NO: 738210 - RNA, 17 nt, Leptospira interrogans serovar lai str. 56601
ggcagccaauuccaaac

SEQ ID NO: 738211 - RNA, 23 nt, Leptospira interrogans serovar lai str. 56601
ggcauaggaaauaauuccuccau

SEQ ID NO: 738212 - RNA, 15 nt, Leptospira interrogans serovar lai str. 56601
ggcauaugaaaauaa

SEQ ID NO: 738213 - RNA, 13 nt, Leptospira interrogans serovar lai str. 56601
ggcauuaauauaa

SEQ ID NO: 738214 - RNA, 17 nt, Leptospira interrogans serovar lai str. 56601
ggauucugcucuucuaa

SEQ ID NO: 738215 - RNA, 18 nt, Leptospira interrogans serovar lai str. 56601
ggaucuaaacuuugcaaa

SEQ ID NO: 738216 - RNA, 23 nt, Leptospira interrogans serovar lai str. 56601
ggauccuuacgaucuaaaaggac

SEQ ID NO: 738217 - RNA, 20 nt, Leptospira interrogans serovar lai str. 56601
ggaucgaucuguaaaaugua

SEQ ID NO: 738218 - RNA, 20 nt, Leptospira interrogans serovar lai str. 56601
ggaguuuuuacuaugaagac

SEQ ID NO: 738219 - RNA, 17 nt, Leptospira interrogans serovar lai str. 56601
ggauaaccuaaaauuuc

SEQ ID NO: 738220 - RNA, 15 nt, Leptospira interrogans serovar lai str. 56601
ggagaacucucucaa

SEQ ID NO: 738221 - RNA, 15 nt, Leptospira interrogans serovar lai str. 56601
ggagaauaaggcaaa

SEQ ID NO: 738222 - RNA, 21 nt, Leptospira interrogans serovar lai str. 56601
ggagacuugauuugagaaucu

SEQ ID NO: 738223 - RNA, 20 nt, Leptospira interrogans serovar lai str. 56601
ggacaaugcuuuccaaaagg

SEQ ID NO: 738224 - RNA, 19 nt, Leptospira interrogans serovar lai str. 56601
ggaauuuuuaaaaagaauu

SEQ ID NO: 738225 - RNA, 21 nt, Leptospira interrogans serovar lai str. 56601
ggaauuuuuguaaaauccaga

SEQ ID NO: 738226 - RNA, 15 nt, Leptospira interrogans serovar lai str. 56601
ggaauuuaaguuauu

SEQ ID NO: 738227 - RNA, 20 nt, Leptospira interrogans serovar lai str. 56601
ggaauuacuacauuugauua

SEQ ID NO: 738228 - RNA, 21 nt, Leptospira interrogans serovar lai str. 56601
ggaauuccgacccagaaaaaa

SEQ ID NO: 738229 - RNA, 14 nt, Leptospira interrogans serovar lai str. 56601
ggaauauuccauuu

SEQ ID NO: 738230 - RNA, 15 nt, Leptospira interrogans serovar lai str. 56601
ggaaucccaaauucu

SEQ ID NO: 738231 - RNA, 23 nt, Leptospira interrogans serovar lai str. 56601
ggaacucuuacuuugagaaaauu

SEQ ID NO: 738232 - RNA, 15 nt, Leptospira interrogans serovar lai str. 56601
ggaacucuauauaaa

SEQ ID NO: 738233 - RNA, 22 nt, Leptospira interrogans serovar lai str. 56601
ggaacucuauauaaagaaaaac

SEQ ID NO: 738234 - RNA, 23 nt, Leptospira interrogans serovar lai str. 56601
ggaacucccacuuuuaaagaaag

SEQ ID NO: 738235 - RNA, 23 nt, Leptospira interrogans serovar lai str. 56601
ggaacuacuacuuuuagaaaaaa

SEQ ID NO: 738236 - RNA, 20 nt, Leptospira interrogans serovar lai str. 56601
ggaacuacugcauuuuauua

SEQ ID NO: 738237 - RNA, 14 nt, Leptospira interrogans serovar lai str. 56601
ggaacuauuacaaa

SEQ ID NO: 738238 - RNA, 13 nt, Leptospira interrogans serovar lai str. 56601
ggaagauucuucu

SEQ ID NO: 738239 - RNA, 15 nt, Leptospira interrogans serovar lai str. 56601
ggaagauaaaacgua

SEQ ID NO: 738240 - RNA, 23 nt, Leptospira interrogans serovar lai str. 56601
ggaagauaaaacguacuuacuga

SEQ ID NO: 738241 - RNA, 19 nt, Leptospira interrogans serovar lai str. 56601
ggaacaaguugaaagggga

SEQ ID NO: 738242 - RNA, 20 nt, Leptospira interrogans serovar lai str. 56601
ggaaauugugagaacuacuu

SEQ ID NO: 738243 - RNA, 18 nt, Leptospira interrogans serovar lai str. 56601
ggaaauuuauuuuaaaga

SEQ ID NO: 738244 - RNA, 22 nt, Leptospira interrogans serovar lai str. 56601
ggaaauucauuuuucugaaaaa

SEQ ID NO: 738245 - RNA, 13 nt, Leptospira interrogans serovar lai str. 56601
ggaaaucuuuuaa

SEQ ID NO: 738246 - RNA, 13 nt, Leptospira interrogans serovar lai str. 56601
ggaaauagaaaga

SEQ ID NO: 738247 - RNA, 24 nt, Leptospira interrogans serovar lai str. 56601
ggaacauaaguuacucauuuccau

SEQ ID NO: 738248 - RNA, 21 nt, Leptospira interrogans serovar lai str. 56601
ggaaccaucaccaaccccaca

SEQ ID NO: 738249 - RNA, 21 nt, Leptospira interrogans serovar lai str. 56601
ggaacccauacaaaauuuaaa

SEQ ID NO: 738250 - RNA, 22 nt, Leptospira interrogans serovar lai str. 56601
ggaacccauggcuuugaaaaag

SEQ ID NO: 738251 - RNA, 12 nt, Leptospira interrogans serovar lai str. 56601
ggaaaaaugaaa

SEQ ID NO: 738252 - RNA, 23 nt, Leptospira interrogans serovar lai str. 56601
ggaaaagucagguuuuaucaaau

SEQ ID NO: 738253 - RNA, 24 nt, Leptospira interrogans serovar lai str. 56601
ggaaaagucagguuuuaucaaaua

SEQ ID NO: 738254 - RNA, 23 nt, Leptospira interrogans serovar lai str. 56601
ggaaaaauaagguuuuauaaaau

SEQ ID NO: 738255 - RNA, 21 nt, Leptospira interrogans serovar lai str. 56601
gcuuuuuuaaaccuuccuuug

SEQ ID NO: 738256 - RNA, 15 nt, Leptospira interrogans serovar lai str. 56601
gcuuuuuuaaauuuu

SEQ ID NO: 738257 - RNA, 21 nt, Leptospira interrogans serovar lai str. 56601
ggaaacgucauaguucccaca

SEQ ID NO: 738258 - RNA, 19 nt, Leptospira interrogans serovar lai str. 56601
ggaaacgcaaugucuccaa

SEQ ID NO: 738259 - RNA, 11 nt, Leptospira interrogans serovar lai str. 56601
ggaaaaucaga

SEQ ID NO: 738260 - RNA, 12 nt, Leptospira interrogans serovar lai str. 56601
ggaaaauuuaaa

SEQ ID NO: 738261 - RNA, 12 nt, Leptospira interrogans serovar lai str. 56601
gcuuuauuaaau

SEQ ID NO: 738262 - RNA, 21 nt, Leptospira interrogans serovar lai str. 56601
gcuuuauagagauuuccuaaa

SEQ ID NO: 738263 - RNA, 13 nt, Leptospira interrogans serovar lai str. 56601
gcuuucucuuuuu

SEQ ID NO: 738264 - RNA, 15 nt, Leptospira interrogans serovar lai str. 56601
gcuuucucuuuuuag

SEQ ID NO: 738265 - RNA, 12 nt, Leptospira interrogans serovar lai str. 56601
gcuuuuguaaau

SEQ ID NO: 738266 - RNA, 20 nt, Leptospira interrogans serovar lai str. 56601
gcuuuuaauaauucaaaauu

SEQ ID NO: 738267 - RNA, 18 nt, Leptospira interrogans serovar lai str. 56601
gcuuuuagcucuagucaa

SEQ ID NO: 738268 - RNA, 19 nt, Leptospira interrogans serovar lai str. 56601
gcuugcuacgggcuuucag

SEQ ID NO: 738269 - RNA, 13 nt, Leptospira interrogans serovar lai str. 56601
gcuuggaaauauc

SEQ ID NO: 738270 - RNA, 17 nt, Leptospira interrogans serovar lai str. 56601
gcuuguuugaauuuuuc

SEQ ID NO: 738271 - RNA, 20 nt, Leptospira interrogans serovar lai str. 56601
gcuuuaagugaaccagagau

SEQ ID NO: 738272 - RNA, 14 nt, Leptospira interrogans serovar lai str. 56601
gcuuguuuuuaaau

SEQ ID NO: 738273 - RNA, 18 nt, Leptospira interrogans serovar lai str. 56601
gcuuguuuuuaaauuaau

SEQ ID NO: 738274 - RNA, 22 nt, Leptospira interrogans serovar lai str. 56601
gcuuuaaucuuuuuaacgcaga

SEQ ID NO: 738275 - RNA, 21 nt, Leptospira interrogans serovar lai str. 56601
gcuuuacaauaaaaauuagag

SEQ ID NO: 738276 - RNA, 12 nt, Leptospira interrogans serovar lai str. 56601
gcuuuagaaaau

SEQ ID NO: 738277 - RNA, 14 nt, Leptospira interrogans serovar lai str. 56601
gcuuuagaaaauaa

SEQ ID NO: 738278 - RNA, 14 nt, Leptospira interrogans serovar lai str. 56601
gcuuuauaaaauga

SEQ ID NO: 738279 - RNA, 22 nt, Leptospira interrogans serovar lai str. 56601
gcuuuauaaaaugaaucucuua

SEQ ID NO: 738280 - RNA, 21 nt, Leptospira interrogans serovar lai str. 56601
gcuucugaacaagaauuuauu

SEQ ID NO: 738281 - RNA, 13 nt, Leptospira interrogans serovar lai str. 56601
gcuucuuuaaaaa

SEQ ID NO: 738282 - RNA, 14 nt, Leptospira interrogans serovar lai str. 56601
gcuucaaaaagaga

SEQ ID NO: 738283 - RNA, 23 nt, Leptospira interrogans serovar lai str. 56601
gcuucaauuguccguuucaauac

SEQ ID NO: 738284 - RNA, 16 nt, Leptospira interrogans serovar lai str. 56601
gcuucauauaauaaaa

SEQ ID NO: 738285 - RNA, 20 nt, Leptospira interrogans serovar lai str. 56601
gcuucaucgaagcaaucugu

SEQ ID NO: 738286 - RNA, 17 nt, Leptospira interrogans serovar lai str. 56601
gcuucagucaaguuauu

SEQ ID NO: 738287 - RNA, 13 nt, Leptospira interrogans serovar lai str. 56601
gcuuccaauccuu

SEQ ID NO: 738288 - RNA, 18 nt, Leptospira interrogans serovar lai str. 56601
gcuuaaagcauuaaaaaa

SEQ ID NO: 738289 - RNA, 23 nt, Leptospira interrogans serovar lai str. 56601
gcuuaaagcauuaaaaaagauaa

SEQ ID NO: 738290 - RNA, 21 nt, Leptospira interrogans serovar lai str. 56601
gcuuaggcccgaauuuuaaau

SEQ ID NO: 738291 - RNA, 22 nt, Leptospira interrogans serovar lai str. 56601
gcuuauacuuuaagaaaauuua

SEQ ID NO: 738292 - RNA, 18 nt, Leptospira interrogans serovar lai str. 56601
gcuguaguuuauuuuucu

SEQ ID NO: 738293 - RNA, 24 nt, Leptospira interrogans serovar lai str. 56601
gcugucgcaacauaaugcugcaau

SEQ ID NO: 738294 - RNA, 21 nt, Leptospira interrogans serovar lai str. 56601
gcugucgcaacauaauguuuc

SEQ ID NO: 738295 - RNA, 15 nt, Leptospira interrogans serovar lai str. 56601
gcuggauaggauucc

SEQ ID NO: 738296 - RNA, 17 nt, Leptospira interrogans serovar lai str. 56601
gcugauucccaguaaau

SEQ ID NO: 738297 - RNA, 13 nt, Leptospira interrogans serovar lai str. 56601
gcugauuuuucuu

SEQ ID NO: 738298 - RNA, 19 nt, Leptospira interrogans serovar lai str. 56601
gcugauuuuucuuuagaca

SEQ ID NO: 738299 - RNA, 19 nt, Leptospira interrogans serovar lai str. 56601
uacaguuaaacuuugaaaa

SEQ ID NO: 738300 - RNA, 19 nt, Leptospira interrogans serovar lai str. 56601
uacaguaaaaccacacuac

SEQ ID NO: 738301 - RNA, 18 nt, Leptospira interrogans serovar lai str. 56601
uacaguaccacuuacauc

SEQ ID NO: 738302 - RNA, 23 nt, Leptospira interrogans serovar lai str. 56601
uacagucguucccacaucuuauu

SEQ ID NO: 738303 - RNA, 22 nt, Leptospira interrogans serovar lai str. 56601
uacagcugaggaguuuuuauaa

SEQ ID NO: 738304 - RNA, 16 nt, Leptospira interrogans serovar lai str. 56601
uacacuccucaaagau

SEQ ID NO: 738305 - RNA, 15 nt, Leptospira interrogans serovar lai str. 56601
uacacucuaaguuuu

SEQ ID NO: 738306 - RNA, 16 nt, Leptospira interrogans serovar lai str. 56601
uacacucuaaguuuuu

SEQ ID NO: 738307 - RNA, 16 nt, Leptospira interrogans serovar lai str. 56601
uacacguuuuccuaau

SEQ ID NO: 738308 - RNA, 17 nt, Leptospira interrogans serovar lai str. 56601
uacacguuuuccuaaua

SEQ ID NO: 738309 - RNA, 13 nt, Leptospira interrogans serovar lai str. 56601
uacaccuucuaaa

SEQ ID NO: 738310 - RNA, 17 nt, Leptospira interrogans serovar lai str. 56601
uacacggagauaaaaaa

SEQ ID NO: 738311 - RNA, 20 nt, Leptospira interrogans serovar lai str. 56601
uacacggagauaaaaaagga

SEQ ID NO: 738312 - RNA, 21 nt, Leptospira interrogans serovar lai str. 56601
uacacggagauaaaaaaggau

SEQ ID NO: 738313 - RNA, 17 nt, Leptospira interrogans serovar lai str. 56601
uacacgauaauuuucuu

SEQ ID NO: 738314 - RNA, 16 nt, Leptospira interrogans serovar lai str. 56601
uacacgauaauuuuua

SEQ ID NO: 738315 - RNA, 12 nt, Leptospira interrogans serovar lai str. 56601
uacaauuaaaaa

SEQ ID NO: 738316 - RNA, 18 nt, Leptospira interrogans serovar lai str. 56601
uacaauuauauuaaauua

SEQ ID NO: 738317 - RNA, 19 nt, Leptospira interrogans serovar lai str. 56601
uacaauaaagcuccaguau

SEQ ID NO: 738318 - RNA, 15 nt, Leptospira interrogans serovar lai str. 56601
uacaauaaaucaaaa

SEQ ID NO: 738319 - RNA, 12 nt, Leptospira interrogans serovar lai str. 56601
uacaauaaaaau

SEQ ID NO: 738320 - RNA, 13 nt, Leptospira interrogans serovar lai str. 56601
uacaauaaaaauu

SEQ ID NO: 738321 - RNA, 13 nt, Leptospira interrogans serovar lai str. 56601
uacaauuaaaaag

SEQ ID NO: 738322 - RNA, 16 nt, Leptospira interrogans serovar lai str. 56601
uacaaugucuaucaaa

SEQ ID NO: 738323 - RNA, 18 nt, Leptospira interrogans serovar lai str. 56601
uacaauucuuucuuaaau

SEQ ID NO: 738324 - RNA, 17 nt, Leptospira interrogans serovar lai str. 56601
uacaauugauuuaaaaa

SEQ ID NO: 738325 - RNA, 13 nt, Leptospira interrogans serovar lai str. 56601
uacaauuguagga

SEQ ID NO: 738326 - RNA, 18 nt, Leptospira interrogans serovar lai str. 56601
uacaauucugaaauuguu

SEQ ID NO: 738327 - RNA, 19 nt, Leptospira interrogans serovar lai str. 56601
uacaauucugaaauuguuu

SEQ ID NO: 738328 - RNA, 16 nt, Leptospira interrogans serovar lai str. 56601
uacaauuuauuauaaa

SEQ ID NO: 738329 - RNA, 17 nt, Leptospira interrogans serovar lai str. 56601
uacaauuucaggaaucg

SEQ ID NO: 738330 - RNA, 20 nt, Leptospira interrogans serovar lai str. 56601
uacaaguuaugauuucauag

SEQ ID NO: 738331 - RNA, 21 nt, Leptospira interrogans serovar lai str. 56601
uacaagacuucuauacucuuc

SEQ ID NO: 738332 - RNA, 22 nt, Leptospira interrogans serovar lai str. 56601
uacaagauuucguucggaaaaa

SEQ ID NO: 738333 - RNA, 24 nt, Leptospira interrogans serovar lai str. 56601
uacaaagcacuuuuuuccucgaau

SEQ ID NO: 738334 - RNA, 19 nt, Leptospira interrogans serovar lai str. 56601
uacaaagaguuuaaaaaau

SEQ ID NO: 738335 - RNA, 16 nt, Leptospira interrogans serovar lai str. 56601
uacaaagauuggacga

SEQ ID NO: 738336 - RNA, 18 nt, Leptospira interrogans serovar lai str. 56601
uacaaacuccgugaacuu

SEQ ID NO: 738337 - RNA, 17 nt, Leptospira interrogans serovar lai str. 56601
uacaacuuuuuuaauuu

SEQ ID NO: 738338 - RNA, 20 nt, Leptospira interrogans serovar lai str. 56601
uacaacuuuuuuaauuuuaa

SEQ ID NO: 738339 - RNA, 23 nt, Leptospira interrogans serovar lai str. 56601
uacaacuuuuuuaauuuuaauua

SEQ ID NO: 738340 - RNA, 19 nt, Leptospira interrogans serovar lai str. 56601
uaauuuucaugaacgaauu

SEQ ID NO: 738341 - RNA, 14 nt, Leptospira interrogans serovar lai str. 56601
uaauuuuauccaua

SEQ ID NO: 738342 - RNA, 11 nt, Leptospira interrogans serovar lai str. 56601
uaauuuuaugu

SEQ ID NO: 738343 - RNA, 16 nt, Leptospira interrogans serovar lai str. 56601
uaauuuuaguaaaaau

SEQ ID NO: 738344 - RNA, 13 nt, Leptospira interrogans serovar lai str. 56601
uaauuuuaauauu

SEQ ID NO: 738345 - RNA, 14 nt, Leptospira interrogans serovar lai str. 56601
uaauuuuaaauaau

SEQ ID NO: 738346 - RNA, 15 nt, Leptospira interrogans serovar lai str. 56601
uaauuuguuuuugga

SEQ ID NO: 738347 - RNA, 18 nt, Leptospira interrogans serovar lai str. 56601
uaauuuguuuuuggaaau

SEQ ID NO: 738348 - RNA, 15 nt, Leptospira interrogans serovar lai str. 56601
uaauuuguaagaguu

SEQ ID NO: 738349 - RNA, 12 nt, Leptospira interrogans serovar lai str. 56601
uaauuuguagga

SEQ ID NO: 738350 - RNA, 17 nt, Leptospira interrogans serovar lai str. 56601
uaauuuguaggaauuac

SEQ ID NO: 738351 - RNA, 12 nt, Leptospira interrogans serovar lai str. 56601
uaauuugugaac

SEQ ID NO: 738352 - RNA, 22 nt, Leptospira interrogans serovar lai str. 56601
uaauuuucuaauauaacucacu

SEQ ID NO: 738353 - RNA, 20 nt, Leptospira interrogans serovar lai str. 56601
uaauuuugaaguauaaacuu

SEQ ID NO: 738354 - RNA, 14 nt, Leptospira interrogans serovar lai str. 56601
uaauuuuccuauuu

SEQ ID NO: 738355 - RNA, 21 nt, Leptospira interrogans serovar lai str. 56601
uaauuuucuagugucuaaacu

SEQ ID NO: 738356 - RNA, 14 nt, Leptospira interrogans serovar lai str. 56601
uaauuuucuuuaga

SEQ ID NO: 738357 - RNA, 21 nt, Leptospira interrogans serovar lai str. 56601
uacaaaaaauguuuaaagaau

SEQ ID NO: 738358 - RNA, 22 nt, Leptospira interrogans serovar lai str. 56601
uacaaaaaauguuuaaagaauu

SEQ ID NO: 738359 - RNA, 17 nt, Leptospira interrogans serovar lai str. 56601
uacaaaaaacugaaacu

SEQ ID NO: 738360 - RNA, 18 nt, Leptospira interrogans serovar lai str. 56601
uacaaaaaacugaaacuu

SEQ ID NO: 738361 - RNA, 22 nt, Leptospira interrogans serovar lai str. 56601
uaauuuuuuauuuuugucuacg

SEQ ID NO: 738362 - RNA, 12 nt, Leptospira interrogans serovar lai str. 56601
uaauuuuuuagc

SEQ ID NO: 738363 - RNA, 14 nt, Leptospira interrogans serovar lai str. 56601
uaauuuuuuaaaaa

SEQ ID NO: 738364 - RNA, 15 nt, Leptospira interrogans serovar lai str. 56601
uaauuuuuuaaaaaa

SEQ ID NO: 738365 - RNA, 17 nt, Leptospira interrogans serovar lai str. 56601
uaauuuuuuaaaaauuu

SEQ ID NO: 738366 - RNA, 12 nt, Leptospira interrogans serovar lai str. 56601
uacaaaauuuaa

SEQ ID NO: 738367 - RNA, 14 nt, Leptospira interrogans serovar lai str. 56601
uacaaaauuuaaaa

SEQ ID NO: 738368 - RNA, 16 nt, Leptospira interrogans serovar lai str. 56601
uacaaaauuuaaaaau

SEQ ID NO: 738369 - RNA, 12 nt, Leptospira interrogans serovar lai str. 56601
uacaaaauuuag

SEQ ID NO: 738370 - RNA, 12 nt, Leptospira interrogans serovar lai str. 56601
uacaaacaaauu

SEQ ID NO: 738371 - RNA, 18 nt, Leptospira interrogans serovar lai str. 56601
uacaaacaaauucuaaaa

SEQ ID NO: 738372 - RNA, 14 nt, Leptospira interrogans serovar lai str. 56601
uacaaaaauucuaa

SEQ ID NO: 738373 - RNA, 14 nt, Leptospira interrogans serovar lai str. 56601
uacaaaaauuuaau

SEQ ID NO: 738374 - RNA, 15 nt, Leptospira interrogans serovar lai str. 56601
uacaaaaauuuaaua

SEQ ID NO: 738375 - RNA, 18 nt, Leptospira interrogans serovar lai str. 56601
uacaaaacucuuuaaaaa

SEQ ID NO: 738376 - RNA, 19 nt, Leptospira interrogans serovar lai str. 56601
uacaaaacucuuuaaaaac

SEQ ID NO: 738377 - RNA, 17 nt, Leptospira interrogans serovar lai str. 56601
uaauucgugaacuuuag

SEQ ID NO: 738378 - RNA, 15 nt, Leptospira interrogans serovar lai str. 56601
uaauucguuuuuuaa

SEQ ID NO: 738379 - RNA, 22 nt, Leptospira interrogans serovar lai str. 56601
uaauucguuuuuuaaaauguag

SEQ ID NO: 738380 - RNA, 12 nt, Leptospira interrogans serovar lai str. 56601
uaauuuaaaaac

SEQ ID NO: 738381 - RNA, 16 nt, Leptospira interrogans serovar lai str. 56601
uaauucugaaaaaguu

SEQ ID NO: 738382 - RNA, 12 nt, Leptospira interrogans serovar lai str. 56601
uaauuuaaaaaa

SEQ ID NO: 738383 - RNA, 18 nt, Leptospira interrogans serovar lai str. 56601
uaauuuaaaaaaaucacu

SEQ ID NO: 738384 - RNA, 20 nt, Leptospira interrogans serovar lai str. 56601
uaauucucuucguuuugccc

SEQ ID NO: 738385 - RNA, 21 nt, Leptospira interrogans serovar lai str. 56601
uaauucuccaucuguuuucuu

SEQ ID NO: 738386 - RNA, 14 nt, Leptospira interrogans serovar lai str. 56601
uaauuuagcuaagu

SEQ ID NO: 738387 - RNA, 18 nt, Leptospira interrogans serovar lai str. 56601
uaauuuaauauauuaaaa

SEQ ID NO: 738388 - RNA, 16 nt, Leptospira interrogans serovar lai str. 56601
uaauuuauauuacaua

SEQ ID NO: 738389 - RNA, 15 nt, Leptospira interrogans serovar lai str. 56601
uaauuugcuuaaagc

SEQ ID NO: 738390 - RNA, 21 nt, Leptospira interrogans serovar lai str. 56601
uaauuugaucaucguuauauu

SEQ ID NO: 738391 - RNA, 17 nt, Leptospira interrogans serovar lai str. 56601
uaauuucucuuauuaga

SEQ ID NO: 738392 - RNA, 19 nt, Leptospira interrogans serovar lai str. 56601
uaauuucuucauaucaaau

SEQ ID NO: 738393 - RNA, 15 nt, Leptospira interrogans serovar lai str. 56601
uaauuucuuuuuaua

SEQ ID NO: 738394 - RNA, 17 nt, Leptospira interrogans serovar lai str. 56601
uaauuucuuuuuauacu

SEQ ID NO: 738395 - RNA, 20 nt, Leptospira interrogans serovar lai str. 56601
uaauuucuaaacaauuuuau

SEQ ID NO: 738396 - RNA, 22 nt, Leptospira interrogans serovar lai str. 56601
uaauuuccaaacuacaaauuca

SEQ ID NO: 738397 - RNA, 18 nt, Leptospira interrogans serovar lai str. 56601
uaauuucccauaaaaaga

SEQ ID NO: 738398 - RNA, 22 nt, Leptospira interrogans serovar lai str. 56601
uaauuucauugaguuuuuuagu

SEQ ID NO: 738399 - RNA, 16 nt, Leptospira interrogans serovar lai str. 56601
uaauucaaaauuugau

SEQ ID NO: 738400 - RNA, 15 nt, Leptospira interrogans serovar lai str. 56601
uaauucgauccaaaa

SEQ ID NO: 738401 - RNA, 13 nt, Leptospira interrogans serovar lai str. 56601
uaauuauuuauuu

SEQ ID NO: 738402 - RNA, 16 nt, Leptospira interrogans serovar lai str. 56601
uaauuauauucuuaua

SEQ ID NO: 738403 - RNA, 14 nt, Leptospira interrogans serovar lai str. 56601
uaauuaaaauuuac

SEQ ID NO: 738404 - RNA, 18 nt, Leptospira interrogans serovar lai str. 56601
uaauuaaacaaagaauaa

SEQ ID NO: 738405 - RNA, 19 nt, Leptospira interrogans serovar lai str. 56601
uaauuaaacaaagaauaaa

SEQ ID NO: 738406 - RNA, 22 nt, Leptospira interrogans serovar lai str. 56601
uaauuaaacaaagaauaaaucc

SEQ ID NO: 738407 - RNA, 21 nt, Leptospira interrogans serovar lai str. 56601
uaaugaggagaaaaaauaaca

SEQ ID NO: 738408 - RNA, 21 nt, Leptospira interrogans serovar lai str. 56601
uaaugagccagguuaauuaaa

SEQ ID NO: 738409 - RNA, 17 nt, Leptospira interrogans serovar lai str. 56601
uaaugagucugucccaa

SEQ ID NO: 738410 - RNA, 19 nt, Leptospira interrogans serovar lai str. 56601
uaaugacgauuuucuccuc

SEQ ID NO: 738411 - RNA, 19 nt, Leptospira interrogans serovar lai str. 56601
uaaugagauuaaaacugcu

SEQ ID NO: 738412 - RNA, 15 nt, Leptospira interrogans serovar lai str. 56601
uaaugaaucguaaaa

SEQ ID NO: 738413 - RNA, 13 nt, Leptospira interrogans serovar lai str. 56601
uaaugaaaaagaa

SEQ ID NO: 738414 - RNA, 16 nt, Leptospira interrogans serovar lai str. 56601
uaaucgaauuuccauu

SEQ ID NO: 738415 - RNA, 23 nt, Leptospira interrogans serovar lai str. 56601
uaaugcagcuucuuccaaaguca

SEQ ID NO: 738416 - RNA, 17 nt, Leptospira interrogans serovar lai str. 56601
uaaugccuacaaaucaa

SEQ ID NO: 738417 - RNA, 20 nt, Leptospira interrogans serovar lai str. 56601
uaaugccuacaaaucaaauc

SEQ ID NO: 738418 - RNA, 21 nt, Leptospira interrogans serovar lai str. 56601
uaaucaugugaauucagaaaa

SEQ ID NO: 738419 - RNA, 22 nt, Leptospira interrogans serovar lai str. 56601
uaaucauggccuucuggaaaaa

SEQ ID NO: 738420 - RNA, 14 nt, Leptospira interrogans serovar lai str. 56601
uaauccuuuuacuu

SEQ ID NO: 738421 - RNA, 19 nt, Leptospira interrogans serovar lai str. 56601
uaauccucuuucguuuuuu

SEQ ID NO: 738422 - RNA, 13 nt, Leptospira interrogans serovar lai str. 56601
uaauauuucucuc

SEQ ID NO: 738423 - RNA, 19 nt, Leptospira interrogans serovar lai str. 56601
uaauauuucucuuuguaau

SEQ ID NO: 738424 - RNA, 18 nt, Leptospira interrogans serovar lai str. 56601
uaaucacgaaaaaugaau

SEQ ID NO: 738425 - RNA, 17 nt, Leptospira interrogans serovar lai str. 56601
uaauaugaauucauugu

SEQ ID NO: 738426 - RNA, 16 nt, Leptospira interrogans serovar lai str. 56601
uaauauuuauaaaaca

SEQ ID NO: 738427 - RNA, 17 nt, Leptospira interrogans serovar lai str. 56601
uaauauacuaaaauuau

SEQ ID NO: 738428 - RNA, 19 nt, Leptospira interrogans serovar lai str. 56601
uaauauacuagggaaagau

SEQ ID NO: 738429 - RNA, 21 nt, Leptospira interrogans serovar lai str. 56601
uaauauagguucuugcaaaaa

SEQ ID NO: 738430 - RNA, 17 nt, Leptospira interrogans serovar lai str. 56601
uaauauaguauaaauuc

SEQ ID NO: 738431 - RNA, 20 nt, Leptospira interrogans serovar lai str. 56601
uaauauaguauaaauucgca

SEQ ID NO: 738432 - RNA, 13 nt, Leptospira interrogans serovar lai str. 56601
uaauauaaaaacc

SEQ ID NO: 738433 - RNA, 15 nt, Leptospira interrogans serovar lai str. 56601
uaauauacaaaacau

SEQ ID NO: 738434 - RNA, 12 nt, Leptospira interrogans serovar lai str. 56601
uaauauaaaauc

SEQ ID NO: 738435 - RNA, 19 nt, Leptospira interrogans serovar lai str. 56601
uaauaucaaaaugaacaau

SEQ ID NO: 738436 - RNA, 21 nt, Leptospira interrogans serovar lai str. 56601
uaacgugagcucuauguaaga

SEQ ID NO: 738437 - RNA, 13 nt, Leptospira interrogans serovar lai str. 56601
uaauaguuuauac

SEQ ID NO: 738438 - RNA, 21 nt, Leptospira interrogans serovar lai str. 56601
uaauaguucccacaaauuacu

SEQ ID NO: 738439 - RNA, 21 nt, Leptospira interrogans serovar lai str. 56601
uaauaguuccuauauuuuaaa

SEQ ID NO: 738440 - RNA, 17 nt, Leptospira interrogans serovar lai str. 56601
uaauaguugaaauucac

SEQ ID NO: 738441 - RNA, 23 nt, Leptospira interrogans serovar lai str. 56601
uacuuaccucuauaaaauuaaau

SEQ ID NO: 738442 - RNA, 19 nt, Leptospira interrogans serovar lai str. 56601
uacuuacuaaacgauuuua

SEQ ID NO: 738443 - RNA, 14 nt, Leptospira interrogans serovar lai str. 56601
uacuuaaaaauacc

SEQ ID NO: 738444 - RNA, 15 nt, Leptospira interrogans serovar lai str. 56601
uacuuaaaaaugaug

SEQ ID NO: 738445 - RNA, 17 nt, Leptospira interrogans serovar lai str. 56601
uacuuaaacguauaaaa

SEQ ID NO: 738446 - RNA, 22 nt, Leptospira interrogans serovar lai str. 56601
uacuuaaacguauaaaaacagc

SEQ ID NO: 738447 - RNA, 21 nt, Leptospira interrogans serovar lai str. 56601
uacuucauccgggcuuuucuu

SEQ ID NO: 738448 - RNA, 14 nt, Leptospira interrogans serovar lai str. 56601
uacuuauuucuaua

SEQ ID NO: 738449 - RNA, 19 nt, Leptospira interrogans serovar lai str. 56601
uacuuauuuuugaaaagau

SEQ ID NO: 738450 - RNA, 14 nt, Leptospira interrogans serovar lai str. 56601
uacuuuuuccaaaa

SEQ ID NO: 738451 - RNA, 13 nt, Leptospira interrogans serovar lai str. 56601
uacuuuucuuccc

SEQ ID NO: 738452 - RNA, 16 nt, Leptospira interrogans serovar lai str. 56601
uacuuuugaaauagau

SEQ ID NO: 738453 - RNA, 18 nt, Leptospira interrogans serovar lai str. 56601
uagaaaaacugauuuaau

SEQ ID NO: 738454 - RNA, 20 nt, Leptospira interrogans serovar lai str. 56601
uagaaaaacugauuuaauua

SEQ ID NO: 738455 - RNA, 12 nt, Leptospira interrogans serovar lai str. 56601
uagaaaaaaagu

SEQ ID NO: 738456 - RNA, 20 nt, Leptospira interrogans serovar lai str. 56601
uagaaaaaaaguauauauua

SEQ ID NO: 738457 - RNA, 13 nt, Leptospira interrogans serovar lai str. 56601
uacuuuuaaaaaa

SEQ ID NO: 738458 - RNA, 22 nt, Leptospira interrogans serovar lai str. 56601
uacuuuuagauaauuauucuca

SEQ ID NO: 738459 - RNA, 15 nt, Leptospira interrogans serovar lai str. 56601
uacuuuuagaaaaaa

SEQ ID NO: 738460 - RNA, 16 nt, Leptospira interrogans serovar lai str. 56601
uacuuuuagaaaaaau

SEQ ID NO: 738461 - RNA, 18 nt, Leptospira interrogans serovar lai str. 56601
uacuuuuagaaaaaauuu

SEQ ID NO: 738462 - RNA, 22 nt, Leptospira interrogans serovar lai str. 56601
uacuuuuagaagauuuuuacuc

SEQ ID NO: 738463 - RNA, 17 nt, Leptospira interrogans serovar lai str. 56601
uacuuucaaaaaauaua

SEQ ID NO: 738464 - RNA, 19 nt, Leptospira interrogans serovar lai str. 56601
uacuuuauagguucuggau

SEQ ID NO: 738465 - RNA, 15 nt, Leptospira interrogans serovar lai str. 56601
uacuuuagaaauuuc

SEQ ID NO: 738466 - RNA, 14 nt, Leptospira interrogans serovar lai str. 56601
uacuuuaaaauuug

SEQ ID NO: 738467 - RNA, 16 nt, Leptospira interrogans serovar lai str. 56601
uacuuuaagaaaauuu

SEQ ID NO: 738468 - RNA, 21 nt, Leptospira interrogans serovar lai str. 56601
uacuuuaagaaaauuuaaaau

SEQ ID NO: 738469 - RNA, 18 nt, Leptospira interrogans serovar lai str. 56601
uacuugucuuuagaacuu

SEQ ID NO: 738470 - RNA, 15 nt, Leptospira interrogans serovar lai str. 56601
uacuugaaaauaaaa

SEQ ID NO: 738471 - RNA, 13 nt, Leptospira interrogans serovar lai str. 56601
uacuugcaaaaag

SEQ ID NO: 738472 - RNA, 15 nt, Leptospira interrogans serovar lai str. 56601
uacuugcaaaaagua

SEQ ID NO: 738473 - RNA, 16 nt, Leptospira interrogans serovar lai str. 56601
uacuugcaaaaaguau

SEQ ID NO: 738474 - RNA, 15 nt, Leptospira interrogans serovar lai str. 56601
uacuugccauggaaa

SEQ ID NO: 738475 - RNA, 12 nt, Leptospira interrogans serovar lai str. 56601
uacuucuaaaaa

SEQ ID NO: 738476 - RNA, 17 nt, Leptospira interrogans serovar lai str. 56601
uacuucuaaaaaauucu

SEQ ID NO: 738477 - RNA, 17 nt, Leptospira interrogans serovar lai str. 56601
uacugaguuucaaacac

SEQ ID NO: 738478 - RNA, 23 nt, Leptospira interrogans serovar lai str. 56601
uacugauuuagagagucaaauca

SEQ ID NO: 738479 - RNA, 18 nt, Leptospira interrogans serovar lai str. 56601
uacugauuucaaaaauaa

SEQ ID NO: 738480 - RNA, 17 nt, Leptospira interrogans serovar lai str. 56601
uacugauuuucaugaau

SEQ ID NO: 738481 - RNA, 18 nt, Leptospira interrogans serovar lai str. 56601
uacugcaucaaccaagaa

SEQ ID NO: 738482 - RNA, 21 nt, Leptospira interrogans serovar lai str. 56601
uacugcauuuuauuaaaaaua

SEQ ID NO: 738483 - RNA, 13 nt, Leptospira interrogans serovar lai str. 56601
uacucuuauaaaa

SEQ ID NO: 738484 - RNA, 14 nt, Leptospira interrogans serovar lai str. 56601
uacucuuauaaaau

SEQ ID NO: 738485 - RNA, 15 nt, Leptospira interrogans serovar lai str. 56601
uacucuuauaaaauu

SEQ ID NO: 738486 - RNA, 16 nt, Leptospira interrogans serovar lai str. 56601
uacucuuauaaaauuu

SEQ ID NO: 738487 - RNA, 21 nt, Leptospira interrogans serovar lai str. 56601
uacucuuauaaaauuuuagau

SEQ ID NO: 738488 - RNA, 17 nt, Leptospira interrogans serovar lai str. 56601
uacucuacuauaaacuu

SEQ ID NO: 738489 - RNA, 21 nt, Leptospira interrogans serovar lai str. 56601
uacuauuuugaugaaugaaua

SEQ ID NO: 738490 - RNA, 12 nt, Leptospira interrogans serovar lai str. 56601
uacuauuauaau

SEQ ID NO: 738491 - RNA, 15 nt, Leptospira interrogans serovar lai str. 56601
uacucacaaauuguc

SEQ ID NO: 738492 - RNA, 18 nt, Leptospira interrogans serovar lai str. 56601
uacucaauuuuacagaga

SEQ ID NO: 738493 - RNA, 23 nt, Leptospira interrogans serovar lai str. 56601
uacucagagcgauauaauaaaau

SEQ ID NO: 738494 - RNA, 20 nt, Leptospira interrogans serovar lai str. 56601
uacuaaaagaguaauucuaa

SEQ ID NO: 738495 - RNA, 20 nt, Leptospira interrogans serovar lai str. 56601
uacguuuuauuauauaauuu

SEQ ID NO: 738496 - RNA, 14 nt, Leptospira interrogans serovar lai str. 56601
uacuaaaauuauuc

SEQ ID NO: 738497 - RNA, 15 nt, Leptospira interrogans serovar lai str. 56601
uacuaaaauuauucu

SEQ ID NO: 738498 - RNA, 17 nt, Leptospira interrogans serovar lai str. 56601
uacuaaaauuuuauaaa

SEQ ID NO: 738499 - RNA, 12 nt, Leptospira interrogans serovar lai str. 56601
uacuaaaaaaca

SEQ ID NO: 738500 - RNA, 22 nt, Leptospira interrogans serovar lai str. 56601
uacuaaaaaacauaaaaauuuu

SEQ ID NO: 738501 - RNA, 20 nt, Leptospira interrogans serovar lai str. 56601
uacgugaccaggaauacuug

SEQ ID NO: 738502 - RNA, 15 nt, Leptospira interrogans serovar lai str. 56601
uacucgauaauucuu

SEQ ID NO: 738503 - RNA, 16 nt, Leptospira interrogans serovar lai str. 56601
uacucggaaauuuauu

SEQ ID NO: 738504 - RNA, 22 nt, Leptospira interrogans serovar lai str. 56601
uacucguuuuuaguuucuuuuu

SEQ ID NO: 738505 - RNA, 21 nt, Leptospira interrogans serovar lai str. 56601
uacuccggcuaaaaaacugau

SEQ ID NO: 738506 - RNA, 21 nt, Leptospira interrogans serovar lai str. 56601
uacuccuaggcauaugaaaau

SEQ ID NO: 738507 - RNA, 18 nt, Leptospira interrogans serovar lai str. 56601
uacucgaaaguuuauaaa

SEQ ID NO: 738508 - RNA, 18 nt, Leptospira interrogans serovar lai str. 56601
uacucgaauuuauauagu

SEQ ID NO: 738509 - RNA, 14 nt, Leptospira interrogans serovar lai str. 56601
uacucauaaaauuu

SEQ ID NO: 738510 - RNA, 14 nt, Leptospira interrogans serovar lai str. 56601
uacucauuuccauc

SEQ ID NO: 738511 - RNA, 16 nt, Leptospira interrogans serovar lai str. 56601
uacccgauauuaaaau

SEQ ID NO: 738512 - RNA, 17 nt, Leptospira interrogans serovar lai str. 56601
uaccgggauuuuaaaaa

SEQ ID NO: 738513 - RNA, 16 nt, Leptospira interrogans serovar lai str. 56601
uaccgcuagaaguuau

SEQ ID NO: 738514 - RNA, 18 nt, Leptospira interrogans serovar lai str. 56601
uacauaacuaauaaaaac

SEQ ID NO: 738515 - RNA, 17 nt, Leptospira interrogans serovar lai str. 56601
uacauaaacgauuauuu

SEQ ID NO: 738516 - RNA, 22 nt, Leptospira interrogans serovar lai str. 56601
uacauaaguucgguguaaaaaa

SEQ ID NO: 738517 - RNA, 23 nt, Leptospira interrogans serovar lai str. 56601
uacauaauaaaguacuaauucaa

SEQ ID NO: 738518 - RNA, 12 nt, Leptospira interrogans serovar lai str. 56601
uacauaauaaua

SEQ ID NO: 738519 - RNA, 15 nt, Leptospira interrogans serovar lai str. 56601
uaccacuuauuucua

SEQ ID NO: 738520 - RNA, 22 nt, Leptospira interrogans serovar lai str. 56601
uacgauauuuuguuuuuaguua

SEQ ID NO: 738521 - RNA, 13 nt, Leptospira interrogans serovar lai str. 56601
uacgaucaaaucc

SEQ ID NO: 738522 - RNA, 19 nt, Leptospira interrogans serovar lai str. 56601
uacgaaccaauucuaaaau

SEQ ID NO: 738523 - RNA, 22 nt, Leptospira interrogans serovar lai str. 56601
uacgaaccaauucuaaaaucau

SEQ ID NO: 738524 - RNA, 15 nt, Leptospira interrogans serovar lai str. 56601
uacgaauuuuuaaau

SEQ ID NO: 738525 - RNA, 21 nt, Leptospira interrogans serovar lai str. 56601
uacgacaaguccucuaugaaa

SEQ ID NO: 738526 - RNA, 18 nt, Leptospira interrogans serovar lai str. 56601
uacgaaaauuuuuuauuu

SEQ ID NO: 738527 - RNA, 22 nt, Leptospira interrogans serovar lai str. 56601
uacgaaaacuuaaugagauuaa

SEQ ID NO: 738528 - RNA, 13 nt, Leptospira interrogans serovar lai str. 56601
uacgaaaauuuaa

SEQ ID NO: 738529 - RNA, 16 nt, Leptospira interrogans serovar lai str. 56601
uacgaaaaaauugacu

SEQ ID NO: 738530 - RNA, 20 nt, Leptospira interrogans serovar lai str. 56601
uacgaacaaauucuaaaauu

SEQ ID NO: 738531 - RNA, 16 nt, Leptospira interrogans serovar lai str. 56601
uacgaacacauucuaa

SEQ ID NO: 738532 - RNA, 20 nt, Leptospira interrogans serovar lai str. 56601
uacgaacacauucuaaaauu

SEQ ID NO: 738533 - RNA, 22 nt, Leptospira interrogans serovar lai str. 56601
uaccuaaauauuuauuacaaag

SEQ ID NO: 738534 - RNA, 23 nt, Leptospira interrogans serovar lai str. 56601
uaccguaaagaagaggugaaauu

SEQ ID NO: 738535 - RNA, 22 nt, Leptospira interrogans serovar lai str. 56601
uacgucaaacucacguuggauu

SEQ ID NO: 738536 - RNA, 21 nt, Leptospira interrogans serovar lai str. 56601
uacggauucucgcauuuuccu

SEQ ID NO: 738537 - RNA, 23 nt, Leptospira interrogans serovar lai str. 56601
uacggaucgcguuugaaacucag

SEQ ID NO: 738538 - RNA, 17 nt, Leptospira interrogans serovar lai str. 56601
uacggcauuuuuuaaau

SEQ ID NO: 738539 - RNA, 13 nt, Leptospira interrogans serovar lai str. 56601
uacgaucuaaaag

SEQ ID NO: 738540 - RNA, 15 nt, Leptospira interrogans serovar lai str. 56601
uacgaugauaaauug

SEQ ID NO: 738541 - RNA, 16 nt, Leptospira interrogans serovar lai str. 56601
uacgaugucuuuucaa

SEQ ID NO: 738542 - RNA, 16 nt, Leptospira interrogans serovar lai str. 56601
uacgcaugauaaaaau

SEQ ID NO: 738543 - RNA, 16 nt, Leptospira interrogans serovar lai str. 56601
uaguaaguuuuucgau

SEQ ID NO: 738544 - RNA, 13 nt, Leptospira interrogans serovar lai str. 56601
uaguaaaaucuuc

SEQ ID NO: 738545 - RNA, 15 nt, Leptospira interrogans serovar lai str. 56601
uaguaaaauuuaaaa

SEQ ID NO: 738546 - RNA, 19 nt, Leptospira interrogans serovar lai str. 56601
uaguaaaacuguuuccagu

SEQ ID NO: 738547 - RNA, 14 nt, Leptospira interrogans serovar lai str. 56601
uaguaaaagaaaau

SEQ ID NO: 738548 - RNA, 21 nt, Leptospira interrogans serovar lai str. 56601
uagguuuguacguaaaaauga

SEQ ID NO: 738549 - RNA, 17 nt, Leptospira interrogans serovar lai str. 56601
uaguaaagauuagaaaa

SEQ ID NO: 738550 - RNA, 14 nt, Leptospira interrogans serovar lai str. 56601
uaguaaauaaaaaa

SEQ ID NO: 738551 - RNA, 15 nt, Leptospira interrogans serovar lai str. 56601
uaguaaauaaaaaac

SEQ ID NO: 738552 - RNA, 15 nt, Leptospira interrogans serovar lai str. 56601
uagguuguguuugau

SEQ ID NO: 738553 - RNA, 20 nt, Leptospira interrogans serovar lai str. 56601
uagguuuaucuguaaaauga

SEQ ID NO: 738554 - RNA, 20 nt, Leptospira interrogans serovar lai str. 56601
uagguucuugcaaaaauaga

SEQ ID NO: 738555 - RNA, 19 nt, Leptospira interrogans serovar lai str. 56601
uagguucgaacguauaaaa

SEQ ID NO: 738556 - RNA, 14 nt, Leptospira interrogans serovar lai str. 56601
uaggugauuaucuc

SEQ ID NO: 738557 - RNA, 18 nt, Leptospira interrogans serovar lai str. 56601
uaggcuuaucuguaaaau

SEQ ID NO: 738558 - RNA, 16 nt, Leptospira interrogans serovar lai str. 56601
uagggaaaacucaaca

SEQ ID NO: 738559 - RNA, 17 nt, Leptospira interrogans serovar lai str. 56601
uagggaaaacucaacac

SEQ ID NO: 738560 - RNA, 22 nt, Leptospira interrogans serovar lai str. 56601
uagucaaauuuggaaauuguga

SEQ ID NO: 738561 - RNA, 21 nt, Leptospira interrogans serovar lai str. 56601
uagucaaugguugcaaaaaag

SEQ ID NO: 738562 - RNA, 12 nt, Leptospira interrogans serovar lai str. 56601
uaguauccaaaa

SEQ ID NO: 738563 - RNA, 12 nt, Leptospira interrogans serovar lai str. 56601
uaguauguuuuu

SEQ ID NO: 738564 - RNA, 12 nt, Leptospira interrogans serovar lai str. 56601
uaguaguuccca

SEQ ID NO: 738565 - RNA, 19 nt, Leptospira interrogans serovar lai str. 56601
uaguauauucuaauagucu

SEQ ID NO: 738566 - RNA, 19 nt, Leptospira interrogans serovar lai str. 56601
uaguagucuuacaauuuua

SEQ ID NO: 738567 - RNA, 21 nt, Leptospira interrogans serovar lai str. 56601
uagucccacauuuuugugaaa

SEQ ID NO: 738568 - RNA, 15 nt, Leptospira interrogans serovar lai str. 56601
uagucauauaaaagu

SEQ ID NO: 738569 - RNA, 22 nt, Leptospira interrogans serovar lai str. 56601
uagucaguuuuuucguaaaaaa

SEQ ID NO: 738570 - RNA, 14 nt, Leptospira interrogans serovar lai str. 56601
uagucauuuccucc

SEQ ID NO: 738571 - RNA, 19 nt, Leptospira interrogans serovar lai str. 56601
uagucauuuccuccaaaca

SEQ ID NO: 738572 - RNA, 13 nt, Leptospira interrogans serovar lai str. 56601
uagucauuuugau

SEQ ID NO: 738573 - RNA, 20 nt, Leptospira interrogans serovar lai str. 56601
uauaaaaacagcacuaaaag

SEQ ID NO: 738574 - RNA, 22 nt, Leptospira interrogans serovar lai str. 56601
uauaaaaaccacaaaaacaaau

SEQ ID NO: 738575 - RNA, 20 nt, Leptospira interrogans serovar lai str. 56601
uauaaaaacgguauuuaaaa

SEQ ID NO: 738576 - RNA, 20 nt, Leptospira interrogans serovar lai str. 56601
uaguuuacaaauugauaauu

SEQ ID NO: 738577 - RNA, 14 nt, Leptospira interrogans serovar lai str. 56601
uaguuguacaaaaa

SEQ ID NO: 738578 - RNA, 15 nt, Leptospira interrogans serovar lai str. 56601
uaguuguacaaaaau

SEQ ID NO: 738579 - RNA, 23 nt, Leptospira interrogans serovar lai str. 56601
uauaaaaccuuuauuuaauaaaa

SEQ ID NO: 738580 - RNA, 23 nt, Leptospira interrogans serovar lai str. 56601
uauaaaagaaucauuaaucagau

SEQ ID NO: 738581 - RNA, 20 nt, Leptospira interrogans serovar lai str. 56601
uauaaaaagcuguuguuaua

SEQ ID NO: 738582 - RNA, 14 nt, Leptospira interrogans serovar lai str. 56601
uauaaaaaguuugu

SEQ ID NO: 738583 - RNA, 23 nt, Leptospira interrogans serovar lai str. 56601
uauaaaaauaauacaauucugaa

SEQ ID NO: 738584 - RNA, 13 nt, Leptospira interrogans serovar lai str. 56601
uauaaaaguauaa

SEQ ID NO: 738585 - RNA, 19 nt, Leptospira interrogans serovar lai str. 56601
uauaaacuuuuuugaauau

SEQ ID NO: 738586 - RNA, 19 nt, Leptospira interrogans serovar lai str. 56601
uaguucucucgaaaugaga

SEQ ID NO: 738587 - RNA, 14 nt, Leptospira interrogans serovar lai str. 56601
uaguucuucaaaau

SEQ ID NO: 738588 - RNA, 18 nt, Leptospira interrogans serovar lai str. 56601
uaguucagaugaauugaa

SEQ ID NO: 738589 - RNA, 11 nt, Leptospira interrogans serovar lai str. 56601
uaguucccaca

SEQ ID NO: 738590 - RNA, 12 nt, Leptospira interrogans serovar lai str. 56601
uaguucccacaa

SEQ ID NO: 738591 - RNA, 18 nt, Leptospira interrogans serovar lai str. 56601
uaguucccacaaauuaag

SEQ ID NO: 738592 - RNA, 17 nt, Leptospira interrogans serovar lai str. 56601
uaguucccacaaauuag

SEQ ID NO: 738593 - RNA, 18 nt, Leptospira interrogans serovar lai str. 56601
uaguucccacaaauucca

SEQ ID NO: 738594 - RNA, 14 nt, Leptospira interrogans serovar lai str. 56601
uaguucccacaagu

SEQ ID NO: 738595 - RNA, 18 nt, Leptospira interrogans serovar lai str. 56601
uaguucccacaguuugaa

SEQ ID NO: 738596 - RNA, 21 nt, Leptospira interrogans serovar lai str. 56601
uaguucccacauuucaaaguu

SEQ ID NO: 738597 - RNA, 21 nt, Leptospira interrogans serovar lai str. 56601
uaguucccacauuuugugaaa

SEQ ID NO: 738598 - RNA, 20 nt, Leptospira interrogans serovar lai str. 56601
uaguuccuacaaauuaaauc

SEQ ID NO: 738599 - RNA, 23 nt, Leptospira interrogans serovar lai str. 56601
uaguuccuacaaauuaaguccca

SEQ ID NO: 738600 - RNA, 16 nt, Leptospira interrogans serovar lai str. 56601
uaguuccuacauuuuu

SEQ ID NO: 738601 - RNA, 19 nt, Leptospira interrogans serovar lai str. 56601
uaguuccuacgguuuuagu

SEQ ID NO: 738602 - RNA, 15 nt, Leptospira interrogans serovar lai str. 56601
uaguuccuauauuuu

SEQ ID NO: 738603 - RNA, 21 nt, Leptospira interrogans serovar lai str. 56601
uaguuccuuaaauauaucuuc

SEQ ID NO: 738604 - RNA, 22 nt, Leptospira interrogans serovar lai str. 56601
uauaacguagauuacuaugaaa

SEQ ID NO: 738605 - RNA, 18 nt, Leptospira interrogans serovar lai str. 56601
uauaacgaaacuuuaauu

SEQ ID NO: 738606 - RNA, 18 nt, Leptospira interrogans serovar lai str. 56601
uauaacgggaauuauaaa

SEQ ID NO: 738607 - RNA, 24 nt, Leptospira interrogans serovar lai str. 56601
uauaaccacaagacaaacaaacau

SEQ ID NO: 738608 - RNA, 20 nt, Leptospira interrogans serovar lai str. 56601
uauaacaaaguauuuaauuu

SEQ ID NO: 738609 - RNA, 14 nt, Leptospira interrogans serovar lai str. 56601
uauaaagauaaauc

SEQ ID NO: 738610 - RNA, 18 nt, Leptospira interrogans serovar lai str. 56601
uauaaagucguuuuuaag

SEQ ID NO: 738611 - RNA, 23 nt, Leptospira interrogans serovar lai str. 56601
uauaaaguuuuaguuuacaaauu

SEQ ID NO: 738612 - RNA, 15 nt, Leptospira interrogans serovar lai str. 56601
uauaaauuuauauuu

SEQ ID NO: 738613 - RNA, 23 nt, Leptospira interrogans serovar lai str. 56601
uauaagccaaaccaaauagaaau

SEQ ID NO: 738614 - RNA, 17 nt, Leptospira interrogans serovar lai str. 56601
uauaagaaaguauuaau

SEQ ID NO: 738615 - RNA, 19 nt, Leptospira interrogans serovar lai str. 56601
uauaagacauuggcaaaug

SEQ ID NO: 738616 - RNA, 22 nt, Leptospira interrogans serovar lai str. 56601
uauaagacauuggcaaauguua

SEQ ID NO: 738617 - RNA, 21 nt, Leptospira interrogans serovar lai str. 56601
uauaacuuacugauuucuaua

SEQ ID NO: 738618 - RNA, 14 nt, Leptospira interrogans serovar lai str. 56601
uauaacuuuuucag

SEQ ID NO: 738619 - RNA, 16 nt, Leptospira interrogans serovar lai str. 56601
uauaacuuuaaaaaau

SEQ ID NO: 738620 - RNA, 17 nt, Leptospira interrogans serovar lai str. 56601
uauaaguuaagugaaaa

SEQ ID NO: 738621 - RNA, 20 nt, Leptospira interrogans serovar lai str. 56601
uauaagucgaucuacuaaau

SEQ ID NO: 738622 - RNA, 19 nt, Leptospira interrogans serovar lai str. 56601
uauaaguuuuuauuauaaa

SEQ ID NO: 738623 - RNA, 12 nt, Leptospira interrogans serovar lai str. 56601
uagcuuaaaagu

SEQ ID NO: 738624 - RNA, 13 nt, Leptospira interrogans serovar lai str. 56601
uagcuuaaaagug

SEQ ID NO: 738625 - RNA, 19 nt, Leptospira interrogans serovar lai str. 56601
uagcuauuuucagaaaaau

SEQ ID NO: 738626 - RNA, 16 nt, Leptospira interrogans serovar lai str. 56601
uaggaauuggaggaaa

SEQ ID NO: 738627 - RNA, 17 nt, Leptospira interrogans serovar lai str. 56601
uaggaauuggaggaaaa

SEQ ID NO: 738628 - RNA, 12 nt, Leptospira interrogans serovar lai str. 56601
uaggaauuuuuu

SEQ ID NO: 738629 - RNA, 14 nt, Leptospira interrogans serovar lai str. 56601
uaggcuaaucaaau

SEQ ID NO: 738630 - RNA, 16 nt, Leptospira interrogans serovar lai str. 56601
uaggcuaaucaaauuu

SEQ ID NO: 738631 - RNA, 13 nt, Leptospira interrogans serovar lai str. 56601
uaggcauuucauu

SEQ ID NO: 738632 - RNA, 13 nt, Leptospira interrogans serovar lai str. 56601
uaggauuuuagaa

SEQ ID NO: 738633 - RNA, 23 nt, Leptospira interrogans serovar lai str. 56601
uaggauuuuagaaucagaaugaa

SEQ ID NO: 738634 - RNA, 18 nt, Leptospira interrogans serovar lai str. 56601
uaggauuuuagaaugaga

SEQ ID NO: 738635 - RNA, 20 nt, Leptospira interrogans serovar lai str. 56601
uaggauuuuauauauauuuu

SEQ ID NO: 738636 - RNA, 21 nt, Leptospira interrogans serovar lai str. 56601
uaggauuuuuggaauaaaauc

SEQ ID NO: 738637 - RNA, 21 nt, Leptospira interrogans serovar lai str. 56601
uaggaugaauugcuaaaaaag

SEQ ID NO: 738638 - RNA, 21 nt, Leptospira interrogans serovar lai str. 56601
uaggauuccauugauuuucau

SEQ ID NO: 738639 - RNA, 16 nt, Leptospira interrogans serovar lai str. 56601
uaggcacguggaaaau

SEQ ID NO: 738640 - RNA, 18 nt, Leptospira interrogans serovar lai str. 56601
uaggcacguggaaaauca

SEQ ID NO: 738641 - RNA, 22 nt, Leptospira interrogans serovar lai str. 56601
uagcguaauacgaugauaaauu

SEQ ID NO: 738642 - RNA, 14 nt, Leptospira interrogans serovar lai str. 56601
uagcgguaaaagaa

SEQ ID NO: 738643 - RNA, 20 nt, Leptospira interrogans serovar lai str. 56601
uagcaaauaacgauuccauu

SEQ ID NO: 738644 - RNA, 16 nt, Leptospira interrogans serovar lai str. 56601
uagauuacuaugaaaa

SEQ ID NO: 738645 - RNA, 20 nt, Leptospira interrogans serovar lai str. 56601
uagauuaaauuuuuauaaaa

SEQ ID NO: 738646 - RNA, 15 nt, Leptospira interrogans serovar lai str. 56601
uagauuaauuuuuau

SEQ ID NO: 738647 - RNA, 19 nt, Leptospira interrogans serovar lai str. 56601
uagauuaauuuuuauagaa

SEQ ID NO: 738648 - RNA, 14 nt, Leptospira interrogans serovar lai str. 56601
uagauucaauuauu

SEQ ID NO: 738649 - RNA, 18 nt, Leptospira interrogans serovar lai str. 56601
uagauucaauuauuauaa

SEQ ID NO: 738650 - RNA, 17 nt, Leptospira interrogans serovar lai str. 56601
uagauuaguuuaaaaac

SEQ ID NO: 738651 - RNA, 17 nt, Leptospira interrogans serovar lai str. 56601
uagauuauuucaaaaau

SEQ ID NO: 738652 - RNA, 21 nt, Leptospira interrogans serovar lai str. 56601
uagauuauuucaaaaauuuaa

SEQ ID NO: 738653 - RNA, 18 nt, Leptospira interrogans serovar lai str. 56601
uagauugcuuuuuaaaag

SEQ ID NO: 738654 - RNA, 15 nt, Leptospira interrogans serovar lai str. 56601
uagauugauuuaaau

SEQ ID NO: 738655 - RNA, 17 nt, Leptospira interrogans serovar lai str. 56601
uagauuuagauucuaaa

SEQ ID NO: 738656 - RNA, 19 nt, Leptospira interrogans serovar lai str. 56601
uagauuuagauucuaaaaa

SEQ ID NO: 738657 - RNA, 15 nt, Leptospira interrogans serovar lai str. 56601
uagauuuauugaaaa

SEQ ID NO: 738658 - RNA, 17 nt, Leptospira interrogans serovar lai str. 56601
uagauuuauugaaaaau

SEQ ID NO: 738659 - RNA, 18 nt, Leptospira interrogans serovar lai str. 56601
uagauuuguguuaguucc

SEQ ID NO: 738660 - RNA, 20 nt, Leptospira interrogans serovar lai str. 56601
uagauuuguguuaguuccca

SEQ ID NO: 738661 - RNA, 20 nt, Leptospira interrogans serovar lai str. 56601
uagauggagaauucauuuuu

SEQ ID NO: 738662 - RNA, 21 nt, Leptospira interrogans serovar lai str. 56601
uagaucuuuuauaauguuuga

SEQ ID NO: 738663 - RNA, 16 nt, Leptospira interrogans serovar lai str. 56601
uagaaaaccauuuugu

SEQ ID NO: 738664 - RNA, 22 nt, Leptospira interrogans serovar lai str. 56601
uagaaaagacuuuuuauggauu

SEQ ID NO: 738665 - RNA, 15 nt, Leptospira interrogans serovar lai str. 56601
uaugaaauuuuucaa

SEQ ID NO: 738666 - RNA, 15 nt, Leptospira interrogans serovar lai str. 56601
uaugaaaguuuuuca

SEQ ID NO: 738667 - RNA, 11 nt, Leptospira interrogans serovar lai str. 56601
uaugaaaaaau

SEQ ID NO: 738668 - RNA, 17 nt, Leptospira interrogans serovar lai str. 56601
uaugaaaauucuuucca

SEQ ID NO: 738669 - RNA, 16 nt, Leptospira interrogans serovar lai str. 56601
uaugaaaauucuuucu

SEQ ID NO: 738670 - RNA, 14 nt, Leptospira interrogans serovar lai str. 56601
uaugaaaauuuaau

SEQ ID NO: 738671 - RNA, 18 nt, Leptospira interrogans serovar lai str. 56601
uaucuuuuuuaaaacauc

SEQ ID NO: 738672 - RNA, 17 nt, Leptospira interrogans serovar lai str. 56601
uaugaagacgcuuaaaa

SEQ ID NO: 738673 - RNA, 19 nt, Leptospira interrogans serovar lai str. 56601
uaugaagacgcuuaaaaau

SEQ ID NO: 738674 - RNA, 20 nt, Leptospira interrogans serovar lai str. 56601
uaugaagacgcuuaaaaaug

SEQ ID NO: 738675 - RNA, 20 nt, Leptospira interrogans serovar lai str. 56601
uaugaaguaaguuauaacgu

SEQ ID NO: 738676 - RNA, 17 nt, Leptospira interrogans serovar lai str. 56601
uaugaaguaugaaguaa

SEQ ID NO: 738677 - RNA, 13 nt, Leptospira interrogans serovar lai str. 56601
uaugaauaaaaaa

SEQ ID NO: 738678 - RNA, 15 nt, Leptospira interrogans serovar lai str. 56601
uaugaauaaaaaauu

SEQ ID NO: 738679 - RNA, 20 nt, Leptospira interrogans serovar lai str. 56601
uaugaaucagccauuaaauu

SEQ ID NO: 738680 - RNA, 20 nt, Leptospira interrogans serovar lai str. 56601
uaugaacucuuacaauuuca

SEQ ID NO: 738681 - RNA, 12 nt, Leptospira interrogans serovar lai str. 56601
uaucuuuaauug

SEQ ID NO: 738682 - RNA, 15 nt, Leptospira interrogans serovar lai str. 56601
uaucuuguuucuguu

SEQ ID NO: 738683 - RNA, 13 nt, Leptospira interrogans serovar lai str. 56601
uaucuuuauaaaa

SEQ ID NO: 738684 - RNA, 13 nt, Leptospira interrogans serovar lai str. 56601
uaucuucuaauua

SEQ ID NO: 738685 - RNA, 19 nt, Leptospira interrogans serovar lai str. 56601
uaugcaaauacaacuuuuu

SEQ ID NO: 738686 - RNA, 15 nt, Leptospira interrogans serovar lai str. 56601
uaugcaguugugauc

SEQ ID NO: 738687 - RNA, 22 nt, Leptospira interrogans serovar lai str. 56601
uaugcaugaauuuguuuuucuu

SEQ ID NO: 738688 - RNA, 15 nt, Leptospira interrogans serovar lai str. 56601
uaugacccaagauuc

SEQ ID NO: 738689 - RNA, 22 nt, Leptospira interrogans serovar lai str. 56601
uaugaauucauuguaagaaaua

SEQ ID NO: 738690 - RNA, 15 nt, Leptospira interrogans serovar lai str. 56601
uaugaauuuuuaaac

SEQ ID NO: 738691 - RNA, 14 nt, Leptospira interrogans serovar lai str. 56601
uaugaguucccaca

SEQ ID NO: 738692 - RNA, 20 nt, Leptospira interrogans serovar lai str. 56601
uaugagucccuacaauuuua

SEQ ID NO: 738693 - RNA, 17 nt, Leptospira interrogans serovar lai str. 56601
uaugacuuaaucugugg

SEQ ID NO: 738694 - RNA, 18 nt, Leptospira interrogans serovar lai str. 56601
uaugauaaguaauuugug

SEQ ID NO: 738695 - RNA, 18 nt, Leptospira interrogans serovar lai str. 56601
uauggcgccccaaccaga

SEQ ID NO: 738696 - RNA, 19 nt, Leptospira interrogans serovar lai str. 56601
uauggcaaucggaaauaua

SEQ ID NO: 738697 - RNA, 14 nt, Leptospira interrogans serovar lai str. 56601
uauggaaauuucau

SEQ ID NO: 738698 - RNA, 13 nt, Leptospira interrogans serovar lai str. 56601
uauggacagaauc

SEQ ID NO: 738699 - RNA, 16 nt, Leptospira interrogans serovar lai str. 56601
uaugccccauucuuuu

SEQ ID NO: 738700 - RNA, 18 nt, Leptospira interrogans serovar lai str. 56601
uaugcuauuuaauuuugu

SEQ ID NO: 738701 - RNA, 13 nt, Leptospira interrogans serovar lai str. 56601
uaugcgaaauucc

SEQ ID NO: 738702 - RNA, 23 nt, Leptospira interrogans serovar lai str. 56601
uauguaguuuugaguaguagaaa

SEQ ID NO: 738703 - RNA, 14 nt, Leptospira interrogans serovar lai str. 56601
uauguagaaauuug

SEQ ID NO: 738704 - RNA, 16 nt, Leptospira interrogans serovar lai str. 56601
uauguaauauuucuuu

SEQ ID NO: 738705 - RNA, 21 nt, Leptospira interrogans serovar lai str. 56601
uauguaauauuucuuucgauu

SEQ ID NO: 738706 - RNA, 23 nt, Leptospira interrogans serovar lai str. 56601
uauguaacaaucuuauuuaguuu

SEQ ID NO: 738707 - RNA, 12 nt, Leptospira interrogans serovar lai str. 56601
uauguauuuuaa

SEQ ID NO: 738708 - RNA, 19 nt, Leptospira interrogans serovar lai str. 56601
uauguauuccaugguuuuu

SEQ ID NO: 738709 - RNA, 14 nt, Leptospira interrogans serovar lai str. 56601
uaugguaaggagcu

SEQ ID NO: 738710 - RNA, 17 nt, Leptospira interrogans serovar lai str. 56601
uauguggaugauaaaaa

SEQ ID NO: 738711 - RNA, 18 nt, Leptospira interrogans serovar lai str. 56601
uauguggaugauaaaaaa

SEQ ID NO: 738712 - RNA, 19 nt, Leptospira interrogans serovar lai str. 56601
uaugugacuuaaucugugg

SEQ ID NO: 738713 - RNA, 22 nt, Leptospira interrogans serovar lai str. 56601
uauguuauauauuuuuaauuug

SEQ ID NO: 738714 - RNA, 16 nt, Leptospira interrogans serovar lai str. 56601
uauuaaaaauaucuaa

SEQ ID NO: 738715 - RNA, 20 nt, Leptospira interrogans serovar lai str. 56601
uauguuuuuggguuuuacua

SEQ ID NO: 738716 - RNA, 14 nt, Leptospira interrogans serovar lai str. 56601
uauuaaaaaaauaa

SEQ ID NO: 738717 - RNA, 16 nt, Leptospira interrogans serovar lai str. 56601
uauguuuuucggaauc

SEQ ID NO: 738718 - RNA, 18 nt, Leptospira interrogans serovar lai str. 56601
uauuaaaaaguuuucuca

SEQ ID NO: 738719 - RNA, 11 nt, Leptospira interrogans serovar lai str. 56601
uauuaaaaaua

SEQ ID NO: 738720 - RNA, 23 nt, Leptospira interrogans serovar lai str. 56601
uauguucguucccacaaauuaag

SEQ ID NO: 738721 - RNA, 20 nt, Leptospira interrogans serovar lai str. 56601
uauguuuacuugaaaauaaa

SEQ ID NO: 738722 - RNA, 23 nt, Leptospira interrogans serovar lai str. 56601
uauguuuacuugaaaauaaaaau

SEQ ID NO: 738723 - RNA, 17 nt, Leptospira interrogans serovar lai str. 56601
uauguuucaguauucua

SEQ ID NO: 738724 - RNA, 21 nt, Leptospira interrogans serovar lai str. 56601
uauguuucaguauucuagaau

SEQ ID NO: 738725 - RNA, 14 nt, Leptospira interrogans serovar lai str. 56601
uauguuucuugugu

SEQ ID NO: 738726 - RNA, 22 nt, Leptospira interrogans serovar lai str. 56601
uauguuucuugugucaagcccu

SEQ ID NO: 738727 - RNA, 21 nt, Leptospira interrogans serovar lai str. 56601
uaucuauugaguuauaaacau

SEQ ID NO: 738728 - RNA, 22 nt, Leptospira interrogans serovar lai str. 56601
uaucuauugaguuauaaacauu

SEQ ID NO: 738729 - RNA, 12 nt, Leptospira interrogans serovar lai str. 56601
uaucuaaaaguu

SEQ ID NO: 738730 - RNA, 13 nt, Leptospira interrogans serovar lai str. 56601
uaucucaaaaaua

SEQ ID NO: 738731 - RNA, 15 nt, Leptospira interrogans serovar lai str. 56601
uaucucaaaaauacu

SEQ ID NO: 738732 - RNA, 19 nt, Leptospira interrogans serovar lai str. 56601
uaucuauugaaacaaaaau

SEQ ID NO: 738733 - RNA, 14 nt, Leptospira interrogans serovar lai str. 56601
uaucuccaaaauca

SEQ ID NO: 738734 - RNA, 19 nt, Leptospira interrogans serovar lai str. 56601
uaucgugaaacuuuccacu

SEQ ID NO: 738735 - RNA, 21 nt, Leptospira interrogans serovar lai str. 56601
uaucggaaucgaggaaauucu

SEQ ID NO: 738736 - RNA, 21 nt, Leptospira interrogans serovar lai str. 56601
uaucauucuuuccuauaaaag

SEQ ID NO: 738737 - RNA, 22 nt, Leptospira interrogans serovar lai str. 56601
uaucauucuuuccuauaaaagu

SEQ ID NO: 738738 - RNA, 18 nt, Leptospira interrogans serovar lai str. 56601
uaucagaucuauuucuua

SEQ ID NO: 738739 - RNA, 16 nt, Leptospira interrogans serovar lai str. 56601
uaucagauguuuuaaa

SEQ ID NO: 738740 - RNA, 18 nt, Leptospira interrogans serovar lai str. 56601
uaucagauguuuuaaaag

SEQ ID NO: 738741 - RNA, 15 nt, Leptospira interrogans serovar lai str. 56601
uauccaaaacucuac

SEQ ID NO: 738742 - RNA, 15 nt, Leptospira interrogans serovar lai str. 56601
uauccaauugaauau

SEQ ID NO: 738743 - RNA, 20 nt, Leptospira interrogans serovar lai str. 56601
uauccaauugaauauaaaau

SEQ ID NO: 738744 - RNA, 13 nt, Leptospira interrogans serovar lai str. 56601
uaucccaauaagg

SEQ ID NO: 738745 - RNA, 22 nt, Leptospira interrogans serovar lai str. 56601
uauccauucggacgauuucuau

SEQ ID NO: 738746 - RNA, 16 nt, Leptospira interrogans serovar lai str. 56601
uauccacuaaaauacu

SEQ ID NO: 738747 - RNA, 19 nt, Leptospira interrogans serovar lai str. 56601
uauccauaaauucuacaaa

SEQ ID NO: 738748 - RNA, 14 nt, Leptospira interrogans serovar lai str. 56601
uauccguaaaaccu

SEQ ID NO: 738749 - RNA, 13 nt, Leptospira interrogans serovar lai str. 56601
uauauauugaaau

SEQ ID NO: 738750 - RNA, 15 nt, Leptospira interrogans serovar lai str. 56601
uauauauugaaauau

SEQ ID NO: 738751 - RNA, 23 nt, Leptospira interrogans serovar lai str. 56601
uauauaaauucgccguaaaaaau

SEQ ID NO: 738752 - RNA, 22 nt, Leptospira interrogans serovar lai str. 56601
uauauaaccaugaauaaacaau

SEQ ID NO: 738753 - RNA, 14 nt, Leptospira interrogans serovar lai str. 56601
uauauaaguauuau

SEQ ID NO: 738754 - RNA, 19 nt, Leptospira interrogans serovar lai str. 56601
uauauaaucugauugagaa

SEQ ID NO: 738755 - RNA, 15 nt, Leptospira interrogans serovar lai str. 56601
uauauaaaaaaugua

SEQ ID NO: 738756 - RNA, 13 nt, Leptospira interrogans serovar lai str. 56601
uauauaaaauuug

SEQ ID NO: 738757 - RNA, 22 nt, Leptospira interrogans serovar lai str. 56601
uauagucaaauuuggaaauugu

SEQ ID NO: 738758 - RNA, 16 nt, Leptospira interrogans serovar lai str. 56601
uauaguagauauuagu

SEQ ID NO: 738759 - RNA, 16 nt, Leptospira interrogans serovar lai str. 56601
uauaguuccuacaauu

SEQ ID NO: 738760 - RNA, 17 nt, Leptospira interrogans serovar lai str. 56601
uauaaucaaauacaaaa

SEQ ID NO: 738761 - RNA, 18 nt, Leptospira interrogans serovar lai str. 56601
uauaaucaaauacaaaaa

SEQ ID NO: 738762 - RNA, 16 nt, Leptospira interrogans serovar lai str. 56601
uauaauccuuuuacuu

SEQ ID NO: 738763 - RNA, 19 nt, Leptospira interrogans serovar lai str. 56601
uauaaucgaauuuccauuu

SEQ ID NO: 738764 - RNA, 23 nt, Leptospira interrogans serovar lai str. 56601
uauaaucgaauuuccauuucuga

SEQ ID NO: 738765 - RNA, 16 nt, Leptospira interrogans serovar lai str. 56601
uauaaucuuaauauuu

SEQ ID NO: 738766 - RNA, 16 nt, Leptospira interrogans serovar lai str. 56601
uauaguaaaagaaaau

SEQ ID NO: 738767 - RNA, 20 nt, Leptospira interrogans serovar lai str. 56601
uauaguaacagaaaaauguu

SEQ ID NO: 738768 - RNA, 16 nt, Leptospira interrogans serovar lai str. 56601
uauauuucauugaaau

SEQ ID NO: 738769 - RNA, 12 nt, Leptospira interrogans serovar lai str. 56601
uauauuuuuaau

SEQ ID NO: 738770 - RNA, 21 nt, Leptospira interrogans serovar lai str. 56601
uauauuuucaggcauagaauc

SEQ ID NO: 738771 - RNA, 14 nt, Leptospira interrogans serovar lai str. 56601
uauauuuuuaaagc

SEQ ID NO: 738772 - RNA, 15 nt, Leptospira interrogans serovar lai str. 56601
uaucaaaauuuaaau

SEQ ID NO: 738773 - RNA, 17 nt, Leptospira interrogans serovar lai str. 56601
uaucaccguaauucuua

SEQ ID NO: 738774 - RNA, 18 nt, Leptospira interrogans serovar lai str. 56601
uaucacgaaaauuaaaaa

SEQ ID NO: 738775 - RNA, 20 nt, Leptospira interrogans serovar lai str. 56601
uaucacgaaaauuaaaaaau

SEQ ID NO: 738776 - RNA, 12 nt, Leptospira interrogans serovar lai str. 56601
uaucagaaaaac

SEQ ID NO: 738777 - RNA, 14 nt, Leptospira interrogans serovar lai str. 56601
uaucagaaaaacau

SEQ ID NO: 738778 - RNA, 15 nt, Leptospira interrogans serovar lai str. 56601
uaucagaaaaacaua

SEQ ID NO: 738779 - RNA, 19 nt, Leptospira interrogans serovar lai str. 56601
uaucagaaaaacauacuuu

SEQ ID NO: 738780 - RNA, 14 nt, Leptospira interrogans serovar lai str. 56601
uaucaacuuuugga

SEQ ID NO: 738781 - RNA, 22 nt, Leptospira interrogans serovar lai str. 56601
uaucaacaagaaugaaaaaacu

SEQ ID NO: 738782 - RNA, 15 nt, Leptospira interrogans serovar lai str. 56601
uaucaaaugugagag

SEQ ID NO: 738783 - RNA, 14 nt, Leptospira interrogans serovar lai str. 56601
ucagcauaaguauu

SEQ ID NO: 738784 - RNA, 22 nt, Leptospira interrogans serovar lai str. 56601
ucagagcgauauaauaaaaucc

SEQ ID NO: 738785 - RNA, 16 nt, Leptospira interrogans serovar lai str. 56601
ucagacuuugaaugca

SEQ ID NO: 738786 - RNA, 18 nt, Leptospira interrogans serovar lai str. 56601
ucagacuuugaaugcaac

SEQ ID NO: 738787 - RNA, 16 nt, Leptospira interrogans serovar lai str. 56601
ucagagucuauuuaau

SEQ ID NO: 738788 - RNA, 21 nt, Leptospira interrogans serovar lai str. 56601
ucagauuuuauuuugauucca

SEQ ID NO: 738789 - RNA, 20 nt, Leptospira interrogans serovar lai str. 56601
ucagauuuuugcacaaaauc

SEQ ID NO: 738790 - RNA, 13 nt, Leptospira interrogans serovar lai str. 56601
ucagauuccaacu

SEQ ID NO: 738791 - RNA, 19 nt, Leptospira interrogans serovar lai str. 56601
ucagauuccguuuuuauuu

SEQ ID NO: 738792 - RNA, 17 nt, Leptospira interrogans serovar lai str. 56601
ucagauugauacugcau

SEQ ID NO: 738793 - RNA, 19 nt, Leptospira interrogans serovar lai str. 56601
ucagauguuuuaaaaguuu

SEQ ID NO: 738794 - RNA, 15 nt, Leptospira interrogans serovar lai str. 56601
ucagaugaaaguuug

SEQ ID NO: 738795 - RNA, 17 nt, Leptospira interrogans serovar lai str. 56601
ucagaugaauugaauuu

SEQ ID NO: 738796 - RNA, 22 nt, Leptospira interrogans serovar lai str. 56601
ucagauauuuucgccgaaacau

SEQ ID NO: 738797 - RNA, 15 nt, Leptospira interrogans serovar lai str. 56601
ucagaagucuuucua

SEQ ID NO: 738798 - RNA, 16 nt, Leptospira interrogans serovar lai str. 56601
ucagaagucuuucuac

SEQ ID NO: 738799 - RNA, 18 nt, Leptospira interrogans serovar lai str. 56601
ucagaauagauucuuaau

SEQ ID NO: 738800 - RNA, 19 nt, Leptospira interrogans serovar lai str. 56601
ucagaauagauucuuaaug

SEQ ID NO: 738801 - RNA, 18 nt, Leptospira interrogans serovar lai str. 56601
ucagaaucaaaggaaaua

SEQ ID NO: 738802 - RNA, 13 nt, Leptospira interrogans serovar lai str. 56601
ucagaaaacucag

SEQ ID NO: 738803 - RNA, 16 nt, Leptospira interrogans serovar lai str. 56601
ucagaaaaaaaaagaa

SEQ ID NO: 738804 - RNA, 17 nt, Leptospira interrogans serovar lai str. 56601
ucagaaaaacauacuuu

SEQ ID NO: 738805 - RNA, 16 nt, Leptospira interrogans serovar lai str. 56601
ucacuuuuuuaaagug

SEQ ID NO: 738806 - RNA, 16 nt, Leptospira interrogans serovar lai str. 56601
ucagaauuucuuucuc

SEQ ID NO: 738807 - RNA, 23 nt, Leptospira interrogans serovar lai str. 56601
ucagaauggcaaaacgauauuuu

SEQ ID NO: 738808 - RNA, 15 nt, Leptospira interrogans serovar lai str. 56601
ucagaauuaaaaauu

SEQ ID NO: 738809 - RNA, 13 nt, Leptospira interrogans serovar lai str. 56601
ucacuauuuuuau

SEQ ID NO: 738810 - RNA, 21 nt, Leptospira interrogans serovar lai str. 56601
ucacucaaaauacuuuuaauu

SEQ ID NO: 738811 - RNA, 16 nt, Leptospira interrogans serovar lai str. 56601
ucacuccgauacauuu

SEQ ID NO: 738812 - RNA, 16 nt, Leptospira interrogans serovar lai str. 56601
ucacuaccuuauaaaa

SEQ ID NO: 738813 - RNA, 18 nt, Leptospira interrogans serovar lai str. 56601
ucacuaccuuauaaaaau

SEQ ID NO: 738814 - RNA, 15 nt, Leptospira interrogans serovar lai str. 56601
ucacguuaaaaguaa

SEQ ID NO: 738815 - RNA, 16 nt, Leptospira interrogans serovar lai str. 56601
ucacguuaaaaguaau

SEQ ID NO: 738816 - RNA, 18 nt, Leptospira interrogans serovar lai str. 56601
ucacguuauauuaaucuu

SEQ ID NO: 738817 - RNA, 16 nt, Leptospira interrogans serovar lai str. 56601
ucacguaaaacuucuu

SEQ ID NO: 738818 - RNA, 24 nt, Leptospira interrogans serovar lai str. 56601
ucacguuggauuaugcaguauuuu

SEQ ID NO: 738819 - RNA, 21 nt, Leptospira interrogans serovar lai str. 56601
ucacguugaaguagucauaua

SEQ ID NO: 738820 - RNA, 15 nt, Leptospira interrogans serovar lai str. 56601
ucacuuuacaaauuu

SEQ ID NO: 738821 - RNA, 16 nt, Leptospira interrogans serovar lai str. 56601
ucacugaaaauuuaau

SEQ ID NO: 738822 - RNA, 18 nt, Leptospira interrogans serovar lai str. 56601
ucacgaaaauuaaaaaau

SEQ ID NO: 738823 - RNA, 16 nt, Leptospira interrogans serovar lai str. 56601
ucaccuuccaaagauu

SEQ ID NO: 738824 - RNA, 15 nt, Leptospira interrogans serovar lai str. 56601
ucaccucuauaaaau

SEQ ID NO: 738825 - RNA, 19 nt, Leptospira interrogans serovar lai str. 56601
ucaccguuuauucuccauu

SEQ ID NO: 738826 - RNA, 18 nt, Leptospira interrogans serovar lai str. 56601
ucacccaccaaaaauagg

SEQ ID NO: 738827 - RNA, 22 nt, Leptospira interrogans serovar lai str. 56601
ucaccaaccccacaaguuaaua

SEQ ID NO: 738828 - RNA, 15 nt, Leptospira interrogans serovar lai str. 56601
ucaccaacaacacca

SEQ ID NO: 738829 - RNA, 21 nt, Leptospira interrogans serovar lai str. 56601
ucaccaacaacaccaccaaca

SEQ ID NO: 738830 - RNA, 22 nt, Leptospira interrogans serovar lai str. 56601
ucaccaacaacaccaccaacag

SEQ ID NO: 738831 - RNA, 15 nt, Leptospira interrogans serovar lai str. 56601
ucacauuaaaauagg

SEQ ID NO: 738832 - RNA, 19 nt, Leptospira interrogans serovar lai str. 56601
ucacauuguguuuuuuaac

SEQ ID NO: 738833 - RNA, 17 nt, Leptospira interrogans serovar lai str. 56601
ucacauuugauaauucg

SEQ ID NO: 738834 - RNA, 14 nt, Leptospira interrogans serovar lai str. 56601
ucacauaaccaacc

SEQ ID NO: 738835 - RNA, 19 nt, Leptospira interrogans serovar lai str. 56601
ucacauccaacccaaacac

SEQ ID NO: 738836 - RNA, 20 nt, Leptospira interrogans serovar lai str. 56601
ucacauccaacccaaacaca

SEQ ID NO: 738837 - RNA, 20 nt, Leptospira interrogans serovar lai str. 56601
ucacaauuuuacaaacaaau

SEQ ID NO: 738838 - RNA, 18 nt, Leptospira interrogans serovar lai str. 56601
ucacaaguuaaauuggua

SEQ ID NO: 738839 - RNA, 19 nt, Leptospira interrogans serovar lai str. 56601
ucacaaauugcaaaauacg

SEQ ID NO: 738840 - RNA, 20 nt, Leptospira interrogans serovar lai str. 56601
ucacaaauugucaaaugcaa

SEQ ID NO: 738841 - RNA, 21 nt, Leptospira interrogans serovar lai str. 56601
ucacagacuucuuuuggcauu

SEQ ID NO: 738842 - RNA, 20 nt, Leptospira interrogans serovar lai str. 56601
ucaaugguugcaaaaaagaa

SEQ ID NO: 738843 - RNA, 17 nt, Leptospira interrogans serovar lai str. 56601
ucaauguuauaaaaugu

SEQ ID NO: 738844 - RNA, 17 nt, Leptospira interrogans serovar lai str. 56601
ucaauggaaaauuaauu

SEQ ID NO: 738845 - RNA, 16 nt, Leptospira interrogans serovar lai str. 56601
ucaaucucuuucucau

SEQ ID NO: 738846 - RNA, 13 nt, Leptospira interrogans serovar lai str. 56601
ucaaucauauuuu

SEQ ID NO: 738847 - RNA, 14 nt, Leptospira interrogans serovar lai str. 56601
ucaaucaguaaaau

SEQ ID NO: 738848 - RNA, 16 nt, Leptospira interrogans serovar lai str. 56601
ucaaucaguaaaaugu

SEQ ID NO: 738849 - RNA, 17 nt, Leptospira interrogans serovar lai str. 56601
ucaauccuguaaauuca

SEQ ID NO: 738850 - RNA, 19 nt, Leptospira interrogans serovar lai str. 56601
ucaauccuguaaauucaaa

SEQ ID NO: 738851 - RNA, 15 nt, Leptospira interrogans serovar lai str. 56601
ucaauuacuuucgua

SEQ ID NO: 738852 - RNA, 15 nt, Leptospira interrogans serovar lai str. 56601
ucaauuaucaaagca

SEQ ID NO: 738853 - RNA, 20 nt, Leptospira interrogans serovar lai str. 56601
ucaauguugcuccuugcugu

SEQ ID NO: 738854 - RNA, 19 nt, Leptospira interrogans serovar lai str. 56601
ucaauuaaauuguaugaaa

SEQ ID NO: 738855 - RNA, 16 nt, Leptospira interrogans serovar lai str. 56601
ucaauucuucuuucgu

SEQ ID NO: 738856 - RNA, 14 nt, Leptospira interrogans serovar lai str. 56601
ucaauucaguaaau

SEQ ID NO: 738857 - RNA, 19 nt, Leptospira interrogans serovar lai str. 56601
ucaauuguccauuucaaug

SEQ ID NO: 738858 - RNA, 19 nt, Leptospira interrogans serovar lai str. 56601
ucaauuguccguuucaaua

SEQ ID NO: 738859 - RNA, 19 nt, Leptospira interrogans serovar lai str. 56601
ucaauucugaaaauguaaa

SEQ ID NO: 738860 - RNA, 13 nt, Leptospira interrogans serovar lai str. 56601
ucaauugaaagua

SEQ ID NO: 738861 - RNA, 10 nt, Leptospira interrogans serovar lai str. 56601
ucaauugauu

SEQ ID NO: 738862 - RNA, 12 nt, Leptospira interrogans serovar lai str. 56601
ucaauuuagaac

SEQ ID NO: 738863 - RNA, 15 nt, Leptospira interrogans serovar lai str. 56601
ucaauuuagaacgca

SEQ ID NO: 738864 - RNA, 14 nt, Leptospira interrogans serovar lai str. 56601
ucaauuucuuuaau

SEQ ID NO: 738865 - RNA, 16 nt, Leptospira interrogans serovar lai str. 56601
ucaauuucuuuaauuu

SEQ ID NO: 738866 - RNA, 19 nt, Leptospira interrogans serovar lai str. 56601
ucaauuucuuuaauuucaa

SEQ ID NO: 738867 - RNA, 20 nt, Leptospira interrogans serovar lai str. 56601
ucaauuuuagaauaaaucuu

SEQ ID NO: 738868 - RNA, 21 nt, Leptospira interrogans serovar lai str. 56601
ucaauuuuagaauaaaucuuc

SEQ ID NO: 738869 - RNA, 16 nt, Leptospira interrogans serovar lai str. 56601
ucaauuuuaguaaacu

SEQ ID NO: 738870 - RNA, 17 nt, Leptospira interrogans serovar lai str. 56601
ucaauuuuccauuucaa

SEQ ID NO: 738871 - RNA, 18 nt, Leptospira interrogans serovar lai str. 56601
ucaauuuuccauuucaau

SEQ ID NO: 738872 - RNA, 19 nt, Leptospira interrogans serovar lai str. 56601
ucaauuuuccauuucaaua

SEQ ID NO: 738873 - RNA, 22 nt, Leptospira interrogans serovar lai str. 56601
ucaauuuucuuucuaaaugagu

SEQ ID NO: 738874 - RNA, 20 nt, Leptospira interrogans serovar lai str. 56601
ucaauuuugaagacuauaaa

SEQ ID NO: 738875 - RNA, 20 nt, Leptospira interrogans serovar lai str. 56601
ucaauuuuaccaaaaaugca

SEQ ID NO: 738876 - RNA, 12 nt, Leptospira interrogans serovar lai str. 56601
ucaauuuaucau

SEQ ID NO: 738877 - RNA, 17 nt, Leptospira interrogans serovar lai str. 56601
ucaauuuuuauaaacuu

SEQ ID NO: 738878 - RNA, 15 nt, Leptospira interrogans serovar lai str. 56601
ucacaaaaaaauuca

SEQ ID NO: 738879 - RNA, 15 nt, Leptospira interrogans serovar lai str. 56601
ucacaaaaaagauaa

SEQ ID NO: 738880 - RNA, 18 nt, Leptospira interrogans serovar lai str. 56601
ucacaaaaaugaaaaaac

SEQ ID NO: 738881 - RNA, 21 nt, Leptospira interrogans serovar lai str. 56601
ucacaaacgguuuuaguaaaa

SEQ ID NO: 738882 - RNA, 11 nt, Leptospira interrogans serovar lai str. 56601
ucaauaaauug

SEQ ID NO: 738883 - RNA, 22 nt, Leptospira interrogans serovar lai str. 56601
ucaauaaauuaguaauuuaaua

SEQ ID NO: 738884 - RNA, 13 nt, Leptospira interrogans serovar lai str. 56601
ucaauaaauugaa

SEQ ID NO: 738885 - RNA, 17 nt, Leptospira interrogans serovar lai str. 56601
ucaauaaauugaaagua

SEQ ID NO: 738886 - RNA, 18 nt, Leptospira interrogans serovar lai str. 56601
ucaaguuuaggcuugauu

SEQ ID NO: 738887 - RNA, 13 nt, Leptospira interrogans serovar lai str. 56601
ucaauaaaauacc

SEQ ID NO: 738888 - RNA, 12 nt, Leptospira interrogans serovar lai str. 56601
ucaaguuuucuu

SEQ ID NO: 738889 - RNA, 14 nt, Leptospira interrogans serovar lai str. 56601
ucaaguuugugaga

SEQ ID NO: 738890 - RNA, 22 nt, Leptospira interrogans serovar lai str. 56601
ucaaguuugugagaguucccac

SEQ ID NO: 738891 - RNA, 18 nt, Leptospira interrogans serovar lai str. 56601
ucaaguuaauacaguauu

SEQ ID NO: 738892 - RNA, 19 nt, Leptospira interrogans serovar lai str. 56601
ucaagugauucauucuaag

SEQ ID NO: 738893 - RNA, 21 nt, Leptospira interrogans serovar lai str. 56601
ucaagugcaguaguuccuaca

SEQ ID NO: 738894 - RNA, 19 nt, Leptospira interrogans serovar lai str. 56601
ucaauagaauuguugaaaa

SEQ ID NO: 738895 - RNA, 22 nt, Leptospira interrogans serovar lai str. 56601
ucaauagaauuguugaaaaauu

SEQ ID NO: 738896 - RNA, 16 nt, Leptospira interrogans serovar lai str. 56601
ucaauaauucuauuuu

SEQ ID NO: 738897 - RNA, 16 nt, Leptospira interrogans serovar lai str. 56601
ucaauacaacgaaaau

SEQ ID NO: 738898 - RNA, 20 nt, Leptospira interrogans serovar lai str. 56601
ucaauaccgauuucuauuuu

SEQ ID NO: 738899 - RNA, 13 nt, Leptospira interrogans serovar lai str. 56601
ucaauaacuugac

SEQ ID NO: 738900 - RNA, 14 nt, Leptospira interrogans serovar lai str. 56601
ucaauaaguuuaca

SEQ ID NO: 738901 - RNA, 14 nt, Leptospira interrogans serovar lai str. 56601
ucaauaauccagcu

SEQ ID NO: 738902 - RNA, 20 nt, Leptospira interrogans serovar lai str. 56601
ucaauaauccagcugaaacu

SEQ ID NO: 738903 - RNA, 13 nt, Leptospira interrogans serovar lai str. 56601
ucaaucaaauuuu

SEQ ID NO: 738904 - RNA, 13 nt, Leptospira interrogans serovar lai str. 56601
ucaauauuuaaaa

SEQ ID NO: 738905 - RNA, 16 nt, Leptospira interrogans serovar lai str. 56601
ucaauauuuaaaaauu

SEQ ID NO: 738906 - RNA, 14 nt, Leptospira interrogans serovar lai str. 56601
ucaaucaaaauuuu

SEQ ID NO: 738907 - RNA, 19 nt, Leptospira interrogans serovar lai str. 56601
ucaauagagucguugaaaa

SEQ ID NO: 738908 - RNA, 15 nt, Leptospira interrogans serovar lai str. 56601
ucaauauaaaucugu

SEQ ID NO: 738909 - RNA, 17 nt, Leptospira interrogans serovar lai str. 56601
ucaacagaacgggcuuu

SEQ ID NO: 738910 - RNA, 21 nt, Leptospira interrogans serovar lai str. 56601
ucaacagaacgggcuuucuau

SEQ ID NO: 738911 - RNA, 14 nt, Leptospira interrogans serovar lai str. 56601
ucaacaauucuauu

SEQ ID NO: 738912 - RNA, 22 nt, Leptospira interrogans serovar lai str. 56601
ucaacaauucuauugugggaac

SEQ ID NO: 738913 - RNA, 16 nt, Leptospira interrogans serovar lai str. 56601
ucaacacaaauauuaa

SEQ ID NO: 738914 - RNA, 20 nt, Leptospira interrogans serovar lai str. 56601
ucaacacaaauauuaagaau

SEQ ID NO: 738915 - RNA, 17 nt, Leptospira interrogans serovar lai str. 56601
ucaacagugauuucaug

SEQ ID NO: 738916 - RNA, 22 nt, Leptospira interrogans serovar lai str. 56601
ucaacagugauuucaugcaaaa

SEQ ID NO: 738917 - RNA, 18 nt, Leptospira interrogans serovar lai str. 56601
ucaacaggggcuuugauu

SEQ ID NO: 738918 - RNA, 23 nt, Leptospira interrogans serovar lai str. 56601
ucaacagaucgcguuuuauaaua

SEQ ID NO: 738919 - RNA, 11 nt, Leptospira interrogans serovar lai str. 56601
ucaacagauac

SEQ ID NO: 738920 - RNA, 20 nt, Leptospira interrogans serovar lai str. 56601
ucaacaucucaaucaaaauu

SEQ ID NO: 738921 - RNA, 15 nt, Leptospira interrogans serovar lai str. 56601
ucaacaucacgcaca

SEQ ID NO: 738922 - RNA, 16 nt, Leptospira interrogans serovar lai str. 56601
ucaacaucauucucau

SEQ ID NO: 738923 - RNA, 22 nt, Leptospira interrogans serovar lai str. 56601
ucaaauuuuauguuauauauuu

SEQ ID NO: 738924 - RNA, 18 nt, Leptospira interrogans serovar lai str. 56601
ucaaauuuuugaaucagu

SEQ ID NO: 738925 - RNA, 21 nt, Leptospira interrogans serovar lai str. 56601
ucaacaaacaaauagaaauaa

SEQ ID NO: 738926 - RNA, 21 nt, Leptospira interrogans serovar lai str. 56601
ucaacaaguuuacacauuuau

SEQ ID NO: 738927 - RNA, 13 nt, Leptospira interrogans serovar lai str. 56601
ucaacaacucuaa

SEQ ID NO: 738928 - RNA, 19 nt, Leptospira interrogans serovar lai str. 56601
ucaacaacucuaaugaauu

SEQ ID NO: 738929 - RNA, 16 nt, Leptospira interrogans serovar lai str. 56601
ucaacaacucuauuuu

SEQ ID NO: 738930 - RNA, 17 nt, Leptospira interrogans serovar lai str. 56601
ucaacaacucuauuuua

SEQ ID NO: 738931 - RNA, 19 nt, Leptospira interrogans serovar lai str. 56601
ucaacaacucuauuuuauu

SEQ ID NO: 738932 - RNA, 13 nt, Leptospira interrogans serovar lai str. 56601
ucaaauucuucag

SEQ ID NO: 738933 - RNA, 15 nt, Leptospira interrogans serovar lai str. 56601
ucaaauucuuuuugg

SEQ ID NO: 738934 - RNA, 16 nt, Leptospira interrogans serovar lai str. 56601
ucaaauucaucaauuu

SEQ ID NO: 738935 - RNA, 20 nt, Leptospira interrogans serovar lai str. 56601
ucaaauucaucaauuuugga

SEQ ID NO: 738936 - RNA, 20 nt, Leptospira interrogans serovar lai str. 56601
ucaaauuguaggaguucaua

SEQ ID NO: 738937 - RNA, 22 nt, Leptospira interrogans serovar lai str. 56601
ucaaauuuacucuuauaaaauu

SEQ ID NO: 738938 - RNA, 16 nt, Leptospira interrogans serovar lai str. 56601
ucaaauuuauaugauu

SEQ ID NO: 738939 - RNA, 21 nt, Leptospira interrogans serovar lai str. 56601
ucaaauuugcuucaacacuga

SEQ ID NO: 738940 - RNA, 18 nt, Leptospira interrogans serovar lai str. 56601
ucaaauuuggaaauugug

SEQ ID NO: 738941 - RNA, 18 nt, Leptospira interrogans serovar lai str. 56601
ucaaauuucugaaacaau

SEQ ID NO: 738942 - RNA, 19 nt, Leptospira interrogans serovar lai str. 56601
ucaaauuucugaaacaauc

SEQ ID NO: 738943 - RNA, 17 nt, Leptospira interrogans serovar lai str. 56601
ucaaauuucugcaucaa

SEQ ID NO: 738944 - RNA, 18 nt, Leptospira interrogans serovar lai str. 56601
ucaaaugcgacuuaauuu

SEQ ID NO: 738945 - RNA, 19 nt, Leptospira interrogans serovar lai str. 56601
ucaaaugugagaguuccca

SEQ ID NO: 738946 - RNA, 22 nt, Leptospira interrogans serovar lai str. 56601
ucaaauagaguaccauaaauuu

SEQ ID NO: 738947 - RNA, 12 nt, Leptospira interrogans serovar lai str. 56601
ucaaaucugaaa

SEQ ID NO: 738948 - RNA, 15 nt, Leptospira interrogans serovar lai str. 56601
ucaaaucugaaauuc

SEQ ID NO: 738949 - RNA, 19 nt, Leptospira interrogans serovar lai str. 56601
ucaacgacucguaauuaaa

SEQ ID NO: 738950 - RNA, 14 nt, Leptospira interrogans serovar lai str. 56601
ucaacgauaagaau

SEQ ID NO: 738951 - RNA, 17 nt, Leptospira interrogans serovar lai str. 56601
ucaacggguucuucauu

SEQ ID NO: 738952 - RNA, 22 nt, Leptospira interrogans serovar lai str. 56601
ucaacuaaauccuucuuuucuu

SEQ ID NO: 738953 - RNA, 20 nt, Leptospira interrogans serovar lai str. 56601
ucaagcccucccguuauuuu

SEQ ID NO: 738954 - RNA, 22 nt, Leptospira interrogans serovar lai str. 56601
ucaagauugucuuuauucgcau

SEQ ID NO: 738955 - RNA, 21 nt, Leptospira interrogans serovar lai str. 56601
ucaagauuuaauuuagaaauu

SEQ ID NO: 738956 - RNA, 15 nt, Leptospira interrogans serovar lai str. 56601
ucaacuuguaaaaca

SEQ ID NO: 738957 - RNA, 13 nt, Leptospira interrogans serovar lai str. 56601
ucaacuuuagaaa

SEQ ID NO: 738958 - RNA, 16 nt, Leptospira interrogans serovar lai str. 56601
ucaacuuuagaaaaau

SEQ ID NO: 738959 - RNA, 14 nt, Leptospira interrogans serovar lai str. 56601
ucaacuuuccuuuu

SEQ ID NO: 738960 - RNA, 12 nt, Leptospira interrogans serovar lai str. 56601
ucaacuuuucca

SEQ ID NO: 738961 - RNA, 13 nt, Leptospira interrogans serovar lai str. 56601
ucaacuuuuccag

SEQ ID NO: 738962 - RNA, 15 nt, Leptospira interrogans serovar lai str. 56601
ucaagaagagucaaa

SEQ ID NO: 738963 - RNA, 24 nt, Leptospira interrogans serovar lai str. 56601
ucaagaagagucaaacacucuaaa

SEQ ID NO: 738964 - RNA, 17 nt, Leptospira interrogans serovar lai str. 56601
ucaacuuuuuucagaaa

SEQ ID NO: 738965 - RNA, 18 nt, Leptospira interrogans serovar lai str. 56601
ucaagacaacagaacaaa

SEQ ID NO: 738966 - RNA, 22 nt, Leptospira interrogans serovar lai str. 56601
ucaagaauuuauuuacaaucga

SEQ ID NO: 738967 - RNA, 22 nt, Leptospira interrogans serovar lai str. 56601
ucaagaauuuuagaauauaaua

SEQ ID NO: 738968 - RNA, 14 nt, Leptospira interrogans serovar lai str. 56601
ucaaacucuuuuuc

SEQ ID NO: 738969 - RNA, 15 nt, Leptospira interrogans serovar lai str. 56601
ucaaacucuuuuucu

SEQ ID NO: 738970 - RNA, 16 nt, Leptospira interrogans serovar lai str. 56601
ucaaacucuuuuucuu

SEQ ID NO: 738971 - RNA, 21 nt, Leptospira interrogans serovar lai str. 56601
ucaaacucuuuuucuucugcu

SEQ ID NO: 738972 - RNA, 18 nt, Leptospira interrogans serovar lai str. 56601
ucaaacugagauuugucu

SEQ ID NO: 738973 - RNA, 16 nt, Leptospira interrogans serovar lai str. 56601
ucaaaauugagaauag

SEQ ID NO: 738974 - RNA, 17 nt, Leptospira interrogans serovar lai str. 56601
ucaaaauucuuaaaaaa

SEQ ID NO: 738975 - RNA, 16 nt, Leptospira interrogans serovar lai str. 56601
ucaaaauuuuuuuaag

SEQ ID NO: 738976 - RNA, 12 nt, Leptospira interrogans serovar lai str. 56601
ucaaaauuuaaa

SEQ ID NO: 738977 - RNA, 16 nt, Leptospira interrogans serovar lai str. 56601
ucaaaauuugauccuc

SEQ ID NO: 738978 - RNA, 18 nt, Leptospira interrogans serovar lai str. 56601
ucaaaauuuaucuguaaa

SEQ ID NO: 738979 - RNA, 21 nt, Leptospira interrogans serovar lai str. 56601
ucaaaauuuaucuguaaaauu

SEQ ID NO: 738980 - RNA, 14 nt, Leptospira interrogans serovar lai str. 56601
ucaaaauuaagaau

SEQ ID NO: 738981 - RNA, 16 nt, Leptospira interrogans serovar lai str. 56601
ucaaacacucuaaauc

SEQ ID NO: 738982 - RNA, 18 nt, Leptospira interrogans serovar lai str. 56601
ucaaacacucuaaaucuu

SEQ ID NO: 738983 - RNA, 16 nt, Leptospira interrogans serovar lai str. 56601
ucaaacaacaaaaaau

SEQ ID NO: 738984 - RNA, 17 nt, Leptospira interrogans serovar lai str. 56601
ucaaacaacaaaaaaua

SEQ ID NO: 738985 - RNA, 20 nt, Leptospira interrogans serovar lai str. 56601
ucaaaaugaacaaugaauuu

SEQ ID NO: 738986 - RNA, 15 nt, Leptospira interrogans serovar lai str. 56601
ucaaaaugaacucaa

SEQ ID NO: 738987 - RNA, 15 nt, Leptospira interrogans serovar lai str. 56601
ucaaaaucuuaauaa

SEQ ID NO: 738988 - RNA, 23 nt, Leptospira interrogans serovar lai str. 56601
ucaaaauacuuuuaauuuugcca

SEQ ID NO: 738989 - RNA, 12 nt, Leptospira interrogans serovar lai str. 56601
ucaaaauagaau

SEQ ID NO: 738990 - RNA, 18 nt, Leptospira interrogans serovar lai str. 56601
ucaaaauagaauaaauua

SEQ ID NO: 738991 - RNA, 21 nt, Leptospira interrogans serovar lai str. 56601
ucaaaauagaauaaauuauac

SEQ ID NO: 738992 - RNA, 18 nt, Leptospira interrogans serovar lai str. 56601
ucaaaauaguaccagaau

SEQ ID NO: 738993 - RNA, 22 nt, Leptospira interrogans serovar lai str. 56601
ucaaaauauuuaguauuuuauu

SEQ ID NO: 738994 - RNA, 15 nt, Leptospira interrogans serovar lai str. 56601
ucaaagauaaaauau

SEQ ID NO: 738995 - RNA, 21 nt, Leptospira interrogans serovar lai str. 56601
ucaaagauauuucaauauaaa

SEQ ID NO: 738996 - RNA, 15 nt, Leptospira interrogans serovar lai str. 56601
ucaaagauuacauaa

SEQ ID NO: 738997 - RNA, 13 nt, Leptospira interrogans serovar lai str. 56601
ucaaagcaagaaa

SEQ ID NO: 738998 - RNA, 14 nt, Leptospira interrogans serovar lai str. 56601
ucaaagaaucauuu

SEQ ID NO: 738999 - RNA, 21 nt, Leptospira interrogans serovar lai str. 56601
ucaaacuuuucggaacaagau

SEQ ID NO: 739000 - RNA, 20 nt, Leptospira interrogans serovar lai str. 56601
ucaaacuugcaauuuuacuu

SEQ ID NO: 739001 - RNA, 13 nt, Leptospira interrogans serovar lai str. 56601
ucaaacuuauaac

SEQ ID NO: 739002 - RNA, 23 nt, Leptospira interrogans serovar lai str. 56601
ucaaagcuauaguuuuuaacagu

SEQ ID NO: 739003 - RNA, 17 nt, Leptospira interrogans serovar lai str. 56601
ucaaaggaaauaaaaau

SEQ ID NO: 739004 - RNA, 14 nt, Leptospira interrogans serovar lai str. 56601
ucaaaggaaaauga

SEQ ID NO: 739005 - RNA, 15 nt, Leptospira interrogans serovar lai str. 56601
ucaaaggaaaaugaa

SEQ ID NO: 739006 - RNA, 21 nt, Leptospira interrogans serovar lai str. 56601
ucaaaggaaaaugaagaaaca

SEQ ID NO: 739007 - RNA, 15 nt, Leptospira interrogans serovar lai str. 56601
ucaaaggccgcuucu

SEQ ID NO: 739008 - RNA, 22 nt, Leptospira interrogans serovar lai str. 56601
ucaaaggccgcuucuuuauuuu

SEQ ID NO: 739009 - RNA, 13 nt, Leptospira interrogans serovar lai str. 56601
ucaaauacaaaaa

SEQ ID NO: 739010 - RNA, 15 nt, Leptospira interrogans serovar lai str. 56601
ucaaauaaagaaaag

SEQ ID NO: 739011 - RNA, 18 nt, Leptospira interrogans serovar lai str. 56601
ucaaauaaagaaaaggaa

SEQ ID NO: 739012 - RNA, 20 nt, Leptospira interrogans serovar lai str. 56601
ucaaauaacauuuuuucaua

SEQ ID NO: 739013 - RNA, 22 nt, Leptospira interrogans serovar lai str. 56601
ucaaauaagcgcggauuuauuu

SEQ ID NO: 739014 - RNA, 21 nt, Leptospira interrogans serovar lai str. 56601
uauuuuccguaccccaaagau

SEQ ID NO: 739015 - RNA, 20 nt, Leptospira interrogans serovar lai str. 56601
uauuuucuaggauuuuauau

SEQ ID NO: 739016 - RNA, 17 nt, Leptospira interrogans serovar lai str. 56601
uauuuucggcauuuuau

SEQ ID NO: 739017 - RNA, 16 nt, Leptospira interrogans serovar lai str. 56601
uauuuuccaaaaauuu

SEQ ID NO: 739018 - RNA, 14 nt, Leptospira interrogans serovar lai str. 56601
uauuuucaaguaaa

SEQ ID NO: 739019 - RNA, 14 nt, Leptospira interrogans serovar lai str. 56601
uauuuuauuuuugg

SEQ ID NO: 739020 - RNA, 15 nt, Leptospira interrogans serovar lai str. 56601
uauuuucauagaaaa

SEQ ID NO: 739021 - RNA, 19 nt, Leptospira interrogans serovar lai str. 56601
uauuuucauaggaaauucu

SEQ ID NO: 739022 - RNA, 22 nt, Leptospira interrogans serovar lai str. 56601
uauuuugagaaaauccagucaa

SEQ ID NO: 739023 - RNA, 15 nt, Leptospira interrogans serovar lai str. 56601
uauuuugauuccaaa

SEQ ID NO: 739024 - RNA, 14 nt, Leptospira interrogans serovar lai str. 56601
uauuuugauuuguu

SEQ ID NO: 739025 - RNA, 18 nt, Leptospira interrogans serovar lai str. 56601
uauuuugauuuguuucuu

SEQ ID NO: 739026 - RNA, 20 nt, Leptospira interrogans serovar lai str. 56601
uauuuugauuuguuucuuua

SEQ ID NO: 739027 - RNA, 22 nt, Leptospira interrogans serovar lai str. 56601
uauuuuuuccaaaaagaaaaac

SEQ ID NO: 739028 - RNA, 17 nt, Leptospira interrogans serovar lai str. 56601
uauuuuuuaauauucaa

SEQ ID NO: 739029 - RNA, 17 nt, Leptospira interrogans serovar lai str. 56601
uauuuuuuacgaaaaaa

SEQ ID NO: 739030 - RNA, 16 nt, Leptospira interrogans serovar lai str. 56601
uauuuuugaaaagauc

SEQ ID NO: 739031 - RNA, 12 nt, Leptospira interrogans serovar lai str. 56601
uauuuuuuaaaa

SEQ ID NO: 739032 - RNA, 13 nt, Leptospira interrogans serovar lai str. 56601
uauuuuuuaaaaa

SEQ ID NO: 739033 - RNA, 15 nt, Leptospira interrogans serovar lai str. 56601
uauuuuuuaaaaauc

SEQ ID NO: 739034 - RNA, 20 nt, Leptospira interrogans serovar lai str. 56601
uauuuugucuuuaauuucaa

SEQ ID NO: 739035 - RNA, 18 nt, Leptospira interrogans serovar lai str. 56601
uauuuuuacaaaaaaauc

SEQ ID NO: 739036 - RNA, 19 nt, Leptospira interrogans serovar lai str. 56601
uauuuuuacagaaaaauca

SEQ ID NO: 739037 - RNA, 15 nt, Leptospira interrogans serovar lai str. 56601
uauuuuguuuuuagu

SEQ ID NO: 739038 - RNA, 14 nt, Leptospira interrogans serovar lai str. 56601
uauuuuuaaaaagu

SEQ ID NO: 739039 - RNA, 21 nt, Leptospira interrogans serovar lai str. 56601
uauuuuuauggaucaaaacca

SEQ ID NO: 739040 - RNA, 20 nt, Leptospira interrogans serovar lai str. 56601
uauuuuuaucgcaaaacauu

SEQ ID NO: 739041 - RNA, 20 nt, Leptospira interrogans serovar lai str. 56601
uauuuuucaacaacucuauu

SEQ ID NO: 739042 - RNA, 19 nt, Leptospira interrogans serovar lai str. 56601
uauuuuuacggaucaaaau

SEQ ID NO: 739043 - RNA, 15 nt, Leptospira interrogans serovar lai str. 56601
ucaaaaacuaaaaua

SEQ ID NO: 739044 - RNA, 18 nt, Leptospira interrogans serovar lai str. 56601
ucaaaaacuaaaauacaa

SEQ ID NO: 739045 - RNA, 13 nt, Leptospira interrogans serovar lai str. 56601
ucaaaaaauuuac

SEQ ID NO: 739046 - RNA, 20 nt, Leptospira interrogans serovar lai str. 56601
ucaaaaaauuuuacgcaauc

SEQ ID NO: 739047 - RNA, 21 nt, Leptospira interrogans serovar lai str. 56601
ucaaaaacaaauuaaguuuaa

SEQ ID NO: 739048 - RNA, 21 nt, Leptospira interrogans serovar lai str. 56601
ucaaaaaggcacauuuuucaa

SEQ ID NO: 739049 - RNA, 23 nt, Leptospira interrogans serovar lai str. 56601
ucaaaaaggcacauuuuucaagu

SEQ ID NO: 739050 - RNA, 21 nt, Leptospira interrogans serovar lai str. 56601
ucaaaaaccgaaauagaaaua

SEQ ID NO: 739051 - RNA, 12 nt, Leptospira interrogans serovar lai str. 56601
ucaaaaagaauc

SEQ ID NO: 739052 - RNA, 12 nt, Leptospira interrogans serovar lai str. 56601
ucaaaaagacua

SEQ ID NO: 739053 - RNA, 21 nt, Leptospira interrogans serovar lai str. 56601
ucaaaaauacuuugaacuugu

SEQ ID NO: 739054 - RNA, 15 nt, Leptospira interrogans serovar lai str. 56601
uauuuuuuuaaaaaa

SEQ ID NO: 739055 - RNA, 14 nt, Leptospira interrogans serovar lai str. 56601
uauuuuuuuuacau

SEQ ID NO: 739056 - RNA, 13 nt, Leptospira interrogans serovar lai str. 56601
uauuuuuuuugag

SEQ ID NO: 739057 - RNA, 18 nt, Leptospira interrogans serovar lai str. 56601
ucaaaaaauaucauuuaa

SEQ ID NO: 739058 - RNA, 18 nt, Leptospira interrogans serovar lai str. 56601
ucaaaaaagaaaaaucuu

SEQ ID NO: 739059 - RNA, 16 nt, Leptospira interrogans serovar lai str. 56601
ucaaaaccgcuuuuag

SEQ ID NO: 739060 - RNA, 21 nt, Leptospira interrogans serovar lai str. 56601
ucaaaaccuguaaaugaauuu

SEQ ID NO: 739061 - RNA, 21 nt, Leptospira interrogans serovar lai str. 56601
ucaaaaauaucuuagaauaau

SEQ ID NO: 739062 - RNA, 18 nt, Leptospira interrogans serovar lai str. 56601
ucaaaaauuauaaaucau

SEQ ID NO: 739063 - RNA, 12 nt, Leptospira interrogans serovar lai str. 56601
ucaaaaauuuaa

SEQ ID NO: 739064 - RNA, 12 nt, Leptospira interrogans serovar lai str. 56601
ucaaaagucuau

SEQ ID NO: 739065 - RNA, 19 nt, Leptospira interrogans serovar lai str. 56601
ucaaaagucuauuucuaaa

SEQ ID NO: 739066 - RNA, 17 nt, Leptospira interrogans serovar lai str. 56601
ucaaaagguauaaaaua

SEQ ID NO: 739067 - RNA, 16 nt, Leptospira interrogans serovar lai str. 56601
ucaaaagcucauaauc

SEQ ID NO: 739068 - RNA, 14 nt, Leptospira interrogans serovar lai str. 56601
ucaaaaguuagaau

SEQ ID NO: 739069 - RNA, 22 nt, Leptospira interrogans serovar lai str. 56601
ucaaaauaaauaauacauuggg

SEQ ID NO: 739070 - RNA, 15 nt, Leptospira interrogans serovar lai str. 56601
ucaaaagauugaauu

SEQ ID NO: 739071 - RNA, 16 nt, Leptospira interrogans serovar lai str. 56601
ucaaaagauugaauuu

SEQ ID NO: 739072 - RNA, 16 nt, Leptospira interrogans serovar lai str. 56601
ucaaaacuuaaaaaug

SEQ ID NO: 739073 - RNA, 15 nt, Leptospira interrogans serovar lai str. 56601
ucaaaacuuaaaucc

SEQ ID NO: 739074 - RNA, 15 nt, Leptospira interrogans serovar lai str. 56601
ucaaaacuuuuucga

SEQ ID NO: 739075 - RNA, 20 nt, Leptospira interrogans serovar lai str. 56601
ucaaaacgguuuucuaauuu

SEQ ID NO: 739076 - RNA, 17 nt, Leptospira interrogans serovar lai str. 56601
uauuucaagaauuuuag

SEQ ID NO: 739077 - RNA, 22 nt, Leptospira interrogans serovar lai str. 56601
uauuucaagaauuuuagaauau

SEQ ID NO: 739078 - RNA, 19 nt, Leptospira interrogans serovar lai str. 56601
uauuucaauuccuguagua

SEQ ID NO: 739079 - RNA, 16 nt, Leptospira interrogans serovar lai str. 56601
uauuucaaaaauuuaa

SEQ ID NO: 739080 - RNA, 15 nt, Leptospira interrogans serovar lai str. 56601
uauuucaaaaauuuu

SEQ ID NO: 739081 - RNA, 15 nt, Leptospira interrogans serovar lai str. 56601
uauuucaaaauuuau

SEQ ID NO: 739082 - RNA, 15 nt, Leptospira interrogans serovar lai str. 56601
uauuucaaaauuuuu

SEQ ID NO: 739083 - RNA, 17 nt, Leptospira interrogans serovar lai str. 56601
uauuucaaaauuuuuuu

SEQ ID NO: 739084 - RNA, 18 nt, Leptospira interrogans serovar lai str. 56601
uauuuauaaaauaaaaaa

SEQ ID NO: 739085 - RNA, 23 nt, Leptospira interrogans serovar lai str. 56601
uauuuauaaaauaaaaaaauuca

SEQ ID NO: 739086 - RNA, 14 nt, Leptospira interrogans serovar lai str. 56601
uauuuauucaaaau

SEQ ID NO: 739087 - RNA, 13 nt, Leptospira interrogans serovar lai str. 56601
uauuuauuauaua

SEQ ID NO: 739088 - RNA, 14 nt, Leptospira interrogans serovar lai str. 56601
uauuuauuauauaa

SEQ ID NO: 739089 - RNA, 15 nt, Leptospira interrogans serovar lai str. 56601
uauuucccaaaauuu

SEQ ID NO: 739090 - RNA, 20 nt, Leptospira interrogans serovar lai str. 56601
uauuucgauguaauuccaga

SEQ ID NO: 739091 - RNA, 12 nt, Leptospira interrogans serovar lai str. 56601
uauuucuaaaau

SEQ ID NO: 739092 - RNA, 13 nt, Leptospira interrogans serovar lai str. 56601
uauuucuaaaauu

SEQ ID NO: 739093 - RNA, 16 nt, Leptospira interrogans serovar lai str. 56601
uauuucuaaaauugaa

SEQ ID NO: 739094 - RNA, 23 nt, Leptospira interrogans serovar lai str. 56601
uauuucuaaaauugaauauugag

SEQ ID NO: 739095 - RNA, 23 nt, Leptospira interrogans serovar lai str. 56601
uauuucuaaguccuuuucuuaua

SEQ ID NO: 739096 - RNA, 21 nt, Leptospira interrogans serovar lai str. 56601
uauuucuaauaguugaaauuc

SEQ ID NO: 739097 - RNA, 17 nt, Leptospira interrogans serovar lai str. 56601
uauuucuaauauucaaa

SEQ ID NO: 739098 - RNA, 15 nt, Leptospira interrogans serovar lai str. 56601
uauuuuauacuucua

SEQ ID NO: 739099 - RNA, 13 nt, Leptospira interrogans serovar lai str. 56601
uauuuuauggaaa

SEQ ID NO: 739100 - RNA, 16 nt, Leptospira interrogans serovar lai str. 56601
uauuuuagguauuucu

SEQ ID NO: 739101 - RNA, 17 nt, Leptospira interrogans serovar lai str. 56601
uauuuuagguauuucua

SEQ ID NO: 739102 - RNA, 16 nt, Leptospira interrogans serovar lai str. 56601
uauuuuauaaauugug

SEQ ID NO: 739103 - RNA, 21 nt, Leptospira interrogans serovar lai str. 56601
uauuuuauaaucgaauuucca

SEQ ID NO: 739104 - RNA, 22 nt, Leptospira interrogans serovar lai str. 56601
uauuuuacgcaggcuuguuuga

SEQ ID NO: 739105 - RNA, 17 nt, Leptospira interrogans serovar lai str. 56601
uauuuuacgcuuaaaua

SEQ ID NO: 739106 - RNA, 12 nt, Leptospira interrogans serovar lai str. 56601
uauuuuaaauug

SEQ ID NO: 739107 - RNA, 14 nt, Leptospira interrogans serovar lai str. 56601
uauuuuaaaauuca

SEQ ID NO: 739108 - RNA, 16 nt, Leptospira interrogans serovar lai str. 56601
uauuuuaaaaaaauuu

SEQ ID NO: 739109 - RNA, 15 nt, Leptospira interrogans serovar lai str. 56601
uauuugguuuucauu

SEQ ID NO: 739110 - RNA, 16 nt, Leptospira interrogans serovar lai str. 56601
uauuuggaucggcucc

SEQ ID NO: 739111 - RNA, 21 nt, Leptospira interrogans serovar lai str. 56601
uauuuggcgacugugaucaga

SEQ ID NO: 739112 - RNA, 15 nt, Leptospira interrogans serovar lai str. 56601
uauuuggcuuuauag

SEQ ID NO: 739113 - RNA, 12 nt, Leptospira interrogans serovar lai str. 56601
uauuucugcugc

SEQ ID NO: 739114 - RNA, 21 nt, Leptospira interrogans serovar lai str. 56601
uauuugauauaaucuuaauau

SEQ ID NO: 739115 - RNA, 21 nt, Leptospira interrogans serovar lai str. 56601
uauuugcggaaucaauuuuag

SEQ ID NO: 739116 - RNA, 23 nt, Leptospira interrogans serovar lai str. 56601
uauuugcggaaucaauuuuagaa

SEQ ID NO: 739117 - RNA, 15 nt, Leptospira interrogans serovar lai str. 56601
uauuguuaagauaaa

SEQ ID NO: 739118 - RNA, 18 nt, Leptospira interrogans serovar lai str. 56601
uauuguuaagauaaauuu

SEQ ID NO: 739119 - RNA, 20 nt, Leptospira interrogans serovar lai str. 56601
uauuguuaagauaaauuuag

SEQ ID NO: 739120 - RNA, 13 nt, Leptospira interrogans serovar lai str. 56601
uauuguaauaaau

SEQ ID NO: 739121 - RNA, 14 nt, Leptospira interrogans serovar lai str. 56601
uauuuaaaaauucu

SEQ ID NO: 739122 - RNA, 15 nt, Leptospira interrogans serovar lai str. 56601
uauuguuuauaaaac

SEQ ID NO: 739123 - RNA, 24 nt, Leptospira interrogans serovar lai str. 56601
uauuguuuauaaaacuguaaauua

SEQ ID NO: 739124 - RNA, 13 nt, Leptospira interrogans serovar lai str. 56601
uauuuaacaugag

SEQ ID NO: 739125 - RNA, 13 nt, Leptospira interrogans serovar lai str. 56601
uauuuauaaaaua

SEQ ID NO: 739126 - RNA, 14 nt, Leptospira interrogans serovar lai str. 56601
uauuuauaaaauaa

SEQ ID NO: 739127 - RNA, 16 nt, Leptospira interrogans serovar lai str. 56601
uauuuacauauauaau

SEQ ID NO: 739128 - RNA, 18 nt, Leptospira interrogans serovar lai str. 56601
uauuuacauauauaauuu

SEQ ID NO: 739129 - RNA, 16 nt, Leptospira interrogans serovar lai str. 56601
uauuuaauaaaauuuu

SEQ ID NO: 739130 - RNA, 21 nt, Leptospira interrogans serovar lai str. 56601
uauuuaauaaaauuuuuaaaa

SEQ ID NO: 739131 - RNA, 22 nt, Leptospira interrogans serovar lai str. 56601
uauugcuuuaguaguauuuaag

SEQ ID NO: 739132 - RNA, 18 nt, Leptospira interrogans serovar lai str. 56601
uauugauucuauauauug

SEQ ID NO: 739133 - RNA, 20 nt, Leptospira interrogans serovar lai str. 56601
uauugaucucuauaaaauca

SEQ ID NO: 739134 - RNA, 13 nt, Leptospira interrogans serovar lai str. 56601
uauuccuccuuua

SEQ ID NO: 739135 - RNA, 15 nt, Leptospira interrogans serovar lai str. 56601
uauuccuccuuuauc

SEQ ID NO: 739136 - RNA, 12 nt, Leptospira interrogans serovar lai str. 56601
uauucccaaaaa

SEQ ID NO: 739137 - RNA, 15 nt, Leptospira interrogans serovar lai str. 56601
uauucaguuuccacu

SEQ ID NO: 739138 - RNA, 18 nt, Leptospira interrogans serovar lai str. 56601
uauucacugaaaauuuaa

SEQ ID NO: 739139 - RNA, 18 nt, Leptospira interrogans serovar lai str. 56601
uauucacuuguuauuaaa

SEQ ID NO: 739140 - RNA, 13 nt, Leptospira interrogans serovar lai str. 56601
uauucacuuuucc

SEQ ID NO: 739141 - RNA, 15 nt, Leptospira interrogans serovar lai str. 56601
uauucacuuuuccaa

SEQ ID NO: 739142 - RNA, 16 nt, Leptospira interrogans serovar lai str. 56601
uauucagaaaacagaa

SEQ ID NO: 739143 - RNA, 17 nt, Leptospira interrogans serovar lai str. 56601
uauucagaaaacagaau

SEQ ID NO: 739144 - RNA, 19 nt, Leptospira interrogans serovar lai str. 56601
uauucagaaacuggaauau

SEQ ID NO: 739145 - RNA, 14 nt, Leptospira interrogans serovar lai str. 56601
uauucaauuuuuau

SEQ ID NO: 739146 - RNA, 18 nt, Leptospira interrogans serovar lai str. 56601
uauucacaaaaaaauuca

SEQ ID NO: 739147 - RNA, 21 nt, Leptospira interrogans serovar lai str. 56601
uauucaauuucuuuaauuuca

SEQ ID NO: 739148 - RNA, 17 nt, Leptospira interrogans serovar lai str. 56601
uauuauuuucagauugu

SEQ ID NO: 739149 - RNA, 18 nt, Leptospira interrogans serovar lai str. 56601
uauuauuuugauuuguuu

SEQ ID NO: 739150 - RNA, 22 nt, Leptospira interrogans serovar lai str. 56601
uauucaaaaaauggaacauucc

SEQ ID NO: 739151 - RNA, 23 nt, Leptospira interrogans serovar lai str. 56601
uauucaaaagauugaauuuuuau

SEQ ID NO: 739152 - RNA, 19 nt, Leptospira interrogans serovar lai str. 56601
uauuauuuuuguuaaacaa

SEQ ID NO: 739153 - RNA, 21 nt, Leptospira interrogans serovar lai str. 56601
uauucaaauuuacucuuauaa

SEQ ID NO: 739154 - RNA, 19 nt, Leptospira interrogans serovar lai str. 56601
uauucaagagcaaaguuac

SEQ ID NO: 739155 - RNA, 22 nt, Leptospira interrogans serovar lai str. 56601
uauucaacuuuuugaagaaaca

SEQ ID NO: 739156 - RNA, 22 nt, Leptospira interrogans serovar lai str. 56601
uauucugaaagugaaaguaauc

SEQ ID NO: 739157 - RNA, 16 nt, Leptospira interrogans serovar lai str. 56601
uauucuccauucuuga

SEQ ID NO: 739158 - RNA, 17 nt, Leptospira interrogans serovar lai str. 56601
uauucucguuucuaaug

SEQ ID NO: 739159 - RNA, 18 nt, Leptospira interrogans serovar lai str. 56601
uauucuacagauaaaaau

SEQ ID NO: 739160 - RNA, 17 nt, Leptospira interrogans serovar lai str. 56601
uauucuaauuuuauaaa

SEQ ID NO: 739161 - RNA, 15 nt, Leptospira interrogans serovar lai str. 56601
uauucuaauuuuuau

SEQ ID NO: 739162 - RNA, 19 nt, Leptospira interrogans serovar lai str. 56601
uauucuaaacaaaauguca

SEQ ID NO: 739163 - RNA, 19 nt, Leptospira interrogans serovar lai str. 56601
uauucguaagaaaaaauuu

SEQ ID NO: 739164 - RNA, 22 nt, Leptospira interrogans serovar lai str. 56601
uauucguaagaaaaaauuucuc

SEQ ID NO: 739165 - RNA, 18 nt, Leptospira interrogans serovar lai str. 56601
uauucguauuuuauagaa

SEQ ID NO: 739166 - RNA, 21 nt, Leptospira interrogans serovar lai str. 56601
uauugaacguaaguuaaauau

SEQ ID NO: 739167 - RNA, 13 nt, Leptospira interrogans serovar lai str. 56601
uauucuuuuuaga

SEQ ID NO: 739168 - RNA, 11 nt, Leptospira interrogans serovar lai str. 56601
uauugaaaaau

SEQ ID NO: 739169 - RNA, 13 nt, Leptospira interrogans serovar lai str. 56601
uauucuuuaaugg

SEQ ID NO: 739170 - RNA, 16 nt, Leptospira interrogans serovar lai str. 56601
uauucuuauaagaauc

SEQ ID NO: 739171 - RNA, 16 nt, Leptospira interrogans serovar lai str. 56601
uauucuuauauaucuu

SEQ ID NO: 739172 - RNA, 19 nt, Leptospira interrogans serovar lai str. 56601
uauucuuauauaucuuugg

SEQ ID NO: 739173 - RNA, 23 nt, Leptospira interrogans serovar lai str. 56601
uauucuuauauuauaauucucuu

SEQ ID NO: 739174 - RNA, 21 nt, Leptospira interrogans serovar lai str. 56601
uauuagaguuucuaaaaaaau

SEQ ID NO: 739175 - RNA, 22 nt, Leptospira interrogans serovar lai str. 56601
uauuagauuuauauguuucuuu

SEQ ID NO: 739176 - RNA, 14 nt, Leptospira interrogans serovar lai str. 56601
uauuaggaaauaca

SEQ ID NO: 739177 - RNA, 19 nt, Leptospira interrogans serovar lai str. 56601
uauuaggaaauacaaaaag

SEQ ID NO: 739178 - RNA, 17 nt, Leptospira interrogans serovar lai str. 56601
uauuaguuuaauauaca

SEQ ID NO: 739179 - RNA, 14 nt, Leptospira interrogans serovar lai str. 56601
uauuauaaaauaca

SEQ ID NO: 739180 - RNA, 19 nt, Leptospira interrogans serovar lai str. 56601
uauuauaaaauacaaaaga

SEQ ID NO: 739181 - RNA, 13 nt, Leptospira interrogans serovar lai str. 56601
uauuauaaauaca

SEQ ID NO: 739182 - RNA, 16 nt, Leptospira interrogans serovar lai str. 56601
uauuauaaauauuaau

SEQ ID NO: 739183 - RNA, 14 nt, Leptospira interrogans serovar lai str. 56601
uauuauaaauuuau

SEQ ID NO: 739184 - RNA, 13 nt, Leptospira interrogans serovar lai str. 56601
uauuauaaauuuu

SEQ ID NO: 739185 - RNA, 16 nt, Leptospira interrogans serovar lai str. 56601
uauuauaaauuuugag

SEQ ID NO: 739186 - RNA, 21 nt, Leptospira interrogans serovar lai str. 56601
uauuauaauaaucuuaacuuu

SEQ ID NO: 739187 - RNA, 14 nt, Leptospira interrogans serovar lai str. 56601
uauuauuauuuuaa

SEQ ID NO: 739188 - RNA, 15 nt, Leptospira interrogans serovar lai str. 56601
uauuaugauucuaua

SEQ ID NO: 739189 - RNA, 17 nt, Leptospira interrogans serovar lai str. 56601
uauuaucuuuauauuau

SEQ ID NO: 739190 - RNA, 22 nt, Leptospira interrogans serovar lai str. 56601
uauuaucaaaauuuaaauccca

SEQ ID NO: 739191 - RNA, 17 nt, Leptospira interrogans serovar lai str. 56601
uauuauauaauuuuuaa

SEQ ID NO: 739192 - RNA, 15 nt, Leptospira interrogans serovar lai str. 56601
uauuaagaauuucua

SEQ ID NO: 739193 - RNA, 19 nt, Leptospira interrogans serovar lai str. 56601
uauuaaauuuuuauacuuu

SEQ ID NO: 739194 - RNA, 14 nt, Leptospira interrogans serovar lai str. 56601
uauuaaauuauauu

SEQ ID NO: 739195 - RNA, 11 nt, Leptospira interrogans serovar lai str. 56601
uauuaaauaaa

SEQ ID NO: 739196 - RNA, 17 nt, Leptospira interrogans serovar lai str. 56601
uauuaaagucucaaguu

SEQ ID NO: 739197 - RNA, 14 nt, Leptospira interrogans serovar lai str. 56601
uauuaaaauguaca

SEQ ID NO: 739198 - RNA, 15 nt, Leptospira interrogans serovar lai str. 56601
uauuaaaauguuuua

SEQ ID NO: 739199 - RNA, 14 nt, Leptospira interrogans serovar lai str. 56601
uauuaaagaauuau

SEQ ID NO: 739200 - RNA, 12 nt, Leptospira interrogans serovar lai str. 56601
uauuaauucuua

SEQ ID NO: 739201 - RNA, 19 nt, Leptospira interrogans serovar lai str. 56601
uauuaaguuuuuuaaauuu

SEQ ID NO: 739202 - RNA, 12 nt, Leptospira interrogans serovar lai str. 56601
uauuacaaaacu

SEQ ID NO: 739203 - RNA, 15 nt, Leptospira interrogans serovar lai str. 56601
uauuacaaaacuuag

SEQ ID NO: 739204 - RNA, 18 nt, Leptospira interrogans serovar lai str. 56601
uauuaauuuaaucaaaau

SEQ ID NO: 739205 - RNA, 22 nt, Leptospira interrogans serovar lai str. 56601
uauuaauuugaauauaauaaaa

SEQ ID NO: 739206 - RNA, 23 nt, Leptospira interrogans serovar lai str. 56601
uauuacgcgcuugucccagagcc

SEQ ID NO: 739207 - RNA, 14 nt, Leptospira interrogans serovar lai str. 56601
uaaagguaaaagag

SEQ ID NO: 739208 - RNA, 17 nt, Leptospira interrogans serovar lai str. 56601
uaaacuuuguaaauugu

SEQ ID NO: 739209 - RNA, 15 nt, Leptospira interrogans serovar lai str. 56601
uaaagacgauugauu

SEQ ID NO: 739210 - RNA, 18 nt, Leptospira interrogans serovar lai str. 56601
uaaagaauuaucauguaa

SEQ ID NO: 739211 - RNA, 22 nt, Leptospira interrogans serovar lai str. 56601
uaaagaaugaucgcauaaaauu

SEQ ID NO: 739212 - RNA, 15 nt, Leptospira interrogans serovar lai str. 56601
uaaagaagauaaaac

SEQ ID NO: 739213 - RNA, 18 nt, Leptospira interrogans serovar lai str. 56601
uaaacuuugcaaaucgau

SEQ ID NO: 739214 - RNA, 20 nt, Leptospira interrogans serovar lai str. 56601
uaaacuuuuauaaaaucuaa

SEQ ID NO: 739215 - RNA, 22 nt, Leptospira interrogans serovar lai str. 56601
uaaacuuuuauaaaaucuaaaa

SEQ ID NO: 739216 - RNA, 22 nt, Leptospira interrogans serovar lai str. 56601
uaaagaagggaugaaauuuuaa

SEQ ID NO: 739217 - RNA, 16 nt, Leptospira interrogans serovar lai str. 56601
uaaacuuuaaucauuu

SEQ ID NO: 739218 - RNA, 18 nt, Leptospira interrogans serovar lai str. 56601
uaaacuuuaaucauuuuc

SEQ ID NO: 739219 - RNA, 22 nt, Leptospira interrogans serovar lai str. 56601
uaaacuuucaaagaauauaaaa

SEQ ID NO: 739220 - RNA, 16 nt, Leptospira interrogans serovar lai str. 56601
uaaacuuguaagacuc

SEQ ID NO: 739221 - RNA, 20 nt, Leptospira interrogans serovar lai str. 56601
uaaacuucuauuuuauaaau

SEQ ID NO: 739222 - RNA, 17 nt, Leptospira interrogans serovar lai str. 56601
uaaacuucuauuuugag

SEQ ID NO: 739223 - RNA, 20 nt, Leptospira interrogans serovar lai str. 56601
uaaacuucuauuuuuuaauu

SEQ ID NO: 739224 - RNA, 21 nt, Leptospira interrogans serovar lai str. 56601
uaaacuucucuuaaaauuuag

SEQ ID NO: 739225 - RNA, 22 nt, Leptospira interrogans serovar lai str. 56601
uaaacauucaagguaauuuaua

SEQ ID NO: 739226 - RNA, 21 nt, Leptospira interrogans serovar lai str. 56601
uaaacauuuauuuuucguaau

SEQ ID NO: 739227 - RNA, 14 nt, Leptospira interrogans serovar lai str. 56601
uaaaaugauguggg

SEQ ID NO: 739228 - RNA, 19 nt, Leptospira interrogans serovar lai str. 56601
uaaaaugagcgauacacca

SEQ ID NO: 739229 - RNA, 23 nt, Leptospira interrogans serovar lai str. 56601
uaaaaugagcgauacaccaaaca

SEQ ID NO: 739230 - RNA, 14 nt, Leptospira interrogans serovar lai str. 56601
uaaaaugaaaaaaa

SEQ ID NO: 739231 - RNA, 19 nt, Leptospira interrogans serovar lai str. 56601
uaaaaugaaaaaaaacaaa

SEQ ID NO: 739232 - RNA, 20 nt, Leptospira interrogans serovar lai str. 56601
uaaaaugaaaaaaaacaaag

SEQ ID NO: 739233 - RNA, 21 nt, Leptospira interrogans serovar lai str. 56601
uaaaaugaaaaaaaacaaaga

SEQ ID NO: 739234 - RNA, 21 nt, Leptospira interrogans serovar lai str. 56601
uaaaaucuuuaaguuugugag

SEQ ID NO: 739235 - RNA, 19 nt, Leptospira interrogans serovar lai str. 56601
uaaaaugaaucucuuaauc

SEQ ID NO: 739236 - RNA, 19 nt, Leptospira interrogans serovar lai str. 56601
uaaacguuuauuucaaaau

SEQ ID NO: 739237 - RNA, 15 nt, Leptospira interrogans serovar lai str. 56601
uaaacuaaaaaaaau

SEQ ID NO: 739238 - RNA, 13 nt, Leptospira interrogans serovar lai str. 56601
uaaacgauuuuau

SEQ ID NO: 739239 - RNA, 16 nt, Leptospira interrogans serovar lai str. 56601
uaaacguauaaaaaca

SEQ ID NO: 739240 - RNA, 14 nt, Leptospira interrogans serovar lai str. 56601
uaaacgaguuuuug

SEQ ID NO: 739241 - RNA, 16 nt, Leptospira interrogans serovar lai str. 56601
uaaacgaucagaaaaa

SEQ ID NO: 739242 - RNA, 18 nt, Leptospira interrogans serovar lai str. 56601
uaaacgaucagaaaaaca

SEQ ID NO: 739243 - RNA, 14 nt, Leptospira interrogans serovar lai str. 56601
uaaacgaucauacu

SEQ ID NO: 739244 - RNA, 16 nt, Leptospira interrogans serovar lai str. 56601
uaaacgaguaguucuu

SEQ ID NO: 739245 - RNA, 13 nt, Leptospira interrogans serovar lai str. 56601
uaaaucuuuaaaa

SEQ ID NO: 739246 - RNA, 15 nt, Leptospira interrogans serovar lai str. 56601
uaaaugaauuuagaa

SEQ ID NO: 739247 - RNA, 19 nt, Leptospira interrogans serovar lai str. 56601
uaaaugacuugcauuuaau

SEQ ID NO: 739248 - RNA, 13 nt, Leptospira interrogans serovar lai str. 56601
uaaaugggauuuu

SEQ ID NO: 739249 - RNA, 13 nt, Leptospira interrogans serovar lai str. 56601
uaaauauuuccaa

SEQ ID NO: 739250 - RNA, 14 nt, Leptospira interrogans serovar lai str. 56601
uaaaucaaaaggaa

SEQ ID NO: 739251 - RNA, 11 nt, Leptospira interrogans serovar lai str. 56601
uaaaucaauca

SEQ ID NO: 739252 - RNA, 19 nt, Leptospira interrogans serovar lai str. 56601
uaaaucaauccucuuugaa

SEQ ID NO: 739253 - RNA, 21 nt, Leptospira interrogans serovar lai str. 56601
uaaaucaaucuacuugaauua

SEQ ID NO: 739254 - RNA, 21 nt, Leptospira interrogans serovar lai str. 56601
uaaauaucgaauuucuucaua

SEQ ID NO: 739255 - RNA, 23 nt, Leptospira interrogans serovar lai str. 56601
uaaaucaccuuuuacuucauaua

SEQ ID NO: 739256 - RNA, 20 nt, Leptospira interrogans serovar lai str. 56601
uaaaucuagcaacacauuuu

SEQ ID NO: 739257 - RNA, 16 nt, Leptospira interrogans serovar lai str. 56601
uaaaucucauuaccaa

SEQ ID NO: 739258 - RNA, 17 nt, Leptospira interrogans serovar lai str. 56601
uaaaucuuagauucacu

SEQ ID NO: 739259 - RNA, 23 nt, Leptospira interrogans serovar lai str. 56601
uaaaucuuaggaacuuuuauaau

SEQ ID NO: 739260 - RNA, 23 nt, Leptospira interrogans serovar lai str. 56601
uaaauagagcuuuguaauaaaaa

SEQ ID NO: 739261 - RNA, 13 nt, Leptospira interrogans serovar lai str. 56601
uaaauacaaaaug

SEQ ID NO: 739262 - RNA, 20 nt, Leptospira interrogans serovar lai str. 56601
uaaauaaauuaaaaaaaaau

SEQ ID NO: 739263 - RNA, 14 nt, Leptospira interrogans serovar lai str. 56601
uaaauacaaaaauu

SEQ ID NO: 739264 - RNA, 13 nt, Leptospira interrogans serovar lai str. 56601
uaaauaaugaaaa

SEQ ID NO: 739265 - RNA, 16 nt, Leptospira interrogans serovar lai str. 56601
uaaauaaugaaaacuu

SEQ ID NO: 739266 - RNA, 18 nt, Leptospira interrogans serovar lai str. 56601
uaaauaaugaaaacuugu

SEQ ID NO: 739267 - RNA, 15 nt, Leptospira interrogans serovar lai str. 56601
uaaaguaaaauuaaa

SEQ ID NO: 739268 - RNA, 17 nt, Leptospira interrogans serovar lai str. 56601
uaaaguuguugaaaaau

SEQ ID NO: 739269 - RNA, 22 nt, Leptospira interrogans serovar lai str. 56601
uaaaguuuacaucaaaaacaaa

SEQ ID NO: 739270 - RNA, 13 nt, Leptospira interrogans serovar lai str. 56601
uaaaguuuagauu

SEQ ID NO: 739271 - RNA, 14 nt, Leptospira interrogans serovar lai str. 56601
uaaaguuuagauuu

SEQ ID NO: 739272 - RNA, 15 nt, Leptospira interrogans serovar lai str. 56601
uaaaguucuuuucuu

SEQ ID NO: 739273 - RNA, 18 nt, Leptospira interrogans serovar lai str. 56601
uaaaguacuaauucaaua

SEQ ID NO: 739274 - RNA, 18 nt, Leptospira interrogans serovar lai str. 56601
uaaauaaaccgcauaaaa

SEQ ID NO: 739275 - RNA, 16 nt, Leptospira interrogans serovar lai str. 56601
uaaauuccccaaaaug

SEQ ID NO: 739276 - RNA, 19 nt, Leptospira interrogans serovar lai str. 56601
uaaauuccccaaaaugaau

SEQ ID NO: 739277 - RNA, 20 nt, Leptospira interrogans serovar lai str. 56601
uaaauucacuguuaaaagau

SEQ ID NO: 739278 - RNA, 23 nt, Leptospira interrogans serovar lai str. 56601
uaaauuaugauagucaaaacucu

SEQ ID NO: 739279 - RNA, 16 nt, Leptospira interrogans serovar lai str. 56601
uaaauuaguaauuuaa

SEQ ID NO: 739280 - RNA, 19 nt, Leptospira interrogans serovar lai str. 56601
uaaauuaguaauuuaauau

SEQ ID NO: 739281 - RNA, 14 nt, Leptospira interrogans serovar lai str. 56601
uaaauuauacaauu

SEQ ID NO: 739282 - RNA, 20 nt, Leptospira interrogans serovar lai str. 56601
uaaauuauaguuuuauuaga

SEQ ID NO: 739283 - RNA, 18 nt, Leptospira interrogans serovar lai str. 56601
uaaauuaaguuuauucaa

SEQ ID NO: 739284 - RNA, 19 nt, Leptospira interrogans serovar lai str. 56601
uaaauugugggaauuacua

SEQ ID NO: 739285 - RNA, 23 nt, Leptospira interrogans serovar lai str. 56601
uaaauuguaugcaggaaacauaa

SEQ ID NO: 739286 - RNA, 20 nt, Leptospira interrogans serovar lai str. 56601
uaaauuguaugcaguuguga

SEQ ID NO: 739287 - RNA, 20 nt, Leptospira interrogans serovar lai str. 56601
uaaauuggguaucuaaauau

SEQ ID NO: 739288 - RNA, 16 nt, Leptospira interrogans serovar lai str. 56601
uaaauugcauaaaaga

SEQ ID NO: 739289 - RNA, 17 nt, Leptospira interrogans serovar lai str. 56601
uaaauugcaucaaagaa

SEQ ID NO: 739290 - RNA, 19 nt, Leptospira interrogans serovar lai str. 56601
uaaauugcaucaaagaaac

SEQ ID NO: 739291 - RNA, 12 nt, Leptospira interrogans serovar lai str. 56601
uaaauuguuuca

SEQ ID NO: 739292 - RNA, 14 nt, Leptospira interrogans serovar lai str. 56601
uaaauuguuucaua

SEQ ID NO: 739293 - RNA, 13 nt, Leptospira interrogans serovar lai str. 56601
uaaauuuaaaaaa

SEQ ID NO: 739294 - RNA, 15 nt, Leptospira interrogans serovar lai str. 56601
uaaauuuaaaaaacc

SEQ ID NO: 739295 - RNA, 14 nt, Leptospira interrogans serovar lai str. 56601
uaaauuuaaaugua

SEQ ID NO: 739296 - RNA, 15 nt, Leptospira interrogans serovar lai str. 56601
uaaauuuaaauguau

SEQ ID NO: 739297 - RNA, 16 nt, Leptospira interrogans serovar lai str. 56601
uaaauucuacauuuga

SEQ ID NO: 739298 - RNA, 14 nt, Leptospira interrogans serovar lai str. 56601
uaaauucuuacuaa

SEQ ID NO: 739299 - RNA, 16 nt, Leptospira interrogans serovar lai str. 56601
uaaauucgcaaaaaaa

SEQ ID NO: 739300 - RNA, 16 nt, Leptospira interrogans serovar lai str. 56601
uaaauuccguaaaauu

SEQ ID NO: 739301 - RNA, 14 nt, Leptospira interrogans serovar lai str. 56601
uaaauucuaaaaaa

SEQ ID NO: 739302 - RNA, 16 nt, Leptospira interrogans serovar lai str. 56601
uaaauucuaaaaaaau

SEQ ID NO: 739303 - RNA, 21 nt, Leptospira interrogans serovar lai str. 56601
uaaauugaauucuuccuucuu

SEQ ID NO: 739304 - RNA, 21 nt, Leptospira interrogans serovar lai str. 56601
uaaauugagaauuuguuuuaa

SEQ ID NO: 739305 - RNA, 22 nt, Leptospira interrogans serovar lai str. 56601
uaaauugagaauuuguuuuaaa

SEQ ID NO: 739306 - RNA, 16 nt, Leptospira interrogans serovar lai str. 56601
uaacaaaaugauuuua

SEQ ID NO: 739307 - RNA, 17 nt, Leptospira interrogans serovar lai str. 56601
uaaauuuucguuuuagu

SEQ ID NO: 739308 - RNA, 16 nt, Leptospira interrogans serovar lai str. 56601
uaaauuuugaaaauac

SEQ ID NO: 739309 - RNA, 20 nt, Leptospira interrogans serovar lai str. 56601
uaaauuuuaaccgcaaaauc

SEQ ID NO: 739310 - RNA, 22 nt, Leptospira interrogans serovar lai str. 56601
uaaauuuucagugaauaaaaua

SEQ ID NO: 739311 - RNA, 23 nt, Leptospira interrogans serovar lai str. 56601
uaaauuuuaauauuauuaaauuu

SEQ ID NO: 739312 - RNA, 17 nt, Leptospira interrogans serovar lai str. 56601
uaaauuuuacaauuaaa

SEQ ID NO: 739313 - RNA, 19 nt, Leptospira interrogans serovar lai str. 56601
uaaauuuuacaauuaaacu

SEQ ID NO: 739314 - RNA, 14 nt, Leptospira interrogans serovar lai str. 56601
uaaauuuuauaaaa

SEQ ID NO: 739315 - RNA, 16 nt, Leptospira interrogans serovar lai str. 56601
uaaauuuuauaaaauu

SEQ ID NO: 739316 - RNA, 17 nt, Leptospira interrogans serovar lai str. 56601
uaaauuuauaaauguag

SEQ ID NO: 739317 - RNA, 15 nt, Leptospira interrogans serovar lai str. 56601
uaaauuuauaaugaa

SEQ ID NO: 739318 - RNA, 14 nt, Leptospira interrogans serovar lai str. 56601
uaaauuugcuuuaa

SEQ ID NO: 739319 - RNA, 19 nt, Leptospira interrogans serovar lai str. 56601
uaaauuugcuuuaagugaa

SEQ ID NO: 739320 - RNA, 16 nt, Leptospira interrogans serovar lai str. 56601
uaacaaagccgcacaa

SEQ ID NO: 739321 - RNA, 12 nt, Leptospira interrogans serovar lai str. 56601
uaacaaaguauu

SEQ ID NO: 739322 - RNA, 16 nt, Leptospira interrogans serovar lai str. 56601
uaacaaauaaaaggag

SEQ ID NO: 739323 - RNA, 16 nt, Leptospira interrogans serovar lai str. 56601
uaacaaauuuaaaaua

SEQ ID NO: 739324 - RNA, 22 nt, Leptospira interrogans serovar lai str. 56601
uaacaauucucgauagaacaau

SEQ ID NO: 739325 - RNA, 17 nt, Leptospira interrogans serovar lai str. 56601
uaacagauuaaauguau

SEQ ID NO: 739326 - RNA, 18 nt, Leptospira interrogans serovar lai str. 56601
uaacauuuuauuauaaau

SEQ ID NO: 739327 - RNA, 23 nt, Leptospira interrogans serovar lai str. 56601
uaacauuuuauuauaaauuuaua

SEQ ID NO: 739328 - RNA, 13 nt, Leptospira interrogans serovar lai str. 56601
uaacauuuuuuca

SEQ ID NO: 739329 - RNA, 15 nt, Leptospira interrogans serovar lai str. 56601
uaacauuuuuucaua

SEQ ID NO: 739330 - RNA, 19 nt, Leptospira interrogans serovar lai str. 56601
uaacgauuguaaaaaaaca

SEQ ID NO: 739331 - RNA, 20 nt, Leptospira interrogans serovar lai str. 56601
uaacgauuucuauuuuucgu

SEQ ID NO: 739332 - RNA, 17 nt, Leptospira interrogans serovar lai str. 56601
uaacgauacuuaaaaau

SEQ ID NO: 739333 - RNA, 17 nt, Leptospira interrogans serovar lai str. 56601
uaacgauauuagaacug

SEQ ID NO: 739334 - RNA, 16 nt, Leptospira interrogans serovar lai str. 56601
uaaccggaauuuccaa

SEQ ID NO: 739335 - RNA, 23 nt, Leptospira interrogans serovar lai str. 56601
uaaccggaauuuccaaacucaau

SEQ ID NO: 739336 - RNA, 15 nt, Leptospira interrogans serovar lai str. 56601
uaaccuuuaccauaa

SEQ ID NO: 739337 - RNA, 16 nt, Leptospira interrogans serovar lai str. 56601
uaaccguagauuuuaa

SEQ ID NO: 739338 - RNA, 14 nt, Leptospira interrogans serovar lai str. 56601
uaaaauacaguacu

SEQ ID NO: 739339 - RNA, 18 nt, Leptospira interrogans serovar lai str. 56601
uaaaauacaguacuauau

SEQ ID NO: 739340 - RNA, 20 nt, Leptospira interrogans serovar lai str. 56601
uaaaauacaguacuauauuu

SEQ ID NO: 739341 - RNA, 15 nt, Leptospira interrogans serovar lai str. 56601
uaaaauaccauaaau

SEQ ID NO: 739342 - RNA, 12 nt, Leptospira interrogans serovar lai str. 56601
uaaaauaaauuu

SEQ ID NO: 739343 - RNA, 13 nt, Leptospira interrogans serovar lai str. 56601
uaaaauacaaaag

SEQ ID NO: 739344 - RNA, 13 nt, Leptospira interrogans serovar lai str. 56601
uaaaauaaacuau

SEQ ID NO: 739345 - RNA, 15 nt, Leptospira interrogans serovar lai str. 56601
uaaaauaaaguaucc

SEQ ID NO: 739346 - RNA, 20 nt, Leptospira interrogans serovar lai str. 56601
uaaaauaaaaaaauucauuu

SEQ ID NO: 739347 - RNA, 14 nt, Leptospira interrogans serovar lai str. 56601
uaaaauaaaaaaau

SEQ ID NO: 739348 - RNA, 19 nt, Leptospira interrogans serovar lai str. 56601
uaaaauagugguuuguagu

SEQ ID NO: 739349 - RNA, 22 nt, Leptospira interrogans serovar lai str. 56601
uaaaauagugguuuguaguagu

SEQ ID NO: 739350 - RNA, 17 nt, Leptospira interrogans serovar lai str. 56601
uaaaauaggauuuaaau

SEQ ID NO: 739351 - RNA, 23 nt, Leptospira interrogans serovar lai str. 56601
uaaaaucacaaaaaagauaaaaa

SEQ ID NO: 739352 - RNA, 20 nt, Leptospira interrogans serovar lai str. 56601
uaaaaucauacuuuuaaaaa

SEQ ID NO: 739353 - RNA, 22 nt, Leptospira interrogans serovar lai str. 56601
uaaaaucauacuuuuaaaaaau

SEQ ID NO: 739354 - RNA, 20 nt, Leptospira interrogans serovar lai str. 56601
uaaaaucacguucuuagccu

SEQ ID NO: 739355 - RNA, 14 nt, Leptospira interrogans serovar lai str. 56601
uaaaaucauauuuu

SEQ ID NO: 739356 - RNA, 15 nt, Leptospira interrogans serovar lai str. 56601
uaaaaucauauuuuc

SEQ ID NO: 739357 - RNA, 18 nt, Leptospira interrogans serovar lai str. 56601
uaaaauauuugcauaaac

SEQ ID NO: 739358 - RNA, 18 nt, Leptospira interrogans serovar lai str. 56601
uaaaaucaaguaccauaa

SEQ ID NO: 739359 - RNA, 13 nt, Leptospira interrogans serovar lai str. 56601
uaaaaguaguagu

SEQ ID NO: 739360 - RNA, 22 nt, Leptospira interrogans serovar lai str. 56601
uaaaaguacgggcucauacauu

SEQ ID NO: 739361 - RNA, 19 nt, Leptospira interrogans serovar lai str. 56601
uaaaaguaacguaaauuuu

SEQ ID NO: 739362 - RNA, 23 nt, Leptospira interrogans serovar lai str. 56601
uaaaaguguaucccuuuggcaua

SEQ ID NO: 739363 - RNA, 16 nt, Leptospira interrogans serovar lai str. 56601
uaaaaguacgaaauuc

SEQ ID NO: 739364 - RNA, 12 nt, Leptospira interrogans serovar lai str. 56601
uaaaauaaaaaa

SEQ ID NO: 739365 - RNA, 13 nt, Leptospira interrogans serovar lai str. 56601
uaaaagaaacauu

SEQ ID NO: 739366 - RNA, 19 nt, Leptospira interrogans serovar lai str. 56601
uaaaagaaacauuauacau

SEQ ID NO: 739367 - RNA, 14 nt, Leptospira interrogans serovar lai str. 56601
uaaaagaaauuuaa

SEQ ID NO: 739368 - RNA, 15 nt, Leptospira interrogans serovar lai str. 56601
uaaaagaaauuuaau

SEQ ID NO: 739369 - RNA, 18 nt, Leptospira interrogans serovar lai str. 56601
uaaaagccauuucaaaaa

SEQ ID NO: 739370 - RNA, 19 nt, Leptospira interrogans serovar lai str. 56601
uaaaagccauuucaaaaau

SEQ ID NO: 739371 - RNA, 20 nt, Leptospira interrogans serovar lai str. 56601
uaaaagccauuucaaaaaua

SEQ ID NO: 739372 - RNA, 19 nt, Leptospira interrogans serovar lai str. 56601
uaaaagccagaauuuugaa

SEQ ID NO: 739373 - RNA, 22 nt, Leptospira interrogans serovar lai str. 56601
uaaaaggguuuuuacaauuaaa

SEQ ID NO: 739374 - RNA, 17 nt, Leptospira interrogans serovar lai str. 56601
uaaaacuguacaauaga

SEQ ID NO: 739375 - RNA, 15 nt, Leptospira interrogans serovar lai str. 56601
uaaaacuguuuccag

SEQ ID NO: 739376 - RNA, 11 nt, Leptospira interrogans serovar lai str. 56601
uaaaagaaaaa

SEQ ID NO: 739377 - RNA, 17 nt, Leptospira interrogans serovar lai str. 56601
uaaaacuucagccgcuu

SEQ ID NO: 739378 - RNA, 20 nt, Leptospira interrogans serovar lai str. 56601
uaaaacgaaauuauacaaaa

SEQ ID NO: 739379 - RNA, 22 nt, Leptospira interrogans serovar lai str. 56601
uaaaaccuuuauuuaauaaaau

SEQ ID NO: 739380 - RNA, 15 nt, Leptospira interrogans serovar lai str. 56601
uaaaacgaauugaua

SEQ ID NO: 739381 - RNA, 21 nt, Leptospira interrogans serovar lai str. 56601
uaaaacgaauugauaaaaccg

SEQ ID NO: 739382 - RNA, 23 nt, Leptospira interrogans serovar lai str. 56601
uaaaaccugauuuuucuguaaaa

SEQ ID NO: 739383 - RNA, 18 nt, Leptospira interrogans serovar lai str. 56601
uaaaaccuggauuugucu

SEQ ID NO: 739384 - RNA, 22 nt, Leptospira interrogans serovar lai str. 56601
uaaaacaccuucucuuuuaaaa

SEQ ID NO: 739385 - RNA, 20 nt, Leptospira interrogans serovar lai str. 56601
uaaaacacgauuuauagaga

SEQ ID NO: 739386 - RNA, 13 nt, Leptospira interrogans serovar lai str. 56601
uaaaaaauuaauc

SEQ ID NO: 739387 - RNA, 13 nt, Leptospira interrogans serovar lai str. 56601
uaaaaaauuuaua

SEQ ID NO: 739388 - RNA, 12 nt, Leptospira interrogans serovar lai str. 56601
uaaaaaauucau

SEQ ID NO: 739389 - RNA, 15 nt, Leptospira interrogans serovar lai str. 56601
uaaaaaauucauucc

SEQ ID NO: 739390 - RNA, 23 nt, Leptospira interrogans serovar lai str. 56601
uaaaaaauucauuccuauaaaua

SEQ ID NO: 739391 - RNA, 17 nt, Leptospira interrogans serovar lai str. 56601
uaaaaaccacaaaaaca

SEQ ID NO: 739392 - RNA, 23 nt, Leptospira interrogans serovar lai str. 56601
uaaaaacaguauuuguaaaaaug

SEQ ID NO: 739393 - RNA, 19 nt, Leptospira interrogans serovar lai str. 56601
uaaaaacaaguuuaaauga

SEQ ID NO: 739394 - RNA, 23 nt, Leptospira interrogans serovar lai str. 56601
uaaaaacagauggagaauuaauu

SEQ ID NO: 739395 - RNA, 22 nt, Leptospira interrogans serovar lai str. 56601
uaaaacacaucuuaaaaacucu

SEQ ID NO: 739396 - RNA, 22 nt, Leptospira interrogans serovar lai str. 56601
uaaaaaucgacuucucauucuu

SEQ ID NO: 739397 - RNA, 24 nt, Leptospira interrogans serovar lai str. 56601
uaaaaaucgacuucucauucuuga

SEQ ID NO: 739398 - RNA, 20 nt, Leptospira interrogans serovar lai str. 56601
uaaaaaucggcauucaauuu

SEQ ID NO: 739399 - RNA, 17 nt, Leptospira interrogans serovar lai str. 56601
uaaaaauauaaaucaau

SEQ ID NO: 739400 - RNA, 20 nt, Leptospira interrogans serovar lai str. 56601
uaaaaauauacaauaaauca

SEQ ID NO: 739401 - RNA, 12 nt, Leptospira interrogans serovar lai str. 56601
uaaaaauaucag

SEQ ID NO: 739402 - RNA, 22 nt, Leptospira interrogans serovar lai str. 56601
uaaaaaacuauaaaucauucga

SEQ ID NO: 739403 - RNA, 17 nt, Leptospira interrogans serovar lai str. 56601
uaaaaaacugauuaaaa

SEQ ID NO: 739404 - RNA, 13 nt, Leptospira interrogans serovar lai str. 56601
uaaaaaaauuaau

SEQ ID NO: 739405 - RNA, 14 nt, Leptospira interrogans serovar lai str. 56601
uaaaaaaauuaauu

SEQ ID NO: 739406 - RNA, 19 nt, Leptospira interrogans serovar lai str. 56601
uaaaaaaauuaauucucca

SEQ ID NO: 739407 - RNA, 10 nt, Leptospira interrogans serovar lai str. 56601
uaaaaaacaa

SEQ ID NO: 739408 - RNA, 14 nt, Leptospira interrogans serovar lai str. 56601
uaaaaaaauuaaaa

SEQ ID NO: 739409 - RNA, 15 nt, Leptospira interrogans serovar lai str. 56601
uaaaaaaauuaaaaa

SEQ ID NO: 739410 - RNA, 17 nt, Leptospira interrogans serovar lai str. 56601
uaaaaaaauuaaaaaag

SEQ ID NO: 739411 - RNA, 14 nt, Leptospira interrogans serovar lai str. 56601
uaaaaaauccauga

SEQ ID NO: 739412 - RNA, 15 nt, Leptospira interrogans serovar lai str. 56601
guuuuuuauaauuua

SEQ ID NO: 739413 - RNA, 14 nt, Leptospira interrogans serovar lai str. 56601
guuuuuguuuucuu

SEQ ID NO: 739414 - RNA, 11 nt, Leptospira interrogans serovar lai str. 56601
guuuuuuaaaa

SEQ ID NO: 739415 - RNA, 13 nt, Leptospira interrogans serovar lai str. 56601
guuuuuucaaaaa

SEQ ID NO: 739416 - RNA, 13 nt, Leptospira interrogans serovar lai str. 56601
uaaaaaaaugaau

SEQ ID NO: 739417 - RNA, 12 nt, Leptospira interrogans serovar lai str. 56601
uaaaaaaauaau

SEQ ID NO: 739418 - RNA, 15 nt, Leptospira interrogans serovar lai str. 56601
uaaaaaaauaauaau

SEQ ID NO: 739419 - RNA, 23 nt, Leptospira interrogans serovar lai str. 56601
uaaaaaaauacgauucgaaagau

SEQ ID NO: 739420 - RNA, 17 nt, Leptospira interrogans serovar lai str. 56601
uaaaaaaauauuaaaac

SEQ ID NO: 739421 - RNA, 17 nt, Leptospira interrogans serovar lai str. 56601
uaaaaaaaucaagagcc

SEQ ID NO: 739422 - RNA, 12 nt, Leptospira interrogans serovar lai str. 56601
uaaaaaaaaaug

SEQ ID NO: 739423 - RNA, 19 nt, Leptospira interrogans serovar lai str. 56601
guuuuuuuggauaacgugu

SEQ ID NO: 739424 - RNA, 15 nt, Leptospira interrogans serovar lai str. 56601
guuuuuguaugaguu

SEQ ID NO: 739425 - RNA, 19 nt, Leptospira interrogans serovar lai str. 56601
guuuuucuuuuuaaauaca

SEQ ID NO: 739426 - RNA, 19 nt, Leptospira interrogans serovar lai str. 56601
guuuuugaaaaaugaauuc

SEQ ID NO: 739427 - RNA, 14 nt, Leptospira interrogans serovar lai str. 56601
guuuuucuugcuaa

SEQ ID NO: 739428 - RNA, 20 nt, Leptospira interrogans serovar lai str. 56601
guuuuucuaaauuuuauaaa

SEQ ID NO: 739429 - RNA, 19 nt, Leptospira interrogans serovar lai str. 56601
guuuuucuauaaccacaag

SEQ ID NO: 739430 - RNA, 17 nt, Leptospira interrogans serovar lai str. 56601
guuuuucgauaaaguaa

SEQ ID NO: 739431 - RNA, 12 nt, Leptospira interrogans serovar lai str. 56601
guuuuuccuuuu

SEQ ID NO: 739432 - RNA, 15 nt, Leptospira interrogans serovar lai str. 56601
guuuuuagcguaaau

SEQ ID NO: 739433 - RNA, 18 nt, Leptospira interrogans serovar lai str. 56601
guuuuuaguuacaauuua

SEQ ID NO: 739434 - RNA, 15 nt, Leptospira interrogans serovar lai str. 56601
guuuuuaaaaauuuc

SEQ ID NO: 739435 - RNA, 15 nt, Leptospira interrogans serovar lai str. 56601
guuuuuaaaauugug

SEQ ID NO: 739436 - RNA, 15 nt, Leptospira interrogans serovar lai str. 56601
guuuuuaaauacucu

SEQ ID NO: 739437 - RNA, 22 nt, Leptospira interrogans serovar lai str. 56601
guuuuuaaauccaacuuaaaac

SEQ ID NO: 739438 - RNA, 22 nt, Leptospira interrogans serovar lai str. 56601
guuuugcgggaacucccacaau

SEQ ID NO: 739439 - RNA, 18 nt, Leptospira interrogans serovar lai str. 56601
guuuugcucuaaaauaau

SEQ ID NO: 739440 - RNA, 19 nt, Leptospira interrogans serovar lai str. 56601
guuuuguaauaguucccac

SEQ ID NO: 739441 - RNA, 16 nt, Leptospira interrogans serovar lai str. 56601
guuuugagcauaaaaa

SEQ ID NO: 739442 - RNA, 22 nt, Leptospira interrogans serovar lai str. 56601
guuuugagcauaaaaaaauauu

SEQ ID NO: 739443 - RNA, 17 nt, Leptospira interrogans serovar lai str. 56601
guuuugagauuacaaaa

SEQ ID NO: 739444 - RNA, 23 nt, Leptospira interrogans serovar lai str. 56601
guuuugaagguugagcaguaaaa

SEQ ID NO: 739445 - RNA, 15 nt, Leptospira interrogans serovar lai str. 56601
guuuucuuuuuuucu

SEQ ID NO: 739446 - RNA, 14 nt, Leptospira interrogans serovar lai str. 56601
guuuuacuaaaaaa

SEQ ID NO: 739447 - RNA, 16 nt, Leptospira interrogans serovar lai str. 56601
guuuuacuaaaaguaa

SEQ ID NO: 739448 - RNA, 14 nt, Leptospira interrogans serovar lai str. 56601
guuuuacugaguuu

SEQ ID NO: 739449 - RNA, 16 nt, Leptospira interrogans serovar lai str. 56601
guuuuacgauccuuuu

SEQ ID NO: 739450 - RNA, 18 nt, Leptospira interrogans serovar lai str. 56601
guuuuacagccaucccac

SEQ ID NO: 739451 - RNA, 14 nt, Leptospira interrogans serovar lai str. 56601
guuuuaaugagaaa

SEQ ID NO: 739452 - RNA, 21 nt, Leptospira interrogans serovar lai str. 56601
guuuuaaacuauagagaaauc

SEQ ID NO: 739453 - RNA, 13 nt, Leptospira interrogans serovar lai str. 56601
guuuuaaaauuua

SEQ ID NO: 739454 - RNA, 20 nt, Leptospira interrogans serovar lai str. 56601
guuuuaucuaaaauuucauu

SEQ ID NO: 739455 - RNA, 14 nt, Leptospira interrogans serovar lai str. 56601
guuuuaucaaauaa

SEQ ID NO: 739456 - RNA, 16 nt, Leptospira interrogans serovar lai str. 56601
guuuuaucaaauaaag

SEQ ID NO: 739457 - RNA, 18 nt, Leptospira interrogans serovar lai str. 56601
guuuuauauguauuuauu

SEQ ID NO: 739458 - RNA, 16 nt, Leptospira interrogans serovar lai str. 56601
guuuuaguaaaauuua

SEQ ID NO: 739459 - RNA, 19 nt, Leptospira interrogans serovar lai str. 56601
guuuuaguuuacaaauuga

SEQ ID NO: 739460 - RNA, 10 nt, Leptospira interrogans serovar lai str. 56601
guuuuauaaa

SEQ ID NO: 739461 - RNA, 21 nt, Leptospira interrogans serovar lai str. 56601
guuuuauaaaaugaaaaauua

SEQ ID NO: 739462 - RNA, 18 nt, Leptospira interrogans serovar lai str. 56601
guuuuacuguaaaauuua

SEQ ID NO: 739463 - RNA, 19 nt, Leptospira interrogans serovar lai str. 56601
guuuucauaaauacaaagu

SEQ ID NO: 739464 - RNA, 23 nt, Leptospira interrogans serovar lai str. 56601
guuuuccagaaaccauaaaauaa

SEQ ID NO: 739465 - RNA, 13 nt, Leptospira interrogans serovar lai str. 56601
guuuucguuguau

SEQ ID NO: 739466 - RNA, 15 nt, Leptospira interrogans serovar lai str. 56601
guuuucuaaaggaaa

SEQ ID NO: 739467 - RNA, 14 nt, Leptospira interrogans serovar lai str. 56601
guuuuccauucuca

SEQ ID NO: 739468 - RNA, 20 nt, Leptospira interrogans serovar lai str. 56601
guuuucccgcuggaaaauga

SEQ ID NO: 739469 - RNA, 16 nt, Leptospira interrogans serovar lai str. 56601
guuugccaauaauucu

SEQ ID NO: 739470 - RNA, 16 nt, Leptospira interrogans serovar lai str. 56601
guuugccauuuuuuuc

SEQ ID NO: 739471 - RNA, 21 nt, Leptospira interrogans serovar lai str. 56601
guuucuugugucaagcccucc

SEQ ID NO: 739472 - RNA, 22 nt, Leptospira interrogans serovar lai str. 56601
guuucuguuugaugaaauaguc

SEQ ID NO: 739473 - RNA, 17 nt, Leptospira interrogans serovar lai str. 56601
guuucuuacucgacaaa

SEQ ID NO: 739474 - RNA, 13 nt, Leptospira interrogans serovar lai str. 56601
guuucuuauauaa

SEQ ID NO: 739475 - RNA, 19 nt, Leptospira interrogans serovar lai str. 56601
guuucuuauauaaaaguaa

SEQ ID NO: 739476 - RNA, 23 nt, Leptospira interrogans serovar lai str. 56601
guuucuaauuuucuuguuuaaau

SEQ ID NO: 739477 - RNA, 18 nt, Leptospira interrogans serovar lai str. 56601
guuugugagaguucccac

SEQ ID NO: 739478 - RNA, 17 nt, Leptospira interrogans serovar lai str. 56601
guuugucccaaaaccuc

SEQ ID NO: 739479 - RNA, 16 nt, Leptospira interrogans serovar lai str. 56601
guuuguuccaaaaccu

SEQ ID NO: 739480 - RNA, 14 nt, Leptospira interrogans serovar lai str. 56601
guuuguuuuuucca

SEQ ID NO: 739481 - RNA, 15 nt, Leptospira interrogans serovar lai str. 56601
guuuguaauaguucc

SEQ ID NO: 739482 - RNA, 20 nt, Leptospira interrogans serovar lai str. 56601
guuugggauauucugaaagu

SEQ ID NO: 739483 - RNA, 17 nt, Leptospira interrogans serovar lai str. 56601
guuuggcggaaugcaac

SEQ ID NO: 739484 - RNA, 23 nt, Leptospira interrogans serovar lai str. 56601
guugucuacgaucgcaacauaau

SEQ ID NO: 739485 - RNA, 12 nt, Leptospira interrogans serovar lai str. 56601
guucuucaaaau

SEQ ID NO: 739486 - RNA, 14 nt, Leptospira interrogans serovar lai str. 56601
guucuucauuaaac

SEQ ID NO: 739487 - RNA, 22 nt, Leptospira interrogans serovar lai str. 56601
guucuucauuaaacaauuuuuc

SEQ ID NO: 739488 - RNA, 19 nt, Leptospira interrogans serovar lai str. 56601
guucuuagucuaaaaacaa

SEQ ID NO: 739489 - RNA, 13 nt, Leptospira interrogans serovar lai str. 56601
guucuuaaauaaa

SEQ ID NO: 739490 - RNA, 15 nt, Leptospira interrogans serovar lai str. 56601
guucugggcucaaaa

SEQ ID NO: 739491 - RNA, 17 nt, Leptospira interrogans serovar lai str. 56601
guucuggguaaaaaaaa

SEQ ID NO: 739492 - RNA, 22 nt, Leptospira interrogans serovar lai str. 56601
guucuggguaaaaaaaaaugag

SEQ ID NO: 739493 - RNA, 17 nt, Leptospira interrogans serovar lai str. 56601
guuguguuaguucccac

SEQ ID NO: 739494 - RNA, 19 nt, Leptospira interrogans serovar lai str. 56601
guuguuauagaugaaauua

SEQ ID NO: 739495 - RNA, 20 nt, Leptospira interrogans serovar lai str. 56601
guuuaagaaacucaguaaaa

SEQ ID NO: 739496 - RNA, 21 nt, Leptospira interrogans serovar lai str. 56601
guuuaagaaacucaguaaaac

SEQ ID NO: 739497 - RNA, 18 nt, Leptospira interrogans serovar lai str. 56601
guuuaacuguaaauccac

SEQ ID NO: 739498 - RNA, 15 nt, Leptospira interrogans serovar lai str. 56601
guuguuaaauuuuuc

SEQ ID NO: 739499 - RNA, 15 nt, Leptospira interrogans serovar lai str. 56601
guuuaauauacaaaa

SEQ ID NO: 739500 - RNA, 15 nt, Leptospira interrogans serovar lai str. 56601
guuuaauauacuaaa

SEQ ID NO: 739501 - RNA, 16 nt, Leptospira interrogans serovar lai str. 56601
guuuaauauacuaaaa

SEQ ID NO: 739502 - RNA, 19 nt, Leptospira interrogans serovar lai str. 56601
guuuaauugugaaaaucua

SEQ ID NO: 739503 - RNA, 14 nt, Leptospira interrogans serovar lai str. 56601
guuuacgugaguuc

SEQ ID NO: 739504 - RNA, 15 nt, Leptospira interrogans serovar lai str. 56601
guuuauuuuaaaaaa

SEQ ID NO: 739505 - RNA, 15 nt, Leptospira interrogans serovar lai str. 56601
guuuauuuuucuaaa

SEQ ID NO: 739506 - RNA, 21 nt, Leptospira interrogans serovar lai str. 56601
guuuauuuuucuuuuaaaauu

SEQ ID NO: 739507 - RNA, 15 nt, Leptospira interrogans serovar lai str. 56601
guuuagauuuuaacu

SEQ ID NO: 739508 - RNA, 17 nt, Leptospira interrogans serovar lai str. 56601
guuuagaguauuauaaa

SEQ ID NO: 739509 - RNA, 16 nt, Leptospira interrogans serovar lai str. 56601
guuuauuguuuauaaa

SEQ ID NO: 739510 - RNA, 17 nt, Leptospira interrogans serovar lai str. 56601
guuuauuguuuauaaaa

SEQ ID NO: 739511 - RNA, 16 nt, Leptospira interrogans serovar lai str. 56601
guuucaauuuaaaaua

SEQ ID NO: 739512 - RNA, 19 nt, Leptospira interrogans serovar lai str. 56601
guuucaauuuaucauagaa

SEQ ID NO: 739513 - RNA, 20 nt, Leptospira interrogans serovar lai str. 56601
guuucaauuuaucauagaac

SEQ ID NO: 739514 - RNA, 13 nt, Leptospira interrogans serovar lai str. 56601
guuucaauuuuug

SEQ ID NO: 739515 - RNA, 15 nt, Leptospira interrogans serovar lai str. 56601
guuucacaaaaugcu

SEQ ID NO: 739516 - RNA, 19 nt, Leptospira interrogans serovar lai str. 56601
guuucaacuuuagaaaaau

SEQ ID NO: 739517 - RNA, 16 nt, Leptospira interrogans serovar lai str. 56601
guuucuaaaaaaauua

SEQ ID NO: 739518 - RNA, 19 nt, Leptospira interrogans serovar lai str. 56601
guuucguucccguuuagaa

SEQ ID NO: 739519 - RNA, 14 nt, Leptospira interrogans serovar lai str. 56601
guuucguucuuuuu

SEQ ID NO: 739520 - RNA, 21 nt, Leptospira interrogans serovar lai str. 56601
guuucguucuuuuuuccuucu

SEQ ID NO: 739521 - RNA, 17 nt, Leptospira interrogans serovar lai str. 56601
guuucauagaaggaucc

SEQ ID NO: 739522 - RNA, 23 nt, Leptospira interrogans serovar lai str. 56601
guuucagacugacugaaaaaaac

SEQ ID NO: 739523 - RNA, 19 nt, Leptospira interrogans serovar lai str. 56601
guucggcuuaagaaaaucu

SEQ ID NO: 739524 - RNA, 18 nt, Leptospira interrogans serovar lai str. 56601
guucgggauuuuuuuauc

SEQ ID NO: 739525 - RNA, 14 nt, Leptospira interrogans serovar lai str. 56601
guucuaguauuauu

SEQ ID NO: 739526 - RNA, 16 nt, Leptospira interrogans serovar lai str. 56601
guucuauaaacucaaa

SEQ ID NO: 739527 - RNA, 21 nt, Leptospira interrogans serovar lai str. 56601
guuccuuaaauauaucuucuu

SEQ ID NO: 739528 - RNA, 14 nt, Leptospira interrogans serovar lai str. 56601
guuccuucuacaau

SEQ ID NO: 739529 - RNA, 15 nt, Leptospira interrogans serovar lai str. 56601
guuccuuugaauaaa

SEQ ID NO: 739530 - RNA, 19 nt, Leptospira interrogans serovar lai str. 56601
guucgacauaagaaagaau

SEQ ID NO: 739531 - RNA, 23 nt, Leptospira interrogans serovar lai str. 56601
guucuaucgaauuuacaugaaac

SEQ ID NO: 739532 - RNA, 23 nt, Leptospira interrogans serovar lai str. 56601
guucucccaaaccucguacuaau

SEQ ID NO: 739533 - RNA, 20 nt, Leptospira interrogans serovar lai str. 56601
guucugaggaggauuagaag

SEQ ID NO: 739534 - RNA, 21 nt, Leptospira interrogans serovar lai str. 56601
guucugagucguucgacaauu

SEQ ID NO: 739535 - RNA, 19 nt, Leptospira interrogans serovar lai str. 56601
guucucuauugucucaaaa

SEQ ID NO: 739536 - RNA, 12 nt, Leptospira interrogans serovar lai str. 56601
guuccauaaaga

SEQ ID NO: 739537 - RNA, 15 nt, Leptospira interrogans serovar lai str. 56601
guuccgaaaauuuga

SEQ ID NO: 739538 - RNA, 22 nt, Leptospira interrogans serovar lai str. 56601
guuccgaaaggaaaagaaaccg

SEQ ID NO: 739539 - RNA, 18 nt, Leptospira interrogans serovar lai str. 56601
guuccgauacgaguaaaa

SEQ ID NO: 739540 - RNA, 20 nt, Leptospira interrogans serovar lai str. 56601
guuccgauacgaguaaaaau

SEQ ID NO: 739541 - RNA, 12 nt, Leptospira interrogans serovar lai str. 56601
guucaucuucuc

SEQ ID NO: 739542 - RNA, 17 nt, Leptospira interrogans serovar lai str. 56601
guuaugauauaauauac

SEQ ID NO: 739543 - RNA, 19 nt, Leptospira interrogans serovar lai str. 56601
guuaugaauaaaaaauuuc

SEQ ID NO: 739544 - RNA, 23 nt, Leptospira interrogans serovar lai str. 56601
guuaugacccaagauucaaagau

SEQ ID NO: 739545 - RNA, 17 nt, Leptospira interrogans serovar lai str. 56601
guuauguuuuaaaacac

SEQ ID NO: 739546 - RNA, 14 nt, Leptospira interrogans serovar lai str. 56601
guuauuaaaauuuc

SEQ ID NO: 739547 - RNA, 22 nt, Leptospira interrogans serovar lai str. 56601
guuauuaaaaucuaucucaaaa

SEQ ID NO: 739548 - RNA, 22 nt, Leptospira interrogans serovar lai str. 56601
guuauuauuuuuguuaaacaac

SEQ ID NO: 739549 - RNA, 15 nt, Leptospira interrogans serovar lai str. 56601
guucaacuuuccuuu

SEQ ID NO: 739550 - RNA, 16 nt, Leptospira interrogans serovar lai str. 56601
guucaaaauuuaucug

SEQ ID NO: 739551 - RNA, 22 nt, Leptospira interrogans serovar lai str. 56601
guucaaauggccucuugcuaau

SEQ ID NO: 739552 - RNA, 19 nt, Leptospira interrogans serovar lai str. 56601
guucaacaaacaaauagaa

SEQ ID NO: 739553 - RNA, 24 nt, Leptospira interrogans serovar lai str. 56601
guucaacaaacaaauagaaauaac

SEQ ID NO: 739554 - RNA, 13 nt, Leptospira interrogans serovar lai str. 56601
guuauuucuuuca

SEQ ID NO: 739555 - RNA, 17 nt, Leptospira interrogans serovar lai str. 56601
guuauuuagaucaaaua

SEQ ID NO: 739556 - RNA, 11 nt, Leptospira interrogans serovar lai str. 56601
guuauaauucu

SEQ ID NO: 739557 - RNA, 18 nt, Leptospira interrogans serovar lai str. 56601
guuauaauucuuuaaaau

SEQ ID NO: 739558 - RNA, 21 nt, Leptospira interrogans serovar lai str. 56601
guuauaauucuuuaaaauuuu

SEQ ID NO: 739559 - RNA, 15 nt, Leptospira interrogans serovar lai str. 56601
guuauaguaaaagaa

SEQ ID NO: 739560 - RNA, 18 nt, Leptospira interrogans serovar lai str. 56601
guuauaguaaaagaaaau

SEQ ID NO: 739561 - RNA, 17 nt, Leptospira interrogans serovar lai str. 56601
guuauaguaguucccac

SEQ ID NO: 739562 - RNA, 23 nt, Leptospira interrogans serovar lai str. 56601
guuauagcgucguuaaauuugcg

SEQ ID NO: 739563 - RNA, 16 nt, Leptospira interrogans serovar lai str. 56601
guuaucaauagaaaua

SEQ ID NO: 739564 - RNA, 19 nt, Leptospira interrogans serovar lai str. 56601
guuaucaacuuuuggaaca

SEQ ID NO: 739565 - RNA, 12 nt, Leptospira interrogans serovar lai str. 56601
guuauauuaaaa

SEQ ID NO: 739566 - RNA, 14 nt, Leptospira interrogans serovar lai str. 56601
guuauauuaaaaug

SEQ ID NO: 739567 - RNA, 16 nt, Leptospira interrogans serovar lai str. 56601
guuauauuaaaaugua

SEQ ID NO: 739568 - RNA, 23 nt, Leptospira interrogans serovar lai str. 56601
guuauccuuacgaugucuuuuca

SEQ ID NO: 739569 - RNA, 14 nt, Leptospira interrogans serovar lai str. 56601
guuaggauaaaagg

SEQ ID NO: 739570 - RNA, 18 nt, Leptospira interrogans serovar lai str. 56601
guuaguucccacaaauua

SEQ ID NO: 739571 - RNA, 23 nt, Leptospira interrogans serovar lai str. 56601
guuaguucccacauuuuugugaa

SEQ ID NO: 739572 - RNA, 23 nt, Leptospira interrogans serovar lai str. 56601
guguucaucguuccaaacccugc

SEQ ID NO: 739573 - RNA, 17 nt, Leptospira interrogans serovar lai str. 56601
guguuaguucccacaaa

SEQ ID NO: 739574 - RNA, 14 nt, Leptospira interrogans serovar lai str. 56601
guuaaaagauuugu

SEQ ID NO: 739575 - RNA, 22 nt, Leptospira interrogans serovar lai str. 56601
guuaaaagauuuguuuuauaaa

SEQ ID NO: 739576 - RNA, 14 nt, Leptospira interrogans serovar lai str. 56601
guuaaaauaaaaaa

SEQ ID NO: 739577 - RNA, 21 nt, Leptospira interrogans serovar lai str. 56601
guuaaaaaaugaauuuuucau

SEQ ID NO: 739578 - RNA, 19 nt, Leptospira interrogans serovar lai str. 56601
guguuuuuuaacauuuguu

SEQ ID NO: 739579 - RNA, 16 nt, Leptospira interrogans serovar lai str. 56601
guuaaaaaacuauaaa

SEQ ID NO: 739580 - RNA, 23 nt, Leptospira interrogans serovar lai str. 56601
guuaagaagauaaauauuuccaa

SEQ ID NO: 739581 - RNA, 16 nt, Leptospira interrogans serovar lai str. 56601
guuaaccaaaaauuca

SEQ ID NO: 739582 - RNA, 19 nt, Leptospira interrogans serovar lai str. 56601
guuaacgcguugauuucua

SEQ ID NO: 739583 - RNA, 13 nt, Leptospira interrogans serovar lai str. 56601
gugucauguuuua

SEQ ID NO: 739584 - RNA, 21 nt, Leptospira interrogans serovar lai str. 56601
guguggauaccuuuaguuuuu

SEQ ID NO: 739585 - RNA, 20 nt, Leptospira interrogans serovar lai str. 56601
gugggaacuauuauaaaaua

SEQ ID NO: 739586 - RNA, 21 nt, Leptospira interrogans serovar lai str. 56601
gugggaacucucacaaaucau

SEQ ID NO: 739587 - RNA, 22 nt, Leptospira interrogans serovar lai str. 56601
guggagauuuugcacguaaaca

SEQ ID NO: 739588 - RNA, 20 nt, Leptospira interrogans serovar lai str. 56601
guggaacucuauauaaagaa

SEQ ID NO: 739589 - RNA, 23 nt, Leptospira interrogans serovar lai str. 56601
guggaacucuauauaaagaaaaa

SEQ ID NO: 739590 - RNA, 22 nt, Leptospira interrogans serovar lai str. 56601
guggaaacgucauaguucccac

SEQ ID NO: 739591 - RNA, 18 nt, Leptospira interrogans serovar lai str. 56601
gugcuuuguucaaagaaa

SEQ ID NO: 739592 - RNA, 23 nt, Leptospira interrogans serovar lai str. 56601
gugcaacgcguuuuaguuuuaua

SEQ ID NO: 739593 - RNA, 16 nt, Leptospira interrogans serovar lai str. 56601
gugaucuccuaaaaua

SEQ ID NO: 739594 - RNA, 23 nt, Leptospira interrogans serovar lai str. 56601
gugcaugcaucaacguaaauaaa

SEQ ID NO: 739595 - RNA, 23 nt, Leptospira interrogans serovar lai str. 56601
gugcaugaaaauaauaucaaaau

SEQ ID NO: 739596 - RNA, 21 nt, Leptospira interrogans serovar lai str. 56601
gugagcucuauguaagaaaau

SEQ ID NO: 739597 - RNA, 23 nt, Leptospira interrogans serovar lai str. 56601
gugauaagaggccuuuuucuugc

SEQ ID NO: 739598 - RNA, 13 nt, Leptospira interrogans serovar lai str. 56601
gugaucuaugaua

SEQ ID NO: 739599 - RNA, 18 nt, Leptospira interrogans serovar lai str. 56601
gugaucagaauuaaaaau

SEQ ID NO: 739600 - RNA, 14 nt, Leptospira interrogans serovar lai str. 56601
gugagaguucccac

SEQ ID NO: 739601 - RNA, 16 nt, Leptospira interrogans serovar lai str. 56601
gugaauuuugcucacu

SEQ ID NO: 739602 - RNA, 12 nt, Leptospira interrogans serovar lai str. 56601
gugaccaccuau

SEQ ID NO: 739603 - RNA, 20 nt, Leptospira interrogans serovar lai str. 56601
gugaauucucuagaaauuua

SEQ ID NO: 739604 - RNA, 16 nt, Leptospira interrogans serovar lai str. 56601
gugaauuaaaagaaac

SEQ ID NO: 739605 - RNA, 15 nt, Leptospira interrogans serovar lai str. 56601
gugaauucagaaaaa

SEQ ID NO: 739606 - RNA, 16 nt, Leptospira interrogans serovar lai str. 56601
gugaauucagaaaaaa

SEQ ID NO: 739607 - RNA, 22 nt, Leptospira interrogans serovar lai str. 56601
gugaaucaaaagguauaaaaua

SEQ ID NO: 739608 - RNA, 20 nt, Leptospira interrogans serovar lai str. 56601
gugaaagauuaaagauuugc

SEQ ID NO: 739609 - RNA, 14 nt, Leptospira interrogans serovar lai str. 56601
gugaaaguaaucuu

SEQ ID NO: 739610 - RNA, 17 nt, Leptospira interrogans serovar lai str. 56601
gugaaaguaaucuuuuu

SEQ ID NO: 739611 - RNA, 14 nt, Leptospira interrogans serovar lai str. 56601
gugaacuauuuaua

SEQ ID NO: 739612 - RNA, 12 nt, Leptospira interrogans serovar lai str. 56601
gugaacuuuaga

SEQ ID NO: 739613 - RNA, 15 nt, Leptospira interrogans serovar lai str. 56601
gucuuuaaaaaauua

SEQ ID NO: 739614 - RNA, 17 nt, Leptospira interrogans serovar lai str. 56601
gucuuuaauuucaauuu

SEQ ID NO: 739615 - RNA, 19 nt, Leptospira interrogans serovar lai str. 56601
gucuuuaugcgguuuuacu

SEQ ID NO: 739616 - RNA, 11 nt, Leptospira interrogans serovar lai str. 56601
gucuuucuaua

SEQ ID NO: 739617 - RNA, 16 nt, Leptospira interrogans serovar lai str. 56601
gucuuuuucuacaagu

SEQ ID NO: 739618 - RNA, 23 nt, Leptospira interrogans serovar lai str. 56601
gugaaaaacgggcccaaauaaaa

SEQ ID NO: 739619 - RNA, 13 nt, Leptospira interrogans serovar lai str. 56601
gucuucuuguaau

SEQ ID NO: 739620 - RNA, 19 nt, Leptospira interrogans serovar lai str. 56601
gucuucuuuacaauuugcu

SEQ ID NO: 739621 - RNA, 12 nt, Leptospira interrogans serovar lai str. 56601
gucuucuaaauu

SEQ ID NO: 739622 - RNA, 22 nt, Leptospira interrogans serovar lai str. 56601
gucucuuuauauaaaauuugaa

SEQ ID NO: 739623 - RNA, 21 nt, Leptospira interrogans serovar lai str. 56601
gucucgaaacccaaaaaugua

SEQ ID NO: 739624 - RNA, 18 nt, Leptospira interrogans serovar lai str. 56601
gucucgaauuguuuuuaa

SEQ ID NO: 739625 - RNA, 19 nt, Leptospira interrogans serovar lai str. 56601
gucugaaggaauauucauu

SEQ ID NO: 739626 - RNA, 17 nt, Leptospira interrogans serovar lai str. 56601
gucugaauccuuuaaac

SEQ ID NO: 739627 - RNA, 19 nt, Leptospira interrogans serovar lai str. 56601
gucuguaaaagaaaaauua

SEQ ID NO: 739628 - RNA, 22 nt, Leptospira interrogans serovar lai str. 56601
gucugucuuaaaauuugaaaag

SEQ ID NO: 739629 - RNA, 12 nt, Leptospira interrogans serovar lai str. 56601
gucguauuaaag

SEQ ID NO: 739630 - RNA, 13 nt, Leptospira interrogans serovar lai str. 56601
gucucaaaaauau

SEQ ID NO: 739631 - RNA, 23 nt, Leptospira interrogans serovar lai str. 56601
gucucaaaaccuguaaaugaauu

SEQ ID NO: 739632 - RNA, 22 nt, Leptospira interrogans serovar lai str. 56601
gucucaagauuuaauuuagaaa

SEQ ID NO: 739633 - RNA, 17 nt, Leptospira interrogans serovar lai str. 56601
gucucaccaacaacacc

SEQ ID NO: 739634 - RNA, 13 nt, Leptospira interrogans serovar lai str. 56601
gucuauuucccaa

SEQ ID NO: 739635 - RNA, 14 nt, Leptospira interrogans serovar lai str. 56601
gucuauuacaaaac

SEQ ID NO: 739636 - RNA, 18 nt, Leptospira interrogans serovar lai str. 56601
gucuaugaugcauuucug

SEQ ID NO: 739637 - RNA, 16 nt, Leptospira interrogans serovar lai str. 56601
gucuaucuuuuuuaaa

SEQ ID NO: 739638 - RNA, 15 nt, Leptospira interrogans serovar lai str. 56601
gucucauuucaaauu

SEQ ID NO: 739639 - RNA, 16 nt, Leptospira interrogans serovar lai str. 56601
gucuccaaagugacca

SEQ ID NO: 739640 - RNA, 22 nt, Leptospira interrogans serovar lai str. 56601
gucuccagcauuuagaaagcga

SEQ ID NO: 739641 - RNA, 12 nt, Leptospira interrogans serovar lai str. 56601
gucuacagauaa

SEQ ID NO: 739642 - RNA, 18 nt, Leptospira interrogans serovar lai str. 56601
gucuaagggaauuugaau

SEQ ID NO: 739643 - RNA, 14 nt, Leptospira interrogans serovar lai str. 56601
gucggaacacuuga

SEQ ID NO: 739644 - RNA, 13 nt, Leptospira interrogans serovar lai str. 56601
gucgcucugugaa

SEQ ID NO: 739645 - RNA, 19 nt, Leptospira interrogans serovar lai str. 56601
gucgcucugugaaacucag

SEQ ID NO: 739646 - RNA, 20 nt, Leptospira interrogans serovar lai str. 56601
gucgcgaguaaauccgugaa

SEQ ID NO: 739647 - RNA, 15 nt, Leptospira interrogans serovar lai str. 56601
gucccaaaauuucua

SEQ ID NO: 739648 - RNA, 23 nt, Leptospira interrogans serovar lai str. 56601
gucccaaaaccucaaaaaauuuu

SEQ ID NO: 739649 - RNA, 14 nt, Leptospira interrogans serovar lai str. 56601
guccuuuuuuucuu

SEQ ID NO: 739650 - RNA, 19 nt, Leptospira interrogans serovar lai str. 56601
gucgacuaucgcaaauaau

SEQ ID NO: 739651 - RNA, 18 nt, Leptospira interrogans serovar lai str. 56601
guccaaaucaaaaaaguc

SEQ ID NO: 739652 - RNA, 14 nt, Leptospira interrogans serovar lai str. 56601
guccaauuuuaaaa

SEQ ID NO: 739653 - RNA, 13 nt, Leptospira interrogans serovar lai str. 56601
guauuuuagagaa

SEQ ID NO: 739654 - RNA, 16 nt, Leptospira interrogans serovar lai str. 56601
guauuuuauuauauaa

SEQ ID NO: 739655 - RNA, 23 nt, Leptospira interrogans serovar lai str. 56601
guauuuugauccguuuuaaaauu

SEQ ID NO: 739656 - RNA, 21 nt, Leptospira interrogans serovar lai str. 56601
guauuuuuacccgaucuuuuu

SEQ ID NO: 739657 - RNA, 14 nt, Leptospira interrogans serovar lai str. 56601
guauuugaucucaa

SEQ ID NO: 739658 - RNA, 20 nt, Leptospira interrogans serovar lai str. 56601
guauuuccacuacaaucacu

SEQ ID NO: 739659 - RNA, 20 nt, Leptospira interrogans serovar lai str. 56601
guauuuaaugaccacaaacu

SEQ ID NO: 739660 - RNA, 19 nt, Leptospira interrogans serovar lai str. 56601
guauuguuaagauaaauuu

SEQ ID NO: 739661 - RNA, 15 nt, Leptospira interrogans serovar lai str. 56601
guauucaagagcaaa

SEQ ID NO: 739662 - RNA, 11 nt, Leptospira interrogans serovar lai str. 56601
guauuauaaac

SEQ ID NO: 739663 - RNA, 11 nt, Leptospira interrogans serovar lai str. 56601
guauuauaaau

SEQ ID NO: 739664 - RNA, 15 nt, Leptospira interrogans serovar lai str. 56601
guauuauaaauuuug

SEQ ID NO: 739665 - RNA, 15 nt, Leptospira interrogans serovar lai str. 56601
guauugaaauagaau

SEQ ID NO: 739666 - RNA, 21 nt, Leptospira interrogans serovar lai str. 56601
guauucucccccaacugaaaa

SEQ ID NO: 739667 - RNA, 18 nt, Leptospira interrogans serovar lai str. 56601
gucaaguuauugcguauu

SEQ ID NO: 739668 - RNA, 17 nt, Leptospira interrogans serovar lai str. 56601
gucaaguuauuguaaaa

SEQ ID NO: 739669 - RNA, 19 nt, Leptospira interrogans serovar lai str. 56601
gucaaauuuggaaauugug

SEQ ID NO: 739670 - RNA, 15 nt, Leptospira interrogans serovar lai str. 56601
gucaaacuuacaaaa

SEQ ID NO: 739671 - RNA, 20 nt, Leptospira interrogans serovar lai str. 56601
gucaaaggagaaggauaaag

SEQ ID NO: 739672 - RNA, 20 nt, Leptospira interrogans serovar lai str. 56601
gucaaaucaucuaucuuuuc

SEQ ID NO: 739673 - RNA, 21 nt, Leptospira interrogans serovar lai str. 56601
gucaaaucaucuaucuuuuca

SEQ ID NO: 739674 - RNA, 18 nt, Leptospira interrogans serovar lai str. 56601
gucaaaauuuaaauccua

SEQ ID NO: 739675 - RNA, 18 nt, Leptospira interrogans serovar lai str. 56601
gucacauuugauaauucg

SEQ ID NO: 739676 - RNA, 18 nt, Leptospira interrogans serovar lai str. 56601
gucacauuguguuuuuua

SEQ ID NO: 739677 - RNA, 15 nt, Leptospira interrogans serovar lai str. 56601
guaugaguucccaca

SEQ ID NO: 739678 - RNA, 14 nt, Leptospira interrogans serovar lai str. 56601
guauccuuaaaaug

SEQ ID NO: 739679 - RNA, 23 nt, Leptospira interrogans serovar lai str. 56601
guauguuuuucugauagagaaaa

SEQ ID NO: 739680 - RNA, 18 nt, Leptospira interrogans serovar lai str. 56601
guaugcaggaaacauaau

SEQ ID NO: 739681 - RNA, 17 nt, Leptospira interrogans serovar lai str. 56601
guaugcaggaaacauac

SEQ ID NO: 739682 - RNA, 16 nt, Leptospira interrogans serovar lai str. 56601
guaucaauagaaauac

SEQ ID NO: 739683 - RNA, 20 nt, Leptospira interrogans serovar lai str. 56601
guaucagaaucaaaggaaau

SEQ ID NO: 739684 - RNA, 22 nt, Leptospira interrogans serovar lai str. 56601
guaucaccguaauucuuaauuu

SEQ ID NO: 739685 - RNA, 12 nt, Leptospira interrogans serovar lai str. 56601
guauauaaaaaa

SEQ ID NO: 739686 - RNA, 10 nt, Leptospira interrogans serovar lai str. 56601
guaggaacuc

SEQ ID NO: 739687 - RNA, 14 nt, Leptospira interrogans serovar lai str. 56601
guagauuuuaacaa

SEQ ID NO: 739688 - RNA, 16 nt, Leptospira interrogans serovar lai str. 56601
guagacaacuaaaaga

SEQ ID NO: 739689 - RNA, 15 nt, Leptospira interrogans serovar lai str. 56601
guagaauugaucuga

SEQ ID NO: 739690 - RNA, 23 nt, Leptospira interrogans serovar lai str. 56601
guagaaccuaaaaauauggaagc

SEQ ID NO: 739691 - RNA, 17 nt, Leptospira interrogans serovar lai str. 56601
guagaaauucuauuuua

SEQ ID NO: 739692 - RNA, 16 nt, Leptospira interrogans serovar lai str. 56601
guagaaacuuauacuu

SEQ ID NO: 739693 - RNA, 16 nt, Leptospira interrogans serovar lai str. 56601
guagaaaguuauuuua

SEQ ID NO: 739694 - RNA, 16 nt, Leptospira interrogans serovar lai str. 56601
guagccaaaaauuaga

SEQ ID NO: 739695 - RNA, 17 nt, Leptospira interrogans serovar lai str. 56601
guacucugcaaaauuua

SEQ ID NO: 739696 - RNA, 19 nt, Leptospira interrogans serovar lai str. 56601
guacuuuacguagaaacaa

SEQ ID NO: 739697 - RNA, 23 nt, Leptospira interrogans serovar lai str. 56601
guacauggcauccaggauuuuca

SEQ ID NO: 739698 - RNA, 20 nt, Leptospira interrogans serovar lai str. 56601
guaccauaaauuuuuauuac

SEQ ID NO: 739699 - RNA, 13 nt, Leptospira interrogans serovar lai str. 56601
guacauaaaucag

SEQ ID NO: 739700 - RNA, 13 nt, Leptospira interrogans serovar lai str. 56601
guaauuuauauua

SEQ ID NO: 739701 - RNA, 22 nt, Leptospira interrogans serovar lai str. 56601
guaauuucguuuuuuuaauauu

SEQ ID NO: 739702 - RNA, 17 nt, Leptospira interrogans serovar lai str. 56601
guaauuuaucuguaauu

SEQ ID NO: 739703 - RNA, 13 nt, Leptospira interrogans serovar lai str. 56601
guaauuuaaaaaa

SEQ ID NO: 739704 - RNA, 13 nt, Leptospira interrogans serovar lai str. 56601
guacaauucaaaa

SEQ ID NO: 739705 - RNA, 13 nt, Leptospira interrogans serovar lai str. 56601
guacaagaaucaa

SEQ ID NO: 739706 - RNA, 23 nt, Leptospira interrogans serovar lai str. 56601
guacaaucccggcggaaaauccu

SEQ ID NO: 739707 - RNA, 19 nt, Leptospira interrogans serovar lai str. 56601
guacaaucggguaaaaaau

SEQ ID NO: 739708 - RNA, 17 nt, Leptospira interrogans serovar lai str. 56601
guaaucaguuaaacccg

SEQ ID NO: 739709 - RNA, 18 nt, Leptospira interrogans serovar lai str. 56601
guaaaagcuuauacuuua

SEQ ID NO: 739710 - RNA, 15 nt, Leptospira interrogans serovar lai str. 56601
guaaaacuucuuuaa

SEQ ID NO: 739711 - RNA, 17 nt, Leptospira interrogans serovar lai str. 56601
guaaaacuuuuaaagaa

SEQ ID NO: 739712 - RNA, 22 nt, Leptospira interrogans serovar lai str. 56601
guaauacgauauuuuguuuuua

SEQ ID NO: 739713 - RNA, 14 nt, Leptospira interrogans serovar lai str. 56601
guaauucuuuggaa

SEQ ID NO: 739714 - RNA, 20 nt, Leptospira interrogans serovar lai str. 56601
guaauucuuuggaaauuuuu

SEQ ID NO: 739715 - RNA, 21 nt, Leptospira interrogans serovar lai str. 56601
guaauucguuccaaauacaau

SEQ ID NO: 739716 - RNA, 14 nt, Leptospira interrogans serovar lai str. 56601
guaauuauaauuga

SEQ ID NO: 739717 - RNA, 18 nt, Leptospira interrogans serovar lai str. 56601
guaaucuuuuuaaaaguu

SEQ ID NO: 739718 - RNA, 12 nt, Leptospira interrogans serovar lai str. 56601
guaauuaaauuu

SEQ ID NO: 739719 - RNA, 19 nt, Leptospira interrogans serovar lai str. 56601
guaaugacgauuuucuccu

SEQ ID NO: 739720 - RNA, 17 nt, Leptospira interrogans serovar lai str. 56601
guaaugaaaucuaguuc

SEQ ID NO: 739721 - RNA, 14 nt, Leptospira interrogans serovar lai str. 56601
gguugagcaaaaau

SEQ ID NO: 739722 - RNA, 16 nt, Leptospira interrogans serovar lai str. 56601
gguugaguucuuuuag

SEQ ID NO: 739723 - RNA, 22 nt, Leptospira interrogans serovar lai str. 56601
gguuuagacguaggaaaugaaa

SEQ ID NO: 739724 - RNA, 12 nt, Leptospira interrogans serovar lai str. 56601
gguuuaaaacua

SEQ ID NO: 739725 - RNA, 12 nt, Leptospira interrogans serovar lai str. 56601
guaaaaaaauau

SEQ ID NO: 739726 - RNA, 21 nt, Leptospira interrogans serovar lai str. 56601
guaaaaaaauauuaaaacacu

SEQ ID NO: 739727 - RNA, 12 nt, Leptospira interrogans serovar lai str. 56601
guaaaaaagaua

SEQ ID NO: 739728 - RNA, 21 nt, Leptospira interrogans serovar lai str. 56601
gguuuuuuaauauuagaauug

SEQ ID NO: 739729 - RNA, 18 nt, Leptospira interrogans serovar lai str. 56601
guaaaacccaauaccaaa

SEQ ID NO: 739730 - RNA, 19 nt, Leptospira interrogans serovar lai str. 56601
guaaaacccaucguaaaca

SEQ ID NO: 739731 - RNA, 14 nt, Leptospira interrogans serovar lai str. 56601
guaaaaauucuccu

SEQ ID NO: 739732 - RNA, 15 nt, Leptospira interrogans serovar lai str. 56601
guaaaaaauccauga

SEQ ID NO: 739733 - RNA, 17 nt, Leptospira interrogans serovar lai str. 56601
guaaaaaauccaugauu

SEQ ID NO: 739734 - RNA, 16 nt, Leptospira interrogans serovar lai str. 56601
guaaaaagcguuucau

SEQ ID NO: 739735 - RNA, 11 nt, Leptospira interrogans serovar lai str. 56601
gguuuuaaaac

SEQ ID NO: 739736 - RNA, 20 nt, Leptospira interrogans serovar lai str. 56601
gguuuuacuaaaaaacauaa

SEQ ID NO: 739737 - RNA, 12 nt, Leptospira interrogans serovar lai str. 56601
gguuuuauaaag

SEQ ID NO: 739738 - RNA, 15 nt, Leptospira interrogans serovar lai str. 56601
gguuuguacguaaaa

SEQ ID NO: 739739 - RNA, 14 nt, Leptospira interrogans serovar lai str. 56601
gguuucaauuuaaa

SEQ ID NO: 739740 - RNA, 20 nt, Leptospira interrogans serovar lai str. 56601
gguuaucauaaaaauaaaga

SEQ ID NO: 739741 - RNA, 18 nt, Leptospira interrogans serovar lai str. 56601
gguuaucgucaaaauuua

SEQ ID NO: 739742 - RNA, 22 nt, Leptospira interrogans serovar lai str. 56601
gguuaugguaaggagcucauca

SEQ ID NO: 739743 - RNA, 16 nt, Leptospira interrogans serovar lai str. 56601
gguuccauaaagacca

SEQ ID NO: 739744 - RNA, 21 nt, Leptospira interrogans serovar lai str. 56601
gguucacguuaauugagauuu

SEQ ID NO: 739745 - RNA, 20 nt, Leptospira interrogans serovar lai str. 56601
ggugcuuuguucaaagaaau

SEQ ID NO: 739746 - RNA, 15 nt, Leptospira interrogans serovar lai str. 56601
ggugauuuaaaaaua

SEQ ID NO: 739747 - RNA, 13 nt, Leptospira interrogans serovar lai str. 56601
ggugcaaauuacg

SEQ ID NO: 739748 - RNA, 23 nt, Leptospira interrogans serovar lai str. 56601
ggucauuuuucaaauaaagaaaa

SEQ ID NO: 739749 - RNA, 19 nt, Leptospira interrogans serovar lai str. 56601
gguauuuuagguauuucua

SEQ ID NO: 739750 - RNA, 12 nt, Leptospira interrogans serovar lai str. 56601
gguauuuauuau

SEQ ID NO: 739751 - RNA, 14 nt, Leptospira interrogans serovar lai str. 56601
gggcucaaaaaggc

SEQ ID NO: 739752 - RNA, 15 nt, Leptospira interrogans serovar lai str. 56601
gggauuuuaaaaauu

SEQ ID NO: 739753 - RNA, 16 nt, Leptospira interrogans serovar lai str. 56601
gggagacucuaguaaa

SEQ ID NO: 739754 - RNA, 16 nt, Leptospira interrogans serovar lai str. 56601
gggcccaaauaaaaac

SEQ ID NO: 739755 - RNA, 14 nt, Leptospira interrogans serovar lai str. 56601
gggagaaacacucc

SEQ ID NO: 739756 - RNA, 12 nt, Leptospira interrogans serovar lai str. 56601
gggaauaaaaac

SEQ ID NO: 739757 - RNA, 19 nt, Leptospira interrogans serovar lai str. 56601
gggaauaaaaacaaaauca

SEQ ID NO: 739758 - RNA, 16 nt, Leptospira interrogans serovar lai str. 56601
gggaauauuccauuuu

SEQ ID NO: 739759 - RNA, 21 nt, Leptospira interrogans serovar lai str. 56601
gggaauauucguaagaaaaaa

SEQ ID NO: 739760 - RNA, 22 nt, Leptospira interrogans serovar lai str. 56601
gggaaguaauuuucgaauucuu

SEQ ID NO: 739761 - RNA, 18 nt, Leptospira interrogans serovar lai str. 56601
cuacaccuucuaaaucau

SEQ ID NO: 739762 - RNA, 14 nt, Leptospira interrogans serovar lai str. 56601
cuacacguuuuccu

SEQ ID NO: 739763 - RNA, 12 nt, Leptospira interrogans serovar lai str. 56601
cuacagaauaaa

SEQ ID NO: 739764 - RNA, 17 nt, Leptospira interrogans serovar lai str. 56601
cuacagaauuuuuuaac

SEQ ID NO: 739765 - RNA, 19 nt, Leptospira interrogans serovar lai str. 56601
cuacacuguguucuuuuug

SEQ ID NO: 739766 - RNA, 14 nt, Leptospira interrogans serovar lai str. 56601
cuacaauuauauua

SEQ ID NO: 739767 - RNA, 15 nt, Leptospira interrogans serovar lai str. 56601
cuacaaguucauaag

SEQ ID NO: 739768 - RNA, 21 nt, Leptospira interrogans serovar lai str. 56601
cuacaaguucauaagauugga

SEQ ID NO: 739769 - RNA, 15 nt, Leptospira interrogans serovar lai str. 56601
cuacaauucaucacc

SEQ ID NO: 739770 - RNA, 20 nt, Leptospira interrogans serovar lai str. 56601
cuacaauuuuagaauuuauu

SEQ ID NO: 739771 - RNA, 18 nt, Leptospira interrogans serovar lai str. 56601
cuacauucauuuuuauuu

SEQ ID NO: 739772 - RNA, 21 nt, Leptospira interrogans serovar lai str. 56601
cuacaugauucauuuaaaaau

SEQ ID NO: 739773 - RNA, 15 nt, Leptospira interrogans serovar lai str. 56601
cuacaucgucuucuu

SEQ ID NO: 739774 - RNA, 17 nt, Leptospira interrogans serovar lai str. 56601
cuacaucaguauuuuuu

SEQ ID NO: 739775 - RNA, 15 nt, Leptospira interrogans serovar lai str. 56601
cuacaguuuuagaau

SEQ ID NO: 739776 - RNA, 13 nt, Leptospira interrogans serovar lai str. 56601
cuacagcaaauca

SEQ ID NO: 739777 - RNA, 14 nt, Leptospira interrogans serovar lai str. 56601
cuacagcaaaucac

SEQ ID NO: 739778 - RNA, 21 nt, Leptospira interrogans serovar lai str. 56601
cuacagcugaggaguuuuuau

SEQ ID NO: 739779 - RNA, 10 nt, Leptospira interrogans serovar lai str. 56601
cuaccacaaa

SEQ ID NO: 739780 - RNA, 20 nt, Leptospira interrogans serovar lai str. 56601
cuaccacaaaucuaaauuuu

SEQ ID NO: 739781 - RNA, 15 nt, Leptospira interrogans serovar lai str. 56601
cuaccacagaaagcu

SEQ ID NO: 739782 - RNA, 16 nt, Leptospira interrogans serovar lai str. 56601
cuaccacagaaagcuu

SEQ ID NO: 739783 - RNA, 16 nt, Leptospira interrogans serovar lai str. 56601
cuacauuuuaaaaauu

SEQ ID NO: 739784 - RNA, 14 nt, Leptospira interrogans serovar lai str. 56601
cuacauuuuauuuu

SEQ ID NO: 739785 - RNA, 15 nt, Leptospira interrogans serovar lai str. 56601
cuacauuuuugugaa

SEQ ID NO: 739786 - RNA, 15 nt, Leptospira interrogans serovar lai str. 56601
cuacauuauuuuaug

SEQ ID NO: 739787 - RNA, 12 nt, Leptospira interrogans serovar lai str. 56601
cuaccaaagcuu

SEQ ID NO: 739788 - RNA, 16 nt, Leptospira interrogans serovar lai str. 56601
cuagaaagaauuuaau

SEQ ID NO: 739789 - RNA, 19 nt, Leptospira interrogans serovar lai str. 56601
cuagaaagaauuuaauaaa

SEQ ID NO: 739790 - RNA, 14 nt, Leptospira interrogans serovar lai str. 56601
cuacguuucaauua

SEQ ID NO: 739791 - RNA, 20 nt, Leptospira interrogans serovar lai str. 56601
cuacgucuucuaaauuugua

SEQ ID NO: 739792 - RNA, 23 nt, Leptospira interrogans serovar lai str. 56601
cuagacuuucuuugaacuuuuuc

SEQ ID NO: 739793 - RNA, 15 nt, Leptospira interrogans serovar lai str. 56601
cuagaaccuggaaaa

SEQ ID NO: 739794 - RNA, 19 nt, Leptospira interrogans serovar lai str. 56601
cuagaagaguuuuauccau

SEQ ID NO: 739795 - RNA, 18 nt, Leptospira interrogans serovar lai str. 56601
cuaguauuauuuuccuuu

SEQ ID NO: 739796 - RNA, 20 nt, Leptospira interrogans serovar lai str. 56601
cuaguaguucccacauuuug

SEQ ID NO: 739797 - RNA, 19 nt, Leptospira interrogans serovar lai str. 56601
cuaguucaacguaagaaaa

SEQ ID NO: 739798 - RNA, 23 nt, Leptospira interrogans serovar lai str. 56601
cuaggaaaauuuaacaacauuag

SEQ ID NO: 739799 - RNA, 22 nt, Leptospira interrogans serovar lai str. 56601
cuaggaauuuccgauaaagaaa

SEQ ID NO: 739800 - RNA, 10 nt, Leptospira interrogans serovar lai str. 56601
cuauaaaauc

SEQ ID NO: 739801 - RNA, 13 nt, Leptospira interrogans serovar lai str. 56601
cuauaaaaucaag

SEQ ID NO: 739802 - RNA, 18 nt, Leptospira interrogans serovar lai str. 56601
cuauaaaaucuaaaaaaa

SEQ ID NO: 739803 - RNA, 19 nt, Leptospira interrogans serovar lai str. 56601
cuauaaaaucuaaaaauaa

SEQ ID NO: 739804 - RNA, 23 nt, Leptospira interrogans serovar lai str. 56601
cuauaaaauggguuuucauuuuu

SEQ ID NO: 739805 - RNA, 23 nt, Leptospira interrogans serovar lai str. 56601
cuauaaaccaucucaaaaacacu

SEQ ID NO: 739806 - RNA, 23 nt, Leptospira interrogans serovar lai str. 56601
cuauaaaaccuuuauuuaauaaa

SEQ ID NO: 739807 - RNA, 15 nt, Leptospira interrogans serovar lai str. 56601
cuauaaaauuugaaa

SEQ ID NO: 739808 - RNA, 18 nt, Leptospira interrogans serovar lai str. 56601
cuaguuuauaugaguucc

SEQ ID NO: 739809 - RNA, 13 nt, Leptospira interrogans serovar lai str. 56601
cuaguuuuccuuc

SEQ ID NO: 739810 - RNA, 12 nt, Leptospira interrogans serovar lai str. 56601
cuauaaaguuuu

SEQ ID NO: 739811 - RNA, 18 nt, Leptospira interrogans serovar lai str. 56601
cuauaaauaaauuuaaau

SEQ ID NO: 739812 - RNA, 20 nt, Leptospira interrogans serovar lai str. 56601
cuauaaauucaucuaaaaaa

SEQ ID NO: 739813 - RNA, 22 nt, Leptospira interrogans serovar lai str. 56601
cuauaaauuggguaucuaaaua

SEQ ID NO: 739814 - RNA, 17 nt, Leptospira interrogans serovar lai str. 56601
cuauaacacgauacuca

SEQ ID NO: 739815 - RNA, 21 nt, Leptospira interrogans serovar lai str. 56601
cuauaaccacaagacaaacaa

SEQ ID NO: 739816 - RNA, 16 nt, Leptospira interrogans serovar lai str. 56601
cuauaacuuuaaaaaa

SEQ ID NO: 739817 - RNA, 17 nt, Leptospira interrogans serovar lai str. 56601
cuauaacuuuaaaaaau

SEQ ID NO: 739818 - RNA, 16 nt, Leptospira interrogans serovar lai str. 56601
cuauaauaacaaaaaa

SEQ ID NO: 739819 - RNA, 14 nt, Leptospira interrogans serovar lai str. 56601
cuauacuuucaaaa

SEQ ID NO: 739820 - RNA, 16 nt, Leptospira interrogans serovar lai str. 56601
cuauacuuucaaaaaa

SEQ ID NO: 739821 - RNA, 18 nt, Leptospira interrogans serovar lai str. 56601
cuauacuuucaaaaaaua

SEQ ID NO: 739822 - RNA, 13 nt, Leptospira interrogans serovar lai str. 56601
cucagcuauaaaa

SEQ ID NO: 739823 - RNA, 14 nt, Leptospira interrogans serovar lai str. 56601
cucacuuuuucgug

SEQ ID NO: 739824 - RNA, 14 nt, Leptospira interrogans serovar lai str. 56601
cucagaaaacucag

SEQ ID NO: 739825 - RNA, 20 nt, Leptospira interrogans serovar lai str. 56601
cucacuucgacaacuuuguc

SEQ ID NO: 739826 - RNA, 11 nt, Leptospira interrogans serovar lai str. 56601
cucaaaggaaa

SEQ ID NO: 739827 - RNA, 12 nt, Leptospira interrogans serovar lai str. 56601
cucaaaggaaaa

SEQ ID NO: 739828 - RNA, 20 nt, Leptospira interrogans serovar lai str. 56601
cucaaaggaaaaugaagaaa

SEQ ID NO: 739829 - RNA, 13 nt, Leptospira interrogans serovar lai str. 56601
cucaaaaucuuaa

SEQ ID NO: 739830 - RNA, 19 nt, Leptospira interrogans serovar lai str. 56601
cucaaaauuaagaaucaau

SEQ ID NO: 739831 - RNA, 13 nt, Leptospira interrogans serovar lai str. 56601
cucaaaauuuaag

SEQ ID NO: 739832 - RNA, 15 nt, Leptospira interrogans serovar lai str. 56601
cucaaaauuucggaa

SEQ ID NO: 739833 - RNA, 19 nt, Leptospira interrogans serovar lai str. 56601
cucaaaagcucauaaucaa

SEQ ID NO: 739834 - RNA, 19 nt, Leptospira interrogans serovar lai str. 56601
cucaaaauucuuaaaaaau

SEQ ID NO: 739835 - RNA, 15 nt, Leptospira interrogans serovar lai str. 56601
cucaauuuuccauuu

SEQ ID NO: 739836 - RNA, 17 nt, Leptospira interrogans serovar lai str. 56601
cucaauuuuacagagau

SEQ ID NO: 739837 - RNA, 12 nt, Leptospira interrogans serovar lai str. 56601
cucaauguugcu

SEQ ID NO: 739838 - RNA, 19 nt, Leptospira interrogans serovar lai str. 56601
cucaaaaaggcacauuuuu

SEQ ID NO: 739839 - RNA, 20 nt, Leptospira interrogans serovar lai str. 56601
cucaaaaaggcacauuuuuc

SEQ ID NO: 739840 - RNA, 21 nt, Leptospira interrogans serovar lai str. 56601
cucaaaaaggcacauuuuuca

SEQ ID NO: 739841 - RNA, 22 nt, Leptospira interrogans serovar lai str. 56601
cucaaaaaggcacauuuuucaa

SEQ ID NO: 739842 - RNA, 12 nt, Leptospira interrogans serovar lai str. 56601
cuauuuuuuucg

SEQ ID NO: 739843 - RNA, 14 nt, Leptospira interrogans serovar lai str. 56601
cucaaaaaaaguaa

SEQ ID NO: 739844 - RNA, 23 nt, Leptospira interrogans serovar lai str. 56601
cucaaaaaauuuacacgauaauu

SEQ ID NO: 739845 - RNA, 14 nt, Leptospira interrogans serovar lai str. 56601
cucaaaaaauuuua

SEQ ID NO: 739846 - RNA, 18 nt, Leptospira interrogans serovar lai str. 56601
cuauuuucuuugaaaaaa

SEQ ID NO: 739847 - RNA, 15 nt, Leptospira interrogans serovar lai str. 56601
cuauuuugagaaaau

SEQ ID NO: 739848 - RNA, 12 nt, Leptospira interrogans serovar lai str. 56601
cuauuuuauaau

SEQ ID NO: 739849 - RNA, 19 nt, Leptospira interrogans serovar lai str. 56601
cuauuuuacugauuuagag

SEQ ID NO: 739850 - RNA, 22 nt, Leptospira interrogans serovar lai str. 56601
cuauuuuacugauuuagagagu

SEQ ID NO: 739851 - RNA, 16 nt, Leptospira interrogans serovar lai str. 56601
cuauuuuauuuuucuu

SEQ ID NO: 739852 - RNA, 16 nt, Leptospira interrogans serovar lai str. 56601
cuauuuggauuuuaua

SEQ ID NO: 739853 - RNA, 20 nt, Leptospira interrogans serovar lai str. 56601
cuauuuccguuauauuaaaa

SEQ ID NO: 739854 - RNA, 20 nt, Leptospira interrogans serovar lai str. 56601
cuauuucaguucauucccuu

SEQ ID NO: 739855 - RNA, 15 nt, Leptospira interrogans serovar lai str. 56601
cuauuucccaaaauu

SEQ ID NO: 739856 - RNA, 16 nt, Leptospira interrogans serovar lai str. 56601
cuauuucccaaaauuu

SEQ ID NO: 739857 - RNA, 20 nt, Leptospira interrogans serovar lai str. 56601
cuauucuacagauaaaaaua

SEQ ID NO: 739858 - RNA, 16 nt, Leptospira interrogans serovar lai str. 56601
cuauugcagauaagua

SEQ ID NO: 739859 - RNA, 17 nt, Leptospira interrogans serovar lai str. 56601
cuauugcagauaaguaa

SEQ ID NO: 739860 - RNA, 11 nt, Leptospira interrogans serovar lai str. 56601
cuauuuauacg

SEQ ID NO: 739861 - RNA, 13 nt, Leptospira interrogans serovar lai str. 56601
cuaucuuaaaaug

SEQ ID NO: 739862 - RNA, 16 nt, Leptospira interrogans serovar lai str. 56601
cuaugaaaauucuuuc

SEQ ID NO: 739863 - RNA, 16 nt, Leptospira interrogans serovar lai str. 56601
cuaugaaauacaaaaa

SEQ ID NO: 739864 - RNA, 20 nt, Leptospira interrogans serovar lai str. 56601
cuaugaagucuuaucucaaa

SEQ ID NO: 739865 - RNA, 20 nt, Leptospira interrogans serovar lai str. 56601
cuauagagaaauccaaucau

SEQ ID NO: 739866 - RNA, 18 nt, Leptospira interrogans serovar lai str. 56601
cuauagauugauuuaaau

SEQ ID NO: 739867 - RNA, 21 nt, Leptospira interrogans serovar lai str. 56601
cuauagauugauuuaaaugug

SEQ ID NO: 739868 - RNA, 12 nt, Leptospira interrogans serovar lai str. 56601
cuaucucaaaaa

SEQ ID NO: 739869 - RNA, 17 nt, Leptospira interrogans serovar lai str. 56601
cuaucucaaaaauacuu

SEQ ID NO: 739870 - RNA, 15 nt, Leptospira interrogans serovar lai str. 56601
cuaucucaaaaccua

SEQ ID NO: 739871 - RNA, 14 nt, Leptospira interrogans serovar lai str. 56601
cuauuaucuuucga

SEQ ID NO: 739872 - RNA, 20 nt, Leptospira interrogans serovar lai str. 56601
cuauuaggaaauacaaaaag

SEQ ID NO: 739873 - RNA, 23 nt, Leptospira interrogans serovar lai str. 56601
cuauuaggaaauacaaaaagaau

SEQ ID NO: 739874 - RNA, 15 nt, Leptospira interrogans serovar lai str. 56601
cuaugggaauuuuug

SEQ ID NO: 739875 - RNA, 23 nt, Leptospira interrogans serovar lai str. 56601
cuaugggaauuuuuguaaaaucc

SEQ ID NO: 739876 - RNA, 18 nt, Leptospira interrogans serovar lai str. 56601
cuauggaauauaaaagaa

SEQ ID NO: 739877 - RNA, 16 nt, Leptospira interrogans serovar lai str. 56601
cuauggaauuuuucaa

SEQ ID NO: 739878 - RNA, 18 nt, Leptospira interrogans serovar lai str. 56601
cuauggaauuuuucaaca

SEQ ID NO: 739879 - RNA, 13 nt, Leptospira interrogans serovar lai str. 56601
cucgguaaaaaga

SEQ ID NO: 739880 - RNA, 21 nt, Leptospira interrogans serovar lai str. 56601
cucgugcaaagguucucccaa

SEQ ID NO: 739881 - RNA, 15 nt, Leptospira interrogans serovar lai str. 56601
cucguuauuuaggau

SEQ ID NO: 739882 - RNA, 14 nt, Leptospira interrogans serovar lai str. 56601
cucgguguaaaaaa

SEQ ID NO: 739883 - RNA, 19 nt, Leptospira interrogans serovar lai str. 56601
cucguucaacuuuccuuuu

SEQ ID NO: 739884 - RNA, 20 nt, Leptospira interrogans serovar lai str. 56601
cucuaaaaaucggcauucaa

SEQ ID NO: 739885 - RNA, 21 nt, Leptospira interrogans serovar lai str. 56601
cucguuugaauuugaggagaa

SEQ ID NO: 739886 - RNA, 16 nt, Leptospira interrogans serovar lai str. 56601
cucuaaaauaauuuuu

SEQ ID NO: 739887 - RNA, 21 nt, Leptospira interrogans serovar lai str. 56601
cucuaaagaucggcauucagg

SEQ ID NO: 739888 - RNA, 17 nt, Leptospira interrogans serovar lai str. 56601
cucuaaaugacuugcau

SEQ ID NO: 739889 - RNA, 20 nt, Leptospira interrogans serovar lai str. 56601
cucuaagcuuuagaaaauaa

SEQ ID NO: 739890 - RNA, 14 nt, Leptospira interrogans serovar lai str. 56601
cucgcauuuuccuu

SEQ ID NO: 739891 - RNA, 20 nt, Leptospira interrogans serovar lai str. 56601
cucgcauuuuccuuuuuccg

SEQ ID NO: 739892 - RNA, 14 nt, Leptospira interrogans serovar lai str. 56601
cucgcaaugaaaau

SEQ ID NO: 739893 - RNA, 20 nt, Leptospira interrogans serovar lai str. 56601
cucgcaacggauuccuccag

SEQ ID NO: 739894 - RNA, 21 nt, Leptospira interrogans serovar lai str. 56601
cucgaaauaucguucuagaau

SEQ ID NO: 739895 - RNA, 12 nt, Leptospira interrogans serovar lai str. 56601
cucgaaaugaga

SEQ ID NO: 739896 - RNA, 16 nt, Leptospira interrogans serovar lai str. 56601
cucgaaguaacucagc

SEQ ID NO: 739897 - RNA, 13 nt, Leptospira interrogans serovar lai str. 56601
cuccuacauuuua

SEQ ID NO: 739898 - RNA, 15 nt, Leptospira interrogans serovar lai str. 56601
cuccggaaaaaacug

SEQ ID NO: 739899 - RNA, 16 nt, Leptospira interrogans serovar lai str. 56601
cuccccaaaaucuuua

SEQ ID NO: 739900 - RNA, 13 nt, Leptospira interrogans serovar lai str. 56601
cuccauucuuacu

SEQ ID NO: 739901 - RNA, 14 nt, Leptospira interrogans serovar lai str. 56601
cuccacgauugauu

SEQ ID NO: 739902 - RNA, 19 nt, Leptospira interrogans serovar lai str. 56601
cuccacgauugauuuugga

SEQ ID NO: 739903 - RNA, 23 nt, Leptospira interrogans serovar lai str. 56601
cuccacgauugauuuuggaaaga

SEQ ID NO: 739904 - RNA, 18 nt, Leptospira interrogans serovar lai str. 56601
cuccagauuuaauuuuuc

SEQ ID NO: 739905 - RNA, 12 nt, Leptospira interrogans serovar lai str. 56601
cuccagaauuag

SEQ ID NO: 739906 - RNA, 18 nt, Leptospira interrogans serovar lai str. 56601
cuccacuuaauuuuucuu

SEQ ID NO: 739907 - RNA, 18 nt, Leptospira interrogans serovar lai str. 56601
cuccacuauggaauuuuu

SEQ ID NO: 739908 - RNA, 15 nt, Leptospira interrogans serovar lai str. 56601
cucauuucaaauuua

SEQ ID NO: 739909 - RNA, 13 nt, Leptospira interrogans serovar lai str. 56601
cucauuuuaaacg

SEQ ID NO: 739910 - RNA, 15 nt, Leptospira interrogans serovar lai str. 56601
cuccaaaaaaauaaa

SEQ ID NO: 739911 - RNA, 14 nt, Leptospira interrogans serovar lai str. 56601
cucauuuuucuaaa

SEQ ID NO: 739912 - RNA, 15 nt, Leptospira interrogans serovar lai str. 56601
cucauuuuucuaaaa

SEQ ID NO: 739913 - RNA, 15 nt, Leptospira interrogans serovar lai str. 56601
cucauuuuucuuaaa

SEQ ID NO: 739914 - RNA, 16 nt, Leptospira interrogans serovar lai str. 56601
cucauuuuucuuaaaa

SEQ ID NO: 739915 - RNA, 20 nt, Leptospira interrogans serovar lai str. 56601
cuccaaaaggcacauuuuuc

SEQ ID NO: 739916 - RNA, 15 nt, Leptospira interrogans serovar lai str. 56601
cuccaaaauaugaag

SEQ ID NO: 739917 - RNA, 12 nt, Leptospira interrogans serovar lai str. 56601
cuccaaagugac

SEQ ID NO: 739918 - RNA, 21 nt, Leptospira interrogans serovar lai str. 56601
cuccaaaauuuuuguguaaaa

SEQ ID NO: 739919 - RNA, 22 nt, Leptospira interrogans serovar lai str. 56601
cuccaaacaauuuuuugaaaaa

SEQ ID NO: 739920 - RNA, 22 nt, Leptospira interrogans serovar lai str. 56601
cucauuagaauuguugaaaaau

SEQ ID NO: 739921 - RNA, 22 nt, Leptospira interrogans serovar lai str. 56601
cucauuauuuauaauuuuauaa

SEQ ID NO: 739922 - RNA, 23 nt, Leptospira interrogans serovar lai str. 56601
cucauuauuuauaauuuuauaau

SEQ ID NO: 739923 - RNA, 13 nt, Leptospira interrogans serovar lai str. 56601
cucauucaaguaa

SEQ ID NO: 739924 - RNA, 12 nt, Leptospira interrogans serovar lai str. 56601
cguuuuaaaauu

SEQ ID NO: 739925 - RNA, 13 nt, Leptospira interrogans serovar lai str. 56601
cguuucuauaaaa

SEQ ID NO: 739926 - RNA, 13 nt, Leptospira interrogans serovar lai str. 56601
cguuuaaaaacag

SEQ ID NO: 739927 - RNA, 14 nt, Leptospira interrogans serovar lai str. 56601
cguuuaaaaacaga

SEQ ID NO: 739928 - RNA, 14 nt, Leptospira interrogans serovar lai str. 56601
cguuucccucuucu

SEQ ID NO: 739929 - RNA, 15 nt, Leptospira interrogans serovar lai str. 56601
cguuguauuuuaaac

SEQ ID NO: 739930 - RNA, 14 nt, Leptospira interrogans serovar lai str. 56601
cuaaaauuuuauaa

SEQ ID NO: 739931 - RNA, 19 nt, Leptospira interrogans serovar lai str. 56601
cuaaacauuuaacuuuuau

SEQ ID NO: 739932 - RNA, 16 nt, Leptospira interrogans serovar lai str. 56601
cuaaaauuuguaggaa

SEQ ID NO: 739933 - RNA, 18 nt, Leptospira interrogans serovar lai str. 56601
cuaaaauuuuaaaaaauu

SEQ ID NO: 739934 - RNA, 20 nt, Leptospira interrogans serovar lai str. 56601
cuaaaauuuuaaaaaauuua

SEQ ID NO: 739935 - RNA, 18 nt, Leptospira interrogans serovar lai str. 56601
cuaaaauuguaggaacua

SEQ ID NO: 739936 - RNA, 21 nt, Leptospira interrogans serovar lai str. 56601
cuaaaauugacaaagaguugu

SEQ ID NO: 739937 - RNA, 15 nt, Leptospira interrogans serovar lai str. 56601
cuaaaauaaaauucc

SEQ ID NO: 739938 - RNA, 18 nt, Leptospira interrogans serovar lai str. 56601
cuaaaauucaguuucaaa

SEQ ID NO: 739939 - RNA, 20 nt, Leptospira interrogans serovar lai str. 56601
cuaaaaguaacaguuccuaa

SEQ ID NO: 739940 - RNA, 18 nt, Leptospira interrogans serovar lai str. 56601
cuaaaaaacugauuaaaa

SEQ ID NO: 739941 - RNA, 14 nt, Leptospira interrogans serovar lai str. 56601
cuaaaaaaauuaau

SEQ ID NO: 739942 - RNA, 19 nt, Leptospira interrogans serovar lai str. 56601
cuaaaaaaauuaauucucc

SEQ ID NO: 739943 - RNA, 11 nt, Leptospira interrogans serovar lai str. 56601
cuaaaaaaaau

SEQ ID NO: 739944 - RNA, 12 nt, Leptospira interrogans serovar lai str. 56601
cuaaaaaaaaug

SEQ ID NO: 739945 - RNA, 13 nt, Leptospira interrogans serovar lai str. 56601
cuaaaaaaaaugg

SEQ ID NO: 739946 - RNA, 23 nt, Leptospira interrogans serovar lai str. 56601
cuaaaaaauuaccgaguuuauca

SEQ ID NO: 739947 - RNA, 12 nt, Leptospira interrogans serovar lai str. 56601
cuaaaaaauucu

SEQ ID NO: 739948 - RNA, 15 nt, Leptospira interrogans serovar lai str. 56601
cuaaaaaauuuuuag

SEQ ID NO: 739949 - RNA, 16 nt, Leptospira interrogans serovar lai str. 56601
cuaaaagcuaauaauc

SEQ ID NO: 739950 - RNA, 21 nt, Leptospira interrogans serovar lai str. 56601
cuaaaagcuaauaaucgauuu

SEQ ID NO: 739951 - RNA, 12 nt, Leptospira interrogans serovar lai str. 56601
cguuuuuuucau

SEQ ID NO: 739952 - RNA, 15 nt, Leptospira interrogans serovar lai str. 56601
cguuuuguugugaac

SEQ ID NO: 739953 - RNA, 15 nt, Leptospira interrogans serovar lai str. 56601
cguuuuguugaguuu

SEQ ID NO: 739954 - RNA, 18 nt, Leptospira interrogans serovar lai str. 56601
cguuuuguugaguuugaa

SEQ ID NO: 739955 - RNA, 14 nt, Leptospira interrogans serovar lai str. 56601
cguuuuuaaaugug

SEQ ID NO: 739956 - RNA, 17 nt, Leptospira interrogans serovar lai str. 56601
cguuuugcguuuuuaaa

SEQ ID NO: 739957 - RNA, 13 nt, Leptospira interrogans serovar lai str. 56601
cguuuugcugagu

SEQ ID NO: 739958 - RNA, 15 nt, Leptospira interrogans serovar lai str. 56601
cguuuuacugaguuu

SEQ ID NO: 739959 - RNA, 20 nt, Leptospira interrogans serovar lai str. 56601
cguucaacaaacaaauagaa

SEQ ID NO: 739960 - RNA, 17 nt, Leptospira interrogans serovar lai str. 56601
cguuauuuuaacuugag

SEQ ID NO: 739961 - RNA, 22 nt, Leptospira interrogans serovar lai str. 56601
cguuauucuauucguauuuuau

SEQ ID NO: 739962 - RNA, 19 nt, Leptospira interrogans serovar lai str. 56601
cguucuaaguccacccaaa

SEQ ID NO: 739963 - RNA, 12 nt, Leptospira interrogans serovar lai str. 56601
cguucuacaaaa

SEQ ID NO: 739964 - RNA, 17 nt, Leptospira interrogans serovar lai str. 56601
cguucguaguuuuuguu

SEQ ID NO: 739965 - RNA, 15 nt, Leptospira interrogans serovar lai str. 56601
cuaaacccugagaau

SEQ ID NO: 739966 - RNA, 19 nt, Leptospira interrogans serovar lai str. 56601
cuaaacgaguuuuuguuau

SEQ ID NO: 739967 - RNA, 14 nt, Leptospira interrogans serovar lai str. 56601
cuaacgugagcucu

SEQ ID NO: 739968 - RNA, 17 nt, Leptospira interrogans serovar lai str. 56601
cuaacugauuauaaaaa

SEQ ID NO: 739969 - RNA, 23 nt, Leptospira interrogans serovar lai str. 56601
cuaacuuauaagacauuggcaaa

SEQ ID NO: 739970 - RNA, 17 nt, Leptospira interrogans serovar lai str. 56601
cuaacgauuguaaaaaa

SEQ ID NO: 739971 - RNA, 18 nt, Leptospira interrogans serovar lai str. 56601
cuaacgauuguaaaaaaa

SEQ ID NO: 739972 - RNA, 22 nt, Leptospira interrogans serovar lai str. 56601
cuaacgauuguaaaaaaacaug

SEQ ID NO: 739973 - RNA, 14 nt, Leptospira interrogans serovar lai str. 56601
cuaagaaaaaaguu

SEQ ID NO: 739974 - RNA, 15 nt, Leptospira interrogans serovar lai str. 56601
cuaagaaaaaaguug

SEQ ID NO: 739975 - RNA, 20 nt, Leptospira interrogans serovar lai str. 56601
cuaagaaaaaaguugcuaag

SEQ ID NO: 739976 - RNA, 17 nt, Leptospira interrogans serovar lai str. 56601
cuaagaucaacacaaau

SEQ ID NO: 739977 - RNA, 21 nt, Leptospira interrogans serovar lai str. 56601
cuaagauccaaauuuuuuaca

SEQ ID NO: 739978 - RNA, 23 nt, Leptospira interrogans serovar lai str. 56601
cuaagaguagaguaagaaacauc

SEQ ID NO: 739979 - RNA, 12 nt, Leptospira interrogans serovar lai str. 56601
cuaaguccuuuu

SEQ ID NO: 739980 - RNA, 15 nt, Leptospira interrogans serovar lai str. 56601
cuaauaaaaaugugg

SEQ ID NO: 739981 - RNA, 14 nt, Leptospira interrogans serovar lai str. 56601
cuaaggauccaaua

SEQ ID NO: 739982 - RNA, 19 nt, Leptospira interrogans serovar lai str. 56601
cuaagcuuuagaaaauaau

SEQ ID NO: 739983 - RNA, 14 nt, Leptospira interrogans serovar lai str. 56601
cuaaugaaggaauu

SEQ ID NO: 739984 - RNA, 20 nt, Leptospira interrogans serovar lai str. 56601
cuaaugaaggaauuggaaua

SEQ ID NO: 739985 - RNA, 15 nt, Leptospira interrogans serovar lai str. 56601
cuaaugaaaaagaaa

SEQ ID NO: 739986 - RNA, 17 nt, Leptospira interrogans serovar lai str. 56601
cuaaugcagcuucuucc

SEQ ID NO: 739987 - RNA, 21 nt, Leptospira interrogans serovar lai str. 56601
cuaauaaacaaaauucaaaug

SEQ ID NO: 739988 - RNA, 20 nt, Leptospira interrogans serovar lai str. 56601
cuaauacaaaaaauguuuaa

SEQ ID NO: 739989 - RNA, 18 nt, Leptospira interrogans serovar lai str. 56601
cuaauauaaaaaccacaa

SEQ ID NO: 739990 - RNA, 23 nt, Leptospira interrogans serovar lai str. 56601
cuaauauaaaaaccacaaaaaca

SEQ ID NO: 739991 - RNA, 16 nt, Leptospira interrogans serovar lai str. 56601
cuaauauaucagauug

SEQ ID NO: 739992 - RNA, 18 nt, Leptospira interrogans serovar lai str. 56601
cuaauauaucagauugau

SEQ ID NO: 739993 - RNA, 16 nt, Leptospira interrogans serovar lai str. 56601
cuaauauguuuagagu

SEQ ID NO: 739994 - RNA, 12 nt, Leptospira interrogans serovar lai str. 56601
cuaauauuaaaa

SEQ ID NO: 739995 - RNA, 19 nt, Leptospira interrogans serovar lai str. 56601
cuaauauuauuuuuuucua

SEQ ID NO: 739996 - RNA, 13 nt, Leptospira interrogans serovar lai str. 56601
cuaaucagauuuu

SEQ ID NO: 739997 - RNA, 15 nt, Leptospira interrogans serovar lai str. 56601
cuaauucuaaaaauu

SEQ ID NO: 739998 - RNA, 22 nt, Leptospira interrogans serovar lai str. 56601
cuaauucuaaaaauuuuuuuaa

SEQ ID NO: 739999 - RNA, 23 nt, Leptospira interrogans serovar lai str. 56601
cuaauucuaaaaauuuuuuuaaa

SEQ ID NO: 740000 - RNA, 16 nt, Leptospira interrogans serovar lai str. 56601
cuaauucuuaaaaauu

SEQ ID NO: 740001 - RNA, 14 nt, Leptospira interrogans serovar lai str. 56601
cuaauuuauaaacu

SEQ ID NO: 740002 - RNA, 16 nt, Leptospira interrogans serovar lai str. 56601
cuaauuuauaaacuua

SEQ ID NO: 740003 - RNA, 22 nt, Leptospira interrogans serovar lai str. 56601
cuaauuuaucgauuuaaaaacu

SEQ ID NO: 740004 - RNA, 18 nt, Leptospira interrogans serovar lai str. 56601
cuaauguuuguccuagau

SEQ ID NO: 740005 - RNA, 13 nt, Leptospira interrogans serovar lai str. 56601
cuaauucaauaag

SEQ ID NO: 740006 - RNA, 17 nt, Leptospira interrogans serovar lai str. 56601
cuaauuacgauuuuuug

SEQ ID NO: 740007 - RNA, 13 nt, Leptospira interrogans serovar lai str. 56601
cuaauuaaauucu

SEQ ID NO: 740008 - RNA, 15 nt, Leptospira interrogans serovar lai str. 56601
cuaauuuguaggaau

SEQ ID NO: 740009 - RNA, 14 nt, Leptospira interrogans serovar lai str. 56601
cuaauuuuuaucca

SEQ ID NO: 740010 - RNA, 18 nt, Leptospira interrogans serovar lai str. 56601
cuaauuuuucaaaaacuc

SEQ ID NO: 740011 - RNA, 19 nt, Leptospira interrogans serovar lai str. 56601
cuaauuuuucaaaaacucu

SEQ ID NO: 740012 - RNA, 15 nt, Leptospira interrogans serovar lai str. 56601
cuaauuuuauuccaa

SEQ ID NO: 740013 - RNA, 21 nt, Leptospira interrogans serovar lai str. 56601
cuaauuuugugaaucaaaagg

SEQ ID NO: 740014 - RNA, 12 nt, Leptospira interrogans serovar lai str. 56601
cuacaaauucau

SEQ ID NO: 740015 - RNA, 17 nt, Leptospira interrogans serovar lai str. 56601
cuacaaauucuucuucc

SEQ ID NO: 740016 - RNA, 14 nt, Leptospira interrogans serovar lai str. 56601
cuacaaauuaaguc

SEQ ID NO: 740017 - RNA, 17 nt, Leptospira interrogans serovar lai str. 56601
cgucggaagccauaauc

SEQ ID NO: 740018 - RNA, 18 nt, Leptospira interrogans serovar lai str. 56601
cgugaucuccuaaaauaa

SEQ ID NO: 740019 - RNA, 22 nt, Leptospira interrogans serovar lai str. 56601
cgugagcucuauguaagaaaau

SEQ ID NO: 740020 - RNA, 19 nt, Leptospira interrogans serovar lai str. 56601
cgucuucuuuacaauuugc

SEQ ID NO: 740021 - RNA, 15 nt, Leptospira interrogans serovar lai str. 56601
cgugacuaaaauuga

SEQ ID NO: 740022 - RNA, 15 nt, Leptospira interrogans serovar lai str. 56601
cgucuauaaaauuca

SEQ ID NO: 740023 - RNA, 11 nt, Leptospira interrogans serovar lai str. 56601
cguauucuuua

SEQ ID NO: 740024 - RNA, 13 nt, Leptospira interrogans serovar lai str. 56601
cguauuuuuaaau

SEQ ID NO: 740025 - RNA, 16 nt, Leptospira interrogans serovar lai str. 56601
cguauuuuuaaaugua

SEQ ID NO: 740026 - RNA, 17 nt, Leptospira interrogans serovar lai str. 56601
cgucaucucgaagaaca

SEQ ID NO: 740027 - RNA, 21 nt, Leptospira interrogans serovar lai str. 56601
cgucauguauauaaauuuaua

SEQ ID NO: 740028 - RNA, 22 nt, Leptospira interrogans serovar lai str. 56601
cguagauuacuaugaaaauucu

SEQ ID NO: 740029 - RNA, 15 nt, Leptospira interrogans serovar lai str. 56601
cguagccgcuucaaa

SEQ ID NO: 740030 - RNA, 15 nt, Leptospira interrogans serovar lai str. 56601
cguauccuuaaaaug

SEQ ID NO: 740031 - RNA, 23 nt, Leptospira interrogans serovar lai str. 56601
cguaggcuugucguaaaaaaaua

SEQ ID NO: 740032 - RNA, 17 nt, Leptospira interrogans serovar lai str. 56601
cguaauucguuccaaau

SEQ ID NO: 740033 - RNA, 22 nt, Leptospira interrogans serovar lai str. 56601
cuuccugauuuggaaucugcau

SEQ ID NO: 740034 - RNA, 18 nt, Leptospira interrogans serovar lai str. 56601
cuuccuuuuucauuuuua

SEQ ID NO: 740035 - RNA, 12 nt, Leptospira interrogans serovar lai str. 56601
cuuccuucuuga

SEQ ID NO: 740036 - RNA, 14 nt, Leptospira interrogans serovar lai str. 56601
cuuccgcauuuuua

SEQ ID NO: 740037 - RNA, 19 nt, Leptospira interrogans serovar lai str. 56601
cuuccgauucacuuccauu

SEQ ID NO: 740038 - RNA, 23 nt, Leptospira interrogans serovar lai str. 56601
aaacuuagcagaacgcucucuca

SEQ ID NO: 740039 - RNA, 14 nt, Leptospira interrogans serovar lai str. 56601
aaacuuauacuuua

SEQ ID NO: 740040 - RNA, 16 nt, Leptospira interrogans serovar lai str. 56601
aaacuuaaauucggaa

SEQ ID NO: 740041 - RNA, 15 nt, Leptospira interrogans serovar lai str. 56601
aaacuuaaucucaug

SEQ ID NO: 740042 - RNA, 14 nt, Leptospira interrogans serovar lai str. 56601
aaacuucaaaaaau

SEQ ID NO: 740043 - RNA, 16 nt, Leptospira interrogans serovar lai str. 56601
aaacuucaaaaaauau

SEQ ID NO: 740044 - RNA, 18 nt, Leptospira interrogans serovar lai str. 56601
aaacuucaaaaaauauag

SEQ ID NO: 740045 - RNA, 13 nt, Leptospira interrogans serovar lai str. 56601
cuuccauuuuuua

SEQ ID NO: 740046 - RNA, 16 nt, Leptospira interrogans serovar lai str. 56601
cuuccaucaaauacaa

SEQ ID NO: 740047 - RNA, 19 nt, Leptospira interrogans serovar lai str. 56601
cuuccaucaaauacaaaau

SEQ ID NO: 740048 - RNA, 18 nt, Leptospira interrogans serovar lai str. 56601
cuucaauuguccauuuca

SEQ ID NO: 740049 - RNA, 17 nt, Leptospira interrogans serovar lai str. 56601
cuuauucuuauaagaau

SEQ ID NO: 740050 - RNA, 14 nt, Leptospira interrogans serovar lai str. 56601
cuucaaaguugauu

SEQ ID NO: 740051 - RNA, 22 nt, Leptospira interrogans serovar lai str. 56601
cuuauugaugauugaaacguuu

SEQ ID NO: 740052 - RNA, 12 nt, Leptospira interrogans serovar lai str. 56601
cuucaaauucua

SEQ ID NO: 740053 - RNA, 18 nt, Leptospira interrogans serovar lai str. 56601
cuucaaguuugugagagu

SEQ ID NO: 740054 - RNA, 19 nt, Leptospira interrogans serovar lai str. 56601
cuucauccgggcuuuucuu

SEQ ID NO: 740055 - RNA, 15 nt, Leptospira interrogans serovar lai str. 56601
cuucaugagaaacaa

SEQ ID NO: 740056 - RNA, 15 nt, Leptospira interrogans serovar lai str. 56601
cuucauuaauuuuug

SEQ ID NO: 740057 - RNA, 23 nt, Leptospira interrogans serovar lai str. 56601
cuucauuaauuuuugaguagaag

SEQ ID NO: 740058 - RNA, 13 nt, Leptospira interrogans serovar lai str. 56601
cuuccaaagauuu

SEQ ID NO: 740059 - RNA, 15 nt, Leptospira interrogans serovar lai str. 56601
cuucauauaauaaaa

SEQ ID NO: 740060 - RNA, 14 nt, Leptospira interrogans serovar lai str. 56601
cuucagccgcuuca

SEQ ID NO: 740061 - RNA, 19 nt, Leptospira interrogans serovar lai str. 56601
cuuaauuuguaggaacuac

SEQ ID NO: 740062 - RNA, 20 nt, Leptospira interrogans serovar lai str. 56601
cuuaauuguggaacaaucuu

SEQ ID NO: 740063 - RNA, 20 nt, Leptospira interrogans serovar lai str. 56601
cuuaauuguugcuauggaau

SEQ ID NO: 740064 - RNA, 21 nt, Leptospira interrogans serovar lai str. 56601
cuuaagauagccuaauuuacu

SEQ ID NO: 740065 - RNA, 17 nt, Leptospira interrogans serovar lai str. 56601
cuuaagcucuaauauuu

SEQ ID NO: 740066 - RNA, 15 nt, Leptospira interrogans serovar lai str. 56601
cuuaagaauugaucu

SEQ ID NO: 740067 - RNA, 20 nt, Leptospira interrogans serovar lai str. 56601
cuuaagacccuaaaaaauuu

SEQ ID NO: 740068 - RNA, 20 nt, Leptospira interrogans serovar lai str. 56601
cuuaagagaaccucuauaaa

SEQ ID NO: 740069 - RNA, 13 nt, Leptospira interrogans serovar lai str. 56601
cuuaauaaacuuu

SEQ ID NO: 740070 - RNA, 16 nt, Leptospira interrogans serovar lai str. 56601
cuuaaguuucaaguuu

SEQ ID NO: 740071 - RNA, 20 nt, Leptospira interrogans serovar lai str. 56601
cuuaaggaaauucauuuuuc

SEQ ID NO: 740072 - RNA, 22 nt, Leptospira interrogans serovar lai str. 56601
cuuacaaagcacuuuuuuccuc

SEQ ID NO: 740073 - RNA, 19 nt, Leptospira interrogans serovar lai str. 56601
cuuacaauaaaaacuuaug

SEQ ID NO: 740074 - RNA, 21 nt, Leptospira interrogans serovar lai str. 56601
cuuacacuccucaaagauuac

SEQ ID NO: 740075 - RNA, 19 nt, Leptospira interrogans serovar lai str. 56601
cuuacagauugauuuuuua

SEQ ID NO: 740076 - RNA, 12 nt, Leptospira interrogans serovar lai str. 56601
cuuacaauuuca

SEQ ID NO: 740077 - RNA, 20 nt, Leptospira interrogans serovar lai str. 56601
cuuacuuaccucuauaaaau

SEQ ID NO: 740078 - RNA, 20 nt, Leptospira interrogans serovar lai str. 56601
cuuagaaagcauggucuguc

SEQ ID NO: 740079 - RNA, 18 nt, Leptospira interrogans serovar lai str. 56601
cuuacuuugagaaaauuu

SEQ ID NO: 740080 - RNA, 14 nt, Leptospira interrogans serovar lai str. 56601
cuuagaauuuuguu

SEQ ID NO: 740081 - RNA, 14 nt, Leptospira interrogans serovar lai str. 56601
cuuagaauuuuuuc

SEQ ID NO: 740082 - RNA, 21 nt, Leptospira interrogans serovar lai str. 56601
cuuagaauuguugaaaaauua

SEQ ID NO: 740083 - RNA, 14 nt, Leptospira interrogans serovar lai str. 56601
cuuauacucuuaaa

SEQ ID NO: 740084 - RNA, 17 nt, Leptospira interrogans serovar lai str. 56601
cuuauacucuuaaaauu

SEQ ID NO: 740085 - RNA, 11 nt, Leptospira interrogans serovar lai str. 56601
cuuauaaaauu

SEQ ID NO: 740086 - RNA, 23 nt, Leptospira interrogans serovar lai str. 56601
cuuauaaugaagacgcuucaucg

SEQ ID NO: 740087 - RNA, 18 nt, Leptospira interrogans serovar lai str. 56601
cuuaugaaagcaauccau

SEQ ID NO: 740088 - RNA, 21 nt, Leptospira interrogans serovar lai str. 56601
cuuaugagaguucccacggau

SEQ ID NO: 740089 - RNA, 21 nt, Leptospira interrogans serovar lai str. 56601
cuuaucucaaagccuuaaauc

SEQ ID NO: 740090 - RNA, 23 nt, Leptospira interrogans serovar lai str. 56601
cuuaucucaaagccuuaaaucaa

SEQ ID NO: 740091 - RNA, 12 nt, Leptospira interrogans serovar lai str. 56601
cuuaucuaauuu

SEQ ID NO: 740092 - RNA, 16 nt, Leptospira interrogans serovar lai str. 56601
cuuaucuaauuuuuug

SEQ ID NO: 740093 - RNA, 12 nt, Leptospira interrogans serovar lai str. 56601
cuuaaaauuuag

SEQ ID NO: 740094 - RNA, 15 nt, Leptospira interrogans serovar lai str. 56601
cuuaaaauuuagaaa

SEQ ID NO: 740095 - RNA, 13 nt, Leptospira interrogans serovar lai str. 56601
cuuaaaagugauu

SEQ ID NO: 740096 - RNA, 15 nt, Leptospira interrogans serovar lai str. 56601
cuuaaauuuuuuuuc

SEQ ID NO: 740097 - RNA, 13 nt, Leptospira interrogans serovar lai str. 56601
aaacuuaaaaugu

SEQ ID NO: 740098 - RNA, 12 nt, Leptospira interrogans serovar lai str. 56601
aaacuuaaaaau

SEQ ID NO: 740099 - RNA, 14 nt, Leptospira interrogans serovar lai str. 56601
aaacuuaaaaaugu

SEQ ID NO: 740100 - RNA, 15 nt, Leptospira interrogans serovar lai str. 56601
aaacugucggaauua

SEQ ID NO: 740101 - RNA, 15 nt, Leptospira interrogans serovar lai str. 56601
cuuaaaauguaggaa

SEQ ID NO: 740102 - RNA, 18 nt, Leptospira interrogans serovar lai str. 56601
cuguucuuagucuaaaaa

SEQ ID NO: 740103 - RNA, 18 nt, Leptospira interrogans serovar lai str. 56601
cuguugaguucauucuga

SEQ ID NO: 740104 - RNA, 21 nt, Leptospira interrogans serovar lai str. 56601
cuguugaguucauucugauuc

SEQ ID NO: 740105 - RNA, 13 nt, Leptospira interrogans serovar lai str. 56601
cuguuaauuuuua

SEQ ID NO: 740106 - RNA, 19 nt, Leptospira interrogans serovar lai str. 56601
cugugggaacuaucacaaa

SEQ ID NO: 740107 - RNA, 19 nt, Leptospira interrogans serovar lai str. 56601
cugugaucagaauuaaaaa

SEQ ID NO: 740108 - RNA, 22 nt, Leptospira interrogans serovar lai str. 56601
cugucuucagcagucugugauu

SEQ ID NO: 740109 - RNA, 16 nt, Leptospira interrogans serovar lai str. 56601
aaacucuuuaaaaacu

SEQ ID NO: 740110 - RNA, 19 nt, Leptospira interrogans serovar lai str. 56601
aaacucuuuauuuuuaacg

SEQ ID NO: 740111 - RNA, 22 nt, Leptospira interrogans serovar lai str. 56601
aaacucuaccuuuauuuaaaaa

SEQ ID NO: 740112 - RNA, 22 nt, Leptospira interrogans serovar lai str. 56601
aaacucuauuagaauuguugaa

SEQ ID NO: 740113 - RNA, 19 nt, Leptospira interrogans serovar lai str. 56601
cuguagaaccuggauuugu

SEQ ID NO: 740114 - RNA, 14 nt, Leptospira interrogans serovar lai str. 56601
cuguagcucaaggu

SEQ ID NO: 740115 - RNA, 22 nt, Leptospira interrogans serovar lai str. 56601
cugucaguagguuuuuaauuuc

SEQ ID NO: 740116 - RNA, 20 nt, Leptospira interrogans serovar lai str. 56601
aaacugcgguucuaguauua

SEQ ID NO: 740117 - RNA, 13 nt, Leptospira interrogans serovar lai str. 56601
aaacugauuaaaa

SEQ ID NO: 740118 - RNA, 16 nt, Leptospira interrogans serovar lai str. 56601
aaacugauuaaaauca

SEQ ID NO: 740119 - RNA, 20 nt, Leptospira interrogans serovar lai str. 56601
aaacugaguaccguuuauuu

SEQ ID NO: 740120 - RNA, 17 nt, Leptospira interrogans serovar lai str. 56601
cuguaaauuagauuauu

SEQ ID NO: 740121 - RNA, 15 nt, Leptospira interrogans serovar lai str. 56601
cuguaaauucaaaau

SEQ ID NO: 740122 - RNA, 17 nt, Leptospira interrogans serovar lai str. 56601
cuguaaauucaaagcaa

SEQ ID NO: 740123 - RNA, 12 nt, Leptospira interrogans serovar lai str. 56601
cuguaaaucaac

SEQ ID NO: 740124 - RNA, 14 nt, Leptospira interrogans serovar lai str. 56601
cuguaaaguuuaga

SEQ ID NO: 740125 - RNA, 13 nt, Leptospira interrogans serovar lai str. 56601
cuguaaacuugau

SEQ ID NO: 740126 - RNA, 13 nt, Leptospira interrogans serovar lai str. 56601
cuguaaaaaauaa

SEQ ID NO: 740127 - RNA, 15 nt, Leptospira interrogans serovar lai str. 56601
cuguaaaaaauaaac

SEQ ID NO: 740128 - RNA, 17 nt, Leptospira interrogans serovar lai str. 56601
cuguaaaagaaaaauua

SEQ ID NO: 740129 - RNA, 12 nt, Leptospira interrogans serovar lai str. 56601
cuguaaaaguuu

SEQ ID NO: 740130 - RNA, 17 nt, Leptospira interrogans serovar lai str. 56601
cuguaaaaguuuuugaa

SEQ ID NO: 740131 - RNA, 23 nt, Leptospira interrogans serovar lai str. 56601
cuguaaaaugauguaggaacuac

SEQ ID NO: 740132 - RNA, 22 nt, Leptospira interrogans serovar lai str. 56601
cuguaacauccaaacucuuaau

SEQ ID NO: 740133 - RNA, 19 nt, Leptospira interrogans serovar lai str. 56601
cugguuuauuuuugaauuu

SEQ ID NO: 740134 - RNA, 22 nt, Leptospira interrogans serovar lai str. 56601
cugguuuauuuuugaauuuuuu

SEQ ID NO: 740135 - RNA, 16 nt, Leptospira interrogans serovar lai str. 56601
cugguuucaaaaaauc

SEQ ID NO: 740136 - RNA, 14 nt, Leptospira interrogans serovar lai str. 56601
cugguuuuauuucu

SEQ ID NO: 740137 - RNA, 20 nt, Leptospira interrogans serovar lai str. 56601
cugguuuuauuucugcugcu

SEQ ID NO: 740138 - RNA, 14 nt, Leptospira interrogans serovar lai str. 56601
cugggcuccaaaag

SEQ ID NO: 740139 - RNA, 17 nt, Leptospira interrogans serovar lai str. 56601
cuggguaaaaaaaaaug

SEQ ID NO: 740140 - RNA, 22 nt, Leptospira interrogans serovar lai str. 56601
cuggguaaaaaaaaaugagaaa

SEQ ID NO: 740141 - RNA, 12 nt, Leptospira interrogans serovar lai str. 56601
aaacucaguaaa

SEQ ID NO: 740142 - RNA, 19 nt, Leptospira interrogans serovar lai str. 56601
aaacucaguaaaacgcucu

SEQ ID NO: 740143 - RNA, 22 nt, Leptospira interrogans serovar lai str. 56601
aaacucaguaaaacgcucucua

SEQ ID NO: 740144 - RNA, 17 nt, Leptospira interrogans serovar lai str. 56601
aaacucaguaaacucaa

SEQ ID NO: 740145 - RNA, 18 nt, Leptospira interrogans serovar lai str. 56601
aaacucacgcuaaaauaa

SEQ ID NO: 740146 - RNA, 16 nt, Leptospira interrogans serovar lai str. 56601
cugggaucggaaccaa

SEQ ID NO: 740147 - RNA, 14 nt, Leptospira interrogans serovar lai str. 56601
aaacuccagaauua

SEQ ID NO: 740148 - RNA, 20 nt, Leptospira interrogans serovar lai str. 56601
aaacucauuuuucuaaaaaa

SEQ ID NO: 740149 - RNA, 21 nt, Leptospira interrogans serovar lai str. 56601
aaacucauuuuucuaaaaaaa

SEQ ID NO: 740150 - RNA, 17 nt, Leptospira interrogans serovar lai str. 56601
cuggauaggauuccauu

SEQ ID NO: 740151 - RNA, 17 nt, Leptospira interrogans serovar lai str. 56601
cuggauauauagaagcc

SEQ ID NO: 740152 - RNA, 16 nt, Leptospira interrogans serovar lai str. 56601
cuggaagccaaaacca

SEQ ID NO: 740153 - RNA, 17 nt, Leptospira interrogans serovar lai str. 56601
cuggaacggaaauguua

SEQ ID NO: 740154 - RNA, 22 nt, Leptospira interrogans serovar lai str. 56601
cugcuacaacccaacuuucgca

SEQ ID NO: 740155 - RNA, 21 nt, Leptospira interrogans serovar lai str. 56601
aaacuaucuuaaaaugauuuu

SEQ ID NO: 740156 - RNA, 14 nt, Leptospira interrogans serovar lai str. 56601
aaacuauuacaaau

SEQ ID NO: 740157 - RNA, 17 nt, Leptospira interrogans serovar lai str. 56601
aaacuauuacaaauagg

SEQ ID NO: 740158 - RNA, 21 nt, Leptospira interrogans serovar lai str. 56601
aaacuauugcagauaaguaag

SEQ ID NO: 740159 - RNA, 13 nt, Leptospira interrogans serovar lai str. 56601
aaacuaucacaaa

SEQ ID NO: 740160 - RNA, 15 nt, Leptospira interrogans serovar lai str. 56601
aaacuauccaaaagu

SEQ ID NO: 740161 - RNA, 16 nt, Leptospira interrogans serovar lai str. 56601
aaacuaucgaaugcga

SEQ ID NO: 740162 - RNA, 19 nt, Leptospira interrogans serovar lai str. 56601
aaacuauacuuucaaaaaa

SEQ ID NO: 740163 - RNA, 22 nt, Leptospira interrogans serovar lai str. 56601
aaacuauagagaaauccaauca

SEQ ID NO: 740164 - RNA, 14 nt, Leptospira interrogans serovar lai str. 56601
cugccuucuuuuuu

SEQ ID NO: 740165 - RNA, 17 nt, Leptospira interrogans serovar lai str. 56601
cugauuuuuuaaaugug

SEQ ID NO: 740166 - RNA, 23 nt, Leptospira interrogans serovar lai str. 56601
cugauuuuuccauaaaaaaugaa

SEQ ID NO: 740167 - RNA, 12 nt, Leptospira interrogans serovar lai str. 56601
cugauuuuucug

SEQ ID NO: 740168 - RNA, 16 nt, Leptospira interrogans serovar lai str. 56601
cugauuuuucuuuaga

SEQ ID NO: 740169 - RNA, 18 nt, Leptospira interrogans serovar lai str. 56601
cugauuuuucuuuagaca

SEQ ID NO: 740170 - RNA, 13 nt, Leptospira interrogans serovar lai str. 56601
cugauuuuuauaa

SEQ ID NO: 740171 - RNA, 18 nt, Leptospira interrogans serovar lai str. 56601
cugauuuuuauaauuuag

SEQ ID NO: 740172 - RNA, 19 nt, Leptospira interrogans serovar lai str. 56601
cugcaaaucccgaauuuac

SEQ ID NO: 740173 - RNA, 17 nt, Leptospira interrogans serovar lai str. 56601
cugcaucaaccaagaau

SEQ ID NO: 740174 - RNA, 13 nt, Leptospira interrogans serovar lai str. 56601
cugcagcugaaag

SEQ ID NO: 740175 - RNA, 13 nt, Leptospira interrogans serovar lai str. 56601
cugaaucucuuuu

SEQ ID NO: 740176 - RNA, 15 nt, Leptospira interrogans serovar lai str. 56601
cugaaucucuuuuuc

SEQ ID NO: 740177 - RNA, 16 nt, Leptospira interrogans serovar lai str. 56601
cugaaucucuuuuucu

SEQ ID NO: 740178 - RNA, 18 nt, Leptospira interrogans serovar lai str. 56601
cucuaccuuuauuuaaaa

SEQ ID NO: 740179 - RNA, 14 nt, Leptospira interrogans serovar lai str. 56601
cucuacucuugaag

SEQ ID NO: 740180 - RNA, 18 nt, Leptospira interrogans serovar lai str. 56601
cucuaauuuuuuauuuuu

SEQ ID NO: 740181 - RNA, 19 nt, Leptospira interrogans serovar lai str. 56601
cugaauuuuaccaaauugu

SEQ ID NO: 740182 - RNA, 21 nt, Leptospira interrogans serovar lai str. 56601
cugaauuguuugaucucggga

SEQ ID NO: 740183 - RNA, 16 nt, Leptospira interrogans serovar lai str. 56601
cugacauucuaaacau

SEQ ID NO: 740184 - RNA, 15 nt, Leptospira interrogans serovar lai str. 56601
cugauuucuauaaaa

SEQ ID NO: 740185 - RNA, 17 nt, Leptospira interrogans serovar lai str. 56601
cugauuucuauaaaauu

SEQ ID NO: 740186 - RNA, 17 nt, Leptospira interrogans serovar lai str. 56601
cugauuucaaaaauaaa

SEQ ID NO: 740187 - RNA, 16 nt, Leptospira interrogans serovar lai str. 56601
cugauaaagaaaaccu

SEQ ID NO: 740188 - RNA, 17 nt, Leptospira interrogans serovar lai str. 56601
cugauaaagaaaaccuu

SEQ ID NO: 740189 - RNA, 16 nt, Leptospira interrogans serovar lai str. 56601
cugaguuugagagagc

SEQ ID NO: 740190 - RNA, 18 nt, Leptospira interrogans serovar lai str. 56601
cugaggaggauuagaaga

SEQ ID NO: 740191 - RNA, 21 nt, Leptospira interrogans serovar lai str. 56601
cugaggaguuuuuauaaaauc

SEQ ID NO: 740192 - RNA, 13 nt, Leptospira interrogans serovar lai str. 56601
gaauuacuaugga

SEQ ID NO: 740193 - RNA, 18 nt, Leptospira interrogans serovar lai str. 56601
gaauuacgacaaaucuuc

SEQ ID NO: 740194 - RNA, 18 nt, Leptospira interrogans serovar lai str. 56601
gaauuacgacaaguccuc

SEQ ID NO: 740195 - RNA, 18 nt, Leptospira interrogans serovar lai str. 56601
gaauuaauuuguaauucu

SEQ ID NO: 740196 - RNA, 18 nt, Leptospira interrogans serovar lai str. 56601
gaauuaauuuuucaacaa

SEQ ID NO: 740197 - RNA, 13 nt, Leptospira interrogans serovar lai str. 56601
gaauugaucuaaa

SEQ ID NO: 740198 - RNA, 20 nt, Leptospira interrogans serovar lai str. 56601
gaauugaucucauaaagaca

SEQ ID NO: 740199 - RNA, 17 nt, Leptospira interrogans serovar lai str. 56601
gaauugcacauaaaaga

SEQ ID NO: 740200 - RNA, 19 nt, Leptospira interrogans serovar lai str. 56601
gaauugcaccaguuaaauc

SEQ ID NO: 740201 - RNA, 20 nt, Leptospira interrogans serovar lai str. 56601
gaauugcaccaguuaaauca

SEQ ID NO: 740202 - RNA, 14 nt, Leptospira interrogans serovar lai str. 56601
gaauugccgauucu

SEQ ID NO: 740203 - RNA, 20 nt, Leptospira interrogans serovar lai str. 56601
gaauuaucauguaaaauuuu

SEQ ID NO: 740204 - RNA, 23 nt, Leptospira interrogans serovar lai str. 56601
gaauuguagaauuuauuuucaua

SEQ ID NO: 740205 - RNA, 20 nt, Leptospira interrogans serovar lai str. 56601
gaauuuaccuccuccuucuc

SEQ ID NO: 740206 - RNA, 20 nt, Leptospira interrogans serovar lai str. 56601
gaauuuaaaaguuuccccaa

SEQ ID NO: 740207 - RNA, 19 nt, Leptospira interrogans serovar lai str. 56601
gaauuguguuaguucccac

SEQ ID NO: 740208 - RNA, 21 nt, Leptospira interrogans serovar lai str. 56601
gaauuguuugaaaguucccaa

SEQ ID NO: 740209 - RNA, 21 nt, Leptospira interrogans serovar lai str. 56601
gaauuuuuucguuccuuugaa

SEQ ID NO: 740210 - RNA, 18 nt, Leptospira interrogans serovar lai str. 56601
gaauuuuuguaaaaucca

SEQ ID NO: 740211 - RNA, 15 nt, Leptospira interrogans serovar lai str. 56601
gaauuuuuguagaau

SEQ ID NO: 740212 - RNA, 19 nt, Leptospira interrogans serovar lai str. 56601
gaauuuuucgaaacaaaau

SEQ ID NO: 740213 - RNA, 16 nt, Leptospira interrogans serovar lai str. 56601
gaauuuuucaacaacu

SEQ ID NO: 740214 - RNA, 21 nt, Leptospira interrogans serovar lai str. 56601
gaauuuuucaacaacucuauu

SEQ ID NO: 740215 - RNA, 13 nt, Leptospira interrogans serovar lai str. 56601
gaauuuuuaaaaa

SEQ ID NO: 740216 - RNA, 15 nt, Leptospira interrogans serovar lai str. 56601
gaauuuuuaaaaaga

SEQ ID NO: 740217 - RNA, 13 nt, Leptospira interrogans serovar lai str. 56601
gaauuuuuauaaa

SEQ ID NO: 740218 - RNA, 17 nt, Leptospira interrogans serovar lai str. 56601
gaauuuuuauaaaaaua

SEQ ID NO: 740219 - RNA, 22 nt, Leptospira interrogans serovar lai str. 56601
gacaaacuuagguuuuguaaua

SEQ ID NO: 740220 - RNA, 21 nt, Leptospira interrogans serovar lai str. 56601
gaauguaaaugaauuggaaag

SEQ ID NO: 740221 - RNA, 22 nt, Leptospira interrogans serovar lai str. 56601
gaauguacuaaaauuuuauaaa

SEQ ID NO: 740222 - RNA, 16 nt, Leptospira interrogans serovar lai str. 56601
gaaugcgacguaauuu

SEQ ID NO: 740223 - RNA, 21 nt, Leptospira interrogans serovar lai str. 56601
gaaucuuaaaaagaguauuau

SEQ ID NO: 740224 - RNA, 22 nt, Leptospira interrogans serovar lai str. 56601
gaaucuucauuuugggauuuua

SEQ ID NO: 740225 - RNA, 13 nt, Leptospira interrogans serovar lai str. 56601
gaaucgaaucuuu

SEQ ID NO: 740226 - RNA, 9 nt, Leptospira interrogans serovar lai str. 56601
gaaugaaaa

SEQ ID NO: 740227 - RNA, 23 nt, Leptospira interrogans serovar lai str. 56601
gaaugaaaaaacuauuuaauaua

SEQ ID NO: 740228 - RNA, 13 nt, Leptospira interrogans serovar lai str. 56601
gaaugaacucaac

SEQ ID NO: 740229 - RNA, 16 nt, Leptospira interrogans serovar lai str. 56601
gaaugaacucaacaga

SEQ ID NO: 740230 - RNA, 11 nt, Leptospira interrogans serovar lai str. 56601
gaauccaaaag

SEQ ID NO: 740231 - RNA, 22 nt, Leptospira interrogans serovar lai str. 56601
gaaucauuacguaaagaacuuc

SEQ ID NO: 740232 - RNA, 18 nt, Leptospira interrogans serovar lai str. 56601
gaaucaucucaaaaauag

SEQ ID NO: 740233 - RNA, 22 nt, Leptospira interrogans serovar lai str. 56601
gaaucaauuuuagaauaaaucu

SEQ ID NO: 740234 - RNA, 16 nt, Leptospira interrogans serovar lai str. 56601
gaaucaacuuuuccag

SEQ ID NO: 740235 - RNA, 17 nt, Leptospira interrogans serovar lai str. 56601
gaaucaacuuuuccagc

SEQ ID NO: 740236 - RNA, 16 nt, Leptospira interrogans serovar lai str. 56601
gaaucauacaaucaaa

SEQ ID NO: 740237 - RNA, 19 nt, Leptospira interrogans serovar lai str. 56601
gaaucauacaaucaaauuu

SEQ ID NO: 740238 - RNA, 12 nt, Leptospira interrogans serovar lai str. 56601
gaaucauauuua

SEQ ID NO: 740239 - RNA, 15 nt, Leptospira interrogans serovar lai str. 56601
aaagauuaaagauuu

SEQ ID NO: 740240 - RNA, 18 nt, Leptospira interrogans serovar lai str. 56601
aaagauucuauuuugaga

SEQ ID NO: 740241 - RNA, 15 nt, Leptospira interrogans serovar lai str. 56601
aaagauucuugauaa

SEQ ID NO: 740242 - RNA, 22 nt, Leptospira interrogans serovar lai str. 56601
gaauauuucuucguuauuuuua

SEQ ID NO: 740243 - RNA, 20 nt, Leptospira interrogans serovar lai str. 56601
gaauauuugggcgaaucgcu

SEQ ID NO: 740244 - RNA, 22 nt, Leptospira interrogans serovar lai str. 56601
gaauauuuucucaguaaaaugg

SEQ ID NO: 740245 - RNA, 13 nt, Leptospira interrogans serovar lai str. 56601
gaaucaaaggaaa

SEQ ID NO: 740246 - RNA, 20 nt, Leptospira interrogans serovar lai str. 56601
gaauagaacgaguuccgaaa

SEQ ID NO: 740247 - RNA, 17 nt, Leptospira interrogans serovar lai str. 56601
gaauagagucuuuaaaa

SEQ ID NO: 740248 - RNA, 13 nt, Leptospira interrogans serovar lai str. 56601
gaauaaggcaaaa

SEQ ID NO: 740249 - RNA, 20 nt, Leptospira interrogans serovar lai str. 56601
gaauaacuuuacaaaaaugu

SEQ ID NO: 740250 - RNA, 18 nt, Leptospira interrogans serovar lai str. 56601
gaauaauaaucuuaaaua

SEQ ID NO: 740251 - RNA, 14 nt, Leptospira interrogans serovar lai str. 56601
gaauaccguucuua

SEQ ID NO: 740252 - RNA, 20 nt, Leptospira interrogans serovar lai str. 56601
gaauaccguucuuacauuga

SEQ ID NO: 740253 - RNA, 18 nt, Leptospira interrogans serovar lai str. 56601
gaaguucggaagauuuuu

SEQ ID NO: 740254 - RNA, 15 nt, Leptospira interrogans serovar lai str. 56601
gaauaaaaacaaacu

SEQ ID NO: 740255 - RNA, 15 nt, Leptospira interrogans serovar lai str. 56601
gaagguagauaaagg

SEQ ID NO: 740256 - RNA, 12 nt, Leptospira interrogans serovar lai str. 56601
gaaguaaucuuu

SEQ ID NO: 740257 - RNA, 13 nt, Leptospira interrogans serovar lai str. 56601
gaaggaauuggaa

SEQ ID NO: 740258 - RNA, 23 nt, Leptospira interrogans serovar lai str. 56601
gaagcaacguagucguguuguuu

SEQ ID NO: 740259 - RNA, 17 nt, Leptospira interrogans serovar lai str. 56601
gaagauauaaucuaaga

SEQ ID NO: 740260 - RNA, 20 nt, Leptospira interrogans serovar lai str. 56601
gaagcaaucuguuuagaaua

SEQ ID NO: 740261 - RNA, 13 nt, Leptospira interrogans serovar lai str. 56601
gaagauagguuca

SEQ ID NO: 740262 - RNA, 17 nt, Leptospira interrogans serovar lai str. 56601
gaagagucaaacacucu

SEQ ID NO: 740263 - RNA, 21 nt, Leptospira interrogans serovar lai str. 56601
gaagagucuauauguaaauga

SEQ ID NO: 740264 - RNA, 18 nt, Leptospira interrogans serovar lai str. 56601
gaagauaaauauuuccaa

SEQ ID NO: 740265 - RNA, 15 nt, Leptospira interrogans serovar lai str. 56601
aaagaggucuaugau

SEQ ID NO: 740266 - RNA, 18 nt, Leptospira interrogans serovar lai str. 56601
gaagacgcuuaaaaauga

SEQ ID NO: 740267 - RNA, 13 nt, Leptospira interrogans serovar lai str. 56601
aaagauaaaaaga

SEQ ID NO: 740268 - RNA, 15 nt, Leptospira interrogans serovar lai str. 56601
aaagauaaaaagaga

SEQ ID NO: 740269 - RNA, 16 nt, Leptospira interrogans serovar lai str. 56601
aaagauaaaaagagac

SEQ ID NO: 740270 - RNA, 13 nt, Leptospira interrogans serovar lai str. 56601
aaagauaaaucgc

SEQ ID NO: 740271 - RNA, 13 nt, Leptospira interrogans serovar lai str. 56601
aaagaguuuaaaa

SEQ ID NO: 740272 - RNA, 14 nt, Leptospira interrogans serovar lai str. 56601
aaagaguuuaaaaa

SEQ ID NO: 740273 - RNA, 15 nt, Leptospira interrogans serovar lai str. 56601
aaagaguuuaaaaaa

SEQ ID NO: 740274 - RNA, 16 nt, Leptospira interrogans serovar lai str. 56601
aaagaguuuaaaaaau

SEQ ID NO: 740275 - RNA, 16 nt, Leptospira interrogans serovar lai str. 56601
gaagaaauaaguaaau

SEQ ID NO: 740276 - RNA, 20 nt, Leptospira interrogans serovar lai str. 56601
gaacuucguuggaaaguuuu

SEQ ID NO: 740277 - RNA, 22 nt, Leptospira interrogans serovar lai str. 56601
gaacuuacaaagcacuuuuuuc

SEQ ID NO: 740278 - RNA, 20 nt, Leptospira interrogans serovar lai str. 56601
gaacuuaccccgaaauacau

SEQ ID NO: 740279 - RNA, 22 nt, Leptospira interrogans serovar lai str. 56601
gaacuguguuucuaauuuucuu

SEQ ID NO: 740280 - RNA, 16 nt, Leptospira interrogans serovar lai str. 56601
gaacuguugaaaaaau

SEQ ID NO: 740281 - RNA, 21 nt, Leptospira interrogans serovar lai str. 56601
gaacuuuuauaauucaagacu

SEQ ID NO: 740282 - RNA, 20 nt, Leptospira interrogans serovar lai str. 56601
gaacuuugcagacugauucu

SEQ ID NO: 740283 - RNA, 22 nt, Leptospira interrogans serovar lai str. 56601
gaacuuucuuaucggaaagcca

SEQ ID NO: 740284 - RNA, 17 nt, Leptospira interrogans serovar lai str. 56601
gaacuugcucaaaagcu

SEQ ID NO: 740285 - RNA, 15 nt, Leptospira interrogans serovar lai str. 56601
gaacuuguccuaaaa

SEQ ID NO: 740286 - RNA, 13 nt, Leptospira interrogans serovar lai str. 56601
gaagaaaauuaau

SEQ ID NO: 740287 - RNA, 18 nt, Leptospira interrogans serovar lai str. 56601
gaacuuuuucaaguguuc

SEQ ID NO: 740288 - RNA, 13 nt, Leptospira interrogans serovar lai str. 56601
gaagaaaaaaaga

SEQ ID NO: 740289 - RNA, 21 nt, Leptospira interrogans serovar lai str. 56601
gaacuuuaccggguuccauuc

SEQ ID NO: 740290 - RNA, 18 nt, Leptospira interrogans serovar lai str. 56601
gaacuuucgaguaguuau

SEQ ID NO: 740291 - RNA, 20 nt, Leptospira interrogans serovar lai str. 56601
gacuaauuuugugaaucaaa

SEQ ID NO: 740292 - RNA, 23 nt, Leptospira interrogans serovar lai str. 56601
gacuaauuuugugaaucaaaagg

SEQ ID NO: 740293 - RNA, 14 nt, Leptospira interrogans serovar lai str. 56601
gacuacagaauaaa

SEQ ID NO: 740294 - RNA, 14 nt, Leptospira interrogans serovar lai str. 56601
gacuacgauuucau

SEQ ID NO: 740295 - RNA, 13 nt, Leptospira interrogans serovar lai str. 56601
gacuauaaaguuu

SEQ ID NO: 740296 - RNA, 22 nt, Leptospira interrogans serovar lai str. 56601
gacuauaaaguuuuaguuuaca

SEQ ID NO: 740297 - RNA, 14 nt, Leptospira interrogans serovar lai str. 56601
gacuauuucuucca

SEQ ID NO: 740298 - RNA, 15 nt, Leptospira interrogans serovar lai str. 56601
gacuauuucuuccag

SEQ ID NO: 740299 - RNA, 17 nt, Leptospira interrogans serovar lai str. 56601
gacuaucgcaaauaaua

SEQ ID NO: 740300 - RNA, 19 nt, Leptospira interrogans serovar lai str. 56601
gacuaucacaaaaaugaaa

SEQ ID NO: 740301 - RNA, 14 nt, Leptospira interrogans serovar lai str. 56601
gacuaaaauugaca

SEQ ID NO: 740302 - RNA, 17 nt, Leptospira interrogans serovar lai str. 56601
gacuaacgauuguaaaa

SEQ ID NO: 740303 - RNA, 20 nt, Leptospira interrogans serovar lai str. 56601
gacuaacgauuguaaaaaaa

SEQ ID NO: 740304 - RNA, 22 nt, Leptospira interrogans serovar lai str. 56601
gacuaacgauuguaaaaaaaca

SEQ ID NO: 740305 - RNA, 21 nt, Leptospira interrogans serovar lai str. 56601
gacguaauuuaccuugaaacu

SEQ ID NO: 740306 - RNA, 17 nt, Leptospira interrogans serovar lai str. 56601
gaccugccuuucuuauu

SEQ ID NO: 740307 - RNA, 14 nt, Leptospira interrogans serovar lai str. 56601
gacgccauguuuuu

SEQ ID NO: 740308 - RNA, 18 nt, Leptospira interrogans serovar lai str. 56601
gacgccauguuuuuaaaa

SEQ ID NO: 740309 - RNA, 14 nt, Leptospira interrogans serovar lai str. 56601
gacagguucuuaug

SEQ ID NO: 740310 - RNA, 23 nt, Leptospira interrogans serovar lai str. 56601
gaccaauuuuuuuguaaaaaaau

SEQ ID NO: 740311 - RNA, 22 nt, Leptospira interrogans serovar lai str. 56601
gaccgaagucacguuauugaau

SEQ ID NO: 740312 - RNA, 20 nt, Leptospira interrogans serovar lai str. 56601
gaaccaauucuaaaaucaua

SEQ ID NO: 740313 - RNA, 16 nt, Leptospira interrogans serovar lai str. 56601
gaacauuccauaauga

SEQ ID NO: 740314 - RNA, 17 nt, Leptospira interrogans serovar lai str. 56601
gaaccaucucaaaaaua

SEQ ID NO: 740315 - RNA, 18 nt, Leptospira interrogans serovar lai str. 56601
gaaccaucucaaaaauau

SEQ ID NO: 740316 - RNA, 12 nt, Leptospira interrogans serovar lai str. 56601
gaaccauuucaa

SEQ ID NO: 740317 - RNA, 16 nt, Leptospira interrogans serovar lai str. 56601
gaaccauuucaaguuu

SEQ ID NO: 740318 - RNA, 20 nt, Leptospira interrogans serovar lai str. 56601
gaacccagucuucuuguaau

SEQ ID NO: 740319 - RNA, 23 nt, Leptospira interrogans serovar lai str. 56601
gaacccauggcuuugaaaaaggu

SEQ ID NO: 740320 - RNA, 16 nt, Leptospira interrogans serovar lai str. 56601
gaaccucaaagaaauu

SEQ ID NO: 740321 - RNA, 15 nt, Leptospira interrogans serovar lai str. 56601
gaaccguaacugaca

SEQ ID NO: 740322 - RNA, 16 nt, Leptospira interrogans serovar lai str. 56601
gaaccguaacugacau

SEQ ID NO: 740323 - RNA, 14 nt, Leptospira interrogans serovar lai str. 56601
gaaccuauaucuua

SEQ ID NO: 740324 - RNA, 22 nt, Leptospira interrogans serovar lai str. 56601
gaacgaccccgucauuuacuca

SEQ ID NO: 740325 - RNA, 15 nt, Leptospira interrogans serovar lai str. 56601
gaacucacacaaaau

SEQ ID NO: 740326 - RNA, 22 nt, Leptospira interrogans serovar lai str. 56601
gaacucauauuuuuagaaaauu

SEQ ID NO: 740327 - RNA, 20 nt, Leptospira interrogans serovar lai str. 56601
gaacuccauucuuacuccau

SEQ ID NO: 740328 - RNA, 17 nt, Leptospira interrogans serovar lai str. 56601
gaacuauuuauaaaaua

SEQ ID NO: 740329 - RNA, 19 nt, Leptospira interrogans serovar lai str. 56601
gaacuauuuauaaaauaaa

SEQ ID NO: 740330 - RNA, 14 nt, Leptospira interrogans serovar lai str. 56601
gaacucaacagaac

SEQ ID NO: 740331 - RNA, 17 nt, Leptospira interrogans serovar lai str. 56601
gaacuauacaaauagag

SEQ ID NO: 740332 - RNA, 20 nt, Leptospira interrogans serovar lai str. 56601
gaacuauuacaaaaucugaa

SEQ ID NO: 740333 - RNA, 23 nt, Leptospira interrogans serovar lai str. 56601
gaacuauuacaaaucgacgauuu

SEQ ID NO: 740334 - RNA, 19 nt, Leptospira interrogans serovar lai str. 56601
gaacuauuauaaaauacaa

SEQ ID NO: 740335 - RNA, 22 nt, Leptospira interrogans serovar lai str. 56601
gaacuauuaucuuucgauuuua

SEQ ID NO: 740336 - RNA, 16 nt, Leptospira interrogans serovar lai str. 56601
gaacuacacguuuucc

SEQ ID NO: 740337 - RNA, 18 nt, Leptospira interrogans serovar lai str. 56601
gaacuacacguuuuccua

SEQ ID NO: 740338 - RNA, 14 nt, Leptospira interrogans serovar lai str. 56601
gaacuaccacaaaa

SEQ ID NO: 740339 - RNA, 15 nt, Leptospira interrogans serovar lai str. 56601
gaacuaccacagaaa

SEQ ID NO: 740340 - RNA, 18 nt, Leptospira interrogans serovar lai str. 56601
gaacuaccacagaaagcu

SEQ ID NO: 740341 - RNA, 16 nt, Leptospira interrogans serovar lai str. 56601
gaacuacuacaaaaau

SEQ ID NO: 740342 - RNA, 23 nt, Leptospira interrogans serovar lai str. 56601
gaacuacuauaaauuacugauuu

SEQ ID NO: 740343 - RNA, 13 nt, Leptospira interrogans serovar lai str. 56601
gaacuacuaugaa

SEQ ID NO: 740344 - RNA, 15 nt, Leptospira interrogans serovar lai str. 56601
gaacucuuacaaaau

SEQ ID NO: 740345 - RNA, 22 nt, Leptospira interrogans serovar lai str. 56601
gaacucucacaaaucaugauuu

SEQ ID NO: 740346 - RNA, 20 nt, Leptospira interrogans serovar lai str. 56601
gaacucucacaaaucaugga

SEQ ID NO: 740347 - RNA, 19 nt, Leptospira interrogans serovar lai str. 56601
gaacucuuuuaccuuacca

SEQ ID NO: 740348 - RNA, 14 nt, Leptospira interrogans serovar lai str. 56601
gaacggaaauguua

SEQ ID NO: 740349 - RNA, 16 nt, Leptospira interrogans serovar lai str. 56601
gaacggauucuaauuu

SEQ ID NO: 740350 - RNA, 16 nt, Leptospira interrogans serovar lai str. 56601
gaacgggcuuucuaug

SEQ ID NO: 740351 - RNA, 21 nt, Leptospira interrogans serovar lai str. 56601
gaacaaguugaaaggggauua

SEQ ID NO: 740352 - RNA, 20 nt, Leptospira interrogans serovar lai str. 56601
gaacaaucuucgguauuuuu

SEQ ID NO: 740353 - RNA, 16 nt, Leptospira interrogans serovar lai str. 56601
gaacaauuuaaaauaa

SEQ ID NO: 740354 - RNA, 17 nt, Leptospira interrogans serovar lai str. 56601
gaacaguuuggcauuua

SEQ ID NO: 740355 - RNA, 21 nt, Leptospira interrogans serovar lai str. 56601
gaacacugcauuuuauuaaaa

SEQ ID NO: 740356 - RNA, 13 nt, Leptospira interrogans serovar lai str. 56601
gaaauucucuuuu

SEQ ID NO: 740357 - RNA, 16 nt, Leptospira interrogans serovar lai str. 56601
gaaauuuuuaauaaaa

SEQ ID NO: 740358 - RNA, 16 nt, Leptospira interrogans serovar lai str. 56601
gaaauuuuuaaucaaa

SEQ ID NO: 740359 - RNA, 17 nt, Leptospira interrogans serovar lai str. 56601
gaaauuuuuaaucaaau

SEQ ID NO: 740360 - RNA, 19 nt, Leptospira interrogans serovar lai str. 56601
gaaauuuucuuagaaaacu

SEQ ID NO: 740361 - RNA, 18 nt, Leptospira interrogans serovar lai str. 56601
gaaauuuuacacguaauu

SEQ ID NO: 740362 - RNA, 20 nt, Leptospira interrogans serovar lai str. 56601
gaaauuuuacacguaauucu

SEQ ID NO: 740363 - RNA, 17 nt, Leptospira interrogans serovar lai str. 56601
gaaauuuuacaguaaaa

SEQ ID NO: 740364 - RNA, 20 nt, Leptospira interrogans serovar lai str. 56601
gaaauucguuuuaucuuaga

SEQ ID NO: 740365 - RNA, 14 nt, Leptospira interrogans serovar lai str. 56601
gaaauucaucaaau

SEQ ID NO: 740366 - RNA, 17 nt, Leptospira interrogans serovar lai str. 56601
gaaauucagaucucacu

SEQ ID NO: 740367 - RNA, 17 nt, Leptospira interrogans serovar lai str. 56601
gaaaucuuuuaaaaaag

SEQ ID NO: 740368 - RNA, 19 nt, Leptospira interrogans serovar lai str. 56601
gaaaucuuuuaaaaaaggu

SEQ ID NO: 740369 - RNA, 14 nt, Leptospira interrogans serovar lai str. 56601
gaaaucgaaaacca

SEQ ID NO: 740370 - RNA, 16 nt, Leptospira interrogans serovar lai str. 56601
gaaaucgauuuguaaa

SEQ ID NO: 740371 - RNA, 21 nt, Leptospira interrogans serovar lai str. 56601
gaaaucgauuuguaaaauuca

SEQ ID NO: 740372 - RNA, 14 nt, Leptospira interrogans serovar lai str. 56601
aaagacuuuuccua

SEQ ID NO: 740373 - RNA, 14 nt, Leptospira interrogans serovar lai str. 56601
aaagacuuuuuaug

SEQ ID NO: 740374 - RNA, 16 nt, Leptospira interrogans serovar lai str. 56601
aaagacuuuucaucau

SEQ ID NO: 740375 - RNA, 14 nt, Leptospira interrogans serovar lai str. 56601
aaagagaaaacaau

SEQ ID NO: 740376 - RNA, 17 nt, Leptospira interrogans serovar lai str. 56601
aaagagacauugaagaa

SEQ ID NO: 740377 - RNA, 23 nt, Leptospira interrogans serovar lai str. 56601
aaagagacauugaagaaaaaaag

SEQ ID NO: 740378 - RNA, 16 nt, Leptospira interrogans serovar lai str. 56601
gaaauuaauuucuaaa

SEQ ID NO: 740379 - RNA, 14 nt, Leptospira interrogans serovar lai str. 56601
gaaacuaauuugua

SEQ ID NO: 740380 - RNA, 17 nt, Leptospira interrogans serovar lai str. 56601
gaaacuauuacaaauag

SEQ ID NO: 740381 - RNA, 15 nt, Leptospira interrogans serovar lai str. 56601
gaaacuauacuuuca

SEQ ID NO: 740382 - RNA, 16 nt, Leptospira interrogans serovar lai str. 56601
gaaacuauacuuucaa

SEQ ID NO: 740383 - RNA, 20 nt, Leptospira interrogans serovar lai str. 56601
gaaaaucgaguguaauauga

SEQ ID NO: 740384 - RNA, 21 nt, Leptospira interrogans serovar lai str. 56601
gaaaaucgaguguaauaugaa

SEQ ID NO: 740385 - RNA, 22 nt, Leptospira interrogans serovar lai str. 56601
gaaaaucgucccgaucauccaa

SEQ ID NO: 740386 - RNA, 19 nt, Leptospira interrogans serovar lai str. 56601
gaaaaucuagguuuccuuc

SEQ ID NO: 740387 - RNA, 15 nt, Leptospira interrogans serovar lai str. 56601
gaaacuuaaaucuca

SEQ ID NO: 740388 - RNA, 14 nt, Leptospira interrogans serovar lai str. 56601
gaaacuuaauaaaa

SEQ ID NO: 740389 - RNA, 19 nt, Leptospira interrogans serovar lai str. 56601
gaaacuuauacuuuauaga

SEQ ID NO: 740390 - RNA, 19 nt, Leptospira interrogans serovar lai str. 56601
gaaacucauuuuucuaaaa

SEQ ID NO: 740391 - RNA, 11 nt, Leptospira interrogans serovar lai str. 56601
gaaacucagua

SEQ ID NO: 740392 - RNA, 18 nt, Leptospira interrogans serovar lai str. 56601
gaaacucaguaaaacgcu

SEQ ID NO: 740393 - RNA, 22 nt, Leptospira interrogans serovar lai str. 56601
gaaacucaguaaaacgcucucu

SEQ ID NO: 740394 - RNA, 20 nt, Leptospira interrogans serovar lai str. 56601
gaaagcaaacuuuuuauaaa

SEQ ID NO: 740395 - RNA, 15 nt, Leptospira interrogans serovar lai str. 56601
gaaagcagcaaagaa

SEQ ID NO: 740396 - RNA, 15 nt, Leptospira interrogans serovar lai str. 56601
gaaaguaaaauuaca

SEQ ID NO: 740397 - RNA, 15 nt, Leptospira interrogans serovar lai str. 56601
gaaaguaaaaaagag

SEQ ID NO: 740398 - RNA, 16 nt, Leptospira interrogans serovar lai str. 56601
gaaaguaaaaaagagc

SEQ ID NO: 740399 - RNA, 16 nt, Leptospira interrogans serovar lai str. 56601
gaaauaauuccuccau

SEQ ID NO: 740400 - RNA, 17 nt, Leptospira interrogans serovar lai str. 56601
gaaaguaucagaaucaa

SEQ ID NO: 740401 - RNA, 13 nt, Leptospira interrogans serovar lai str. 56601
gaaauacaaaaag

SEQ ID NO: 740402 - RNA, 18 nt, Leptospira interrogans serovar lai str. 56601
gaaauacaaaaagaauau

SEQ ID NO: 740403 - RNA, 16 nt, Leptospira interrogans serovar lai str. 56601
gaaauagaauuuugca

SEQ ID NO: 740404 - RNA, 17 nt, Leptospira interrogans serovar lai str. 56601
gaaauagaauuuugcaa

SEQ ID NO: 740405 - RNA, 15 nt, Leptospira interrogans serovar lai str. 56601
gaaauacuuaaaaug

SEQ ID NO: 740406 - RNA, 15 nt, Leptospira interrogans serovar lai str. 56601
gaaaucaauucuucu

SEQ ID NO: 740407 - RNA, 23 nt, Leptospira interrogans serovar lai str. 56601
gaaaucaauucuucuuucguuug

SEQ ID NO: 740408 - RNA, 15 nt, Leptospira interrogans serovar lai str. 56601
gaaaacgauuuuuca

SEQ ID NO: 740409 - RNA, 20 nt, Leptospira interrogans serovar lai str. 56601
gaaaacucaacacaacggcu

SEQ ID NO: 740410 - RNA, 15 nt, Leptospira interrogans serovar lai str. 56601
gaaaacucaucacaa

SEQ ID NO: 740411 - RNA, 18 nt, Leptospira interrogans serovar lai str. 56601
gaaaaccaaauaauaaaa

SEQ ID NO: 740412 - RNA, 18 nt, Leptospira interrogans serovar lai str. 56601
gaaaaccaugauucugaa

SEQ ID NO: 740413 - RNA, 22 nt, Leptospira interrogans serovar lai str. 56601
gaaaaccagauguaaucuauaa

SEQ ID NO: 740414 - RNA, 13 nt, Leptospira interrogans serovar lai str. 56601
gaaaauagauaga

SEQ ID NO: 740415 - RNA, 15 nt, Leptospira interrogans serovar lai str. 56601
gaaaauagauagaga

SEQ ID NO: 740416 - RNA, 12 nt, Leptospira interrogans serovar lai str. 56601
gaaaauaauaau

SEQ ID NO: 740417 - RNA, 14 nt, Leptospira interrogans serovar lai str. 56601
gaaaauaauaauau

SEQ ID NO: 740418 - RNA, 19 nt, Leptospira interrogans serovar lai str. 56601
gaaaacuugguuggauucc

SEQ ID NO: 740419 - RNA, 20 nt, Leptospira interrogans serovar lai str. 56601
gaaaagaaacaguauauuau

SEQ ID NO: 740420 - RNA, 12 nt, Leptospira interrogans serovar lai str. 56601
gaaaacuuucuu

SEQ ID NO: 740421 - RNA, 13 nt, Leptospira interrogans serovar lai str. 56601
gaaaagaaucugc

SEQ ID NO: 740422 - RNA, 12 nt, Leptospira interrogans serovar lai str. 56601
gaaaaaaaaauu

SEQ ID NO: 740423 - RNA, 16 nt, Leptospira interrogans serovar lai str. 56601
gaaaaaaaacaaagag

SEQ ID NO: 740424 - RNA, 20 nt, Leptospira interrogans serovar lai str. 56601
cuuuuuuuucuaaaauauuu

SEQ ID NO: 740425 - RNA, 14 nt, Leptospira interrogans serovar lai str. 56601
gaaaaaaaguauau

SEQ ID NO: 740426 - RNA, 23 nt, Leptospira interrogans serovar lai str. 56601
gaaaaaaaguauauauuaaagua

SEQ ID NO: 740427 - RNA, 14 nt, Leptospira interrogans serovar lai str. 56601
gaaaaaaauaacga

SEQ ID NO: 740428 - RNA, 13 nt, Leptospira interrogans serovar lai str. 56601
gaaaaaaauuaga

SEQ ID NO: 740429 - RNA, 15 nt, Leptospira interrogans serovar lai str. 56601
gaaaaaaauuagaau

SEQ ID NO: 740430 - RNA, 20 nt, Leptospira interrogans serovar lai str. 56601
gaaaaaaauuagaaucugaa

SEQ ID NO: 740431 - RNA, 20 nt, Leptospira interrogans serovar lai str. 56601
gaaaaaacuuucuaaaaaua

SEQ ID NO: 740432 - RNA, 15 nt, Leptospira interrogans serovar lai str. 56601
gaaaaaguuagaauc

SEQ ID NO: 740433 - RNA, 19 nt, Leptospira interrogans serovar lai str. 56601
gaaaaaguuagaaucugaa

SEQ ID NO: 740434 - RNA, 23 nt, Leptospira interrogans serovar lai str. 56601
gaaaaauuucccuaguuccaauu

SEQ ID NO: 740435 - RNA, 20 nt, Leptospira interrogans serovar lai str. 56601
gaaaaauuucauaguucaau

SEQ ID NO: 740436 - RNA, 14 nt, Leptospira interrogans serovar lai str. 56601
cuuuuucuucugcu

SEQ ID NO: 740437 - RNA, 15 nt, Leptospira interrogans serovar lai str. 56601
cuuuuucuucugcug

SEQ ID NO: 740438 - RNA, 17 nt, Leptospira interrogans serovar lai str. 56601
cuuuuucuuuuuuuaaa

SEQ ID NO: 740439 - RNA, 18 nt, Leptospira interrogans serovar lai str. 56601
cuuuuucuuuuuuuaaac

SEQ ID NO: 740440 - RNA, 17 nt, Leptospira interrogans serovar lai str. 56601
cuuuuuuaaguucuuua

SEQ ID NO: 740441 - RNA, 17 nt, Leptospira interrogans serovar lai str. 56601
cuuuuuuagaaaaagca

SEQ ID NO: 740442 - RNA, 15 nt, Leptospira interrogans serovar lai str. 56601
cuuuuuuaaaacauc

SEQ ID NO: 740443 - RNA, 11 nt, Leptospira interrogans serovar lai str. 56601
cuuuuuuaaag

SEQ ID NO: 740444 - RNA, 15 nt, Leptospira interrogans serovar lai str. 56601
cuuuuuuaaagugau

SEQ ID NO: 740445 - RNA, 24 nt, Leptospira interrogans serovar lai str. 56601
cuuuuguugcggagaauguuugag

SEQ ID NO: 740446 - RNA, 18 nt, Leptospira interrogans serovar lai str. 56601
cuuuuguuuuuauaaaua

SEQ ID NO: 740447 - RNA, 14 nt, Leptospira interrogans serovar lai str. 56601
cuuuuuaaaaccaa

SEQ ID NO: 740448 - RNA, 17 nt, Leptospira interrogans serovar lai str. 56601
cuuuuuaaaaccaaaau

SEQ ID NO: 740449 - RNA, 19 nt, Leptospira interrogans serovar lai str. 56601
cuuuuuaaaaccaaaaugc

SEQ ID NO: 740450 - RNA, 14 nt, Leptospira interrogans serovar lai str. 56601
cuuuuucuagguuu

SEQ ID NO: 740451 - RNA, 20 nt, Leptospira interrogans serovar lai str. 56601
cuuuuccuaaaauuuugcag

SEQ ID NO: 740452 - RNA, 17 nt, Leptospira interrogans serovar lai str. 56601
cuuuucgaauuuccuuu

SEQ ID NO: 740453 - RNA, 20 nt, Leptospira interrogans serovar lai str. 56601
cuuuucgacuauuucuucca

SEQ ID NO: 740454 - RNA, 19 nt, Leptospira interrogans serovar lai str. 56601
cuuuucgaaaauucugcuc

SEQ ID NO: 740455 - RNA, 18 nt, Leptospira interrogans serovar lai str. 56601
cuuuuccccuuuuuuaau

SEQ ID NO: 740456 - RNA, 21 nt, Leptospira interrogans serovar lai str. 56601
cuuuuccaucgcguagauaau

SEQ ID NO: 740457 - RNA, 15 nt, Leptospira interrogans serovar lai str. 56601
cuuuucaaaaguauu

SEQ ID NO: 740458 - RNA, 18 nt, Leptospira interrogans serovar lai str. 56601
cuuuuaaagaagauaaaa

SEQ ID NO: 740459 - RNA, 13 nt, Leptospira interrogans serovar lai str. 56601
cuuuuaaaaaguu

SEQ ID NO: 740460 - RNA, 12 nt, Leptospira interrogans serovar lai str. 56601
cuuuuaaaaaag

SEQ ID NO: 740461 - RNA, 16 nt, Leptospira interrogans serovar lai str. 56601
cuuuuaaaaaauuuuu

SEQ ID NO: 740462 - RNA, 20 nt, Leptospira interrogans serovar lai str. 56601
cuuuuaaaaaauuuuuucuu

SEQ ID NO: 740463 - RNA, 16 nt, Leptospira interrogans serovar lai str. 56601
cuuuuaaaaucaagag

SEQ ID NO: 740464 - RNA, 15 nt, Leptospira interrogans serovar lai str. 56601
cuuuuacgacuuuau

SEQ ID NO: 740465 - RNA, 21 nt, Leptospira interrogans serovar lai str. 56601
cuuuuaugaguucacuucuug

SEQ ID NO: 740466 - RNA, 15 nt, Leptospira interrogans serovar lai str. 56601
cuuuuacuucauaua

SEQ ID NO: 740467 - RNA, 23 nt, Leptospira interrogans serovar lai str. 56601
cuuuuaccuuaccaccguguuga

SEQ ID NO: 740468 - RNA, 15 nt, Leptospira interrogans serovar lai str. 56601
cuuuuagaaaaaauu

SEQ ID NO: 740469 - RNA, 21 nt, Leptospira interrogans serovar lai str. 56601
cuuuuagaaaaaauuuuucuu

SEQ ID NO: 740470 - RNA, 16 nt, Leptospira interrogans serovar lai str. 56601
aaagacgauccuuuuu

SEQ ID NO: 740471 - RNA, 15 nt, Leptospira interrogans serovar lai str. 56601
cuuuucuuaaaaaaa

SEQ ID NO: 740472 - RNA, 14 nt, Leptospira interrogans serovar lai str. 56601
cuuuucuuaaaauu

SEQ ID NO: 740473 - RNA, 18 nt, Leptospira interrogans serovar lai str. 56601
cuuuucugauuuuuauaa

SEQ ID NO: 740474 - RNA, 16 nt, Leptospira interrogans serovar lai str. 56601
cuuuucugaauaaaaa

SEQ ID NO: 740475 - RNA, 23 nt, Leptospira interrogans serovar lai str. 56601
cuuuucuauaaucugaaauagaa

SEQ ID NO: 740476 - RNA, 14 nt, Leptospira interrogans serovar lai str. 56601
cuuuucuagacuuu

SEQ ID NO: 740477 - RNA, 18 nt, Leptospira interrogans serovar lai str. 56601
cuuuucuaucaaaaaauu

SEQ ID NO: 740478 - RNA, 17 nt, Leptospira interrogans serovar lai str. 56601
cuuuucucaucaaaaaa

SEQ ID NO: 740479 - RNA, 21 nt, Leptospira interrogans serovar lai str. 56601
cuuuugaaaguuuuuuuauaa

SEQ ID NO: 740480 - RNA, 15 nt, Leptospira interrogans serovar lai str. 56601
cuuuugcauugaaau

SEQ ID NO: 740481 - RNA, 19 nt, Leptospira interrogans serovar lai str. 56601
cuuuugaaacuauccaaaa

SEQ ID NO: 740482 - RNA, 19 nt, Leptospira interrogans serovar lai str. 56601
aaagacuuaaaagaagauu

SEQ ID NO: 740483 - RNA, 19 nt, Leptospira interrogans serovar lai str. 56601
aaagacucacaccuucuuu

SEQ ID NO: 740484 - RNA, 21 nt, Leptospira interrogans serovar lai str. 56601
aaagacucacaccuucuuuuu

SEQ ID NO: 740485 - RNA, 16 nt, Leptospira interrogans serovar lai str. 56601
aaagacucauucuugu

SEQ ID NO: 740486 - RNA, 14 nt, Leptospira interrogans serovar lai str. 56601
aaagacuaaaaagu

SEQ ID NO: 740487 - RNA, 19 nt, Leptospira interrogans serovar lai str. 56601
aaagacuauauucuucgcu

SEQ ID NO: 740488 - RNA, 15 nt, Leptospira interrogans serovar lai str. 56601
cuuuaccgaauuuag

SEQ ID NO: 740489 - RNA, 21 nt, Leptospira interrogans serovar lai str. 56601
cuuuaccggguuccauucuaa

SEQ ID NO: 740490 - RNA, 22 nt, Leptospira interrogans serovar lai str. 56601
cuuuaaugcugauuuuucuuua

SEQ ID NO: 740491 - RNA, 16 nt, Leptospira interrogans serovar lai str. 56601
cuuuaccauaaauuuu

SEQ ID NO: 740492 - RNA, 17 nt, Leptospira interrogans serovar lai str. 56601
cuuuaccauaaauuuuu

SEQ ID NO: 740493 - RNA, 14 nt, Leptospira interrogans serovar lai str. 56601
cuuuagaaaaauau

SEQ ID NO: 740494 - RNA, 18 nt, Leptospira interrogans serovar lai str. 56601
cuuuacgaaaguugaaag

SEQ ID NO: 740495 - RNA, 21 nt, Leptospira interrogans serovar lai str. 56601
cuuuaaucauuuucaauuuuu

SEQ ID NO: 740496 - RNA, 19 nt, Leptospira interrogans serovar lai str. 56601
cuuuaaauugaauucuucc

SEQ ID NO: 740497 - RNA, 21 nt, Leptospira interrogans serovar lai str. 56601
cuuuaaauugaauucuuccuu

SEQ ID NO: 740498 - RNA, 18 nt, Leptospira interrogans serovar lai str. 56601
cuuuaaguuugugagagu

SEQ ID NO: 740499 - RNA, 12 nt, Leptospira interrogans serovar lai str. 56601
cuuuaauaauau

SEQ ID NO: 740500 - RNA, 15 nt, Leptospira interrogans serovar lai str. 56601
cuuuaaaugugggaa

SEQ ID NO: 740501 - RNA, 23 nt, Leptospira interrogans serovar lai str. 56601
cuuucagccccagucuauaaauu

SEQ ID NO: 740502 - RNA, 15 nt, Leptospira interrogans serovar lai str. 56601
cuuucaagaauuuau

SEQ ID NO: 740503 - RNA, 16 nt, Leptospira interrogans serovar lai str. 56601
cuuucaagaauuuauu

SEQ ID NO: 740504 - RNA, 14 nt, Leptospira interrogans serovar lai str. 56601
cuuuauuuaaaaac

SEQ ID NO: 740505 - RNA, 22 nt, Leptospira interrogans serovar lai str. 56601
cuuuauuuaauaaaauuuuuaa

SEQ ID NO: 740506 - RNA, 18 nt, Leptospira interrogans serovar lai str. 56601
cuuuauuaaauuauauuu

SEQ ID NO: 740507 - RNA, 18 nt, Leptospira interrogans serovar lai str. 56601
cuuuauucaaaauagaau

SEQ ID NO: 740508 - RNA, 21 nt, Leptospira interrogans serovar lai str. 56601
cuuuauucaaaauagaauaaa

SEQ ID NO: 740509 - RNA, 22 nt, Leptospira interrogans serovar lai str. 56601
cuuuauucaaaauagaauaaau

SEQ ID NO: 740510 - RNA, 16 nt, Leptospira interrogans serovar lai str. 56601
cuuuagaauuuuucga

SEQ ID NO: 740511 - RNA, 21 nt, Leptospira interrogans serovar lai str. 56601
cuuuguuuauuguuuauaaaa

SEQ ID NO: 740512 - RNA, 22 nt, Leptospira interrogans serovar lai str. 56601
cuuuguucaaagaaauguggga

SEQ ID NO: 740513 - RNA, 14 nt, Leptospira interrogans serovar lai str. 56601
cuuugucuuuaugc

SEQ ID NO: 740514 - RNA, 17 nt, Leptospira interrogans serovar lai str. 56601
cuuuguaauuaaaauuu

SEQ ID NO: 740515 - RNA, 23 nt, Leptospira interrogans serovar lai str. 56601
cuuuguaaccuuuguuuccucuu

SEQ ID NO: 740516 - RNA, 18 nt, Leptospira interrogans serovar lai str. 56601
cuuuguaugaguucccac

SEQ ID NO: 740517 - RNA, 16 nt, Leptospira interrogans serovar lai str. 56601
cuuugagaaaauuuuu

SEQ ID NO: 740518 - RNA, 18 nt, Leptospira interrogans serovar lai str. 56601
cuuugagaaaauuuuuuu

SEQ ID NO: 740519 - RNA, 22 nt, Leptospira interrogans serovar lai str. 56601
cuuugcucucgcaaugaaaauu

SEQ ID NO: 740520 - RNA, 19 nt, Leptospira interrogans serovar lai str. 56601
cuuugauugaauuaaaaaa

SEQ ID NO: 740521 - RNA, 21 nt, Leptospira interrogans serovar lai str. 56601
cuuugcaaaucgauuucuaaa

SEQ ID NO: 740522 - RNA, 23 nt, Leptospira interrogans serovar lai str. 56601
cuuucuauagccaaguauaaaag

SEQ ID NO: 740523 - RNA, 14 nt, Leptospira interrogans serovar lai str. 56601
cuuucuauuuuuuc

SEQ ID NO: 740524 - RNA, 13 nt, Leptospira interrogans serovar lai str. 56601
cuuucuccuuccc

SEQ ID NO: 740525 - RNA, 17 nt, Leptospira interrogans serovar lai str. 56601
cuuucuuugaacuuuuu

SEQ ID NO: 740526 - RNA, 16 nt, Leptospira interrogans serovar lai str. 56601
cuuugaaaaaauuuuu

SEQ ID NO: 740527 - RNA, 15 nt, Leptospira interrogans serovar lai str. 56601
cuuugaauugaaaug

SEQ ID NO: 740528 - RNA, 22 nt, Leptospira interrogans serovar lai str. 56601
cuuuccaucguuuaagaauuuu

SEQ ID NO: 740529 - RNA, 22 nt, Leptospira interrogans serovar lai str. 56601
cuuucauuuuuccauaaaaaac

SEQ ID NO: 740530 - RNA, 18 nt, Leptospira interrogans serovar lai str. 56601
cuuucaucucuauaaauu

SEQ ID NO: 740531 - RNA, 17 nt, Leptospira interrogans serovar lai str. 56601
cuuuccgauuucuuuca

SEQ ID NO: 740532 - RNA, 19 nt, Leptospira interrogans serovar lai str. 56601
cuuuccgauuucuuucaaa

SEQ ID NO: 740533 - RNA, 20 nt, Leptospira interrogans serovar lai str. 56601
cuuucuaaaugaguuuuaga

SEQ ID NO: 740534 - RNA, 18 nt, Leptospira interrogans serovar lai str. 56601
gagcagauucuaaaaaug

SEQ ID NO: 740535 - RNA, 16 nt, Leptospira interrogans serovar lai str. 56601
gagcaacauugaguuc

SEQ ID NO: 740536 - RNA, 15 nt, Leptospira interrogans serovar lai str. 56601
gagcauucuugagaa

SEQ ID NO: 740537 - RNA, 16 nt, Leptospira interrogans serovar lai str. 56601
gagcauucuugagaaa

SEQ ID NO: 740538 - RNA, 18 nt, Leptospira interrogans serovar lai str. 56601
gacucaguauguuguucu

SEQ ID NO: 740539 - RNA, 19 nt, Leptospira interrogans serovar lai str. 56601
gacucaguauguuguucuc

SEQ ID NO: 740540 - RNA, 16 nt, Leptospira interrogans serovar lai str. 56601
gacucauaacgugaca

SEQ ID NO: 740541 - RNA, 17 nt, Leptospira interrogans serovar lai str. 56601
gacucauggagaauaaa

SEQ ID NO: 740542 - RNA, 15 nt, Leptospira interrogans serovar lai str. 56601
gacucagaaaacuca

SEQ ID NO: 740543 - RNA, 23 nt, Leptospira interrogans serovar lai str. 56601
gagauuccuuuuaagaauacugg

SEQ ID NO: 740544 - RNA, 22 nt, Leptospira interrogans serovar lai str. 56601
gagauugauauuucuuaaauuc

SEQ ID NO: 740545 - RNA, 17 nt, Leptospira interrogans serovar lai str. 56601
gagauuuugucuccugu

SEQ ID NO: 740546 - RNA, 20 nt, Leptospira interrogans serovar lai str. 56601
gagagugaccguugugagaa

SEQ ID NO: 740547 - RNA, 13 nt, Leptospira interrogans serovar lai str. 56601
gagauuacuuuuu

SEQ ID NO: 740548 - RNA, 16 nt, Leptospira interrogans serovar lai str. 56601
gagauuacuuuuucug

SEQ ID NO: 740549 - RNA, 16 nt, Leptospira interrogans serovar lai str. 56601
gagcguugaauguuua

SEQ ID NO: 740550 - RNA, 13 nt, Leptospira interrogans serovar lai str. 56601
gagcguuuuguug

SEQ ID NO: 740551 - RNA, 15 nt, Leptospira interrogans serovar lai str. 56601
gagcucaucauucug

SEQ ID NO: 740552 - RNA, 18 nt, Leptospira interrogans serovar lai str. 56601
gagcgauauaauaaaauc

SEQ ID NO: 740553 - RNA, 19 nt, Leptospira interrogans serovar lai str. 56601
gauaaaauauaguuaaauu

SEQ ID NO: 740554 - RNA, 13 nt, Leptospira interrogans serovar lai str. 56601
gaguuuuagaaua

SEQ ID NO: 740555 - RNA, 13 nt, Leptospira interrogans serovar lai str. 56601
gaguuugagagag

SEQ ID NO: 740556 - RNA, 17 nt, Leptospira interrogans serovar lai str. 56601
gaguuucuugaacucaa

SEQ ID NO: 740557 - RNA, 18 nt, Leptospira interrogans serovar lai str. 56601
gaguuucuugaacucaau

SEQ ID NO: 740558 - RNA, 14 nt, Leptospira interrogans serovar lai str. 56601
gaguuguugaaaaa

SEQ ID NO: 740559 - RNA, 18 nt, Leptospira interrogans serovar lai str. 56601
gaguuguugaaaaauuuc

SEQ ID NO: 740560 - RNA, 16 nt, Leptospira interrogans serovar lai str. 56601
gaguuguugaaagggg

SEQ ID NO: 740561 - RNA, 14 nt, Leptospira interrogans serovar lai str. 56601
gaguuguauaacag

SEQ ID NO: 740562 - RNA, 11 nt, Leptospira interrogans serovar lai str. 56601
gaguuuaaaaa

SEQ ID NO: 740563 - RNA, 22 nt, Leptospira interrogans serovar lai str. 56601
gaguuuaaagacgauugauucu

SEQ ID NO: 740564 - RNA, 15 nt, Leptospira interrogans serovar lai str. 56601
gaguucguggagaaa

SEQ ID NO: 740565 - RNA, 22 nt, Leptospira interrogans serovar lai str. 56601
gaguucuaaauuaugauaguca

SEQ ID NO: 740566 - RNA, 20 nt, Leptospira interrogans serovar lai str. 56601
gaguucgacguaaagaauuc

SEQ ID NO: 740567 - RNA, 23 nt, Leptospira interrogans serovar lai str. 56601
gaguucggcguaagaaaaccaug

SEQ ID NO: 740568 - RNA, 16 nt, Leptospira interrogans serovar lai str. 56601
gauaaacauuagaguu

SEQ ID NO: 740569 - RNA, 16 nt, Leptospira interrogans serovar lai str. 56601
gauaacggcuaaaucu

SEQ ID NO: 740570 - RNA, 21 nt, Leptospira interrogans serovar lai str. 56601
gauaacgcguccucaaaucuu

SEQ ID NO: 740571 - RNA, 13 nt, Leptospira interrogans serovar lai str. 56601
gaguguaaucuua

SEQ ID NO: 740572 - RNA, 18 nt, Leptospira interrogans serovar lai str. 56601
gaguuccuacauuuucag

SEQ ID NO: 740573 - RNA, 16 nt, Leptospira interrogans serovar lai str. 56601
gaguuccuacauuuuu

SEQ ID NO: 740574 - RNA, 21 nt, Leptospira interrogans serovar lai str. 56601
gagugaccguugugagaaaua

SEQ ID NO: 740575 - RNA, 18 nt, Leptospira interrogans serovar lai str. 56601
gagugagguuuuggaaag

SEQ ID NO: 740576 - RNA, 21 nt, Leptospira interrogans serovar lai str. 56601
gagugagguuuuggaaagguc

SEQ ID NO: 740577 - RNA, 19 nt, Leptospira interrogans serovar lai str. 56601
gagugcagauuaaaaaaua

SEQ ID NO: 740578 - RNA, 16 nt, Leptospira interrogans serovar lai str. 56601
gaguauuauaaacagu

SEQ ID NO: 740579 - RNA, 15 nt, Leptospira interrogans serovar lai str. 56601
gaguaccauaaauuu

SEQ ID NO: 740580 - RNA, 17 nt, Leptospira interrogans serovar lai str. 56601
gaguaccauaaauuuuu

SEQ ID NO: 740581 - RNA, 13 nt, Leptospira interrogans serovar lai str. 56601
gaguaaggcaaac

SEQ ID NO: 740582 - RNA, 24 nt, Leptospira interrogans serovar lai str. 56601
gaguaacgauuucuauuuuucguc

SEQ ID NO: 740583 - RNA, 13 nt, Leptospira interrogans serovar lai str. 56601
gaguaaacuauug

SEQ ID NO: 740584 - RNA, 17 nt, Leptospira interrogans serovar lai str. 56601
gaguaaaacuuuuaaag

SEQ ID NO: 740585 - RNA, 16 nt, Leptospira interrogans serovar lai str. 56601
gagguacagaaacaaa

SEQ ID NO: 740586 - RNA, 12 nt, Leptospira interrogans serovar lai str. 56601
gagcugagugau

SEQ ID NO: 740587 - RNA, 18 nt, Leptospira interrogans serovar lai str. 56601
gaucugauauuuuaaauu

SEQ ID NO: 740588 - RNA, 21 nt, Leptospira interrogans serovar lai str. 56601
gaucuaaccgacuugagauuc

SEQ ID NO: 740589 - RNA, 21 nt, Leptospira interrogans serovar lai str. 56601
gaucuaauuuguaagaacacu

SEQ ID NO: 740590 - RNA, 23 nt, Leptospira interrogans serovar lai str. 56601
gaucuacuaaaucagaauaaucu

SEQ ID NO: 740591 - RNA, 14 nt, Leptospira interrogans serovar lai str. 56601
gaucuacaaugucu

SEQ ID NO: 740592 - RNA, 22 nt, Leptospira interrogans serovar lai str. 56601
gaucuaucuuuccaguauaaua

SEQ ID NO: 740593 - RNA, 13 nt, Leptospira interrogans serovar lai str. 56601
gaucuauagagag

SEQ ID NO: 740594 - RNA, 20 nt, Leptospira interrogans serovar lai str. 56601
gaucuauguccuuuuuuucu

SEQ ID NO: 740595 - RNA, 21 nt, Leptospira interrogans serovar lai str. 56601
gaucuauguccuuuuuuucuu

SEQ ID NO: 740596 - RNA, 11 nt, Leptospira interrogans serovar lai str. 56601
gaucuacuuug

SEQ ID NO: 740597 - RNA, 18 nt, Leptospira interrogans serovar lai str. 56601
gaucucgagugagguuuu

SEQ ID NO: 740598 - RNA, 13 nt, Leptospira interrogans serovar lai str. 56601
gaucggaaccaaa

SEQ ID NO: 740599 - RNA, 18 nt, Leptospira interrogans serovar lai str. 56601
gaucgcguuugaaacuca

SEQ ID NO: 740600 - RNA, 12 nt, Leptospira interrogans serovar lai str. 56601
gaucguauuuua

SEQ ID NO: 740601 - RNA, 15 nt, Leptospira interrogans serovar lai str. 56601
gaucgguuuuagaau

SEQ ID NO: 740602 - RNA, 14 nt, Leptospira interrogans serovar lai str. 56601
gaucguaaaauuuu

SEQ ID NO: 740603 - RNA, 16 nt, Leptospira interrogans serovar lai str. 56601
gaucguguucuaaauu

SEQ ID NO: 740604 - RNA, 18 nt, Leptospira interrogans serovar lai str. 56601
gaucguguucuaaauuga

SEQ ID NO: 740605 - RNA, 22 nt, Leptospira interrogans serovar lai str. 56601
gaucgggauggagauuacuuuu

SEQ ID NO: 740606 - RNA, 24 nt, Leptospira interrogans serovar lai str. 56601
gaucggcauucagggagugauacg

SEQ ID NO: 740607 - RNA, 19 nt, Leptospira interrogans serovar lai str. 56601
gaucggcauuuaggaagua

SEQ ID NO: 740608 - RNA, 17 nt, Leptospira interrogans serovar lai str. 56601
gauccguagagagcguu

SEQ ID NO: 740609 - RNA, 23 nt, Leptospira interrogans serovar lai str. 56601
gauccguaaaaaacguuuuguug

SEQ ID NO: 740610 - RNA, 21 nt, Leptospira interrogans serovar lai str. 56601
aaagccccagaacaaauccug

SEQ ID NO: 740611 - RNA, 14 nt, Leptospira interrogans serovar lai str. 56601
aaagcccuauaucc

SEQ ID NO: 740612 - RNA, 22 nt, Leptospira interrogans serovar lai str. 56601
aaagccauuucaaaaauauauu

SEQ ID NO: 740613 - RNA, 16 nt, Leptospira interrogans serovar lai str. 56601
aaagccagaauuuuga

SEQ ID NO: 740614 - RNA, 12 nt, Leptospira interrogans serovar lai str. 56601
gaucgacauucc

SEQ ID NO: 740615 - RNA, 18 nt, Leptospira interrogans serovar lai str. 56601
gauccuuacgaucuaaaa

SEQ ID NO: 740616 - RNA, 20 nt, Leptospira interrogans serovar lai str. 56601
gauccuuacgaucuaaaagg

SEQ ID NO: 740617 - RNA, 23 nt, Leptospira interrogans serovar lai str. 56601
gaucgcagcauaauaaucgcuuu

SEQ ID NO: 740618 - RNA, 14 nt, Leptospira interrogans serovar lai str. 56601
gaucgauuccuacu

SEQ ID NO: 740619 - RNA, 14 nt, Leptospira interrogans serovar lai str. 56601
gauccccuugauuc

SEQ ID NO: 740620 - RNA, 19 nt, Leptospira interrogans serovar lai str. 56601
gaucccgauacagaauaaa

SEQ ID NO: 740621 - RNA, 20 nt, Leptospira interrogans serovar lai str. 56601
gauccaauacaaaacaagua

SEQ ID NO: 740622 - RNA, 13 nt, Leptospira interrogans serovar lai str. 56601
gaucauuuaaaac

SEQ ID NO: 740623 - RNA, 14 nt, Leptospira interrogans serovar lai str. 56601
gaucauuuaaaacu

SEQ ID NO: 740624 - RNA, 22 nt, Leptospira interrogans serovar lai str. 56601
gauccacuacggaaggaaaaaa

SEQ ID NO: 740625 - RNA, 18 nt, Leptospira interrogans serovar lai str. 56601
gaucagaaaaacaaaaaa

SEQ ID NO: 740626 - RNA, 16 nt, Leptospira interrogans serovar lai str. 56601
gaucagaauuucuuuc

SEQ ID NO: 740627 - RNA, 20 nt, Leptospira interrogans serovar lai str. 56601
gaucagaauuucuuucucuc

SEQ ID NO: 740628 - RNA, 10 nt, Leptospira interrogans serovar lai str. 56601
gaucacgucg

SEQ ID NO: 740629 - RNA, 19 nt, Leptospira interrogans serovar lai str. 56601
gaucauaauccuaugaaaa

SEQ ID NO: 740630 - RNA, 14 nt, Leptospira interrogans serovar lai str. 56601
gaucaguaguucuc

SEQ ID NO: 740631 - RNA, 22 nt, Leptospira interrogans serovar lai str. 56601
gauaugaaucagccauuaaauu

SEQ ID NO: 740632 - RNA, 23 nt, Leptospira interrogans serovar lai str. 56601
gauagauuaauuuuuauagaauu

SEQ ID NO: 740633 - RNA, 19 nt, Leptospira interrogans serovar lai str. 56601
gauagauucaauuauuaua

SEQ ID NO: 740634 - RNA, 14 nt, Leptospira interrogans serovar lai str. 56601
gauagauuuauaau

SEQ ID NO: 740635 - RNA, 21 nt, Leptospira interrogans serovar lai str. 56601
gauagauuuauaauaaaucaa

SEQ ID NO: 740636 - RNA, 17 nt, Leptospira interrogans serovar lai str. 56601
gauacugccaaugauga

SEQ ID NO: 740637 - RNA, 14 nt, Leptospira interrogans serovar lai str. 56601
gauagaaguuuaua

SEQ ID NO: 740638 - RNA, 16 nt, Leptospira interrogans serovar lai str. 56601
gauagaaguuuauaau

SEQ ID NO: 740639 - RNA, 18 nt, Leptospira interrogans serovar lai str. 56601
gauagaaauauuuagaau

SEQ ID NO: 740640 - RNA, 19 nt, Leptospira interrogans serovar lai str. 56601
gauagagaaaaauuuuccg

SEQ ID NO: 740641 - RNA, 14 nt, Leptospira interrogans serovar lai str. 56601
gaugauugauuguu

SEQ ID NO: 740642 - RNA, 19 nt, Leptospira interrogans serovar lai str. 56601
gaugcauacauagauaaau

SEQ ID NO: 740643 - RNA, 18 nt, Leptospira interrogans serovar lai str. 56601
gaugcucggcuucuucaa

SEQ ID NO: 740644 - RNA, 20 nt, Leptospira interrogans serovar lai str. 56601
gaugaugggaccaagagugu

SEQ ID NO: 740645 - RNA, 21 nt, Leptospira interrogans serovar lai str. 56601
gaugagcaaaauuugcuucca

SEQ ID NO: 740646 - RNA, 18 nt, Leptospira interrogans serovar lai str. 56601
gaucuuaaaaacuugaau

SEQ ID NO: 740647 - RNA, 19 nt, Leptospira interrogans serovar lai str. 56601
gaucuuauacucuuaaaau

SEQ ID NO: 740648 - RNA, 20 nt, Leptospira interrogans serovar lai str. 56601
gaucuuauacucuuaaaauu

SEQ ID NO: 740649 - RNA, 12 nt, Leptospira interrogans serovar lai str. 56601
gaucuuuauaaa

SEQ ID NO: 740650 - RNA, 17 nt, Leptospira interrogans serovar lai str. 56601
gaucuuuuugauaaaau

SEQ ID NO: 740651 - RNA, 13 nt, Leptospira interrogans serovar lai str. 56601
gaucuuuuuuucu

SEQ ID NO: 740652 - RNA, 14 nt, Leptospira interrogans serovar lai str. 56601
gaucuuuuuuucua

SEQ ID NO: 740653 - RNA, 22 nt, Leptospira interrogans serovar lai str. 56601
gaugaaguuuuacuaaaaguaa

SEQ ID NO: 740654 - RNA, 12 nt, Leptospira interrogans serovar lai str. 56601
gauuaaaaaggu

SEQ ID NO: 740655 - RNA, 23 nt, Leptospira interrogans serovar lai str. 56601
gauuaagaaagacuuuuccuaaa

SEQ ID NO: 740656 - RNA, 19 nt, Leptospira interrogans serovar lai str. 56601
gauuaaauuuugaaaaauu

SEQ ID NO: 740657 - RNA, 23 nt, Leptospira interrogans serovar lai str. 56601
gauuaaccguagauuuuaacaau

SEQ ID NO: 740658 - RNA, 18 nt, Leptospira interrogans serovar lai str. 56601
gaugucguuuaacaaaaa

SEQ ID NO: 740659 - RNA, 17 nt, Leptospira interrogans serovar lai str. 56601
gaugugauagaaaggua

SEQ ID NO: 740660 - RNA, 16 nt, Leptospira interrogans serovar lai str. 56601
gauuaggucuaaaaga

SEQ ID NO: 740661 - RNA, 14 nt, Leptospira interrogans serovar lai str. 56601
gauuaugaagaaug

SEQ ID NO: 740662 - RNA, 17 nt, Leptospira interrogans serovar lai str. 56601
gauuaugugacuuuaau

SEQ ID NO: 740663 - RNA, 12 nt, Leptospira interrogans serovar lai str. 56601
gauuauuuacau

SEQ ID NO: 740664 - RNA, 18 nt, Leptospira interrogans serovar lai str. 56601
gauuauuucaaaaauuua

SEQ ID NO: 740665 - RNA, 21 nt, Leptospira interrogans serovar lai str. 56601
gauuauuucaaaaauuuaaau

SEQ ID NO: 740666 - RNA, 18 nt, Leptospira interrogans serovar lai str. 56601
gauucaaaaacuaaaaua

SEQ ID NO: 740667 - RNA, 12 nt, Leptospira interrogans serovar lai str. 56601
gauucaaaauug

SEQ ID NO: 740668 - RNA, 14 nt, Leptospira interrogans serovar lai str. 56601
gauuagcaugaaau

SEQ ID NO: 740669 - RNA, 15 nt, Leptospira interrogans serovar lai str. 56601
gauuagaguuaaauu

SEQ ID NO: 740670 - RNA, 11 nt, Leptospira interrogans serovar lai str. 56601
gauuagaaaaa

SEQ ID NO: 740671 - RNA, 16 nt, Leptospira interrogans serovar lai str. 56601
gauuagaaaaaaagua

SEQ ID NO: 740672 - RNA, 16 nt, Leptospira interrogans serovar lai str. 56601
gauuagaagaauugua

SEQ ID NO: 740673 - RNA, 15 nt, Leptospira interrogans serovar lai str. 56601
gauuacuaugaaaau

SEQ ID NO: 740674 - RNA, 14 nt, Leptospira interrogans serovar lai str. 56601
gauuaccuaacuau

SEQ ID NO: 740675 - RNA, 19 nt, Leptospira interrogans serovar lai str. 56601
gauuaaucuguaaaucaac

SEQ ID NO: 740676 - RNA, 22 nt, Leptospira interrogans serovar lai str. 56601
gauuacaauuauacuauaaguu

SEQ ID NO: 740677 - RNA, 21 nt, Leptospira interrogans serovar lai str. 56601
gaugcuuucucuuuuuagaca

SEQ ID NO: 740678 - RNA, 23 nt, Leptospira interrogans serovar lai str. 56601
gauggaucuauaucgugaaacuu

SEQ ID NO: 740679 - RNA, 14 nt, Leptospira interrogans serovar lai str. 56601
gauuuuaaauaaaa

SEQ ID NO: 740680 - RNA, 15 nt, Leptospira interrogans serovar lai str. 56601
gauuuuaaauaaaaa

SEQ ID NO: 740681 - RNA, 18 nt, Leptospira interrogans serovar lai str. 56601
gauuuuaaauaaaaagaa

SEQ ID NO: 740682 - RNA, 15 nt, Leptospira interrogans serovar lai str. 56601
gauuuuacgaacaaa

SEQ ID NO: 740683 - RNA, 22 nt, Leptospira interrogans serovar lai str. 56601
gauuuuacgaacacauucuaaa

SEQ ID NO: 740684 - RNA, 22 nt, Leptospira interrogans serovar lai str. 56601
gauuuuacgaaccaauucuaaa

SEQ ID NO: 740685 - RNA, 20 nt, Leptospira interrogans serovar lai str. 56601
gauuuuacgauuaaauuuug

SEQ ID NO: 740686 - RNA, 13 nt, Leptospira interrogans serovar lai str. 56601
gauuuuacaaaga

SEQ ID NO: 740687 - RNA, 17 nt, Leptospira interrogans serovar lai str. 56601
gauuuuagaaucagaau

SEQ ID NO: 740688 - RNA, 18 nt, Leptospira interrogans serovar lai str. 56601
gauuuuaaaaauuuugaa

SEQ ID NO: 740689 - RNA, 14 nt, Leptospira interrogans serovar lai str. 56601
gauuugucucaaaa

SEQ ID NO: 740690 - RNA, 13 nt, Leptospira interrogans serovar lai str. 56601
gauuuguugaaaa

SEQ ID NO: 740691 - RNA, 17 nt, Leptospira interrogans serovar lai str. 56601
gauuuguugaaaaguga

SEQ ID NO: 740692 - RNA, 19 nt, Leptospira interrogans serovar lai str. 56601
gauuuguguuaguucccac

SEQ ID NO: 740693 - RNA, 17 nt, Leptospira interrogans serovar lai str. 56601
gauuuuaugaaaguuuu

SEQ ID NO: 740694 - RNA, 16 nt, Leptospira interrogans serovar lai str. 56601
gauuuuauguaagaaa

SEQ ID NO: 740695 - RNA, 19 nt, Leptospira interrogans serovar lai str. 56601
gauuuugaaaguaauuuau

SEQ ID NO: 740696 - RNA, 14 nt, Leptospira interrogans serovar lai str. 56601
gauuucuauccauu

SEQ ID NO: 740697 - RNA, 15 nt, Leptospira interrogans serovar lai str. 56601
gauuucuauccauuc

SEQ ID NO: 740698 - RNA, 22 nt, Leptospira interrogans serovar lai str. 56601
gauuucguucggaaaaaauaug

SEQ ID NO: 740699 - RNA, 14 nt, Leptospira interrogans serovar lai str. 56601
gauuucuauauuca

SEQ ID NO: 740700 - RNA, 18 nt, Leptospira interrogans serovar lai str. 56601
gauuucuauauucaaaaa

SEQ ID NO: 740701 - RNA, 15 nt, Leptospira interrogans serovar lai str. 56601
gauuucuuucaaagc

SEQ ID NO: 740702 - RNA, 21 nt, Leptospira interrogans serovar lai str. 56601
gauuugcaucgacaaaacuuc

SEQ ID NO: 740703 - RNA, 18 nt, Leptospira interrogans serovar lai str. 56601
gauuugcggaucguuuuu

SEQ ID NO: 740704 - RNA, 16 nt, Leptospira interrogans serovar lai str. 56601
gauuugguuuucauuc

SEQ ID NO: 740705 - RNA, 13 nt, Leptospira interrogans serovar lai str. 56601
gauuuguaaaauu

SEQ ID NO: 740706 - RNA, 14 nt, Leptospira interrogans serovar lai str. 56601
gauuucauccaugu

SEQ ID NO: 740707 - RNA, 23 nt, Leptospira interrogans serovar lai str. 56601
gauuucauccaugucuucuaaau

SEQ ID NO: 740708 - RNA, 23 nt, Leptospira interrogans serovar lai str. 56601
gauuucauucggagacuugauuu

SEQ ID NO: 740709 - RNA, 15 nt, Leptospira interrogans serovar lai str. 56601
gauuuauauguuucu

SEQ ID NO: 740710 - RNA, 17 nt, Leptospira interrogans serovar lai str. 56601
gauuuauugaaaaauag

SEQ ID NO: 740711 - RNA, 21 nt, Leptospira interrogans serovar lai str. 56601
gauuucaacuuuuuucagaaa

SEQ ID NO: 740712 - RNA, 16 nt, Leptospira interrogans serovar lai str. 56601
gauuuauuuuaaaauu

SEQ ID NO: 740713 - RNA, 16 nt, Leptospira interrogans serovar lai str. 56601
gauuuauuuuagaaug

SEQ ID NO: 740714 - RNA, 19 nt, Leptospira interrogans serovar lai str. 56601
gauuuaucaguuaaacuuu

SEQ ID NO: 740715 - RNA, 14 nt, Leptospira interrogans serovar lai str. 56601
gauuuauaacuuac

SEQ ID NO: 740716 - RNA, 21 nt, Leptospira interrogans serovar lai str. 56601
gauuuaguaaaauuuaaaauu

SEQ ID NO: 740717 - RNA, 18 nt, Leptospira interrogans serovar lai str. 56601
gauuuacuuuaaaauuug

SEQ ID NO: 740718 - RNA, 15 nt, Leptospira interrogans serovar lai str. 56601
gauuuagauucuaaa

SEQ ID NO: 740719 - RNA, 18 nt, Leptospira interrogans serovar lai str. 56601
gauuuagagccaaauuuu

SEQ ID NO: 740720 - RNA, 19 nt, Leptospira interrogans serovar lai str. 56601
gauuguugaacuugcucaa

SEQ ID NO: 740721 - RNA, 20 nt, Leptospira interrogans serovar lai str. 56601
gauuuaauuuagaaauuuau

SEQ ID NO: 740722 - RNA, 20 nt, Leptospira interrogans serovar lai str. 56601
gauuuaaaaacuaucaguuu

SEQ ID NO: 740723 - RNA, 20 nt, Leptospira interrogans serovar lai str. 56601
gauuuaaaaucacaaaaaag

SEQ ID NO: 740724 - RNA, 16 nt, Leptospira interrogans serovar lai str. 56601
gauucuaaaaaugaaa

SEQ ID NO: 740725 - RNA, 18 nt, Leptospira interrogans serovar lai str. 56601
gauucuaaaaaaaguuuu

SEQ ID NO: 740726 - RNA, 20 nt, Leptospira interrogans serovar lai str. 56601
gauucuaacugguuuuucuu

SEQ ID NO: 740727 - RNA, 14 nt, Leptospira interrogans serovar lai str. 56601
gauucguacaacca

SEQ ID NO: 740728 - RNA, 14 nt, Leptospira interrogans serovar lai str. 56601
gauucgcucaaauu

SEQ ID NO: 740729 - RNA, 14 nt, Leptospira interrogans serovar lai str. 56601
gauuccuaaaaauu

SEQ ID NO: 740730 - RNA, 17 nt, Leptospira interrogans serovar lai str. 56601
gauuccuaaaaauuguu

SEQ ID NO: 740731 - RNA, 16 nt, Leptospira interrogans serovar lai str. 56601
gauuccgguaaauuuu

SEQ ID NO: 740732 - RNA, 22 nt, Leptospira interrogans serovar lai str. 56601
gauucgaacuuuuuuuagaauc

SEQ ID NO: 740733 - RNA, 22 nt, Leptospira interrogans serovar lai str. 56601
gauuccuuuccgauuucuuuca

SEQ ID NO: 740734 - RNA, 15 nt, Leptospira interrogans serovar lai str. 56601
gauuccuuuuaagaa

SEQ ID NO: 740735 - RNA, 13 nt, Leptospira interrogans serovar lai str. 56601
gauucgaaagauu

SEQ ID NO: 740736 - RNA, 14 nt, Leptospira interrogans serovar lai str. 56601
gauucgaaauuuuc

SEQ ID NO: 740737 - RNA, 18 nt, Leptospira interrogans serovar lai str. 56601
gauucauuuuuugaaaaa

SEQ ID NO: 740738 - RNA, 16 nt, Leptospira interrogans serovar lai str. 56601
gauuccaaagauaaaa

SEQ ID NO: 740739 - RNA, 21 nt, Leptospira interrogans serovar lai str. 56601
gauuccaaagauaaaaaagaa

SEQ ID NO: 740740 - RNA, 18 nt, Leptospira interrogans serovar lai str. 56601
gauuccauugauuuucau

SEQ ID NO: 740741 - RNA, 18 nt, Leptospira interrogans serovar lai str. 56601
gauuccauuuuuuagaau

SEQ ID NO: 740742 - RNA, 19 nt, Leptospira interrogans serovar lai str. 56601
gauuccauuuuuuagaauc

SEQ ID NO: 740743 - RNA, 20 nt, Leptospira interrogans serovar lai str. 56601
gauuccaacuuuuucagaaa

SEQ ID NO: 740744 - RNA, 14 nt, Leptospira interrogans serovar lai str. 56601
gauucauuucgaaa

SEQ ID NO: 740745 - RNA, 20 nt, Leptospira interrogans serovar lai str. 56601
gauucauuucgaaaacgauu

SEQ ID NO: 740746 - RNA, 21 nt, Leptospira interrogans serovar lai str. 56601
gauucauuucguaaaauccau

SEQ ID NO: 740747 - RNA, 17 nt, Leptospira interrogans serovar lai str. 56601
gauucaauuuuuauaaa

SEQ ID NO: 740748 - RNA, 22 nt, Leptospira interrogans serovar lai str. 56601
gauucacaaacgguuuuaguaa

SEQ ID NO: 740749 - RNA, 17 nt, Leptospira interrogans serovar lai str. 56601
gauucaauuauuauaaa

SEQ ID NO: 740750 - RNA, 12 nt, Leptospira interrogans serovar lai str. 56601
gauucacuucca

SEQ ID NO: 740751 - RNA, 15 nt, Leptospira interrogans serovar lai str. 56601
gauucacuuccauug

SEQ ID NO: 740752 - RNA, 15 nt, Leptospira interrogans serovar lai str. 56601
gauugcuuuuuaaaa

SEQ ID NO: 740753 - RNA, 18 nt, Leptospira interrogans serovar lai str. 56601
gauugagaauucuacauu

SEQ ID NO: 740754 - RNA, 15 nt, Leptospira interrogans serovar lai str. 56601
gauugaguuucacaa

SEQ ID NO: 740755 - RNA, 15 nt, Leptospira interrogans serovar lai str. 56601
gauugauuuuggaaa

SEQ ID NO: 740756 - RNA, 14 nt, Leptospira interrogans serovar lai str. 56601
gauugcaaauucaa

SEQ ID NO: 740757 - RNA, 17 nt, Leptospira interrogans serovar lai str. 56601
gauucugcucuucuaau

SEQ ID NO: 740758 - RNA, 19 nt, Leptospira interrogans serovar lai str. 56601
gauucugaaaaaaauuaga

SEQ ID NO: 740759 - RNA, 14 nt, Leptospira interrogans serovar lai str. 56601
gauucugaaaaaag

SEQ ID NO: 740760 - RNA, 13 nt, Leptospira interrogans serovar lai str. 56601
gauucugaaaaga

SEQ ID NO: 740761 - RNA, 22 nt, Leptospira interrogans serovar lai str. 56601
gauucuauccaauugaauauaa

SEQ ID NO: 740762 - RNA, 21 nt, Leptospira interrogans serovar lai str. 56601
gauucuauuuucuuugaaaaa

SEQ ID NO: 740763 - RNA, 21 nt, Leptospira interrogans serovar lai str. 56601
gauucucaaaauggccuucua

SEQ ID NO: 740764 - RNA, 21 nt, Leptospira interrogans serovar lai str. 56601
gauucuccauccgaauugauc

SEQ ID NO: 740765 - RNA, 19 nt, Leptospira interrogans serovar lai str. 56601
gauucucgcauuuuccuuu

SEQ ID NO: 740766 - RNA, 22 nt, Leptospira interrogans serovar lai str. 56601
gauucucguucaacuuuccuuu

SEQ ID NO: 740767 - RNA, 23 nt, Leptospira interrogans serovar lai str. 56601
gauucucguucaacuuuccuuuu

SEQ ID NO: 740768 - RNA, 19 nt, Leptospira interrogans serovar lai str. 56601
gauugaagcaguuuuguua

SEQ ID NO: 740769 - RNA, 18 nt, Leptospira interrogans serovar lai str. 56601
gauucuuucgacuucuuu

SEQ ID NO: 740770 - RNA, 20 nt, Leptospira interrogans serovar lai str. 56601
gauucuuucgacuucuuuuu

SEQ ID NO: 740771 - RNA, 15 nt, Leptospira interrogans serovar lai str. 56601
gauucuuuaaaugug

SEQ ID NO: 740772 - RNA, 20 nt, Leptospira interrogans serovar lai str. 56601
gauucuuuucccgcuaaaag

SEQ ID NO: 740773 - RNA, 20 nt, Leptospira interrogans serovar lai str. 56601
gcaaaucacaauuuuacaaa

SEQ ID NO: 740774 - RNA, 19 nt, Leptospira interrogans serovar lai str. 56601
gcaaaucacgauuuuacga

SEQ ID NO: 740775 - RNA, 13 nt, Leptospira interrogans serovar lai str. 56601
gcaaauaauaaaa

SEQ ID NO: 740776 - RNA, 19 nt, Leptospira interrogans serovar lai str. 56601
gcaaaguuucuuauauaaa

SEQ ID NO: 740777 - RNA, 16 nt, Leptospira interrogans serovar lai str. 56601
gcaaauuuacuucaau

SEQ ID NO: 740778 - RNA, 12 nt, Leptospira interrogans serovar lai str. 56601
gcaaauuuuuuc

SEQ ID NO: 740779 - RNA, 21 nt, Leptospira interrogans serovar lai str. 56601
gcaaauuuuuuucuaaaauau

SEQ ID NO: 740780 - RNA, 15 nt, Leptospira interrogans serovar lai str. 56601
gcaaauuuuauagua

SEQ ID NO: 740781 - RNA, 12 nt, Leptospira interrogans serovar lai str. 56601
gcaaauucuacu

SEQ ID NO: 740782 - RNA, 20 nt, Leptospira interrogans serovar lai str. 56601
gcaaauguuauuuuugcaca

SEQ ID NO: 740783 - RNA, 13 nt, Leptospira interrogans serovar lai str. 56601
gcaacacacacuu

SEQ ID NO: 740784 - RNA, 19 nt, Leptospira interrogans serovar lai str. 56601
gcaacacacacuuuauaaa

SEQ ID NO: 740785 - RNA, 14 nt, Leptospira interrogans serovar lai str. 56601
gcaaagaagaaaua

SEQ ID NO: 740786 - RNA, 17 nt, Leptospira interrogans serovar lai str. 56601
gcaaacuuuuuauaaaa

SEQ ID NO: 740787 - RNA, 19 nt, Leptospira interrogans serovar lai str. 56601
gcaaacuuuuuauaaaaag

SEQ ID NO: 740788 - RNA, 20 nt, Leptospira interrogans serovar lai str. 56601
gcaaacuuuuuauaaaaagc

SEQ ID NO: 740789 - RNA, 16 nt, Leptospira interrogans serovar lai str. 56601
gcaaaggaucaaaucg

SEQ ID NO: 740790 - RNA, 21 nt, Leptospira interrogans serovar lai str. 56601
gauuuuuuacaaaaguagaaa

SEQ ID NO: 740791 - RNA, 23 nt, Leptospira interrogans serovar lai str. 56601
gauuuuuuacaaaaguagaaaga

SEQ ID NO: 740792 - RNA, 22 nt, Leptospira interrogans serovar lai str. 56601
gauuuuuguucacuaaggccca

SEQ ID NO: 740793 - RNA, 15 nt, Leptospira interrogans serovar lai str. 56601
gauuuuuuagcaccu

SEQ ID NO: 740794 - RNA, 16 nt, Leptospira interrogans serovar lai str. 56601
gauuuuucuucuucau

SEQ ID NO: 740795 - RNA, 18 nt, Leptospira interrogans serovar lai str. 56601
gauuuuggauagcaaaaa

SEQ ID NO: 740796 - RNA, 11 nt, Leptospira interrogans serovar lai str. 56601
gcaaaaaaaau

SEQ ID NO: 740797 - RNA, 14 nt, Leptospira interrogans serovar lai str. 56601
gcaaaaaaauaaaa

SEQ ID NO: 740798 - RNA, 20 nt, Leptospira interrogans serovar lai str. 56601
gcaaaaaguauguuuuucug

SEQ ID NO: 740799 - RNA, 12 nt, Leptospira interrogans serovar lai str. 56601
gcaaaaauuccu

SEQ ID NO: 740800 - RNA, 14 nt, Leptospira interrogans serovar lai str. 56601
gcaaaaauuccuuu

SEQ ID NO: 740801 - RNA, 17 nt, Leptospira interrogans serovar lai str. 56601
gcaaaaucgauugaucu

SEQ ID NO: 740802 - RNA, 19 nt, Leptospira interrogans serovar lai str. 56601
gcaaaaucaguuaauacaa

SEQ ID NO: 740803 - RNA, 16 nt, Leptospira interrogans serovar lai str. 56601
gcauccaaucaugaau

SEQ ID NO: 740804 - RNA, 16 nt, Leptospira interrogans serovar lai str. 56601
gcauuuaauauauuca

SEQ ID NO: 740805 - RNA, 17 nt, Leptospira interrogans serovar lai str. 56601
gcauuuauauucgcucc

SEQ ID NO: 740806 - RNA, 16 nt, Leptospira interrogans serovar lai str. 56601
gcauuuuaaacaaaga

SEQ ID NO: 740807 - RNA, 14 nt, Leptospira interrogans serovar lai str. 56601
gcauuuuauuaaaa

SEQ ID NO: 740808 - RNA, 14 nt, Leptospira interrogans serovar lai str. 56601
gccaaagaaauaga

SEQ ID NO: 740809 - RNA, 20 nt, Leptospira interrogans serovar lai str. 56601
gcauugaguuacgcugaguu

SEQ ID NO: 740810 - RNA, 13 nt, Leptospira interrogans serovar lai str. 56601
gcauugaugacaa

SEQ ID NO: 740811 - RNA, 15 nt, Leptospira interrogans serovar lai str. 56601
gcagcuaagaaaaaa

SEQ ID NO: 740812 - RNA, 19 nt, Leptospira interrogans serovar lai str. 56601
gcagcuaagaaaaaaguug

SEQ ID NO: 740813 - RNA, 19 nt, Leptospira interrogans serovar lai str. 56601
gcagcuaaaaagaaaguug

SEQ ID NO: 740814 - RNA, 15 nt, Leptospira interrogans serovar lai str. 56601
gcagcuauuuuuuuc

SEQ ID NO: 740815 - RNA, 11 nt, Leptospira interrogans serovar lai str. 56601
gcaguauuuua

SEQ ID NO: 740816 - RNA, 14 nt, Leptospira interrogans serovar lai str. 56601
gcaguucaauuuuu

SEQ ID NO: 740817 - RNA, 12 nt, Leptospira interrogans serovar lai str. 56601
gcauaaaaaaau

SEQ ID NO: 740818 - RNA, 17 nt, Leptospira interrogans serovar lai str. 56601
aaagcuccuuucaucuc

SEQ ID NO: 740819 - RNA, 14 nt, Leptospira interrogans serovar lai str. 56601
gccgcuauggaagg

SEQ ID NO: 740820 - RNA, 13 nt, Leptospira interrogans serovar lai str. 56601
gccgaacucacgu

SEQ ID NO: 740821 - RNA, 18 nt, Leptospira interrogans serovar lai str. 56601
gccauuauccaaaacucu

SEQ ID NO: 740822 - RNA, 20 nt, Leptospira interrogans serovar lai str. 56601
gccauguuuuuaaaaucuuc

SEQ ID NO: 740823 - RNA, 16 nt, Leptospira interrogans serovar lai str. 56601
gccaucuuuuuuugcc

SEQ ID NO: 740824 - RNA, 16 nt, Leptospira interrogans serovar lai str. 56601
gccauuuccaauuuug

SEQ ID NO: 740825 - RNA, 18 nt, Leptospira interrogans serovar lai str. 56601
gccauuucaaaaauauau

SEQ ID NO: 740826 - RNA, 15 nt, Leptospira interrogans serovar lai str. 56601
gcccacaucgaaaaa

SEQ ID NO: 740827 - RNA, 22 nt, Leptospira interrogans serovar lai str. 56601
gcccacaucgaaaaaacaaaua

SEQ ID NO: 740828 - RNA, 15 nt, Leptospira interrogans serovar lai str. 56601
gcccgcguauauaaa

SEQ ID NO: 740829 - RNA, 22 nt, Leptospira interrogans serovar lai str. 56601
gcggauucuacgacaacuauaa

SEQ ID NO: 740830 - RNA, 20 nt, Leptospira interrogans serovar lai str. 56601
gcgaucuaaccgacuugaga

SEQ ID NO: 740831 - RNA, 15 nt, Leptospira interrogans serovar lai str. 56601
gcgauucuaggaucu

SEQ ID NO: 740832 - RNA, 14 nt, Leptospira interrogans serovar lai str. 56601
gcgauucauaaaga

SEQ ID NO: 740833 - RNA, 14 nt, Leptospira interrogans serovar lai str. 56601
gccuuuuuauuucu

SEQ ID NO: 740834 - RNA, 18 nt, Leptospira interrogans serovar lai str. 56601
gcgaaagagggaauguau

SEQ ID NO: 740835 - RNA, 12 nt, Leptospira interrogans serovar lai str. 56601
gcgaaagaaugu

SEQ ID NO: 740836 - RNA, 21 nt, Leptospira interrogans serovar lai str. 56601
gcgaaagaauguauaccaaua

SEQ ID NO: 740837 - RNA, 13 nt, Leptospira interrogans serovar lai str. 56601
gcgaaauaaaaac

SEQ ID NO: 740838 - RNA, 20 nt, Leptospira interrogans serovar lai str. 56601
gcgaacuuuuuuauaaaugg

SEQ ID NO: 740839 - RNA, 15 nt, Leptospira interrogans serovar lai str. 56601
gccuucuuuucaaaa

SEQ ID NO: 740840 - RNA, 15 nt, Leptospira interrogans serovar lai str. 56601
gccuucuuuuuucua

SEQ ID NO: 740841 - RNA, 15 nt, Leptospira interrogans serovar lai str. 56601
gccuucacccaccaa

SEQ ID NO: 740842 - RNA, 23 nt, Leptospira interrogans serovar lai str. 56601
gccguuugcaaguagaagucgua

SEQ ID NO: 740843 - RNA, 20 nt, Leptospira interrogans serovar lai str. 56601
gccuacacuguguucuuuuu

SEQ ID NO: 740844 - RNA, 22 nt, Leptospira interrogans serovar lai str. 56601
ggucauuuuucaaauaaagaaa

SEQ ID NO: 740845 - RNA, 19 nt, Leptospira interrogans serovar lai str. 56601
ggucccaaacuuucuuuuu

SEQ ID NO: 740846 - RNA, 13 nt, Leptospira interrogans serovar lai str. 56601
ggucgauugaagc

SEQ ID NO: 740847 - RNA, 20 nt, Leptospira interrogans serovar lai str. 56601
ggucggaauuacgacaaguc

SEQ ID NO: 740848 - RNA, 13 nt, Leptospira interrogans serovar lai str. 56601
gguaauuugugaa

SEQ ID NO: 740849 - RNA, 13 nt, Leptospira interrogans serovar lai str. 56601
gguacagaaacaa

SEQ ID NO: 740850 - RNA, 20 nt, Leptospira interrogans serovar lai str. 56601
gguaucuacauuggaaggac

SEQ ID NO: 740851 - RNA, 18 nt, Leptospira interrogans serovar lai str. 56601
gguauuuuagguauuucu

SEQ ID NO: 740852 - RNA, 19 nt, Leptospira interrogans serovar lai str. 56601
gguauaaaauaaaaauuuc

SEQ ID NO: 740853 - RNA, 16 nt, Leptospira interrogans serovar lai str. 56601
gguauagaaguucgga

SEQ ID NO: 740854 - RNA, 17 nt, Leptospira interrogans serovar lai str. 56601
gguaauuguagauucuu

SEQ ID NO: 740855 - RNA, 14 nt, Leptospira interrogans serovar lai str. 56601
gguaaggagcucau

SEQ ID NO: 740856 - RNA, 18 nt, Leptospira interrogans serovar lai str. 56601
gguaaauuuuuuagaaau

SEQ ID NO: 740857 - RNA, 19 nt, Leptospira interrogans serovar lai str. 56601
ggguuuuaccaggaugaau

SEQ ID NO: 740858 - RNA, 19 nt, Leptospira interrogans serovar lai str. 56601
ggguuuuaucuaaaauuuc

SEQ ID NO: 740859 - RNA, 20 nt, Leptospira interrogans serovar lai str. 56601
ggguuuguaacuccuagaug

SEQ ID NO: 740860 - RNA, 13 nt, Leptospira interrogans serovar lai str. 56601
gguaaaaaaaaau

SEQ ID NO: 740861 - RNA, 15 nt, Leptospira interrogans serovar lai str. 56601
ggguauauuggcuuu

SEQ ID NO: 740862 - RNA, 18 nt, Leptospira interrogans serovar lai str. 56601
gggauuuuaaaaauuuug

SEQ ID NO: 740863 - RNA, 17 nt, Leptospira interrogans serovar lai str. 56601
gggauacucauaaaauu

SEQ ID NO: 740864 - RNA, 21 nt, Leptospira interrogans serovar lai str. 56601
gggagacucuaguaaagaaac

SEQ ID NO: 740865 - RNA, 23 nt, Leptospira interrogans serovar lai str. 56601
gggagacucuaguaaagaaacuc

SEQ ID NO: 740866 - RNA, 16 nt, Leptospira interrogans serovar lai str. 56601
gggaagguuuuguaaa

SEQ ID NO: 740867 - RNA, 18 nt, Leptospira interrogans serovar lai str. 56601
gggaauuacuacaaauua

SEQ ID NO: 740868 - RNA, 22 nt, Leptospira interrogans serovar lai str. 56601
gggaauuuuuguaaaauccaga

SEQ ID NO: 740869 - RNA, 13 nt, Leptospira interrogans serovar lai str. 56601
gggacaagcucau

SEQ ID NO: 740870 - RNA, 15 nt, Leptospira interrogans serovar lai str. 56601
gggaacucucacaaa

SEQ ID NO: 740871 - RNA, 16 nt, Leptospira interrogans serovar lai str. 56601
gggaacuaccaccaaa

SEQ ID NO: 740872 - RNA, 18 nt, Leptospira interrogans serovar lai str. 56601
gggaacuacuacaaaaau

SEQ ID NO: 740873 - RNA, 14 nt, Leptospira interrogans serovar lai str. 56601
gggaacuacuacau

SEQ ID NO: 740874 - RNA, 23 nt, Leptospira interrogans serovar lai str. 56601
gggaacuacuacauuuuauugug

SEQ ID NO: 740875 - RNA, 19 nt, Leptospira interrogans serovar lai str. 56601
gggaacuaucacaaaucua

SEQ ID NO: 740876 - RNA, 13 nt, Leptospira interrogans serovar lai str. 56601
ggcuuuuguaaau

SEQ ID NO: 740877 - RNA, 21 nt, Leptospira interrogans serovar lai str. 56601
ggcuuguauuuuauuuuugga

SEQ ID NO: 740878 - RNA, 15 nt, Leptospira interrogans serovar lai str. 56601
ggcucgguaaaaaga

SEQ ID NO: 740879 - RNA, 13 nt, Leptospira interrogans serovar lai str. 56601
ggcuccauauucc

SEQ ID NO: 740880 - RNA, 19 nt, Leptospira interrogans serovar lai str. 56601
ggcugauucccaguaaauc

SEQ ID NO: 740881 - RNA, 15 nt, Leptospira interrogans serovar lai str. 56601
aaauaaauuuaaaug

SEQ ID NO: 740882 - RNA, 12 nt, Leptospira interrogans serovar lai str. 56601
aaauaaauuuau

SEQ ID NO: 740883 - RNA, 15 nt, Leptospira interrogans serovar lai str. 56601
ggcgagacauaaaaa

SEQ ID NO: 740884 - RNA, 23 nt, Leptospira interrogans serovar lai str. 56601
aaauaagaaucgaaaaaauacaa

SEQ ID NO: 740885 - RNA, 14 nt, Leptospira interrogans serovar lai str. 56601
ggccuuuuuuauuu

SEQ ID NO: 740886 - RNA, 14 nt, Leptospira interrogans serovar lai str. 56601
aaauaauauuauaa

SEQ ID NO: 740887 - RNA, 20 nt, Leptospira interrogans serovar lai str. 56601
aaauaaugauagaaauauuu

SEQ ID NO: 740888 - RNA, 21 nt, Leptospira interrogans serovar lai str. 56601
aaauaaugauagaaauauuua

SEQ ID NO: 740889 - RNA, 20 nt, Leptospira interrogans serovar lai str. 56601
aaauaagcuaagcauaaaau

SEQ ID NO: 740890 - RNA, 15 nt, Leptospira interrogans serovar lai str. 56601
aaauaaguaaaucua

SEQ ID NO: 740891 - RNA, 13 nt, Leptospira interrogans serovar lai str. 56601
aaauaagaagcca

SEQ ID NO: 740892 - RNA, 19 nt, Leptospira interrogans serovar lai str. 56601
aaauaagcccgaagauucu

SEQ ID NO: 740893 - RNA, 13 nt, Leptospira interrogans serovar lai str. 56601
aaauaauaaaacu

SEQ ID NO: 740894 - RNA, 17 nt, Leptospira interrogans serovar lai str. 56601
aaauaauaauauuuuua

SEQ ID NO: 740895 - RNA, 12 nt, Leptospira interrogans serovar lai str. 56601
aaauaauaccaa

SEQ ID NO: 740896 - RNA, 20 nt, Leptospira interrogans serovar lai str. 56601
aaauaauugauuagaguuaa

SEQ ID NO: 740897 - RNA, 13 nt, Leptospira interrogans serovar lai str. 56601
aaauaauuuuuac

SEQ ID NO: 740898 - RNA, 19 nt, Leptospira interrogans serovar lai str. 56601
aaauaauuuuuacuuccca

SEQ ID NO: 740899 - RNA, 12 nt, Leptospira interrogans serovar lai str. 56601
aaauaauuuuua

SEQ ID NO: 740900 - RNA, 18 nt, Leptospira interrogans serovar lai str. 56601
aaauacaaaaacgauuau

SEQ ID NO: 740901 - RNA, 16 nt, Leptospira interrogans serovar lai str. 56601
aaauacaaaauuuuuu

SEQ ID NO: 740902 - RNA, 14 nt, Leptospira interrogans serovar lai str. 56601
aaauacaaaguauu

SEQ ID NO: 740903 - RNA, 16 nt, Leptospira interrogans serovar lai str. 56601
aaauacaaaguauucu

SEQ ID NO: 740904 - RNA, 13 nt, Leptospira interrogans serovar lai str. 56601
aaauacaaaguuu

SEQ ID NO: 740905 - RNA, 18 nt, Leptospira interrogans serovar lai str. 56601
aaauacagugucuugaaa

SEQ ID NO: 740906 - RNA, 13 nt, Leptospira interrogans serovar lai str. 56601
aaauacauaaaaa

SEQ ID NO: 740907 - RNA, 19 nt, Leptospira interrogans serovar lai str. 56601
aaauacauacaaugaaaaa

SEQ ID NO: 740908 - RNA, 21 nt, Leptospira interrogans serovar lai str. 56601
aaauacauacaaugaaaaagc

SEQ ID NO: 740909 - RNA, 22 nt, Leptospira interrogans serovar lai str. 56601
aaauacauuaagauuauauuau

SEQ ID NO: 740910 - RNA, 18 nt, Leptospira interrogans serovar lai str. 56601
aaauaccauaaauuuuga

SEQ ID NO: 740911 - RNA, 15 nt, Leptospira interrogans serovar lai str. 56601
aaauacgaaaacaau

SEQ ID NO: 740912 - RNA, 16 nt, Leptospira interrogans serovar lai str. 56601
aaauacgaaaacaauu

SEQ ID NO: 740913 - RNA, 17 nt, Leptospira interrogans serovar lai str. 56601
aaauaccuaaauauuua

SEQ ID NO: 740914 - RNA, 16 nt, Leptospira interrogans serovar lai str. 56601
aaauacgcuucucuug

SEQ ID NO: 740915 - RNA, 20 nt, Leptospira interrogans serovar lai str. 56601
aaauacggcacucaauuuua

SEQ ID NO: 740916 - RNA, 12 nt, Leptospira interrogans serovar lai str. 56601
aaauacuuuacc

SEQ ID NO: 740917 - RNA, 16 nt, Leptospira interrogans serovar lai str. 56601
aaauacuuuauuugua

SEQ ID NO: 740918 - RNA, 13 nt, Leptospira interrogans serovar lai str. 56601
aaauacuuugauu

SEQ ID NO: 740919 - RNA, 23 nt, Leptospira interrogans serovar lai str. 56601
aaauacuuuuagaaaauuagaaa

SEQ ID NO: 740920 - RNA, 15 nt, Leptospira interrogans serovar lai str. 56601
aaauagaaaccuuuc

SEQ ID NO: 740921 - RNA, 20 nt, Leptospira interrogans serovar lai str. 56601
aaauagaaaccuuucaucua

SEQ ID NO: 740922 - RNA, 13 nt, Leptospira interrogans serovar lai str. 56601
aaauagaaagacu

SEQ ID NO: 740923 - RNA, 23 nt, Leptospira interrogans serovar lai str. 56601
ggcggaaugcaacagagaaagug

SEQ ID NO: 740924 - RNA, 19 nt, Leptospira interrogans serovar lai str. 56601
ggcgguucuaaaaguccca

SEQ ID NO: 740925 - RNA, 16 nt, Leptospira interrogans serovar lai str. 56601
aaagucuauuucccaa

SEQ ID NO: 740926 - RNA, 20 nt, Leptospira interrogans serovar lai str. 56601
aaagucuauuucccaaaauu

SEQ ID NO: 740927 - RNA, 22 nt, Leptospira interrogans serovar lai str. 56601
aaagugaaucucuuacgaugag

SEQ ID NO: 740928 - RNA, 22 nt, Leptospira interrogans serovar lai str. 56601
aaagucugucuuaaaauuugaa

SEQ ID NO: 740929 - RNA, 15 nt, Leptospira interrogans serovar lai str. 56601
aaagugaguuuucuu

SEQ ID NO: 740930 - RNA, 17 nt, Leptospira interrogans serovar lai str. 56601
aaagugaugaagagaaa

SEQ ID NO: 740931 - RNA, 17 nt, Leptospira interrogans serovar lai str. 56601
ggccccaccuaaaauga

SEQ ID NO: 740932 - RNA, 20 nt, Leptospira interrogans serovar lai str. 56601
ggccccaccuaaaaugaaaa

SEQ ID NO: 740933 - RNA, 13 nt, Leptospira interrogans serovar lai str. 56601
ggcauuuauauuc

SEQ ID NO: 740934 - RNA, 17 nt, Leptospira interrogans serovar lai str. 56601
aaaguccaauuuuaaaa

SEQ ID NO: 740935 - RNA, 16 nt, Leptospira interrogans serovar lai str. 56601
aaaguccaaaacaaag

SEQ ID NO: 740936 - RNA, 22 nt, Leptospira interrogans serovar lai str. 56601
aaaguauuuuuaagauaaauua

SEQ ID NO: 740937 - RNA, 18 nt, Leptospira interrogans serovar lai str. 56601
aaaguauuaauuuaauca

SEQ ID NO: 740938 - RNA, 21 nt, Leptospira interrogans serovar lai str. 56601
aaaguauuaauuuaaucaaaa

SEQ ID NO: 740939 - RNA, 22 nt, Leptospira interrogans serovar lai str. 56601
aaaguauucuuuccaaccauuu

SEQ ID NO: 740940 - RNA, 21 nt, Leptospira interrogans serovar lai str. 56601
aaaguauuuaauuuuaagcuc

SEQ ID NO: 740941 - RNA, 18 nt, Leptospira interrogans serovar lai str. 56601
ggcaguacaauucaaaac

SEQ ID NO: 740942 - RNA, 14 nt, Leptospira interrogans serovar lai str. 56601
aaaguaucagaauc

SEQ ID NO: 740943 - RNA, 21 nt, Leptospira interrogans serovar lai str. 56601
aaaguaguaugcgaaauuccu

SEQ ID NO: 740944 - RNA, 20 nt, Leptospira interrogans serovar lai str. 56601
aaaguauaacccaaaacuaa

SEQ ID NO: 740945 - RNA, 18 nt, Leptospira interrogans serovar lai str. 56601
ggcaggaucaaaauccgu

SEQ ID NO: 740946 - RNA, 23 nt, Leptospira interrogans serovar lai str. 56601
ggauuuuauaaaguaaagguuuc

SEQ ID NO: 740947 - RNA, 19 nt, Leptospira interrogans serovar lai str. 56601
ggauuuuauguaagaaaaa

SEQ ID NO: 740948 - RNA, 14 nt, Leptospira interrogans serovar lai str. 56601
ggauuuguaauagu

SEQ ID NO: 740949 - RNA, 20 nt, Leptospira interrogans serovar lai str. 56601
ggauuucguuucuuuuucua

SEQ ID NO: 740950 - RNA, 21 nt, Leptospira interrogans serovar lai str. 56601
ggauucuuuucccgcuaaaag

SEQ ID NO: 740951 - RNA, 15 nt, Leptospira interrogans serovar lai str. 56601
ggauuccauucuuca

SEQ ID NO: 740952 - RNA, 13 nt, Leptospira interrogans serovar lai str. 56601
ggauuaugaagaa

SEQ ID NO: 740953 - RNA, 15 nt, Leptospira interrogans serovar lai str. 56601
ggauuaugaagaaug

SEQ ID NO: 740954 - RNA, 22 nt, Leptospira interrogans serovar lai str. 56601
aaaguaauuuaucuguaauuuu

SEQ ID NO: 740955 - RNA, 13 nt, Leptospira interrogans serovar lai str. 56601
aaaguaaucuuuu

SEQ ID NO: 740956 - RNA, 13 nt, Leptospira interrogans serovar lai str. 56601
aaaguaauuuauc

SEQ ID NO: 740957 - RNA, 20 nt, Leptospira interrogans serovar lai str. 56601
aaaguaaucguuuaaagauu

SEQ ID NO: 740958 - RNA, 22 nt, Leptospira interrogans serovar lai str. 56601
ggaugguuguuaggauaaaagg

SEQ ID NO: 740959 - RNA, 15 nt, Leptospira interrogans serovar lai str. 56601
ggauggaaaaugaau

SEQ ID NO: 740960 - RNA, 19 nt, Leptospira interrogans serovar lai str. 56601
ggauggaugcgcaaacuca

SEQ ID NO: 740961 - RNA, 16 nt, Leptospira interrogans serovar lai str. 56601
ggaugcgcaaacucag

SEQ ID NO: 740962 - RNA, 12 nt, Leptospira interrogans serovar lai str. 56601
ggaucguucucc

SEQ ID NO: 740963 - RNA, 13 nt, Leptospira interrogans serovar lai str. 56601
ggaugaagcuaug

SEQ ID NO: 740964 - RNA, 14 nt, Leptospira interrogans serovar lai str. 56601
ggaucaacaaaauu

SEQ ID NO: 740965 - RNA, 21 nt, Leptospira interrogans serovar lai str. 56601
ggaucaaaucgcgaagaaagg

SEQ ID NO: 740966 - RNA, 21 nt, Leptospira interrogans serovar lai str. 56601
ggauaacccucaucagucauu

SEQ ID NO: 740967 - RNA, 19 nt, Leptospira interrogans serovar lai str. 56601
ggauaaauuuuagaauauc

SEQ ID NO: 740968 - RNA, 11 nt, Leptospira interrogans serovar lai str. 56601
aaaggguuuuu

SEQ ID NO: 740969 - RNA, 18 nt, Leptospira interrogans serovar lai str. 56601
aaaggguuuuuacaauua

SEQ ID NO: 740970 - RNA, 13 nt, Leptospira interrogans serovar lai str. 56601
aaaggguuucugu

SEQ ID NO: 740971 - RNA, 21 nt, Leptospira interrogans serovar lai str. 56601
aaagguauauaggaauuuauc

SEQ ID NO: 740972 - RNA, 17 nt, Leptospira interrogans serovar lai str. 56601
aaaggugaucuuagaaa

SEQ ID NO: 740973 - RNA, 19 nt, Leptospira interrogans serovar lai str. 56601
aaaggugcaugaaaauaau

SEQ ID NO: 740974 - RNA, 11 nt, Leptospira interrogans serovar lai str. 56601
aaagguugagc

SEQ ID NO: 740975 - RNA, 17 nt, Leptospira interrogans serovar lai str. 56601
ggagaaaauuuaaacaa

SEQ ID NO: 740976 - RNA, 20 nt, Leptospira interrogans serovar lai str. 56601
ggagauuacuuuuucugguu

SEQ ID NO: 740977 - RNA, 16 nt, Leptospira interrogans serovar lai str. 56601
aaaggcugucuucagc

SEQ ID NO: 740978 - RNA, 16 nt, Leptospira interrogans serovar lai str. 56601
ggacggaaucggcuug

SEQ ID NO: 740979 - RNA, 21 nt, Leptospira interrogans serovar lai str. 56601
ggaaugacugaccguaaaagc

SEQ ID NO: 740980 - RNA, 14 nt, Leptospira interrogans serovar lai str. 56601
ggaaugugauaguu

SEQ ID NO: 740981 - RNA, 17 nt, Leptospira interrogans serovar lai str. 56601
ggaauuacgacaaaucu

SEQ ID NO: 740982 - RNA, 15 nt, Leptospira interrogans serovar lai str. 56601
ggacaauuuuucucu

SEQ ID NO: 740983 - RNA, 21 nt, Leptospira interrogans serovar lai str. 56601
ggacaaugcuuuccaaaagga

SEQ ID NO: 740984 - RNA, 13 nt, Leptospira interrogans serovar lai str. 56601
ggaauucauaauu

SEQ ID NO: 740985 - RNA, 18 nt, Leptospira interrogans serovar lai str. 56601
ggaauucauacuuuuaaa

SEQ ID NO: 740986 - RNA, 23 nt, Leptospira interrogans serovar lai str. 56601
ggaauucauacuuuuaaaaaguu

SEQ ID NO: 740987 - RNA, 20 nt, Leptospira interrogans serovar lai str. 56601
ggaauuccgacccagaaaaa

SEQ ID NO: 740988 - RNA, 18 nt, Leptospira interrogans serovar lai str. 56601
ggaauuuccgauaaagaa

SEQ ID NO: 740989 - RNA, 13 nt, Leptospira interrogans serovar lai str. 56601
ggaauuuuuaaaa

SEQ ID NO: 740990 - RNA, 18 nt, Leptospira interrogans serovar lai str. 56601
ggaauuuuuaaaaagaau

SEQ ID NO: 740991 - RNA, 21 nt, Leptospira interrogans serovar lai str. 56601
ggaauuuuucaacaacucuaa

SEQ ID NO: 740992 - RNA, 22 nt, Leptospira interrogans serovar lai str. 56601
ggaacugcuuccaaaaaaaguc

SEQ ID NO: 740993 - RNA, 17 nt, Leptospira interrogans serovar lai str. 56601
ggaacucucacaaauca

SEQ ID NO: 740994 - RNA, 18 nt, Leptospira interrogans serovar lai str. 56601
ggaacucucacaaaucag

SEQ ID NO: 740995 - RNA, 13 nt, Leptospira interrogans serovar lai str. 56601
ggaacuauuauaa

SEQ ID NO: 740996 - RNA, 13 nt, Leptospira interrogans serovar lai str. 56601
ggaacuaccacca

SEQ ID NO: 740997 - RNA, 17 nt, Leptospira interrogans serovar lai str. 56601
ggaacuacuacaaauca

SEQ ID NO: 740998 - RNA, 20 nt, Leptospira interrogans serovar lai str. 56601
ggaacuacuacaauuaaaaa

SEQ ID NO: 740999 - RNA, 15 nt, Leptospira interrogans serovar lai str. 56601
ggaaccaucaccaac

SEQ ID NO: 741000 - RNA, 17 nt, Leptospira interrogans serovar lai str. 56601
ggaaauuuuuaauaaaa

SEQ ID NO: 741001 - RNA, 23 nt, Leptospira interrogans serovar lai str. 56601
gcuuuaagaucauuuaaaacuca

SEQ ID NO: 741002 - RNA, 21 nt, Leptospira interrogans serovar lai str. 56601
gcuuuaucuuuauaaaaauga

SEQ ID NO: 741003 - RNA, 19 nt, Leptospira interrogans serovar lai str. 56601
gcuuucagcucuggucaau

SEQ ID NO: 741004 - RNA, 13 nt, Leptospira interrogans serovar lai str. 56601
aaaggcggagaaa

SEQ ID NO: 741005 - RNA, 20 nt, Leptospira interrogans serovar lai str. 56601
gcuuguauuuuauuuuugga

SEQ ID NO: 741006 - RNA, 18 nt, Leptospira interrogans serovar lai str. 56601
gcuugucccaaaaacuca

SEQ ID NO: 741007 - RNA, 14 nt, Leptospira interrogans serovar lai str. 56601
gcuugucccagagc

SEQ ID NO: 741008 - RNA, 15 nt, Leptospira interrogans serovar lai str. 56601
gcuugucccagagcc

SEQ ID NO: 741009 - RNA, 22 nt, Leptospira interrogans serovar lai str. 56601
aaaggcaccggcuacaggugga

SEQ ID NO: 741010 - RNA, 18 nt, Leptospira interrogans serovar lai str. 56601
gcuugaguugcuuugaau

SEQ ID NO: 741011 - RNA, 19 nt, Leptospira interrogans serovar lai str. 56601
gcuucuucaauguuauaaa

SEQ ID NO: 741012 - RNA, 13 nt, Leptospira interrogans serovar lai str. 56601
gcuucucuugcuu

SEQ ID NO: 741013 - RNA, 15 nt, Leptospira interrogans serovar lai str. 56601
gcuuaucuaauuuuu

SEQ ID NO: 741014 - RNA, 10 nt, Leptospira interrogans serovar lai str. 56601
gcuuccuuuu

SEQ ID NO: 741015 - RNA, 14 nt, Leptospira interrogans serovar lai str. 56601
gcuucauauaauaa

SEQ ID NO: 741016 - RNA, 22 nt, Leptospira interrogans serovar lai str. 56601
gcuucaucaaacggucuuucuu

SEQ ID NO: 741017 - RNA, 12 nt, Leptospira interrogans serovar lai str. 56601
gcuuacaaagug

SEQ ID NO: 741018 - RNA, 22 nt, Leptospira interrogans serovar lai str. 56601
gcuuaagagaaccucuauaaaa

SEQ ID NO: 741019 - RNA, 12 nt, Leptospira interrogans serovar lai str. 56601
gcuuaaaaguga

SEQ ID NO: 741020 - RNA, 22 nt, Leptospira interrogans serovar lai str. 56601
gcuguucuuagucuaaaaacaa

SEQ ID NO: 741021 - RNA, 15 nt, Leptospira interrogans serovar lai str. 56601
gcugucauaaaccga

SEQ ID NO: 741022 - RNA, 20 nt, Leptospira interrogans serovar lai str. 56601
aaaggaagcacaagcuuccu

SEQ ID NO: 741023 - RNA, 24 nt, Leptospira interrogans serovar lai str. 56601
aaaggaaggaguaucaauagaaau

SEQ ID NO: 741024 - RNA, 23 nt, Leptospira interrogans serovar lai str. 56601
aaaggaauacaauugauuuaaaa

SEQ ID NO: 741025 - RNA, 23 nt, Leptospira interrogans serovar lai str. 56601
aaaggaauccaugauucugaaaa

SEQ ID NO: 741026 - RNA, 14 nt, Leptospira interrogans serovar lai str. 56601
aaaggaaucccaaa

SEQ ID NO: 741027 - RNA, 15 nt, Leptospira interrogans serovar lai str. 56601
aaaggaguauuuuuu

SEQ ID NO: 741028 - RNA, 17 nt, Leptospira interrogans serovar lai str. 56601
aaaggauaaucuacccc

SEQ ID NO: 741029 - RNA, 14 nt, Leptospira interrogans serovar lai str. 56601
gcuguaugaaaacg

SEQ ID NO: 741030 - RNA, 22 nt, Leptospira interrogans serovar lai str. 56601
gcuguaguuuauuuuucuuuua

SEQ ID NO: 741031 - RNA, 15 nt, Leptospira interrogans serovar lai str. 56601
gcuggaaauaucaau

SEQ ID NO: 741032 - RNA, 15 nt, Leptospira interrogans serovar lai str. 56601
gcugcuuuuuugaga

SEQ ID NO: 741033 - RNA, 16 nt, Leptospira interrogans serovar lai str. 56601
gcugccgcucuuucuu

SEQ ID NO: 741034 - RNA, 19 nt, Leptospira interrogans serovar lai str. 56601
gcugccgcucuuucuuccg

SEQ ID NO: 741035 - RNA, 12 nt, Leptospira interrogans serovar lai str. 56601
gcugauuuuucu

SEQ ID NO: 741036 - RNA, 18 nt, Leptospira interrogans serovar lai str. 56601
gcucucguuuuuaggauu

SEQ ID NO: 741037 - RNA, 14 nt, Leptospira interrogans serovar lai str. 56601
gcucucgcaaugaa

SEQ ID NO: 741038 - RNA, 19 nt, Leptospira interrogans serovar lai str. 56601
gcucucguaauaucuaaaa

SEQ ID NO: 741039 - RNA, 22 nt, Leptospira interrogans serovar lai str. 56601
gcucucguaauaucuaaaaccu

SEQ ID NO: 741040 - RNA, 21 nt, Leptospira interrogans serovar lai str. 56601
gcucuaauauuuuaaagaaac

SEQ ID NO: 741041 - RNA, 15 nt, Leptospira interrogans serovar lai str. 56601
gcucgauuuuauaga

SEQ ID NO: 741042 - RNA, 20 nt, Leptospira interrogans serovar lai str. 56601
gcuccuuucaucucuauaaa

SEQ ID NO: 741043 - RNA, 15 nt, Leptospira interrogans serovar lai str. 56601
gcucgaaguaacuca

SEQ ID NO: 741044 - RNA, 13 nt, Leptospira interrogans serovar lai str. 56601
gcucgaauuuuuu

SEQ ID NO: 741045 - RNA, 17 nt, Leptospira interrogans serovar lai str. 56601
gcuccuccaaccagagc

SEQ ID NO: 741046 - RNA, 22 nt, Leptospira interrogans serovar lai str. 56601
gcuccgauaauuguagaagcaa

SEQ ID NO: 741047 - RNA, 13 nt, Leptospira interrogans serovar lai str. 56601
gcucauuuuucuu

SEQ ID NO: 741048 - RNA, 22 nt, Leptospira interrogans serovar lai str. 56601
gcuccaaaaggcacauuuuuca

SEQ ID NO: 741049 - RNA, 17 nt, Leptospira interrogans serovar lai str. 56601
gcucauuuuucuuaaaa

SEQ ID NO: 741050 - RNA, 15 nt, Leptospira interrogans serovar lai str. 56601
gcuccaaaaaaauaa

SEQ ID NO: 741051 - RNA, 14 nt, Leptospira interrogans serovar lai str. 56601
gcgguaguucccac

SEQ ID NO: 741052 - RNA, 23 nt, Leptospira interrogans serovar lai str. 56601
guuuuauaaaaccugauuuuucu

SEQ ID NO: 741053 - RNA, 16 nt, Leptospira interrogans serovar lai str. 56601
aaaucauacuuuuaaa

SEQ ID NO: 741054 - RNA, 21 nt, Leptospira interrogans serovar lai str. 56601
aaaucauacuuuuaaaaaauu

SEQ ID NO: 741055 - RNA, 22 nt, Leptospira interrogans serovar lai str. 56601
aaaucauacuuuuaaaaaauuu

SEQ ID NO: 741056 - RNA, 22 nt, Leptospira interrogans serovar lai str. 56601
guuuuacuguuguuaaauuuuu

SEQ ID NO: 741057 - RNA, 23 nt, Leptospira interrogans serovar lai str. 56601
aaaucauagaguuucuuuaaagu

SEQ ID NO: 741058 - RNA, 19 nt, Leptospira interrogans serovar lai str. 56601
aaaucauaggauacaaaac

SEQ ID NO: 741059 - RNA, 19 nt, Leptospira interrogans serovar lai str. 56601
aaaucauauggauuaucca

SEQ ID NO: 741060 - RNA, 17 nt, Leptospira interrogans serovar lai str. 56601
aaaucauauuuucaaaa

SEQ ID NO: 741061 - RNA, 19 nt, Leptospira interrogans serovar lai str. 56601
aaaucauauuuucaaaaaa

SEQ ID NO: 741062 - RNA, 20 nt, Leptospira interrogans serovar lai str. 56601
aaaucauauuuucaaaaaau

SEQ ID NO: 741063 - RNA, 21 nt, Leptospira interrogans serovar lai str. 56601
aaaucauauuuucaaaaaaua

SEQ ID NO: 741064 - RNA, 16 nt, Leptospira interrogans serovar lai str. 56601
aaauccaacuuaaaac

SEQ ID NO: 741065 - RNA, 17 nt, Leptospira interrogans serovar lai str. 56601
aaauccaacuuaaaacu

SEQ ID NO: 741066 - RNA, 16 nt, Leptospira interrogans serovar lai str. 56601
guuuugaguaguagaa

SEQ ID NO: 741067 - RNA, 20 nt, Leptospira interrogans serovar lai str. 56601
guuuugagauuacaaaaaau

SEQ ID NO: 741068 - RNA, 23 nt, Leptospira interrogans serovar lai str. 56601
guuuucuuuuuuucucuucuaau

SEQ ID NO: 741069 - RNA, 19 nt, Leptospira interrogans serovar lai str. 56601
guuuugaccugccuuucuu

SEQ ID NO: 741070 - RNA, 16 nt, Leptospira interrogans serovar lai str. 56601
guuuugcucuaaaaua

SEQ ID NO: 741071 - RNA, 19 nt, Leptospira interrogans serovar lai str. 56601
guuuugcucuaaaauaauu

SEQ ID NO: 741072 - RNA, 16 nt, Leptospira interrogans serovar lai str. 56601
guuuucaaaaaauuuc

SEQ ID NO: 741073 - RNA, 16 nt, Leptospira interrogans serovar lai str. 56601
guuuucauaaauacaa

SEQ ID NO: 741074 - RNA, 15 nt, Leptospira interrogans serovar lai str. 56601
guuugcuuuucuauc

SEQ ID NO: 741075 - RNA, 22 nt, Leptospira interrogans serovar lai str. 56601
guuugcuuuucuaucaaaaaau

SEQ ID NO: 741076 - RNA, 15 nt, Leptospira interrogans serovar lai str. 56601
guuugucuuuuucua

SEQ ID NO: 741077 - RNA, 20 nt, Leptospira interrogans serovar lai str. 56601
guuugucuuuuucuacaagu

SEQ ID NO: 741078 - RNA, 17 nt, Leptospira interrogans serovar lai str. 56601
guuuguuccaaaaccuc

SEQ ID NO: 741079 - RNA, 16 nt, Leptospira interrogans serovar lai str. 56601
guuugagguuuuaaaa

SEQ ID NO: 741080 - RNA, 12 nt, Leptospira interrogans serovar lai str. 56601
guuugauacuuu

SEQ ID NO: 741081 - RNA, 18 nt, Leptospira interrogans serovar lai str. 56601
guuucuucggauucacaa

SEQ ID NO: 741082 - RNA, 19 nt, Leptospira interrogans serovar lai str. 56601
guuucuguuugaugaaaua

SEQ ID NO: 741083 - RNA, 22 nt, Leptospira interrogans serovar lai str. 56601
guuucuuaaaucuuagauucac

SEQ ID NO: 741084 - RNA, 15 nt, Leptospira interrogans serovar lai str. 56601
guuucuuaaauuugu

SEQ ID NO: 741085 - RNA, 16 nt, Leptospira interrogans serovar lai str. 56601
guuucuuaauuuuacu

SEQ ID NO: 741086 - RNA, 14 nt, Leptospira interrogans serovar lai str. 56601
guuucuuauauaaa

SEQ ID NO: 741087 - RNA, 20 nt, Leptospira interrogans serovar lai str. 56601
guuucuuauaucaaacuuau

SEQ ID NO: 741088 - RNA, 15 nt, Leptospira interrogans serovar lai str. 56601
guuucugaggaauua

SEQ ID NO: 741089 - RNA, 14 nt, Leptospira interrogans serovar lai str. 56601
guuucuaaaaaaau

SEQ ID NO: 741090 - RNA, 18 nt, Leptospira interrogans serovar lai str. 56601
aaaucaaucauauuuuaa

SEQ ID NO: 741091 - RNA, 19 nt, Leptospira interrogans serovar lai str. 56601
aaaucaauccucuuugaaa

SEQ ID NO: 741092 - RNA, 22 nt, Leptospira interrogans serovar lai str. 56601
aaaucaaucuacuugaauuaag

SEQ ID NO: 741093 - RNA, 16 nt, Leptospira interrogans serovar lai str. 56601
aaaucaauggaaaauu

SEQ ID NO: 741094 - RNA, 18 nt, Leptospira interrogans serovar lai str. 56601
aaaucaauggaaaauuaa

SEQ ID NO: 741095 - RNA, 23 nt, Leptospira interrogans serovar lai str. 56601
aaaucaagagcuggaugaagcua

SEQ ID NO: 741096 - RNA, 22 nt, Leptospira interrogans serovar lai str. 56601
aaaucaacuuggaaucuuaaaa

SEQ ID NO: 741097 - RNA, 19 nt, Leptospira interrogans serovar lai str. 56601
guuucuacucggaaauuua

SEQ ID NO: 741098 - RNA, 14 nt, Leptospira interrogans serovar lai str. 56601
guuucuacauuuuu

SEQ ID NO: 741099 - RNA, 22 nt, Leptospira interrogans serovar lai str. 56601
guuucuaaguguaaaauuaaaa

SEQ ID NO: 741100 - RNA, 22 nt, Leptospira interrogans serovar lai str. 56601
guuucuccacuuaaaaaguuuu

SEQ ID NO: 741101 - RNA, 17 nt, Leptospira interrogans serovar lai str. 56601
guuucuauacuacgaau

SEQ ID NO: 741102 - RNA, 15 nt, Leptospira interrogans serovar lai str. 56601
aaaucacaauuuuac

SEQ ID NO: 741103 - RNA, 15 nt, Leptospira interrogans serovar lai str. 56601
aaaucacgauuuuac

SEQ ID NO: 741104 - RNA, 13 nt, Leptospira interrogans serovar lai str. 56601
aaaucaaagcaaa

SEQ ID NO: 741105 - RNA, 24 nt, Leptospira interrogans serovar lai str. 56601
aaauauuuuuuuuaaucauccaau

SEQ ID NO: 741106 - RNA, 15 nt, Leptospira interrogans serovar lai str. 56601
aaaucaaaaggaaua

SEQ ID NO: 741107 - RNA, 20 nt, Leptospira interrogans serovar lai str. 56601
aaaucaaaaggaauacaauu

SEQ ID NO: 741108 - RNA, 18 nt, Leptospira interrogans serovar lai str. 56601
aaaucaaauauacaaagu

SEQ ID NO: 741109 - RNA, 13 nt, Leptospira interrogans serovar lai str. 56601
aaaucaaaucgca

SEQ ID NO: 741110 - RNA, 24 nt, Leptospira interrogans serovar lai str. 56601
aaauauuuugagcagauucuaaaa

SEQ ID NO: 741111 - RNA, 23 nt, Leptospira interrogans serovar lai str. 56601
guuucgaacucacguuaaaagua

SEQ ID NO: 741112 - RNA, 24 nt, Leptospira interrogans serovar lai str. 56601
guuucgaacucacguuaaaaguaa

SEQ ID NO: 741113 - RNA, 19 nt, Leptospira interrogans serovar lai str. 56601
aaauauuugcauaaacuuc

SEQ ID NO: 741114 - RNA, 13 nt, Leptospira interrogans serovar lai str. 56601
aaauauuucaaaa

SEQ ID NO: 741115 - RNA, 18 nt, Leptospira interrogans serovar lai str. 56601
aaauauuuagaauaaaau

SEQ ID NO: 741116 - RNA, 19 nt, Leptospira interrogans serovar lai str. 56601
aaauauuuagaauaaaauu

SEQ ID NO: 741117 - RNA, 18 nt, Leptospira interrogans serovar lai str. 56601
guuuccccaagacuuuga

SEQ ID NO: 741118 - RNA, 22 nt, Leptospira interrogans serovar lai str. 56601
guuucccaguucuuaaauaaaa

SEQ ID NO: 741119 - RNA, 17 nt, Leptospira interrogans serovar lai str. 56601
guuucaauuuaaaauau

SEQ ID NO: 741120 - RNA, 15 nt, Leptospira interrogans serovar lai str. 56601
guuucaauuuagaac

SEQ ID NO: 741121 - RNA, 18 nt, Leptospira interrogans serovar lai str. 56601
guuucaauuuauuauaga

SEQ ID NO: 741122 - RNA, 15 nt, Leptospira interrogans serovar lai str. 56601
guuucacaaaaauau

SEQ ID NO: 741123 - RNA, 14 nt, Leptospira interrogans serovar lai str. 56601
guuucacaaauuuu

SEQ ID NO: 741124 - RNA, 23 nt, Leptospira interrogans serovar lai str. 56601
guuuagaacagaaugucuuagaa

SEQ ID NO: 741125 - RNA, 14 nt, Leptospira interrogans serovar lai str. 56601
guuuaacuguaaau

SEQ ID NO: 741126 - RNA, 15 nt, Leptospira interrogans serovar lai str. 56601
aaauauuaauuauau

SEQ ID NO: 741127 - RNA, 19 nt, Leptospira interrogans serovar lai str. 56601
aaauauuaauuuaaaaaca

SEQ ID NO: 741128 - RNA, 17 nt, Leptospira interrogans serovar lai str. 56601
aaauauucagaaacugg

SEQ ID NO: 741129 - RNA, 20 nt, Leptospira interrogans serovar lai str. 56601
aaauauggaagcuaacacaa

SEQ ID NO: 741130 - RNA, 14 nt, Leptospira interrogans serovar lai str. 56601
aaauaugauuuaaa

SEQ ID NO: 741131 - RNA, 21 nt, Leptospira interrogans serovar lai str. 56601
aaauauguuuuuuuucaacaa

SEQ ID NO: 741132 - RNA, 13 nt, Leptospira interrogans serovar lai str. 56601
aaauauuaaaaaa

SEQ ID NO: 741133 - RNA, 17 nt, Leptospira interrogans serovar lai str. 56601
aaauauuaaaaaaauaa

SEQ ID NO: 741134 - RNA, 12 nt, Leptospira interrogans serovar lai str. 56601
aaauauuaaaac

SEQ ID NO: 741135 - RNA, 20 nt, Leptospira interrogans serovar lai str. 56601
aaauauuauauuuuuaaaaa

SEQ ID NO: 741136 - RNA, 19 nt, Leptospira interrogans serovar lai str. 56601
aaauauucguguucuauua

SEQ ID NO: 741137 - RNA, 14 nt, Leptospira interrogans serovar lai str. 56601
guuucauugaguuu

SEQ ID NO: 741138 - RNA, 13 nt, Leptospira interrogans serovar lai str. 56601
guuucauagaagg

SEQ ID NO: 741139 - RNA, 13 nt, Leptospira interrogans serovar lai str. 56601
guuucaugaaaua

SEQ ID NO: 741140 - RNA, 21 nt, Leptospira interrogans serovar lai str. 56601
guuucauucccuucuccugca

SEQ ID NO: 741141 - RNA, 18 nt, Leptospira interrogans serovar lai str. 56601
aaauaucguucuagaauu

SEQ ID NO: 741142 - RNA, 14 nt, Leptospira interrogans serovar lai str. 56601
aaauaucuuagaau

SEQ ID NO: 741143 - RNA, 15 nt, Leptospira interrogans serovar lai str. 56601
aaauaucuuagaaua

SEQ ID NO: 741144 - RNA, 12 nt, Leptospira interrogans serovar lai str. 56601
aaauaugacgau

SEQ ID NO: 741145 - RNA, 19 nt, Leptospira interrogans serovar lai str. 56601
guuggaaucuaaacucuau

SEQ ID NO: 741146 - RNA, 23 nt, Leptospira interrogans serovar lai str. 56601
guuggaaucuaaacuuuguaaau

SEQ ID NO: 741147 - RNA, 19 nt, Leptospira interrogans serovar lai str. 56601
guuguaugauuuauaguuu

SEQ ID NO: 741148 - RNA, 14 nt, Leptospira interrogans serovar lai str. 56601
guuguauuuuaaac

SEQ ID NO: 741149 - RNA, 16 nt, Leptospira interrogans serovar lai str. 56601
guuguauuuuaaacaa

SEQ ID NO: 741150 - RNA, 14 nt, Leptospira interrogans serovar lai str. 56601
guugcuaagaaaaa

SEQ ID NO: 741151 - RNA, 16 nt, Leptospira interrogans serovar lai str. 56601
guugcguuuggucugu

SEQ ID NO: 741152 - RNA, 21 nt, Leptospira interrogans serovar lai str. 56601
guugcuauggaauuuuuucaa

SEQ ID NO: 741153 - RNA, 20 nt, Leptospira interrogans serovar lai str. 56601
guucuaaccggaauuuccaa

SEQ ID NO: 741154 - RNA, 15 nt, Leptospira interrogans serovar lai str. 56601
guucuaagaaucuug

SEQ ID NO: 741155 - RNA, 18 nt, Leptospira interrogans serovar lai str. 56601
guucuaauguuguuaaau

SEQ ID NO: 741156 - RNA, 21 nt, Leptospira interrogans serovar lai str. 56601
guucuaguauuauuuuccuuu

SEQ ID NO: 741157 - RNA, 17 nt, Leptospira interrogans serovar lai str. 56601
guucuacugaguuucaa

SEQ ID NO: 741158 - RNA, 23 nt, Leptospira interrogans serovar lai str. 56601
guugagcaguaaaaucuuuaagu

SEQ ID NO: 741159 - RNA, 19 nt, Leptospira interrogans serovar lai str. 56601
guucaucguuccaaacccu

SEQ ID NO: 741160 - RNA, 17 nt, Leptospira interrogans serovar lai str. 56601
guuccaacguaccaaaa

SEQ ID NO: 741161 - RNA, 21 nt, Leptospira interrogans serovar lai str. 56601
guuauuucuuucaaaaauuua

SEQ ID NO: 741162 - RNA, 13 nt, Leptospira interrogans serovar lai str. 56601
guuauuggaucgu

SEQ ID NO: 741163 - RNA, 17 nt, Leptospira interrogans serovar lai str. 56601
guuccuuugaauaaaac

SEQ ID NO: 741164 - RNA, 19 nt, Leptospira interrogans serovar lai str. 56601
guuccuuugaauaaaaccg

SEQ ID NO: 741165 - RNA, 20 nt, Leptospira interrogans serovar lai str. 56601
guuccuuugaauaaaaccgc

SEQ ID NO: 741166 - RNA, 21 nt, Leptospira interrogans serovar lai str. 56601
guuccuguggaaacguccaac

SEQ ID NO: 741167 - RNA, 15 nt, Leptospira interrogans serovar lai str. 56601
guuauggaauuuuuc

SEQ ID NO: 741168 - RNA, 16 nt, Leptospira interrogans serovar lai str. 56601
guuaugcaaauacaac

SEQ ID NO: 741169 - RNA, 19 nt, Leptospira interrogans serovar lai str. 56601
guuaucaauagaaauacca

SEQ ID NO: 741170 - RNA, 22 nt, Leptospira interrogans serovar lai str. 56601
guuauagacaacguuacuuuua

SEQ ID NO: 741171 - RNA, 14 nt, Leptospira interrogans serovar lai str. 56601
guuauauauuuuua

SEQ ID NO: 741172 - RNA, 15 nt, Leptospira interrogans serovar lai str. 56601
guuacucauuuccau

SEQ ID NO: 741173 - RNA, 19 nt, Leptospira interrogans serovar lai str. 56601
guuacucgucuuuauaaag

SEQ ID NO: 741174 - RNA, 17 nt, Leptospira interrogans serovar lai str. 56601
guuaccuagaggagcca

SEQ ID NO: 741175 - RNA, 14 nt, Leptospira interrogans serovar lai str. 56601
guuacuucccuuca

SEQ ID NO: 741176 - RNA, 16 nt, Leptospira interrogans serovar lai str. 56601
guuaggauaaaaggga

SEQ ID NO: 741177 - RNA, 14 nt, Leptospira interrogans serovar lai str. 56601
guuaauuuagaaua

SEQ ID NO: 741178 - RNA, 19 nt, Leptospira interrogans serovar lai str. 56601
guuaauuuagaauaaaaac

SEQ ID NO: 741179 - RNA, 22 nt, Leptospira interrogans serovar lai str. 56601
guuaagaguuuguuccaaaaac

SEQ ID NO: 741180 - RNA, 15 nt, Leptospira interrogans serovar lai str. 56601
guuaagaauaaauaa

SEQ ID NO: 741181 - RNA, 18 nt, Leptospira interrogans serovar lai str. 56601
guuaagagaauuucuaua

SEQ ID NO: 741182 - RNA, 23 nt, Leptospira interrogans serovar lai str. 56601
guuaaaagauuuguuuuauaaaa

SEQ ID NO: 741183 - RNA, 23 nt, Leptospira interrogans serovar lai str. 56601
guuaaaagccauuucaaaaauau

SEQ ID NO: 741184 - RNA, 21 nt, Leptospira interrogans serovar lai str. 56601
guguugacucuuuugagaaac

SEQ ID NO: 741185 - RNA, 14 nt, Leptospira interrogans serovar lai str. 56601
guguugaguuucaa

SEQ ID NO: 741186 - RNA, 22 nt, Leptospira interrogans serovar lai str. 56601
guguugaguuuucccuauuuuu

SEQ ID NO: 741187 - RNA, 22 nt, Leptospira interrogans serovar lai str. 56601
guguugaguuuuuccuauuuuu

SEQ ID NO: 741188 - RNA, 16 nt, Leptospira interrogans serovar lai str. 56601
aaauauaucuucuuug

SEQ ID NO: 741189 - RNA, 14 nt, Leptospira interrogans serovar lai str. 56601
guguuaguucccac

SEQ ID NO: 741190 - RNA, 13 nt, Leptospira interrogans serovar lai str. 56601
guguuccgacaag

SEQ ID NO: 741191 - RNA, 13 nt, Leptospira interrogans serovar lai str. 56601
guguccauuucaa

SEQ ID NO: 741192 - RNA, 19 nt, Leptospira interrogans serovar lai str. 56601
gugggaauuacuacaaauu

SEQ ID NO: 741193 - RNA, 19 nt, Leptospira interrogans serovar lai str. 56601
guggaaguuuucaaaaaau

SEQ ID NO: 741194 - RNA, 12 nt, Leptospira interrogans serovar lai str. 56601
guggaaacgucc

SEQ ID NO: 741195 - RNA, 13 nt, Leptospira interrogans serovar lai str. 56601
aaauauaauauac

SEQ ID NO: 741196 - RNA, 14 nt, Leptospira interrogans serovar lai str. 56601
aaauauaaaagauu

SEQ ID NO: 741197 - RNA, 11 nt, Leptospira interrogans serovar lai str. 56601
gugacuaaaau

SEQ ID NO: 741198 - RNA, 15 nt, Leptospira interrogans serovar lai str. 56601
gugagacgcuuucgu

SEQ ID NO: 741199 - RNA, 17 nt, Leptospira interrogans serovar lai str. 56601
gugaguuuuaaaacuca

SEQ ID NO: 741200 - RNA, 17 nt, Leptospira interrogans serovar lai str. 56601
gugcagauuaaaaaaua

SEQ ID NO: 741201 - RNA, 19 nt, Leptospira interrogans serovar lai str. 56601
gugaucuccuaaaauaaaa

SEQ ID NO: 741202 - RNA, 22 nt, Leptospira interrogans serovar lai str. 56601
gugauuguuuguuuuuuccagc

SEQ ID NO: 741203 - RNA, 18 nt, Leptospira interrogans serovar lai str. 56601
aaauagcgauacuuaaaa

SEQ ID NO: 741204 - RNA, 19 nt, Leptospira interrogans serovar lai str. 56601
aaauagcgauacuuaaaaa

SEQ ID NO: 741205 - RNA, 22 nt, Leptospira interrogans serovar lai str. 56601
aaauagcgauacuuaaaaauga

SEQ ID NO: 741206 - RNA, 12 nt, Leptospira interrogans serovar lai str. 56601
gugaagauuugu

SEQ ID NO: 741207 - RNA, 16 nt, Leptospira interrogans serovar lai str. 56601
gugaacuauuuauaaa

SEQ ID NO: 741208 - RNA, 16 nt, Leptospira interrogans serovar lai str. 56601
gugaacuuuuaagcag

SEQ ID NO: 741209 - RNA, 16 nt, Leptospira interrogans serovar lai str. 56601
gugaaucgaaaguuua

SEQ ID NO: 741210 - RNA, 14 nt, Leptospira interrogans serovar lai str. 56601
gugaaucaaaaggu

SEQ ID NO: 741211 - RNA, 19 nt, Leptospira interrogans serovar lai str. 56601
aaauagugguuuguaguag

SEQ ID NO: 741212 - RNA, 16 nt, Leptospira interrogans serovar lai str. 56601
aaauaguauccaaaau

SEQ ID NO: 741213 - RNA, 18 nt, Leptospira interrogans serovar lai str. 56601
aaauaggauuuaaauuuu

SEQ ID NO: 741214 - RNA, 14 nt, Leptospira interrogans serovar lai str. 56601
aaauagggaaaacu

SEQ ID NO: 741215 - RNA, 16 nt, Leptospira interrogans serovar lai str. 56601
aaauagggaaaacuca

SEQ ID NO: 741216 - RNA, 17 nt, Leptospira interrogans serovar lai str. 56601
aaauagggaaaacucaa

SEQ ID NO: 741217 - RNA, 20 nt, Leptospira interrogans serovar lai str. 56601
aaauagggaaaacucaacac

SEQ ID NO: 741218 - RNA, 21 nt, Leptospira interrogans serovar lai str. 56601
gucuuugaauucgcuuugguc

SEQ ID NO: 741219 - RNA, 12 nt, Leptospira interrogans serovar lai str. 56601
gucuuucuucug

SEQ ID NO: 741220 - RNA, 21 nt, Leptospira interrogans serovar lai str. 56601
gucuuuauccauccauacaac

SEQ ID NO: 741221 - RNA, 23 nt, Leptospira interrogans serovar lai str. 56601
gucuuucuacaccaguauucaau

SEQ ID NO: 741222 - RNA, 21 nt, Leptospira interrogans serovar lai str. 56601
gugaaaguaaucuuuuuaaaa

SEQ ID NO: 741223 - RNA, 13 nt, Leptospira interrogans serovar lai str. 56601
gucugucuuaaaa

SEQ ID NO: 741224 - RNA, 13 nt, Leptospira interrogans serovar lai str. 56601
gucugugaucgau

SEQ ID NO: 741225 - RNA, 18 nt, Leptospira interrogans serovar lai str. 56601
gucuugaacuuucuuauc

SEQ ID NO: 741226 - RNA, 17 nt, Leptospira interrogans serovar lai str. 56601
gucuugauuauuuucug

SEQ ID NO: 741227 - RNA, 23 nt, Leptospira interrogans serovar lai str. 56601
gucuucuaaaucuaauucuucua

SEQ ID NO: 741228 - RNA, 13 nt, Leptospira interrogans serovar lai str. 56601
gucugaaauaaau

SEQ ID NO: 741229 - RNA, 18 nt, Leptospira interrogans serovar lai str. 56601
gucugguuuauuuuugaa

SEQ ID NO: 741230 - RNA, 21 nt, Leptospira interrogans serovar lai str. 56601
gucugguuuauuuuugaauuu

SEQ ID NO: 741231 - RNA, 17 nt, Leptospira interrogans serovar lai str. 56601
gucuguaaaagaaaaau

SEQ ID NO: 741232 - RNA, 18 nt, Leptospira interrogans serovar lai str. 56601
gucuccagcauuuagaaa

SEQ ID NO: 741233 - RNA, 13 nt, Leptospira interrogans serovar lai str. 56601
gucuccauaauac

SEQ ID NO: 741234 - RNA, 22 nt, Leptospira interrogans serovar lai str. 56601
gucgcaacacacacuuuauaaa

SEQ ID NO: 741235 - RNA, 22 nt, Leptospira interrogans serovar lai str. 56601
gucgcacccccgucuacuuuua

SEQ ID NO: 741236 - RNA, 22 nt, Leptospira interrogans serovar lai str. 56601
guccucaaaucuucgguuuaau

SEQ ID NO: 741237 - RNA, 22 nt, Leptospira interrogans serovar lai str. 56601
guccuccaaacaauuuuuugaa

SEQ ID NO: 741238 - RNA, 22 nt, Leptospira interrogans serovar lai str. 56601
guccuucgaaaaacccagcgcc

SEQ ID NO: 741239 - RNA, 13 nt, Leptospira interrogans serovar lai str. 56601
gucacuauuuuua

SEQ ID NO: 741240 - RNA, 21 nt, Leptospira interrogans serovar lai str. 56601
ggugaacuauuuauaaaauaa

SEQ ID NO: 741241 - RNA, 13 nt, Leptospira interrogans serovar lai str. 56601
gucaagcccuccc

SEQ ID NO: 741242 - RNA, 23 nt, Leptospira interrogans serovar lai str. 56601
gucaagcccucccguuauuuuuu

SEQ ID NO: 741243 - RNA, 18 nt, Leptospira interrogans serovar lai str. 56601
gucaaugguugcaaaaaa

SEQ ID NO: 741244 - RNA, 14 nt, Leptospira interrogans serovar lai str. 56601
guccacccaaaccg

SEQ ID NO: 741245 - RNA, 15 nt, Leptospira interrogans serovar lai str. 56601
guccacccaaaccgg

SEQ ID NO: 741246 - RNA, 23 nt, Leptospira interrogans serovar lai str. 56601
guccacaaauugaauuugcagua

SEQ ID NO: 741247 - RNA, 22 nt, Leptospira interrogans serovar lai str. 56601
gucauuaagggaguuuguaaag

SEQ ID NO: 741248 - RNA, 14 nt, Leptospira interrogans serovar lai str. 56601
uacgacauuuuaau

SEQ ID NO: 741249 - RNA, 21 nt, Leptospira interrogans serovar lai str. 56601
uacgacagauucaauuuuuau

SEQ ID NO: 741250 - RNA, 21 nt, Leptospira interrogans serovar lai str. 56601
uacgacuuuauucaaaauaga

SEQ ID NO: 741251 - RNA, 18 nt, Leptospira interrogans serovar lai str. 56601
uacgauuuaaucuaggau

SEQ ID NO: 741252 - RNA, 13 nt, Leptospira interrogans serovar lai str. 56601
uacgauuucucca

SEQ ID NO: 741253 - RNA, 18 nt, Leptospira interrogans serovar lai str. 56601
uacgaguaaaaauucuuc

SEQ ID NO: 741254 - RNA, 14 nt, Leptospira interrogans serovar lai str. 56601
uacuaaauuaaguu

SEQ ID NO: 741255 - RNA, 19 nt, Leptospira interrogans serovar lai str. 56601
uacuaaauuauuuucaagu

SEQ ID NO: 741256 - RNA, 20 nt, Leptospira interrogans serovar lai str. 56601
uacuaaaauuuuauaaaaau

SEQ ID NO: 741257 - RNA, 22 nt, Leptospira interrogans serovar lai str. 56601
uacuaaacgauuuuauacauuc

SEQ ID NO: 741258 - RNA, 13 nt, Leptospira interrogans serovar lai str. 56601
uacuaaaauuaaa

SEQ ID NO: 741259 - RNA, 15 nt, Leptospira interrogans serovar lai str. 56601
uacuaaaauuaaaaa

SEQ ID NO: 741260 - RNA, 16 nt, Leptospira interrogans serovar lai str. 56601
uacuaaaauuaaaaau

SEQ ID NO: 741261 - RNA, 21 nt, Leptospira interrogans serovar lai str. 56601
uacuaaucgagcuuuucuguu

SEQ ID NO: 741262 - RNA, 17 nt, Leptospira interrogans serovar lai str. 56601
uacuaaucucuauaaaa

SEQ ID NO: 741263 - RNA, 16 nt, Leptospira interrogans serovar lai str. 56601
uacuacaauuaaaaag

SEQ ID NO: 741264 - RNA, 16 nt, Leptospira interrogans serovar lai str. 56601
uacuacaauuuuagaa

SEQ ID NO: 741265 - RNA, 12 nt, Leptospira interrogans serovar lai str. 56601
uacuacaaaaau

SEQ ID NO: 741266 - RNA, 13 nt, Leptospira interrogans serovar lai str. 56601
uacuacaaaucac

SEQ ID NO: 741267 - RNA, 23 nt, Leptospira interrogans serovar lai str. 56601
uacuacucgaacgcaugaaaaua

SEQ ID NO: 741268 - RNA, 18 nt, Leptospira interrogans serovar lai str. 56601
uacuacgaaaacuuaaug

SEQ ID NO: 741269 - RNA, 17 nt, Leptospira interrogans serovar lai str. 56601
uacuacgucuucuaaau

SEQ ID NO: 741270 - RNA, 14 nt, Leptospira interrogans serovar lai str. 56601
uacguaaauggugg

SEQ ID NO: 741271 - RNA, 14 nt, Leptospira interrogans serovar lai str. 56601
uacugcauuuuauu

SEQ ID NO: 741272 - RNA, 16 nt, Leptospira interrogans serovar lai str. 56601
uacugauuucaaaaau

SEQ ID NO: 741273 - RNA, 20 nt, Leptospira interrogans serovar lai str. 56601
uacugauuucaaaaauaaau

SEQ ID NO: 741274 - RNA, 14 nt, Leptospira interrogans serovar lai str. 56601
uacugauuucuaua

SEQ ID NO: 741275 - RNA, 19 nt, Leptospira interrogans serovar lai str. 56601
uacugauuucuauaaaauu

SEQ ID NO: 741276 - RNA, 11 nt, Leptospira interrogans serovar lai str. 56601
uacugauuuuc

SEQ ID NO: 741277 - RNA, 14 nt, Leptospira interrogans serovar lai str. 56601
uacugaucuuaugg

SEQ ID NO: 741278 - RNA, 22 nt, Leptospira interrogans serovar lai str. 56601
uacucuauuauauaguuaucag

SEQ ID NO: 741279 - RNA, 19 nt, Leptospira interrogans serovar lai str. 56601
uacucguuuuuaguuucuu

SEQ ID NO: 741280 - RNA, 20 nt, Leptospira interrogans serovar lai str. 56601
uacucguuuuuaguuucuuu

SEQ ID NO: 741281 - RNA, 23 nt, Leptospira interrogans serovar lai str. 56601
uacucguuuuuaguuucuuuuuu

SEQ ID NO: 741282 - RNA, 23 nt, Leptospira interrogans serovar lai str. 56601
uacucugcaaaauuuaaaaagug

SEQ ID NO: 741283 - RNA, 16 nt, Leptospira interrogans serovar lai str. 56601
uacuaggaaaauuuaa

SEQ ID NO: 741284 - RNA, 17 nt, Leptospira interrogans serovar lai str. 56601
uacuacuuuuagaaaaa

SEQ ID NO: 741285 - RNA, 23 nt, Leptospira interrogans serovar lai str. 56601
uacuacuuuaacgugaguuugau

SEQ ID NO: 741286 - RNA, 14 nt, Leptospira interrogans serovar lai str. 56601
uacucgauaauucu

SEQ ID NO: 741287 - RNA, 19 nt, Leptospira interrogans serovar lai str. 56601
uacuguuguuaaauuuuug

SEQ ID NO: 741288 - RNA, 18 nt, Leptospira interrogans serovar lai str. 56601
uacuucaauuguccauuu

SEQ ID NO: 741289 - RNA, 17 nt, Leptospira interrogans serovar lai str. 56601
uacuguuuuugaaacau

SEQ ID NO: 741290 - RNA, 18 nt, Leptospira interrogans serovar lai str. 56601
uacuuauuucuauaaaau

SEQ ID NO: 741291 - RNA, 22 nt, Leptospira interrogans serovar lai str. 56601
uacuugcaaaaaguauguuuuu

SEQ ID NO: 741292 - RNA, 12 nt, Leptospira interrogans serovar lai str. 56601
uacuucuguaau

SEQ ID NO: 741293 - RNA, 18 nt, Leptospira interrogans serovar lai str. 56601
uacccuuaagauagccua

SEQ ID NO: 741294 - RNA, 18 nt, Leptospira interrogans serovar lai str. 56601
uaccgcuggaaauaucaa

SEQ ID NO: 741295 - RNA, 21 nt, Leptospira interrogans serovar lai str. 56601
uaccgauuucuauuuuaaaag

SEQ ID NO: 741296 - RNA, 18 nt, Leptospira interrogans serovar lai str. 56601
uacccagucuccauaaua

SEQ ID NO: 741297 - RNA, 16 nt, Leptospira interrogans serovar lai str. 56601
uaccauaaauuuugau

SEQ ID NO: 741298 - RNA, 20 nt, Leptospira interrogans serovar lai str. 56601
uaccauucauuucauaucca

SEQ ID NO: 741299 - RNA, 21 nt, Leptospira interrogans serovar lai str. 56601
uaccaccccacccaaaaauag

SEQ ID NO: 741300 - RNA, 15 nt, Leptospira interrogans serovar lai str. 56601
uaccagcaagcacau

SEQ ID NO: 741301 - RNA, 19 nt, Leptospira interrogans serovar lai str. 56601
uacauuagaauuuuaugau

SEQ ID NO: 741302 - RNA, 15 nt, Leptospira interrogans serovar lai str. 56601
uacauuagaguuguu

SEQ ID NO: 741303 - RNA, 21 nt, Leptospira interrogans serovar lai str. 56601
uacauuagaguuguugaaaaa

SEQ ID NO: 741304 - RNA, 14 nt, Leptospira interrogans serovar lai str. 56601
uacauucuuauaaa

SEQ ID NO: 741305 - RNA, 22 nt, Leptospira interrogans serovar lai str. 56601
uacauuaugaauuuuuaaacau

SEQ ID NO: 741306 - RNA, 18 nt, Leptospira interrogans serovar lai str. 56601
uaccacaaaucuaaauuu

SEQ ID NO: 741307 - RNA, 14 nt, Leptospira interrogans serovar lai str. 56601
uaccaaauaaauau

SEQ ID NO: 741308 - RNA, 20 nt, Leptospira interrogans serovar lai str. 56601
uaccaaauuguuuucuaaag

SEQ ID NO: 741309 - RNA, 14 nt, Leptospira interrogans serovar lai str. 56601
uacaucgaauucau

SEQ ID NO: 741310 - RNA, 15 nt, Leptospira interrogans serovar lai str. 56601
uacaucguuugucgc

SEQ ID NO: 741311 - RNA, 21 nt, Leptospira interrogans serovar lai str. 56601
uacaucguuugucgcaacaca

SEQ ID NO: 741312 - RNA, 15 nt, Leptospira interrogans serovar lai str. 56601
uacaucccaaaccuc

SEQ ID NO: 741313 - RNA, 21 nt, Leptospira interrogans serovar lai str. 56601
uacaucaacucuguaaauuca

SEQ ID NO: 741314 - RNA, 17 nt, Leptospira interrogans serovar lai str. 56601
uacaucaaaaacaaauu

SEQ ID NO: 741315 - RNA, 22 nt, Leptospira interrogans serovar lai str. 56601
uacaucaaaaacaaauuaaguu

SEQ ID NO: 741316 - RNA, 23 nt, Leptospira interrogans serovar lai str. 56601
uacauaaguucgguguaaaaaau

SEQ ID NO: 741317 - RNA, 17 nt, Leptospira interrogans serovar lai str. 56601
uacauacaaugaaaaag

SEQ ID NO: 741318 - RNA, 19 nt, Leptospira interrogans serovar lai str. 56601
uacauacaaugaaaaagca

SEQ ID NO: 741319 - RNA, 16 nt, Leptospira interrogans serovar lai str. 56601
uacaauucaucaccaa

SEQ ID NO: 741320 - RNA, 18 nt, Leptospira interrogans serovar lai str. 56601
uacaauugauuuaaaaac

SEQ ID NO: 741321 - RNA, 14 nt, Leptospira interrogans serovar lai str. 56601
uacaauuuaauagu

SEQ ID NO: 741322 - RNA, 15 nt, Leptospira interrogans serovar lai str. 56601
uacaauuuauuauaa

SEQ ID NO: 741323 - RNA, 20 nt, Leptospira interrogans serovar lai str. 56601
uacaauuuauugaccagagc

SEQ ID NO: 741324 - RNA, 16 nt, Leptospira interrogans serovar lai str. 56601
uacaauuugcuaaaau

SEQ ID NO: 741325 - RNA, 20 nt, Leptospira interrogans serovar lai str. 56601
uacaauuguaggaauucaua

SEQ ID NO: 741326 - RNA, 23 nt, Leptospira interrogans serovar lai str. 56601
uacaguaaaaucuaaauuuguaa

SEQ ID NO: 741327 - RNA, 16 nt, Leptospira interrogans serovar lai str. 56601
uaauaagaauacguga

SEQ ID NO: 741328 - RNA, 19 nt, Leptospira interrogans serovar lai str. 56601
uaauaagauuuguugaaaa

SEQ ID NO: 741329 - RNA, 22 nt, Leptospira interrogans serovar lai str. 56601
uaauaagagugcagauuaaaaa

SEQ ID NO: 741330 - RNA, 15 nt, Leptospira interrogans serovar lai str. 56601
uaauaccaaguuauu

SEQ ID NO: 741331 - RNA, 12 nt, Leptospira interrogans serovar lai str. 56601
uaauacaaaacu

SEQ ID NO: 741332 - RNA, 15 nt, Leptospira interrogans serovar lai str. 56601
uaauacaauucugaa

SEQ ID NO: 741333 - RNA, 14 nt, Leptospira interrogans serovar lai str. 56601
uaauaauucaaaau

SEQ ID NO: 741334 - RNA, 19 nt, Leptospira interrogans serovar lai str. 56601
uaauacaaaaaauguuuaa

SEQ ID NO: 741335 - RNA, 14 nt, Leptospira interrogans serovar lai str. 56601
uaauacaaaaaacu

SEQ ID NO: 741336 - RNA, 13 nt, Leptospira interrogans serovar lai str. 56601
uaauacaaaaaau

SEQ ID NO: 741337 - RNA, 17 nt, Leptospira interrogans serovar lai str. 56601
uaauaauuguugaauau

SEQ ID NO: 741338 - RNA, 17 nt, Leptospira interrogans serovar lai str. 56601
uaauaauuuuagaauau

SEQ ID NO: 741339 - RNA, 13 nt, Leptospira interrogans serovar lai str. 56601
uaauauacaaaac

SEQ ID NO: 741340 - RNA, 20 nt, Leptospira interrogans serovar lai str. 56601
uaauauaaguuaagugaaaa

SEQ ID NO: 741341 - RNA, 19 nt, Leptospira interrogans serovar lai str. 56601
uaauauaaccucaacauaa

SEQ ID NO: 741342 - RNA, 17 nt, Leptospira interrogans serovar lai str. 56601
uaauauaacauuuccaa

SEQ ID NO: 741343 - RNA, 21 nt, Leptospira interrogans serovar lai str. 56601
uaauauaacauuuccaacugu

SEQ ID NO: 741344 - RNA, 12 nt, Leptospira interrogans serovar lai str. 56601
uaauauaaaaaa

SEQ ID NO: 741345 - RNA, 16 nt, Leptospira interrogans serovar lai str. 56601
uaauauaaaaaauaau

SEQ ID NO: 741346 - RNA, 22 nt, Leptospira interrogans serovar lai str. 56601
uaauauaaaaaauaauauuaua

SEQ ID NO: 741347 - RNA, 12 nt, Leptospira interrogans serovar lai str. 56601
uaauauaaaaac

SEQ ID NO: 741348 - RNA, 14 nt, Leptospira interrogans serovar lai str. 56601
uaauaguucccaca

SEQ ID NO: 741349 - RNA, 19 nt, Leptospira interrogans serovar lai str. 56601
uaauaguucccacauuuuu

SEQ ID NO: 741350 - RNA, 23 nt, Leptospira interrogans serovar lai str. 56601
uaauaguucccacauuuuucaaa

SEQ ID NO: 741351 - RNA, 20 nt, Leptospira interrogans serovar lai str. 56601
uaauaguuccuauauuuuaa

SEQ ID NO: 741352 - RNA, 12 nt, Leptospira interrogans serovar lai str. 56601
uaauaguuuuac

SEQ ID NO: 741353 - RNA, 21 nt, Leptospira interrogans serovar lai str. 56601
uaauaguuuuacaaauuagua

SEQ ID NO: 741354 - RNA, 23 nt, Leptospira interrogans serovar lai str. 56601
uaauagcuugucacuauuuuuau

SEQ ID NO: 741355 - RNA, 14 nt, Leptospira interrogans serovar lai str. 56601
uaauacuaccaaag

SEQ ID NO: 741356 - RNA, 14 nt, Leptospira interrogans serovar lai str. 56601
uaauacgauauuuu

SEQ ID NO: 741357 - RNA, 16 nt, Leptospira interrogans serovar lai str. 56601
uaauacgauauuuugu

SEQ ID NO: 741358 - RNA, 13 nt, Leptospira interrogans serovar lai str. 56601
uaauagaaaacuu

SEQ ID NO: 741359 - RNA, 14 nt, Leptospira interrogans serovar lai str. 56601
uaauagagaaaaau

SEQ ID NO: 741360 - RNA, 17 nt, Leptospira interrogans serovar lai str. 56601
uaauagagaaaaauuuu

SEQ ID NO: 741361 - RNA, 20 nt, Leptospira interrogans serovar lai str. 56601
uaauagaguuacagaaaaaa

SEQ ID NO: 741362 - RNA, 21 nt, Leptospira interrogans serovar lai str. 56601
uaauagaguuacagaaaaaau

SEQ ID NO: 741363 - RNA, 23 nt, Leptospira interrogans serovar lai str. 56601
uaauccaauaaaauuuuauacuu

SEQ ID NO: 741364 - RNA, 18 nt, Leptospira interrogans serovar lai str. 56601
uaaucaugugaauucaga

SEQ ID NO: 741365 - RNA, 23 nt, Leptospira interrogans serovar lai str. 56601
uaaucauggccuucuggaaaaau

SEQ ID NO: 741366 - RNA, 16 nt, Leptospira interrogans serovar lai str. 56601
uaaucaguuaaacccg

SEQ ID NO: 741367 - RNA, 12 nt, Leptospira interrogans serovar lai str. 56601
uaaucaucaaaa

SEQ ID NO: 741368 - RNA, 17 nt, Leptospira interrogans serovar lai str. 56601
uaaucagauuuugcaca

SEQ ID NO: 741369 - RNA, 22 nt, Leptospira interrogans serovar lai str. 56601
uaaucagauuuugcacaaaacc

SEQ ID NO: 741370 - RNA, 13 nt, Leptospira interrogans serovar lai str. 56601
uaauauuagaauu

SEQ ID NO: 741371 - RNA, 17 nt, Leptospira interrogans serovar lai str. 56601
uaauauuacauucaaua

SEQ ID NO: 741372 - RNA, 13 nt, Leptospira interrogans serovar lai str. 56601
uaauauucuuuua

SEQ ID NO: 741373 - RNA, 16 nt, Leptospira interrogans serovar lai str. 56601
uaauauucuuuuauau

SEQ ID NO: 741374 - RNA, 16 nt, Leptospira interrogans serovar lai str. 56601
uaauauuucaauuccu

SEQ ID NO: 741375 - RNA, 18 nt, Leptospira interrogans serovar lai str. 56601
uaauauuucguuuuuagu

SEQ ID NO: 741376 - RNA, 23 nt, Leptospira interrogans serovar lai str. 56601
uaauauuucguuuuuaguuucaa

SEQ ID NO: 741377 - RNA, 22 nt, Leptospira interrogans serovar lai str. 56601
uaauauuucucucaaauucuuc

SEQ ID NO: 741378 - RNA, 22 nt, Leptospira interrogans serovar lai str. 56601
uaauauuuuuauguauuuuaaa

SEQ ID NO: 741379 - RNA, 14 nt, Leptospira interrogans serovar lai str. 56601
uaauauuuuaaaga

SEQ ID NO: 741380 - RNA, 10 nt, Leptospira interrogans serovar lai str. 56601
uaauauuaaa

SEQ ID NO: 741381 - RNA, 15 nt, Leptospira interrogans serovar lai str. 56601
uaauaugauguaaau

SEQ ID NO: 741382 - RNA, 21 nt, Leptospira interrogans serovar lai str. 56601
uaauaugaauuuuuaauagac

SEQ ID NO: 741383 - RNA, 14 nt, Leptospira interrogans serovar lai str. 56601
uaauauauucaaaa

SEQ ID NO: 741384 - RNA, 15 nt, Leptospira interrogans serovar lai str. 56601
uaauauauucaauuu

SEQ ID NO: 741385 - RNA, 17 nt, Leptospira interrogans serovar lai str. 56601
uaauauauucaauuucu

SEQ ID NO: 741386 - RNA, 16 nt, Leptospira interrogans serovar lai str. 56601
uaauauacuuauaaag

SEQ ID NO: 741387 - RNA, 23 nt, Leptospira interrogans serovar lai str. 56601
uaauauagguucuugcaaaaaua

SEQ ID NO: 741388 - RNA, 15 nt, Leptospira interrogans serovar lai str. 56601
uaauauacuaaaauu

SEQ ID NO: 741389 - RNA, 14 nt, Leptospira interrogans serovar lai str. 56601
uaauauauuaaaau

SEQ ID NO: 741390 - RNA, 21 nt, Leptospira interrogans serovar lai str. 56601
uaauuucauaaaauucuuaga

SEQ ID NO: 741391 - RNA, 21 nt, Leptospira interrogans serovar lai str. 56601
uaauuucaauaacuugacucc

SEQ ID NO: 741392 - RNA, 17 nt, Leptospira interrogans serovar lai str. 56601
uaauuugcuuaaagcau

SEQ ID NO: 741393 - RNA, 12 nt, Leptospira interrogans serovar lai str. 56601
uaauuucaaucu

SEQ ID NO: 741394 - RNA, 12 nt, Leptospira interrogans serovar lai str. 56601
uaauuucaauuu

SEQ ID NO: 741395 - RNA, 18 nt, Leptospira interrogans serovar lai str. 56601
uaauuuaucgauuuaaaa

SEQ ID NO: 741396 - RNA, 13 nt, Leptospira interrogans serovar lai str. 56601
uaauugagauuug

SEQ ID NO: 741397 - RNA, 17 nt, Leptospira interrogans serovar lai str. 56601
uaauugagauuugguga

SEQ ID NO: 741398 - RNA, 22 nt, Leptospira interrogans serovar lai str. 56601
uaauugagauuuggugauuuaa

SEQ ID NO: 741399 - RNA, 16 nt, Leptospira interrogans serovar lai str. 56601
uaauuuugugaaucaa

SEQ ID NO: 741400 - RNA, 22 nt, Leptospira interrogans serovar lai str. 56601
uaauuuugugaaucaaaaggua

SEQ ID NO: 741401 - RNA, 12 nt, Leptospira interrogans serovar lai str. 56601
uaauuuuuacuc

SEQ ID NO: 741402 - RNA, 14 nt, Leptospira interrogans serovar lai str. 56601
uaauuuuuacucaa

SEQ ID NO: 741403 - RNA, 16 nt, Leptospira interrogans serovar lai str. 56601
uaauuuugaaguauaa

SEQ ID NO: 741404 - RNA, 15 nt, Leptospira interrogans serovar lai str. 56601
uaauuuucuuaauaa

SEQ ID NO: 741405 - RNA, 17 nt, Leptospira interrogans serovar lai str. 56601
uaauuuucgauuuaaua

SEQ ID NO: 741406 - RNA, 20 nt, Leptospira interrogans serovar lai str. 56601
uaauuuguaagaacacugca

SEQ ID NO: 741407 - RNA, 22 nt, Leptospira interrogans serovar lai str. 56601
uaauuuguaagaguuccacauu

SEQ ID NO: 741408 - RNA, 15 nt, Leptospira interrogans serovar lai str. 56601
uaauuuuuauagaau

SEQ ID NO: 741409 - RNA, 17 nt, Leptospira interrogans serovar lai str. 56601
uaauuuuuauagaauuu

SEQ ID NO: 741410 - RNA, 21 nt, Leptospira interrogans serovar lai str. 56601
uaauuuuuauccaaauuaauu

SEQ ID NO: 741411 - RNA, 18 nt, Leptospira interrogans serovar lai str. 56601
uaauuuuucaaaaacucu

SEQ ID NO: 741412 - RNA, 12 nt, Leptospira interrogans serovar lai str. 56601
uaauuuuuagaa

SEQ ID NO: 741413 - RNA, 23 nt, Leptospira interrogans serovar lai str. 56601
uaauuuuucuuugaaggaucuua

SEQ ID NO: 741414 - RNA, 15 nt, Leptospira interrogans serovar lai str. 56601
uaauuuuuuauugaa

SEQ ID NO: 741415 - RNA, 15 nt, Leptospira interrogans serovar lai str. 56601
uacaaaaaaaucagg

SEQ ID NO: 741416 - RNA, 17 nt, Leptospira interrogans serovar lai str. 56601
uacaaauucuucuuccu

SEQ ID NO: 741417 - RNA, 12 nt, Leptospira interrogans serovar lai str. 56601
uacaaauugaua

SEQ ID NO: 741418 - RNA, 14 nt, Leptospira interrogans serovar lai str. 56601
uacaagaaucaaaa

SEQ ID NO: 741419 - RNA, 20 nt, Leptospira interrogans serovar lai str. 56601
uacaacuuuuuuaaguucuu

SEQ ID NO: 741420 - RNA, 23 nt, Leptospira interrogans serovar lai str. 56601
uacaacuuuuuuaaguucuuuag

SEQ ID NO: 741421 - RNA, 15 nt, Leptospira interrogans serovar lai str. 56601
uacaacuuuuuuaau

SEQ ID NO: 741422 - RNA, 23 nt, Leptospira interrogans serovar lai str. 56601
uacaacuuucagauuaaaaccgu

SEQ ID NO: 741423 - RNA, 20 nt, Leptospira interrogans serovar lai str. 56601
uacaaaguaaguucaaauuu

SEQ ID NO: 741424 - RNA, 23 nt, Leptospira interrogans serovar lai str. 56601
uacaaaguaaguucaaauuuaug

SEQ ID NO: 741425 - RNA, 15 nt, Leptospira interrogans serovar lai str. 56601
uacaaaguauucuuu

SEQ ID NO: 741426 - RNA, 19 nt, Leptospira interrogans serovar lai str. 56601
uacaaagugaugaagagaa

SEQ ID NO: 741427 - RNA, 21 nt, Leptospira interrogans serovar lai str. 56601
uacaaagugaugaagagaaag

SEQ ID NO: 741428 - RNA, 14 nt, Leptospira interrogans serovar lai str. 56601
uacaaacuuacauu

SEQ ID NO: 741429 - RNA, 17 nt, Leptospira interrogans serovar lai str. 56601
uacaaagaguuuaaaaa

SEQ ID NO: 741430 - RNA, 18 nt, Leptospira interrogans serovar lai str. 56601
uacaaagaguuuaaaaaa

SEQ ID NO: 741431 - RNA, 17 nt, Leptospira interrogans serovar lai str. 56601
uacaaaauuuuuuccuu

SEQ ID NO: 741432 - RNA, 18 nt, Leptospira interrogans serovar lai str. 56601
uacaaaauuuuuuccuuu

SEQ ID NO: 741433 - RNA, 18 nt, Leptospira interrogans serovar lai str. 56601
uacaaaaauucuaauaua

SEQ ID NO: 741434 - RNA, 17 nt, Leptospira interrogans serovar lai str. 56601
uacaaaacucuuuaaaa

SEQ ID NO: 741435 - RNA, 15 nt, Leptospira interrogans serovar lai str. 56601
uacaaaacuguuuuu

SEQ ID NO: 741436 - RNA, 20 nt, Leptospira interrogans serovar lai str. 56601
uacaaaaguagaaagauuaa

SEQ ID NO: 741437 - RNA, 19 nt, Leptospira interrogans serovar lai str. 56601
uaaugccuacaaaucaaau

SEQ ID NO: 741438 - RNA, 20 nt, Leptospira interrogans serovar lai str. 56601
uaauguaaaguucuuuucuu

SEQ ID NO: 741439 - RNA, 14 nt, Leptospira interrogans serovar lai str. 56601
uaauguauaauccu

SEQ ID NO: 741440 - RNA, 18 nt, Leptospira interrogans serovar lai str. 56601
uaaugucccagauucguu

SEQ ID NO: 741441 - RNA, 20 nt, Leptospira interrogans serovar lai str. 56601
uaaugagccagguuaauuaa

SEQ ID NO: 741442 - RNA, 15 nt, Leptospira interrogans serovar lai str. 56601
uaaugagauuaaaac

SEQ ID NO: 741443 - RNA, 21 nt, Leptospira interrogans serovar lai str. 56601
uaaugagucugucccaaaauc

SEQ ID NO: 741444 - RNA, 16 nt, Leptospira interrogans serovar lai str. 56601
uaauucccguuauaaa

SEQ ID NO: 741445 - RNA, 17 nt, Leptospira interrogans serovar lai str. 56601
uaauuccacucagacca

SEQ ID NO: 741446 - RNA, 20 nt, Leptospira interrogans serovar lai str. 56601
uaauuccgacgauagaucuu

SEQ ID NO: 741447 - RNA, 21 nt, Leptospira interrogans serovar lai str. 56601
uaauuauucucagcugaacuc

SEQ ID NO: 741448 - RNA, 21 nt, Leptospira interrogans serovar lai str. 56601
uaauuauugauaaaaaaaugu

SEQ ID NO: 741449 - RNA, 22 nt, Leptospira interrogans serovar lai str. 56601
uaauuauugauaaaaaaauguu

SEQ ID NO: 741450 - RNA, 13 nt, Leptospira interrogans serovar lai str. 56601
uaauuauugauau

SEQ ID NO: 741451 - RNA, 23 nt, Leptospira interrogans serovar lai str. 56601
uaauuauggcacuuauucuuaua

SEQ ID NO: 741452 - RNA, 20 nt, Leptospira interrogans serovar lai str. 56601
uaauuauguuugccauuuuu

SEQ ID NO: 741453 - RNA, 18 nt, Leptospira interrogans serovar lai str. 56601
uaauguuucaauuccuaa

SEQ ID NO: 741454 - RNA, 14 nt, Leptospira interrogans serovar lai str. 56601
uaauuaaaaaauca

SEQ ID NO: 741455 - RNA, 12 nt, Leptospira interrogans serovar lai str. 56601
uaauuaaaaaga

SEQ ID NO: 741456 - RNA, 13 nt, Leptospira interrogans serovar lai str. 56601
uaauguuugaauu

SEQ ID NO: 741457 - RNA, 17 nt, Leptospira interrogans serovar lai str. 56601
uaauguuuuuuauuuaa

SEQ ID NO: 741458 - RNA, 13 nt, Leptospira interrogans serovar lai str. 56601
uaauuacaguuaa

SEQ ID NO: 741459 - RNA, 15 nt, Leptospira interrogans serovar lai str. 56601
uaauuacaguuaaua

SEQ ID NO: 741460 - RNA, 16 nt, Leptospira interrogans serovar lai str. 56601
uaauuacaguuaauaa

SEQ ID NO: 741461 - RNA, 14 nt, Leptospira interrogans serovar lai str. 56601
aaaucccauuuuaa

SEQ ID NO: 741462 - RNA, 16 nt, Leptospira interrogans serovar lai str. 56601
aaaucccauuuuaacg

SEQ ID NO: 741463 - RNA, 17 nt, Leptospira interrogans serovar lai str. 56601
aaauccaugauuuguaa

SEQ ID NO: 741464 - RNA, 15 nt, Leptospira interrogans serovar lai str. 56601
aaaucccaaaaccga

SEQ ID NO: 741465 - RNA, 16 nt, Leptospira interrogans serovar lai str. 56601
uaacuuagucuuuguu

SEQ ID NO: 741466 - RNA, 22 nt, Leptospira interrogans serovar lai str. 56601
uaacuuagucuuuguuuauugu

SEQ ID NO: 741467 - RNA, 13 nt, Leptospira interrogans serovar lai str. 56601
uaacuucauuucc

SEQ ID NO: 741468 - RNA, 15 nt, Leptospira interrogans serovar lai str. 56601
uaacuucgguauaau

SEQ ID NO: 741469 - RNA, 20 nt, Leptospira interrogans serovar lai str. 56601
uaacuucguugaaaaucgga

SEQ ID NO: 741470 - RNA, 13 nt, Leptospira interrogans serovar lai str. 56601
uaacgucuugauu

SEQ ID NO: 741471 - RNA, 21 nt, Leptospira interrogans serovar lai str. 56601
uaacgugaguucguggagaaa

SEQ ID NO: 741472 - RNA, 16 nt, Leptospira interrogans serovar lai str. 56601
uaacuaccgcaaacau

SEQ ID NO: 741473 - RNA, 19 nt, Leptospira interrogans serovar lai str. 56601
uaacuacacgagagcugcu

SEQ ID NO: 741474 - RNA, 16 nt, Leptospira interrogans serovar lai str. 56601
uaacuaugucuaucag

SEQ ID NO: 741475 - RNA, 19 nt, Leptospira interrogans serovar lai str. 56601
uaacucauauagaaauuau

SEQ ID NO: 741476 - RNA, 12 nt, Leptospira interrogans serovar lai str. 56601
uaagaaaguauu

SEQ ID NO: 741477 - RNA, 23 nt, Leptospira interrogans serovar lai str. 56601
uaagaaagaauuuucuaaaagua

SEQ ID NO: 741478 - RNA, 19 nt, Leptospira interrogans serovar lai str. 56601
uaagaacaauuuaaaauaa

SEQ ID NO: 741479 - RNA, 16 nt, Leptospira interrogans serovar lai str. 56601
uaagaagauaaauauu

SEQ ID NO: 741480 - RNA, 21 nt, Leptospira interrogans serovar lai str. 56601
uaagaagauaaauauuuccaa

SEQ ID NO: 741481 - RNA, 17 nt, Leptospira interrogans serovar lai str. 56601
uaagaacuuucucgaaa

SEQ ID NO: 741482 - RNA, 23 nt, Leptospira interrogans serovar lai str. 56601
uaagaacuuucucgaaaaucuca

SEQ ID NO: 741483 - RNA, 23 nt, Leptospira interrogans serovar lai str. 56601
uaagaaucugccccaaaauuuag

SEQ ID NO: 741484 - RNA, 15 nt, Leptospira interrogans serovar lai str. 56601
uaagaauauuauaaa

SEQ ID NO: 741485 - RNA, 15 nt, Leptospira interrogans serovar lai str. 56601
uaagaauaauuuaaa

SEQ ID NO: 741486 - RNA, 23 nt, Leptospira interrogans serovar lai str. 56601
uaagaauacgugaguucguuaua

SEQ ID NO: 741487 - RNA, 15 nt, Leptospira interrogans serovar lai str. 56601
uaacuuuuuuuaaaa

SEQ ID NO: 741488 - RNA, 19 nt, Leptospira interrogans serovar lai str. 56601
uaacuuuuuuuaaaaaauu

SEQ ID NO: 741489 - RNA, 13 nt, Leptospira interrogans serovar lai str. 56601
uaagaaaaacuag

SEQ ID NO: 741490 - RNA, 21 nt, Leptospira interrogans serovar lai str. 56601
uaagaaaaaaguugcuaagaa

SEQ ID NO: 741491 - RNA, 11 nt, Leptospira interrogans serovar lai str. 56601
uaagaaaaaau

SEQ ID NO: 741492 - RNA, 20 nt, Leptospira interrogans serovar lai str. 56601
uaagaaaaauuaaaauucua

SEQ ID NO: 741493 - RNA, 17 nt, Leptospira interrogans serovar lai str. 56601
uaagaaaauuuaaaaua

SEQ ID NO: 741494 - RNA, 12 nt, Leptospira interrogans serovar lai str. 56601
uaagaaacucag

SEQ ID NO: 741495 - RNA, 14 nt, Leptospira interrogans serovar lai str. 56601
uaagaaacucagua

SEQ ID NO: 741496 - RNA, 17 nt, Leptospira interrogans serovar lai str. 56601
uaagaaacucaguaaaa

SEQ ID NO: 741497 - RNA, 12 nt, Leptospira interrogans serovar lai str. 56601
uaacuuucauug

SEQ ID NO: 741498 - RNA, 14 nt, Leptospira interrogans serovar lai str. 56601
uaacuuuacaaaaa

SEQ ID NO: 741499 - RNA, 14 nt, Leptospira interrogans serovar lai str. 56601
uaagauaaauuuag

SEQ ID NO: 741500 - RNA, 14 nt, Leptospira interrogans serovar lai str. 56601
uaagauaaauuaua

SEQ ID NO: 741501 - RNA, 19 nt, Leptospira interrogans serovar lai str. 56601
uaagauagccuaauuuacu

SEQ ID NO: 741502 - RNA, 20 nt, Leptospira interrogans serovar lai str. 56601
uaagauauuaacaaauuuaa

SEQ ID NO: 741503 - RNA, 21 nt, Leptospira interrogans serovar lai str. 56601
uaagauccaaauuuuuuacaa

SEQ ID NO: 741504 - RNA, 15 nt, Leptospira interrogans serovar lai str. 56601
uaagaucauuuaaaa

SEQ ID NO: 741505 - RNA, 16 nt, Leptospira interrogans serovar lai str. 56601
uaagaucuaucucaaa

SEQ ID NO: 741506 - RNA, 22 nt, Leptospira interrogans serovar lai str. 56601
uaagaucuaucucaaaaccuau

SEQ ID NO: 741507 - RNA, 22 nt, Leptospira interrogans serovar lai str. 56601
uaagaucuauuccuaaaaugug

SEQ ID NO: 741508 - RNA, 15 nt, Leptospira interrogans serovar lai str. 56601
uaagaucugauauuc

SEQ ID NO: 741509 - RNA, 19 nt, Leptospira interrogans serovar lai str. 56601
uaagagaugugaguuuuaa

SEQ ID NO: 741510 - RNA, 22 nt, Leptospira interrogans serovar lai str. 56601
uaagagccuacaaaucgaagau

SEQ ID NO: 741511 - RNA, 19 nt, Leptospira interrogans serovar lai str. 56601
uaagagccuuucacaucuc

SEQ ID NO: 741512 - RNA, 16 nt, Leptospira interrogans serovar lai str. 56601
uaagagcgucuuugaa

SEQ ID NO: 741513 - RNA, 22 nt, Leptospira interrogans serovar lai str. 56601
uaagagaauuucuauaaaaucu

SEQ ID NO: 741514 - RNA, 20 nt, Leptospira interrogans serovar lai str. 56601
uaagagugcagauuaaaaaa

SEQ ID NO: 741515 - RNA, 16 nt, Leptospira interrogans serovar lai str. 56601
uaagaccuaaacccug

SEQ ID NO: 741516 - RNA, 19 nt, Leptospira interrogans serovar lai str. 56601
uaagacccuaaaaaauuuu

SEQ ID NO: 741517 - RNA, 20 nt, Leptospira interrogans serovar lai str. 56601
uaagaauuuaucauuucuuu

SEQ ID NO: 741518 - RNA, 21 nt, Leptospira interrogans serovar lai str. 56601
uaagacauuggcaaauguuau

SEQ ID NO: 741519 - RNA, 18 nt, Leptospira interrogans serovar lai str. 56601
uaaguauuguuaagauaa

SEQ ID NO: 741520 - RNA, 16 nt, Leptospira interrogans serovar lai str. 56601
uaaguauucaauuuca

SEQ ID NO: 741521 - RNA, 17 nt, Leptospira interrogans serovar lai str. 56601
uaaguauucaauuucag

SEQ ID NO: 741522 - RNA, 18 nt, Leptospira interrogans serovar lai str. 56601
uaaguaucuaaaaguuuu

SEQ ID NO: 741523 - RNA, 20 nt, Leptospira interrogans serovar lai str. 56601
uaaguagaaauuuaauuuga

SEQ ID NO: 741524 - RNA, 20 nt, Leptospira interrogans serovar lai str. 56601
uaagucguuguauuuuaaac

SEQ ID NO: 741525 - RNA, 14 nt, Leptospira interrogans serovar lai str. 56601
uaagucuuuaaaaa

SEQ ID NO: 741526 - RNA, 14 nt, Leptospira interrogans serovar lai str. 56601
uaagggaaaguuau

SEQ ID NO: 741527 - RNA, 14 nt, Leptospira interrogans serovar lai str. 56601
uaaguuaaauauaa

SEQ ID NO: 741528 - RNA, 17 nt, Leptospira interrogans serovar lai str. 56601
uaaguuaaauauaaaag

SEQ ID NO: 741529 - RNA, 16 nt, Leptospira interrogans serovar lai str. 56601
uaaguguaaaauuaaa

SEQ ID NO: 741530 - RNA, 14 nt, Leptospira interrogans serovar lai str. 56601
uaaguguaugaaaa

SEQ ID NO: 741531 - RNA, 22 nt, Leptospira interrogans serovar lai str. 56601
uaaguuguguugaaucuuaaau

SEQ ID NO: 741532 - RNA, 16 nt, Leptospira interrogans serovar lai str. 56601
uaaguuuaaaaacagu

SEQ ID NO: 741533 - RNA, 17 nt, Leptospira interrogans serovar lai str. 56601
uaaguuuauucaauuuu

SEQ ID NO: 741534 - RNA, 23 nt, Leptospira interrogans serovar lai str. 56601
uaaguucaucuacguuucaauua

SEQ ID NO: 741535 - RNA, 12 nt, Leptospira interrogans serovar lai str. 56601
uaaguuauuaau

SEQ ID NO: 741536 - RNA, 18 nt, Leptospira interrogans serovar lai str. 56601
uaaguuaggugauauuuu

SEQ ID NO: 741537 - RNA, 13 nt, Leptospira interrogans serovar lai str. 56601
uaaguuacucauu

SEQ ID NO: 741538 - RNA, 18 nt, Leptospira interrogans serovar lai str. 56601
uaaguuacucauuuccau

SEQ ID NO: 741539 - RNA, 21 nt, Leptospira interrogans serovar lai str. 56601
uaauaaauuuuugacuaccuu

SEQ ID NO: 741540 - RNA, 13 nt, Leptospira interrogans serovar lai str. 56601
uaauaacaaaaaa

SEQ ID NO: 741541 - RNA, 19 nt, Leptospira interrogans serovar lai str. 56601
uaauaaaucaauuuucuuu

SEQ ID NO: 741542 - RNA, 18 nt, Leptospira interrogans serovar lai str. 56601
uaauaaaguacuaauuca

SEQ ID NO: 741543 - RNA, 20 nt, Leptospira interrogans serovar lai str. 56601
uaaguuugucuguaaaauga

SEQ ID NO: 741544 - RNA, 22 nt, Leptospira interrogans serovar lai str. 56601
uaaguuugugagaguucccaca

SEQ ID NO: 741545 - RNA, 17 nt, Leptospira interrogans serovar lai str. 56601
uaaguuuuacagaagau

SEQ ID NO: 741546 - RNA, 17 nt, Leptospira interrogans serovar lai str. 56601
uaaguuuugauagaaaa

SEQ ID NO: 741547 - RNA, 14 nt, Leptospira interrogans serovar lai str. 56601
uaaguuuuuaaaua

SEQ ID NO: 741548 - RNA, 18 nt, Leptospira interrogans serovar lai str. 56601
uaauaaaaauuuaaaaua

SEQ ID NO: 741549 - RNA, 17 nt, Leptospira interrogans serovar lai str. 56601
uaauaaaaauuuacaga

SEQ ID NO: 741550 - RNA, 22 nt, Leptospira interrogans serovar lai str. 56601
uaauaaaaaaaugaauuuuuua

SEQ ID NO: 741551 - RNA, 19 nt, Leptospira interrogans serovar lai str. 56601
uaauaaaacuuuucuaaau

SEQ ID NO: 741552 - RNA, 17 nt, Leptospira interrogans serovar lai str. 56601
uaauaaaacguggauuu

SEQ ID NO: 741553 - RNA, 11 nt, Leptospira interrogans serovar lai str. 56601
uaauaaaaugc

SEQ ID NO: 741554 - RNA, 16 nt, Leptospira interrogans serovar lai str. 56601
uaaggcaaacuuuuuu

SEQ ID NO: 741555 - RNA, 15 nt, Leptospira interrogans serovar lai str. 56601
uaaggauucuuuucc

SEQ ID NO: 741556 - RNA, 16 nt, Leptospira interrogans serovar lai str. 56601
uaaggauucuuuuccc

SEQ ID NO: 741557 - RNA, 21 nt, Leptospira interrogans serovar lai str. 56601
uaaggaacucaugauucugaa

SEQ ID NO: 741558 - RNA, 21 nt, Leptospira interrogans serovar lai str. 56601
uaaggagcucaucauucugaa

SEQ ID NO: 741559 - RNA, 20 nt, Leptospira interrogans serovar lai str. 56601
uaaggaaguguuugcugagu

SEQ ID NO: 741560 - RNA, 23 nt, Leptospira interrogans serovar lai str. 56601
uaaggaacacaugauucugaaaa

SEQ ID NO: 741561 - RNA, 17 nt, Leptospira interrogans serovar lai str. 56601
uaagcuaagcauaaaau

SEQ ID NO: 741562 - RNA, 13 nt, Leptospira interrogans serovar lai str. 56601
uaagcuuuagaaa

SEQ ID NO: 741563 - RNA, 14 nt, Leptospira interrogans serovar lai str. 56601
uaagcuuuagaaaa

SEQ ID NO: 741564 - RNA, 15 nt, Leptospira interrogans serovar lai str. 56601
uaagcuuuagaaaau

SEQ ID NO: 741565 - RNA, 17 nt, Leptospira interrogans serovar lai str. 56601
uaagcauuauaaguuuu

SEQ ID NO: 741566 - RNA, 17 nt, Leptospira interrogans serovar lai str. 56601
uaagcccccgaagaauu

SEQ ID NO: 741567 - RNA, 23 nt, Leptospira interrogans serovar lai str. 56601
uaagcaguuuuacuguuguuaaa

SEQ ID NO: 741568 - RNA, 18 nt, Leptospira interrogans serovar lai str. 56601
uaagcauaaaauucuaau

SEQ ID NO: 741569 - RNA, 17 nt, Leptospira interrogans serovar lai str. 56601
uaagauugaaugaaauc

SEQ ID NO: 741570 - RNA, 21 nt, Leptospira interrogans serovar lai str. 56601
uaagauuuguugaaaagugag

SEQ ID NO: 741571 - RNA, 15 nt, Leptospira interrogans serovar lai str. 56601
uaagauuuuagaauc

SEQ ID NO: 741572 - RNA, 14 nt, Leptospira interrogans serovar lai str. 56601
uaacgcaaaauacu

SEQ ID NO: 741573 - RNA, 20 nt, Leptospira interrogans serovar lai str. 56601
uaacgcagauuugauguaaa

SEQ ID NO: 741574 - RNA, 13 nt, Leptospira interrogans serovar lai str. 56601
uaaccucaacaua

SEQ ID NO: 741575 - RNA, 17 nt, Leptospira interrogans serovar lai str. 56601
uaaccuaaaauuuccau

SEQ ID NO: 741576 - RNA, 18 nt, Leptospira interrogans serovar lai str. 56601
uaaccguagauuuuaaca

SEQ ID NO: 741577 - RNA, 17 nt, Leptospira interrogans serovar lai str. 56601
uaacgggaauuauaaau

SEQ ID NO: 741578 - RNA, 17 nt, Leptospira interrogans serovar lai str. 56601
uaacggaguuucucauu

SEQ ID NO: 741579 - RNA, 16 nt, Leptospira interrogans serovar lai str. 56601
uaacggcuaaaucuag

SEQ ID NO: 741580 - RNA, 19 nt, Leptospira interrogans serovar lai str. 56601
uaacagaaaaauguuaaaa

SEQ ID NO: 741581 - RNA, 15 nt, Leptospira interrogans serovar lai str. 56601
uaacaugcaguaguu

SEQ ID NO: 741582 - RNA, 17 nt, Leptospira interrogans serovar lai str. 56601
uaacaucuugaaacccc

SEQ ID NO: 741583 - RNA, 18 nt, Leptospira interrogans serovar lai str. 56601
uaacaucuugaaacccca

SEQ ID NO: 741584 - RNA, 17 nt, Leptospira interrogans serovar lai str. 56601
uaacccucaucagucau

SEQ ID NO: 741585 - RNA, 18 nt, Leptospira interrogans serovar lai str. 56601
uaacccggauuuguugau

SEQ ID NO: 741586 - RNA, 12 nt, Leptospira interrogans serovar lai str. 56601
uaacaauucucg

SEQ ID NO: 741587 - RNA, 13 nt, Leptospira interrogans serovar lai str. 56601
uaaauuuuuuaga

SEQ ID NO: 741588 - RNA, 14 nt, Leptospira interrogans serovar lai str. 56601
uaaauuuuuuagaa

SEQ ID NO: 741589 - RNA, 23 nt, Leptospira interrogans serovar lai str. 56601
uaaauuuuucggaaauagaaaga

SEQ ID NO: 741590 - RNA, 20 nt, Leptospira interrogans serovar lai str. 56601
uaaauuuuuugcaaaaaaau

SEQ ID NO: 741591 - RNA, 21 nt, Leptospira interrogans serovar lai str. 56601
uaaauuuuuugcaaaaaaaua

SEQ ID NO: 741592 - RNA, 16 nt, Leptospira interrogans serovar lai str. 56601
uaaauuuuuuggaaau

SEQ ID NO: 741593 - RNA, 22 nt, Leptospira interrogans serovar lai str. 56601
uaaauuuuuauugcaaauccua

SEQ ID NO: 741594 - RNA, 15 nt, Leptospira interrogans serovar lai str. 56601
uaaauuuuuaucaua

SEQ ID NO: 741595 - RNA, 15 nt, Leptospira interrogans serovar lai str. 56601
uaaauuuuuauaaaa

SEQ ID NO: 741596 - RNA, 14 nt, Leptospira interrogans serovar lai str. 56601
uaaauuuuuauacu

SEQ ID NO: 741597 - RNA, 20 nt, Leptospira interrogans serovar lai str. 56601
uaaauuuuuaaaaguagaau

SEQ ID NO: 741598 - RNA, 23 nt, Leptospira interrogans serovar lai str. 56601
uaaauuuucagugaauaaaauaa

SEQ ID NO: 741599 - RNA, 15 nt, Leptospira interrogans serovar lai str. 56601
uaaauugaaacuaua

SEQ ID NO: 741600 - RNA, 15 nt, Leptospira interrogans serovar lai str. 56601
uaaauuuucuuuauu

SEQ ID NO: 741601 - RNA, 13 nt, Leptospira interrogans serovar lai str. 56601
uaacaaaaugauu

SEQ ID NO: 741602 - RNA, 16 nt, Leptospira interrogans serovar lai str. 56601
uaacaaaaaguguuua

SEQ ID NO: 741603 - RNA, 14 nt, Leptospira interrogans serovar lai str. 56601
uaacaaacuuuuau

SEQ ID NO: 741604 - RNA, 20 nt, Leptospira interrogans serovar lai str. 56601
uaacaaagccgcacaaacca

SEQ ID NO: 741605 - RNA, 21 nt, Leptospira interrogans serovar lai str. 56601
uaaauuaaaaaaaaauguaaa

SEQ ID NO: 741606 - RNA, 20 nt, Leptospira interrogans serovar lai str. 56601
uaaauguuauuuuguauaaa

SEQ ID NO: 741607 - RNA, 14 nt, Leptospira interrogans serovar lai str. 56601
uaaauuaacagcua

SEQ ID NO: 741608 - RNA, 15 nt, Leptospira interrogans serovar lai str. 56601
uaaauuaauauuuau

SEQ ID NO: 741609 - RNA, 20 nt, Leptospira interrogans serovar lai str. 56601
uaaauuaauauuuauaaaac

SEQ ID NO: 741610 - RNA, 12 nt, Leptospira interrogans serovar lai str. 56601
uaaauuaauauu

SEQ ID NO: 741611 - RNA, 21 nt, Leptospira interrogans serovar lai str. 56601
uaaauuauuuucaaguaaauc

SEQ ID NO: 741612 - RNA, 14 nt, Leptospira interrogans serovar lai str. 56601
uaaauucaaaauaa

SEQ ID NO: 741613 - RNA, 15 nt, Leptospira interrogans serovar lai str. 56601
uaaauucaaaauaag

SEQ ID NO: 741614 - RNA, 18 nt, Leptospira interrogans serovar lai str. 56601
uaaauucgccguaaaaaa

SEQ ID NO: 741615 - RNA, 15 nt, Leptospira interrogans serovar lai str. 56601
uaaauucuaaaaaaa

SEQ ID NO: 741616 - RNA, 23 nt, Leptospira interrogans serovar lai str. 56601
uaaauucuagcgucuaaaaaauu

SEQ ID NO: 741617 - RNA, 17 nt, Leptospira interrogans serovar lai str. 56601
uaaauucaucaaugaau

SEQ ID NO: 741618 - RNA, 18 nt, Leptospira interrogans serovar lai str. 56601
uaaauucaucaaugaaua

SEQ ID NO: 741619 - RNA, 20 nt, Leptospira interrogans serovar lai str. 56601
uaaauucagaaaaaaaaaga

SEQ ID NO: 741620 - RNA, 21 nt, Leptospira interrogans serovar lai str. 56601
uaaauucagaaaaaaaaagaa

SEQ ID NO: 741621 - RNA, 18 nt, Leptospira interrogans serovar lai str. 56601
uaaauucaggauaaacau

SEQ ID NO: 741622 - RNA, 20 nt, Leptospira interrogans serovar lai str. 56601
uaaaucgaugguuucaauuu

SEQ ID NO: 741623 - RNA, 18 nt, Leptospira interrogans serovar lai str. 56601
uaaaucgacaaaaugagu

SEQ ID NO: 741624 - RNA, 17 nt, Leptospira interrogans serovar lai str. 56601
uaaauggcguauaagaa

SEQ ID NO: 741625 - RNA, 17 nt, Leptospira interrogans serovar lai str. 56601
uaaauggagauuucauu

SEQ ID NO: 741626 - RNA, 14 nt, Leptospira interrogans serovar lai str. 56601
uaaauggauaaauu

SEQ ID NO: 741627 - RNA, 15 nt, Leptospira interrogans serovar lai str. 56601
uaaauggauaaauuu

SEQ ID NO: 741628 - RNA, 23 nt, Leptospira interrogans serovar lai str. 56601
uaaauggauaaauuuuagaauau

SEQ ID NO: 741629 - RNA, 15 nt, Leptospira interrogans serovar lai str. 56601
uaaaucgguucuaua

SEQ ID NO: 741630 - RNA, 16 nt, Leptospira interrogans serovar lai str. 56601
uaaaccgcauaaaaga

SEQ ID NO: 741631 - RNA, 20 nt, Leptospira interrogans serovar lai str. 56601
uaaaccgauuuucccaaaca

SEQ ID NO: 741632 - RNA, 19 nt, Leptospira interrogans serovar lai str. 56601
uaaacauuuaacuuuuauu

SEQ ID NO: 741633 - RNA, 12 nt, Leptospira interrogans serovar lai str. 56601
uaaacaaagaau

SEQ ID NO: 741634 - RNA, 16 nt, Leptospira interrogans serovar lai str. 56601
uaaacaaagaauaaau

SEQ ID NO: 741635 - RNA, 18 nt, Leptospira interrogans serovar lai str. 56601
guuuugcuguaaaauuua

SEQ ID NO: 741636 - RNA, 17 nt, Leptospira interrogans serovar lai str. 56601
guuuuggcucuugcuaa

SEQ ID NO: 741637 - RNA, 20 nt, Leptospira interrogans serovar lai str. 56601
guuuuggcucuugcuaaaau

SEQ ID NO: 741638 - RNA, 23 nt, Leptospira interrogans serovar lai str. 56601
guuuuggcucuugcuaaaauuuu

SEQ ID NO: 741639 - RNA, 18 nt, Leptospira interrogans serovar lai str. 56601
guuuugggacaaacuuua

SEQ ID NO: 741640 - RNA, 13 nt, Leptospira interrogans serovar lai str. 56601
guuuuuauucacu

SEQ ID NO: 741641 - RNA, 14 nt, Leptospira interrogans serovar lai str. 56601
guuuuuaguuucaa

SEQ ID NO: 741642 - RNA, 18 nt, Leptospira interrogans serovar lai str. 56601
guuuuuauaaauaaaaga

SEQ ID NO: 741643 - RNA, 20 nt, Leptospira interrogans serovar lai str. 56601
uaaacuguaaacuugauuaa

SEQ ID NO: 741644 - RNA, 21 nt, Leptospira interrogans serovar lai str. 56601
uaaacuuacuaugaagucuua

SEQ ID NO: 741645 - RNA, 14 nt, Leptospira interrogans serovar lai str. 56601
uaaacuucaaaaaa

SEQ ID NO: 741646 - RNA, 15 nt, Leptospira interrogans serovar lai str. 56601
uaaacuucaaaaaau

SEQ ID NO: 741647 - RNA, 20 nt, Leptospira interrogans serovar lai str. 56601
uaaagaauuaucauguaaaa

SEQ ID NO: 741648 - RNA, 20 nt, Leptospira interrogans serovar lai str. 56601
uaaagaauuaucguguaaaa

SEQ ID NO: 741649 - RNA, 18 nt, Leptospira interrogans serovar lai str. 56601
uaaagaauucauuuuucu

SEQ ID NO: 741650 - RNA, 18 nt, Leptospira interrogans serovar lai str. 56601
uaaagaauuuuaaaucga

SEQ ID NO: 741651 - RNA, 19 nt, Leptospira interrogans serovar lai str. 56601
uaaagaauuuuuacagaaa

SEQ ID NO: 741652 - RNA, 16 nt, Leptospira interrogans serovar lai str. 56601
uaaagaccacaguagg

SEQ ID NO: 741653 - RNA, 19 nt, Leptospira interrogans serovar lai str. 56601
uaaagacaauauucuugau

SEQ ID NO: 741654 - RNA, 13 nt, Leptospira interrogans serovar lai str. 56601
uaaacuacuaaau

SEQ ID NO: 741655 - RNA, 15 nt, Leptospira interrogans serovar lai str. 56601
uaaacuaucuauuag

SEQ ID NO: 741656 - RNA, 20 nt, Leptospira interrogans serovar lai str. 56601
uaaaccgguaaaaaguaaaa

SEQ ID NO: 741657 - RNA, 20 nt, Leptospira interrogans serovar lai str. 56601
uaaacgcgauaaguuuucua

SEQ ID NO: 741658 - RNA, 13 nt, Leptospira interrogans serovar lai str. 56601
uaaauaaaaagaa

SEQ ID NO: 741659 - RNA, 14 nt, Leptospira interrogans serovar lai str. 56601
uaaauaaaaagaag

SEQ ID NO: 741660 - RNA, 12 nt, Leptospira interrogans serovar lai str. 56601
uaaauaauaaua

SEQ ID NO: 741661 - RNA, 14 nt, Leptospira interrogans serovar lai str. 56601
uaaauaauaugggu

SEQ ID NO: 741662 - RNA, 17 nt, Leptospira interrogans serovar lai str. 56601
uaaaucaugaucaaauu

SEQ ID NO: 741663 - RNA, 21 nt, Leptospira interrogans serovar lai str. 56601
uaaaucaugaucaaauucaca

SEQ ID NO: 741664 - RNA, 19 nt, Leptospira interrogans serovar lai str. 56601
uaaauauguuuuuuuucaa

SEQ ID NO: 741665 - RNA, 18 nt, Leptospira interrogans serovar lai str. 56601
uaaauauggauuuuucca

SEQ ID NO: 741666 - RNA, 15 nt, Leptospira interrogans serovar lai str. 56601
uaaauauuaauuaua

SEQ ID NO: 741667 - RNA, 15 nt, Leptospira interrogans serovar lai str. 56601
uaaaucagaauaauc

SEQ ID NO: 741668 - RNA, 19 nt, Leptospira interrogans serovar lai str. 56601
uaaaguucuuuucuuaaaa

SEQ ID NO: 741669 - RNA, 22 nt, Leptospira interrogans serovar lai str. 56601
uaaaguucuuuucuuaaaaaaa

SEQ ID NO: 741670 - RNA, 20 nt, Leptospira interrogans serovar lai str. 56601
uaaaguuaauacaaaaaacu

SEQ ID NO: 741671 - RNA, 14 nt, Leptospira interrogans serovar lai str. 56601
uaaaguaaauucga

SEQ ID NO: 741672 - RNA, 19 nt, Leptospira interrogans serovar lai str. 56601
uaaaguacuaauucaauaa

SEQ ID NO: 741673 - RNA, 13 nt, Leptospira interrogans serovar lai str. 56601
uaaaguauccauu

SEQ ID NO: 741674 - RNA, 13 nt, Leptospira interrogans serovar lai str. 56601
uaaagugaaucuc

SEQ ID NO: 741675 - RNA, 15 nt, Leptospira interrogans serovar lai str. 56601
uaaagugaaucucuu

SEQ ID NO: 741676 - RNA, 22 nt, Leptospira interrogans serovar lai str. 56601
uaaagauugaacgguaaaaucu

SEQ ID NO: 741677 - RNA, 15 nt, Leptospira interrogans serovar lai str. 56601
uaaagauuagaaaaa

SEQ ID NO: 741678 - RNA, 13 nt, Leptospira interrogans serovar lai str. 56601
uaaagcauuaaaa

SEQ ID NO: 741679 - RNA, 23 nt, Leptospira interrogans serovar lai str. 56601
uaaagccgaucugugauugaaca

SEQ ID NO: 741680 - RNA, 20 nt, Leptospira interrogans serovar lai str. 56601
ucacaucucuuuuuuauaau

SEQ ID NO: 741681 - RNA, 22 nt, Leptospira interrogans serovar lai str. 56601
aaaucgcugguuuuauuucugc

SEQ ID NO: 741682 - RNA, 19 nt, Leptospira interrogans serovar lai str. 56601
aaaucggauaguuuaaauu

SEQ ID NO: 741683 - RNA, 15 nt, Leptospira interrogans serovar lai str. 56601
aaaucgauuacaauu

SEQ ID NO: 741684 - RNA, 21 nt, Leptospira interrogans serovar lai str. 56601
aaaucggcccgcguauauaaa

SEQ ID NO: 741685 - RNA, 21 nt, Leptospira interrogans serovar lai str. 56601
ucacauaaaguuaauacaaaa

SEQ ID NO: 741686 - RNA, 21 nt, Leptospira interrogans serovar lai str. 56601
aaaucgaguguaauaugaauu

SEQ ID NO: 741687 - RNA, 20 nt, Leptospira interrogans serovar lai str. 56601
aaaucgaguuucacaaaaau

SEQ ID NO: 741688 - RNA, 16 nt, Leptospira interrogans serovar lai str. 56601
aaaucgaaucgcuaaa

SEQ ID NO: 741689 - RNA, 14 nt, Leptospira interrogans serovar lai str. 56601
aaaucgaauguacg

SEQ ID NO: 741690 - RNA, 17 nt, Leptospira interrogans serovar lai str. 56601
aaaucgauccuguuuau

SEQ ID NO: 741691 - RNA, 22 nt, Leptospira interrogans serovar lai str. 56601
aaaucgaugguuucaauuuaaa

SEQ ID NO: 741692 - RNA, 23 nt, Leptospira interrogans serovar lai str. 56601
aaaucgaugguuucaauuuaaaa

SEQ ID NO: 741693 - RNA, 21 nt, Leptospira interrogans serovar lai str. 56601
aaaucgauuugaucuacaaug

SEQ ID NO: 741694 - RNA, 16 nt, Leptospira interrogans serovar lai str. 56601
aaaucgauuuguaaaa

SEQ ID NO: 741695 - RNA, 12 nt, Leptospira interrogans serovar lai str. 56601
ucacaaaaauau

SEQ ID NO: 741696 - RNA, 13 nt, Leptospira interrogans serovar lai str. 56601
ucacaaaaaugaa

SEQ ID NO: 741697 - RNA, 16 nt, Leptospira interrogans serovar lai str. 56601
ucacaaaaaugaaaaa

SEQ ID NO: 741698 - RNA, 17 nt, Leptospira interrogans serovar lai str. 56601
ucacaaaaaugaaaaaa

SEQ ID NO: 741699 - RNA, 14 nt, Leptospira interrogans serovar lai str. 56601
ucacagaguacaua

SEQ ID NO: 741700 - RNA, 16 nt, Leptospira interrogans serovar lai str. 56601
ucacaaacuauucuau

SEQ ID NO: 741701 - RNA, 23 nt, Leptospira interrogans serovar lai str. 56601
ucacagauucagucucauuucaa

SEQ ID NO: 741702 - RNA, 14 nt, Leptospira interrogans serovar lai str. 56601
ucaauauaaaaauu

SEQ ID NO: 741703 - RNA, 17 nt, Leptospira interrogans serovar lai str. 56601
ucaauacaauaaaaaca

SEQ ID NO: 741704 - RNA, 23 nt, Leptospira interrogans serovar lai str. 56601
ucaauacaauaaaaacagaugga

SEQ ID NO: 741705 - RNA, 13 nt, Leptospira interrogans serovar lai str. 56601
ucaauaauuuuaa

SEQ ID NO: 741706 - RNA, 17 nt, Leptospira interrogans serovar lai str. 56601
ucaauaauuuuaauauu

SEQ ID NO: 741707 - RNA, 18 nt, Leptospira interrogans serovar lai str. 56601
ucaauaauuuuaauauuu

SEQ ID NO: 741708 - RNA, 17 nt, Leptospira interrogans serovar lai str. 56601
ucaauaccgauuucuau

SEQ ID NO: 741709 - RNA, 14 nt, Leptospira interrogans serovar lai str. 56601
ucaauagaaauacc

SEQ ID NO: 741710 - RNA, 22 nt, Leptospira interrogans serovar lai str. 56601
ucaauagaaauaccauucauuu

SEQ ID NO: 741711 - RNA, 21 nt, Leptospira interrogans serovar lai str. 56601
ucaauagaauuguugaaaaau

SEQ ID NO: 741712 - RNA, 12 nt, Leptospira interrogans serovar lai str. 56601
ucaauaaauugc

SEQ ID NO: 741713 - RNA, 17 nt, Leptospira interrogans serovar lai str. 56601
ucaauaaaauaccauaa

SEQ ID NO: 741714 - RNA, 21 nt, Leptospira interrogans serovar lai str. 56601
ucaauaaaauaccauaaauuu

SEQ ID NO: 741715 - RNA, 21 nt, Leptospira interrogans serovar lai str. 56601
ucaaguuugugagaguuccca

SEQ ID NO: 741716 - RNA, 23 nt, Leptospira interrogans serovar lai str. 56601
ucaaguuugugagaguucccacg

SEQ ID NO: 741717 - RNA, 19 nt, Leptospira interrogans serovar lai str. 56601
ucaacuuuuuucagaaaaa

SEQ ID NO: 741718 - RNA, 20 nt, Leptospira interrogans serovar lai str. 56601
ucaacuuuuuucagaaaaag

SEQ ID NO: 741719 - RNA, 21 nt, Leptospira interrogans serovar lai str. 56601
ucaacuuuuuucagaaaaagu

SEQ ID NO: 741720 - RNA, 18 nt, Leptospira interrogans serovar lai str. 56601
ucaacuuuuugaagaaac

SEQ ID NO: 741721 - RNA, 22 nt, Leptospira interrogans serovar lai str. 56601
ucaacuuuuugaagaaacaauu

SEQ ID NO: 741722 - RNA, 23 nt, Leptospira interrogans serovar lai str. 56601
ucaacuuuuugaagaaacaauuc

SEQ ID NO: 741723 - RNA, 15 nt, Leptospira interrogans serovar lai str. 56601
ucaauaauucuaucg

SEQ ID NO: 741724 - RNA, 18 nt, Leptospira interrogans serovar lai str. 56601
ucaauaaguuuacaucaa

SEQ ID NO: 741725 - RNA, 20 nt, Leptospira interrogans serovar lai str. 56601
ucaaugaauauccuucgcau

SEQ ID NO: 741726 - RNA, 16 nt, Leptospira interrogans serovar lai str. 56601
ucaauccaauauuuau

SEQ ID NO: 741727 - RNA, 14 nt, Leptospira interrogans serovar lai str. 56601
ucaaugguuuuucu

SEQ ID NO: 741728 - RNA, 15 nt, Leptospira interrogans serovar lai str. 56601
ucaaugguuuuucuu

SEQ ID NO: 741729 - RNA, 14 nt, Leptospira interrogans serovar lai str. 56601
ucaauguuauaaaa

SEQ ID NO: 741730 - RNA, 17 nt, Leptospira interrogans serovar lai str. 56601
ucaauguguugucuacg

SEQ ID NO: 741731 - RNA, 15 nt, Leptospira interrogans serovar lai str. 56601
ucaauucaguaaauu

SEQ ID NO: 741732 - RNA, 13 nt, Leptospira interrogans serovar lai str. 56601
ucaauuuauaaac

SEQ ID NO: 741733 - RNA, 18 nt, Leptospira interrogans serovar lai str. 56601
ucaauucugaaaauguaa

SEQ ID NO: 741734 - RNA, 20 nt, Leptospira interrogans serovar lai str. 56601
ucaauucugaaaauguaaaa

SEQ ID NO: 741735 - RNA, 16 nt, Leptospira interrogans serovar lai str. 56601
ucaacgauaagaauau

SEQ ID NO: 741736 - RNA, 21 nt, Leptospira interrogans serovar lai str. 56601
ucaaccgcaaauuuuuucguu

SEQ ID NO: 741737 - RNA, 13 nt, Leptospira interrogans serovar lai str. 56601
ucaacuuguaaaa

SEQ ID NO: 741738 - RNA, 17 nt, Leptospira interrogans serovar lai str. 56601
ucaacuuguaaaacagc

SEQ ID NO: 741739 - RNA, 14 nt, Leptospira interrogans serovar lai str. 56601
ucaacuuuagaaaa

SEQ ID NO: 741740 - RNA, 15 nt, Leptospira interrogans serovar lai str. 56601
ucaacuuuagaaaaa

SEQ ID NO: 741741 - RNA, 22 nt, Leptospira interrogans serovar lai str. 56601
ucaacuacuaaucucuauaaaa

SEQ ID NO: 741742 - RNA, 17 nt, Leptospira interrogans serovar lai str. 56601
ucaacacaaauauuaag

SEQ ID NO: 741743 - RNA, 19 nt, Leptospira interrogans serovar lai str. 56601
ucaacacaacgcucucuac

SEQ ID NO: 741744 - RNA, 20 nt, Leptospira interrogans serovar lai str. 56601
ucaacacaacgcucuuuaug

SEQ ID NO: 741745 - RNA, 12 nt, Leptospira interrogans serovar lai str. 56601
ucaacaacucua

SEQ ID NO: 741746 - RNA, 23 nt, Leptospira interrogans serovar lai str. 56601
ucaacaacucuaauacaaaaaau

SEQ ID NO: 741747 - RNA, 19 nt, Leptospira interrogans serovar lai str. 56601
ucaacaacucuaauauaaa

SEQ ID NO: 741748 - RNA, 13 nt, Leptospira interrogans serovar lai str. 56601
ucaacaacucuau

SEQ ID NO: 741749 - RNA, 18 nt, Leptospira interrogans serovar lai str. 56601
ucaacaacucuauuuuau

SEQ ID NO: 741750 - RNA, 19 nt, Leptospira interrogans serovar lai str. 56601
ucaaauuuuugcauaaaau

SEQ ID NO: 741751 - RNA, 18 nt, Leptospira interrogans serovar lai str. 56601
ucaacaaguuuacacauu

SEQ ID NO: 741752 - RNA, 19 nt, Leptospira interrogans serovar lai str. 56601
ucaacaaguuuacacauuu

SEQ ID NO: 741753 - RNA, 16 nt, Leptospira interrogans serovar lai str. 56601
ucaacaagaaugaaaa

SEQ ID NO: 741754 - RNA, 17 nt, Leptospira interrogans serovar lai str. 56601
ucaacaagaaugaaaaa

SEQ ID NO: 741755 - RNA, 19 nt, Leptospira interrogans serovar lai str. 56601
ucaacaggggcuuugauug

SEQ ID NO: 741756 - RNA, 12 nt, Leptospira interrogans serovar lai str. 56601
ucaacauaaaaa

SEQ ID NO: 741757 - RNA, 14 nt, Leptospira interrogans serovar lai str. 56601
ucaacauaaaaaca

SEQ ID NO: 741758 - RNA, 13 nt, Leptospira interrogans serovar lai str. 56601
ucaacaucauucu

SEQ ID NO: 741759 - RNA, 16 nt, Leptospira interrogans serovar lai str. 56601
ucaacaucucaaucaa

SEQ ID NO: 741760 - RNA, 15 nt, Leptospira interrogans serovar lai str. 56601
ucaaaacuauuaaau

SEQ ID NO: 741761 - RNA, 18 nt, Leptospira interrogans serovar lai str. 56601
ucaaaacuauuaaauuga

SEQ ID NO: 741762 - RNA, 18 nt, Leptospira interrogans serovar lai str. 56601
ucaaaacgguuuucuaau

SEQ ID NO: 741763 - RNA, 22 nt, Leptospira interrogans serovar lai str. 56601
ucaaaacgguuuucuaauuuau

SEQ ID NO: 741764 - RNA, 23 nt, Leptospira interrogans serovar lai str. 56601
uauuuaaugaccacaaacuaucu

SEQ ID NO: 741765 - RNA, 14 nt, Leptospira interrogans serovar lai str. 56601
ucaaaacuuaaaaa

SEQ ID NO: 741766 - RNA, 13 nt, Leptospira interrogans serovar lai str. 56601
ucaaaacuuaaau

SEQ ID NO: 741767 - RNA, 11 nt, Leptospira interrogans serovar lai str. 56601
ucaaaaucgga

SEQ ID NO: 741768 - RNA, 17 nt, Leptospira interrogans serovar lai str. 56601
ucaaaaucguuuuaaaa

SEQ ID NO: 741769 - RNA, 17 nt, Leptospira interrogans serovar lai str. 56601
ucaaaaucuuaauaaaa

SEQ ID NO: 741770 - RNA, 15 nt, Leptospira interrogans serovar lai str. 56601
ucaaaagguauaaaa

SEQ ID NO: 741771 - RNA, 21 nt, Leptospira interrogans serovar lai str. 56601
ucaaaagcucauaaucaauua

SEQ ID NO: 741772 - RNA, 11 nt, Leptospira interrogans serovar lai str. 56601
ucaaaaggaau

SEQ ID NO: 741773 - RNA, 12 nt, Leptospira interrogans serovar lai str. 56601
ucaaaaggaaua

SEQ ID NO: 741774 - RNA, 14 nt, Leptospira interrogans serovar lai str. 56601
ucaaaaggaauaca

SEQ ID NO: 741775 - RNA, 15 nt, Leptospira interrogans serovar lai str. 56601
ucaaaaggaauacaa

SEQ ID NO: 741776 - RNA, 19 nt, Leptospira interrogans serovar lai str. 56601
ucaaaauuaccuuucauuu

SEQ ID NO: 741777 - RNA, 21 nt, Leptospira interrogans serovar lai str. 56601
ucaaaauuaccuuucauuuuu

SEQ ID NO: 741778 - RNA, 16 nt, Leptospira interrogans serovar lai str. 56601
ucaaaauucuuaaaaa

SEQ ID NO: 741779 - RNA, 23 nt, Leptospira interrogans serovar lai str. 56601
ucaaaauucuuaaaaaauauuuu

SEQ ID NO: 741780 - RNA, 17 nt, Leptospira interrogans serovar lai str. 56601
ucaaaauucuuugucgg

SEQ ID NO: 741781 - RNA, 23 nt, Leptospira interrogans serovar lai str. 56601
ucaaaauugagcuuguuuuuaaa

SEQ ID NO: 741782 - RNA, 22 nt, Leptospira interrogans serovar lai str. 56601
ucaaaauuaagcgggaauuuaa

SEQ ID NO: 741783 - RNA, 13 nt, Leptospira interrogans serovar lai str. 56601
ucaaaauuucgga

SEQ ID NO: 741784 - RNA, 21 nt, Leptospira interrogans serovar lai str. 56601
ucaaaauuuaaauccuauuuu

SEQ ID NO: 741785 - RNA, 13 nt, Leptospira interrogans serovar lai str. 56601
ucaaaauuuaaga

SEQ ID NO: 741786 - RNA, 17 nt, Leptospira interrogans serovar lai str. 56601
ucaaaauuuuuuuaaga

SEQ ID NO: 741787 - RNA, 17 nt, Leptospira interrogans serovar lai str. 56601
ucaaacacucuaaaucu

SEQ ID NO: 741788 - RNA, 23 nt, Leptospira interrogans serovar lai str. 56601
ucaaacucacguuggauuaugca

SEQ ID NO: 741789 - RNA, 23 nt, Leptospira interrogans serovar lai str. 56601
ucaaauucuacaccuucuaaauc

SEQ ID NO: 741790 - RNA, 21 nt, Leptospira interrogans serovar lai str. 56601
ucaaauucaugauaguuaauu

SEQ ID NO: 741791 - RNA, 22 nt, Leptospira interrogans serovar lai str. 56601
ucaaauucaugauaguuaauuu

SEQ ID NO: 741792 - RNA, 19 nt, Leptospira interrogans serovar lai str. 56601
ucaaauuuauaugauuuua

SEQ ID NO: 741793 - RNA, 14 nt, Leptospira interrogans serovar lai str. 56601
ucaaauuucugaaa

SEQ ID NO: 741794 - RNA, 14 nt, Leptospira interrogans serovar lai str. 56601
ucaaauuucugcau

SEQ ID NO: 741795 - RNA, 20 nt, Leptospira interrogans serovar lai str. 56601
ucaaauuucugcaucaaauc

SEQ ID NO: 741796 - RNA, 17 nt, Leptospira interrogans serovar lai str. 56601
ucaaauuucugcaugaa

SEQ ID NO: 741797 - RNA, 17 nt, Leptospira interrogans serovar lai str. 56601
ucaaauuuacucuuaua

SEQ ID NO: 741798 - RNA, 13 nt, Leptospira interrogans serovar lai str. 56601
ucaacaaacaaau

SEQ ID NO: 741799 - RNA, 20 nt, Leptospira interrogans serovar lai str. 56601
ucaacaaacaaauagaaaua

SEQ ID NO: 741800 - RNA, 14 nt, Leptospira interrogans serovar lai str. 56601
ucaaauuuggaaau

SEQ ID NO: 741801 - RNA, 15 nt, Leptospira interrogans serovar lai str. 56601
ucaaacuuacaaaaa

SEQ ID NO: 741802 - RNA, 20 nt, Leptospira interrogans serovar lai str. 56601
ucaaagcaaaguuucuuaua

SEQ ID NO: 741803 - RNA, 18 nt, Leptospira interrogans serovar lai str. 56601
ucaaagccuuaaaucaau

SEQ ID NO: 741804 - RNA, 20 nt, Leptospira interrogans serovar lai str. 56601
ucaaagccuuaaaucaaucc

SEQ ID NO: 741805 - RNA, 13 nt, Leptospira interrogans serovar lai str. 56601
ucaaaucaauuuu

SEQ ID NO: 741806 - RNA, 11 nt, Leptospira interrogans serovar lai str. 56601
ucaaaggaaaa

SEQ ID NO: 741807 - RNA, 17 nt, Leptospira interrogans serovar lai str. 56601
ucaaaggaaaaugaaga

SEQ ID NO: 741808 - RNA, 18 nt, Leptospira interrogans serovar lai str. 56601
ucaaaggaaauaaaaaua

SEQ ID NO: 741809 - RNA, 13 nt, Leptospira interrogans serovar lai str. 56601
ucacguuauccuu

SEQ ID NO: 741810 - RNA, 21 nt, Leptospira interrogans serovar lai str. 56601
ucacguuauuuuaacuugagu

SEQ ID NO: 741811 - RNA, 17 nt, Leptospira interrogans serovar lai str. 56601
ucacguucaacaaacaa

SEQ ID NO: 741812 - RNA, 15 nt, Leptospira interrogans serovar lai str. 56601
ucagaaaaaugaauu

SEQ ID NO: 741813 - RNA, 17 nt, Leptospira interrogans serovar lai str. 56601
ucagaaaaacaaaaaac

SEQ ID NO: 741814 - RNA, 13 nt, Leptospira interrogans serovar lai str. 56601
ucagaaaaacaua

SEQ ID NO: 741815 - RNA, 17 nt, Leptospira interrogans serovar lai str. 56601
ucagaaaaaaaaagaau

SEQ ID NO: 741816 - RNA, 18 nt, Leptospira interrogans serovar lai str. 56601
ucagaaaaaaaaagaauu

SEQ ID NO: 741817 - RNA, 23 nt, Leptospira interrogans serovar lai str. 56601
ucagaaaaaaaaagaauuucuaa

SEQ ID NO: 741818 - RNA, 23 nt, Leptospira interrogans serovar lai str. 56601
ucagaaacguucguauugaauau

SEQ ID NO: 741819 - RNA, 23 nt, Leptospira interrogans serovar lai str. 56601
ucagaaacauuggaacuuuuuau

SEQ ID NO: 741820 - RNA, 13 nt, Leptospira interrogans serovar lai str. 56601
ucacuucuugaaa

SEQ ID NO: 741821 - RNA, 18 nt, Leptospira interrogans serovar lai str. 56601
ucacuuccauuuuuugau

SEQ ID NO: 741822 - RNA, 13 nt, Leptospira interrogans serovar lai str. 56601
aaaucuaaauuuu

SEQ ID NO: 741823 - RNA, 14 nt, Leptospira interrogans serovar lai str. 56601
aaaucuaaauuuua

SEQ ID NO: 741824 - RNA, 15 nt, Leptospira interrogans serovar lai str. 56601
aaaucuaaauuuuac

SEQ ID NO: 741825 - RNA, 18 nt, Leptospira interrogans serovar lai str. 56601
aaaucgugaauuuacagu

SEQ ID NO: 741826 - RNA, 15 nt, Leptospira interrogans serovar lai str. 56601
aaaucuaaaaaaaau

SEQ ID NO: 741827 - RNA, 16 nt, Leptospira interrogans serovar lai str. 56601
aaaucuaaaaaaaauc

SEQ ID NO: 741828 - RNA, 16 nt, Leptospira interrogans serovar lai str. 56601
aaaucuaaaaaaacaa

SEQ ID NO: 741829 - RNA, 20 nt, Leptospira interrogans serovar lai str. 56601
aaaucuaaaaaaacaauuaa

SEQ ID NO: 741830 - RNA, 20 nt, Leptospira interrogans serovar lai str. 56601
ucagauuucagcuccaaaaa

SEQ ID NO: 741831 - RNA, 17 nt, Leptospira interrogans serovar lai str. 56601
aaaucuacaaaacuuua

SEQ ID NO: 741832 - RNA, 19 nt, Leptospira interrogans serovar lai str. 56601
aaaucuacaaaacuuuacg

SEQ ID NO: 741833 - RNA, 15 nt, Leptospira interrogans serovar lai str. 56601
ucagauuuuuguagu

SEQ ID NO: 741834 - RNA, 13 nt, Leptospira interrogans serovar lai str. 56601
ucagauuuuuucu

SEQ ID NO: 741835 - RNA, 14 nt, Leptospira interrogans serovar lai str. 56601
ucagauuaaaaccg

SEQ ID NO: 741836 - RNA, 13 nt, Leptospira interrogans serovar lai str. 56601
ucagaugaaaguu

SEQ ID NO: 741837 - RNA, 23 nt, Leptospira interrogans serovar lai str. 56601
ucagaugaauugaauuuuuuaaa

SEQ ID NO: 741838 - RNA, 21 nt, Leptospira interrogans serovar lai str. 56601
ucagacaugauucauuuuucu

SEQ ID NO: 741839 - RNA, 21 nt, Leptospira interrogans serovar lai str. 56601
ucagaccaguaguauguuuuu

SEQ ID NO: 741840 - RNA, 20 nt, Leptospira interrogans serovar lai str. 56601
ucagaaucauggguucuuua

SEQ ID NO: 741841 - RNA, 22 nt, Leptospira interrogans serovar lai str. 56601
ucagaaucauuggaguuuuuua

SEQ ID NO: 741842 - RNA, 15 nt, Leptospira interrogans serovar lai str. 56601
ucagaaucaaaggaa

SEQ ID NO: 741843 - RNA, 17 nt, Leptospira interrogans serovar lai str. 56601
ucagaaucaaaggaaau

SEQ ID NO: 741844 - RNA, 17 nt, Leptospira interrogans serovar lai str. 56601
ucagaagucuuucuaca

SEQ ID NO: 741845 - RNA, 23 nt, Leptospira interrogans serovar lai str. 56601
ucagaagucuuucuacaccagua

SEQ ID NO: 741846 - RNA, 18 nt, Leptospira interrogans serovar lai str. 56601
ucagagugguuucuuaug

SEQ ID NO: 741847 - RNA, 14 nt, Leptospira interrogans serovar lai str. 56601
ucagugauucgaaa

SEQ ID NO: 741848 - RNA, 18 nt, Leptospira interrogans serovar lai str. 56601
ucagugauucgaaauuuu

SEQ ID NO: 741849 - RNA, 19 nt, Leptospira interrogans serovar lai str. 56601
ucagugauucgaaauuuuc

SEQ ID NO: 741850 - RNA, 15 nt, Leptospira interrogans serovar lai str. 56601
ucagucucauuucaa

SEQ ID NO: 741851 - RNA, 15 nt, Leptospira interrogans serovar lai str. 56601
ucaguauguuguucu

SEQ ID NO: 741852 - RNA, 18 nt, Leptospira interrogans serovar lai str. 56601
ucaguagguuuuuaauuu

SEQ ID NO: 741853 - RNA, 20 nt, Leptospira interrogans serovar lai str. 56601
ucaguagguuuuuaauuucg

SEQ ID NO: 741854 - RNA, 15 nt, Leptospira interrogans serovar lai str. 56601
ucaguagugaaaaac

SEQ ID NO: 741855 - RNA, 15 nt, Leptospira interrogans serovar lai str. 56601
ucaggucacauuuua

SEQ ID NO: 741856 - RNA, 19 nt, Leptospira interrogans serovar lai str. 56601
ucaggaccaaaucuuucac

SEQ ID NO: 741857 - RNA, 15 nt, Leptospira interrogans serovar lai str. 56601
ucagcugaacucacg

SEQ ID NO: 741858 - RNA, 19 nt, Leptospira interrogans serovar lai str. 56601
ucagcucuggucaaguuau

SEQ ID NO: 741859 - RNA, 20 nt, Leptospira interrogans serovar lai str. 56601
ucagcucuggucaauaaauu

SEQ ID NO: 741860 - RNA, 22 nt, Leptospira interrogans serovar lai str. 56601
ucagcucugguuaauaaauugc

SEQ ID NO: 741861 - RNA, 18 nt, Leptospira interrogans serovar lai str. 56601
ucaggauaaccuaaaauu

SEQ ID NO: 741862 - RNA, 15 nt, Leptospira interrogans serovar lai str. 56601
aaaucucuaacaaaa

SEQ ID NO: 741863 - RNA, 18 nt, Leptospira interrogans serovar lai str. 56601
aaaucucuaacaaaaagu

SEQ ID NO: 741864 - RNA, 14 nt, Leptospira interrogans serovar lai str. 56601
aaaucucaaauucg

SEQ ID NO: 741865 - RNA, 22 nt, Leptospira interrogans serovar lai str. 56601
aaaucucaaauucgucaaaacc

SEQ ID NO: 741866 - RNA, 17 nt, Leptospira interrogans serovar lai str. 56601
aaaucucagaaaauuuu

SEQ ID NO: 741867 - RNA, 17 nt, Leptospira interrogans serovar lai str. 56601
aaaucucaauucaguaa

SEQ ID NO: 741868 - RNA, 14 nt, Leptospira interrogans serovar lai str. 56601
aaaucucauuacca

SEQ ID NO: 741869 - RNA, 14 nt, Leptospira interrogans serovar lai str. 56601
aaaucuaucucaaa

SEQ ID NO: 741870 - RNA, 20 nt, Leptospira interrogans serovar lai str. 56601
aaaucuaucucaaaaauacu

SEQ ID NO: 741871 - RNA, 21 nt, Leptospira interrogans serovar lai str. 56601
aaaucuaucucaaaaauacuu

SEQ ID NO: 741872 - RNA, 16 nt, Leptospira interrogans serovar lai str. 56601
ucagcagucugugauu

SEQ ID NO: 741873 - RNA, 23 nt, Leptospira interrogans serovar lai str. 56601
ucagcuccaaaaaaauaaaucau

SEQ ID NO: 741874 - RNA, 22 nt, Leptospira interrogans serovar lai str. 56601
ucagcguaagguguuuauaaaa

SEQ ID NO: 741875 - RNA, 14 nt, Leptospira interrogans serovar lai str. 56601
uauguauuuuaaac

SEQ ID NO: 741876 - RNA, 17 nt, Leptospira interrogans serovar lai str. 56601
uauguauuuauucaaaa

SEQ ID NO: 741877 - RNA, 17 nt, Leptospira interrogans serovar lai str. 56601
uauguccuuuuuuucuu

SEQ ID NO: 741878 - RNA, 22 nt, Leptospira interrogans serovar lai str. 56601
uauguagaaauuugauuucgag

SEQ ID NO: 741879 - RNA, 15 nt, Leptospira interrogans serovar lai str. 56601
uauguaauauuucuu

SEQ ID NO: 741880 - RNA, 17 nt, Leptospira interrogans serovar lai str. 56601
uauguaagaaaaacuag

SEQ ID NO: 741881 - RNA, 19 nt, Leptospira interrogans serovar lai str. 56601
uauuaaaacacuuuacauu

SEQ ID NO: 741882 - RNA, 18 nt, Leptospira interrogans serovar lai str. 56601
uauuaaaauguuuuauuu

SEQ ID NO: 741883 - RNA, 15 nt, Leptospira interrogans serovar lai str. 56601
uauguuuuuuuucaa

SEQ ID NO: 741884 - RNA, 20 nt, Leptospira interrogans serovar lai str. 56601
uauuaaaaaaauaauauauu

SEQ ID NO: 741885 - RNA, 20 nt, Leptospira interrogans serovar lai str. 56601
uauuaaaaccaucuuugaua

SEQ ID NO: 741886 - RNA, 21 nt, Leptospira interrogans serovar lai str. 56601
uauuaaaaccaucuuugauau

SEQ ID NO: 741887 - RNA, 17 nt, Leptospira interrogans serovar lai str. 56601
uauguuucuugugucaa

SEQ ID NO: 741888 - RNA, 21 nt, Leptospira interrogans serovar lai str. 56601
uauguuucuugugucaagccc

SEQ ID NO: 741889 - RNA, 16 nt, Leptospira interrogans serovar lai str. 56601
uaugugguaguuccca

SEQ ID NO: 741890 - RNA, 18 nt, Leptospira interrogans serovar lai str. 56601
uaugugguaguucccaca

SEQ ID NO: 741891 - RNA, 18 nt, Leptospira interrogans serovar lai str. 56601
uauguggaaaacuuucuu

SEQ ID NO: 741892 - RNA, 17 nt, Leptospira interrogans serovar lai str. 56601
uauguugaguuuugaua

SEQ ID NO: 741893 - RNA, 16 nt, Leptospira interrogans serovar lai str. 56601
uauuaaguuuuuuaaa

SEQ ID NO: 741894 - RNA, 17 nt, Leptospira interrogans serovar lai str. 56601
uauuaaguuuuuuaaau

SEQ ID NO: 741895 - RNA, 21 nt, Leptospira interrogans serovar lai str. 56601
uauuaaguuuuuuaaauuuac

SEQ ID NO: 741896 - RNA, 24 nt, Leptospira interrogans serovar lai str. 56601
uauuaagaaaaauuaaaauucuag

SEQ ID NO: 741897 - RNA, 18 nt, Leptospira interrogans serovar lai str. 56601
uauuaauauucuaauuca

SEQ ID NO: 741898 - RNA, 20 nt, Leptospira interrogans serovar lai str. 56601
uauuaaauugaguuuuccaa

SEQ ID NO: 741899 - RNA, 16 nt, Leptospira interrogans serovar lai str. 56601
uauuaaaauuucccga

SEQ ID NO: 741900 - RNA, 23 nt, Leptospira interrogans serovar lai str. 56601
uauuaaagaauaauauuuuaaug

SEQ ID NO: 741901 - RNA, 19 nt, Leptospira interrogans serovar lai str. 56601
uauuaaagucucaaguugu

SEQ ID NO: 741902 - RNA, 12 nt, Leptospira interrogans serovar lai str. 56601
uauuaaauaaag

SEQ ID NO: 741903 - RNA, 15 nt, Leptospira interrogans serovar lai str. 56601
uauuaaauuuuauuu

SEQ ID NO: 741904 - RNA, 20 nt, Leptospira interrogans serovar lai str. 56601
uauuaacaaauuuaaaauaa

SEQ ID NO: 741905 - RNA, 13 nt, Leptospira interrogans serovar lai str. 56601
uauuauaaauauu

SEQ ID NO: 741906 - RNA, 21 nt, Leptospira interrogans serovar lai str. 56601
uauuauaaacuucuauuuuau

SEQ ID NO: 741907 - RNA, 23 nt, Leptospira interrogans serovar lai str. 56601
uauuauaaauacaaaaauucuaa

SEQ ID NO: 741908 - RNA, 12 nt, Leptospira interrogans serovar lai str. 56601
uauuauaaauuu

SEQ ID NO: 741909 - RNA, 14 nt, Leptospira interrogans serovar lai str. 56601
uauuauaaauuuaa

SEQ ID NO: 741910 - RNA, 16 nt, Leptospira interrogans serovar lai str. 56601
uauuauaaauuuaaaa

SEQ ID NO: 741911 - RNA, 18 nt, Leptospira interrogans serovar lai str. 56601
uauuauaaauuuaaaaaa

SEQ ID NO: 741912 - RNA, 13 nt, Leptospira interrogans serovar lai str. 56601
uauuaauuuaaaa

SEQ ID NO: 741913 - RNA, 15 nt, Leptospira interrogans serovar lai str. 56601
uauuaauuuaaaaac

SEQ ID NO: 741914 - RNA, 16 nt, Leptospira interrogans serovar lai str. 56601
uauuaauuuaaaaaca

SEQ ID NO: 741915 - RNA, 17 nt, Leptospira interrogans serovar lai str. 56601
uauuaauuuaaaaacaa

SEQ ID NO: 741916 - RNA, 11 nt, Leptospira interrogans serovar lai str. 56601
uauuacaaaac

SEQ ID NO: 741917 - RNA, 21 nt, Leptospira interrogans serovar lai str. 56601
uauuacauucaauaauuuuaa

SEQ ID NO: 741918 - RNA, 14 nt, Leptospira interrogans serovar lai str. 56601
uauuacaauuuuau

SEQ ID NO: 741919 - RNA, 17 nt, Leptospira interrogans serovar lai str. 56601
uauuacaauuuuaucuu

SEQ ID NO: 741920 - RNA, 17 nt, Leptospira interrogans serovar lai str. 56601
uauuaauuuaaucaaaa

SEQ ID NO: 741921 - RNA, 16 nt, Leptospira interrogans serovar lai str. 56601
uauuguguuuuuucuu

SEQ ID NO: 741922 - RNA, 14 nt, Leptospira interrogans serovar lai str. 56601
uauuggguuugauu

SEQ ID NO: 741923 - RNA, 23 nt, Leptospira interrogans serovar lai str. 56601
uauugguagauugcuuuuuaaaa

SEQ ID NO: 741924 - RNA, 13 nt, Leptospira interrogans serovar lai str. 56601
uauuuaauaaaau

SEQ ID NO: 741925 - RNA, 19 nt, Leptospira interrogans serovar lai str. 56601
uauuuaacuucguugaaaa

SEQ ID NO: 741926 - RNA, 13 nt, Leptospira interrogans serovar lai str. 56601
uauugcaaaaccg

SEQ ID NO: 741927 - RNA, 14 nt, Leptospira interrogans serovar lai str. 56601
uauugaaauauuau

SEQ ID NO: 741928 - RNA, 18 nt, Leptospira interrogans serovar lai str. 56601
uauugaaauauuauaaau

SEQ ID NO: 741929 - RNA, 15 nt, Leptospira interrogans serovar lai str. 56601
uauugaagauauuuu

SEQ ID NO: 741930 - RNA, 16 nt, Leptospira interrogans serovar lai str. 56601
aaauccucaacagaua

SEQ ID NO: 741931 - RNA, 15 nt, Leptospira interrogans serovar lai str. 56601
aaauccuaguuuuac

SEQ ID NO: 741932 - RNA, 16 nt, Leptospira interrogans serovar lai str. 56601
aaauccuauucaacuu

SEQ ID NO: 741933 - RNA, 14 nt, Leptospira interrogans serovar lai str. 56601
aaauccguauacuu

SEQ ID NO: 741934 - RNA, 17 nt, Leptospira interrogans serovar lai str. 56601
uauuauuaaauuuuuau

SEQ ID NO: 741935 - RNA, 18 nt, Leptospira interrogans serovar lai str. 56601
uauuauuaaauuuuuaua

SEQ ID NO: 741936 - RNA, 18 nt, Leptospira interrogans serovar lai str. 56601
uauuauuuguaguuucaa

SEQ ID NO: 741937 - RNA, 22 nt, Leptospira interrogans serovar lai str. 56601
uauuauuuugauuuguuucuuu

SEQ ID NO: 741938 - RNA, 22 nt, Leptospira interrogans serovar lai str. 56601
uauucaaaaaagaaaaaucuuc

SEQ ID NO: 741939 - RNA, 14 nt, Leptospira interrogans serovar lai str. 56601
uauucaaaaaaugg

SEQ ID NO: 741940 - RNA, 15 nt, Leptospira interrogans serovar lai str. 56601
uauucaaaaaaugga

SEQ ID NO: 741941 - RNA, 15 nt, Leptospira interrogans serovar lai str. 56601
uauucaaaagauuga

SEQ ID NO: 741942 - RNA, 16 nt, Leptospira interrogans serovar lai str. 56601
uauucaaauuuacucu

SEQ ID NO: 741943 - RNA, 23 nt, Leptospira interrogans serovar lai str. 56601
uauucaaauuuacucuuauaaaa

SEQ ID NO: 741944 - RNA, 14 nt, Leptospira interrogans serovar lai str. 56601
uauuccauuuucau

SEQ ID NO: 741945 - RNA, 16 nt, Leptospira interrogans serovar lai str. 56601
uauuccaugguuuuuu

SEQ ID NO: 741946 - RNA, 18 nt, Leptospira interrogans serovar lai str. 56601
uauuccaugguuuuuuca

SEQ ID NO: 741947 - RNA, 16 nt, Leptospira interrogans serovar lai str. 56601
uauucuagaagaguuu

SEQ ID NO: 741948 - RNA, 22 nt, Leptospira interrogans serovar lai str. 56601
uauucuauaaaauuugaaagua

SEQ ID NO: 741949 - RNA, 13 nt, Leptospira interrogans serovar lai str. 56601
uauuccuaaaaug

SEQ ID NO: 741950 - RNA, 15 nt, Leptospira interrogans serovar lai str. 56601
uauuccuaaaaugug

SEQ ID NO: 741951 - RNA, 15 nt, Leptospira interrogans serovar lai str. 56601
uauucguaagaaaaa

SEQ ID NO: 741952 - RNA, 16 nt, Leptospira interrogans serovar lai str. 56601
uauucguaagaaaaaa

SEQ ID NO: 741953 - RNA, 21 nt, Leptospira interrogans serovar lai str. 56601
uauucuucaucauuauuugaa

SEQ ID NO: 741954 - RNA, 21 nt, Leptospira interrogans serovar lai str. 56601
uauucuuuucugaauaaaaau

SEQ ID NO: 741955 - RNA, 16 nt, Leptospira interrogans serovar lai str. 56601
uauugaaaaauuucau

SEQ ID NO: 741956 - RNA, 15 nt, Leptospira interrogans serovar lai str. 56601
uauucuuuuuagacu

SEQ ID NO: 741957 - RNA, 15 nt, Leptospira interrogans serovar lai str. 56601
uaugcgguuuuacuu

SEQ ID NO: 741958 - RNA, 18 nt, Leptospira interrogans serovar lai str. 56601
uauggcaggaucaaaauc

SEQ ID NO: 741959 - RNA, 16 nt, Leptospira interrogans serovar lai str. 56601
uauggaagcuaacaca

SEQ ID NO: 741960 - RNA, 14 nt, Leptospira interrogans serovar lai str. 56601
uauggaauauaaaa

SEQ ID NO: 741961 - RNA, 23 nt, Leptospira interrogans serovar lai str. 56601
uauggaauuccgacccagaaaaa

SEQ ID NO: 741962 - RNA, 13 nt, Leptospira interrogans serovar lai str. 56601
uaugguaaaaaua

SEQ ID NO: 741963 - RNA, 23 nt, Leptospira interrogans serovar lai str. 56601
uaugggaauuuuuguaaaaucca

SEQ ID NO: 741964 - RNA, 23 nt, Leptospira interrogans serovar lai str. 56601
uaugggugcucgaaguaacucag

SEQ ID NO: 741965 - RNA, 18 nt, Leptospira interrogans serovar lai str. 56601
uauggcucugaguagaaa

SEQ ID NO: 741966 - RNA, 13 nt, Leptospira interrogans serovar lai str. 56601
uaugaauuaauuu

SEQ ID NO: 741967 - RNA, 21 nt, Leptospira interrogans serovar lai str. 56601
uaugaauuuuuaauagacuaa

SEQ ID NO: 741968 - RNA, 13 nt, Leptospira interrogans serovar lai str. 56601
uaugaauuuccau

SEQ ID NO: 741969 - RNA, 15 nt, Leptospira interrogans serovar lai str. 56601
uaugaauuuccauua

SEQ ID NO: 741970 - RNA, 14 nt, Leptospira interrogans serovar lai str. 56601
uaugauaaguaauu

SEQ ID NO: 741971 - RNA, 19 nt, Leptospira interrogans serovar lai str. 56601
uaugauaaguaauuugugg

SEQ ID NO: 741972 - RNA, 13 nt, Leptospira interrogans serovar lai str. 56601
uaugacaauuucu

SEQ ID NO: 741973 - RNA, 12 nt, Leptospira interrogans serovar lai str. 56601
uaugaguucauu

SEQ ID NO: 741974 - RNA, 17 nt, Leptospira interrogans serovar lai str. 56601
uaugaguucccacaaau

SEQ ID NO: 741975 - RNA, 21 nt, Leptospira interrogans serovar lai str. 56601
uaugaguucccacauuuuuaa

SEQ ID NO: 741976 - RNA, 21 nt, Leptospira interrogans serovar lai str. 56601
uaugaguuccuaacuuugaaa

SEQ ID NO: 741977 - RNA, 22 nt, Leptospira interrogans serovar lai str. 56601
uaugaguuucuccacuuaaaaa

SEQ ID NO: 741978 - RNA, 14 nt, Leptospira interrogans serovar lai str. 56601
uaugauucugaaaa

SEQ ID NO: 741979 - RNA, 16 nt, Leptospira interrogans serovar lai str. 56601
uaugauucugaaaaaa

SEQ ID NO: 741980 - RNA, 18 nt, Leptospira interrogans serovar lai str. 56601
uaugauucugaaaaaaau

SEQ ID NO: 741981 - RNA, 22 nt, Leptospira interrogans serovar lai str. 56601
uaugauuaugugacuuuaauuu

SEQ ID NO: 741982 - RNA, 19 nt, Leptospira interrogans serovar lai str. 56601
uaugauuuucuuuuccguu

SEQ ID NO: 741983 - RNA, 15 nt, Leptospira interrogans serovar lai str. 56601
uaugauuuuuuugaa

SEQ ID NO: 741984 - RNA, 19 nt, Leptospira interrogans serovar lai str. 56601
uaucuccaaaauuuuugug

SEQ ID NO: 741985 - RNA, 18 nt, Leptospira interrogans serovar lai str. 56601
uaucucaagauuaaucug

SEQ ID NO: 741986 - RNA, 20 nt, Leptospira interrogans serovar lai str. 56601
uaucucaaagccuuaaauca

SEQ ID NO: 741987 - RNA, 13 nt, Leptospira interrogans serovar lai str. 56601
uaucugcaaaaua

SEQ ID NO: 741988 - RNA, 14 nt, Leptospira interrogans serovar lai str. 56601
uaucugccuucuuu

SEQ ID NO: 741989 - RNA, 15 nt, Leptospira interrogans serovar lai str. 56601
uaucuguaaaauuug

SEQ ID NO: 741990 - RNA, 12 nt, Leptospira interrogans serovar lai str. 56601
uaucuaaaacac

SEQ ID NO: 741991 - RNA, 22 nt, Leptospira interrogans serovar lai str. 56601
uaucuaaaacacaucuuaaaaa

SEQ ID NO: 741992 - RNA, 13 nt, Leptospira interrogans serovar lai str. 56601
uaucuaaaaguuu

SEQ ID NO: 741993 - RNA, 17 nt, Leptospira interrogans serovar lai str. 56601
uaucuaaagacuaaaaa

SEQ ID NO: 741994 - RNA, 13 nt, Leptospira interrogans serovar lai str. 56601
uaucuauugaaac

SEQ ID NO: 741995 - RNA, 13 nt, Leptospira interrogans serovar lai str. 56601
uaucuauaaaauc

SEQ ID NO: 741996 - RNA, 18 nt, Leptospira interrogans serovar lai str. 56601
uaucugugaauucuccaa

SEQ ID NO: 741997 - RNA, 18 nt, Leptospira interrogans serovar lai str. 56601
uaucuuagaauuguugaa

SEQ ID NO: 741998 - RNA, 21 nt, Leptospira interrogans serovar lai str. 56601
uaucuuagaauuguugaaaaa

SEQ ID NO: 741999 - RNA, 19 nt, Leptospira interrogans serovar lai str. 56601
uaucuuagaucaauuuguu

SEQ ID NO: 742000 - RNA, 14 nt, Leptospira interrogans serovar lai str. 56601
uaucuucuaauuaa

SEQ ID NO: 742001 - RNA, 17 nt, Leptospira interrogans serovar lai str. 56601
uaucuucuaauuaaauu

SEQ ID NO: 742002 - RNA, 20 nt, Leptospira interrogans serovar lai str. 56601
uaucuuuuucuaucaagaag

SEQ ID NO: 742003 - RNA, 17 nt, Leptospira interrogans serovar lai str. 56601
uaucuuuucuuaaaauu

SEQ ID NO: 742004 - RNA, 12 nt, Leptospira interrogans serovar lai str. 56601
uaucuuuccagu

SEQ ID NO: 742005 - RNA, 15 nt, Leptospira interrogans serovar lai str. 56601
uaucuuuauaaaaau

SEQ ID NO: 742006 - RNA, 16 nt, Leptospira interrogans serovar lai str. 56601
uaugaaauacaaaaag

SEQ ID NO: 742007 - RNA, 19 nt, Leptospira interrogans serovar lai str. 56601
uaugaaauacaaaaagaau

SEQ ID NO: 742008 - RNA, 16 nt, Leptospira interrogans serovar lai str. 56601
uaugaaacgaaauaua

SEQ ID NO: 742009 - RNA, 16 nt, Leptospira interrogans serovar lai str. 56601
uaugaaaguuuuucaa

SEQ ID NO: 742010 - RNA, 12 nt, Leptospira interrogans serovar lai str. 56601
uaugaaauaaag

SEQ ID NO: 742011 - RNA, 17 nt, Leptospira interrogans serovar lai str. 56601
uaugaagucuuaucuca

SEQ ID NO: 742012 - RNA, 11 nt, Leptospira interrogans serovar lai str. 56601
uaugaauaaaa

SEQ ID NO: 742013 - RNA, 17 nt, Leptospira interrogans serovar lai str. 56601
uaugaagaaaaccuaaa

SEQ ID NO: 742014 - RNA, 13 nt, Leptospira interrogans serovar lai str. 56601
uaucgauuuaaaa

SEQ ID NO: 742015 - RNA, 15 nt, Leptospira interrogans serovar lai str. 56601
uaucgaauuucuuca

SEQ ID NO: 742016 - RNA, 20 nt, Leptospira interrogans serovar lai str. 56601
uaucgaauuucuucauaaaa

SEQ ID NO: 742017 - RNA, 16 nt, Leptospira interrogans serovar lai str. 56601
uaucgaauaagaaauu

SEQ ID NO: 742018 - RNA, 21 nt, Leptospira interrogans serovar lai str. 56601
uauccuuacuuaccucuauaa

SEQ ID NO: 742019 - RNA, 17 nt, Leptospira interrogans serovar lai str. 56601
uaucgaacgaccugcag

SEQ ID NO: 742020 - RNA, 14 nt, Leptospira interrogans serovar lai str. 56601
uaucgaaaauuaac

SEQ ID NO: 742021 - RNA, 19 nt, Leptospira interrogans serovar lai str. 56601
uauccuugggauaaauauu

SEQ ID NO: 742022 - RNA, 23 nt, Leptospira interrogans serovar lai str. 56601
uauccuugggauaaauauucucu

SEQ ID NO: 742023 - RNA, 16 nt, Leptospira interrogans serovar lai str. 56601
uaucggcacuuuuguu

SEQ ID NO: 742024 - RNA, 13 nt, Leptospira interrogans serovar lai str. 56601
uaucgucaaaauu

SEQ ID NO: 742025 - RNA, 19 nt, Leptospira interrogans serovar lai str. 56601
uauccuaaugaaaaagaaa

SEQ ID NO: 742026 - RNA, 16 nt, Leptospira interrogans serovar lai str. 56601
uaucauaaguuuugau

SEQ ID NO: 742027 - RNA, 15 nt, Leptospira interrogans serovar lai str. 56601
uauauuuaaauguua

SEQ ID NO: 742028 - RNA, 11 nt, Leptospira interrogans serovar lai str. 56601
uauauuuuaau

SEQ ID NO: 742029 - RNA, 13 nt, Leptospira interrogans serovar lai str. 56601
uauauuuuaauuu

SEQ ID NO: 742030 - RNA, 16 nt, Leptospira interrogans serovar lai str. 56601
uauauuucuaaaagaa

SEQ ID NO: 742031 - RNA, 14 nt, Leptospira interrogans serovar lai str. 56601
uauauuucauugaa

SEQ ID NO: 742032 - RNA, 16 nt, Leptospira interrogans serovar lai str. 56601
uauauucaauuucuuu

SEQ ID NO: 742033 - RNA, 20 nt, Leptospira interrogans serovar lai str. 56601
uauauucacaaaaaaauuca

SEQ ID NO: 742034 - RNA, 21 nt, Leptospira interrogans serovar lai str. 56601
uauauucaaaaaauggaacau

SEQ ID NO: 742035 - RNA, 22 nt, Leptospira interrogans serovar lai str. 56601
uauauuagaauuguugaaaaac

SEQ ID NO: 742036 - RNA, 18 nt, Leptospira interrogans serovar lai str. 56601
uauauuagaguuuuugaa

SEQ ID NO: 742037 - RNA, 22 nt, Leptospira interrogans serovar lai str. 56601
uauauuagaguuuuugaaaaau

SEQ ID NO: 742038 - RNA, 12 nt, Leptospira interrogans serovar lai str. 56601
uauauuauaaaa

SEQ ID NO: 742039 - RNA, 11 nt, Leptospira interrogans serovar lai str. 56601
uauauuauaau

SEQ ID NO: 742040 - RNA, 14 nt, Leptospira interrogans serovar lai str. 56601
uauauuauaauaau

SEQ ID NO: 742041 - RNA, 19 nt, Leptospira interrogans serovar lai str. 56601
uauauuauaauuuuaaaua

SEQ ID NO: 742042 - RNA, 14 nt, Leptospira interrogans serovar lai str. 56601
uauauguaaaugau

SEQ ID NO: 742043 - RNA, 15 nt, Leptospira interrogans serovar lai str. 56601
uauauuuucugcuua

SEQ ID NO: 742044 - RNA, 18 nt, Leptospira interrogans serovar lai str. 56601
uaucaagaagagucaaac

SEQ ID NO: 742045 - RNA, 22 nt, Leptospira interrogans serovar lai str. 56601
uaucagaaccuuuaguuuccaa

SEQ ID NO: 742046 - RNA, 14 nt, Leptospira interrogans serovar lai str. 56601
uaucacaaacuauu

SEQ ID NO: 742047 - RNA, 18 nt, Leptospira interrogans serovar lai str. 56601
uaucacaaacuauucuau

SEQ ID NO: 742048 - RNA, 15 nt, Leptospira interrogans serovar lai str. 56601
uaucacaaauuuuaa

SEQ ID NO: 742049 - RNA, 20 nt, Leptospira interrogans serovar lai str. 56601
uauaguaaugaguaacgaaa

SEQ ID NO: 742050 - RNA, 20 nt, Leptospira interrogans serovar lai str. 56601
uauaguagauauuaguaaaa

SEQ ID NO: 742051 - RNA, 14 nt, Leptospira interrogans serovar lai str. 56601
uauaguuuugagau

SEQ ID NO: 742052 - RNA, 23 nt, Leptospira interrogans serovar lai str. 56601
uauaguuuugagcauaaaaaaau

SEQ ID NO: 742053 - RNA, 13 nt, Leptospira interrogans serovar lai str. 56601
uauaguuuuuaac

SEQ ID NO: 742054 - RNA, 11 nt, Leptospira interrogans serovar lai str. 56601
uauauaaaaaa

SEQ ID NO: 742055 - RNA, 12 nt, Leptospira interrogans serovar lai str. 56601
uauauaaaaaau

SEQ ID NO: 742056 - RNA, 21 nt, Leptospira interrogans serovar lai str. 56601
uauaggaacucauacuucuaa

SEQ ID NO: 742057 - RNA, 20 nt, Leptospira interrogans serovar lai str. 56601
uauaguaaagauuagaaaaa

SEQ ID NO: 742058 - RNA, 22 nt, Leptospira interrogans serovar lai str. 56601
uauagguuucuucgccuauuuu

SEQ ID NO: 742059 - RNA, 13 nt, Leptospira interrogans serovar lai str. 56601
uauacaauuuaau

SEQ ID NO: 742060 - RNA, 22 nt, Leptospira interrogans serovar lai str. 56601
uauacaacuuuuuuaauuuuaa

SEQ ID NO: 742061 - RNA, 23 nt, Leptospira interrogans serovar lai str. 56601
uauacaacuuuuuuaauuuuaau

SEQ ID NO: 742062 - RNA, 16 nt, Leptospira interrogans serovar lai str. 56601
uauaauuuuaaauaau

SEQ ID NO: 742063 - RNA, 17 nt, Leptospira interrogans serovar lai str. 56601
uauaauuuuaaauaaua

SEQ ID NO: 742064 - RNA, 20 nt, Leptospira interrogans serovar lai str. 56601
uauacaaaacucuuuaaaaa

SEQ ID NO: 742065 - RNA, 16 nt, Leptospira interrogans serovar lai str. 56601
uauaauuuucaugaac

SEQ ID NO: 742066 - RNA, 18 nt, Leptospira interrogans serovar lai str. 56601
uauauaguuuugagcaua

SEQ ID NO: 742067 - RNA, 15 nt, Leptospira interrogans serovar lai str. 56601
uauauaaagaaaaac

SEQ ID NO: 742068 - RNA, 16 nt, Leptospira interrogans serovar lai str. 56601
uauauaaagaaaaaca

SEQ ID NO: 742069 - RNA, 17 nt, Leptospira interrogans serovar lai str. 56601
uauauaaagaaaaacag

SEQ ID NO: 742070 - RNA, 22 nt, Leptospira interrogans serovar lai str. 56601
uauauaaauucgccguaaaaaa

SEQ ID NO: 742071 - RNA, 21 nt, Leptospira interrogans serovar lai str. 56601
uauauagauccugauuuguuu

SEQ ID NO: 742072 - RNA, 16 nt, Leptospira interrogans serovar lai str. 56601
uauauccuuaugaaag

SEQ ID NO: 742073 - RNA, 21 nt, Leptospira interrogans serovar lai str. 56601
uauauauuaaaguauuaauuu

SEQ ID NO: 742074 - RNA, 19 nt, Leptospira interrogans serovar lai str. 56601
uauauauucacaaaaaaau

SEQ ID NO: 742075 - RNA, 14 nt, Leptospira interrogans serovar lai str. 56601
uauaucuuaauuaa

SEQ ID NO: 742076 - RNA, 18 nt, Leptospira interrogans serovar lai str. 56601
uauaucuuaauuaaaaaa

SEQ ID NO: 742077 - RNA, 14 nt, Leptospira interrogans serovar lai str. 56601
uauaucuucuuugg

SEQ ID NO: 742078 - RNA, 12 nt, Leptospira interrogans serovar lai str. 56601
uauaaaauacca

SEQ ID NO: 742079 - RNA, 17 nt, Leptospira interrogans serovar lai str. 56601
uauaaaaucuuaaauua

SEQ ID NO: 742080 - RNA, 22 nt, Leptospira interrogans serovar lai str. 56601
uauaaaaguauaauauuuauuu

SEQ ID NO: 742081 - RNA, 14 nt, Leptospira interrogans serovar lai str. 56601
uauaaaauaaaaaa

SEQ ID NO: 742082 - RNA, 14 nt, Leptospira interrogans serovar lai str. 56601
uaguucuucgucua

SEQ ID NO: 742083 - RNA, 20 nt, Leptospira interrogans serovar lai str. 56601
uaguugcaccugguuuuuug

SEQ ID NO: 742084 - RNA, 14 nt, Leptospira interrogans serovar lai str. 56601
uauaaaguauagaa

SEQ ID NO: 742085 - RNA, 16 nt, Leptospira interrogans serovar lai str. 56601
uauaaaguuuuaguuu

SEQ ID NO: 742086 - RNA, 15 nt, Leptospira interrogans serovar lai str. 56601
uauaaaguugaaugu

SEQ ID NO: 742087 - RNA, 11 nt, Leptospira interrogans serovar lai str. 56601
uauaaauaaau

SEQ ID NO: 742088 - RNA, 16 nt, Leptospira interrogans serovar lai str. 56601
uauaaagauaaaucgu

SEQ ID NO: 742089 - RNA, 23 nt, Leptospira interrogans serovar lai str. 56601
uauaaagauaaaucguuugcuuu

SEQ ID NO: 742090 - RNA, 14 nt, Leptospira interrogans serovar lai str. 56601
uauaaacauauuau

SEQ ID NO: 742091 - RNA, 22 nt, Leptospira interrogans serovar lai str. 56601
uauaaaauuugaaaguaaaaaa

SEQ ID NO: 742092 - RNA, 12 nt, Leptospira interrogans serovar lai str. 56601
uauaaaaucaag

SEQ ID NO: 742093 - RNA, 16 nt, Leptospira interrogans serovar lai str. 56601
uauaaaauuuuucucc

SEQ ID NO: 742094 - RNA, 12 nt, Leptospira interrogans serovar lai str. 56601
uauaaaucaauc

SEQ ID NO: 742095 - RNA, 15 nt, Leptospira interrogans serovar lai str. 56601
uauaaauauuaauuu

SEQ ID NO: 742096 - RNA, 20 nt, Leptospira interrogans serovar lai str. 56601
uauaaauauuaauuuaaaaa

SEQ ID NO: 742097 - RNA, 14 nt, Leptospira interrogans serovar lai str. 56601
uauaaaucauacaa

SEQ ID NO: 742098 - RNA, 11 nt, Leptospira interrogans serovar lai str. 56601
uauaaaucauu

SEQ ID NO: 742099 - RNA, 18 nt, Leptospira interrogans serovar lai str. 56601
uauaaaugaauuuuaaau

SEQ ID NO: 742100 - RNA, 19 nt, Leptospira interrogans serovar lai str. 56601
uauaaaugaauuuuaaauu

SEQ ID NO: 742101 - RNA, 21 nt, Leptospira interrogans serovar lai str. 56601
uauaaaucuguacuuaaauuu

SEQ ID NO: 742102 - RNA, 20 nt, Leptospira interrogans serovar lai str. 56601
uauaaccuuugauagaacuc

SEQ ID NO: 742103 - RNA, 17 nt, Leptospira interrogans serovar lai str. 56601
uauaacgaaacuuuaau

SEQ ID NO: 742104 - RNA, 21 nt, Leptospira interrogans serovar lai str. 56601
uauaagaaucgauucagagug

SEQ ID NO: 742105 - RNA, 17 nt, Leptospira interrogans serovar lai str. 56601
uauaaccucaacauaaa

SEQ ID NO: 742106 - RNA, 23 nt, Leptospira interrogans serovar lai str. 56601
uauaaccucaacauaaaaacauc

SEQ ID NO: 742107 - RNA, 23 nt, Leptospira interrogans serovar lai str. 56601
uauaauguuaauuuagaauaaaa

SEQ ID NO: 742108 - RNA, 16 nt, Leptospira interrogans serovar lai str. 56601
uauaauguuugaauuu

SEQ ID NO: 742109 - RNA, 12 nt, Leptospira interrogans serovar lai str. 56601
uauaauuaaaaa

SEQ ID NO: 742110 - RNA, 23 nt, Leptospira interrogans serovar lai str. 56601
uauaaucuuuguaugaguuccca

SEQ ID NO: 742111 - RNA, 19 nt, Leptospira interrogans serovar lai str. 56601
uauaaucaaauacaaaaac

SEQ ID NO: 742112 - RNA, 16 nt, Leptospira interrogans serovar lai str. 56601
uauaaucuaagauuga

SEQ ID NO: 742113 - RNA, 17 nt, Leptospira interrogans serovar lai str. 56601
uauaaucugaaauagaa

SEQ ID NO: 742114 - RNA, 14 nt, Leptospira interrogans serovar lai str. 56601
uauaaucugauuga

SEQ ID NO: 742115 - RNA, 15 nt, Leptospira interrogans serovar lai str. 56601
uauaaucuuaauauu

SEQ ID NO: 742116 - RNA, 16 nt, Leptospira interrogans serovar lai str. 56601
uauaaugaacucuuuu

SEQ ID NO: 742117 - RNA, 21 nt, Leptospira interrogans serovar lai str. 56601
uauaaugaacucuuuuuauuu

SEQ ID NO: 742118 - RNA, 15 nt, Leptospira interrogans serovar lai str. 56601
uauaauuaauaaaac

SEQ ID NO: 742119 - RNA, 18 nt, Leptospira interrogans serovar lai str. 56601
uauaauuaauaaaacuga

SEQ ID NO: 742120 - RNA, 16 nt, Leptospira interrogans serovar lai str. 56601
uauaauuaaucauguu

SEQ ID NO: 742121 - RNA, 13 nt, Leptospira interrogans serovar lai str. 56601
uauaauuuaguuu

SEQ ID NO: 742122 - RNA, 18 nt, Leptospira interrogans serovar lai str. 56601
uauaauucuguaaaauaa

SEQ ID NO: 742123 - RNA, 22 nt, Leptospira interrogans serovar lai str. 56601
uauaauucuguaaaauaaauuu

SEQ ID NO: 742124 - RNA, 18 nt, Leptospira interrogans serovar lai str. 56601
uauaauucguuugaacuc

SEQ ID NO: 742125 - RNA, 16 nt, Leptospira interrogans serovar lai str. 56601
uauaauucguuuuuua

SEQ ID NO: 742126 - RNA, 19 nt, Leptospira interrogans serovar lai str. 56601
uauaauucguuuuuuaaaa

SEQ ID NO: 742127 - RNA, 12 nt, Leptospira interrogans serovar lai str. 56601
uauaauucuuua

SEQ ID NO: 742128 - RNA, 15 nt, Leptospira interrogans serovar lai str. 56601
uauaauucuuuaaaa

SEQ ID NO: 742129 - RNA, 22 nt, Leptospira interrogans serovar lai str. 56601
uauaauucuuuaaaauuuuuaa

SEQ ID NO: 742130 - RNA, 19 nt, Leptospira interrogans serovar lai str. 56601
uauaaggcgguaaaacaaa

SEQ ID NO: 742131 - RNA, 14 nt, Leptospira interrogans serovar lai str. 56601
uauaaguuaaauuu

SEQ ID NO: 742132 - RNA, 19 nt, Leptospira interrogans serovar lai str. 56601
uauaaguagaaauuuaauu

SEQ ID NO: 742133 - RNA, 13 nt, Leptospira interrogans serovar lai str. 56601
uauaauaacaaaa

SEQ ID NO: 742134 - RNA, 14 nt, Leptospira interrogans serovar lai str. 56601
uauaauaacaaaaa

SEQ ID NO: 742135 - RNA, 15 nt, Leptospira interrogans serovar lai str. 56601
uauaauaacaaaaaa

SEQ ID NO: 742136 - RNA, 15 nt, Leptospira interrogans serovar lai str. 56601
uauaaguuuuuauua

SEQ ID NO: 742137 - RNA, 17 nt, Leptospira interrogans serovar lai str. 56601
uauaaguuuuuauuaua

SEQ ID NO: 742138 - RNA, 20 nt, Leptospira interrogans serovar lai str. 56601
uauaaguuuuuauuauaaaa

SEQ ID NO: 742139 - RNA, 12 nt, Leptospira interrogans serovar lai str. 56601
uauaauaaaauc

SEQ ID NO: 742140 - RNA, 13 nt, Leptospira interrogans serovar lai str. 56601
uauaauaaaaucc

SEQ ID NO: 742141 - RNA, 16 nt, Leptospira interrogans serovar lai str. 56601
uauaauaaaauuaaca

SEQ ID NO: 742142 - RNA, 24 nt, Leptospira interrogans serovar lai str. 56601
uauaauaauuguugaauaucuaau

SEQ ID NO: 742143 - RNA, 12 nt, Leptospira interrogans serovar lai str. 56601
uauaauaaucuu

SEQ ID NO: 742144 - RNA, 22 nt, Leptospira interrogans serovar lai str. 56601
uauaauacaugaauucuaauuu

SEQ ID NO: 742145 - RNA, 23 nt, Leptospira interrogans serovar lai str. 56601
uauaauaguuacgacauuuuaau

SEQ ID NO: 742146 - RNA, 16 nt, Leptospira interrogans serovar lai str. 56601
uauaauauauauaaau

SEQ ID NO: 742147 - RNA, 15 nt, Leptospira interrogans serovar lai str. 56601
uauaauauucuuaug

SEQ ID NO: 742148 - RNA, 22 nt, Leptospira interrogans serovar lai str. 56601
uauaauauucuuauguuuuuua

SEQ ID NO: 742149 - RNA, 17 nt, Leptospira interrogans serovar lai str. 56601
uauaauauucuuuuaua

SEQ ID NO: 742150 - RNA, 21 nt, Leptospira interrogans serovar lai str. 56601
uauaauauucuuuuauauaau

SEQ ID NO: 742151 - RNA, 18 nt, Leptospira interrogans serovar lai str. 56601
uagguuguaacucaaaau

SEQ ID NO: 742152 - RNA, 14 nt, Leptospira interrogans serovar lai str. 56601
uaguaacuuucagc

SEQ ID NO: 742153 - RNA, 13 nt, Leptospira interrogans serovar lai str. 56601
uacuuuauuaaaa

SEQ ID NO: 742154 - RNA, 14 nt, Leptospira interrogans serovar lai str. 56601
uacuuuauuaaaaa

SEQ ID NO: 742155 - RNA, 15 nt, Leptospira interrogans serovar lai str. 56601
uacuuuauuaaaaag

SEQ ID NO: 742156 - RNA, 13 nt, Leptospira interrogans serovar lai str. 56601
uagucauauaaaa

SEQ ID NO: 742157 - RNA, 14 nt, Leptospira interrogans serovar lai str. 56601
uagucauauaaaag

SEQ ID NO: 742158 - RNA, 17 nt, Leptospira interrogans serovar lai str. 56601
uaguaauucuuacauua

SEQ ID NO: 742159 - RNA, 17 nt, Leptospira interrogans serovar lai str. 56601
uaguaauuuaauauauu

SEQ ID NO: 742160 - RNA, 19 nt, Leptospira interrogans serovar lai str. 56601
uaguuauaacguuauaaaa

SEQ ID NO: 742161 - RNA, 18 nt, Leptospira interrogans serovar lai str. 56601
uaguuauguuuuaaaaca

SEQ ID NO: 742162 - RNA, 14 nt, Leptospira interrogans serovar lai str. 56601
uaguucuauuuuau

SEQ ID NO: 742163 - RNA, 18 nt, Leptospira interrogans serovar lai str. 56601
uagugaagauuuguaaaa

SEQ ID NO: 742164 - RNA, 20 nt, Leptospira interrogans serovar lai str. 56601
uagucguguuguuuagacca

SEQ ID NO: 742165 - RNA, 14 nt, Leptospira interrogans serovar lai str. 56601
uagucucauacuua

SEQ ID NO: 742166 - RNA, 17 nt, Leptospira interrogans serovar lai str. 56601
uagucugaaauaaauuu

SEQ ID NO: 742167 - RNA, 16 nt, Leptospira interrogans serovar lai str. 56601
uccgcuguaugaaaac

SEQ ID NO: 742168 - RNA, 21 nt, Leptospira interrogans serovar lai str. 56601
uccggaugcgaguaauauuuu

SEQ ID NO: 742169 - RNA, 14 nt, Leptospira interrogans serovar lai str. 56601
uccggaagaacaac

SEQ ID NO: 742170 - RNA, 17 nt, Leptospira interrogans serovar lai str. 56601
uccggacuuuccagaaa

SEQ ID NO: 742171 - RNA, 19 nt, Leptospira interrogans serovar lai str. 56601
uccggcgugguuuaaaacu

SEQ ID NO: 742172 - RNA, 12 nt, Leptospira interrogans serovar lai str. 56601
uccggcuaaaaa

SEQ ID NO: 742173 - RNA, 19 nt, Leptospira interrogans serovar lai str. 56601
uccggcuaaaaaacugauu

SEQ ID NO: 742174 - RNA, 17 nt, Leptospira interrogans serovar lai str. 56601
uccgguaaguaauauau

SEQ ID NO: 742175 - RNA, 20 nt, Leptospira interrogans serovar lai str. 56601
uccgguaaauuuuuuagaaa

SEQ ID NO: 742176 - RNA, 21 nt, Leptospira interrogans serovar lai str. 56601
uccgggaggaauuuuuaaaaa

SEQ ID NO: 742177 - RNA, 13 nt, Leptospira interrogans serovar lai str. 56601
uccguaccccaaa

SEQ ID NO: 742178 - RNA, 17 nt, Leptospira interrogans serovar lai str. 56601
uccguacuguuuuugaa

SEQ ID NO: 742179 - RNA, 23 nt, Leptospira interrogans serovar lai str. 56601
uccguacuguuuuugaaacauuu

SEQ ID NO: 742180 - RNA, 19 nt, Leptospira interrogans serovar lai str. 56601
uccguagaucuuuuauaau

SEQ ID NO: 742181 - RNA, 22 nt, Leptospira interrogans serovar lai str. 56601
uccguaaaaaguuaauucuaaa

SEQ ID NO: 742182 - RNA, 12 nt, Leptospira interrogans serovar lai str. 56601
uccuaaaaccuc

SEQ ID NO: 742183 - RNA, 20 nt, Leptospira interrogans serovar lai str. 56601
uccuaaaaccucaaaaaauu

SEQ ID NO: 742184 - RNA, 13 nt, Leptospira interrogans serovar lai str. 56601
uccuaaaauaaaa

SEQ ID NO: 742185 - RNA, 19 nt, Leptospira interrogans serovar lai str. 56601
uccguuuuuauuucuuuug

SEQ ID NO: 742186 - RNA, 23 nt, Leptospira interrogans serovar lai str. 56601
uccguuuuuaaucgcagguugca

SEQ ID NO: 742187 - RNA, 13 nt, Leptospira interrogans serovar lai str. 56601
uccguuuuaaaau

SEQ ID NO: 742188 - RNA, 14 nt, Leptospira interrogans serovar lai str. 56601
uccguuauauuaaa

SEQ ID NO: 742189 - RNA, 15 nt, Leptospira interrogans serovar lai str. 56601
uccguuauauuaaaa

SEQ ID NO: 742190 - RNA, 13 nt, Leptospira interrogans serovar lai str. 56601
uccgucguuugca

SEQ ID NO: 742191 - RNA, 17 nt, Leptospira interrogans serovar lai str. 56601
uccuacuccggcuaaaa

SEQ ID NO: 742192 - RNA, 18 nt, Leptospira interrogans serovar lai str. 56601
uccuacuuauuucuauaa

SEQ ID NO: 742193 - RNA, 19 nt, Leptospira interrogans serovar lai str. 56601
uccuacuuauuucuauaaa

SEQ ID NO: 742194 - RNA, 15 nt, Leptospira interrogans serovar lai str. 56601
uccuacauuuuaaaa

SEQ ID NO: 742195 - RNA, 12 nt, Leptospira interrogans serovar lai str. 56601
uccuacauuuuc

SEQ ID NO: 742196 - RNA, 12 nt, Leptospira interrogans serovar lai str. 56601
uccuacauuuuu

SEQ ID NO: 742197 - RNA, 16 nt, Leptospira interrogans serovar lai str. 56601
uccuacaauuuuagaa

SEQ ID NO: 742198 - RNA, 14 nt, Leptospira interrogans serovar lai str. 56601
uccuacaguuuuag

SEQ ID NO: 742199 - RNA, 18 nt, Leptospira interrogans serovar lai str. 56601
uccuaaugcagcuucuuc

SEQ ID NO: 742200 - RNA, 19 nt, Leptospira interrogans serovar lai str. 56601
uccuaaugcagcuucuucc

SEQ ID NO: 742201 - RNA, 20 nt, Leptospira interrogans serovar lai str. 56601
uccuaaugcagcuucuucca

SEQ ID NO: 742202 - RNA, 16 nt, Leptospira interrogans serovar lai str. 56601
uccuaaugaaaaagaa

SEQ ID NO: 742203 - RNA, 20 nt, Leptospira interrogans serovar lai str. 56601
uccuaaaauuuuaaaaaauu

SEQ ID NO: 742204 - RNA, 23 nt, Leptospira interrogans serovar lai str. 56601
uccuauguuucuugugucaagcc

SEQ ID NO: 742205 - RNA, 19 nt, Leptospira interrogans serovar lai str. 56601
uccuauucaacuugugggg

SEQ ID NO: 742206 - RNA, 14 nt, Leptospira interrogans serovar lai str. 56601
uccucaacagauac

SEQ ID NO: 742207 - RNA, 18 nt, Leptospira interrogans serovar lai str. 56601
uccucaacggguucuuca

SEQ ID NO: 742208 - RNA, 16 nt, Leptospira interrogans serovar lai str. 56601
uccugucaauuuucca

SEQ ID NO: 742209 - RNA, 17 nt, Leptospira interrogans serovar lai str. 56601
uccuguaaauucaaaau

SEQ ID NO: 742210 - RNA, 19 nt, Leptospira interrogans serovar lai str. 56601
uccuucaaaacuaggaucu

SEQ ID NO: 742211 - RNA, 17 nt, Leptospira interrogans serovar lai str. 56601
uccuuacgaucuaaaag

SEQ ID NO: 742212 - RNA, 19 nt, Leptospira interrogans serovar lai str. 56601
uccuuacgaucuaaaagga

SEQ ID NO: 742213 - RNA, 20 nt, Leptospira interrogans serovar lai str. 56601
uccuuacgaugucuuuucaa

SEQ ID NO: 742214 - RNA, 22 nt, Leptospira interrogans serovar lai str. 56601
uccuuacucguuuuuaguuucu

SEQ ID NO: 742215 - RNA, 22 nt, Leptospira interrogans serovar lai str. 56601
uccuuaagacccuaaaaaauuu

SEQ ID NO: 742216 - RNA, 16 nt, Leptospira interrogans serovar lai str. 56601
uccuuaaauauaucuu

SEQ ID NO: 742217 - RNA, 20 nt, Leptospira interrogans serovar lai str. 56601
uccuuaaauauaucuucuuu

SEQ ID NO: 742218 - RNA, 13 nt, Leptospira interrogans serovar lai str. 56601
uccucuaugaaac

SEQ ID NO: 742219 - RNA, 18 nt, Leptospira interrogans serovar lai str. 56601
uccucugauaaaaucacg

SEQ ID NO: 742220 - RNA, 20 nt, Leptospira interrogans serovar lai str. 56601
uccucuuucguuuuuuucau

SEQ ID NO: 742221 - RNA, 21 nt, Leptospira interrogans serovar lai str. 56601
uccugaucuauguuauagaca

SEQ ID NO: 742222 - RNA, 23 nt, Leptospira interrogans serovar lai str. 56601
uccuccaaacaauuuuuugaaaa

SEQ ID NO: 742223 - RNA, 22 nt, Leptospira interrogans serovar lai str. 56601
uccuccugaaaauuuuccuuua

SEQ ID NO: 742224 - RNA, 13 nt, Leptospira interrogans serovar lai str. 56601
uccucuaaaaugc

SEQ ID NO: 742225 - RNA, 17 nt, Leptospira interrogans serovar lai str. 56601
ucgcauaacauuuugcu

SEQ ID NO: 742226 - RNA, 17 nt, Leptospira interrogans serovar lai str. 56601
ucgcacgucccacaaau

SEQ ID NO: 742227 - RNA, 20 nt, Leptospira interrogans serovar lai str. 56601
ucgcacgucccacaaaucga

SEQ ID NO: 742228 - RNA, 15 nt, Leptospira interrogans serovar lai str. 56601
ucgcaaauaauaaaa

SEQ ID NO: 742229 - RNA, 19 nt, Leptospira interrogans serovar lai str. 56601
ucgcaacauaauguuucaa

SEQ ID NO: 742230 - RNA, 20 nt, Leptospira interrogans serovar lai str. 56601
ucgcaacauaauguuucaau

SEQ ID NO: 742231 - RNA, 16 nt, Leptospira interrogans serovar lai str. 56601
ucgcaaguugauuaug

SEQ ID NO: 742232 - RNA, 14 nt, Leptospira interrogans serovar lai str. 56601
ucgaucuacuaaau

SEQ ID NO: 742233 - RNA, 24 nt, Leptospira interrogans serovar lai str. 56601
ucgauccuguuuauaaccccuaag

SEQ ID NO: 742234 - RNA, 14 nt, Leptospira interrogans serovar lai str. 56601
ucgaucuguaaaau

SEQ ID NO: 742235 - RNA, 19 nt, Leptospira interrogans serovar lai str. 56601
ucgauucugauaacuauau

SEQ ID NO: 742236 - RNA, 14 nt, Leptospira interrogans serovar lai str. 56601
ucgauuuaauauau

SEQ ID NO: 742237 - RNA, 14 nt, Leptospira interrogans serovar lai str. 56601
ucgauuucuaaaau

SEQ ID NO: 742238 - RNA, 15 nt, Leptospira interrogans serovar lai str. 56601
ucgauuucuaaaaug

SEQ ID NO: 742239 - RNA, 12 nt, Leptospira interrogans serovar lai str. 56601
ucgauuuaaaaa

SEQ ID NO: 742240 - RNA, 13 nt, Leptospira interrogans serovar lai str. 56601
ucgauuuguaaaa

SEQ ID NO: 742241 - RNA, 15 nt, Leptospira interrogans serovar lai str. 56601
ucgauuuguaaaauu

SEQ ID NO: 742242 - RNA, 18 nt, Leptospira interrogans serovar lai str. 56601
ucgauuuguaaaauucag

SEQ ID NO: 742243 - RNA, 15 nt, Leptospira interrogans serovar lai str. 56601
ucgauuucuaauauu

SEQ ID NO: 742244 - RNA, 16 nt, Leptospira interrogans serovar lai str. 56601
ucgauuucuaauauua

SEQ ID NO: 742245 - RNA, 22 nt, Leptospira interrogans serovar lai str. 56601
ucgauuucuaauauuaaaaaca

SEQ ID NO: 742246 - RNA, 17 nt, Leptospira interrogans serovar lai str. 56601
ucgauuugaucuacaau

SEQ ID NO: 742247 - RNA, 17 nt, Leptospira interrogans serovar lai str. 56601
ucgcaaaaaaaauucga

SEQ ID NO: 742248 - RNA, 19 nt, Leptospira interrogans serovar lai str. 56601
ucgauuuuaaauaaaaaga

SEQ ID NO: 742249 - RNA, 23 nt, Leptospira interrogans serovar lai str. 56601
ucgauuuuacagagauauagaaa

SEQ ID NO: 742250 - RNA, 12 nt, Leptospira interrogans serovar lai str. 56601
ucgauuuuucga

SEQ ID NO: 742251 - RNA, 19 nt, Leptospira interrogans serovar lai str. 56601
ucgauuacucuuugagaaa

SEQ ID NO: 742252 - RNA, 20 nt, Leptospira interrogans serovar lai str. 56601
ucgauuccuaaaauguggga

SEQ ID NO: 742253 - RNA, 18 nt, Leptospira interrogans serovar lai str. 56601
ucgaugguuucaauuuaa

SEQ ID NO: 742254 - RNA, 17 nt, Leptospira interrogans serovar lai str. 56601
ucgauguaagaaaauau

SEQ ID NO: 742255 - RNA, 17 nt, Leptospira interrogans serovar lai str. 56601
ucgauaaaguaaaauua

SEQ ID NO: 742256 - RNA, 19 nt, Leptospira interrogans serovar lai str. 56601
ucgaguguaaucuuauuuu

SEQ ID NO: 742257 - RNA, 23 nt, Leptospira interrogans serovar lai str. 56601
ucgauaauucuuuagaaauuuuu

SEQ ID NO: 742258 - RNA, 15 nt, Leptospira interrogans serovar lai str. 56601
ucgacuuuaguucuc

SEQ ID NO: 742259 - RNA, 16 nt, Leptospira interrogans serovar lai str. 56601
ucgacuauuucuucca

SEQ ID NO: 742260 - RNA, 20 nt, Leptospira interrogans serovar lai str. 56601
ucgagauguugaguuucuuu

SEQ ID NO: 742261 - RNA, 18 nt, Leptospira interrogans serovar lai str. 56601
ucgacagguuuuggaaca

SEQ ID NO: 742262 - RNA, 17 nt, Leptospira interrogans serovar lai str. 56601
ucgacauaagaaagaau

SEQ ID NO: 742263 - RNA, 15 nt, Leptospira interrogans serovar lai str. 56601
ucgaccguuuccaug

SEQ ID NO: 742264 - RNA, 22 nt, Leptospira interrogans serovar lai str. 56601
ucgacauuccccaaguaaaauu

SEQ ID NO: 742265 - RNA, 15 nt, Leptospira interrogans serovar lai str. 56601
ucgacguaaagaauu

SEQ ID NO: 742266 - RNA, 18 nt, Leptospira interrogans serovar lai str. 56601
ucgacguaaagaauucau

SEQ ID NO: 742267 - RNA, 14 nt, Leptospira interrogans serovar lai str. 56601
ucgacguaagaaua

SEQ ID NO: 742268 - RNA, 19 nt, Leptospira interrogans serovar lai str. 56601
ucgacgauuuuacgaacaa

SEQ ID NO: 742269 - RNA, 16 nt, Leptospira interrogans serovar lai str. 56601
ucgaccuuaacucuua

SEQ ID NO: 742270 - RNA, 12 nt, Leptospira interrogans serovar lai str. 56601
ucgaauaagaaa

SEQ ID NO: 742271 - RNA, 16 nt, Leptospira interrogans serovar lai str. 56601
ucgaauacauuuaaac

SEQ ID NO: 742272 - RNA, 20 nt, Leptospira interrogans serovar lai str. 56601
ucgaauacauuuaaacuuuu

SEQ ID NO: 742273 - RNA, 21 nt, Leptospira interrogans serovar lai str. 56601
ucgaaucgcuaaacuaucuau

SEQ ID NO: 742274 - RNA, 15 nt, Leptospira interrogans serovar lai str. 56601
ucgaauuuuaguucu

SEQ ID NO: 742275 - RNA, 17 nt, Leptospira interrogans serovar lai str. 56601
ucgaauggaauuuauua

SEQ ID NO: 742276 - RNA, 18 nt, Leptospira interrogans serovar lai str. 56601
ucgaauucuuucuauuuu

SEQ ID NO: 742277 - RNA, 17 nt, Leptospira interrogans serovar lai str. 56601
ucgaauuuuuucacaaa

SEQ ID NO: 742278 - RNA, 19 nt, Leptospira interrogans serovar lai str. 56601
ucgaacgcaugaaaauaau

SEQ ID NO: 742279 - RNA, 19 nt, Leptospira interrogans serovar lai str. 56601
ucgaacguauaaaaacggu

SEQ ID NO: 742280 - RNA, 12 nt, Leptospira interrogans serovar lai str. 56601
ucgaacuaccca

SEQ ID NO: 742281 - RNA, 15 nt, Leptospira interrogans serovar lai str. 56601
ucgaacuacccaaaa

SEQ ID NO: 742282 - RNA, 17 nt, Leptospira interrogans serovar lai str. 56601
ucgaacuuuuuuuagaa

SEQ ID NO: 742283 - RNA, 21 nt, Leptospira interrogans serovar lai str. 56601
uccuuuucgaauuuccuuuug

SEQ ID NO: 742284 - RNA, 14 nt, Leptospira interrogans serovar lai str. 56601
uccuuuucuuauaa

SEQ ID NO: 742285 - RNA, 16 nt, Leptospira interrogans serovar lai str. 56601
uccuuuucuugguuca

SEQ ID NO: 742286 - RNA, 17 nt, Leptospira interrogans serovar lai str. 56601
uccuuuucuuuuuuaaa

SEQ ID NO: 742287 - RNA, 22 nt, Leptospira interrogans serovar lai str. 56601
uccuuuuacuucguuauaauuu

SEQ ID NO: 742288 - RNA, 20 nt, Leptospira interrogans serovar lai str. 56601
uccuuucgacuuuaguucuc

SEQ ID NO: 742289 - RNA, 12 nt, Leptospira interrogans serovar lai str. 56601
ucgaaaaaacaa

SEQ ID NO: 742290 - RNA, 20 nt, Leptospira interrogans serovar lai str. 56601
uccuuuuuuucuuuuaaaag

SEQ ID NO: 742291 - RNA, 13 nt, Leptospira interrogans serovar lai str. 56601
ucgaaaagaaaua

SEQ ID NO: 742292 - RNA, 23 nt, Leptospira interrogans serovar lai str. 56601
ucgaaaagaaauauuaaaaaaau

SEQ ID NO: 742293 - RNA, 12 nt, Leptospira interrogans serovar lai str. 56601
ucgaaaaguuuu

SEQ ID NO: 742294 - RNA, 19 nt, Leptospira interrogans serovar lai str. 56601
uccuuuuuguaaggauucc

SEQ ID NO: 742295 - RNA, 23 nt, Leptospira interrogans serovar lai str. 56601
uccuuuuuguaaggauuccuuuc

SEQ ID NO: 742296 - RNA, 12 nt, Leptospira interrogans serovar lai str. 56601
uccuuuuucauu

SEQ ID NO: 742297 - RNA, 18 nt, Leptospira interrogans serovar lai str. 56601
uccuuuuucauuuuuaag

SEQ ID NO: 742298 - RNA, 20 nt, Leptospira interrogans serovar lai str. 56601
uccuuuugagcacaauauau

SEQ ID NO: 742299 - RNA, 22 nt, Leptospira interrogans serovar lai str. 56601
uccuuuugagcacaauauauuc

SEQ ID NO: 742300 - RNA, 19 nt, Leptospira interrogans serovar lai str. 56601
uccuuuuuaaaaccaaaau

SEQ ID NO: 742301 - RNA, 21 nt, Leptospira interrogans serovar lai str. 56601
ucgaaaguuuacaaauuggca

SEQ ID NO: 742302 - RNA, 15 nt, Leptospira interrogans serovar lai str. 56601
ucgaaauaucguucu

SEQ ID NO: 742303 - RNA, 15 nt, Leptospira interrogans serovar lai str. 56601
ucgaaacuauaacgg

SEQ ID NO: 742304 - RNA, 17 nt, Leptospira interrogans serovar lai str. 56601
ucgaaacuguauuauaa

SEQ ID NO: 742305 - RNA, 16 nt, Leptospira interrogans serovar lai str. 56601
ucgaaagauuuuucau

SEQ ID NO: 742306 - RNA, 12 nt, Leptospira interrogans serovar lai str. 56601
ucgaaaaucuca

SEQ ID NO: 742307 - RNA, 16 nt, Leptospira interrogans serovar lai str. 56601
ucgaaaaucucagaaa

SEQ ID NO: 742308 - RNA, 20 nt, Leptospira interrogans serovar lai str. 56601
ucgaaaauuuuaaguucaga

SEQ ID NO: 742309 - RNA, 19 nt, Leptospira interrogans serovar lai str. 56601
uccuugggauaaauauucu

SEQ ID NO: 742310 - RNA, 16 nt, Leptospira interrogans serovar lai str. 56601
uccuugugcaauaauu

SEQ ID NO: 742311 - RNA, 23 nt, Leptospira interrogans serovar lai str. 56601
uccuuuaaauugaauucuuccuu

SEQ ID NO: 742312 - RNA, 20 nt, Leptospira interrogans serovar lai str. 56601
uccuuuaauauuuucagaag

SEQ ID NO: 742313 - RNA, 20 nt, Leptospira interrogans serovar lai str. 56601
uccuuucaucucuauaaauu

SEQ ID NO: 742314 - RNA, 14 nt, Leptospira interrogans serovar lai str. 56601
uccuucgaaaaacc

SEQ ID NO: 742315 - RNA, 23 nt, Leptospira interrogans serovar lai str. 56601
uccuucggugauacugucaccgu

SEQ ID NO: 742316 - RNA, 14 nt, Leptospira interrogans serovar lai str. 56601
uccuugaaaaaaaa

SEQ ID NO: 742317 - RNA, 12 nt, Leptospira interrogans serovar lai str. 56601
uccuucuuuucu

SEQ ID NO: 742318 - RNA, 16 nt, Leptospira interrogans serovar lai str. 56601
uccuucuuuucuucuu

SEQ ID NO: 742319 - RNA, 20 nt, Leptospira interrogans serovar lai str. 56601
uccuucuuuacaguuuuuaa

SEQ ID NO: 742320 - RNA, 21 nt, Leptospira interrogans serovar lai str. 56601
uccuucuuuacaguuuuuaau

SEQ ID NO: 742321 - RNA, 19 nt, Leptospira interrogans serovar lai str. 56601
uccgauuugguuuucauuc

SEQ ID NO: 742322 - RNA, 14 nt, Leptospira interrogans serovar lai str. 56601
uccgaucauuugaa

SEQ ID NO: 742323 - RNA, 19 nt, Leptospira interrogans serovar lai str. 56601
aaaucuguacuuaaauuuu

SEQ ID NO: 742324 - RNA, 16 nt, Leptospira interrogans serovar lai str. 56601
uccgaauugaucucau

SEQ ID NO: 742325 - RNA, 21 nt, Leptospira interrogans serovar lai str. 56601
aaaucugaaaaagagcaaagg

SEQ ID NO: 742326 - RNA, 11 nt, Leptospira interrogans serovar lai str. 56601
aaaucugaccu

SEQ ID NO: 742327 - RNA, 14 nt, Leptospira interrogans serovar lai str. 56601
aaaucugaaauuca

SEQ ID NO: 742328 - RNA, 19 nt, Leptospira interrogans serovar lai str. 56601
aaaucugaaauucaucaaa

SEQ ID NO: 742329 - RNA, 21 nt, Leptospira interrogans serovar lai str. 56601
aaaucugaacauaaaaucgau

SEQ ID NO: 742330 - RNA, 17 nt, Leptospira interrogans serovar lai str. 56601
aaaucuuaaaagaaaau

SEQ ID NO: 742331 - RNA, 20 nt, Leptospira interrogans serovar lai str. 56601
aaaucuuaauaaaauuuuca

SEQ ID NO: 742332 - RNA, 16 nt, Leptospira interrogans serovar lai str. 56601
uccgaaaggaaaagaa

SEQ ID NO: 742333 - RNA, 14 nt, Leptospira interrogans serovar lai str. 56601
uccgaaaucccaaa

SEQ ID NO: 742334 - RNA, 16 nt, Leptospira interrogans serovar lai str. 56601
uccgaaaucccaaaac

SEQ ID NO: 742335 - RNA, 17 nt, Leptospira interrogans serovar lai str. 56601
ucccuuuugaucuuuaa

SEQ ID NO: 742336 - RNA, 18 nt, Leptospira interrogans serovar lai str. 56601
ucccuuuugaucuuuaaa

SEQ ID NO: 742337 - RNA, 15 nt, Leptospira interrogans serovar lai str. 56601
ucccuugagaaauca

SEQ ID NO: 742338 - RNA, 14 nt, Leptospira interrogans serovar lai str. 56601
uccgaaccuuacca

SEQ ID NO: 742339 - RNA, 19 nt, Leptospira interrogans serovar lai str. 56601
uccgaaggaauugcagcau

SEQ ID NO: 742340 - RNA, 15 nt, Leptospira interrogans serovar lai str. 56601
uccgaauucuaaaau

SEQ ID NO: 742341 - RNA, 13 nt, Leptospira interrogans serovar lai str. 56601
ucccguuuagaaa

SEQ ID NO: 742342 - RNA, 21 nt, Leptospira interrogans serovar lai str. 56601
ucccuauuguauuugauuuua

SEQ ID NO: 742343 - RNA, 23 nt, Leptospira interrogans serovar lai str. 56601
ucccucuucuagcaaucuuccug

SEQ ID NO: 742344 - RNA, 17 nt, Leptospira interrogans serovar lai str. 56601
ucccugauaacucaguu

SEQ ID NO: 742345 - RNA, 17 nt, Leptospira interrogans serovar lai str. 56601
ucccuuaccuccuuuuu

SEQ ID NO: 742346 - RNA, 18 nt, Leptospira interrogans serovar lai str. 56601
ucccuuaccuccuuuuuc

SEQ ID NO: 742347 - RNA, 22 nt, Leptospira interrogans serovar lai str. 56601
ucccgcuggaaaaugaaaacga

SEQ ID NO: 742348 - RNA, 13 nt, Leptospira interrogans serovar lai str. 56601
ucccgccaaaaau

SEQ ID NO: 742349 - RNA, 14 nt, Leptospira interrogans serovar lai str. 56601
ucccgcccaaagua

SEQ ID NO: 742350 - RNA, 13 nt, Leptospira interrogans serovar lai str. 56601
uccccuuucuaau

SEQ ID NO: 742351 - RNA, 14 nt, Leptospira interrogans serovar lai str. 56601
uccccuuucuaauc

SEQ ID NO: 742352 - RNA, 14 nt, Leptospira interrogans serovar lai str. 56601
ucccgauucucaaa

SEQ ID NO: 742353 - RNA, 17 nt, Leptospira interrogans serovar lai str. 56601
ucccgauucucaaaaug

SEQ ID NO: 742354 - RNA, 23 nt, Leptospira interrogans serovar lai str. 56601
ucccccuuccgauucacuuccau

SEQ ID NO: 742355 - RNA, 15 nt, Leptospira interrogans serovar lai str. 56601
ucccacuuauaauaa

SEQ ID NO: 742356 - RNA, 14 nt, Leptospira interrogans serovar lai str. 56601
ucccacuuuuaaag

SEQ ID NO: 742357 - RNA, 15 nt, Leptospira interrogans serovar lai str. 56601
ucccacuuuuaaaga

SEQ ID NO: 742358 - RNA, 18 nt, Leptospira interrogans serovar lai str. 56601
ucccagaaaggaacuaag

SEQ ID NO: 742359 - RNA, 14 nt, Leptospira interrogans serovar lai str. 56601
ucccauaaaagaac

SEQ ID NO: 742360 - RNA, 20 nt, Leptospira interrogans serovar lai str. 56601
ucccauccgaaaucccaaaa

SEQ ID NO: 742361 - RNA, 12 nt, Leptospira interrogans serovar lai str. 56601
ucccaguaaauc

SEQ ID NO: 742362 - RNA, 14 nt, Leptospira interrogans serovar lai str. 56601
ucccaguaaaucca

SEQ ID NO: 742363 - RNA, 14 nt, Leptospira interrogans serovar lai str. 56601
ucccaguucuuaaa

SEQ ID NO: 742364 - RNA, 14 nt, Leptospira interrogans serovar lai str. 56601
ucccauuuuaacgu

SEQ ID NO: 742365 - RNA, 15 nt, Leptospira interrogans serovar lai str. 56601
uccccaagacgucua

SEQ ID NO: 742366 - RNA, 14 nt, Leptospira interrogans serovar lai str. 56601
ucccccaacugaaa

SEQ ID NO: 742367 - RNA, 23 nt, Leptospira interrogans serovar lai str. 56601
ucccccaacugaaaaugaccaaa

SEQ ID NO: 742368 - RNA, 18 nt, Leptospira interrogans serovar lai str. 56601
ucccaaaaacucaaagaa

SEQ ID NO: 742369 - RNA, 14 nt, Leptospira interrogans serovar lai str. 56601
ucccaaaaccgaau

SEQ ID NO: 742370 - RNA, 17 nt, Leptospira interrogans serovar lai str. 56601
ucccaaaaccucaaaaa

SEQ ID NO: 742371 - RNA, 19 nt, Leptospira interrogans serovar lai str. 56601
ucccaaaaccucaaaaaau

SEQ ID NO: 742372 - RNA, 16 nt, Leptospira interrogans serovar lai str. 56601
uccauuuguuucuauu

SEQ ID NO: 742373 - RNA, 12 nt, Leptospira interrogans serovar lai str. 56601
uccauucuaaaa

SEQ ID NO: 742374 - RNA, 13 nt, Leptospira interrogans serovar lai str. 56601
uccauugauuuuc

SEQ ID NO: 742375 - RNA, 16 nt, Leptospira interrogans serovar lai str. 56601
uccauugauuuucauu

SEQ ID NO: 742376 - RNA, 20 nt, Leptospira interrogans serovar lai str. 56601
ucccaaacuuucuuuuucuu

SEQ ID NO: 742377 - RNA, 17 nt, Leptospira interrogans serovar lai str. 56601
ucccaaauucuuuccuu

SEQ ID NO: 742378 - RNA, 22 nt, Leptospira interrogans serovar lai str. 56601
ucccaaaccucguacuaauucu

SEQ ID NO: 742379 - RNA, 20 nt, Leptospira interrogans serovar lai str. 56601
ucccaaaaucuuaaaagaaa

SEQ ID NO: 742380 - RNA, 18 nt, Leptospira interrogans serovar lai str. 56601
ucccaaaauuucuaaagu

SEQ ID NO: 742381 - RNA, 14 nt, Leptospira interrogans serovar lai str. 56601
ucccaacugcugga

SEQ ID NO: 742382 - RNA, 15 nt, Leptospira interrogans serovar lai str. 56601
ucccacaauuuugaa

SEQ ID NO: 742383 - RNA, 14 nt, Leptospira interrogans serovar lai str. 56601
ucccacaaauuaag

SEQ ID NO: 742384 - RNA, 17 nt, Leptospira interrogans serovar lai str. 56601
ucccacaaauuccugcc

SEQ ID NO: 742385 - RNA, 22 nt, Leptospira interrogans serovar lai str. 56601
ucccacaaauuccugccuucuc

SEQ ID NO: 742386 - RNA, 18 nt, Leptospira interrogans serovar lai str. 56601
ucccacauuuaaauuaau

SEQ ID NO: 742387 - RNA, 16 nt, Leptospira interrogans serovar lai str. 56601
ucccacauuucaaagu

SEQ ID NO: 742388 - RNA, 22 nt, Leptospira interrogans serovar lai str. 56601
ucccacauuugugggaacucau

SEQ ID NO: 742389 - RNA, 16 nt, Leptospira interrogans serovar lai str. 56601
ucccacauuuuaaaga

SEQ ID NO: 742390 - RNA, 16 nt, Leptospira interrogans serovar lai str. 56601
ucccacauuuuaaagu

SEQ ID NO: 742391 - RNA, 16 nt, Leptospira interrogans serovar lai str. 56601
ucccacauuuuagaaa

SEQ ID NO: 742392 - RNA, 14 nt, Leptospira interrogans serovar lai str. 56601
ucccacauuuucaa

SEQ ID NO: 742393 - RNA, 16 nt, Leptospira interrogans serovar lai str. 56601
ucccacauuuucaaaa

SEQ ID NO: 742394 - RNA, 15 nt, Leptospira interrogans serovar lai str. 56601
ucccacauuuuuaaa

SEQ ID NO: 742395 - RNA, 20 nt, Leptospira interrogans serovar lai str. 56601
ucccacauuuuuaaaaguua

SEQ ID NO: 742396 - RNA, 17 nt, Leptospira interrogans serovar lai str. 56601
ucccacauuuuucaaau

SEQ ID NO: 742397 - RNA, 23 nt, Leptospira interrogans serovar lai str. 56601
uccaucguuuaagaauuuuaaaa

SEQ ID NO: 742398 - RNA, 21 nt, Leptospira interrogans serovar lai str. 56601
uccaucguuuauuuuucuaaa

SEQ ID NO: 742399 - RNA, 23 nt, Leptospira interrogans serovar lai str. 56601
uccaucguuuauuuuucuaaaaa

SEQ ID NO: 742400 - RNA, 17 nt, Leptospira interrogans serovar lai str. 56601
uccaucuuuuuuuucua

SEQ ID NO: 742401 - RNA, 21 nt, Leptospira interrogans serovar lai str. 56601
uccaucuuuuuuuucuaaaau

SEQ ID NO: 742402 - RNA, 22 nt, Leptospira interrogans serovar lai str. 56601
uccaucuuuuuuuucuaaaaua

SEQ ID NO: 742403 - RNA, 19 nt, Leptospira interrogans serovar lai str. 56601
uccaucuuuauaucuugaa

SEQ ID NO: 742404 - RNA, 16 nt, Leptospira interrogans serovar lai str. 56601
uccaugguuuuuucaa

SEQ ID NO: 742405 - RNA, 10 nt, Leptospira interrogans serovar lai str. 56601
uccaugauuc

SEQ ID NO: 742406 - RNA, 18 nt, Leptospira interrogans serovar lai str. 56601
uccaugauucauuuuucu

SEQ ID NO: 742407 - RNA, 14 nt, Leptospira interrogans serovar lai str. 56601
uccaugauucugaa

SEQ ID NO: 742408 - RNA, 15 nt, Leptospira interrogans serovar lai str. 56601
uccaugauucugaaa

SEQ ID NO: 742409 - RNA, 16 nt, Leptospira interrogans serovar lai str. 56601
uccaugauucugaaaa

SEQ ID NO: 742410 - RNA, 22 nt, Leptospira interrogans serovar lai str. 56601
uccauagugaagauuuguaaaa

SEQ ID NO: 742411 - RNA, 16 nt, Leptospira interrogans serovar lai str. 56601
uccaucaaauacaaaa

SEQ ID NO: 742412 - RNA, 21 nt, Leptospira interrogans serovar lai str. 56601
uccauagaguguuguguugag

SEQ ID NO: 742413 - RNA, 14 nt, Leptospira interrogans serovar lai str. 56601
uccacuugaauaga

SEQ ID NO: 742414 - RNA, 14 nt, Leptospira interrogans serovar lai str. 56601
uccacuuuaaaaau

SEQ ID NO: 742415 - RNA, 15 nt, Leptospira interrogans serovar lai str. 56601
uccagaaccucaaag

SEQ ID NO: 742416 - RNA, 17 nt, Leptospira interrogans serovar lai str. 56601
uccagcauuuagaaagc

SEQ ID NO: 742417 - RNA, 15 nt, Leptospira interrogans serovar lai str. 56601
uccagaauaauaauc

SEQ ID NO: 742418 - RNA, 16 nt, Leptospira interrogans serovar lai str. 56601
uccagaagauugaaag

SEQ ID NO: 742419 - RNA, 17 nt, Leptospira interrogans serovar lai str. 56601
uccaauguggcagcuac

SEQ ID NO: 742420 - RNA, 13 nt, Leptospira interrogans serovar lai str. 56601
uccaauuauaaaa

SEQ ID NO: 742421 - RNA, 22 nt, Leptospira interrogans serovar lai str. 56601
uccacgaauugccgauucuaac

SEQ ID NO: 742422 - RNA, 22 nt, Leptospira interrogans serovar lai str. 56601
uccacgauugauuuuggaaaga

SEQ ID NO: 742423 - RNA, 19 nt, Leptospira interrogans serovar lai str. 56601
uccacccgcaaucggagaa

SEQ ID NO: 742424 - RNA, 14 nt, Leptospira interrogans serovar lai str. 56601
uccaauaauuuaac

SEQ ID NO: 742425 - RNA, 15 nt, Leptospira interrogans serovar lai str. 56601
uccaauacaaaacaa

SEQ ID NO: 742426 - RNA, 22 nt, Leptospira interrogans serovar lai str. 56601
uccaagggaagguuuuguaaaa

SEQ ID NO: 742427 - RNA, 17 nt, Leptospira interrogans serovar lai str. 56601
uccaaguaggaauugga

SEQ ID NO: 742428 - RNA, 22 nt, Leptospira interrogans serovar lai str. 56601
uccaaucgccucuugaagccuu

SEQ ID NO: 742429 - RNA, 15 nt, Leptospira interrogans serovar lai str. 56601
uccaaucucuuucgg

SEQ ID NO: 742430 - RNA, 13 nt, Leptospira interrogans serovar lai str. 56601
uccaaucaugaau

SEQ ID NO: 742431 - RNA, 13 nt, Leptospira interrogans serovar lai str. 56601
uccaauccaaaau

SEQ ID NO: 742432 - RNA, 14 nt, Leptospira interrogans serovar lai str. 56601
uccaauccaaaauu

SEQ ID NO: 742433 - RNA, 15 nt, Leptospira interrogans serovar lai str. 56601
uccaaucaaauuuuu

SEQ ID NO: 742434 - RNA, 13 nt, Leptospira interrogans serovar lai str. 56601
uccaauauuuaug

SEQ ID NO: 742435 - RNA, 21 nt, Leptospira interrogans serovar lai str. 56601
uccaauauuuaugcuuuaauc

SEQ ID NO: 742436 - RNA, 15 nt, Leptospira interrogans serovar lai str. 56601
uccaacguaccaaaa

SEQ ID NO: 742437 - RNA, 18 nt, Leptospira interrogans serovar lai str. 56601
uccaacguaccaaaaccc

SEQ ID NO: 742438 - RNA, 16 nt, Leptospira interrogans serovar lai str. 56601
uccaagauuuuuuaau

SEQ ID NO: 742439 - RNA, 20 nt, Leptospira interrogans serovar lai str. 56601
uccaagaacguuuccagaaa

SEQ ID NO: 742440 - RNA, 16 nt, Leptospira interrogans serovar lai str. 56601
uccaacuuaaaacugu

SEQ ID NO: 742441 - RNA, 17 nt, Leptospira interrogans serovar lai str. 56601
uccaaauuguaugaaga

SEQ ID NO: 742442 - RNA, 17 nt, Leptospira interrogans serovar lai str. 56601
uccaacaagggcggcuu

SEQ ID NO: 742443 - RNA, 11 nt, Leptospira interrogans serovar lai str. 56601
uccaaacccug

SEQ ID NO: 742444 - RNA, 16 nt, Leptospira interrogans serovar lai str. 56601
uccaaacucaaugcug

SEQ ID NO: 742445 - RNA, 13 nt, Leptospira interrogans serovar lai str. 56601
ucauuuugauaau

SEQ ID NO: 742446 - RNA, 20 nt, Leptospira interrogans serovar lai str. 56601
uccaaacacuaauaaaaaug

SEQ ID NO: 742447 - RNA, 21 nt, Leptospira interrogans serovar lai str. 56601
uccaaacacuaauaaaaaugu

SEQ ID NO: 742448 - RNA, 20 nt, Leptospira interrogans serovar lai str. 56601
ucauuuaaagcaaauaccaa

SEQ ID NO: 742449 - RNA, 15 nt, Leptospira interrogans serovar lai str. 56601
ucauuguuugaaaua

SEQ ID NO: 742450 - RNA, 15 nt, Leptospira interrogans serovar lai str. 56601
ucauuguaagaaaua

SEQ ID NO: 742451 - RNA, 23 nt, Leptospira interrogans serovar lai str. 56601
ucauuucguuucccauauaauuu

SEQ ID NO: 742452 - RNA, 16 nt, Leptospira interrogans serovar lai str. 56601
ucaguucuuauagaaa

SEQ ID NO: 742453 - RNA, 23 nt, Leptospira interrogans serovar lai str. 56601
ucaguguuuugugauaaaauuaa

SEQ ID NO: 742454 - RNA, 18 nt, Leptospira interrogans serovar lai str. 56601
ucaugucguacuaaaauu

SEQ ID NO: 742455 - RNA, 15 nt, Leptospira interrogans serovar lai str. 56601
ucauuaaacaauuuu

SEQ ID NO: 742456 - RNA, 23 nt, Leptospira interrogans serovar lai str. 56601
ucauuaaaacgaauugauaaaac

SEQ ID NO: 742457 - RNA, 22 nt, Leptospira interrogans serovar lai str. 56601
ucauuagaguuauugaaaaauu

SEQ ID NO: 742458 - RNA, 23 nt, Leptospira interrogans serovar lai str. 56601
ucauuagaguuauugaaaaauuu

SEQ ID NO: 742459 - RNA, 23 nt, Leptospira interrogans serovar lai str. 56601
ucauugaguuucuugaacucaau

SEQ ID NO: 742460 - RNA, 17 nt, Leptospira interrogans serovar lai str. 56601
ucauugaguuuuuuagu

SEQ ID NO: 742461 - RNA, 22 nt, Leptospira interrogans serovar lai str. 56601
ucauucccuuaaucauuuuuug

SEQ ID NO: 742462 - RNA, 14 nt, Leptospira interrogans serovar lai str. 56601
ugaaaaguuuauga

SEQ ID NO: 742463 - RNA, 22 nt, Leptospira interrogans serovar lai str. 56601
ugaaaauaaaaaucauaaaaca

SEQ ID NO: 742464 - RNA, 16 nt, Leptospira interrogans serovar lai str. 56601
ugaaaagucaaaaaau

SEQ ID NO: 742465 - RNA, 13 nt, Leptospira interrogans serovar lai str. 56601
ugaaaaauuucau

SEQ ID NO: 742466 - RNA, 14 nt, Leptospira interrogans serovar lai str. 56601
ugaaaaauuucaua

SEQ ID NO: 742467 - RNA, 22 nt, Leptospira interrogans serovar lai str. 56601
ugaaaaaugaauucucuaucuu

SEQ ID NO: 742468 - RNA, 12 nt, Leptospira interrogans serovar lai str. 56601
ugaaaaauuaau

SEQ ID NO: 742469 - RNA, 16 nt, Leptospira interrogans serovar lai str. 56601
ugaaaacgaugucuuu

SEQ ID NO: 742470 - RNA, 18 nt, Leptospira interrogans serovar lai str. 56601
ugaaaaagcauauaggac

SEQ ID NO: 742471 - RNA, 17 nt, Leptospira interrogans serovar lai str. 56601
ugaaaaagaauauaacu

SEQ ID NO: 742472 - RNA, 11 nt, Leptospira interrogans serovar lai str. 56601
ugaaaaagagc

SEQ ID NO: 742473 - RNA, 18 nt, Leptospira interrogans serovar lai str. 56601
ugaaaaaguugggaucua

SEQ ID NO: 742474 - RNA, 19 nt, Leptospira interrogans serovar lai str. 56601
ugaaaaagcggucuugaaa

SEQ ID NO: 742475 - RNA, 19 nt, Leptospira interrogans serovar lai str. 56601
ugaaaaagguuggaaucua

SEQ ID NO: 742476 - RNA, 20 nt, Leptospira interrogans serovar lai str. 56601
ugaaaaagguuggaaucuaa

SEQ ID NO: 742477 - RNA, 22 nt, Leptospira interrogans serovar lai str. 56601
ugaaaaagguuggaaucuaaac

SEQ ID NO: 742478 - RNA, 11 nt, Leptospira interrogans serovar lai str. 56601
ugaaaaacucg

SEQ ID NO: 742479 - RNA, 21 nt, Leptospira interrogans serovar lai str. 56601
ugaaaaacucgguuucuuaua

SEQ ID NO: 742480 - RNA, 16 nt, Leptospira interrogans serovar lai str. 56601
ugaaaaaaguuagaau

SEQ ID NO: 742481 - RNA, 20 nt, Leptospira interrogans serovar lai str. 56601
ugaaaaaaguuagaaucuaa

SEQ ID NO: 742482 - RNA, 19 nt, Leptospira interrogans serovar lai str. 56601
ugaaaaaaguugaaaucug

SEQ ID NO: 742483 - RNA, 19 nt, Leptospira interrogans serovar lai str. 56601
ucuuuuuuaauaauguuuu

SEQ ID NO: 742484 - RNA, 21 nt, Leptospira interrogans serovar lai str. 56601
ucuuuuuugacuucggaacau

SEQ ID NO: 742485 - RNA, 13 nt, Leptospira interrogans serovar lai str. 56601
ucuuuuuucuaaa

SEQ ID NO: 742486 - RNA, 14 nt, Leptospira interrogans serovar lai str. 56601
ucuuuuuucuaaau

SEQ ID NO: 742487 - RNA, 15 nt, Leptospira interrogans serovar lai str. 56601
ucuuuuuucuaaaua

SEQ ID NO: 742488 - RNA, 19 nt, Leptospira interrogans serovar lai str. 56601
ucuuuuuucuaaauaauac

SEQ ID NO: 742489 - RNA, 15 nt, Leptospira interrogans serovar lai str. 56601
ugaaaaaaauuagaa

SEQ ID NO: 742490 - RNA, 16 nt, Leptospira interrogans serovar lai str. 56601
ugaaaaaacuauuuaa

SEQ ID NO: 742491 - RNA, 17 nt, Leptospira interrogans serovar lai str. 56601
ugaaaaaacuuuuuaua

SEQ ID NO: 742492 - RNA, 17 nt, Leptospira interrogans serovar lai str. 56601
ucuuuuuuuucuaaaau

SEQ ID NO: 742493 - RNA, 21 nt, Leptospira interrogans serovar lai str. 56601
ucuuuuuuuucuaaaauauuu

SEQ ID NO: 742494 - RNA, 14 nt, Leptospira interrogans serovar lai str. 56601
ugaaaaaaaacagg

SEQ ID NO: 742495 - RNA, 12 nt, Leptospira interrogans serovar lai str. 56601
ugaaaauguaaa

SEQ ID NO: 742496 - RNA, 13 nt, Leptospira interrogans serovar lai str. 56601
ugaaaauguaaaa

SEQ ID NO: 742497 - RNA, 17 nt, Leptospira interrogans serovar lai str. 56601
ugaaaauucuuucuaua

SEQ ID NO: 742498 - RNA, 17 nt, Leptospira interrogans serovar lai str. 56601
ugaaaauugaauuuaaa

SEQ ID NO: 742499 - RNA, 14 nt, Leptospira interrogans serovar lai str. 56601
ugaaaauuuaauua

SEQ ID NO: 742500 - RNA, 17 nt, Leptospira interrogans serovar lai str. 56601
ugaaaauucuaagauca

SEQ ID NO: 742501 - RNA, 16 nt, Leptospira interrogans serovar lai str. 56601
ugaaaaugaccaaaau

SEQ ID NO: 742502 - RNA, 20 nt, Leptospira interrogans serovar lai str. 56601
ugaaaaucuagguuuccuuc

SEQ ID NO: 742503 - RNA, 17 nt, Leptospira interrogans serovar lai str. 56601
ugaaaaucggauaguuu

SEQ ID NO: 742504 - RNA, 19 nt, Leptospira interrogans serovar lai str. 56601
ugaaaaucggauaguuuaa

SEQ ID NO: 742505 - RNA, 15 nt, Leptospira interrogans serovar lai str. 56601
ugaaacucaaugcau

SEQ ID NO: 742506 - RNA, 13 nt, Leptospira interrogans serovar lai str. 56601
ugaaacaaauucu

SEQ ID NO: 742507 - RNA, 14 nt, Leptospira interrogans serovar lai str. 56601
ugaaaauuuuccuu

SEQ ID NO: 742508 - RNA, 14 nt, Leptospira interrogans serovar lai str. 56601
ugaaaguuuuucuu

SEQ ID NO: 742509 - RNA, 21 nt, Leptospira interrogans serovar lai str. 56601
ugaaaguuuuucuuuuuaaga

SEQ ID NO: 742510 - RNA, 19 nt, Leptospira interrogans serovar lai str. 56601
ugaaauacaaaaagaauca

SEQ ID NO: 742511 - RNA, 19 nt, Leptospira interrogans serovar lai str. 56601
ugaaaucucuaacaaaaag

SEQ ID NO: 742512 - RNA, 20 nt, Leptospira interrogans serovar lai str. 56601
ugaaaucugaacauaaaauc

SEQ ID NO: 742513 - RNA, 23 nt, Leptospira interrogans serovar lai str. 56601
ugaaaucugaacauaaaaucgau

SEQ ID NO: 742514 - RNA, 18 nt, Leptospira interrogans serovar lai str. 56601
ugaaaucugaacuuugca

SEQ ID NO: 742515 - RNA, 16 nt, Leptospira interrogans serovar lai str. 56601
ugaaaucuaaauuugu

SEQ ID NO: 742516 - RNA, 21 nt, Leptospira interrogans serovar lai str. 56601
ugaaccucuguaaauacaaaa

SEQ ID NO: 742517 - RNA, 17 nt, Leptospira interrogans serovar lai str. 56601
ugaaccauuugaaaaag

SEQ ID NO: 742518 - RNA, 17 nt, Leptospira interrogans serovar lai str. 56601
ugaacucaauguugcuc

SEQ ID NO: 742519 - RNA, 22 nt, Leptospira interrogans serovar lai str. 56601
ugaacucaauguugcuccuugc

SEQ ID NO: 742520 - RNA, 14 nt, Leptospira interrogans serovar lai str. 56601
ugaacuccauucuu

SEQ ID NO: 742521 - RNA, 15 nt, Leptospira interrogans serovar lai str. 56601
ugaacuccauucuua

SEQ ID NO: 742522 - RNA, 13 nt, Leptospira interrogans serovar lai str. 56601
ugaacuacagaau

SEQ ID NO: 742523 - RNA, 18 nt, Leptospira interrogans serovar lai str. 56601
ugaacucgguguaaaaaa

SEQ ID NO: 742524 - RNA, 19 nt, Leptospira interrogans serovar lai str. 56601
ugaacgguaaaaucuuuaa

SEQ ID NO: 742525 - RNA, 13 nt, Leptospira interrogans serovar lai str. 56601
ugaacguauucuu

SEQ ID NO: 742526 - RNA, 14 nt, Leptospira interrogans serovar lai str. 56601
ugaacguaauacaa

SEQ ID NO: 742527 - RNA, 16 nt, Leptospira interrogans serovar lai str. 56601
ugaaguaguaacacuc

SEQ ID NO: 742528 - RNA, 17 nt, Leptospira interrogans serovar lai str. 56601
ugaaggaauuggaauau

SEQ ID NO: 742529 - RNA, 22 nt, Leptospira interrogans serovar lai str. 56601
ugaaguaguuccuacauuuuaa

SEQ ID NO: 742530 - RNA, 22 nt, Leptospira interrogans serovar lai str. 56601
ugaaguauaaacuuuuuugaau

SEQ ID NO: 742531 - RNA, 17 nt, Leptospira interrogans serovar lai str. 56601
ugaagucuuaucucaaa

SEQ ID NO: 742532 - RNA, 19 nt, Leptospira interrogans serovar lai str. 56601
ugaagucuuaucucaaagc

SEQ ID NO: 742533 - RNA, 18 nt, Leptospira interrogans serovar lai str. 56601
ugaaguuuuacuaaaagu

SEQ ID NO: 742534 - RNA, 16 nt, Leptospira interrogans serovar lai str. 56601
ugaauaaaauaaaaaa

SEQ ID NO: 742535 - RNA, 16 nt, Leptospira interrogans serovar lai str. 56601
ugaagaaugauaaauc

SEQ ID NO: 742536 - RNA, 18 nt, Leptospira interrogans serovar lai str. 56601
ugaagaagcuaaaauuga

SEQ ID NO: 742537 - RNA, 21 nt, Leptospira interrogans serovar lai str. 56601
ugaagaagcuaaaauugaaua

SEQ ID NO: 742538 - RNA, 17 nt, Leptospira interrogans serovar lai str. 56601
ugaacuuacaaagcacu

SEQ ID NO: 742539 - RNA, 18 nt, Leptospira interrogans serovar lai str. 56601
ugaacuuacaaagcacuu

SEQ ID NO: 742540 - RNA, 17 nt, Leptospira interrogans serovar lai str. 56601
ugaagauuuguaaaauu

SEQ ID NO: 742541 - RNA, 24 nt, Leptospira interrogans serovar lai str. 56601
ugaagacuuccacgaauuacauag

SEQ ID NO: 742542 - RNA, 22 nt, Leptospira interrogans serovar lai str. 56601
ucuuuggaaaccucgucuaucu

SEQ ID NO: 742543 - RNA, 14 nt, Leptospira interrogans serovar lai str. 56601
ucuuuggaaauuuu

SEQ ID NO: 742544 - RNA, 20 nt, Leptospira interrogans serovar lai str. 56601
ucuuugaacuugucccaaaa

SEQ ID NO: 742545 - RNA, 13 nt, Leptospira interrogans serovar lai str. 56601
ucuuugaacuuuu

SEQ ID NO: 742546 - RNA, 19 nt, Leptospira interrogans serovar lai str. 56601
ucuuugaaggaucuuagag

SEQ ID NO: 742547 - RNA, 19 nt, Leptospira interrogans serovar lai str. 56601
ucuuugaauucgcuuuggu

SEQ ID NO: 742548 - RNA, 15 nt, Leptospira interrogans serovar lai str. 56601
ucuuugaauugaaau

SEQ ID NO: 742549 - RNA, 16 nt, Leptospira interrogans serovar lai str. 56601
ucuuugaaaaaauuuu

SEQ ID NO: 742550 - RNA, 19 nt, Leptospira interrogans serovar lai str. 56601
ucuuugaaaaaauuuuuuc

SEQ ID NO: 742551 - RNA, 18 nt, Leptospira interrogans serovar lai str. 56601
ucuuucuucuguaacgau

SEQ ID NO: 742552 - RNA, 11 nt, Leptospira interrogans serovar lai str. 56601
ucuuucuuccg

SEQ ID NO: 742553 - RNA, 15 nt, Leptospira interrogans serovar lai str. 56601
ucuuucuuaaauuuu

SEQ ID NO: 742554 - RNA, 19 nt, Leptospira interrogans serovar lai str. 56601
ucuuuccaucguuuaagaa

SEQ ID NO: 742555 - RNA, 22 nt, Leptospira interrogans serovar lai str. 56601
ucuuucggcagccaauuccaaa

SEQ ID NO: 742556 - RNA, 22 nt, Leptospira interrogans serovar lai str. 56601
ucuuucggcccggauauuuucu

SEQ ID NO: 742557 - RNA, 22 nt, Leptospira interrogans serovar lai str. 56601
ucuuucuacaccaguauucaau

SEQ ID NO: 742558 - RNA, 15 nt, Leptospira interrogans serovar lai str. 56601
ucuuucgagauuaaa

SEQ ID NO: 742559 - RNA, 16 nt, Leptospira interrogans serovar lai str. 56601
ucuuucgagauuaaaa

SEQ ID NO: 742560 - RNA, 13 nt, Leptospira interrogans serovar lai str. 56601
ucuuuuuuaauua

SEQ ID NO: 742561 - RNA, 22 nt, Leptospira interrogans serovar lai str. 56601
ucuuuuuaggaagaaacaaaga

SEQ ID NO: 742562 - RNA, 13 nt, Leptospira interrogans serovar lai str. 56601
ucuuuuucuucug

SEQ ID NO: 742563 - RNA, 13 nt, Leptospira interrogans serovar lai str. 56601
ucuuuuuaaauac

SEQ ID NO: 742564 - RNA, 15 nt, Leptospira interrogans serovar lai str. 56601
ucuuuuuaaauacac

SEQ ID NO: 742565 - RNA, 18 nt, Leptospira interrogans serovar lai str. 56601
ucuuuuuaaauacacucu

SEQ ID NO: 742566 - RNA, 11 nt, Leptospira interrogans serovar lai str. 56601
ucuuuuuacuu

SEQ ID NO: 742567 - RNA, 18 nt, Leptospira interrogans serovar lai str. 56601
ucuuuuuagacaaaaaua

SEQ ID NO: 742568 - RNA, 17 nt, Leptospira interrogans serovar lai str. 56601
ucuuuuuaaguaauauu

SEQ ID NO: 742569 - RNA, 16 nt, Leptospira interrogans serovar lai str. 56601
ucuuuuggcauuccca

SEQ ID NO: 742570 - RNA, 15 nt, Leptospira interrogans serovar lai str. 56601
ucuuuuguaaguuuu

SEQ ID NO: 742571 - RNA, 19 nt, Leptospira interrogans serovar lai str. 56601
ucuuuuguaaguuuuccau

SEQ ID NO: 742572 - RNA, 13 nt, Leptospira interrogans serovar lai str. 56601
ucuuuucuauaau

SEQ ID NO: 742573 - RNA, 12 nt, Leptospira interrogans serovar lai str. 56601
ucuuuucuuaaa

SEQ ID NO: 742574 - RNA, 15 nt, Leptospira interrogans serovar lai str. 56601
ucuuuucuuaaaaaa

SEQ ID NO: 742575 - RNA, 21 nt, Leptospira interrogans serovar lai str. 56601
ucuuuucuuaaaaaaaugauu

SEQ ID NO: 742576 - RNA, 20 nt, Leptospira interrogans serovar lai str. 56601
ucuuuugaacacgucuuaaa

SEQ ID NO: 742577 - RNA, 21 nt, Leptospira interrogans serovar lai str. 56601
ucuuuugaacacgucuuaaau

SEQ ID NO: 742578 - RNA, 16 nt, Leptospira interrogans serovar lai str. 56601
ucuuuugcauaguuuu

SEQ ID NO: 742579 - RNA, 12 nt, Leptospira interrogans serovar lai str. 56601
ucuuuuaaaaaa

SEQ ID NO: 742580 - RNA, 18 nt, Leptospira interrogans serovar lai str. 56601
ucuuuuaaaaaagguaua

SEQ ID NO: 742581 - RNA, 11 nt, Leptospira interrogans serovar lai str. 56601
ucuuuuaaaau

SEQ ID NO: 742582 - RNA, 12 nt, Leptospira interrogans serovar lai str. 56601
ucuuuuaaacaa

SEQ ID NO: 742583 - RNA, 24 nt, Leptospira interrogans serovar lai str. 56601
ucuuuguaaccuuuguuuccucuu

SEQ ID NO: 742584 - RNA, 22 nt, Leptospira interrogans serovar lai str. 56601
ucuuuuagaaguggaucuugaa

SEQ ID NO: 742585 - RNA, 23 nt, Leptospira interrogans serovar lai str. 56601
ucuuuuccaaaaacuuucggaau

SEQ ID NO: 742586 - RNA, 20 nt, Leptospira interrogans serovar lai str. 56601
ucuuuuccccuuuuuuaaua

SEQ ID NO: 742587 - RNA, 16 nt, Leptospira interrogans serovar lai str. 56601
ucuuuucaaaaguauu

SEQ ID NO: 742588 - RNA, 14 nt, Leptospira interrogans serovar lai str. 56601
ucuuuauuuuuaac

SEQ ID NO: 742589 - RNA, 23 nt, Leptospira interrogans serovar lai str. 56601
ucuuuauuuugggcgugccucuc

SEQ ID NO: 742590 - RNA, 13 nt, Leptospira interrogans serovar lai str. 56601
ucuuucaaagcua

SEQ ID NO: 742591 - RNA, 22 nt, Leptospira interrogans serovar lai str. 56601
ucuuuaugcgguuuuacuucug

SEQ ID NO: 742592 - RNA, 15 nt, Leptospira interrogans serovar lai str. 56601
ucuuuaucagaaaaa

SEQ ID NO: 742593 - RNA, 22 nt, Leptospira interrogans serovar lai str. 56601
ucuuuaucagaaccuuuaguuu

SEQ ID NO: 742594 - RNA, 15 nt, Leptospira interrogans serovar lai str. 56601
ucuuuauaucuugaa

SEQ ID NO: 742595 - RNA, 17 nt, Leptospira interrogans serovar lai str. 56601
ucuuuauauuauauaag

SEQ ID NO: 742596 - RNA, 13 nt, Leptospira interrogans serovar lai str. 56601
ucuuuaauuucaa

SEQ ID NO: 742597 - RNA, 23 nt, Leptospira interrogans serovar lai str. 56601
ucuuuaauuucaauaacuugacu

SEQ ID NO: 742598 - RNA, 15 nt, Leptospira interrogans serovar lai str. 56601
ucuuuaaugguaucu

SEQ ID NO: 742599 - RNA, 20 nt, Leptospira interrogans serovar lai str. 56601
ucuuuaaugagucuguccca

SEQ ID NO: 742600 - RNA, 21 nt, Leptospira interrogans serovar lai str. 56601
ucuuuaaugagucugucccaa

SEQ ID NO: 742601 - RNA, 23 nt, Leptospira interrogans serovar lai str. 56601
ucuuuaaugagucugucccaaaa

SEQ ID NO: 742602 - RNA, 18 nt, Leptospira interrogans serovar lai str. 56601
ucuuuagaaauuuuuaau

SEQ ID NO: 742603 - RNA, 19 nt, Leptospira interrogans serovar lai str. 56601
ucuuuagaaauuuuuaaua

SEQ ID NO: 742604 - RNA, 23 nt, Leptospira interrogans serovar lai str. 56601
ucuuuagaaauuuuuaauaaaau

SEQ ID NO: 742605 - RNA, 14 nt, Leptospira interrogans serovar lai str. 56601
ucuuuauaaaaaug

SEQ ID NO: 742606 - RNA, 22 nt, Leptospira interrogans serovar lai str. 56601
ucuuuaaauguagaaacuacug

SEQ ID NO: 742607 - RNA, 12 nt, Leptospira interrogans serovar lai str. 56601
ucuuuaaaauuu

SEQ ID NO: 742608 - RNA, 17 nt, Leptospira interrogans serovar lai str. 56601
ucuuuaaaauuuuuaau

SEQ ID NO: 742609 - RNA, 19 nt, Leptospira interrogans serovar lai str. 56601
ucuuuaaaauuuuuaauaa

SEQ ID NO: 742610 - RNA, 15 nt, Leptospira interrogans serovar lai str. 56601
ucuuuaaaauacuuu

SEQ ID NO: 742611 - RNA, 21 nt, Leptospira interrogans serovar lai str. 56601
ucuuuaagagucauuuuuaaa

SEQ ID NO: 742612 - RNA, 19 nt, Leptospira interrogans serovar lai str. 56601
ucuugucucuacucuugaa

SEQ ID NO: 742613 - RNA, 22 nt, Leptospira interrogans serovar lai str. 56601
ucuuguaaguauucaauuucag

SEQ ID NO: 742614 - RNA, 13 nt, Leptospira interrogans serovar lai str. 56601
ucuugcuaaaauu

SEQ ID NO: 742615 - RNA, 13 nt, Leptospira interrogans serovar lai str. 56601
ucuugcuaacauc

SEQ ID NO: 742616 - RNA, 12 nt, Leptospira interrogans serovar lai str. 56601
ucuugcuaaaau

SEQ ID NO: 742617 - RNA, 19 nt, Leptospira interrogans serovar lai str. 56601
ucuugaucgacuguaauua

SEQ ID NO: 742618 - RNA, 18 nt, Leptospira interrogans serovar lai str. 56601
ucuugaaucgaaucuuuu

SEQ ID NO: 742619 - RNA, 23 nt, Leptospira interrogans serovar lai str. 56601
ucuucuuuuguuuuuauaaauaa

SEQ ID NO: 742620 - RNA, 17 nt, Leptospira interrogans serovar lai str. 56601
ucuucuuguaauuuguu

SEQ ID NO: 742621 - RNA, 17 nt, Leptospira interrogans serovar lai str. 56601
ucuucgccuauuuuuuu

SEQ ID NO: 742622 - RNA, 16 nt, Leptospira interrogans serovar lai str. 56601
ucuucuaaauuuguaa

SEQ ID NO: 742623 - RNA, 21 nt, Leptospira interrogans serovar lai str. 56601
ucuucuaaauuuguaaauucu

SEQ ID NO: 742624 - RNA, 13 nt, Leptospira interrogans serovar lai str. 56601
ucuucuaaaucua

SEQ ID NO: 742625 - RNA, 23 nt, Leptospira interrogans serovar lai str. 56601
ucuucuaaaucuaauucuucuaa

SEQ ID NO: 742626 - RNA, 20 nt, Leptospira interrogans serovar lai str. 56601
ucuucuauuucuuauuuauu

SEQ ID NO: 742627 - RNA, 20 nt, Leptospira interrogans serovar lai str. 56601
ucuuccggauuaaaaagguu

SEQ ID NO: 742628 - RNA, 20 nt, Leptospira interrogans serovar lai str. 56601
ucuucucguucggaaugcug

SEQ ID NO: 742629 - RNA, 19 nt, Leptospira interrogans serovar lai str. 56601
ucuucuccucuuccggaag

SEQ ID NO: 742630 - RNA, 22 nt, Leptospira interrogans serovar lai str. 56601
ucuucugcaauucgcauuaaaa

SEQ ID NO: 742631 - RNA, 21 nt, Leptospira interrogans serovar lai str. 56601
ucuucuucaugauuuuuuaau

SEQ ID NO: 742632 - RNA, 16 nt, Leptospira interrogans serovar lai str. 56601
ucuucuuccuuuuuaa

SEQ ID NO: 742633 - RNA, 13 nt, Leptospira interrogans serovar lai str. 56601
ucuuaaaauuuag

SEQ ID NO: 742634 - RNA, 14 nt, Leptospira interrogans serovar lai str. 56601
ucuuaaaauuuaga

SEQ ID NO: 742635 - RNA, 12 nt, Leptospira interrogans serovar lai str. 56601
ucuuaaaagauu

SEQ ID NO: 742636 - RNA, 15 nt, Leptospira interrogans serovar lai str. 56601
ucuuaaaaugauuuu

SEQ ID NO: 742637 - RNA, 14 nt, Leptospira interrogans serovar lai str. 56601
ucuuaaaauuaaug

SEQ ID NO: 742638 - RNA, 11 nt, Leptospira interrogans serovar lai str. 56601
ucuuaaaucuu

SEQ ID NO: 742639 - RNA, 16 nt, Leptospira interrogans serovar lai str. 56601
ucuuaaaucuuuaaaa

SEQ ID NO: 742640 - RNA, 18 nt, Leptospira interrogans serovar lai str. 56601
ucuuaaaucuuuaaaaua

SEQ ID NO: 742641 - RNA, 12 nt, Leptospira interrogans serovar lai str. 56601
ucuuaaauuaac

SEQ ID NO: 742642 - RNA, 13 nt, Leptospira interrogans serovar lai str. 56601
ucuuaaauaaaau

SEQ ID NO: 742643 - RNA, 16 nt, Leptospira interrogans serovar lai str. 56601
ucuuaaauaaaauuuu

SEQ ID NO: 742644 - RNA, 14 nt, Leptospira interrogans serovar lai str. 56601
ucuuaaauucuaaa

SEQ ID NO: 742645 - RNA, 14 nt, Leptospira interrogans serovar lai str. 56601
ucuuaaaagaaaau

SEQ ID NO: 742646 - RNA, 12 nt, Leptospira interrogans serovar lai str. 56601
ucuuaaaaaaau

SEQ ID NO: 742647 - RNA, 13 nt, Leptospira interrogans serovar lai str. 56601
ucuuaaaaacucu

SEQ ID NO: 742648 - RNA, 14 nt, Leptospira interrogans serovar lai str. 56601
ucuuaaaaacucua

SEQ ID NO: 742649 - RNA, 15 nt, Leptospira interrogans serovar lai str. 56601
ucuuaaaaacuugaa

SEQ ID NO: 742650 - RNA, 16 nt, Leptospira interrogans serovar lai str. 56601
ucuguuuuguuuccuu

SEQ ID NO: 742651 - RNA, 21 nt, Leptospira interrogans serovar lai str. 56601
ucuguuucuauuuuauguaaa

SEQ ID NO: 742652 - RNA, 19 nt, Leptospira interrogans serovar lai str. 56601
ucuuaauggaucaaaagag

SEQ ID NO: 742653 - RNA, 22 nt, Leptospira interrogans serovar lai str. 56601
ucuuaauguaaaguucuuuucu

SEQ ID NO: 742654 - RNA, 16 nt, Leptospira interrogans serovar lai str. 56601
ucuuaauauuucucuu

SEQ ID NO: 742655 - RNA, 15 nt, Leptospira interrogans serovar lai str. 56601
ucuuaauaaaauuuu

SEQ ID NO: 742656 - RNA, 20 nt, Leptospira interrogans serovar lai str. 56601
ucuuaauaaaauuuucauuu

SEQ ID NO: 742657 - RNA, 15 nt, Leptospira interrogans serovar lai str. 56601
ucuuaauauaauaau

SEQ ID NO: 742658 - RNA, 16 nt, Leptospira interrogans serovar lai str. 56601
ucuuaauauaauaauu

SEQ ID NO: 742659 - RNA, 15 nt, Leptospira interrogans serovar lai str. 56601
ucuuacuccaucugu

SEQ ID NO: 742660 - RNA, 20 nt, Leptospira interrogans serovar lai str. 56601
ucuuagaauuuuguuucuaa

SEQ ID NO: 742661 - RNA, 22 nt, Leptospira interrogans serovar lai str. 56601
ucuuacuuugagaaaauuuuuu

SEQ ID NO: 742662 - RNA, 23 nt, Leptospira interrogans serovar lai str. 56601
ucuuacuuugagaaaauuuuuuu

SEQ ID NO: 742663 - RNA, 14 nt, Leptospira interrogans serovar lai str. 56601
ucuuagaaaaccau

SEQ ID NO: 742664 - RNA, 19 nt, Leptospira interrogans serovar lai str. 56601
ucuuauguucccaaaugag

SEQ ID NO: 742665 - RNA, 18 nt, Leptospira interrogans serovar lai str. 56601
ucuuauucaauaaaauac

SEQ ID NO: 742666 - RNA, 15 nt, Leptospira interrogans serovar lai str. 56601
ucuuauuuauuaaag

SEQ ID NO: 742667 - RNA, 20 nt, Leptospira interrogans serovar lai str. 56601
ucuuauugaacguaaguuaa

SEQ ID NO: 742668 - RNA, 21 nt, Leptospira interrogans serovar lai str. 56601
ucuuauugaacguaaguuaaa

SEQ ID NO: 742669 - RNA, 17 nt, Leptospira interrogans serovar lai str. 56601
ucuuaugguuuuuuaau

SEQ ID NO: 742670 - RNA, 18 nt, Leptospira interrogans serovar lai str. 56601
ucuuauuauucucggccu

SEQ ID NO: 742671 - RNA, 12 nt, Leptospira interrogans serovar lai str. 56601
ucuuauuuuuua

SEQ ID NO: 742672 - RNA, 14 nt, Leptospira interrogans serovar lai str. 56601
ucuuauuuuuuaau

SEQ ID NO: 742673 - RNA, 12 nt, Leptospira interrogans serovar lai str. 56601
ucuuauuuccau

SEQ ID NO: 742674 - RNA, 20 nt, Leptospira interrogans serovar lai str. 56601
ucuucaaauaacauuuuuuc

SEQ ID NO: 742675 - RNA, 20 nt, Leptospira interrogans serovar lai str. 56601
ucuucaaaaucguuuuaaaa

SEQ ID NO: 742676 - RNA, 14 nt, Leptospira interrogans serovar lai str. 56601
ucuucaaaauugag

SEQ ID NO: 742677 - RNA, 14 nt, Leptospira interrogans serovar lai str. 56601
ucuucaucuuacca

SEQ ID NO: 742678 - RNA, 14 nt, Leptospira interrogans serovar lai str. 56601
ucuucauuaaacaa

SEQ ID NO: 742679 - RNA, 16 nt, Leptospira interrogans serovar lai str. 56601
ucuucaucauuauuug

SEQ ID NO: 742680 - RNA, 20 nt, Leptospira interrogans serovar lai str. 56601
ucugauugagaaaauaaaaa

SEQ ID NO: 742681 - RNA, 20 nt, Leptospira interrogans serovar lai str. 56601
ucugcaaagcucagauucca

SEQ ID NO: 742682 - RNA, 19 nt, Leptospira interrogans serovar lai str. 56601
ucugccccaaaauuuagaa

SEQ ID NO: 742683 - RNA, 17 nt, Leptospira interrogans serovar lai str. 56601
ucuggaagccaaaacca

SEQ ID NO: 742684 - RNA, 16 nt, Leptospira interrogans serovar lai str. 56601
ucuggagaaagauuuu

SEQ ID NO: 742685 - RNA, 14 nt, Leptospira interrogans serovar lai str. 56601
ucugauauuuuaaa

SEQ ID NO: 742686 - RNA, 24 nt, Leptospira interrogans serovar lai str. 56601
ucugacuuggugauaaucaucaaa

SEQ ID NO: 742687 - RNA, 14 nt, Leptospira interrogans serovar lai str. 56601
ucugaaguaucucu

SEQ ID NO: 742688 - RNA, 22 nt, Leptospira interrogans serovar lai str. 56601
ucugaauaauugaauaaacugu

SEQ ID NO: 742689 - RNA, 20 nt, Leptospira interrogans serovar lai str. 56601
ucugaauuguggguuguaua

SEQ ID NO: 742690 - RNA, 17 nt, Leptospira interrogans serovar lai str. 56601
ucugaauuuuaccaaau

SEQ ID NO: 742691 - RNA, 14 nt, Leptospira interrogans serovar lai str. 56601
ucugaauuuuuaua

SEQ ID NO: 742692 - RNA, 15 nt, Leptospira interrogans serovar lai str. 56601
ucucuuuguaauaau

SEQ ID NO: 742693 - RNA, 17 nt, Leptospira interrogans serovar lai str. 56601
ucucuuuguaauaaugu

SEQ ID NO: 742694 - RNA, 20 nt, Leptospira interrogans serovar lai str. 56601
ucucuuuugagagccuuuuu

SEQ ID NO: 742695 - RNA, 15 nt, Leptospira interrogans serovar lai str. 56601
ucucuuuuucucuuu

SEQ ID NO: 742696 - RNA, 17 nt, Leptospira interrogans serovar lai str. 56601
ucugaacuuugcagacu

SEQ ID NO: 742697 - RNA, 19 nt, Leptospira interrogans serovar lai str. 56601
ucugaauaaaaauacuaaa

SEQ ID NO: 742698 - RNA, 20 nt, Leptospira interrogans serovar lai str. 56601
ucugaauaaaaauacuaaaa

SEQ ID NO: 742699 - RNA, 18 nt, Leptospira interrogans serovar lai str. 56601
ucugaaggaauauucauu

SEQ ID NO: 742700 - RNA, 16 nt, Leptospira interrogans serovar lai str. 56601
ucugaaccaaauacuu

SEQ ID NO: 742701 - RNA, 14 nt, Leptospira interrogans serovar lai str. 56601
ucugaaaaaaguua

SEQ ID NO: 742702 - RNA, 14 nt, Leptospira interrogans serovar lai str. 56601
ucugaaaaaaguug

SEQ ID NO: 742703 - RNA, 14 nt, Leptospira interrogans serovar lai str. 56601
ucugaaauaaaaaa

SEQ ID NO: 742704 - RNA, 18 nt, Leptospira interrogans serovar lai str. 56601
ucucguaauaucuaaaac

SEQ ID NO: 742705 - RNA, 20 nt, Leptospira interrogans serovar lai str. 56601
ucucguaauaucuaaaaccu

SEQ ID NO: 742706 - RNA, 16 nt, Leptospira interrogans serovar lai str. 56601
ucgcauuguuuaaaua

SEQ ID NO: 742707 - RNA, 13 nt, Leptospira interrogans serovar lai str. 56601
ucgcauuuuccuu

SEQ ID NO: 742708 - RNA, 14 nt, Leptospira interrogans serovar lai str. 56601
ucgcauuuuccuuu

SEQ ID NO: 742709 - RNA, 15 nt, Leptospira interrogans serovar lai str. 56601
ucgcauuuuccuuuu

SEQ ID NO: 742710 - RNA, 17 nt, Leptospira interrogans serovar lai str. 56601
ucgcauuuuccuuuuuc

SEQ ID NO: 742711 - RNA, 18 nt, Leptospira interrogans serovar lai str. 56601
ucucuagaaauuuauaau

SEQ ID NO: 742712 - RNA, 16 nt, Leptospira interrogans serovar lai str. 56601
ucucuaauacaugaua

SEQ ID NO: 742713 - RNA, 19 nt, Leptospira interrogans serovar lai str. 56601
ucucuacgguuaucaauag

SEQ ID NO: 742714 - RNA, 15 nt, Leptospira interrogans serovar lai str. 56601
ucucuaauucuaaaa

SEQ ID NO: 742715 - RNA, 20 nt, Leptospira interrogans serovar lai str. 56601
ucucuaauucuaaaaauuuu

SEQ ID NO: 742716 - RNA, 12 nt, Leptospira interrogans serovar lai str. 56601
ucucuuaaaauu

SEQ ID NO: 742717 - RNA, 13 nt, Leptospira interrogans serovar lai str. 56601
ucucuauaaaauc

SEQ ID NO: 742718 - RNA, 16 nt, Leptospira interrogans serovar lai str. 56601
ugacauucuaaacauu

SEQ ID NO: 742719 - RNA, 17 nt, Leptospira interrogans serovar lai str. 56601
ugacauucuaaacauuu

SEQ ID NO: 742720 - RNA, 21 nt, Leptospira interrogans serovar lai str. 56601
ugaccaccuauacuagaacaa

SEQ ID NO: 742721 - RNA, 17 nt, Leptospira interrogans serovar lai str. 56601
ugaccucauaucaaaaa

SEQ ID NO: 742722 - RNA, 19 nt, Leptospira interrogans serovar lai str. 56601
ugaccucauaucaaaaauu

SEQ ID NO: 742723 - RNA, 17 nt, Leptospira interrogans serovar lai str. 56601
ugagaaaggagaacuca

SEQ ID NO: 742724 - RNA, 22 nt, Leptospira interrogans serovar lai str. 56601
ugagaaaggagaacucauucaa

SEQ ID NO: 742725 - RNA, 12 nt, Leptospira interrogans serovar lai str. 56601
ugagaacuacuu

SEQ ID NO: 742726 - RNA, 17 nt, Leptospira interrogans serovar lai str. 56601
ugagaacuacuuuuaua

SEQ ID NO: 742727 - RNA, 14 nt, Leptospira interrogans serovar lai str. 56601
ugagagccuuuuua

SEQ ID NO: 742728 - RNA, 14 nt, Leptospira interrogans serovar lai str. 56601
ugagaguucccaca

SEQ ID NO: 742729 - RNA, 20 nt, Leptospira interrogans serovar lai str. 56601
ugagaguucgugaagaaauu

SEQ ID NO: 742730 - RNA, 16 nt, Leptospira interrogans serovar lai str. 56601
ugagaguuuuucuaua

SEQ ID NO: 742731 - RNA, 19 nt, Leptospira interrogans serovar lai str. 56601
ugacucuaagcuuuagaaa

SEQ ID NO: 742732 - RNA, 21 nt, Leptospira interrogans serovar lai str. 56601
ugacucuuuugagaaaccuuu

SEQ ID NO: 742733 - RNA, 12 nt, Leptospira interrogans serovar lai str. 56601
ugacuccaaaaa

SEQ ID NO: 742734 - RNA, 14 nt, Leptospira interrogans serovar lai str. 56601
ugacguaaaaaaau

SEQ ID NO: 742735 - RNA, 22 nt, Leptospira interrogans serovar lai str. 56601
ugacguaaaggaauccaugauu

SEQ ID NO: 742736 - RNA, 20 nt, Leptospira interrogans serovar lai str. 56601
ugacuaucaacaagaaugaa

SEQ ID NO: 742737 - RNA, 16 nt, Leptospira interrogans serovar lai str. 56601
ugacuaucacaaaaau

SEQ ID NO: 742738 - RNA, 14 nt, Leptospira interrogans serovar lai str. 56601
ugaucgauuuuuua

SEQ ID NO: 742739 - RNA, 15 nt, Leptospira interrogans serovar lai str. 56601
ugaucgcauaaaauu

SEQ ID NO: 742740 - RNA, 14 nt, Leptospira interrogans serovar lai str. 56601
ugaucuuagaaaac

SEQ ID NO: 742741 - RNA, 21 nt, Leptospira interrogans serovar lai str. 56601
ugaucuuauacucuuaaaauu

SEQ ID NO: 742742 - RNA, 19 nt, Leptospira interrogans serovar lai str. 56601
ugaucagugauucgaaauu

SEQ ID NO: 742743 - RNA, 17 nt, Leptospira interrogans serovar lai str. 56601
ugauccguuuuaaaauu

SEQ ID NO: 742744 - RNA, 15 nt, Leptospira interrogans serovar lai str. 56601
ugaucauauccgaaa

SEQ ID NO: 742745 - RNA, 18 nt, Leptospira interrogans serovar lai str. 56601
ugauauaaucuuaauauu

SEQ ID NO: 742746 - RNA, 16 nt, Leptospira interrogans serovar lai str. 56601
ugauauauuuuuaaag

SEQ ID NO: 742747 - RNA, 13 nt, Leptospira interrogans serovar lai str. 56601
ugauagaaacuaa

SEQ ID NO: 742748 - RNA, 17 nt, Leptospira interrogans serovar lai str. 56601
ugauagagaaaaauuuu

SEQ ID NO: 742749 - RNA, 19 nt, Leptospira interrogans serovar lai str. 56601
ugauagauuaauuuuuaua

SEQ ID NO: 742750 - RNA, 15 nt, Leptospira interrogans serovar lai str. 56601
ugauaauaauuagaa

SEQ ID NO: 742751 - RNA, 20 nt, Leptospira interrogans serovar lai str. 56601
ugagucugucccaaaaucug

SEQ ID NO: 742752 - RNA, 15 nt, Leptospira interrogans serovar lai str. 56601
ugagucuuuuuacuu

SEQ ID NO: 742753 - RNA, 19 nt, Leptospira interrogans serovar lai str. 56601
ugagucuuuuuacuugcaa

SEQ ID NO: 742754 - RNA, 16 nt, Leptospira interrogans serovar lai str. 56601
ugagggaauucccaca

SEQ ID NO: 742755 - RNA, 18 nt, Leptospira interrogans serovar lai str. 56601
ugagggguuuuuccuuuu

SEQ ID NO: 742756 - RNA, 23 nt, Leptospira interrogans serovar lai str. 56601
ugauaaaaaaucuuuaacaacau

SEQ ID NO: 742757 - RNA, 15 nt, Leptospira interrogans serovar lai str. 56601
ugaguuuuuccuauu

SEQ ID NO: 742758 - RNA, 14 nt, Leptospira interrogans serovar lai str. 56601
ugauaaaaaacgaa

SEQ ID NO: 742759 - RNA, 22 nt, Leptospira interrogans serovar lai str. 56601
ugauaaaaccguuuuauaaaua

SEQ ID NO: 742760 - RNA, 20 nt, Leptospira interrogans serovar lai str. 56601
ugaguucgguguaaggaauu

SEQ ID NO: 742761 - RNA, 19 nt, Leptospira interrogans serovar lai str. 56601
ugaguucguggagaaauuc

SEQ ID NO: 742762 - RNA, 20 nt, Leptospira interrogans serovar lai str. 56601
ugaguuaaccuacagaacac

SEQ ID NO: 742763 - RNA, 21 nt, Leptospira interrogans serovar lai str. 56601
ugaguggauugccauccacaa

SEQ ID NO: 742764 - RNA, 14 nt, Leptospira interrogans serovar lai str. 56601
ugaguucauucuga

SEQ ID NO: 742765 - RNA, 20 nt, Leptospira interrogans serovar lai str. 56601
ugaguucaauguaagaaacu

SEQ ID NO: 742766 - RNA, 22 nt, Leptospira interrogans serovar lai str. 56601
ugaguucggcguaagaaaacca

SEQ ID NO: 742767 - RNA, 19 nt, Leptospira interrogans serovar lai str. 56601
ugaguucggcuuaagaaaa

SEQ ID NO: 742768 - RNA, 12 nt, Leptospira interrogans serovar lai str. 56601
ugaguucccaca

SEQ ID NO: 742769 - RNA, 21 nt, Leptospira interrogans serovar lai str. 56601
ugaguucccacauuuuuaaaa

SEQ ID NO: 742770 - RNA, 17 nt, Leptospira interrogans serovar lai str. 56601
ugaguuccuaacuuuga

SEQ ID NO: 742771 - RNA, 19 nt, Leptospira interrogans serovar lai str. 56601
ugaguuccuacauuuucag

SEQ ID NO: 742772 - RNA, 20 nt, Leptospira interrogans serovar lai str. 56601
ugaguucgacauaagaaaga

SEQ ID NO: 742773 - RNA, 20 nt, Leptospira interrogans serovar lai str. 56601
ugaguucgacguaagaaucc

SEQ ID NO: 742774 - RNA, 22 nt, Leptospira interrogans serovar lai str. 56601
ugagauagguuuuguaagaauu

SEQ ID NO: 742775 - RNA, 14 nt, Leptospira interrogans serovar lai str. 56601
ugagauaucacaaa

SEQ ID NO: 742776 - RNA, 18 nt, Leptospira interrogans serovar lai str. 56601
ugagauaucacaaauuuu

SEQ ID NO: 742777 - RNA, 16 nt, Leptospira interrogans serovar lai str. 56601
ugagauccaauuauuu

SEQ ID NO: 742778 - RNA, 15 nt, Leptospira interrogans serovar lai str. 56601
ugagcaaaaauuuuc

SEQ ID NO: 742779 - RNA, 22 nt, Leptospira interrogans serovar lai str. 56601
ugagauuguuuucuaguuuucc

SEQ ID NO: 742780 - RNA, 22 nt, Leptospira interrogans serovar lai str. 56601
ugagcaaaauuugcuuccauug

SEQ ID NO: 742781 - RNA, 16 nt, Leptospira interrogans serovar lai str. 56601
ugagauuugucucaaa

SEQ ID NO: 742782 - RNA, 15 nt, Leptospira interrogans serovar lai str. 56601
ugagcggaaggaaac

SEQ ID NO: 742783 - RNA, 23 nt, Leptospira interrogans serovar lai str. 56601
ugagcucuauguaagaaaaucug

SEQ ID NO: 742784 - RNA, 14 nt, Leptospira interrogans serovar lai str. 56601
ugagcugagugauu

SEQ ID NO: 742785 - RNA, 13 nt, Leptospira interrogans serovar lai str. 56601
ugcauugaaauca

SEQ ID NO: 742786 - RNA, 20 nt, Leptospira interrogans serovar lai str. 56601
ugcauucaaaaaguuuuaua

SEQ ID NO: 742787 - RNA, 21 nt, Leptospira interrogans serovar lai str. 56601
ugcauucaaaaaguuuuauaa

SEQ ID NO: 742788 - RNA, 17 nt, Leptospira interrogans serovar lai str. 56601
ugcauuuuauuaaaaau

SEQ ID NO: 742789 - RNA, 19 nt, Leptospira interrogans serovar lai str. 56601
ugcauuuuauuaaaaauau

SEQ ID NO: 742790 - RNA, 22 nt, Leptospira interrogans serovar lai str. 56601
ugcauuuuauuaaaaauuuuua

SEQ ID NO: 742791 - RNA, 17 nt, Leptospira interrogans serovar lai str. 56601
ugcauuuuauuaaagaa

SEQ ID NO: 742792 - RNA, 12 nt, Leptospira interrogans serovar lai str. 56601
ugcauuuaaaaa

SEQ ID NO: 742793 - RNA, 19 nt, Leptospira interrogans serovar lai str. 56601
ugcaguaaggauucuuuuc

SEQ ID NO: 742794 - RNA, 18 nt, Leptospira interrogans serovar lai str. 56601
ugcaguaaugccuacaaa

SEQ ID NO: 742795 - RNA, 19 nt, Leptospira interrogans serovar lai str. 56601
ugcaguaguucccacaaau

SEQ ID NO: 742796 - RNA, 17 nt, Leptospira interrogans serovar lai str. 56601
ugcaguaguuccuacaa

SEQ ID NO: 742797 - RNA, 23 nt, Leptospira interrogans serovar lai str. 56601
ugcaguaguuccuauaaauucau

SEQ ID NO: 742798 - RNA, 15 nt, Leptospira interrogans serovar lai str. 56601
ugcaguugugaucag

SEQ ID NO: 742799 - RNA, 19 nt, Leptospira interrogans serovar lai str. 56601
ugcauaauagauuucugcu

SEQ ID NO: 742800 - RNA, 11 nt, Leptospira interrogans serovar lai str. 56601
ugcauaaaauc

SEQ ID NO: 742801 - RNA, 13 nt, Leptospira interrogans serovar lai str. 56601
ugcacaaguuuuu

SEQ ID NO: 742802 - RNA, 16 nt, Leptospira interrogans serovar lai str. 56601
ugcaccaguuaaauca

SEQ ID NO: 742803 - RNA, 15 nt, Leptospira interrogans serovar lai str. 56601
ugcagauagugcacu

SEQ ID NO: 742804 - RNA, 22 nt, Leptospira interrogans serovar lai str. 56601
ugcacuguagagcauuacuaca

SEQ ID NO: 742805 - RNA, 22 nt, Leptospira interrogans serovar lai str. 56601
ugcacugaaauagaauuuugca

SEQ ID NO: 742806 - RNA, 12 nt, Leptospira interrogans serovar lai str. 56601
ugcaauuccuuc

SEQ ID NO: 742807 - RNA, 17 nt, Leptospira interrogans serovar lai str. 56601
ugcaauucgcauuaaaa

SEQ ID NO: 742808 - RNA, 18 nt, Leptospira interrogans serovar lai str. 56601
ugcaauucgcauuaaaau

SEQ ID NO: 742809 - RNA, 19 nt, Leptospira interrogans serovar lai str. 56601
ugcaauucgcauuaaaauu

SEQ ID NO: 742810 - RNA, 21 nt, Leptospira interrogans serovar lai str. 56601
ugcaauucgcauuaaaauuuu

SEQ ID NO: 742811 - RNA, 20 nt, Leptospira interrogans serovar lai str. 56601
ugcacaaaaccucuguuuug

SEQ ID NO: 742812 - RNA, 19 nt, Leptospira interrogans serovar lai str. 56601
ugcaauuuuugccauuauc

SEQ ID NO: 742813 - RNA, 13 nt, Leptospira interrogans serovar lai str. 56601
ugcaauccaaagu

SEQ ID NO: 742814 - RNA, 20 nt, Leptospira interrogans serovar lai str. 56601
ugcaauccaaaguucccgcc

SEQ ID NO: 742815 - RNA, 16 nt, Leptospira interrogans serovar lai str. 56601
ugcaaucguccaaucu

SEQ ID NO: 742816 - RNA, 20 nt, Leptospira interrogans serovar lai str. 56601
ugcaaucguccaaucucuuu

SEQ ID NO: 742817 - RNA, 16 nt, Leptospira interrogans serovar lai str. 56601
ugcaauauauugucuu

SEQ ID NO: 742818 - RNA, 15 nt, Leptospira interrogans serovar lai str. 56601
ugcaaguaaaaagac

SEQ ID NO: 742819 - RNA, 18 nt, Leptospira interrogans serovar lai str. 56601
ugcaaguaaaaagacuca

SEQ ID NO: 742820 - RNA, 19 nt, Leptospira interrogans serovar lai str. 56601
ugcaacgcguuuuaguuuu

SEQ ID NO: 742821 - RNA, 15 nt, Leptospira interrogans serovar lai str. 56601
ugcaacgaaaucaau

SEQ ID NO: 742822 - RNA, 20 nt, Leptospira interrogans serovar lai str. 56601
ugcaaauucaagugauucau

SEQ ID NO: 742823 - RNA, 16 nt, Leptospira interrogans serovar lai str. 56601
ugauugaauuaaaaaa

SEQ ID NO: 742824 - RNA, 21 nt, Leptospira interrogans serovar lai str. 56601
ugauugacguccuuauauccg

SEQ ID NO: 742825 - RNA, 17 nt, Leptospira interrogans serovar lai str. 56601
ugauucgcccaaauauu

SEQ ID NO: 742826 - RNA, 15 nt, Leptospira interrogans serovar lai str. 56601
ugauuguuaauuuuc

SEQ ID NO: 742827 - RNA, 23 nt, Leptospira interrogans serovar lai str. 56601
ugauugagaaaauaaaaaauuuu

SEQ ID NO: 742828 - RNA, 22 nt, Leptospira interrogans serovar lai str. 56601
ugauuuuacagacguauuuuua

SEQ ID NO: 742829 - RNA, 18 nt, Leptospira interrogans serovar lai str. 56601
ugauuuaaaaucacaaaa

SEQ ID NO: 742830 - RNA, 20 nt, Leptospira interrogans serovar lai str. 56601
ugauuuaaaaucacaaaaaa

SEQ ID NO: 742831 - RNA, 23 nt, Leptospira interrogans serovar lai str. 56601
ugauuuaaaaauaguauuuugug

SEQ ID NO: 742832 - RNA, 18 nt, Leptospira interrogans serovar lai str. 56601
ugauuguuuguuuuuucc

SEQ ID NO: 742833 - RNA, 19 nt, Leptospira interrogans serovar lai str. 56601
ugauuguuuguuuuuucca

SEQ ID NO: 742834 - RNA, 20 nt, Leptospira interrogans serovar lai str. 56601
ugaugaucgcguaauauuuc

SEQ ID NO: 742835 - RNA, 18 nt, Leptospira interrogans serovar lai str. 56601
ugauuccaagauuuuuua

SEQ ID NO: 742836 - RNA, 20 nt, Leptospira interrogans serovar lai str. 56601
ugauuccaagauuuuuuaau

SEQ ID NO: 742837 - RNA, 14 nt, Leptospira interrogans serovar lai str. 56601
ugauucauuuuucu

SEQ ID NO: 742838 - RNA, 22 nt, Leptospira interrogans serovar lai str. 56601
ugauucauuuuucugaaaaaag

SEQ ID NO: 742839 - RNA, 23 nt, Leptospira interrogans serovar lai str. 56601
ugaugcaaauucgggauuuacga

SEQ ID NO: 742840 - RNA, 20 nt, Leptospira interrogans serovar lai str. 56601
ugauuccgguaaauuuuuua

SEQ ID NO: 742841 - RNA, 11 nt, Leptospira interrogans serovar lai str. 56601
ugauuccaaag

SEQ ID NO: 742842 - RNA, 13 nt, Leptospira interrogans serovar lai str. 56601
ugauuuuuuaaau

SEQ ID NO: 742843 - RNA, 16 nt, Leptospira interrogans serovar lai str. 56601
ugauuuuuuaaaugug

SEQ ID NO: 742844 - RNA, 14 nt, Leptospira interrogans serovar lai str. 56601
ugauuuuuuaaaau

SEQ ID NO: 742845 - RNA, 22 nt, Leptospira interrogans serovar lai str. 56601
ugcaaaaaccguuccuuucaag

SEQ ID NO: 742846 - RNA, 13 nt, Leptospira interrogans serovar lai str. 56601
ugcaaaaaagaaa

SEQ ID NO: 742847 - RNA, 15 nt, Leptospira interrogans serovar lai str. 56601
ugcaaaaaagaaagc

SEQ ID NO: 742848 - RNA, 12 nt, Leptospira interrogans serovar lai str. 56601
ugcaaaaauaga

SEQ ID NO: 742849 - RNA, 15 nt, Leptospira interrogans serovar lai str. 56601
ugcaaaaauagaauu

SEQ ID NO: 742850 - RNA, 13 nt, Leptospira interrogans serovar lai str. 56601
ugauuuucauuuu

SEQ ID NO: 742851 - RNA, 21 nt, Leptospira interrogans serovar lai str. 56601
ugauuuucauuuugcuaaggu

SEQ ID NO: 742852 - RNA, 22 nt, Leptospira interrogans serovar lai str. 56601
ugauuuuagccuggaauucuuu

SEQ ID NO: 742853 - RNA, 23 nt, Leptospira interrogans serovar lai str. 56601
ugauuuucagggaaaaauaaggu

SEQ ID NO: 742854 - RNA, 18 nt, Leptospira interrogans serovar lai str. 56601
ugauuuuuccauaaaaaa

SEQ ID NO: 742855 - RNA, 16 nt, Leptospira interrogans serovar lai str. 56601
ugauuuuguuaauuaa

SEQ ID NO: 742856 - RNA, 22 nt, Leptospira interrogans serovar lai str. 56601
ugcaaacggauaaaauguagga

SEQ ID NO: 742857 - RNA, 15 nt, Leptospira interrogans serovar lai str. 56601
ugcaaaauuuaaaaa

SEQ ID NO: 742858 - RNA, 14 nt, Leptospira interrogans serovar lai str. 56601
ugcaaagaagaaau

SEQ ID NO: 742859 - RNA, 15 nt, Leptospira interrogans serovar lai str. 56601
ugcaaagaagaaaua

SEQ ID NO: 742860 - RNA, 21 nt, Leptospira interrogans serovar lai str. 56601
ugccucuacaaguucauaaga

SEQ ID NO: 742861 - RNA, 23 nt, Leptospira interrogans serovar lai str. 56601
ugccucuacaaguucauaagauu

SEQ ID NO: 742862 - RNA, 21 nt, Leptospira interrogans serovar lai str. 56601
ugccuuauaaugaagacgcuu

SEQ ID NO: 742863 - RNA, 15 nt, Leptospira interrogans serovar lai str. 56601
ugccuucguuuaaaa

SEQ ID NO: 742864 - RNA, 15 nt, Leptospira interrogans serovar lai str. 56601
ugccuuguucauaaa

SEQ ID NO: 742865 - RNA, 22 nt, Leptospira interrogans serovar lai str. 56601
ugccuuguucauaaaaacgucu

SEQ ID NO: 742866 - RNA, 22 nt, Leptospira interrogans serovar lai str. 56601
ugccuuuguauuaauuugaaua

SEQ ID NO: 742867 - RNA, 13 nt, Leptospira interrogans serovar lai str. 56601
ugcucacuaccuu

SEQ ID NO: 742868 - RNA, 16 nt, Leptospira interrogans serovar lai str. 56601
ugcucaauaaauuaua

SEQ ID NO: 742869 - RNA, 20 nt, Leptospira interrogans serovar lai str. 56601
ugcucgaaaguucacaaauu

SEQ ID NO: 742870 - RNA, 17 nt, Leptospira interrogans serovar lai str. 56601
ugcuacgggcuuucagc

SEQ ID NO: 742871 - RNA, 19 nt, Leptospira interrogans serovar lai str. 56601
ugcuaaaauuuuuuuaaga

SEQ ID NO: 742872 - RNA, 14 nt, Leptospira interrogans serovar lai str. 56601
ugcguuuuuaaaca

SEQ ID NO: 742873 - RNA, 22 nt, Leptospira interrogans serovar lai str. 56601
ugcuaacugauuauaaaaacaa

SEQ ID NO: 742874 - RNA, 19 nt, Leptospira interrogans serovar lai str. 56601
ugcuaagaaaaaagcagcu

SEQ ID NO: 742875 - RNA, 17 nt, Leptospira interrogans serovar lai str. 56601
ugcuauaaaaaggaucu

SEQ ID NO: 742876 - RNA, 18 nt, Leptospira interrogans serovar lai str. 56601
ugcgguuaucgucaaaau

SEQ ID NO: 742877 - RNA, 22 nt, Leptospira interrogans serovar lai str. 56601
ugcguuuggucugucguuugca

SEQ ID NO: 742878 - RNA, 19 nt, Leptospira interrogans serovar lai str. 56601
uggaauuggcuucuuauua

SEQ ID NO: 742879 - RNA, 20 nt, Leptospira interrogans serovar lai str. 56601
uggaauuuuucaacaacucu

SEQ ID NO: 742880 - RNA, 15 nt, Leptospira interrogans serovar lai str. 56601
uggaauuuuuuaaca

SEQ ID NO: 742881 - RNA, 20 nt, Leptospira interrogans serovar lai str. 56601
uggaauuuuuuaacaacucu

SEQ ID NO: 742882 - RNA, 22 nt, Leptospira interrogans serovar lai str. 56601
uggaauguacuaaaauuuuaua

SEQ ID NO: 742883 - RNA, 23 nt, Leptospira interrogans serovar lai str. 56601
uggaauuccgacccagaaaaaac

SEQ ID NO: 742884 - RNA, 19 nt, Leptospira interrogans serovar lai str. 56601
uggaauucguuaaguuauc

SEQ ID NO: 742885 - RNA, 18 nt, Leptospira interrogans serovar lai str. 56601
uggaaucugcaucuuuuc

SEQ ID NO: 742886 - RNA, 15 nt, Leptospira interrogans serovar lai str. 56601
uggaaucuuaaaaag

SEQ ID NO: 742887 - RNA, 12 nt, Leptospira interrogans serovar lai str. 56601
uggaauaaaauc

SEQ ID NO: 742888 - RNA, 14 nt, Leptospira interrogans serovar lai str. 56601
uggaauaaaaucau

SEQ ID NO: 742889 - RNA, 21 nt, Leptospira interrogans serovar lai str. 56601
uggaauauaauucgauccaaa

SEQ ID NO: 742890 - RNA, 21 nt, Leptospira interrogans serovar lai str. 56601
uggaccaaaucgcugguuuua

SEQ ID NO: 742891 - RNA, 20 nt, Leptospira interrogans serovar lai str. 56601
uggacgauuuugagaccagc

SEQ ID NO: 742892 - RNA, 17 nt, Leptospira interrogans serovar lai str. 56601
uggacagcucuuuugcu

SEQ ID NO: 742893 - RNA, 11 nt, Leptospira interrogans serovar lai str. 56601
uggaaaaguuu

SEQ ID NO: 742894 - RNA, 17 nt, Leptospira interrogans serovar lai str. 56601
uggaaaaguuuuuaaaa

SEQ ID NO: 742895 - RNA, 12 nt, Leptospira interrogans serovar lai str. 56601
uggaaaaugaaa

SEQ ID NO: 742896 - RNA, 13 nt, Leptospira interrogans serovar lai str. 56601
uggaaaaugaaaa

SEQ ID NO: 742897 - RNA, 12 nt, Leptospira interrogans serovar lai str. 56601
uggaaaaugaau

SEQ ID NO: 742898 - RNA, 14 nt, Leptospira interrogans serovar lai str. 56601
uggaaaaugaauuu

SEQ ID NO: 742899 - RNA, 16 nt, Leptospira interrogans serovar lai str. 56601
uggaaaucuuuuaaaa

SEQ ID NO: 742900 - RNA, 19 nt, Leptospira interrogans serovar lai str. 56601
uggaaaucuuuuaaaaaag

SEQ ID NO: 742901 - RNA, 13 nt, Leptospira interrogans serovar lai str. 56601
uggaaaggucuga

SEQ ID NO: 742902 - RNA, 14 nt, Leptospira interrogans serovar lai str. 56601
uggaaaguaaacua

SEQ ID NO: 742903 - RNA, 22 nt, Leptospira interrogans serovar lai str. 56601
uggaaagccccagaacaaaucc

SEQ ID NO: 742904 - RNA, 20 nt, Leptospira interrogans serovar lai str. 56601
uggaacucuauauaaagaaa

SEQ ID NO: 742905 - RNA, 15 nt, Leptospira interrogans serovar lai str. 56601
uggaaauuuuuaaua

SEQ ID NO: 742906 - RNA, 21 nt, Leptospira interrogans serovar lai str. 56601
uggaagccaaaaccaauuuuu

SEQ ID NO: 742907 - RNA, 17 nt, Leptospira interrogans serovar lai str. 56601
uggaaggacgaacuaca

SEQ ID NO: 742908 - RNA, 13 nt, Leptospira interrogans serovar lai str. 56601
ugcuuuuuaaaag

SEQ ID NO: 742909 - RNA, 20 nt, Leptospira interrogans serovar lai str. 56601
ugcuuuaguaguauuuaaga

SEQ ID NO: 742910 - RNA, 18 nt, Leptospira interrogans serovar lai str. 56601
ugcuugaaccauuugaaa

SEQ ID NO: 742911 - RNA, 19 nt, Leptospira interrogans serovar lai str. 56601
ugcuugagcucccucacgu

SEQ ID NO: 742912 - RNA, 18 nt, Leptospira interrogans serovar lai str. 56601
ugcuuccauugucuauuu

SEQ ID NO: 742913 - RNA, 16 nt, Leptospira interrogans serovar lai str. 56601
ugcuucaauuguccgu

SEQ ID NO: 742914 - RNA, 21 nt, Leptospira interrogans serovar lai str. 56601
ugcuucaacacugagucaaca

SEQ ID NO: 742915 - RNA, 23 nt, Leptospira interrogans serovar lai str. 56601
ugcuucaacacugagucaacaaa

SEQ ID NO: 742916 - RNA, 16 nt, Leptospira interrogans serovar lai str. 56601
aaaugucuaugauuaa

SEQ ID NO: 742917 - RNA, 23 nt, Leptospira interrogans serovar lai str. 56601
ugcuguaguuuauuuuucuuuua

SEQ ID NO: 742918 - RNA, 16 nt, Leptospira interrogans serovar lai str. 56601
ugcugucgcaacauaa

SEQ ID NO: 742919 - RNA, 21 nt, Leptospira interrogans serovar lai str. 56601
ugcugucgcaacauaaugcug

SEQ ID NO: 742920 - RNA, 13 nt, Leptospira interrogans serovar lai str. 56601
aaauguaaaaacu

SEQ ID NO: 742921 - RNA, 19 nt, Leptospira interrogans serovar lai str. 56601
aaauguaaaaaaauauuaa

SEQ ID NO: 742922 - RNA, 23 nt, Leptospira interrogans serovar lai str. 56601
aaauguaggaacuacuaauuuau

SEQ ID NO: 742923 - RNA, 21 nt, Leptospira interrogans serovar lai str. 56601
aaauguaguaacuacuauguu

SEQ ID NO: 742924 - RNA, 21 nt, Leptospira interrogans serovar lai str. 56601
aaauguauccaauccaaaauu

SEQ ID NO: 742925 - RNA, 12 nt, Leptospira interrogans serovar lai str. 56601
ugcucuaaaaua

SEQ ID NO: 742926 - RNA, 21 nt, Leptospira interrogans serovar lai str. 56601
ugcucuaaaauaauuuuuacu

SEQ ID NO: 742927 - RNA, 22 nt, Leptospira interrogans serovar lai str. 56601
ugcucuuaauggaucaaaagag

SEQ ID NO: 742928 - RNA, 12 nt, Leptospira interrogans serovar lai str. 56601
ugugaaacucaa

SEQ ID NO: 742929 - RNA, 16 nt, Leptospira interrogans serovar lai str. 56601
ugugaaccuuuaagca

SEQ ID NO: 742930 - RNA, 13 nt, Leptospira interrogans serovar lai str. 56601
ugucuuuaaaauu

SEQ ID NO: 742931 - RNA, 16 nt, Leptospira interrogans serovar lai str. 56601
ugucuuuucaaucucc

SEQ ID NO: 742932 - RNA, 16 nt, Leptospira interrogans serovar lai str. 56601
ugucucuacucuugaa

SEQ ID NO: 742933 - RNA, 15 nt, Leptospira interrogans serovar lai str. 56601
ugucuaaacuaaaaa

SEQ ID NO: 742934 - RNA, 21 nt, Leptospira interrogans serovar lai str. 56601
ugucggaacacuugaaaaaug

SEQ ID NO: 742935 - RNA, 14 nt, Leptospira interrogans serovar lai str. 56601
ugucgcaacauaau

SEQ ID NO: 742936 - RNA, 18 nt, Leptospira interrogans serovar lai str. 56601
ugucgcaacauaauguuu

SEQ ID NO: 742937 - RNA, 23 nt, Leptospira interrogans serovar lai str. 56601
ugucgcaacauaauguuucaauu

SEQ ID NO: 742938 - RNA, 14 nt, Leptospira interrogans serovar lai str. 56601
uguccuagaucucc

SEQ ID NO: 742939 - RNA, 13 nt, Leptospira interrogans serovar lai str. 56601
uguccuaaaauuu

SEQ ID NO: 742940 - RNA, 20 nt, Leptospira interrogans serovar lai str. 56601
uguccuaaaauuuuaaaaaa

SEQ ID NO: 742941 - RNA, 21 nt, Leptospira interrogans serovar lai str. 56601
uguccuaaaauuuuaaaaaau

SEQ ID NO: 742942 - RNA, 18 nt, Leptospira interrogans serovar lai str. 56601
uguccuaaaaccucaaaa

SEQ ID NO: 742943 - RNA, 20 nt, Leptospira interrogans serovar lai str. 56601
uguccuaaaaccucaaaaaa

SEQ ID NO: 742944 - RNA, 23 nt, Leptospira interrogans serovar lai str. 56601
uguccuaaaaccucaaaaaauuu

SEQ ID NO: 742945 - RNA, 18 nt, Leptospira interrogans serovar lai str. 56601
uguccauuuccauaaaau

SEQ ID NO: 742946 - RNA, 20 nt, Leptospira interrogans serovar lai str. 56601
ugucccaaaaccucaaaaaa

SEQ ID NO: 742947 - RNA, 16 nt, Leptospira interrogans serovar lai str. 56601
uguauccaauccaaaa

SEQ ID NO: 742948 - RNA, 20 nt, Leptospira interrogans serovar lai str. 56601
uguauccaauccaaaauugu

SEQ ID NO: 742949 - RNA, 17 nt, Leptospira interrogans serovar lai str. 56601
uguaucccuuuggcaua

SEQ ID NO: 742950 - RNA, 16 nt, Leptospira interrogans serovar lai str. 56601
uguaucucaagauuaa

SEQ ID NO: 742951 - RNA, 16 nt, Leptospira interrogans serovar lai str. 56601
uguagaucaaaucuga

SEQ ID NO: 742952 - RNA, 14 nt, Leptospira interrogans serovar lai str. 56601
uguauuuuuaaguu

SEQ ID NO: 742953 - RNA, 17 nt, Leptospira interrogans serovar lai str. 56601
uguauuuuaaaccaguu

SEQ ID NO: 742954 - RNA, 12 nt, Leptospira interrogans serovar lai str. 56601
uguauuuuauuu

SEQ ID NO: 742955 - RNA, 19 nt, Leptospira interrogans serovar lai str. 56601
uguauuuuauuuuuggauc

SEQ ID NO: 742956 - RNA, 19 nt, Leptospira interrogans serovar lai str. 56601
uguauuugcggaaucaauu

SEQ ID NO: 742957 - RNA, 21 nt, Leptospira interrogans serovar lai str. 56601
uguauuugcggaaucaauuuu

SEQ ID NO: 742958 - RNA, 16 nt, Leptospira interrogans serovar lai str. 56601
ugucaauuuuccagau

SEQ ID NO: 742959 - RNA, 14 nt, Leptospira interrogans serovar lai str. 56601
ugguuauaccaaau

SEQ ID NO: 742960 - RNA, 15 nt, Leptospira interrogans serovar lai str. 56601
ugguugcaaaaaaga

SEQ ID NO: 742961 - RNA, 23 nt, Leptospira interrogans serovar lai str. 56601
ugguugaaagaaucuaauuucag

SEQ ID NO: 742962 - RNA, 11 nt, Leptospira interrogans serovar lai str. 56601
uguaaaugaau

SEQ ID NO: 742963 - RNA, 17 nt, Leptospira interrogans serovar lai str. 56601
uguaaaugaauuggaaa

SEQ ID NO: 742964 - RNA, 14 nt, Leptospira interrogans serovar lai str. 56601
uguaaaugaauuua

SEQ ID NO: 742965 - RNA, 19 nt, Leptospira interrogans serovar lai str. 56601
uguaaaugaauuuagaaaa

SEQ ID NO: 742966 - RNA, 18 nt, Leptospira interrogans serovar lai str. 56601
uguaaauccguauacuuu

SEQ ID NO: 742967 - RNA, 21 nt, Leptospira interrogans serovar lai str. 56601
uguaaauccguauacuuuaaa

SEQ ID NO: 742968 - RNA, 15 nt, Leptospira interrogans serovar lai str. 56601
uguaaaguuuagauu

SEQ ID NO: 742969 - RNA, 18 nt, Leptospira interrogans serovar lai str. 56601
uguaaauacaaaaugaau

SEQ ID NO: 742970 - RNA, 19 nt, Leptospira interrogans serovar lai str. 56601
uguaaaguucuuuucuuaa

SEQ ID NO: 742971 - RNA, 12 nt, Leptospira interrogans serovar lai str. 56601
uguaaacuauua

SEQ ID NO: 742972 - RNA, 11 nt, Leptospira interrogans serovar lai str. 56601
uguaaacuucu

SEQ ID NO: 742973 - RNA, 14 nt, Leptospira interrogans serovar lai str. 56601
uguaaacuugauua

SEQ ID NO: 742974 - RNA, 15 nt, Leptospira interrogans serovar lai str. 56601
ugguuuucauucaaa

SEQ ID NO: 742975 - RNA, 15 nt, Leptospira interrogans serovar lai str. 56601
ugguuuguaauaguu

SEQ ID NO: 742976 - RNA, 20 nt, Leptospira interrogans serovar lai str. 56601
ugguuuuaaacgauuuaaaa

SEQ ID NO: 742977 - RNA, 22 nt, Leptospira interrogans serovar lai str. 56601
ugguuuuaaacgauuuaaaaga

SEQ ID NO: 742978 - RNA, 16 nt, Leptospira interrogans serovar lai str. 56601
uguacuaaaauuuuau

SEQ ID NO: 742979 - RNA, 20 nt, Leptospira interrogans serovar lai str. 56601
uguacuaaaauuuuauaaaa

SEQ ID NO: 742980 - RNA, 22 nt, Leptospira interrogans serovar lai str. 56601
uguaagauuucguucggaaaaa

SEQ ID NO: 742981 - RNA, 17 nt, Leptospira interrogans serovar lai str. 56601
uguaaggaauucauaau

SEQ ID NO: 742982 - RNA, 18 nt, Leptospira interrogans serovar lai str. 56601
uguaaggugacaauaauc

SEQ ID NO: 742983 - RNA, 16 nt, Leptospira interrogans serovar lai str. 56601
uguaagaguuccacau

SEQ ID NO: 742984 - RNA, 18 nt, Leptospira interrogans serovar lai str. 56601
uguaagaguuccuacauc

SEQ ID NO: 742985 - RNA, 17 nt, Leptospira interrogans serovar lai str. 56601
uguaaauguuccaaagc

SEQ ID NO: 742986 - RNA, 13 nt, Leptospira interrogans serovar lai str. 56601
uguaaauucaaaa

SEQ ID NO: 742987 - RNA, 13 nt, Leptospira interrogans serovar lai str. 56601
uguaaauucaaag

SEQ ID NO: 742988 - RNA, 13 nt, Leptospira interrogans serovar lai str. 56601
uguaauaaaaauu

SEQ ID NO: 742989 - RNA, 16 nt, Leptospira interrogans serovar lai str. 56601
uguaauaaaaauuuaa

SEQ ID NO: 742990 - RNA, 18 nt, Leptospira interrogans serovar lai str. 56601
uguaauaaaaauuuaaaa

SEQ ID NO: 742991 - RNA, 19 nt, Leptospira interrogans serovar lai str. 56601
uguaaguaucuaaaaguuu

SEQ ID NO: 742992 - RNA, 12 nt, Leptospira interrogans serovar lai str. 56601
uguaaguuuucc

SEQ ID NO: 742993 - RNA, 15 nt, Leptospira interrogans serovar lai str. 56601
uguaauguauaaucc

SEQ ID NO: 742994 - RNA, 15 nt, Leptospira interrogans serovar lai str. 56601
uguaauuaaaauuua

SEQ ID NO: 742995 - RNA, 16 nt, Leptospira interrogans serovar lai str. 56601
uguaauuaaaauuuac

SEQ ID NO: 742996 - RNA, 13 nt, Leptospira interrogans serovar lai str. 56601
uguaauaguuccc

SEQ ID NO: 742997 - RNA, 18 nt, Leptospira interrogans serovar lai str. 56601
uguaauaguucccacagu

SEQ ID NO: 742998 - RNA, 13 nt, Leptospira interrogans serovar lai str. 56601
uguaauaguuccu

SEQ ID NO: 742999 - RNA, 17 nt, Leptospira interrogans serovar lai str. 56601
uggccuucuggaaaaau

SEQ ID NO: 743000 - RNA, 22 nt, Leptospira interrogans serovar lai str. 56601
uggccuucuggaaaaauuccua

SEQ ID NO: 743001 - RNA, 23 nt, Leptospira interrogans serovar lai str. 56601
uggcccuccucuaaaaugcugca

SEQ ID NO: 743002 - RNA, 16 nt, Leptospira interrogans serovar lai str. 56601
uggcucaacuuuucca

SEQ ID NO: 743003 - RNA, 18 nt, Leptospira interrogans serovar lai str. 56601
uggcucaacuuuuccaga

SEQ ID NO: 743004 - RNA, 16 nt, Leptospira interrogans serovar lai str. 56601
uggcugagaaccauuu

SEQ ID NO: 743005 - RNA, 17 nt, Leptospira interrogans serovar lai str. 56601
uggcucuugcuaaaauu

SEQ ID NO: 743006 - RNA, 21 nt, Leptospira interrogans serovar lai str. 56601
uggcucauuuuucuuaaaaaa

SEQ ID NO: 743007 - RNA, 12 nt, Leptospira interrogans serovar lai str. 56601
ugggaauucuua

SEQ ID NO: 743008 - RNA, 15 nt, Leptospira interrogans serovar lai str. 56601
ugggaacuaccacca

SEQ ID NO: 743009 - RNA, 17 nt, Leptospira interrogans serovar lai str. 56601
ugggaacuaccaccaaa

SEQ ID NO: 743010 - RNA, 19 nt, Leptospira interrogans serovar lai str. 56601
ugggaacuacuaugaaaua

SEQ ID NO: 743011 - RNA, 19 nt, Leptospira interrogans serovar lai str. 56601
ugggaacuauuauaaaaua

SEQ ID NO: 743012 - RNA, 20 nt, Leptospira interrogans serovar lai str. 56601
ugggaacucucacaaaucau

SEQ ID NO: 743013 - RNA, 21 nt, Leptospira interrogans serovar lai str. 56601
uggguaacgcgccguuugcaa

SEQ ID NO: 743014 - RNA, 12 nt, Leptospira interrogans serovar lai str. 56601
ugggguuuacua

SEQ ID NO: 743015 - RNA, 17 nt, Leptospira interrogans serovar lai str. 56601
ugggacuuuuuucguug

SEQ ID NO: 743016 - RNA, 15 nt, Leptospira interrogans serovar lai str. 56601
ugggcauaggaaaua

SEQ ID NO: 743017 - RNA, 23 nt, Leptospira interrogans serovar lai str. 56601
ugggcauaggaaauaauuccucc

SEQ ID NO: 743018 - RNA, 23 nt, Leptospira interrogans serovar lai str. 56601
uggcaaaacgauauuuuuuaaaa

SEQ ID NO: 743019 - RNA, 12 nt, Leptospira interrogans serovar lai str. 56601
uggauuuuaugu

SEQ ID NO: 743020 - RNA, 12 nt, Leptospira interrogans serovar lai str. 56601
uggauuuuauuu

SEQ ID NO: 743021 - RNA, 15 nt, Leptospira interrogans serovar lai str. 56601
uggauuuuauuuuua

SEQ ID NO: 743022 - RNA, 21 nt, Leptospira interrogans serovar lai str. 56601
uggauuuuauuuuuacaaaga

SEQ ID NO: 743023 - RNA, 14 nt, Leptospira interrogans serovar lai str. 56601
uggauuuuuaugua

SEQ ID NO: 743024 - RNA, 15 nt, Leptospira interrogans serovar lai str. 56601
uggauuuuuauguaa

SEQ ID NO: 743025 - RNA, 17 nt, Leptospira interrogans serovar lai str. 56601
uggauuuuuauguaaua

SEQ ID NO: 743026 - RNA, 17 nt, Leptospira interrogans serovar lai str. 56601
uggcacuuauucuuaua

SEQ ID NO: 743027 - RNA, 13 nt, Leptospira interrogans serovar lai str. 56601
uggcaagaggaac

SEQ ID NO: 743028 - RNA, 16 nt, Leptospira interrogans serovar lai str. 56601
uggcauacaucucuaa

SEQ ID NO: 743029 - RNA, 17 nt, Leptospira interrogans serovar lai str. 56601
uggcauccaggauuuuc

SEQ ID NO: 743030 - RNA, 16 nt, Leptospira interrogans serovar lai str. 56601
uggaguucuaaauuau

SEQ ID NO: 743031 - RNA, 14 nt, Leptospira interrogans serovar lai str. 56601
uggaguuuuuuaaa

SEQ ID NO: 743032 - RNA, 16 nt, Leptospira interrogans serovar lai str. 56601
uggaguuuuuuaaaau

SEQ ID NO: 743033 - RNA, 15 nt, Leptospira interrogans serovar lai str. 56601
uggauaaauuuuaga

SEQ ID NO: 743034 - RNA, 16 nt, Leptospira interrogans serovar lai str. 56601
uggauaaauuuuagaa

SEQ ID NO: 743035 - RNA, 16 nt, Leptospira interrogans serovar lai str. 56601
uggauagcaaaaaaau

SEQ ID NO: 743036 - RNA, 14 nt, Leptospira interrogans serovar lai str. 56601
uggaucaaaagagu

SEQ ID NO: 743037 - RNA, 21 nt, Leptospira interrogans serovar lai str. 56601
uggaucuacuaagauuucuug

SEQ ID NO: 743038 - RNA, 16 nt, Leptospira interrogans serovar lai str. 56601
uggaugcgcaaacuca

SEQ ID NO: 743039 - RNA, 19 nt, Leptospira interrogans serovar lai str. 56601
uggaugcgcaaacucagca

SEQ ID NO: 743040 - RNA, 17 nt, Leptospira interrogans serovar lai str. 56601
uggaugauaaaaaacga

SEQ ID NO: 743041 - RNA, 14 nt, Leptospira interrogans serovar lai str. 56601
uggaucgccguucu

SEQ ID NO: 743042 - RNA, 20 nt, Leptospira interrogans serovar lai str. 56601
uggaggcgguaagguucgga

SEQ ID NO: 743043 - RNA, 21 nt, Leptospira interrogans serovar lai str. 56601
uggagaaaacgagaaagaauu

SEQ ID NO: 743044 - RNA, 12 nt, Leptospira interrogans serovar lai str. 56601
uggagaaagauu

SEQ ID NO: 743045 - RNA, 16 nt, Leptospira interrogans serovar lai str. 56601
uggagaauuaauuuuu

SEQ ID NO: 743046 - RNA, 22 nt, Leptospira interrogans serovar lai str. 56601
uggagaauuaauuuuuuaaaaa

SEQ ID NO: 743047 - RNA, 17 nt, Leptospira interrogans serovar lai str. 56601
uggagaauucauuuuuc

SEQ ID NO: 743048 - RNA, 14 nt, Leptospira interrogans serovar lai str. 56601
uggacuauuuuauu

SEQ ID NO: 743049 - RNA, 17 nt, Leptospira interrogans serovar lai str. 56601
uucgcauaacaaaaaua

SEQ ID NO: 743050 - RNA, 19 nt, Leptospira interrogans serovar lai str. 56601
uucgcauaacaaaaauacu

SEQ ID NO: 743051 - RNA, 17 nt, Leptospira interrogans serovar lai str. 56601
uucgaaagauuuuucau

SEQ ID NO: 743052 - RNA, 17 nt, Leptospira interrogans serovar lai str. 56601
uucgaaaauuuuaaguu

SEQ ID NO: 743053 - RNA, 17 nt, Leptospira interrogans serovar lai str. 56601
uucgaaaagaaauauua

SEQ ID NO: 743054 - RNA, 21 nt, Leptospira interrogans serovar lai str. 56601
uucgaaaagaaauauuaaaaa

SEQ ID NO: 743055 - RNA, 14 nt, Leptospira interrogans serovar lai str. 56601
uuccuuugaauaaa

SEQ ID NO: 743056 - RNA, 16 nt, Leptospira interrogans serovar lai str. 56601
uuccuuugaauaaaac

SEQ ID NO: 743057 - RNA, 15 nt, Leptospira interrogans serovar lai str. 56601
uuccuuucaagaauu

SEQ ID NO: 743058 - RNA, 14 nt, Leptospira interrogans serovar lai str. 56601
uuccuuuaaauuga

SEQ ID NO: 743059 - RNA, 22 nt, Leptospira interrogans serovar lai str. 56601
uuccuuuaaauugaauucuucc

SEQ ID NO: 743060 - RNA, 23 nt, Leptospira interrogans serovar lai str. 56601
uuccuuaagacccuaaaaaauuu

SEQ ID NO: 743061 - RNA, 15 nt, Leptospira interrogans serovar lai str. 56601
uucgccguaaaaaau

SEQ ID NO: 743062 - RNA, 15 nt, Leptospira interrogans serovar lai str. 56601
uucggugauacuguc

SEQ ID NO: 743063 - RNA, 16 nt, Leptospira interrogans serovar lai str. 56601
uucggagucauacauu

SEQ ID NO: 743064 - RNA, 23 nt, Leptospira interrogans serovar lai str. 56601
uucggaguuuuuacuaugaagac

SEQ ID NO: 743065 - RNA, 19 nt, Leptospira interrogans serovar lai str. 56601
uucggaaauagaaagacuu

SEQ ID NO: 743066 - RNA, 15 nt, Leptospira interrogans serovar lai str. 56601
uucggaaugauaacg

SEQ ID NO: 743067 - RNA, 15 nt, Leptospira interrogans serovar lai str. 56601
uucgcuuaucuaauu

SEQ ID NO: 743068 - RNA, 23 nt, Leptospira interrogans serovar lai str. 56601
uucguaaaaaauagaugugggaa

SEQ ID NO: 743069 - RNA, 13 nt, Leptospira interrogans serovar lai str. 56601
uucguaagaaaaa

SEQ ID NO: 743070 - RNA, 14 nt, Leptospira interrogans serovar lai str. 56601
uucguaagaaaaaa

SEQ ID NO: 743071 - RNA, 16 nt, Leptospira interrogans serovar lai str. 56601
uucguaagaaaaaauu

SEQ ID NO: 743072 - RNA, 18 nt, Leptospira interrogans serovar lai str. 56601
uucguaagaaaaaauuuc

SEQ ID NO: 743073 - RNA, 19 nt, Leptospira interrogans serovar lai str. 56601
uucgguguaagaaaaaacu

SEQ ID NO: 743074 - RNA, 22 nt, Leptospira interrogans serovar lai str. 56601
uucuaaauuaauauuuauaaaa

SEQ ID NO: 743075 - RNA, 18 nt, Leptospira interrogans serovar lai str. 56601
uucuaacugguuuuucuu

SEQ ID NO: 743076 - RNA, 18 nt, Leptospira interrogans serovar lai str. 56601
uucuaagaucugauauuc

SEQ ID NO: 743077 - RNA, 14 nt, Leptospira interrogans serovar lai str. 56601
uucguucggaaaaa

SEQ ID NO: 743078 - RNA, 13 nt, Leptospira interrogans serovar lai str. 56601
uucuaaaucugaa

SEQ ID NO: 743079 - RNA, 17 nt, Leptospira interrogans serovar lai str. 56601
uucuaaauuccaaaauu

SEQ ID NO: 743080 - RNA, 17 nt, Leptospira interrogans serovar lai str. 56601
uucuaaauugagaauuu

SEQ ID NO: 743081 - RNA, 12 nt, Leptospira interrogans serovar lai str. 56601
uucuaaauugug

SEQ ID NO: 743082 - RNA, 13 nt, Leptospira interrogans serovar lai str. 56601
uucuaaauuguga

SEQ ID NO: 743083 - RNA, 13 nt, Leptospira interrogans serovar lai str. 56601
uucuaaauuugua

SEQ ID NO: 743084 - RNA, 17 nt, Leptospira interrogans serovar lai str. 56601
uucuaaauuuuauaaaa

SEQ ID NO: 743085 - RNA, 19 nt, Leptospira interrogans serovar lai str. 56601
uucuaaauuuuauaaaauu

SEQ ID NO: 743086 - RNA, 16 nt, Leptospira interrogans serovar lai str. 56601
uucguggagaaaucug

SEQ ID NO: 743087 - RNA, 22 nt, Leptospira interrogans serovar lai str. 56601
uucguggagaaauucguuuuau

SEQ ID NO: 743088 - RNA, 21 nt, Leptospira interrogans serovar lai str. 56601
uucguaguuuuuguuccgaaa

SEQ ID NO: 743089 - RNA, 18 nt, Leptospira interrogans serovar lai str. 56601
uucguauugaauauuuuu

SEQ ID NO: 743090 - RNA, 18 nt, Leptospira interrogans serovar lai str. 56601
uucucucgacaaucaaaa

SEQ ID NO: 743091 - RNA, 14 nt, Leptospira interrogans serovar lai str. 56601
uucucuuaaaauuu

SEQ ID NO: 743092 - RNA, 15 nt, Leptospira interrogans serovar lai str. 56601
uucucuuaaaauuua

SEQ ID NO: 743093 - RNA, 11 nt, Leptospira interrogans serovar lai str. 56601
uucugauauaa

SEQ ID NO: 743094 - RNA, 19 nt, Leptospira interrogans serovar lai str. 56601
uucucgcauuuuccuuuuu

SEQ ID NO: 743095 - RNA, 20 nt, Leptospira interrogans serovar lai str. 56601
uucucgcaacggauuccucc

SEQ ID NO: 743096 - RNA, 15 nt, Leptospira interrogans serovar lai str. 56601
uucuaaguccuuuuc

SEQ ID NO: 743097 - RNA, 18 nt, Leptospira interrogans serovar lai str. 56601
uucuaaguccuuuucuua

SEQ ID NO: 743098 - RNA, 21 nt, Leptospira interrogans serovar lai str. 56601
uucuaaguaauuuaaaaaaau

SEQ ID NO: 743099 - RNA, 18 nt, Leptospira interrogans serovar lai str. 56601
uucuaauagagaaaaauu

SEQ ID NO: 743100 - RNA, 21 nt, Leptospira interrogans serovar lai str. 56601
uucuaauagagaaaaauuuuc

SEQ ID NO: 743101 - RNA, 22 nt, Leptospira interrogans serovar lai str. 56601
uucuaauagucucauacuuaau

SEQ ID NO: 743102 - RNA, 18 nt, Leptospira interrogans serovar lai str. 56601
uucuaauauuaaaaacac

SEQ ID NO: 743103 - RNA, 18 nt, Leptospira interrogans serovar lai str. 56601
uucuaauuuuuauccaaa

SEQ ID NO: 743104 - RNA, 17 nt, Leptospira interrogans serovar lai str. 56601
uucuaauuuuucaaaaa

SEQ ID NO: 743105 - RNA, 15 nt, Leptospira interrogans serovar lai str. 56601
uucuaauuuuauaaa

SEQ ID NO: 743106 - RNA, 20 nt, Leptospira interrogans serovar lai str. 56601
uucuaauuuuauaaauuauu

SEQ ID NO: 743107 - RNA, 21 nt, Leptospira interrogans serovar lai str. 56601
uucuaauuuuauaaauuauuu

SEQ ID NO: 743108 - RNA, 18 nt, Leptospira interrogans serovar lai str. 56601
uucuacaccuucuaaauc

SEQ ID NO: 743109 - RNA, 16 nt, Leptospira interrogans serovar lai str. 56601
uucuacagauaaaaau

SEQ ID NO: 743110 - RNA, 15 nt, Leptospira interrogans serovar lai str. 56601
uucuaauugcaacua

SEQ ID NO: 743111 - RNA, 13 nt, Leptospira interrogans serovar lai str. 56601
uucuacaaaauuu

SEQ ID NO: 743112 - RNA, 19 nt, Leptospira interrogans serovar lai str. 56601
uucuacaaauucuucuucc

SEQ ID NO: 743113 - RNA, 19 nt, Leptospira interrogans serovar lai str. 56601
uucuacaauuauauuaaau

SEQ ID NO: 743114 - RNA, 21 nt, Leptospira interrogans serovar lai str. 56601
uucuacauucugaaacuuuuc

SEQ ID NO: 743115 - RNA, 14 nt, Leptospira interrogans serovar lai str. 56601
uucuacauuuuugu

SEQ ID NO: 743116 - RNA, 17 nt, Leptospira interrogans serovar lai str. 56601
uucuacauuuuugugaa

SEQ ID NO: 743117 - RNA, 23 nt, Leptospira interrogans serovar lai str. 56601
uucuacauuuuugugaaacucaa

SEQ ID NO: 743118 - RNA, 12 nt, Leptospira interrogans serovar lai str. 56601
uucuauaaaauc

SEQ ID NO: 743119 - RNA, 12 nt, Leptospira interrogans serovar lai str. 56601
uucuauaaaauu

SEQ ID NO: 743120 - RNA, 23 nt, Leptospira interrogans serovar lai str. 56601
uucuauaaaauugaauaucauaa

SEQ ID NO: 743121 - RNA, 17 nt, Leptospira interrogans serovar lai str. 56601
uucuauaaaguugaaug

SEQ ID NO: 743122 - RNA, 13 nt, Leptospira interrogans serovar lai str. 56601
uucuaguuuguuu

SEQ ID NO: 743123 - RNA, 17 nt, Leptospira interrogans serovar lai str. 56601
uucuaguuuuccuucua

SEQ ID NO: 743124 - RNA, 20 nt, Leptospira interrogans serovar lai str. 56601
uucuaguaguucccacauuu

SEQ ID NO: 743125 - RNA, 17 nt, Leptospira interrogans serovar lai str. 56601
uucuacggcuuguauuu

SEQ ID NO: 743126 - RNA, 17 nt, Leptospira interrogans serovar lai str. 56601
uucuauaaccacaagac

SEQ ID NO: 743127 - RNA, 22 nt, Leptospira interrogans serovar lai str. 56601
uucuauggucgcucugugaaac

SEQ ID NO: 743128 - RNA, 15 nt, Leptospira interrogans serovar lai str. 56601
uucuauuaguuuuua

SEQ ID NO: 743129 - RNA, 13 nt, Leptospira interrogans serovar lai str. 56601
uucuauuuuaaaa

SEQ ID NO: 743130 - RNA, 16 nt, Leptospira interrogans serovar lai str. 56601
uucuauuuuaauauau

SEQ ID NO: 743131 - RNA, 17 nt, Leptospira interrogans serovar lai str. 56601
uucuauuuuaauauauu

SEQ ID NO: 743132 - RNA, 19 nt, Leptospira interrogans serovar lai str. 56601
uucuauuuuauaaauugug

SEQ ID NO: 743133 - RNA, 20 nt, Leptospira interrogans serovar lai str. 56601
uuccaccuuggaaagaaaag

SEQ ID NO: 743134 - RNA, 23 nt, Leptospira interrogans serovar lai str. 56601
uuccacucuuugacccauaaaaa

SEQ ID NO: 743135 - RNA, 19 nt, Leptospira interrogans serovar lai str. 56601
uuccacauuuuaaagguug

SEQ ID NO: 743136 - RNA, 15 nt, Leptospira interrogans serovar lai str. 56601
uuccaauuaacaaaa

SEQ ID NO: 743137 - RNA, 21 nt, Leptospira interrogans serovar lai str. 56601
uuccaauuuugcuucuaaaaa

SEQ ID NO: 743138 - RNA, 17 nt, Leptospira interrogans serovar lai str. 56601
uucagggcucaaaguca

SEQ ID NO: 743139 - RNA, 21 nt, Leptospira interrogans serovar lai str. 56601
uuccagcgaucgugauaagag

SEQ ID NO: 743140 - RNA, 16 nt, Leptospira interrogans serovar lai str. 56601
uuccagaaaccauaaa

SEQ ID NO: 743141 - RNA, 16 nt, Leptospira interrogans serovar lai str. 56601
uuccagaagauugaaa

SEQ ID NO: 743142 - RNA, 14 nt, Leptospira interrogans serovar lai str. 56601
uuccacuguauucg

SEQ ID NO: 743143 - RNA, 18 nt, Leptospira interrogans serovar lai str. 56601
uuccacuucaaaaagacu

SEQ ID NO: 743144 - RNA, 22 nt, Leptospira interrogans serovar lai str. 56601
uuccacuuuucucaucaaaaaa

SEQ ID NO: 743145 - RNA, 14 nt, Leptospira interrogans serovar lai str. 56601
uuccacuuuaaaaa

SEQ ID NO: 743146 - RNA, 15 nt, Leptospira interrogans serovar lai str. 56601
uuccacuuuaaaaau

SEQ ID NO: 743147 - RNA, 12 nt, Leptospira interrogans serovar lai str. 56601
uuccagaucauu

SEQ ID NO: 743148 - RNA, 17 nt, Leptospira interrogans serovar lai str. 56601
uuccagaucauuuugua

SEQ ID NO: 743149 - RNA, 22 nt, Leptospira interrogans serovar lai str. 56601
uuccagagauucgcccacuucu

SEQ ID NO: 743150 - RNA, 21 nt, Leptospira interrogans serovar lai str. 56601
uuccaugaaauagaaaucaau

SEQ ID NO: 743151 - RNA, 16 nt, Leptospira interrogans serovar lai str. 56601
uuccaucaaauacaaa

SEQ ID NO: 743152 - RNA, 17 nt, Leptospira interrogans serovar lai str. 56601
uuccaucaaauacaaaa

SEQ ID NO: 743153 - RNA, 12 nt, Leptospira interrogans serovar lai str. 56601
uuccauucuaag

SEQ ID NO: 743154 - RNA, 17 nt, Leptospira interrogans serovar lai str. 56601
uuccauucuucaaauaa

SEQ ID NO: 743155 - RNA, 14 nt, Leptospira interrogans serovar lai str. 56601
uuccauuucugaca

SEQ ID NO: 743156 - RNA, 19 nt, Leptospira interrogans serovar lai str. 56601
uuccauaaagaccacagua

SEQ ID NO: 743157 - RNA, 15 nt, Leptospira interrogans serovar lai str. 56601
uuccauaaauuuugu

SEQ ID NO: 743158 - RNA, 12 nt, Leptospira interrogans serovar lai str. 56601
uuccauaaaaaa

SEQ ID NO: 743159 - RNA, 15 nt, Leptospira interrogans serovar lai str. 56601
uuccauaaaaaacau

SEQ ID NO: 743160 - RNA, 15 nt, Leptospira interrogans serovar lai str. 56601
uuccauaaaaaauga

SEQ ID NO: 743161 - RNA, 19 nt, Leptospira interrogans serovar lai str. 56601
uuccaguaggauaauacaa

SEQ ID NO: 743162 - RNA, 16 nt, Leptospira interrogans serovar lai str. 56601
uuccgacaagaaugag

SEQ ID NO: 743163 - RNA, 19 nt, Leptospira interrogans serovar lai str. 56601
uuccgaauucuaaaauacu

SEQ ID NO: 743164 - RNA, 16 nt, Leptospira interrogans serovar lai str. 56601
uuccgaaaggaaaaga

SEQ ID NO: 743165 - RNA, 18 nt, Leptospira interrogans serovar lai str. 56601
uuccgauacgaguaaaaa

SEQ ID NO: 743166 - RNA, 18 nt, Leptospira interrogans serovar lai str. 56601
uuccgaucauuugaagua

SEQ ID NO: 743167 - RNA, 16 nt, Leptospira interrogans serovar lai str. 56601
uuccgauuucuuucaa

SEQ ID NO: 743168 - RNA, 13 nt, Leptospira interrogans serovar lai str. 56601
uuccgcaaaaauu

SEQ ID NO: 743169 - RNA, 17 nt, Leptospira interrogans serovar lai str. 56601
uuccgacccagaaaaaa

SEQ ID NO: 743170 - RNA, 23 nt, Leptospira interrogans serovar lai str. 56601
uuccccaagacgucuacagauaa

SEQ ID NO: 743171 - RNA, 15 nt, Leptospira interrogans serovar lai str. 56601
uuccccaaaaugaau

SEQ ID NO: 743172 - RNA, 15 nt, Leptospira interrogans serovar lai str. 56601
uucccgccaaaugcu

SEQ ID NO: 743173 - RNA, 16 nt, Leptospira interrogans serovar lai str. 56601
uuccauuuuuuagaau

SEQ ID NO: 743174 - RNA, 14 nt, Leptospira interrogans serovar lai str. 56601
uucccaaaugagag

SEQ ID NO: 743175 - RNA, 11 nt, Leptospira interrogans serovar lai str. 56601
uucccacaaau

SEQ ID NO: 743176 - RNA, 15 nt, Leptospira interrogans serovar lai str. 56601
uucccacaaauuaag

SEQ ID NO: 743177 - RNA, 13 nt, Leptospira interrogans serovar lai str. 56601
uucccacauuuca

SEQ ID NO: 743178 - RNA, 23 nt, Leptospira interrogans serovar lai str. 56601
uucccacauuuuaaagauugaac

SEQ ID NO: 743179 - RNA, 20 nt, Leptospira interrogans serovar lai str. 56601
uucccacauuuugaagguug

SEQ ID NO: 743180 - RNA, 23 nt, Leptospira interrogans serovar lai str. 56601
uucccacauuuugaagguugagc

SEQ ID NO: 743181 - RNA, 23 nt, Leptospira interrogans serovar lai str. 56601
uucccacauuuuuaaaaguuauu

SEQ ID NO: 743182 - RNA, 18 nt, Leptospira interrogans serovar lai str. 56601
uucccaguucuuaaauaa

SEQ ID NO: 743183 - RNA, 12 nt, Leptospira interrogans serovar lai str. 56601
uucccauaaaaa

SEQ ID NO: 743184 - RNA, 18 nt, Leptospira interrogans serovar lai str. 56601
uucccauccgaaauccca

SEQ ID NO: 743185 - RNA, 22 nt, Leptospira interrogans serovar lai str. 56601
uucccagacguaucaaaauagu

SEQ ID NO: 743186 - RNA, 15 nt, Leptospira interrogans serovar lai str. 56601
uuccggaaaacgaau

SEQ ID NO: 743187 - RNA, 17 nt, Leptospira interrogans serovar lai str. 56601
uuccuacgguuuuaguc

SEQ ID NO: 743188 - RNA, 14 nt, Leptospira interrogans serovar lai str. 56601
uuccuacauuuuca

SEQ ID NO: 743189 - RNA, 18 nt, Leptospira interrogans serovar lai str. 56601
uuccuacauuuuuuaaau

SEQ ID NO: 743190 - RNA, 21 nt, Leptospira interrogans serovar lai str. 56601
uugcauuuaauauauucaaaa

SEQ ID NO: 743191 - RNA, 16 nt, Leptospira interrogans serovar lai str. 56601
uugcacauaaaagacc

SEQ ID NO: 743192 - RNA, 22 nt, Leptospira interrogans serovar lai str. 56601
uugcaccgcauugaugacaaga

SEQ ID NO: 743193 - RNA, 13 nt, Leptospira interrogans serovar lai str. 56601
uugcucuaaaaua

SEQ ID NO: 743194 - RNA, 20 nt, Leptospira interrogans serovar lai str. 56601
uugcucucgcaaugaaaauu

SEQ ID NO: 743195 - RNA, 22 nt, Leptospira interrogans serovar lai str. 56601
uugcucucgcaaugaaaauucc

SEQ ID NO: 743196 - RNA, 14 nt, Leptospira interrogans serovar lai str. 56601
uugcguuuaaaaac

SEQ ID NO: 743197 - RNA, 13 nt, Leptospira interrogans serovar lai str. 56601
uugcaaaaaagaa

SEQ ID NO: 743198 - RNA, 22 nt, Leptospira interrogans serovar lai str. 56601
uugcaaagaagaaauaaguaaa

SEQ ID NO: 743199 - RNA, 15 nt, Leptospira interrogans serovar lai str. 56601
uugcaaguaaaaaga

SEQ ID NO: 743200 - RNA, 16 nt, Leptospira interrogans serovar lai str. 56601
uugcaaguaaaaagac

SEQ ID NO: 743201 - RNA, 13 nt, Leptospira interrogans serovar lai str. 56601
uugcacaaaagaa

SEQ ID NO: 743202 - RNA, 16 nt, Leptospira interrogans serovar lai str. 56601
uugcacaaaagaaacg

SEQ ID NO: 743203 - RNA, 11 nt, Leptospira interrogans serovar lai str. 56601
uugcacaaaau

SEQ ID NO: 743204 - RNA, 21 nt, Leptospira interrogans serovar lai str. 56601
uugauucaaaaacuaaaauac

SEQ ID NO: 743205 - RNA, 23 nt, Leptospira interrogans serovar lai str. 56601
uugauucaaaaacuaaaauacaa

SEQ ID NO: 743206 - RNA, 19 nt, Leptospira interrogans serovar lai str. 56601
uugauuccuuuuucuaauc

SEQ ID NO: 743207 - RNA, 12 nt, Leptospira interrogans serovar lai str. 56601
uugauugaagca

SEQ ID NO: 743208 - RNA, 18 nt, Leptospira interrogans serovar lai str. 56601
uugauuccaaagauaaaa

SEQ ID NO: 743209 - RNA, 16 nt, Leptospira interrogans serovar lai str. 56601
uugauuccaagcaauu

SEQ ID NO: 743210 - RNA, 12 nt, Leptospira interrogans serovar lai str. 56601
uugauuuuucaa

SEQ ID NO: 743211 - RNA, 21 nt, Leptospira interrogans serovar lai str. 56601
uugauuuuggaaagaauacga

SEQ ID NO: 743212 - RNA, 20 nt, Leptospira interrogans serovar lai str. 56601
uugcaaaauacgaucuaauu

SEQ ID NO: 743213 - RNA, 17 nt, Leptospira interrogans serovar lai str. 56601
uugcaaaaaguauguuu

SEQ ID NO: 743214 - RNA, 19 nt, Leptospira interrogans serovar lai str. 56601
uugcaaaaaguauguuuuu

SEQ ID NO: 743215 - RNA, 15 nt, Leptospira interrogans serovar lai str. 56601
uugcaaaaaaaauac

SEQ ID NO: 743216 - RNA, 15 nt, Leptospira interrogans serovar lai str. 56601
uugaucuuuuagaua

SEQ ID NO: 743217 - RNA, 15 nt, Leptospira interrogans serovar lai str. 56601
uugauauuucuuaaa

SEQ ID NO: 743218 - RNA, 14 nt, Leptospira interrogans serovar lai str. 56601
uugauauucaaauu

SEQ ID NO: 743219 - RNA, 16 nt, Leptospira interrogans serovar lai str. 56601
uugauauucucugaau

SEQ ID NO: 743220 - RNA, 14 nt, Leptospira interrogans serovar lai str. 56601
uugacuucggaaca

SEQ ID NO: 743221 - RNA, 17 nt, Leptospira interrogans serovar lai str. 56601
uugacuuaggauaaaac

SEQ ID NO: 743222 - RNA, 16 nt, Leptospira interrogans serovar lai str. 56601
uugagaaaauaaaaaa

SEQ ID NO: 743223 - RNA, 22 nt, Leptospira interrogans serovar lai str. 56601
uugagaauucuacauucugaaa

SEQ ID NO: 743224 - RNA, 18 nt, Leptospira interrogans serovar lai str. 56601
uugagaaaauucgaauca

SEQ ID NO: 743225 - RNA, 11 nt, Leptospira interrogans serovar lai str. 56601
uugagaaacaa

SEQ ID NO: 743226 - RNA, 17 nt, Leptospira interrogans serovar lai str. 56601
uugagacaagaagaaaa

SEQ ID NO: 743227 - RNA, 23 nt, Leptospira interrogans serovar lai str. 56601
uugagacaagaagaaaagaaucu

SEQ ID NO: 743228 - RNA, 22 nt, Leptospira interrogans serovar lai str. 56601
uugagacagguucugauauaau

SEQ ID NO: 743229 - RNA, 17 nt, Leptospira interrogans serovar lai str. 56601
uugagcacagcaaaaaa

SEQ ID NO: 743230 - RNA, 14 nt, Leptospira interrogans serovar lai str. 56601
uugaguuuuuguuu

SEQ ID NO: 743231 - RNA, 16 nt, Leptospira interrogans serovar lai str. 56601
uugaguuuuuuaaaac

SEQ ID NO: 743232 - RNA, 15 nt, Leptospira interrogans serovar lai str. 56601
uugaguuuuuuauuc

SEQ ID NO: 743233 - RNA, 18 nt, Leptospira interrogans serovar lai str. 56601
uugaguuucacaaaaaua

SEQ ID NO: 743234 - RNA, 20 nt, Leptospira interrogans serovar lai str. 56601
uugaguuuaagaaacucagu

SEQ ID NO: 743235 - RNA, 23 nt, Leptospira interrogans serovar lai str. 56601
uugaguuuaaggaaguguuugcu

SEQ ID NO: 743236 - RNA, 12 nt, Leptospira interrogans serovar lai str. 56601
uugaauuuaaaa

SEQ ID NO: 743237 - RNA, 17 nt, Leptospira interrogans serovar lai str. 56601
uugaauuuaaaaguuuc

SEQ ID NO: 743238 - RNA, 17 nt, Leptospira interrogans serovar lai str. 56601
uugaauucgcuuugguc

SEQ ID NO: 743239 - RNA, 21 nt, Leptospira interrogans serovar lai str. 56601
uugaauuuaggaaauuuucaa

SEQ ID NO: 743240 - RNA, 18 nt, Leptospira interrogans serovar lai str. 56601
uugaauuuauagauauaa

SEQ ID NO: 743241 - RNA, 13 nt, Leptospira interrogans serovar lai str. 56601
uugaauuuuacua

SEQ ID NO: 743242 - RNA, 14 nt, Leptospira interrogans serovar lai str. 56601
uugaauuuuacuaa

SEQ ID NO: 743243 - RNA, 20 nt, Leptospira interrogans serovar lai str. 56601
uugaauuuuacuaaaaauuc

SEQ ID NO: 743244 - RNA, 21 nt, Leptospira interrogans serovar lai str. 56601
uugaauuuuacuaaaaauuca

SEQ ID NO: 743245 - RNA, 12 nt, Leptospira interrogans serovar lai str. 56601
uugaauuuuaua

SEQ ID NO: 743246 - RNA, 12 nt, Leptospira interrogans serovar lai str. 56601
uugaauuuuucg

SEQ ID NO: 743247 - RNA, 12 nt, Leptospira interrogans serovar lai str. 56601
uugacaucuuuu

SEQ ID NO: 743248 - RNA, 21 nt, Leptospira interrogans serovar lai str. 56601
uugacaucuuuuaaaaucaag

SEQ ID NO: 743249 - RNA, 18 nt, Leptospira interrogans serovar lai str. 56601
uugacugcagcugaaagc

SEQ ID NO: 743250 - RNA, 13 nt, Leptospira interrogans serovar lai str. 56601
uugacguaagaaa

SEQ ID NO: 743251 - RNA, 14 nt, Leptospira interrogans serovar lai str. 56601
uugaaguagauaca

SEQ ID NO: 743252 - RNA, 19 nt, Leptospira interrogans serovar lai str. 56601
uugaaguagucauauaaaa

SEQ ID NO: 743253 - RNA, 18 nt, Leptospira interrogans serovar lai str. 56601
uugaaggaaauuuuguua

SEQ ID NO: 743254 - RNA, 16 nt, Leptospira interrogans serovar lai str. 56601
uugaagcguuuuguua

SEQ ID NO: 743255 - RNA, 23 nt, Leptospira interrogans serovar lai str. 56601
uugaagcguuuuguuaauuguug

SEQ ID NO: 743256 - RNA, 17 nt, Leptospira interrogans serovar lai str. 56601
uugaagauauuuuccuu

SEQ ID NO: 743257 - RNA, 17 nt, Leptospira interrogans serovar lai str. 56601
uugaagcaguuuuguua

SEQ ID NO: 743258 - RNA, 20 nt, Leptospira interrogans serovar lai str. 56601
uugaacuacuacuuuaacgu

SEQ ID NO: 743259 - RNA, 21 nt, Leptospira interrogans serovar lai str. 56601
uugaacggacuguuuuaauuu

SEQ ID NO: 743260 - RNA, 22 nt, Leptospira interrogans serovar lai str. 56601
uugaagaaacaauucuuccuuu

SEQ ID NO: 743261 - RNA, 23 nt, Leptospira interrogans serovar lai str. 56601
uugaagaaacaauucuuccuuuu

SEQ ID NO: 743262 - RNA, 12 nt, Leptospira interrogans serovar lai str. 56601
uugaagaaaaaa

SEQ ID NO: 743263 - RNA, 15 nt, Leptospira interrogans serovar lai str. 56601
uugaauccgaauaca

SEQ ID NO: 743264 - RNA, 18 nt, Leptospira interrogans serovar lai str. 56601
uugaauccgaauacaaag

SEQ ID NO: 743265 - RNA, 12 nt, Leptospira interrogans serovar lai str. 56601
uugaaucuuaaa

SEQ ID NO: 743266 - RNA, 20 nt, Leptospira interrogans serovar lai str. 56601
uugaauauuuuuaaacucau

SEQ ID NO: 743267 - RNA, 12 nt, Leptospira interrogans serovar lai str. 56601
uugaaucaaaua

SEQ ID NO: 743268 - RNA, 14 nt, Leptospira interrogans serovar lai str. 56601
uugaaugaaaucua

SEQ ID NO: 743269 - RNA, 15 nt, Leptospira interrogans serovar lai str. 56601
uugaaugaaaucuaa

SEQ ID NO: 743270 - RNA, 23 nt, Leptospira interrogans serovar lai str. 56601
uugaauuaaaaaacuuuuuaaaa

SEQ ID NO: 743271 - RNA, 14 nt, Leptospira interrogans serovar lai str. 56601
uugaauaucauaaa

SEQ ID NO: 743272 - RNA, 20 nt, Leptospira interrogans serovar lai str. 56601
uugaauauucacuuuuccaa

SEQ ID NO: 743273 - RNA, 22 nt, Leptospira interrogans serovar lai str. 56601
uugaaguuacgcguuuaaauac

SEQ ID NO: 743274 - RNA, 22 nt, Leptospira interrogans serovar lai str. 56601
uugaauaaaaccgcugaaaaaa

SEQ ID NO: 743275 - RNA, 19 nt, Leptospira interrogans serovar lai str. 56601
uugaauaaagagaaaacaa

SEQ ID NO: 743276 - RNA, 16 nt, Leptospira interrogans serovar lai str. 56601
uugaauaaguuuuaua

SEQ ID NO: 743277 - RNA, 18 nt, Leptospira interrogans serovar lai str. 56601
uucuugcuucaaaaagag

SEQ ID NO: 743278 - RNA, 19 nt, Leptospira interrogans serovar lai str. 56601
uucuugagggguuuuuccu

SEQ ID NO: 743279 - RNA, 20 nt, Leptospira interrogans serovar lai str. 56601
uucuugagggguuuuuccuu

SEQ ID NO: 743280 - RNA, 22 nt, Leptospira interrogans serovar lai str. 56601
uucuugagggguuuuuccuuuu

SEQ ID NO: 743281 - RNA, 18 nt, Leptospira interrogans serovar lai str. 56601
uucuugagaaaggagaac

SEQ ID NO: 743282 - RNA, 19 nt, Leptospira interrogans serovar lai str. 56601
uucuuuaaugcugauuuuu

SEQ ID NO: 743283 - RNA, 22 nt, Leptospira interrogans serovar lai str. 56601
uucuuuagaaauuuuuaaucaa

SEQ ID NO: 743284 - RNA, 15 nt, Leptospira interrogans serovar lai str. 56601
uucuuuccaaccauu

SEQ ID NO: 743285 - RNA, 14 nt, Leptospira interrogans serovar lai str. 56601
uucuuucgacuucu

SEQ ID NO: 743286 - RNA, 16 nt, Leptospira interrogans serovar lai str. 56601
uucuuucgacuucuuu

SEQ ID NO: 743287 - RNA, 12 nt, Leptospira interrogans serovar lai str. 56601
uucuuucuauuu

SEQ ID NO: 743288 - RNA, 12 nt, Leptospira interrogans serovar lai str. 56601
uucuuuuaaaag

SEQ ID NO: 743289 - RNA, 14 nt, Leptospira interrogans serovar lai str. 56601
uucuuuuaaaauuc

SEQ ID NO: 743290 - RNA, 19 nt, Leptospira interrogans serovar lai str. 56601
uucuuuguaaccuuuguuu

SEQ ID NO: 743291 - RNA, 16 nt, Leptospira interrogans serovar lai str. 56601
uucuuuucugaauaaa

SEQ ID NO: 743292 - RNA, 13 nt, Leptospira interrogans serovar lai str. 56601
uucuuuucuuaaa

SEQ ID NO: 743293 - RNA, 15 nt, Leptospira interrogans serovar lai str. 56601
uucuuuuccaaaaac

SEQ ID NO: 743294 - RNA, 15 nt, Leptospira interrogans serovar lai str. 56601
uucuuuucagguuga

SEQ ID NO: 743295 - RNA, 11 nt, Leptospira interrogans serovar lai str. 56601
uucuuuuuaag

SEQ ID NO: 743296 - RNA, 17 nt, Leptospira interrogans serovar lai str. 56601
uugaaaaauuucauagu

SEQ ID NO: 743297 - RNA, 19 nt, Leptospira interrogans serovar lai str. 56601
uugaaaaauagaauuguug

SEQ ID NO: 743298 - RNA, 18 nt, Leptospira interrogans serovar lai str. 56601
uugaaaaauuaauucucc

SEQ ID NO: 743299 - RNA, 23 nt, Leptospira interrogans serovar lai str. 56601
uugaaaaauuaauucuccaucug

SEQ ID NO: 743300 - RNA, 18 nt, Leptospira interrogans serovar lai str. 56601
uugaaaaauuaauucucu

SEQ ID NO: 743301 - RNA, 16 nt, Leptospira interrogans serovar lai str. 56601
uugaaaagaaaccaau

SEQ ID NO: 743302 - RNA, 18 nt, Leptospira interrogans serovar lai str. 56601
uucuuuuuuuaaacagag

SEQ ID NO: 743303 - RNA, 22 nt, Leptospira interrogans serovar lai str. 56601
uugaaaaagcggucuugaaaau

SEQ ID NO: 743304 - RNA, 23 nt, Leptospira interrogans serovar lai str. 56601
uugaaaauugaauuuaaaaguuu

SEQ ID NO: 743305 - RNA, 19 nt, Leptospira interrogans serovar lai str. 56601
uugaaaauucuauaguaaa

SEQ ID NO: 743306 - RNA, 17 nt, Leptospira interrogans serovar lai str. 56601
uugaaacauuucuaaaa

SEQ ID NO: 743307 - RNA, 19 nt, Leptospira interrogans serovar lai str. 56601
uugaaacauuucuaaaaua

SEQ ID NO: 743308 - RNA, 16 nt, Leptospira interrogans serovar lai str. 56601
uugaaacuuuuaauaa

SEQ ID NO: 743309 - RNA, 19 nt, Leptospira interrogans serovar lai str. 56601
uugaaacuuuuaauaaaac

SEQ ID NO: 743310 - RNA, 17 nt, Leptospira interrogans serovar lai str. 56601
uugaaagaaucuaauuu

SEQ ID NO: 743311 - RNA, 15 nt, Leptospira interrogans serovar lai str. 56601
uugaaaguaaaaaag

SEQ ID NO: 743312 - RNA, 14 nt, Leptospira interrogans serovar lai str. 56601
uugaaaguaaagau

SEQ ID NO: 743313 - RNA, 24 nt, Leptospira interrogans serovar lai str. 56601
uugaaaguaauuuaucuguaauuu

SEQ ID NO: 743314 - RNA, 12 nt, Leptospira interrogans serovar lai str. 56601
uugaaaguuuuu

SEQ ID NO: 743315 - RNA, 16 nt, Leptospira interrogans serovar lai str. 56601
uugaaaguuuuucuuu

SEQ ID NO: 743316 - RNA, 17 nt, Leptospira interrogans serovar lai str. 56601
uugaacaaguucuaaau

SEQ ID NO: 743317 - RNA, 20 nt, Leptospira interrogans serovar lai str. 56601
uugaacaaguucuaaaucga

SEQ ID NO: 743318 - RNA, 17 nt, Leptospira interrogans serovar lai str. 56601
uugaacauuuuuaaaaa

SEQ ID NO: 743319 - RNA, 18 nt, Leptospira interrogans serovar lai str. 56601
uugaacauuuuuaaaaau

SEQ ID NO: 743320 - RNA, 21 nt, Leptospira interrogans serovar lai str. 56601
uugaaauucucuuuugaccaa

SEQ ID NO: 743321 - RNA, 19 nt, Leptospira interrogans serovar lai str. 56601
uugaaaucugaacauaaaa

SEQ ID NO: 743322 - RNA, 18 nt, Leptospira interrogans serovar lai str. 56601
uucaagauugucuuuauu

SEQ ID NO: 743323 - RNA, 19 nt, Leptospira interrogans serovar lai str. 56601
uucaagagugguuuucaaa

SEQ ID NO: 743324 - RNA, 17 nt, Leptospira interrogans serovar lai str. 56601
uucaagacaacagaaca

SEQ ID NO: 743325 - RNA, 20 nt, Leptospira interrogans serovar lai str. 56601
uucaagacaacagaacaaaa

SEQ ID NO: 743326 - RNA, 19 nt, Leptospira interrogans serovar lai str. 56601
uucaacuuuuugaagaaac

SEQ ID NO: 743327 - RNA, 12 nt, Leptospira interrogans serovar lai str. 56601
uucaacuuuuuu

SEQ ID NO: 743328 - RNA, 14 nt, Leptospira interrogans serovar lai str. 56601
uucaaguuugugag

SEQ ID NO: 743329 - RNA, 17 nt, Leptospira interrogans serovar lai str. 56601
uucaaguuuucuuuuuu

SEQ ID NO: 743330 - RNA, 15 nt, Leptospira interrogans serovar lai str. 56601
uucaauaacucuaau

SEQ ID NO: 743331 - RNA, 12 nt, Leptospira interrogans serovar lai str. 56601
uucaauaauucu

SEQ ID NO: 743332 - RNA, 14 nt, Leptospira interrogans serovar lai str. 56601
uucaauaauucuau

SEQ ID NO: 743333 - RNA, 15 nt, Leptospira interrogans serovar lai str. 56601
uucaaaauaaauaau

SEQ ID NO: 743334 - RNA, 16 nt, Leptospira interrogans serovar lai str. 56601
uucaaaauaagaaaau

SEQ ID NO: 743335 - RNA, 18 nt, Leptospira interrogans serovar lai str. 56601
uucaaaauaagaauuuuc

SEQ ID NO: 743336 - RNA, 15 nt, Leptospira interrogans serovar lai str. 56601
uucaaaagauugaau

SEQ ID NO: 743337 - RNA, 19 nt, Leptospira interrogans serovar lai str. 56601
uucaaaauuuaucuguaaa

SEQ ID NO: 743338 - RNA, 15 nt, Leptospira interrogans serovar lai str. 56601
uucaaaacuauuaaa

SEQ ID NO: 743339 - RNA, 20 nt, Leptospira interrogans serovar lai str. 56601
uucaaaaccgcuuuuaguuu

SEQ ID NO: 743340 - RNA, 22 nt, Leptospira interrogans serovar lai str. 56601
uucaaaaauuuucuguuuauuu

SEQ ID NO: 743341 - RNA, 13 nt, Leptospira interrogans serovar lai str. 56601
uucaaaaauauau

SEQ ID NO: 743342 - RNA, 22 nt, Leptospira interrogans serovar lai str. 56601
uucaaaauugagcuuguuuuua

SEQ ID NO: 743343 - RNA, 17 nt, Leptospira interrogans serovar lai str. 56601
uucaaacaacaaaaaau

SEQ ID NO: 743344 - RNA, 12 nt, Leptospira interrogans serovar lai str. 56601
uuauuauauaau

SEQ ID NO: 743345 - RNA, 18 nt, Leptospira interrogans serovar lai str. 56601
uuauuauaaauuuauaaa

SEQ ID NO: 743346 - RNA, 11 nt, Leptospira interrogans serovar lai str. 56601
uuauuauauuu

SEQ ID NO: 743347 - RNA, 12 nt, Leptospira interrogans serovar lai str. 56601
uuauuauaaaac

SEQ ID NO: 743348 - RNA, 21 nt, Leptospira interrogans serovar lai str. 56601
uuauugaacguaaguuaaaua

SEQ ID NO: 743349 - RNA, 16 nt, Leptospira interrogans serovar lai str. 56601
uuauugaaaaauuuca

SEQ ID NO: 743350 - RNA, 14 nt, Leptospira interrogans serovar lai str. 56601
uuauuguuuauaaa

SEQ ID NO: 743351 - RNA, 15 nt, Leptospira interrogans serovar lai str. 56601
uuauuuaaaaaccgu

SEQ ID NO: 743352 - RNA, 14 nt, Leptospira interrogans serovar lai str. 56601
uuauuuguaaaauu

SEQ ID NO: 743353 - RNA, 13 nt, Leptospira interrogans serovar lai str. 56601
uuauuuguaaauc

SEQ ID NO: 743354 - RNA, 21 nt, Leptospira interrogans serovar lai str. 56601
uuauuuuucuaaaaaaaaugu

SEQ ID NO: 743355 - RNA, 19 nt, Leptospira interrogans serovar lai str. 56601
uuauuuuucuuuuaaaauu

SEQ ID NO: 743356 - RNA, 18 nt, Leptospira interrogans serovar lai str. 56601
uuauuuuuacagaaaaau

SEQ ID NO: 743357 - RNA, 14 nt, Leptospira interrogans serovar lai str. 56601
uuauuuuaaaauuc

SEQ ID NO: 743358 - RNA, 12 nt, Leptospira interrogans serovar lai str. 56601
uuauuuuaaaaa

SEQ ID NO: 743359 - RNA, 18 nt, Leptospira interrogans serovar lai str. 56601
uucaaaaacguuucuaua

SEQ ID NO: 743360 - RNA, 22 nt, Leptospira interrogans serovar lai str. 56601
uucaaaaacuaaaauacaaaau

SEQ ID NO: 743361 - RNA, 13 nt, Leptospira interrogans serovar lai str. 56601
uucaaaaauaaau

SEQ ID NO: 743362 - RNA, 22 nt, Leptospira interrogans serovar lai str. 56601
uucaaaaaauuucuaugaaaau

SEQ ID NO: 743363 - RNA, 19 nt, Leptospira interrogans serovar lai str. 56601
uucaaaaaaucaaauauac

SEQ ID NO: 743364 - RNA, 13 nt, Leptospira interrogans serovar lai str. 56601
uucaaaaaacuuu

SEQ ID NO: 743365 - RNA, 19 nt, Leptospira interrogans serovar lai str. 56601
uucaaaaaacuuucuuaaa

SEQ ID NO: 743366 - RNA, 16 nt, Leptospira interrogans serovar lai str. 56601
uuauuuuuuuuacaua

SEQ ID NO: 743367 - RNA, 12 nt, Leptospira interrogans serovar lai str. 56601
uucaaaaaauau

SEQ ID NO: 743368 - RNA, 22 nt, Leptospira interrogans serovar lai str. 56601
uucagccgcgcuuuccuuauua

SEQ ID NO: 743369 - RNA, 20 nt, Leptospira interrogans serovar lai str. 56601
uucagacugacugaaaaaaa

SEQ ID NO: 743370 - RNA, 21 nt, Leptospira interrogans serovar lai str. 56601
uucagacugacugaaaaaaac

SEQ ID NO: 743371 - RNA, 14 nt, Leptospira interrogans serovar lai str. 56601
uucaauauaaaaau

SEQ ID NO: 743372 - RNA, 22 nt, Leptospira interrogans serovar lai str. 56601
uucacauaaaguuaauacaaaa

SEQ ID NO: 743373 - RNA, 22 nt, Leptospira interrogans serovar lai str. 56601
uucacauaaccaaccccacaag

SEQ ID NO: 743374 - RNA, 14 nt, Leptospira interrogans serovar lai str. 56601
uucacguuaaaaua

SEQ ID NO: 743375 - RNA, 15 nt, Leptospira interrogans serovar lai str. 56601
uucacguuaacuaac

SEQ ID NO: 743376 - RNA, 17 nt, Leptospira interrogans serovar lai str. 56601
uuauaguuuuuucaaaa

SEQ ID NO: 743377 - RNA, 20 nt, Leptospira interrogans serovar lai str. 56601
uuauaguagauauuaguaaa

SEQ ID NO: 743378 - RNA, 16 nt, Leptospira interrogans serovar lai str. 56601
uuauagaugaaauuaa

SEQ ID NO: 743379 - RNA, 22 nt, Leptospira interrogans serovar lai str. 56601
uuauagauaauuuuuacucaaa

SEQ ID NO: 743380 - RNA, 19 nt, Leptospira interrogans serovar lai str. 56601
uuauauaauuuacuucauu

SEQ ID NO: 743381 - RNA, 21 nt, Leptospira interrogans serovar lai str. 56601
uuauauaagaucuaucucaaa

SEQ ID NO: 743382 - RNA, 17 nt, Leptospira interrogans serovar lai str. 56601
uuauauaaguuaaauuu

SEQ ID NO: 743383 - RNA, 18 nt, Leptospira interrogans serovar lai str. 56601
uuauauaaguuaaauuuu

SEQ ID NO: 743384 - RNA, 16 nt, Leptospira interrogans serovar lai str. 56601
uuauauaaucugauug

SEQ ID NO: 743385 - RNA, 22 nt, Leptospira interrogans serovar lai str. 56601
uuauauaaucugauugagaaaa

SEQ ID NO: 743386 - RNA, 15 nt, Leptospira interrogans serovar lai str. 56601
uuauauaaaauuuga

SEQ ID NO: 743387 - RNA, 17 nt, Leptospira interrogans serovar lai str. 56601
uuauauaaccaugaaua

SEQ ID NO: 743388 - RNA, 21 nt, Leptospira interrogans serovar lai str. 56601
uuauauaaccaugaauaaaca

SEQ ID NO: 743389 - RNA, 20 nt, Leptospira interrogans serovar lai str. 56601
uuauauauauucacaaaaaa

SEQ ID NO: 743390 - RNA, 13 nt, Leptospira interrogans serovar lai str. 56601
uuauauucuagaa

SEQ ID NO: 743391 - RNA, 15 nt, Leptospira interrogans serovar lai str. 56601
uuauauucuuauaua

SEQ ID NO: 743392 - RNA, 12 nt, Leptospira interrogans serovar lai str. 56601
uuauauguuucu

SEQ ID NO: 743393 - RNA, 21 nt, Leptospira interrogans serovar lai str. 56601
uuauauguuucuuuuguaaaa

SEQ ID NO: 743394 - RNA, 13 nt, Leptospira interrogans serovar lai str. 56601
uuauauuaaauua

SEQ ID NO: 743395 - RNA, 18 nt, Leptospira interrogans serovar lai str. 56601
uuauaucuuaauuaaaaa

SEQ ID NO: 743396 - RNA, 15 nt, Leptospira interrogans serovar lai str. 56601
uuauaugaguuccca

SEQ ID NO: 743397 - RNA, 12 nt, Leptospira interrogans serovar lai str. 56601
uuauauuaauau

SEQ ID NO: 743398 - RNA, 22 nt, Leptospira interrogans serovar lai str. 56601
uuauauccgugauguuuaagcc

SEQ ID NO: 743399 - RNA, 14 nt, Leptospira interrogans serovar lai str. 56601
uuauauuugaauuu

SEQ ID NO: 743400 - RNA, 13 nt, Leptospira interrogans serovar lai str. 56601
uuauauuuuaauu

SEQ ID NO: 743401 - RNA, 15 nt, Leptospira interrogans serovar lai str. 56601
uuaucaauagaaaua

SEQ ID NO: 743402 - RNA, 17 nt, Leptospira interrogans serovar lai str. 56601
uuaucaauucacucuua

SEQ ID NO: 743403 - RNA, 22 nt, Leptospira interrogans serovar lai str. 56601
uuaucaauucacucuuaaauac

SEQ ID NO: 743404 - RNA, 14 nt, Leptospira interrogans serovar lai str. 56601
uuaucagaaaaaca

SEQ ID NO: 743405 - RNA, 19 nt, Leptospira interrogans serovar lai str. 56601
uuaucacgaaaauuaaaaa

SEQ ID NO: 743406 - RNA, 20 nt, Leptospira interrogans serovar lai str. 56601
uuaucauaaaaauaaagaaa

SEQ ID NO: 743407 - RNA, 18 nt, Leptospira interrogans serovar lai str. 56601
uuaucauaaaacacuguu

SEQ ID NO: 743408 - RNA, 12 nt, Leptospira interrogans serovar lai str. 56601
uuaucauucuuu

SEQ ID NO: 743409 - RNA, 22 nt, Leptospira interrogans serovar lai str. 56601
uuaucauguaaaauuuuuugaa

SEQ ID NO: 743410 - RNA, 19 nt, Leptospira interrogans serovar lai str. 56601
uuauccauuucuauaaauu

SEQ ID NO: 743411 - RNA, 16 nt, Leptospira interrogans serovar lai str. 56601
uuaucgaauggaauuu

SEQ ID NO: 743412 - RNA, 19 nt, Leptospira interrogans serovar lai str. 56601
uuaucgaauggaauuuauu

SEQ ID NO: 743413 - RNA, 14 nt, Leptospira interrogans serovar lai str. 56601
uuauccuuaaaaug

SEQ ID NO: 743414 - RNA, 14 nt, Leptospira interrogans serovar lai str. 56601
uuauggaaauuuca

SEQ ID NO: 743415 - RNA, 22 nt, Leptospira interrogans serovar lai str. 56601
uuauggacucuauuaugauucu

SEQ ID NO: 743416 - RNA, 16 nt, Leptospira interrogans serovar lai str. 56601
uuaugcuauuuaauuu

SEQ ID NO: 743417 - RNA, 20 nt, Leptospira interrogans serovar lai str. 56601
uuaugcuauuuaauuuugua

SEQ ID NO: 743418 - RNA, 17 nt, Leptospira interrogans serovar lai str. 56601
uuaugcaugaauuuguu

SEQ ID NO: 743419 - RNA, 21 nt, Leptospira interrogans serovar lai str. 56601
uuaugcaaauacaacuuuuuu

SEQ ID NO: 743420 - RNA, 18 nt, Leptospira interrogans serovar lai str. 56601
uuauggcaggaucaaaau

SEQ ID NO: 743421 - RNA, 14 nt, Leptospira interrogans serovar lai str. 56601
uuauguaauauaca

SEQ ID NO: 743422 - RNA, 13 nt, Leptospira interrogans serovar lai str. 56601
uuauguaauauuu

SEQ ID NO: 743423 - RNA, 13 nt, Leptospira interrogans serovar lai str. 56601
uuauguaagaaaa

SEQ ID NO: 743424 - RNA, 17 nt, Leptospira interrogans serovar lai str. 56601
uuauuaauucuuauucu

SEQ ID NO: 743425 - RNA, 17 nt, Leptospira interrogans serovar lai str. 56601
uuaugugacuuuaauuu

SEQ ID NO: 743426 - RNA, 15 nt, Leptospira interrogans serovar lai str. 56601
uuauguucguuccca

SEQ ID NO: 743427 - RNA, 13 nt, Leptospira interrogans serovar lai str. 56601
uuauuaaaaauau

SEQ ID NO: 743428 - RNA, 14 nt, Leptospira interrogans serovar lai str. 56601
uuauuaaaaauauc

SEQ ID NO: 743429 - RNA, 14 nt, Leptospira interrogans serovar lai str. 56601
uuauuaaaauuucc

SEQ ID NO: 743430 - RNA, 13 nt, Leptospira interrogans serovar lai str. 56601
uuauuaaauugua

SEQ ID NO: 743431 - RNA, 15 nt, Leptospira interrogans serovar lai str. 56601
uuaucuguaaaauga

SEQ ID NO: 743432 - RNA, 18 nt, Leptospira interrogans serovar lai str. 56601
uuaucugagcacaaaaua

SEQ ID NO: 743433 - RNA, 23 nt, Leptospira interrogans serovar lai str. 56601
uuaugaaucuuucauguauuacu

SEQ ID NO: 743434 - RNA, 14 nt, Leptospira interrogans serovar lai str. 56601
uuaugaauaaaaaa

SEQ ID NO: 743435 - RNA, 13 nt, Leptospira interrogans serovar lai str. 56601
uuaugacuucuua

SEQ ID NO: 743436 - RNA, 15 nt, Leptospira interrogans serovar lai str. 56601
uuaugagaguuccca

SEQ ID NO: 743437 - RNA, 13 nt, Leptospira interrogans serovar lai str. 56601
uuaucuaaaauuu

SEQ ID NO: 743438 - RNA, 14 nt, Leptospira interrogans serovar lai str. 56601
uuaucuaaaauuuc

SEQ ID NO: 743439 - RNA, 22 nt, Leptospira interrogans serovar lai str. 56601
uuaucuaaaauuucauuucuau

SEQ ID NO: 743440 - RNA, 16 nt, Leptospira interrogans serovar lai str. 56601
uuaucgggauacucau

SEQ ID NO: 743441 - RNA, 16 nt, Leptospira interrogans serovar lai str. 56601
uuaucgauuuaaaaac

SEQ ID NO: 743442 - RNA, 13 nt, Leptospira interrogans serovar lai str. 56601
uuaucuauaaaau

SEQ ID NO: 743443 - RNA, 14 nt, Leptospira interrogans serovar lai str. 56601
uuaucuauugaaac

SEQ ID NO: 743444 - RNA, 16 nt, Leptospira interrogans serovar lai str. 56601
uuaucuauugaaacaa

SEQ ID NO: 743445 - RNA, 19 nt, Leptospira interrogans serovar lai str. 56601
uuacugaguuucaaacgcu

SEQ ID NO: 743446 - RNA, 16 nt, Leptospira interrogans serovar lai str. 56601
uuacugauucugcaua

SEQ ID NO: 743447 - RNA, 19 nt, Leptospira interrogans serovar lai str. 56601
uuacugauuucaaaaauaa

SEQ ID NO: 743448 - RNA, 21 nt, Leptospira interrogans serovar lai str. 56601
uuacugauuucaaaaauaaau

SEQ ID NO: 743449 - RNA, 19 nt, Leptospira interrogans serovar lai str. 56601
uuacugauuucuauaaaau

SEQ ID NO: 743450 - RNA, 13 nt, Leptospira interrogans serovar lai str. 56601
uuacugcauuuua

SEQ ID NO: 743451 - RNA, 17 nt, Leptospira interrogans serovar lai str. 56601
uuacugcuugacaucuu

SEQ ID NO: 743452 - RNA, 22 nt, Leptospira interrogans serovar lai str. 56601
uuagaacagaaugucuuagaau

SEQ ID NO: 743453 - RNA, 14 nt, Leptospira interrogans serovar lai str. 56601
uuagaaccaguauc

SEQ ID NO: 743454 - RNA, 19 nt, Leptospira interrogans serovar lai str. 56601
uuagaaccaguaucguuuu

SEQ ID NO: 743455 - RNA, 23 nt, Leptospira interrogans serovar lai str. 56601
uuagaaccaguaucguuuuccau

SEQ ID NO: 743456 - RNA, 16 nt, Leptospira interrogans serovar lai str. 56601
uuacuuuugggaaaag

SEQ ID NO: 743457 - RNA, 13 nt, Leptospira interrogans serovar lai str. 56601
uuacuuuuuccaa

SEQ ID NO: 743458 - RNA, 15 nt, Leptospira interrogans serovar lai str. 56601
uuacuuuuuccaaaa

SEQ ID NO: 743459 - RNA, 14 nt, Leptospira interrogans serovar lai str. 56601
uuagaaauuucuaa

SEQ ID NO: 743460 - RNA, 18 nt, Leptospira interrogans serovar lai str. 56601
uuagaaauuuuuaauaaa

SEQ ID NO: 743461 - RNA, 16 nt, Leptospira interrogans serovar lai str. 56601
uuagaaauuuuuaauc

SEQ ID NO: 743462 - RNA, 13 nt, Leptospira interrogans serovar lai str. 56601
uuacuuuaaaauu

SEQ ID NO: 743463 - RNA, 13 nt, Leptospira interrogans serovar lai str. 56601
uuacuugcaaaaa

SEQ ID NO: 743464 - RNA, 15 nt, Leptospira interrogans serovar lai str. 56601
uuacuguaaaauuua

SEQ ID NO: 743465 - RNA, 20 nt, Leptospira interrogans serovar lai str. 56601
uuacgugacgaucacacuuu

SEQ ID NO: 743466 - RNA, 17 nt, Leptospira interrogans serovar lai str. 56601
uuaccgaguuuaucaga

SEQ ID NO: 743467 - RNA, 12 nt, Leptospira interrogans serovar lai str. 56601
uuacuaaaaaac

SEQ ID NO: 743468 - RNA, 14 nt, Leptospira interrogans serovar lai str. 56601
uuacuaaaaauuca

SEQ ID NO: 743469 - RNA, 16 nt, Leptospira interrogans serovar lai str. 56601
uuacucaaagaaucga

SEQ ID NO: 743470 - RNA, 13 nt, Leptospira interrogans serovar lai str. 56601
uuagcuuaagaau

SEQ ID NO: 743471 - RNA, 16 nt, Leptospira interrogans serovar lai str. 56601
uuaggaauuuuuuaaa

SEQ ID NO: 743472 - RNA, 18 nt, Leptospira interrogans serovar lai str. 56601
uuaggaauuuuuuaaacu

SEQ ID NO: 743473 - RNA, 19 nt, Leptospira interrogans serovar lai str. 56601
uuaggaaauacaaaaagaa

SEQ ID NO: 743474 - RNA, 16 nt, Leptospira interrogans serovar lai str. 56601
uuaggaagugagauug

SEQ ID NO: 743475 - RNA, 17 nt, Leptospira interrogans serovar lai str. 56601
uuagcaugaaauuuucu

SEQ ID NO: 743476 - RNA, 23 nt, Leptospira interrogans serovar lai str. 56601
uuagaguaaaacuuuuaaagaag

SEQ ID NO: 743477 - RNA, 21 nt, Leptospira interrogans serovar lai str. 56601
uuagagugaauuuguaauucu

SEQ ID NO: 743478 - RNA, 17 nt, Leptospira interrogans serovar lai str. 56601
uuagaguuguccuaaaa

SEQ ID NO: 743479 - RNA, 19 nt, Leptospira interrogans serovar lai str. 56601
uuagaguuugaguuucuuu

SEQ ID NO: 743480 - RNA, 15 nt, Leptospira interrogans serovar lai str. 56601
uuagcaguucuacuu

SEQ ID NO: 743481 - RNA, 13 nt, Leptospira interrogans serovar lai str. 56601
uuagaauaaaaac

SEQ ID NO: 743482 - RNA, 20 nt, Leptospira interrogans serovar lai str. 56601
uuagaacugcucgaaaguuu

SEQ ID NO: 743483 - RNA, 18 nt, Leptospira interrogans serovar lai str. 56601
uuagaacuguugaaaaaa

SEQ ID NO: 743484 - RNA, 19 nt, Leptospira interrogans serovar lai str. 56601
uuagaacgcaaucuguuga

SEQ ID NO: 743485 - RNA, 20 nt, Leptospira interrogans serovar lai str. 56601
uuagacguuugaaaaucagg

SEQ ID NO: 743486 - RNA, 14 nt, Leptospira interrogans serovar lai str. 56601
uuauaagaauuuuc

SEQ ID NO: 743487 - RNA, 19 nt, Leptospira interrogans serovar lai str. 56601
uuauaagaaucgauucaga

SEQ ID NO: 743488 - RNA, 14 nt, Leptospira interrogans serovar lai str. 56601
uuauaaauuuaaaa

SEQ ID NO: 743489 - RNA, 15 nt, Leptospira interrogans serovar lai str. 56601
uuauaaauuuaaaaa

SEQ ID NO: 743490 - RNA, 16 nt, Leptospira interrogans serovar lai str. 56601
uuauaaauuuaaaaaa

SEQ ID NO: 743491 - RNA, 15 nt, Leptospira interrogans serovar lai str. 56601
uuauaaauuuauaaa

SEQ ID NO: 743492 - RNA, 21 nt, Leptospira interrogans serovar lai str. 56601
uuauaacgggaauuauaaauc

SEQ ID NO: 743493 - RNA, 12 nt, Leptospira interrogans serovar lai str. 56601
uuauaaaauuuu

SEQ ID NO: 743494 - RNA, 14 nt, Leptospira interrogans serovar lai str. 56601
uuauaaaauuuuuc

SEQ ID NO: 743495 - RNA, 21 nt, Leptospira interrogans serovar lai str. 56601
uuauaaacaauaugaaaggaa

SEQ ID NO: 743496 - RNA, 12 nt, Leptospira interrogans serovar lai str. 56601
uuauaaaauacc

SEQ ID NO: 743497 - RNA, 16 nt, Leptospira interrogans serovar lai str. 56601
uuauaaaaucuaaaaa

SEQ ID NO: 743498 - RNA, 13 nt, Leptospira interrogans serovar lai str. 56601
uuauaaaaugaau

SEQ ID NO: 743499 - RNA, 22 nt, Leptospira interrogans serovar lai str. 56601
uuauaaaauguauuaaaguugu

SEQ ID NO: 743500 - RNA, 18 nt, Leptospira interrogans serovar lai str. 56601
uuauaaagaauuuuaaau

SEQ ID NO: 743501 - RNA, 23 nt, Leptospira interrogans serovar lai str. 56601
uuauaaaguugagugccuaaauu

SEQ ID NO: 743502 - RNA, 16 nt, Leptospira interrogans serovar lai str. 56601
uuauaaauaaaagaga

SEQ ID NO: 743503 - RNA, 12 nt, Leptospira interrogans serovar lai str. 56601
uuauaaauaaaa

SEQ ID NO: 743504 - RNA, 22 nt, Leptospira interrogans serovar lai str. 56601
uuauaaauauuaauuuaaaaac

SEQ ID NO: 743505 - RNA, 13 nt, Leptospira interrogans serovar lai str. 56601
uuauaaauguagg

SEQ ID NO: 743506 - RNA, 23 nt, Leptospira interrogans serovar lai str. 56601
uuauaauagauugauaauuaucc

SEQ ID NO: 743507 - RNA, 16 nt, Leptospira interrogans serovar lai str. 56601
uuauaaguagaaauuu

SEQ ID NO: 743508 - RNA, 16 nt, Leptospira interrogans serovar lai str. 56601
uuauaauaaucuuaac

SEQ ID NO: 743509 - RNA, 16 nt, Leptospira interrogans serovar lai str. 56601
uuauaaugauaaagua

SEQ ID NO: 743510 - RNA, 14 nt, Leptospira interrogans serovar lai str. 56601
uuauaauauucuuu

SEQ ID NO: 743511 - RNA, 20 nt, Leptospira interrogans serovar lai str. 56601
uuauaauucguuuuuuaaaa

SEQ ID NO: 743512 - RNA, 22 nt, Leptospira interrogans serovar lai str. 56601
uuauaauucguuuuuuaaaaug

SEQ ID NO: 743513 - RNA, 15 nt, Leptospira interrogans serovar lai str. 56601
uuauaauucuuuaaa

SEQ ID NO: 743514 - RNA, 16 nt, Leptospira interrogans serovar lai str. 56601
uuauaauucuuuaaaa

SEQ ID NO: 743515 - RNA, 21 nt, Leptospira interrogans serovar lai str. 56601
uuauaauuuagaguuguuaaa

SEQ ID NO: 743516 - RNA, 17 nt, Leptospira interrogans serovar lai str. 56601
uuauaauuuucuuaaua

SEQ ID NO: 743517 - RNA, 14 nt, Leptospira interrogans serovar lai str. 56601
uuauacuuuaauaa

SEQ ID NO: 743518 - RNA, 15 nt, Leptospira interrogans serovar lai str. 56601
uuauacuuuaauaau

SEQ ID NO: 743519 - RNA, 18 nt, Leptospira interrogans serovar lai str. 56601
uuauagaacgugucaugu

SEQ ID NO: 743520 - RNA, 13 nt, Leptospira interrogans serovar lai str. 56601
uuauacuauaacu

SEQ ID NO: 743521 - RNA, 14 nt, Leptospira interrogans serovar lai str. 56601
uuaguaaacuacua

SEQ ID NO: 743522 - RNA, 18 nt, Leptospira interrogans serovar lai str. 56601
uuaguaaaauuuaaaauu

SEQ ID NO: 743523 - RNA, 16 nt, Leptospira interrogans serovar lai str. 56601
uuaguaaaauuuaaau

SEQ ID NO: 743524 - RNA, 19 nt, Leptospira interrogans serovar lai str. 56601
uuagguuuuguaauaguuc

SEQ ID NO: 743525 - RNA, 15 nt, Leptospira interrogans serovar lai str. 56601
uuaggugauauuuuc

SEQ ID NO: 743526 - RNA, 13 nt, Leptospira interrogans serovar lai str. 56601
uuaggugcuacug

SEQ ID NO: 743527 - RNA, 20 nt, Leptospira interrogans serovar lai str. 56601
uuaguacuuuugaauuuacu

SEQ ID NO: 743528 - RNA, 19 nt, Leptospira interrogans serovar lai str. 56601
uuaguauuuuauuauauaa

SEQ ID NO: 743529 - RNA, 17 nt, Leptospira interrogans serovar lai str. 56601
uuaguauuuuucuuaau

SEQ ID NO: 743530 - RNA, 13 nt, Leptospira interrogans serovar lai str. 56601
uuagucuaaaaac

SEQ ID NO: 743531 - RNA, 17 nt, Leptospira interrogans serovar lai str. 56601
uuaguuguacaaaaaug

SEQ ID NO: 743532 - RNA, 23 nt, Leptospira interrogans serovar lai str. 56601
uuauaaaacgaaauuauacaaaa

SEQ ID NO: 743533 - RNA, 22 nt, Leptospira interrogans serovar lai str. 56601
uuauaaaaguauaauauuuauu

SEQ ID NO: 743534 - RNA, 13 nt, Leptospira interrogans serovar lai str. 56601
uuaguuuccaaaa

SEQ ID NO: 743535 - RNA, 12 nt, Leptospira interrogans serovar lai str. 56601
uuauaaaaacaa

SEQ ID NO: 743536 - RNA, 14 nt, Leptospira interrogans serovar lai str. 56601
uuaguucccacauu

SEQ ID NO: 743537 - RNA, 21 nt, Leptospira interrogans serovar lai str. 56601
uuaguuccuauagaauuuuca

SEQ ID NO: 743538 - RNA, 15 nt, Leptospira interrogans serovar lai str. 56601
uuaauuaaguaguuu

SEQ ID NO: 743539 - RNA, 23 nt, Leptospira interrogans serovar lai str. 56601
uuaauucuccauccuauuucugu

SEQ ID NO: 743540 - RNA, 19 nt, Leptospira interrogans serovar lai str. 56601
uuaauugcgguaguuccca

SEQ ID NO: 743541 - RNA, 17 nt, Leptospira interrogans serovar lai str. 56601
uuaaugcgaaaauuuaa

SEQ ID NO: 743542 - RNA, 21 nt, Leptospira interrogans serovar lai str. 56601
uuaaugcgaaaauuuaacuac

SEQ ID NO: 743543 - RNA, 23 nt, Leptospira interrogans serovar lai str. 56601
uuaccaaaaaugcaaaaguuuuc

SEQ ID NO: 743544 - RNA, 21 nt, Leptospira interrogans serovar lai str. 56601
uuaccaccccacccaaaaaua

SEQ ID NO: 743545 - RNA, 16 nt, Leptospira interrogans serovar lai str. 56601
uuaccacagugaaaga

SEQ ID NO: 743546 - RNA, 18 nt, Leptospira interrogans serovar lai str. 56601
uuaccacgaauuaaauac

SEQ ID NO: 743547 - RNA, 17 nt, Leptospira interrogans serovar lai str. 56601
uuacauuuuuaaauugu

SEQ ID NO: 743548 - RNA, 19 nt, Leptospira interrogans serovar lai str. 56601
uuacauuuuuaucuugauc

SEQ ID NO: 743549 - RNA, 14 nt, Leptospira interrogans serovar lai str. 56601
uuacauucaauaau

SEQ ID NO: 743550 - RNA, 17 nt, Leptospira interrogans serovar lai str. 56601
uuaauuucuaaacaauu

SEQ ID NO: 743551 - RNA, 23 nt, Leptospira interrogans serovar lai str. 56601
uuaauuucucuuauuagaacuca

SEQ ID NO: 743552 - RNA, 19 nt, Leptospira interrogans serovar lai str. 56601
uuaauuucuucauaucaaa

SEQ ID NO: 743553 - RNA, 23 nt, Leptospira interrogans serovar lai str. 56601
uuaauuugaucaucguuauauuu

SEQ ID NO: 743554 - RNA, 15 nt, Leptospira interrogans serovar lai str. 56601
uuaauuuuaguaaaa

SEQ ID NO: 743555 - RNA, 16 nt, Leptospira interrogans serovar lai str. 56601
uuaauuuuaguaaaaa

SEQ ID NO: 743556 - RNA, 20 nt, Leptospira interrogans serovar lai str. 56601
uuaauuuguuuggauucucc

SEQ ID NO: 743557 - RNA, 23 nt, Leptospira interrogans serovar lai str. 56601
uuacaaucgaacggauucuaauu

SEQ ID NO: 743558 - RNA, 18 nt, Leptospira interrogans serovar lai str. 56601
uuacaauuuauuauaaaa

SEQ ID NO: 743559 - RNA, 16 nt, Leptospira interrogans serovar lai str. 56601
uuacaauuaaacuuca

SEQ ID NO: 743560 - RNA, 24 nt, Leptospira interrogans serovar lai str. 56601
uuacaauuugcuaaaauaagaauc

SEQ ID NO: 743561 - RNA, 23 nt, Leptospira interrogans serovar lai str. 56601
uuacagacguauuuuuaaaugua

SEQ ID NO: 743562 - RNA, 16 nt, Leptospira interrogans serovar lai str. 56601
uuaagugaaaauuaca

SEQ ID NO: 743563 - RNA, 22 nt, Leptospira interrogans serovar lai str. 56601
uuaaguuguguugaaucuuaaa

SEQ ID NO: 743564 - RNA, 14 nt, Leptospira interrogans serovar lai str. 56601
uuaaguuuaaaaac

SEQ ID NO: 743565 - RNA, 15 nt, Leptospira interrogans serovar lai str. 56601
uuaaguucaaaaaaa

SEQ ID NO: 743566 - RNA, 17 nt, Leptospira interrogans serovar lai str. 56601
uuaagucacauuguguu

SEQ ID NO: 743567 - RNA, 23 nt, Leptospira interrogans serovar lai str. 56601
uuaagucccauuuagcaauuugu

SEQ ID NO: 743568 - RNA, 14 nt, Leptospira interrogans serovar lai str. 56601
uuaauaauaugaau

SEQ ID NO: 743569 - RNA, 15 nt, Leptospira interrogans serovar lai str. 56601
uuaauaagcugaaca

SEQ ID NO: 743570 - RNA, 14 nt, Leptospira interrogans serovar lai str. 56601
uuaaguuugugaga

SEQ ID NO: 743571 - RNA, 18 nt, Leptospira interrogans serovar lai str. 56601
uuaauauuuauaaaacaa

SEQ ID NO: 743572 - RNA, 21 nt, Leptospira interrogans serovar lai str. 56601
uuaauauuacauucaauaauu

SEQ ID NO: 743573 - RNA, 15 nt, Leptospira interrogans serovar lai str. 56601
uuaauauuauuaaau

SEQ ID NO: 743574 - RNA, 17 nt, Leptospira interrogans serovar lai str. 56601
uuaauauuauuaaauuu

SEQ ID NO: 743575 - RNA, 13 nt, Leptospira interrogans serovar lai str. 56601
uuaauauaaaaaa

SEQ ID NO: 743576 - RNA, 15 nt, Leptospira interrogans serovar lai str. 56601
uuaauauaaaaaaua

SEQ ID NO: 743577 - RNA, 16 nt, Leptospira interrogans serovar lai str. 56601
uuaauauaaaaaauaa

SEQ ID NO: 743578 - RNA, 23 nt, Leptospira interrogans serovar lai str. 56601
uuaauagacuaacgauuguaaaa

SEQ ID NO: 743579 - RNA, 17 nt, Leptospira interrogans serovar lai str. 56601
uuaaccuacagaacacu

SEQ ID NO: 743580 - RNA, 13 nt, Leptospira interrogans serovar lai str. 56601
uuaacgugaauuc

SEQ ID NO: 743581 - RNA, 20 nt, Leptospira interrogans serovar lai str. 56601
uguggauaccuuuaguuuuu

SEQ ID NO: 743582 - RNA, 19 nt, Leptospira interrogans serovar lai str. 56601
uguggagcucgauuuuaua

SEQ ID NO: 743583 - RNA, 18 nt, Leptospira interrogans serovar lai str. 56601
uguggaacucuauauaaa

SEQ ID NO: 743584 - RNA, 22 nt, Leptospira interrogans serovar lai str. 56601
uguggaaaacuuucuuuuacau

SEQ ID NO: 743585 - RNA, 17 nt, Leptospira interrogans serovar lai str. 56601
uuaagagaugugaguuu

SEQ ID NO: 743586 - RNA, 20 nt, Leptospira interrogans serovar lai str. 56601
uuaagcucgaauaaaaacaa

SEQ ID NO: 743587 - RNA, 19 nt, Leptospira interrogans serovar lai str. 56601
uuaagcgggaauuuaaguu

SEQ ID NO: 743588 - RNA, 20 nt, Leptospira interrogans serovar lai str. 56601
uuaagaauuuguuugucuuu

SEQ ID NO: 743589 - RNA, 19 nt, Leptospira interrogans serovar lai str. 56601
uuaagaauucuaaacacag

SEQ ID NO: 743590 - RNA, 17 nt, Leptospira interrogans serovar lai str. 56601
uuaacucccugauaacu

SEQ ID NO: 743591 - RNA, 14 nt, Leptospira interrogans serovar lai str. 56601
uuaagaauaaauaa

SEQ ID NO: 743592 - RNA, 22 nt, Leptospira interrogans serovar lai str. 56601
uuuccaacgaaguuccaacgua

SEQ ID NO: 743593 - RNA, 17 nt, Leptospira interrogans serovar lai str. 56601
uuuccaacuguuuauau

SEQ ID NO: 743594 - RNA, 17 nt, Leptospira interrogans serovar lai str. 56601
uuuccaaacucaaugcu

SEQ ID NO: 743595 - RNA, 18 nt, Leptospira interrogans serovar lai str. 56601
uuuccaaaaagaaaaaca

SEQ ID NO: 743596 - RNA, 18 nt, Leptospira interrogans serovar lai str. 56601
uuucauuuuuuucgaauu

SEQ ID NO: 743597 - RNA, 18 nt, Leptospira interrogans serovar lai str. 56601
uuucauuuuguuucuguu

SEQ ID NO: 743598 - RNA, 12 nt, Leptospira interrogans serovar lai str. 56601
uuucauuuuucc

SEQ ID NO: 743599 - RNA, 20 nt, Leptospira interrogans serovar lai str. 56601
uuucauuuuuccauaaaaaa

SEQ ID NO: 743600 - RNA, 14 nt, Leptospira interrogans serovar lai str. 56601
uuucauucccuucu

SEQ ID NO: 743601 - RNA, 19 nt, Leptospira interrogans serovar lai str. 56601
uuuccacuuuucucaucaa

SEQ ID NO: 743602 - RNA, 16 nt, Leptospira interrogans serovar lai str. 56601
uuuccagaaagaaguu

SEQ ID NO: 743603 - RNA, 15 nt, Leptospira interrogans serovar lai str. 56601
uuuccacuucaaaaa

SEQ ID NO: 743604 - RNA, 12 nt, Leptospira interrogans serovar lai str. 56601
uuuccacucuuu

SEQ ID NO: 743605 - RNA, 13 nt, Leptospira interrogans serovar lai str. 56601
uuucauauccaaa

SEQ ID NO: 743606 - RNA, 14 nt, Leptospira interrogans serovar lai str. 56601
uuucauauccaaaa

SEQ ID NO: 743607 - RNA, 22 nt, Leptospira interrogans serovar lai str. 56601
uuucauaggaaauucuuuucca

SEQ ID NO: 743608 - RNA, 16 nt, Leptospira interrogans serovar lai str. 56601
uuucauugaaauauga

SEQ ID NO: 743609 - RNA, 12 nt, Leptospira interrogans serovar lai str. 56601
uuucauuaaaac

SEQ ID NO: 743610 - RNA, 13 nt, Leptospira interrogans serovar lai str. 56601
uuucauuacaaaa

SEQ ID NO: 743611 - RNA, 23 nt, Leptospira interrogans serovar lai str. 56601
uuucauucaaaauaaauaauaca

SEQ ID NO: 743612 - RNA, 15 nt, Leptospira interrogans serovar lai str. 56601
uuucaugcaaaaauu

SEQ ID NO: 743613 - RNA, 17 nt, Leptospira interrogans serovar lai str. 56601
uuucaugcaaaaauuua

SEQ ID NO: 743614 - RNA, 15 nt, Leptospira interrogans serovar lai str. 56601
uuucaucuuugaacu

SEQ ID NO: 743615 - RNA, 14 nt, Leptospira interrogans serovar lai str. 56601
uuucaucuuuucca

SEQ ID NO: 743616 - RNA, 16 nt, Leptospira interrogans serovar lai str. 56601
uuucaucuuuuccauu

SEQ ID NO: 743617 - RNA, 16 nt, Leptospira interrogans serovar lai str. 56601
uuucaguucugagacc

SEQ ID NO: 743618 - RNA, 14 nt, Leptospira interrogans serovar lai str. 56601
uuucagcuccaaaa

SEQ ID NO: 743619 - RNA, 19 nt, Leptospira interrogans serovar lai str. 56601
uuucagugaauaaaauaaa

SEQ ID NO: 743620 - RNA, 22 nt, Leptospira interrogans serovar lai str. 56601
uuucagugaauaaaauaaaaaa

SEQ ID NO: 743621 - RNA, 21 nt, Leptospira interrogans serovar lai str. 56601
uuucaguauucuagaauauaa

SEQ ID NO: 743622 - RNA, 16 nt, Leptospira interrogans serovar lai str. 56601
uuucacuuuuuuaaag

SEQ ID NO: 743623 - RNA, 15 nt, Leptospira interrogans serovar lai str. 56601
uuucacuuuaaaaca

SEQ ID NO: 743624 - RNA, 16 nt, Leptospira interrogans serovar lai str. 56601
uuucaacaauucuauu

SEQ ID NO: 743625 - RNA, 17 nt, Leptospira interrogans serovar lai str. 56601
uuucaacaacucuaauu

SEQ ID NO: 743626 - RNA, 22 nt, Leptospira interrogans serovar lai str. 56601
uuucaacaacucuauuuuauuu

SEQ ID NO: 743627 - RNA, 15 nt, Leptospira interrogans serovar lai str. 56601
uuucaaauaaagaaa

SEQ ID NO: 743628 - RNA, 17 nt, Leptospira interrogans serovar lai str. 56601
uuucaaacacaaucugu

SEQ ID NO: 743629 - RNA, 21 nt, Leptospira interrogans serovar lai str. 56601
uuucaaaauuuuuuuaagagc

SEQ ID NO: 743630 - RNA, 13 nt, Leptospira interrogans serovar lai str. 56601
uuuauuuucuauu

SEQ ID NO: 743631 - RNA, 13 nt, Leptospira interrogans serovar lai str. 56601
uuuauuucugaga

SEQ ID NO: 743632 - RNA, 14 nt, Leptospira interrogans serovar lai str. 56601
uuuauuucugcugc

SEQ ID NO: 743633 - RNA, 12 nt, Leptospira interrogans serovar lai str. 56601
uuuauuuuaaaa

SEQ ID NO: 743634 - RNA, 12 nt, Leptospira interrogans serovar lai str. 56601
uuuauuuuaaag

SEQ ID NO: 743635 - RNA, 15 nt, Leptospira interrogans serovar lai str. 56601
uuuauucuccauucu

SEQ ID NO: 743636 - RNA, 12 nt, Leptospira interrogans serovar lai str. 56601
uuuauucuaaac

SEQ ID NO: 743637 - RNA, 19 nt, Leptospira interrogans serovar lai str. 56601
uuuauucacugaaaauuua

SEQ ID NO: 743638 - RNA, 22 nt, Leptospira interrogans serovar lai str. 56601
uuuauucauagaccaauuuuuu

SEQ ID NO: 743639 - RNA, 16 nt, Leptospira interrogans serovar lai str. 56601
uuuauuucaaaauuuu

SEQ ID NO: 743640 - RNA, 18 nt, Leptospira interrogans serovar lai str. 56601
uuuauuucaaaauuuuuu

SEQ ID NO: 743641 - RNA, 14 nt, Leptospira interrogans serovar lai str. 56601
uuuauuucuaaguc

SEQ ID NO: 743642 - RNA, 21 nt, Leptospira interrogans serovar lai str. 56601
uuuauuauaaauuuauaaaug

SEQ ID NO: 743643 - RNA, 13 nt, Leptospira interrogans serovar lai str. 56601
uuuauauaauuua

SEQ ID NO: 743644 - RNA, 15 nt, Leptospira interrogans serovar lai str. 56601
uuuauucaaaauauc

SEQ ID NO: 743645 - RNA, 23 nt, Leptospira interrogans serovar lai str. 56601
uuuauuauguagccaaaucugaa

SEQ ID NO: 743646 - RNA, 22 nt, Leptospira interrogans serovar lai str. 56601
uuuauauaguaaauaccuguuc

SEQ ID NO: 743647 - RNA, 16 nt, Leptospira interrogans serovar lai str. 56601
uuuauaguuuuuaacu

SEQ ID NO: 743648 - RNA, 13 nt, Leptospira interrogans serovar lai str. 56601
uuuauagaauuua

SEQ ID NO: 743649 - RNA, 22 nt, Leptospira interrogans serovar lai str. 56601
uuuauagaucgauucuuuaaau

SEQ ID NO: 743650 - RNA, 12 nt, Leptospira interrogans serovar lai str. 56601
uuuauaaauugc

SEQ ID NO: 743651 - RNA, 22 nt, Leptospira interrogans serovar lai str. 56601
uuuauacggaugugaauucucu

SEQ ID NO: 743652 - RNA, 22 nt, Leptospira interrogans serovar lai str. 56601
uuuauacuauaacuuuaaaaaa

SEQ ID NO: 743653 - RNA, 15 nt, Leptospira interrogans serovar lai str. 56601
uuucaauaauucuau

SEQ ID NO: 743654 - RNA, 18 nt, Leptospira interrogans serovar lai str. 56601
uuucaaguguucuacggc

SEQ ID NO: 743655 - RNA, 15 nt, Leptospira interrogans serovar lai str. 56601
uuucaaguuuucuuu

SEQ ID NO: 743656 - RNA, 16 nt, Leptospira interrogans serovar lai str. 56601
uuucaacuuuagaaaa

SEQ ID NO: 743657 - RNA, 20 nt, Leptospira interrogans serovar lai str. 56601
uuucaacuuuagaaaaauau

SEQ ID NO: 743658 - RNA, 19 nt, Leptospira interrogans serovar lai str. 56601
uuucaacuuuuuucagaaa

SEQ ID NO: 743659 - RNA, 21 nt, Leptospira interrogans serovar lai str. 56601
uuucaacuuuuuucagaaaaa

SEQ ID NO: 743660 - RNA, 13 nt, Leptospira interrogans serovar lai str. 56601
uuucaauauaaaa

SEQ ID NO: 743661 - RNA, 14 nt, Leptospira interrogans serovar lai str. 56601
uuucaauauaaaaa

SEQ ID NO: 743662 - RNA, 20 nt, Leptospira interrogans serovar lai str. 56601
uuucaaucuauuaacuuuac

SEQ ID NO: 743663 - RNA, 21 nt, Leptospira interrogans serovar lai str. 56601
uuucaaucuccccaaaaucuu

SEQ ID NO: 743664 - RNA, 18 nt, Leptospira interrogans serovar lai str. 56601
uuucaauguuuuucgcuu

SEQ ID NO: 743665 - RNA, 15 nt, Leptospira interrogans serovar lai str. 56601
uuucaauuuaaaaua

SEQ ID NO: 743666 - RNA, 16 nt, Leptospira interrogans serovar lai str. 56601
uuucaauuuaaaauau

SEQ ID NO: 743667 - RNA, 18 nt, Leptospira interrogans serovar lai str. 56601
uuucaauuuaaaauauca

SEQ ID NO: 743668 - RNA, 13 nt, Leptospira interrogans serovar lai str. 56601
uuucaauuuuuga

SEQ ID NO: 743669 - RNA, 14 nt, Leptospira interrogans serovar lai str. 56601
uuucaauuuuugaa

SEQ ID NO: 743670 - RNA, 17 nt, Leptospira interrogans serovar lai str. 56601
uuucacaaaaaaauucu

SEQ ID NO: 743671 - RNA, 23 nt, Leptospira interrogans serovar lai str. 56601
uuucacaaaaaaauucuccucuu

SEQ ID NO: 743672 - RNA, 12 nt, Leptospira interrogans serovar lai str. 56601
uuucacaaaaau

SEQ ID NO: 743673 - RNA, 14 nt, Leptospira interrogans serovar lai str. 56601
uuucaauuuucuca

SEQ ID NO: 743674 - RNA, 11 nt, Leptospira interrogans serovar lai str. 56601
uuuaauuugua

SEQ ID NO: 743675 - RNA, 19 nt, Leptospira interrogans serovar lai str. 56601
uuuaauuuauaauucguuu

SEQ ID NO: 743676 - RNA, 16 nt, Leptospira interrogans serovar lai str. 56601
uuuaauuucuucauau

SEQ ID NO: 743677 - RNA, 22 nt, Leptospira interrogans serovar lai str. 56601
uuuaauuucuucauaucaaauu

SEQ ID NO: 743678 - RNA, 23 nt, Leptospira interrogans serovar lai str. 56601
uuuaacuguaauuagaggauaaa

SEQ ID NO: 743679 - RNA, 22 nt, Leptospira interrogans serovar lai str. 56601
uuuaauuggacgagcuuuauuu

SEQ ID NO: 743680 - RNA, 11 nt, Leptospira interrogans serovar lai str. 56601
uuuaauuauuu

SEQ ID NO: 743681 - RNA, 20 nt, Leptospira interrogans serovar lai str. 56601
uuuaccagaucaauucuuaa

SEQ ID NO: 743682 - RNA, 14 nt, Leptospira interrogans serovar lai str. 56601
uuuacgauccuuuu

SEQ ID NO: 743683 - RNA, 18 nt, Leptospira interrogans serovar lai str. 56601
uuuacgaacgaauucuaa

SEQ ID NO: 743684 - RNA, 22 nt, Leptospira interrogans serovar lai str. 56601
uuuacgaacgaauucuaaaauu

SEQ ID NO: 743685 - RNA, 21 nt, Leptospira interrogans serovar lai str. 56601
uuuacgaaaguugaaaguuuu

SEQ ID NO: 743686 - RNA, 20 nt, Leptospira interrogans serovar lai str. 56601
uuuacgaacaaauucuaaaa

SEQ ID NO: 743687 - RNA, 18 nt, Leptospira interrogans serovar lai str. 56601
uuuacgaacacauucuaa

SEQ ID NO: 743688 - RNA, 20 nt, Leptospira interrogans serovar lai str. 56601
uuuacgaacacauucuaaaa

SEQ ID NO: 743689 - RNA, 18 nt, Leptospira interrogans serovar lai str. 56601
uuuaccuugaaacuuuua

SEQ ID NO: 743690 - RNA, 16 nt, Leptospira interrogans serovar lai str. 56601
uuuacccgauauuaaa

SEQ ID NO: 743691 - RNA, 19 nt, Leptospira interrogans serovar lai str. 56601
uuuacccgauauuaaaaug

SEQ ID NO: 743692 - RNA, 21 nt, Leptospira interrogans serovar lai str. 56601
uuuacaauuugcuaaaauaag

SEQ ID NO: 743693 - RNA, 13 nt, Leptospira interrogans serovar lai str. 56601
uuuaccaaauugu

SEQ ID NO: 743694 - RNA, 15 nt, Leptospira interrogans serovar lai str. 56601
uuuaccaaaaaugca

SEQ ID NO: 743695 - RNA, 15 nt, Leptospira interrogans serovar lai str. 56601
uuuacacauuuauuu

SEQ ID NO: 743696 - RNA, 14 nt, Leptospira interrogans serovar lai str. 56601
uuuaauuuuucuga

SEQ ID NO: 743697 - RNA, 22 nt, Leptospira interrogans serovar lai str. 56601
uuuacaaagacucggaaauucu

SEQ ID NO: 743698 - RNA, 19 nt, Leptospira interrogans serovar lai str. 56601
uuuacaaagaguuuaaaaa

SEQ ID NO: 743699 - RNA, 20 nt, Leptospira interrogans serovar lai str. 56601
uuuacaaagaguuuaaaaaa

SEQ ID NO: 743700 - RNA, 18 nt, Leptospira interrogans serovar lai str. 56601
uuuacaaagucuugaacu

SEQ ID NO: 743701 - RNA, 13 nt, Leptospira interrogans serovar lai str. 56601
uuuacaaaaaugu

SEQ ID NO: 743702 - RNA, 14 nt, Leptospira interrogans serovar lai str. 56601
uuuacaaaaaugua

SEQ ID NO: 743703 - RNA, 11 nt, Leptospira interrogans serovar lai str. 56601
uuuacaaacaa

SEQ ID NO: 743704 - RNA, 19 nt, Leptospira interrogans serovar lai str. 56601
uuuacaaacuuacauuagu

SEQ ID NO: 743705 - RNA, 21 nt, Leptospira interrogans serovar lai str. 56601
uuuagucauuuccuccaaaca

SEQ ID NO: 743706 - RNA, 16 nt, Leptospira interrogans serovar lai str. 56601
uuuaguaguaaauaaa

SEQ ID NO: 743707 - RNA, 19 nt, Leptospira interrogans serovar lai str. 56601
uuuaguaguaaauaaaaaa

SEQ ID NO: 743708 - RNA, 15 nt, Leptospira interrogans serovar lai str. 56601
uuuaguauaaucaaa

SEQ ID NO: 743709 - RNA, 19 nt, Leptospira interrogans serovar lai str. 56601
uuuaggguuaucuucgaaa

SEQ ID NO: 743710 - RNA, 13 nt, Leptospira interrogans serovar lai str. 56601
uuuagguuuuugg

SEQ ID NO: 743711 - RNA, 12 nt, Leptospira interrogans serovar lai str. 56601
uuuauaaauaaa

SEQ ID NO: 743712 - RNA, 12 nt, Leptospira interrogans serovar lai str. 56601
uuuauaaaguuu

SEQ ID NO: 743713 - RNA, 13 nt, Leptospira interrogans serovar lai str. 56601
uuuauaaaguuua

SEQ ID NO: 743714 - RNA, 22 nt, Leptospira interrogans serovar lai str. 56601
uuuauaaauguaggaacuacua

SEQ ID NO: 743715 - RNA, 18 nt, Leptospira interrogans serovar lai str. 56601
uuuauaaaguaaagguuu

SEQ ID NO: 743716 - RNA, 18 nt, Leptospira interrogans serovar lai str. 56601
uuuauaaagauuuccuaa

SEQ ID NO: 743717 - RNA, 18 nt, Leptospira interrogans serovar lai str. 56601
uuuauaaagacuuuaaau

SEQ ID NO: 743718 - RNA, 13 nt, Leptospira interrogans serovar lai str. 56601
uuuauaaagauaa

SEQ ID NO: 743719 - RNA, 16 nt, Leptospira interrogans serovar lai str. 56601
uuuauaaagauaaauc

SEQ ID NO: 743720 - RNA, 14 nt, Leptospira interrogans serovar lai str. 56601
uuuauaaacuucuc

SEQ ID NO: 743721 - RNA, 13 nt, Leptospira interrogans serovar lai str. 56601
uuuaguuuuuccu

SEQ ID NO: 743722 - RNA, 13 nt, Leptospira interrogans serovar lai str. 56601
uuuauaaaaucua

SEQ ID NO: 743723 - RNA, 14 nt, Leptospira interrogans serovar lai str. 56601
uuuauaaaaucuaa

SEQ ID NO: 743724 - RNA, 15 nt, Leptospira interrogans serovar lai str. 56601
uuuauaaaaauacag

SEQ ID NO: 743725 - RNA, 22 nt, Leptospira interrogans serovar lai str. 56601
uuuauaaaacaaucuucaaauu

SEQ ID NO: 743726 - RNA, 24 nt, Leptospira interrogans serovar lai str. 56601
uuuauaaaacgaaauuauacaaaa

SEQ ID NO: 743727 - RNA, 16 nt, Leptospira interrogans serovar lai str. 56601
uuuauaaaacuguaaa

SEQ ID NO: 743728 - RNA, 15 nt, Leptospira interrogans serovar lai str. 56601
uuuauaaaaguauaa

SEQ ID NO: 743729 - RNA, 21 nt, Leptospira interrogans serovar lai str. 56601
uuuauaaaauaaaaaaauuca

SEQ ID NO: 743730 - RNA, 17 nt, Leptospira interrogans serovar lai str. 56601
uuuacgcaggcuuguuu

SEQ ID NO: 743731 - RNA, 19 nt, Leptospira interrogans serovar lai str. 56601
uuuacugcuugacaucuuu

SEQ ID NO: 743732 - RNA, 14 nt, Leptospira interrogans serovar lai str. 56601
uuuacucuuauuua

SEQ ID NO: 743733 - RNA, 17 nt, Leptospira interrogans serovar lai str. 56601
uuuacucuuauuuauau

SEQ ID NO: 743734 - RNA, 21 nt, Leptospira interrogans serovar lai str. 56601
uuuacucgugcacaaguuuuu

SEQ ID NO: 743735 - RNA, 15 nt, Leptospira interrogans serovar lai str. 56601
uuuacuguaaaauuu

SEQ ID NO: 743736 - RNA, 17 nt, Leptospira interrogans serovar lai str. 56601
uuuaggaagaaacaaag

SEQ ID NO: 743737 - RNA, 13 nt, Leptospira interrogans serovar lai str. 56601
uuuaggauuaauu

SEQ ID NO: 743738 - RNA, 15 nt, Leptospira interrogans serovar lai str. 56601
uuuaggauuuaguuc

SEQ ID NO: 743739 - RNA, 21 nt, Leptospira interrogans serovar lai str. 56601
uuuagcucuagucaaguuaau

SEQ ID NO: 743740 - RNA, 14 nt, Leptospira interrogans serovar lai str. 56601
uuuaaauuuacuau

SEQ ID NO: 743741 - RNA, 18 nt, Leptospira interrogans serovar lai str. 56601
uuuaaauguagaaacuac

SEQ ID NO: 743742 - RNA, 19 nt, Leptospira interrogans serovar lai str. 56601
uuuaaauguauguuuacuu

SEQ ID NO: 743743 - RNA, 23 nt, Leptospira interrogans serovar lai str. 56601
uuuaaauguauguuuacuugaaa

SEQ ID NO: 743744 - RNA, 12 nt, Leptospira interrogans serovar lai str. 56601
uuuaaauguuau

SEQ ID NO: 743745 - RNA, 18 nt, Leptospira interrogans serovar lai str. 56601
uuuaaauuagcuuaagaa

SEQ ID NO: 743746 - RNA, 15 nt, Leptospira interrogans serovar lai str. 56601
uuuaaauucccucaa

SEQ ID NO: 743747 - RNA, 19 nt, Leptospira interrogans serovar lai str. 56601
uuuaaauucccucaauaau

SEQ ID NO: 743748 - RNA, 17 nt, Leptospira interrogans serovar lai str. 56601
uuuaaauacuuuauaau

SEQ ID NO: 743749 - RNA, 17 nt, Leptospira interrogans serovar lai str. 56601
uuuaaauacuuuuaugg

SEQ ID NO: 743750 - RNA, 20 nt, Leptospira interrogans serovar lai str. 56601
uuuaaauacucuaauuuuuu

SEQ ID NO: 743751 - RNA, 17 nt, Leptospira interrogans serovar lai str. 56601
uuuaaauccaacuuaaa

SEQ ID NO: 743752 - RNA, 20 nt, Leptospira interrogans serovar lai str. 56601
uuuaaaaucguaaaaaagau

SEQ ID NO: 743753 - RNA, 21 nt, Leptospira interrogans serovar lai str. 56601
uuuaaaaucguaaaaaagaua

SEQ ID NO: 743754 - RNA, 23 nt, Leptospira interrogans serovar lai str. 56601
uuuaaaaucguaaaaaagauaaa

SEQ ID NO: 743755 - RNA, 15 nt, Leptospira interrogans serovar lai str. 56601
uuuaaacaacaguac

SEQ ID NO: 743756 - RNA, 21 nt, Leptospira interrogans serovar lai str. 56601
uuuaaacaacaguacaagaau

SEQ ID NO: 743757 - RNA, 23 nt, Leptospira interrogans serovar lai str. 56601
uuuaaacaacaguacaagaauca

SEQ ID NO: 743758 - RNA, 21 nt, Leptospira interrogans serovar lai str. 56601
uuuaaaauuguguaugaguuc

SEQ ID NO: 743759 - RNA, 22 nt, Leptospira interrogans serovar lai str. 56601
uuuaaaccgauuucaauuuucu

SEQ ID NO: 743760 - RNA, 20 nt, Leptospira interrogans serovar lai str. 56601
uuuaaaccuucuuuaagaua

SEQ ID NO: 743761 - RNA, 19 nt, Leptospira interrogans serovar lai str. 56601
uuuaaacgaucagaaaaac

SEQ ID NO: 743762 - RNA, 23 nt, Leptospira interrogans serovar lai str. 56601
uuuaaacgaucagaaaaacaaaa

SEQ ID NO: 743763 - RNA, 20 nt, Leptospira interrogans serovar lai str. 56601
uuuaaacgauuuaaaagaau

SEQ ID NO: 743764 - RNA, 22 nt, Leptospira interrogans serovar lai str. 56601
uuuaaagaaugaucaacuacua

SEQ ID NO: 743765 - RNA, 21 nt, Leptospira interrogans serovar lai str. 56601
uuuaaagaauuuuuacagaaa

SEQ ID NO: 743766 - RNA, 21 nt, Leptospira interrogans serovar lai str. 56601
uuuaaacuuuguuuuugcuca

SEQ ID NO: 743767 - RNA, 24 nt, Leptospira interrogans serovar lai str. 56601
uuuaaacuauagagaaauccaauc

SEQ ID NO: 743768 - RNA, 22 nt, Leptospira interrogans serovar lai str. 56601
uuuaaagccucaugaaaaucua

SEQ ID NO: 743769 - RNA, 22 nt, Leptospira interrogans serovar lai str. 56601
uuuaaaguaaucguuuaaagau

SEQ ID NO: 743770 - RNA, 18 nt, Leptospira interrogans serovar lai str. 56601
uuuaaauaaaaagaagag

SEQ ID NO: 743771 - RNA, 15 nt, Leptospira interrogans serovar lai str. 56601
uuuaaaaacuaucag

SEQ ID NO: 743772 - RNA, 21 nt, Leptospira interrogans serovar lai str. 56601
uuuaaaaacuuguuguaccau

SEQ ID NO: 743773 - RNA, 11 nt, Leptospira interrogans serovar lai str. 56601
uuuaaaaacag

SEQ ID NO: 743774 - RNA, 11 nt, Leptospira interrogans serovar lai str. 56601
uuuaaaaaacc

SEQ ID NO: 743775 - RNA, 13 nt, Leptospira interrogans serovar lai str. 56601
uuuaaaaaauauc

SEQ ID NO: 743776 - RNA, 13 nt, Leptospira interrogans serovar lai str. 56601
uuuaaaaaauuaa

SEQ ID NO: 743777 - RNA, 13 nt, Leptospira interrogans serovar lai str. 56601
uuuaaaaaauuuc

SEQ ID NO: 743778 - RNA, 13 nt, Leptospira interrogans serovar lai str. 56601
uuguuuuuuccag

SEQ ID NO: 743779 - RNA, 14 nt, Leptospira interrogans serovar lai str. 56601
uuguuuuuaaauua

SEQ ID NO: 743780 - RNA, 23 nt, Leptospira interrogans serovar lai str. 56601
uuguuuaaaaugcggaaacuuuu

SEQ ID NO: 743781 - RNA, 17 nt, Leptospira interrogans serovar lai str. 56601
uuguuguuauggaauuu

SEQ ID NO: 743782 - RNA, 23 nt, Leptospira interrogans serovar lai str. 56601
uuguuuacccgauauuaaaauga

SEQ ID NO: 743783 - RNA, 15 nt, Leptospira interrogans serovar lai str. 56601
uuguuuacaaacuua

SEQ ID NO: 743784 - RNA, 15 nt, Leptospira interrogans serovar lai str. 56601
uuguuucauaaaauu

SEQ ID NO: 743785 - RNA, 11 nt, Leptospira interrogans serovar lai str. 56601
uuguuuccuuc

SEQ ID NO: 743786 - RNA, 13 nt, Leptospira interrogans serovar lai str. 56601
uuguuuccuucuu

SEQ ID NO: 743787 - RNA, 11 nt, Leptospira interrogans serovar lai str. 56601
uuguugugaac

SEQ ID NO: 743788 - RNA, 18 nt, Leptospira interrogans serovar lai str. 56601
uuguuauaaacuucuauu

SEQ ID NO: 743789 - RNA, 22 nt, Leptospira interrogans serovar lai str. 56601
uuguuaucugugaauucuccaa

SEQ ID NO: 743790 - RNA, 16 nt, Leptospira interrogans serovar lai str. 56601
uuguuaugcaaauaca

SEQ ID NO: 743791 - RNA, 20 nt, Leptospira interrogans serovar lai str. 56601
uuugcaguaaggauucuuuu

SEQ ID NO: 743792 - RNA, 23 nt, Leptospira interrogans serovar lai str. 56601
uuugcgaccaucaucaaaacuua

SEQ ID NO: 743793 - RNA, 20 nt, Leptospira interrogans serovar lai str. 56601
uuugcggaucguuuuuauuc

SEQ ID NO: 743794 - RNA, 23 nt, Leptospira interrogans serovar lai str. 56601
uuugcucagagaauaucugaauu

SEQ ID NO: 743795 - RNA, 21 nt, Leptospira interrogans serovar lai str. 56601
uuugauaccgggauuuuaaaa

SEQ ID NO: 743796 - RNA, 22 nt, Leptospira interrogans serovar lai str. 56601
uuugaguccacagguuuuaaac

SEQ ID NO: 743797 - RNA, 16 nt, Leptospira interrogans serovar lai str. 56601
uuugaguagaagccaa

SEQ ID NO: 743798 - RNA, 21 nt, Leptospira interrogans serovar lai str. 56601
uuugaguagccaauugaauau

SEQ ID NO: 743799 - RNA, 14 nt, Leptospira interrogans serovar lai str. 56601
uuugagguuuuaaa

SEQ ID NO: 743800 - RNA, 15 nt, Leptospira interrogans serovar lai str. 56601
uuugagguuuuaaaa

SEQ ID NO: 743801 - RNA, 18 nt, Leptospira interrogans serovar lai str. 56601
uuugaggucccacaauca

SEQ ID NO: 743802 - RNA, 19 nt, Leptospira interrogans serovar lai str. 56601
uuugauuagaaaaaaagua

SEQ ID NO: 743803 - RNA, 20 nt, Leptospira interrogans serovar lai str. 56601
uuugauuaaaaauuucuaaa

SEQ ID NO: 743804 - RNA, 19 nt, Leptospira interrogans serovar lai str. 56601
uuugaucuuuuugauaaaa

SEQ ID NO: 743805 - RNA, 22 nt, Leptospira interrogans serovar lai str. 56601
uuugaucuuuuuuucuagauau

SEQ ID NO: 743806 - RNA, 13 nt, Leptospira interrogans serovar lai str. 56601
uuugaugaaauag

SEQ ID NO: 743807 - RNA, 15 nt, Leptospira interrogans serovar lai str. 56601
uuugaugaaauaguc

SEQ ID NO: 743808 - RNA, 14 nt, Leptospira interrogans serovar lai str. 56601
uuugaugaaugaau

SEQ ID NO: 743809 - RNA, 16 nt, Leptospira interrogans serovar lai str. 56601
uuugaucucaauauaa

SEQ ID NO: 743810 - RNA, 15 nt, Leptospira interrogans serovar lai str. 56601
uuugauaugaaucag

SEQ ID NO: 743811 - RNA, 18 nt, Leptospira interrogans serovar lai str. 56601
uuugauauauuuuuaaag

SEQ ID NO: 743812 - RNA, 12 nt, Leptospira interrogans serovar lai str. 56601
uuugcaaguaaa

SEQ ID NO: 743813 - RNA, 20 nt, Leptospira interrogans serovar lai str. 56601
uuugauuuuucgaaaauuaa

SEQ ID NO: 743814 - RNA, 14 nt, Leptospira interrogans serovar lai str. 56601
uuugcaaaaaaaua

SEQ ID NO: 743815 - RNA, 14 nt, Leptospira interrogans serovar lai str. 56601
uuugauuggauucu

SEQ ID NO: 743816 - RNA, 14 nt, Leptospira interrogans serovar lai str. 56601
uuugauucauucag

SEQ ID NO: 743817 - RNA, 22 nt, Leptospira interrogans serovar lai str. 56601
uuugauuccaaagauaaaaaag

SEQ ID NO: 743818 - RNA, 15 nt, Leptospira interrogans serovar lai str. 56601
uuucuuugucuuuau

SEQ ID NO: 743819 - RNA, 17 nt, Leptospira interrogans serovar lai str. 56601
uuucuuucucucgaaau

SEQ ID NO: 743820 - RNA, 19 nt, Leptospira interrogans serovar lai str. 56601
uuucuuucggcagccaauu

SEQ ID NO: 743821 - RNA, 13 nt, Leptospira interrogans serovar lai str. 56601
uuucuuucuaaau

SEQ ID NO: 743822 - RNA, 22 nt, Leptospira interrogans serovar lai str. 56601
uuucuuugauugaauuaaaaaa

SEQ ID NO: 743823 - RNA, 18 nt, Leptospira interrogans serovar lai str. 56601
uuucuuugaacuuuuuca

SEQ ID NO: 743824 - RNA, 22 nt, Leptospira interrogans serovar lai str. 56601
uuucuuuaaugcugauuuuucu

SEQ ID NO: 743825 - RNA, 17 nt, Leptospira interrogans serovar lai str. 56601
uuucuugucucuacucu

SEQ ID NO: 743826 - RNA, 13 nt, Leptospira interrogans serovar lai str. 56601
uuucuuucaaaaa

SEQ ID NO: 743827 - RNA, 18 nt, Leptospira interrogans serovar lai str. 56601
uuucuuucaaaaauuuaa

SEQ ID NO: 743828 - RNA, 23 nt, Leptospira interrogans serovar lai str. 56601
uuucuuuagaaauuuuuaauaaa

SEQ ID NO: 743829 - RNA, 22 nt, Leptospira interrogans serovar lai str. 56601
uuucuuuagacauuguuuuacu

SEQ ID NO: 743830 - RNA, 21 nt, Leptospira interrogans serovar lai str. 56601
uuucuuuaucagaaaaacaua

SEQ ID NO: 743831 - RNA, 15 nt, Leptospira interrogans serovar lai str. 56601
uuucuuuauuggaaa

SEQ ID NO: 743832 - RNA, 16 nt, Leptospira interrogans serovar lai str. 56601
uuucuugguucaaaug

SEQ ID NO: 743833 - RNA, 13 nt, Leptospira interrogans serovar lai str. 56601
uuucuugcccaac

SEQ ID NO: 743834 - RNA, 12 nt, Leptospira interrogans serovar lai str. 56601
uuucuuguguca

SEQ ID NO: 743835 - RNA, 17 nt, Leptospira interrogans serovar lai str. 56601
uuucuugugucaagccc

SEQ ID NO: 743836 - RNA, 21 nt, Leptospira interrogans serovar lai str. 56601
uuucuugugucaagcccuccu

SEQ ID NO: 743837 - RNA, 20 nt, Leptospira interrogans serovar lai str. 56601
uuucuugaacucaauacauc

SEQ ID NO: 743838 - RNA, 11 nt, Leptospira interrogans serovar lai str. 56601
uuucuucuuuu

SEQ ID NO: 743839 - RNA, 16 nt, Leptospira interrogans serovar lai str. 56601
uuucuucgauuucuuu

SEQ ID NO: 743840 - RNA, 19 nt, Leptospira interrogans serovar lai str. 56601
uuucuucccagauucccuu

SEQ ID NO: 743841 - RNA, 19 nt, Leptospira interrogans serovar lai str. 56601
uuucuuccggauuaaaaag

SEQ ID NO: 743842 - RNA, 15 nt, Leptospira interrogans serovar lai str. 56601
uuucuucauaaaauc

SEQ ID NO: 743843 - RNA, 17 nt, Leptospira interrogans serovar lai str. 56601
uuucuuccaauuguucc

SEQ ID NO: 743844 - RNA, 16 nt, Leptospira interrogans serovar lai str. 56601
uuucuuauuaauucuu

SEQ ID NO: 743845 - RNA, 21 nt, Leptospira interrogans serovar lai str. 56601
uuucuuauuaauucuuauucu

SEQ ID NO: 743846 - RNA, 20 nt, Leptospira interrogans serovar lai str. 56601
uuucuuauguggaugauaaa

SEQ ID NO: 743847 - RNA, 21 nt, Leptospira interrogans serovar lai str. 56601
uuucuuauaaccuaucacaaa

SEQ ID NO: 743848 - RNA, 23 nt, Leptospira interrogans serovar lai str. 56601
uuucuuauaaccuaucacaaacu

SEQ ID NO: 743849 - RNA, 20 nt, Leptospira interrogans serovar lai str. 56601
uuucuuacucgacaaaacac

SEQ ID NO: 743850 - RNA, 13 nt, Leptospira interrogans serovar lai str. 56601
uuucuuaaauuaa

SEQ ID NO: 743851 - RNA, 12 nt, Leptospira interrogans serovar lai str. 56601
uuucuuaaaaaa

SEQ ID NO: 743852 - RNA, 13 nt, Leptospira interrogans serovar lai str. 56601
uuucuuaaaaaaa

SEQ ID NO: 743853 - RNA, 19 nt, Leptospira interrogans serovar lai str. 56601
uuucuuaaauuuuuuuuca

SEQ ID NO: 743854 - RNA, 12 nt, Leptospira interrogans serovar lai str. 56601
uuucuguuuauu

SEQ ID NO: 743855 - RNA, 16 nt, Leptospira interrogans serovar lai str. 56601
uuucuguuucaugaaa

SEQ ID NO: 743856 - RNA, 15 nt, Leptospira interrogans serovar lai str. 56601
uuugagauuaaaaag

SEQ ID NO: 743857 - RNA, 17 nt, Leptospira interrogans serovar lai str. 56601
uuugagauuaaaaagaa

SEQ ID NO: 743858 - RNA, 15 nt, Leptospira interrogans serovar lai str. 56601
uuugagauuacaaaa

SEQ ID NO: 743859 - RNA, 22 nt, Leptospira interrogans serovar lai str. 56601
uuugagaaaagagauuucugag

SEQ ID NO: 743860 - RNA, 15 nt, Leptospira interrogans serovar lai str. 56601
uuugagaaaccuuuu

SEQ ID NO: 743861 - RNA, 20 nt, Leptospira interrogans serovar lai str. 56601
uuugagacaggcucaauauu

SEQ ID NO: 743862 - RNA, 22 nt, Leptospira interrogans serovar lai str. 56601
uuugagacagguucugauauaa

SEQ ID NO: 743863 - RNA, 21 nt, Leptospira interrogans serovar lai str. 56601
uuugagagagaguucuacuga

SEQ ID NO: 743864 - RNA, 22 nt, Leptospira interrogans serovar lai str. 56601
uuugacucuaagcuuuagaaaa

SEQ ID NO: 743865 - RNA, 16 nt, Leptospira interrogans serovar lai str. 56601
uuugacguaaaaaaau

SEQ ID NO: 743866 - RNA, 13 nt, Leptospira interrogans serovar lai str. 56601
uuugaauugaaau

SEQ ID NO: 743867 - RNA, 14 nt, Leptospira interrogans serovar lai str. 56601
uuugaauuuuacua

SEQ ID NO: 743868 - RNA, 16 nt, Leptospira interrogans serovar lai str. 56601
uuugaauuuuacuaaa

SEQ ID NO: 743869 - RNA, 11 nt, Leptospira interrogans serovar lai str. 56601
uuugaauagag

SEQ ID NO: 743870 - RNA, 20 nt, Leptospira interrogans serovar lai str. 56601
uuugacacucuaauguacaa

SEQ ID NO: 743871 - RNA, 13 nt, Leptospira interrogans serovar lai str. 56601
uuugaauuuuucg

SEQ ID NO: 743872 - RNA, 20 nt, Leptospira interrogans serovar lai str. 56601
uuucuuuuucuagguuuaaa

SEQ ID NO: 743873 - RNA, 14 nt, Leptospira interrogans serovar lai str. 56601
uuucuuuuuuaaac

SEQ ID NO: 743874 - RNA, 13 nt, Leptospira interrogans serovar lai str. 56601
uuucuuuuuaaau

SEQ ID NO: 743875 - RNA, 17 nt, Leptospira interrogans serovar lai str. 56601
uuugaaacucaguaaaa

SEQ ID NO: 743876 - RNA, 17 nt, Leptospira interrogans serovar lai str. 56601
uuugaaacauuucuaaa

SEQ ID NO: 743877 - RNA, 20 nt, Leptospira interrogans serovar lai str. 56601
uuugaaacauuucuaaaaua

SEQ ID NO: 743878 - RNA, 22 nt, Leptospira interrogans serovar lai str. 56601
uuugaaaaagggauucuauucu

SEQ ID NO: 743879 - RNA, 21 nt, Leptospira interrogans serovar lai str. 56601
uuugaaaguaaaaaagagcuu

SEQ ID NO: 743880 - RNA, 22 nt, Leptospira interrogans serovar lai str. 56601
uuugaaauagauucuaauuuuu

SEQ ID NO: 743881 - RNA, 19 nt, Leptospira interrogans serovar lai str. 56601
uuugaaaucucuaacaaaa

SEQ ID NO: 743882 - RNA, 20 nt, Leptospira interrogans serovar lai str. 56601
uuugaauauagcacaaauga

SEQ ID NO: 743883 - RNA, 23 nt, Leptospira interrogans serovar lai str. 56601
uuugaauauagcacaaaugacau

SEQ ID NO: 743884 - RNA, 22 nt, Leptospira interrogans serovar lai str. 56601
uuugaauacgacagguuuaauu

SEQ ID NO: 743885 - RNA, 15 nt, Leptospira interrogans serovar lai str. 56601
uuugaacuacagaau

SEQ ID NO: 743886 - RNA, 21 nt, Leptospira interrogans serovar lai str. 56601
uuugaacuuguuccaaaacua

SEQ ID NO: 743887 - RNA, 22 nt, Leptospira interrogans serovar lai str. 56601
uuugaacuuguuccaaaacuaa

SEQ ID NO: 743888 - RNA, 17 nt, Leptospira interrogans serovar lai str. 56601
uuugaagaaacaauucu

SEQ ID NO: 743889 - RNA, 23 nt, Leptospira interrogans serovar lai str. 56601
uuugaagaauaaaagugguugaa

SEQ ID NO: 743890 - RNA, 18 nt, Leptospira interrogans serovar lai str. 56601
uuugaacacgucuuaaau

SEQ ID NO: 743891 - RNA, 16 nt, Leptospira interrogans serovar lai str. 56601
uuucucgaaaaucuca

SEQ ID NO: 743892 - RNA, 17 nt, Leptospira interrogans serovar lai str. 56601
uuucucgaaaucgauuu

SEQ ID NO: 743893 - RNA, 14 nt, Leptospira interrogans serovar lai str. 56601
uuucucguuuucuu

SEQ ID NO: 743894 - RNA, 13 nt, Leptospira interrogans serovar lai str. 56601
uuucucguuuuuu

SEQ ID NO: 743895 - RNA, 13 nt, Leptospira interrogans serovar lai str. 56601
uuucucuaauucu

SEQ ID NO: 743896 - RNA, 16 nt, Leptospira interrogans serovar lai str. 56601
uuucucuaauucuaaa

SEQ ID NO: 743897 - RNA, 16 nt, Leptospira interrogans serovar lai str. 56601
uuucucuaucagaaaa

SEQ ID NO: 743898 - RNA, 18 nt, Leptospira interrogans serovar lai str. 56601
uuucucaguaaaauggga

SEQ ID NO: 743899 - RNA, 15 nt, Leptospira interrogans serovar lai str. 56601
uuucucaucaaaaaa

SEQ ID NO: 743900 - RNA, 13 nt, Leptospira interrogans serovar lai str. 56601
uuucucauucuac

SEQ ID NO: 743901 - RNA, 16 nt, Leptospira interrogans serovar lai str. 56601
uuucucauucuacuuu

SEQ ID NO: 743902 - RNA, 14 nt, Leptospira interrogans serovar lai str. 56601
uuucuauuuuaaaa

SEQ ID NO: 743903 - RNA, 22 nt, Leptospira interrogans serovar lai str. 56601
uuucugauagagaaaaauuuuc

SEQ ID NO: 743904 - RNA, 16 nt, Leptospira interrogans serovar lai str. 56601
uuucugacauucuaaa

SEQ ID NO: 743905 - RNA, 20 nt, Leptospira interrogans serovar lai str. 56601
uuucucuuuuuagacaaaaa

SEQ ID NO: 743906 - RNA, 15 nt, Leptospira interrogans serovar lai str. 56601
uuucugaaaaaguug

SEQ ID NO: 743907 - RNA, 19 nt, Leptospira interrogans serovar lai str. 56601
uuucugaaaaaguuggaau

SEQ ID NO: 743908 - RNA, 22 nt, Leptospira interrogans serovar lai str. 56601
uuucugaaaaguuuaugaauuu

SEQ ID NO: 743909 - RNA, 21 nt, Leptospira interrogans serovar lai str. 56601
uuucuguaaaaauaaaaugua

SEQ ID NO: 743910 - RNA, 21 nt, Leptospira interrogans serovar lai str. 56601
uuucuguaacauccaaacucu

SEQ ID NO: 743911 - RNA, 12 nt, Leptospira interrogans serovar lai str. 56601
uuucuguagaaa

SEQ ID NO: 743912 - RNA, 15 nt, Leptospira interrogans serovar lai str. 56601
uuucugcuucuaagu

SEQ ID NO: 743913 - RNA, 15 nt, Leptospira interrogans serovar lai str. 56601
uuucuggaaaaguuu

SEQ ID NO: 743914 - RNA, 23 nt, Leptospira interrogans serovar lai str. 56601
uuucuggaaaaguuuuuaaaaau

SEQ ID NO: 743915 - RNA, 22 nt, Leptospira interrogans serovar lai str. 56601
uuucugcuacaacccaacuuuc

SEQ ID NO: 743916 - RNA, 15 nt, Leptospira interrogans serovar lai str. 56601
uuucugccauuuuua

SEQ ID NO: 743917 - RNA, 22 nt, Leptospira interrogans serovar lai str. 56601
uuucuagugucuaaacuaaaaa

SEQ ID NO: 743918 - RNA, 19 nt, Leptospira interrogans serovar lai str. 56601
uuucuauaaaaucuaaaaa

SEQ ID NO: 743919 - RNA, 16 nt, Leptospira interrogans serovar lai str. 56601
uuucuauaaucugaaa

SEQ ID NO: 743920 - RNA, 22 nt, Leptospira interrogans serovar lai str. 56601
uuucuauaaucugaaauagaau

SEQ ID NO: 743921 - RNA, 14 nt, Leptospira interrogans serovar lai str. 56601
uuucuauauucaaa

SEQ ID NO: 743922 - RNA, 21 nt, Leptospira interrogans serovar lai str. 56601
uuucuauauucaaaaaaugga

SEQ ID NO: 743923 - RNA, 20 nt, Leptospira interrogans serovar lai str. 56601
uuucuaauagagaaaaauuu

SEQ ID NO: 743924 - RNA, 12 nt, Leptospira interrogans serovar lai str. 56601
uuucuaauauua

SEQ ID NO: 743925 - RNA, 19 nt, Leptospira interrogans serovar lai str. 56601
uuucuaauauuaaaaacac

SEQ ID NO: 743926 - RNA, 17 nt, Leptospira interrogans serovar lai str. 56601
uuucuaauauucaaauu

SEQ ID NO: 743927 - RNA, 22 nt, Leptospira interrogans serovar lai str. 56601
uuucuaagguuugucuacguac

SEQ ID NO: 743928 - RNA, 22 nt, Leptospira interrogans serovar lai str. 56601
uuucuaauuuucuuguuuaaau

SEQ ID NO: 743929 - RNA, 21 nt, Leptospira interrogans serovar lai str. 56601
uuucuacaaauaaaacuucuc

SEQ ID NO: 743930 - RNA, 23 nt, Leptospira interrogans serovar lai str. 56601
uuucuaaucccgccaaaaaugcc

SEQ ID NO: 743931 - RNA, 20 nt, Leptospira interrogans serovar lai str. 56601
uuucuacauuuuugugaaac

SEQ ID NO: 743932 - RNA, 20 nt, Leptospira interrogans serovar lai str. 56601
uuucuacaauuauauuaaau

SEQ ID NO: 743933 - RNA, 23 nt, Leptospira interrogans serovar lai str. 56601
uuucuacaauuauauuaaauuaa

SEQ ID NO: 743934 - RNA, 17 nt, Leptospira interrogans serovar lai str. 56601
uuucuagacuuucuuug

SEQ ID NO: 743935 - RNA, 23 nt, Leptospira interrogans serovar lai str. 56601
uuucgguuguuuugcucuaaaau

SEQ ID NO: 743936 - RNA, 13 nt, Leptospira interrogans serovar lai str. 56601
uuucuaaauuuua

SEQ ID NO: 743937 - RNA, 18 nt, Leptospira interrogans serovar lai str. 56601
uuucuaaauuaauauuua

SEQ ID NO: 743938 - RNA, 13 nt, Leptospira interrogans serovar lai str. 56601
uuucuaaaaauaa

SEQ ID NO: 743939 - RNA, 13 nt, Leptospira interrogans serovar lai str. 56601
uuucuaaaaugua

SEQ ID NO: 743940 - RNA, 12 nt, Leptospira interrogans serovar lai str. 56601
uuucuaaaauau

SEQ ID NO: 743941 - RNA, 13 nt, Leptospira interrogans serovar lai str. 56601
uuucuaaaauauc

SEQ ID NO: 743942 - RNA, 22 nt, Leptospira interrogans serovar lai str. 56601
uuucuaaaagaagaugcuuucu

SEQ ID NO: 743943 - RNA, 19 nt, Leptospira interrogans serovar lai str. 56601
uuucuaaaaguaaaaguac

SEQ ID NO: 743944 - RNA, 17 nt, Leptospira interrogans serovar lai str. 56601
uuucuaaaaaaauuaau

SEQ ID NO: 743945 - RNA, 14 nt, Leptospira interrogans serovar lai str. 56601
uuucguucggaaaa

SEQ ID NO: 743946 - RNA, 21 nt, Leptospira interrogans serovar lai str. 56601
uuucguucggaaaaaauauga

SEQ ID NO: 743947 - RNA, 15 nt, Leptospira interrogans serovar lai str. 56601
uuucgugauaacaaa

SEQ ID NO: 743948 - RNA, 22 nt, Leptospira interrogans serovar lai str. 56601
uuucguuucaacuuuagaaaaa

SEQ ID NO: 743949 - RNA, 21 nt, Leptospira interrogans serovar lai str. 56601
uuuccuuaagacccuaaaaaa

SEQ ID NO: 743950 - RNA, 23 nt, Leptospira interrogans serovar lai str. 56601
uuuccuuauuaaaaccaucuuug

SEQ ID NO: 743951 - RNA, 17 nt, Leptospira interrogans serovar lai str. 56601
uuuccuucuuucugaaa

SEQ ID NO: 743952 - RNA, 18 nt, Leptospira interrogans serovar lai str. 56601
uuuccuucuuucugaaau

SEQ ID NO: 743953 - RNA, 17 nt, Leptospira interrogans serovar lai str. 56601
uuuccucuugaagauuu

SEQ ID NO: 743954 - RNA, 14 nt, Leptospira interrogans serovar lai str. 56601
uuuccucgaauuca

SEQ ID NO: 743955 - RNA, 14 nt, Leptospira interrogans serovar lai str. 56601
uuuccguuuaacaa

SEQ ID NO: 743956 - RNA, 14 nt, Leptospira interrogans serovar lai str. 56601
uuuccguuaauaaa

SEQ ID NO: 743957 - RNA, 14 nt, Leptospira interrogans serovar lai str. 56601
uuucgauugcucuc

SEQ ID NO: 743958 - RNA, 16 nt, Leptospira interrogans serovar lai str. 56601
uuucgauuuuaaauaa

SEQ ID NO: 743959 - RNA, 13 nt, Leptospira interrogans serovar lai str. 56601
uuucgcaaauucu

SEQ ID NO: 743960 - RNA, 21 nt, Leptospira interrogans serovar lai str. 56601
uuucgcauaccgaacucacgu

SEQ ID NO: 743961 - RNA, 15 nt, Leptospira interrogans serovar lai str. 56601
uuucgcgguuuucuu

SEQ ID NO: 743962 - RNA, 18 nt, Leptospira interrogans serovar lai str. 56601
uuuccuuuccuugaaaaa

SEQ ID NO: 743963 - RNA, 16 nt, Leptospira interrogans serovar lai str. 56601
uuuccuuucucugaau

SEQ ID NO: 743964 - RNA, 20 nt, Leptospira interrogans serovar lai str. 56601
uuuccuuuuguuuuucuuua

SEQ ID NO: 743965 - RNA, 23 nt, Leptospira interrogans serovar lai str. 56601
uuucgaaaagaaauauuaaaaaa

SEQ ID NO: 743966 - RNA, 22 nt, Leptospira interrogans serovar lai str. 56601
uuuccuuuaaacuuagauucga

SEQ ID NO: 743967 - RNA, 16 nt, Leptospira interrogans serovar lai str. 56601
uuuccuugagauuaca

SEQ ID NO: 743968 - RNA, 14 nt, Leptospira interrogans serovar lai str. 56601
uuucgaacuauuuu

SEQ ID NO: 743969 - RNA, 18 nt, Leptospira interrogans serovar lai str. 56601
uuucgacaacuuauaauu

SEQ ID NO: 743970 - RNA, 15 nt, Leptospira interrogans serovar lai str. 56601
uuucgaaauuuuaca

SEQ ID NO: 743971 - RNA, 22 nt, Leptospira interrogans serovar lai str. 56601
uuucccgcuggaaaaugaaaac

SEQ ID NO: 743972 - RNA, 16 nt, Leptospira interrogans serovar lai str. 56601
uuuccgaaccuuacca

SEQ ID NO: 743973 - RNA, 17 nt, Leptospira interrogans serovar lai str. 56601
uuuccgaaccuuaccac

SEQ ID NO: 743974 - RNA, 22 nt, Leptospira interrogans serovar lai str. 56601
uuuccgaauaggaucagaauuu

SEQ ID NO: 743975 - RNA, 16 nt, Leptospira interrogans serovar lai str. 56601
uuuccguaaaaaguua

SEQ ID NO: 743976 - RNA, 17 nt, Leptospira interrogans serovar lai str. 56601
uuuccguagaucuuuua

SEQ ID NO: 743977 - RNA, 19 nt, Leptospira interrogans serovar lai str. 56601
uuuccgggucgauuuugau

SEQ ID NO: 743978 - RNA, 18 nt, Leptospira interrogans serovar lai str. 56601
uuuccggaauacuuuucu

SEQ ID NO: 743979 - RNA, 16 nt, Leptospira interrogans serovar lai str. 56601
uuucccaguucuuaaa

SEQ ID NO: 743980 - RNA, 16 nt, Leptospira interrogans serovar lai str. 56601
uuucccauaaaaagag

SEQ ID NO: 743981 - RNA, 15 nt, Leptospira interrogans serovar lai str. 56601
uuuccccaagacuuu

SEQ ID NO: 743982 - RNA, 15 nt, Leptospira interrogans serovar lai str. 56601
uuucccgauucucaa

SEQ ID NO: 743983 - RNA, 13 nt, Leptospira interrogans serovar lai str. 56601
uuuccauaaaaaa

SEQ ID NO: 743984 - RNA, 15 nt, Leptospira interrogans serovar lai str. 56601
uuuccauaaaaaaca

SEQ ID NO: 743985 - RNA, 18 nt, Leptospira interrogans serovar lai str. 56601
uuuccauaaaaaacauaa

SEQ ID NO: 743986 - RNA, 20 nt, Leptospira interrogans serovar lai str. 56601
uuuccauaaaauagaaacag

SEQ ID NO: 743987 - RNA, 16 nt, Leptospira interrogans serovar lai str. 56601
aaauuaauucuccauc

SEQ ID NO: 743988 - RNA, 19 nt, Leptospira interrogans serovar lai str. 56601
aaauuaauuucuaaacaau

SEQ ID NO: 743989 - RNA, 20 nt, Leptospira interrogans serovar lai str. 56601
aaauuaauuccuaacuaaua

SEQ ID NO: 743990 - RNA, 17 nt, Leptospira interrogans serovar lai str. 56601
aaauuaauuacuuagau

SEQ ID NO: 743991 - RNA, 13 nt, Leptospira interrogans serovar lai str. 56601
aaauuaauauuua

SEQ ID NO: 743992 - RNA, 22 nt, Leptospira interrogans serovar lai str. 56601
aaauuaauauuuauaaaacaau

SEQ ID NO: 743993 - RNA, 22 nt, Leptospira interrogans serovar lai str. 56601
aaauuaauauuuauaauauucu

SEQ ID NO: 743994 - RNA, 21 nt, Leptospira interrogans serovar lai str. 56601
aaauuaaugaauaacuuuaca

SEQ ID NO: 743995 - RNA, 17 nt, Leptospira interrogans serovar lai str. 56601
aaauuaaucuguaaagu

SEQ ID NO: 743996 - RNA, 15 nt, Leptospira interrogans serovar lai str. 56601
aaauuaaguuuaaaa

SEQ ID NO: 743997 - RNA, 17 nt, Leptospira interrogans serovar lai str. 56601
aaauuaacgguacucaa

SEQ ID NO: 743998 - RNA, 13 nt, Leptospira interrogans serovar lai str. 56601
aaauuaacucuuu

SEQ ID NO: 743999 - RNA, 12 nt, Leptospira interrogans serovar lai str. 56601
aaauguuuuuuu

SEQ ID NO: 744000 - RNA, 13 nt, Leptospira interrogans serovar lai str. 56601
aaauuaaaauaaa

SEQ ID NO: 744001 - RNA, 18 nt, Leptospira interrogans serovar lai str. 56601
aaauuaaacccauuuuag

SEQ ID NO: 744002 - RNA, 17 nt, Leptospira interrogans serovar lai str. 56601
aaauuaaaguauccauu

SEQ ID NO: 744003 - RNA, 18 nt, Leptospira interrogans serovar lai str. 56601
aaauuaaaguauccauuc

SEQ ID NO: 744004 - RNA, 14 nt, Leptospira interrogans serovar lai str. 56601
aaauuaaaaaaucu

SEQ ID NO: 744005 - RNA, 12 nt, Leptospira interrogans serovar lai str. 56601
aaauuaaaaaau

SEQ ID NO: 744006 - RNA, 13 nt, Leptospira interrogans serovar lai str. 56601
aaauguuuaaaga

SEQ ID NO: 744007 - RNA, 18 nt, Leptospira interrogans serovar lai str. 56601
aaauguuuaaagaauuuu

SEQ ID NO: 744008 - RNA, 16 nt, Leptospira interrogans serovar lai str. 56601
aaauguuaaaaaacua

SEQ ID NO: 744009 - RNA, 19 nt, Leptospira interrogans serovar lai str. 56601
aaauguuaaaaaacuauaa

SEQ ID NO: 744010 - RNA, 15 nt, Leptospira interrogans serovar lai str. 56601
aaauguucaaauuca

SEQ ID NO: 744011 - RNA, 13 nt, Leptospira interrogans serovar lai str. 56601
uuuuuuauuuaaa

SEQ ID NO: 744012 - RNA, 20 nt, Leptospira interrogans serovar lai str. 56601
uuuuuuagaguuaagagaau

SEQ ID NO: 744013 - RNA, 12 nt, Leptospira interrogans serovar lai str. 56601
uuuuuucagaaa

SEQ ID NO: 744014 - RNA, 19 nt, Leptospira interrogans serovar lai str. 56601
aaaugugagaguucccacg

SEQ ID NO: 744015 - RNA, 23 nt, Leptospira interrogans serovar lai str. 56601
aaaugugggaacuacuacaauua

SEQ ID NO: 744016 - RNA, 21 nt, Leptospira interrogans serovar lai str. 56601
aaaugugggaacucccacuuu

SEQ ID NO: 744017 - RNA, 21 nt, Leptospira interrogans serovar lai str. 56601
aaaugugggaacucucacaaa

SEQ ID NO: 744018 - RNA, 21 nt, Leptospira interrogans serovar lai str. 56601
aaaugugggaauucuuacaac

SEQ ID NO: 744019 - RNA, 12 nt, Leptospira interrogans serovar lai str. 56601
uuuuucucccuu

SEQ ID NO: 744020 - RNA, 14 nt, Leptospira interrogans serovar lai str. 56601
uuuuucuaaauuaa

SEQ ID NO: 744021 - RNA, 19 nt, Leptospira interrogans serovar lai str. 56601
uuuuucuaaauuuuauaaa

SEQ ID NO: 744022 - RNA, 17 nt, Leptospira interrogans serovar lai str. 56601
uuuuucuguaaaaauaa

SEQ ID NO: 744023 - RNA, 12 nt, Leptospira interrogans serovar lai str. 56601
uuuuucugaaaa

SEQ ID NO: 744024 - RNA, 13 nt, Leptospira interrogans serovar lai str. 56601
uuuuucuccuuuu

SEQ ID NO: 744025 - RNA, 22 nt, Leptospira interrogans serovar lai str. 56601
uuuuuccuucuuuacaguuuuu

SEQ ID NO: 744026 - RNA, 20 nt, Leptospira interrogans serovar lai str. 56601
uuuuucgaaaagaaauauua

SEQ ID NO: 744027 - RNA, 15 nt, Leptospira interrogans serovar lai str. 56601
uuuuucggagucaua

SEQ ID NO: 744028 - RNA, 20 nt, Leptospira interrogans serovar lai str. 56601
uuuuucuaaaaaaaauguaa

SEQ ID NO: 744029 - RNA, 21 nt, Leptospira interrogans serovar lai str. 56601
uuuuucgguucgggauuuuuu

SEQ ID NO: 744030 - RNA, 19 nt, Leptospira interrogans serovar lai str. 56601
uuuuugaaaaagaauauaa

SEQ ID NO: 744031 - RNA, 17 nt, Leptospira interrogans serovar lai str. 56601
uuuuugaagaaacaauu

SEQ ID NO: 744032 - RNA, 17 nt, Leptospira interrogans serovar lai str. 56601
uuuuugugaaacucaau

SEQ ID NO: 744033 - RNA, 12 nt, Leptospira interrogans serovar lai str. 56601
uuuuuguauaua

SEQ ID NO: 744034 - RNA, 18 nt, Leptospira interrogans serovar lai str. 56601
uuuuuguaaaauccagaa

SEQ ID NO: 744035 - RNA, 21 nt, Leptospira interrogans serovar lai str. 56601
uuuuuguaaggauuccuuucc

SEQ ID NO: 744036 - RNA, 16 nt, Leptospira interrogans serovar lai str. 56601
uuuuugggaauuuuuu

SEQ ID NO: 744037 - RNA, 22 nt, Leptospira interrogans serovar lai str. 56601
uuuuuguaaugacacuuaucaa

SEQ ID NO: 744038 - RNA, 16 nt, Leptospira interrogans serovar lai str. 56601
uuuuuuaauuauguuu

SEQ ID NO: 744039 - RNA, 13 nt, Leptospira interrogans serovar lai str. 56601
uuuuuuaagaauc

SEQ ID NO: 744040 - RNA, 14 nt, Leptospira interrogans serovar lai str. 56601
uuuuuuaagaaucu

SEQ ID NO: 744041 - RNA, 16 nt, Leptospira interrogans serovar lai str. 56601
uuuuuuaagaaucuca

SEQ ID NO: 744042 - RNA, 18 nt, Leptospira interrogans serovar lai str. 56601
uuuuuuaagaauuuguuu

SEQ ID NO: 744043 - RNA, 23 nt, Leptospira interrogans serovar lai str. 56601
uuuuuuaaguucuuuaguuguuu

SEQ ID NO: 744044 - RNA, 13 nt, Leptospira interrogans serovar lai str. 56601
uuuuuuaaaugca

SEQ ID NO: 744045 - RNA, 13 nt, Leptospira interrogans serovar lai str. 56601
uuuuuguuaucaa

SEQ ID NO: 744046 - RNA, 12 nt, Leptospira interrogans serovar lai str. 56601
uuuuuuaaaaaa

SEQ ID NO: 744047 - RNA, 11 nt, Leptospira interrogans serovar lai str. 56601
uuuuuuaaaac

SEQ ID NO: 744048 - RNA, 14 nt, Leptospira interrogans serovar lai str. 56601
uuuuuuaaaaugua

SEQ ID NO: 744049 - RNA, 17 nt, Leptospira interrogans serovar lai str. 56601
uuuuuuaaacuuuguuu

SEQ ID NO: 744050 - RNA, 16 nt, Leptospira interrogans serovar lai str. 56601
uuuuugagcccagaac

SEQ ID NO: 744051 - RNA, 13 nt, Leptospira interrogans serovar lai str. 56601
uuuuugauucaaa

SEQ ID NO: 744052 - RNA, 22 nt, Leptospira interrogans serovar lai str. 56601
uuuuugcaaguaaaaagacuca

SEQ ID NO: 744053 - RNA, 15 nt, Leptospira interrogans serovar lai str. 56601
uuuuugauuuuagaa

SEQ ID NO: 744054 - RNA, 19 nt, Leptospira interrogans serovar lai str. 56601
uuuuuggaaaucgaaaacc

SEQ ID NO: 744055 - RNA, 17 nt, Leptospira interrogans serovar lai str. 56601
uuuuuggguuaaaguuu

SEQ ID NO: 744056 - RNA, 17 nt, Leptospira interrogans serovar lai str. 56601
aaauuacugauuucaaa

SEQ ID NO: 744057 - RNA, 18 nt, Leptospira interrogans serovar lai str. 56601
aaauuacugauuucaaaa

SEQ ID NO: 744058 - RNA, 22 nt, Leptospira interrogans serovar lai str. 56601
aaauuacugauuucaaaaauaa

SEQ ID NO: 744059 - RNA, 18 nt, Leptospira interrogans serovar lai str. 56601
aaauuacuucaauugucc

SEQ ID NO: 744060 - RNA, 13 nt, Leptospira interrogans serovar lai str. 56601
aaauuagaaaauu

SEQ ID NO: 744061 - RNA, 14 nt, Leptospira interrogans serovar lai str. 56601
aaauuagaaaauua

SEQ ID NO: 744062 - RNA, 15 nt, Leptospira interrogans serovar lai str. 56601
aaauuagaaaugauu

SEQ ID NO: 744063 - RNA, 12 nt, Leptospira interrogans serovar lai str. 56601
uuuuuuuuaauc

SEQ ID NO: 744064 - RNA, 17 nt, Leptospira interrogans serovar lai str. 56601
aaauuaccuuucauuuu

SEQ ID NO: 744065 - RNA, 13 nt, Leptospira interrogans serovar lai str. 56601
uuuuuucuuagac

SEQ ID NO: 744066 - RNA, 17 nt, Leptospira interrogans serovar lai str. 56601
uuuuuuuaaaaaauuca

SEQ ID NO: 744067 - RNA, 11 nt, Leptospira interrogans serovar lai str. 56601
uuuuuuuaaac

SEQ ID NO: 744068 - RNA, 14 nt, Leptospira interrogans serovar lai str. 56601
uuuuuuuagaauca

SEQ ID NO: 744069 - RNA, 11 nt, Leptospira interrogans serovar lai str. 56601
uuuuuuuauga

SEQ ID NO: 744070 - RNA, 13 nt, Leptospira interrogans serovar lai str. 56601
uuuuuucuaaaau

SEQ ID NO: 744071 - RNA, 14 nt, Leptospira interrogans serovar lai str. 56601
aaauuaauuuuaua

SEQ ID NO: 744072 - RNA, 20 nt, Leptospira interrogans serovar lai str. 56601
aaauuaauuuuucaacaacu

SEQ ID NO: 744073 - RNA, 18 nt, Leptospira interrogans serovar lai str. 56601
aaauuagcuuaagaauuu

SEQ ID NO: 744074 - RNA, 19 nt, Leptospira interrogans serovar lai str. 56601
aaauuagcuuaagaauuuc

SEQ ID NO: 744075 - RNA, 20 nt, Leptospira interrogans serovar lai str. 56601
aaauuaggcuuaucuguaaa

SEQ ID NO: 744076 - RNA, 17 nt, Leptospira interrogans serovar lai str. 56601
aaauuaguaauuuaaua

SEQ ID NO: 744077 - RNA, 17 nt, Leptospira interrogans serovar lai str. 56601
aaauuauagauaauuuu

SEQ ID NO: 744078 - RNA, 14 nt, Leptospira interrogans serovar lai str. 56601
aaauuaguuuucuu

SEQ ID NO: 744079 - RNA, 17 nt, Leptospira interrogans serovar lai str. 56601
aaauuauaaguagaaau

SEQ ID NO: 744080 - RNA, 20 nt, Leptospira interrogans serovar lai str. 56601
aaauuauaaguagaaauuua

SEQ ID NO: 744081 - RNA, 14 nt, Leptospira interrogans serovar lai str. 56601
aaauuauauuuuga

SEQ ID NO: 744082 - RNA, 13 nt, Leptospira interrogans serovar lai str. 56601
aaauuauucugaa

SEQ ID NO: 744083 - RNA, 17 nt, Leptospira interrogans serovar lai str. 56601
aaauucgccguaaaaaa

SEQ ID NO: 744084 - RNA, 18 nt, Leptospira interrogans serovar lai str. 56601
aaauucgccguaaaaaau

SEQ ID NO: 744085 - RNA, 15 nt, Leptospira interrogans serovar lai str. 56601
aaauucgcaaaaaaa

SEQ ID NO: 744086 - RNA, 13 nt, Leptospira interrogans serovar lai str. 56601
aaauucgaaucau

SEQ ID NO: 744087 - RNA, 23 nt, Leptospira interrogans serovar lai str. 56601
aaauuccuuuuuguaaggauucc

SEQ ID NO: 744088 - RNA, 16 nt, Leptospira interrogans serovar lai str. 56601
aaauuccuaaaacacc

SEQ ID NO: 744089 - RNA, 19 nt, Leptospira interrogans serovar lai str. 56601
aaauuccuaaaacaccuuc

SEQ ID NO: 744090 - RNA, 15 nt, Leptospira interrogans serovar lai str. 56601
aaauuccguaaaauu

SEQ ID NO: 744091 - RNA, 20 nt, Leptospira interrogans serovar lai str. 56601
aaauuccgaauucuaaaaua

SEQ ID NO: 744092 - RNA, 22 nt, Leptospira interrogans serovar lai str. 56601
aaauuccgaauucuaaaauacu

SEQ ID NO: 744093 - RNA, 14 nt, Leptospira interrogans serovar lai str. 56601
aaauucgucaaaac

SEQ ID NO: 744094 - RNA, 21 nt, Leptospira interrogans serovar lai str. 56601
aaauucuaaucacgaaaaaug

SEQ ID NO: 744095 - RNA, 17 nt, Leptospira interrogans serovar lai str. 56601
aaauucuaauuguggga

SEQ ID NO: 744096 - RNA, 23 nt, Leptospira interrogans serovar lai str. 56601
aaauucuacaaauucuucuuccu

SEQ ID NO: 744097 - RNA, 16 nt, Leptospira interrogans serovar lai str. 56601
aaauucguuuuacuuc

SEQ ID NO: 744098 - RNA, 20 nt, Leptospira interrogans serovar lai str. 56601
aaauucuaugggaauuuuug

SEQ ID NO: 744099 - RNA, 22 nt, Leptospira interrogans serovar lai str. 56601
aaauucuaugggaauuuuugua

SEQ ID NO: 744100 - RNA, 13 nt, Leptospira interrogans serovar lai str. 56601
aaauucuuaauau

SEQ ID NO: 744101 - RNA, 21 nt, Leptospira interrogans serovar lai str. 56601
aaauucaaagcaagaaaaucu

SEQ ID NO: 744102 - RNA, 18 nt, Leptospira interrogans serovar lai str. 56601
aaauucaaauucuuuuug

SEQ ID NO: 744103 - RNA, 12 nt, Leptospira interrogans serovar lai str. 56601
aaauuauuuuga

SEQ ID NO: 744104 - RNA, 19 nt, Leptospira interrogans serovar lai str. 56601
aaauuauuuugaaccauau

SEQ ID NO: 744105 - RNA, 13 nt, Leptospira interrogans serovar lai str. 56601
aaauuauuuucaa

SEQ ID NO: 744106 - RNA, 23 nt, Leptospira interrogans serovar lai str. 56601
aaauucaaguggguuacuuugaa

SEQ ID NO: 744107 - RNA, 17 nt, Leptospira interrogans serovar lai str. 56601
aaauucaaaauaagaaa

SEQ ID NO: 744108 - RNA, 17 nt, Leptospira interrogans serovar lai str. 56601
aaauucaccuuccaaag

SEQ ID NO: 744109 - RNA, 22 nt, Leptospira interrogans serovar lai str. 56601
aaauucacgaccuuaaauaaua

SEQ ID NO: 744110 - RNA, 17 nt, Leptospira interrogans serovar lai str. 56601
aaauucacauaaaguua

SEQ ID NO: 744111 - RNA, 21 nt, Leptospira interrogans serovar lai str. 56601
aaauucacauuauauauuuau

SEQ ID NO: 744112 - RNA, 18 nt, Leptospira interrogans serovar lai str. 56601
aaauucacguucaacaaa

SEQ ID NO: 744113 - RNA, 20 nt, Leptospira interrogans serovar lai str. 56601
aaauucaggugggaguuuag

SEQ ID NO: 744114 - RNA, 11 nt, Leptospira interrogans serovar lai str. 56601
aaauucaguuc

SEQ ID NO: 744115 - RNA, 21 nt, Leptospira interrogans serovar lai str. 56601
aaauucauauugagauaaaaa

SEQ ID NO: 744116 - RNA, 17 nt, Leptospira interrogans serovar lai str. 56601
aaauucaucaaugaaua

SEQ ID NO: 744117 - RNA, 17 nt, Leptospira interrogans serovar lai str. 56601
aaauucaucuaaaaaaa

SEQ ID NO: 744118 - RNA, 18 nt, Leptospira interrogans serovar lai str. 56601
aaauucaucuaaaaaaaa

SEQ ID NO: 744119 - RNA, 21 nt, Leptospira interrogans serovar lai str. 56601
aaauucaucuccuccgauucu

SEQ ID NO: 744120 - RNA, 19 nt, Leptospira interrogans serovar lai str. 56601
aaauuccauagcaacaauu

SEQ ID NO: 744121 - RNA, 16 nt, Leptospira interrogans serovar lai str. 56601
aaauuccacuucucac

SEQ ID NO: 744122 - RNA, 21 nt, Leptospira interrogans serovar lai str. 56601
aaauucauuccuauaaauaaa

SEQ ID NO: 744123 - RNA, 17 nt, Leptospira interrogans serovar lai str. 56601
uuuuggaagauucuucu

SEQ ID NO: 744124 - RNA, 20 nt, Leptospira interrogans serovar lai str. 56601
uuuugggauuugaauuuaaa

SEQ ID NO: 744125 - RNA, 15 nt, Leptospira interrogans serovar lai str. 56601
uuuugcuucuaaaaa

SEQ ID NO: 744126 - RNA, 22 nt, Leptospira interrogans serovar lai str. 56601
uuuugcucacuaccuuauaaaa

SEQ ID NO: 744127 - RNA, 18 nt, Leptospira interrogans serovar lai str. 56601
uuuugaucuuuaaaagag

SEQ ID NO: 744128 - RNA, 22 nt, Leptospira interrogans serovar lai str. 56601
uuuugaucguaacuuucuuuua

SEQ ID NO: 744129 - RNA, 20 nt, Leptospira interrogans serovar lai str. 56601
uuuugaucuaauaauauacu

SEQ ID NO: 744130 - RNA, 19 nt, Leptospira interrogans serovar lai str. 56601
uuuugauuguggcaagagg

SEQ ID NO: 744131 - RNA, 14 nt, Leptospira interrogans serovar lai str. 56601
uuuugauuuuagaa

SEQ ID NO: 744132 - RNA, 14 nt, Leptospira interrogans serovar lai str. 56601
uuuugcacugaaau

SEQ ID NO: 744133 - RNA, 21 nt, Leptospira interrogans serovar lai str. 56601
uuuugcaaucguccaaucucu

SEQ ID NO: 744134 - RNA, 17 nt, Leptospira interrogans serovar lai str. 56601
uuuugcacaaaaccucu

SEQ ID NO: 744135 - RNA, 17 nt, Leptospira interrogans serovar lai str. 56601
uuuugcacaaaaucgcu

SEQ ID NO: 744136 - RNA, 15 nt, Leptospira interrogans serovar lai str. 56601
uuuugcaaaaaaaau

SEQ ID NO: 744137 - RNA, 14 nt, Leptospira interrogans serovar lai str. 56601
uuuugaauuuuuua

SEQ ID NO: 744138 - RNA, 11 nt, Leptospira interrogans serovar lai str. 56601
uuuugagaaac

SEQ ID NO: 744139 - RNA, 23 nt, Leptospira interrogans serovar lai str. 56601
uuuugagacaagaagaaaagaau

SEQ ID NO: 744140 - RNA, 22 nt, Leptospira interrogans serovar lai str. 56601
uuuugagagaagccuauauuuu

SEQ ID NO: 744141 - RNA, 13 nt, Leptospira interrogans serovar lai str. 56601
uuuugauaaaaua

SEQ ID NO: 744142 - RNA, 19 nt, Leptospira interrogans serovar lai str. 56601
uuuugagcacaauauauuc

SEQ ID NO: 744143 - RNA, 18 nt, Leptospira interrogans serovar lai str. 56601
uuuugagcaguaaaaaag

SEQ ID NO: 744144 - RNA, 21 nt, Leptospira interrogans serovar lai str. 56601
uuuugauaccgggauuuuaaa

SEQ ID NO: 744145 - RNA, 22 nt, Leptospira interrogans serovar lai str. 56601
uuuugauaccgggauuuuaaaa

SEQ ID NO: 744146 - RNA, 13 nt, Leptospira interrogans serovar lai str. 56601
uuuucuuuuaaaa

SEQ ID NO: 744147 - RNA, 15 nt, Leptospira interrogans serovar lai str. 56601
uuuucuuugauugaa

SEQ ID NO: 744148 - RNA, 18 nt, Leptospira interrogans serovar lai str. 56601
uuuucuuugaaaaaauuu

SEQ ID NO: 744149 - RNA, 21 nt, Leptospira interrogans serovar lai str. 56601
uuuucuuugaaaaaauuuuuu

SEQ ID NO: 744150 - RNA, 18 nt, Leptospira interrogans serovar lai str. 56601
uuuucuuugaauugaaau

SEQ ID NO: 744151 - RNA, 12 nt, Leptospira interrogans serovar lai str. 56601
uuuucuuuagaa

SEQ ID NO: 744152 - RNA, 16 nt, Leptospira interrogans serovar lai str. 56601
uuuucuuuaucagaaa

SEQ ID NO: 744153 - RNA, 19 nt, Leptospira interrogans serovar lai str. 56601
uuuugaaauagauucuaau

SEQ ID NO: 744154 - RNA, 18 nt, Leptospira interrogans serovar lai str. 56601
uuuugaagacuauaaaac

SEQ ID NO: 744155 - RNA, 14 nt, Leptospira interrogans serovar lai str. 56601
uuuugaaaaagaau

SEQ ID NO: 744156 - RNA, 19 nt, Leptospira interrogans serovar lai str. 56601
uuuugaaacauuucuaaaa

SEQ ID NO: 744157 - RNA, 19 nt, Leptospira interrogans serovar lai str. 56601
uuuucuuaauaaacuuuca

SEQ ID NO: 744158 - RNA, 24 nt, Leptospira interrogans serovar lai str. 56601
uuuucuuaauuucucuuauuagaa

SEQ ID NO: 744159 - RNA, 15 nt, Leptospira interrogans serovar lai str. 56601
uuuucuuaaaaaaau

SEQ ID NO: 744160 - RNA, 14 nt, Leptospira interrogans serovar lai str. 56601
uuuucuuaaaaagu

SEQ ID NO: 744161 - RNA, 15 nt, Leptospira interrogans serovar lai str. 56601
uuuucuuaaaaaguu

SEQ ID NO: 744162 - RNA, 22 nt, Leptospira interrogans serovar lai str. 56601
uuuucuuauaaccuaucacaaa

SEQ ID NO: 744163 - RNA, 21 nt, Leptospira interrogans serovar lai str. 56601
uuuucuaaauuuuauaaaauu

SEQ ID NO: 744164 - RNA, 16 nt, Leptospira interrogans serovar lai str. 56601
uuuucguuuuuuagaa

SEQ ID NO: 744165 - RNA, 22 nt, Leptospira interrogans serovar lai str. 56601
uuuucuacaaauaaaacuucuc

SEQ ID NO: 744166 - RNA, 17 nt, Leptospira interrogans serovar lai str. 56601
uuuucucaaaaaaugca

SEQ ID NO: 744167 - RNA, 20 nt, Leptospira interrogans serovar lai str. 56601
uuuucucaucaaaaaaauga

SEQ ID NO: 744168 - RNA, 19 nt, Leptospira interrogans serovar lai str. 56601
uuuucuauaaucugaaaua

SEQ ID NO: 744169 - RNA, 16 nt, Leptospira interrogans serovar lai str. 56601
uuuucuagacuuucuu

SEQ ID NO: 744170 - RNA, 12 nt, Leptospira interrogans serovar lai str. 56601
uuuucuaucaaa

SEQ ID NO: 744171 - RNA, 13 nt, Leptospira interrogans serovar lai str. 56601
uuuucuaucaaga

SEQ ID NO: 744172 - RNA, 16 nt, Leptospira interrogans serovar lai str. 56601
uuuucugaaaaaagcu

SEQ ID NO: 744173 - RNA, 16 nt, Leptospira interrogans serovar lai str. 56601
uuuucugaaaaaaguu

SEQ ID NO: 744174 - RNA, 21 nt, Leptospira interrogans serovar lai str. 56601
uuuucugaaaaaaguugaaau

SEQ ID NO: 744175 - RNA, 14 nt, Leptospira interrogans serovar lai str. 56601
uuuucugaaaaguu

SEQ ID NO: 744176 - RNA, 16 nt, Leptospira interrogans serovar lai str. 56601
uuuucucuaucagaaa

SEQ ID NO: 744177 - RNA, 23 nt, Leptospira interrogans serovar lai str. 56601
uuuucuguaaaaauaaaauguag

SEQ ID NO: 744178 - RNA, 15 nt, Leptospira interrogans serovar lai str. 56601
uuuucuggaaaaguu

SEQ ID NO: 744179 - RNA, 16 nt, Leptospira interrogans serovar lai str. 56601
uuuucuggaaaaguuu

SEQ ID NO: 744180 - RNA, 19 nt, Leptospira interrogans serovar lai str. 56601
uuuuguuaggcaauauuau

SEQ ID NO: 744181 - RNA, 23 nt, Leptospira interrogans serovar lai str. 56601
uuuuguuaauuaaacuuuuauaa

SEQ ID NO: 744182 - RNA, 20 nt, Leptospira interrogans serovar lai str. 56601
uuuuguuaaccaaaaauuca

SEQ ID NO: 744183 - RNA, 15 nt, Leptospira interrogans serovar lai str. 56601
uuuugugaaucaaaa

SEQ ID NO: 744184 - RNA, 20 nt, Leptospira interrogans serovar lai str. 56601
uuuugugaaguuaaaacauu

SEQ ID NO: 744185 - RNA, 17 nt, Leptospira interrogans serovar lai str. 56601
uuuuguaaguuuugaau

SEQ ID NO: 744186 - RNA, 19 nt, Leptospira interrogans serovar lai str. 56601
uuuuguaauaguucccaca

SEQ ID NO: 744187 - RNA, 13 nt, Leptospira interrogans serovar lai str. 56601
uuuuguauauaaa

SEQ ID NO: 744188 - RNA, 11 nt, Leptospira interrogans serovar lai str. 56601
uuuuguagaau

SEQ ID NO: 744189 - RNA, 19 nt, Leptospira interrogans serovar lai str. 56601
uuuuguagagucaaaaguu

SEQ ID NO: 744190 - RNA, 10 nt, Leptospira interrogans serovar lai str. 56601
uuuuuaaaaa

SEQ ID NO: 744191 - RNA, 23 nt, Leptospira interrogans serovar lai str. 56601
uuuuuaaaaaauaggaguuccua

SEQ ID NO: 744192 - RNA, 11 nt, Leptospira interrogans serovar lai str. 56601
uuuuuaaaaau

SEQ ID NO: 744193 - RNA, 12 nt, Leptospira interrogans serovar lai str. 56601
uuuuuaaaauaa

SEQ ID NO: 744194 - RNA, 16 nt, Leptospira interrogans serovar lai str. 56601
uuuuuaaaaaugucua

SEQ ID NO: 744195 - RNA, 13 nt, Leptospira interrogans serovar lai str. 56601
uuuuuaaaaauuu

SEQ ID NO: 744196 - RNA, 21 nt, Leptospira interrogans serovar lai str. 56601
uuuuuaaacuuuguuuuugcu

SEQ ID NO: 744197 - RNA, 12 nt, Leptospira interrogans serovar lai str. 56601
uuuuuaaauuaa

SEQ ID NO: 744198 - RNA, 15 nt, Leptospira interrogans serovar lai str. 56601
uuuuuaacaauucua

SEQ ID NO: 744199 - RNA, 18 nt, Leptospira interrogans serovar lai str. 56601
uuuuuaaaugugggaacu

SEQ ID NO: 744200 - RNA, 12 nt, Leptospira interrogans serovar lai str. 56601
uuuuuacagaaa

SEQ ID NO: 744201 - RNA, 13 nt, Leptospira interrogans serovar lai str. 56601
uuuuuacagaaaa

SEQ ID NO: 744202 - RNA, 20 nt, Leptospira interrogans serovar lai str. 56601
uuuuuaaucaaaugcaguaa

SEQ ID NO: 744203 - RNA, 18 nt, Leptospira interrogans serovar lai str. 56601
uuuuuaauauacugcaau

SEQ ID NO: 744204 - RNA, 14 nt, Leptospira interrogans serovar lai str. 56601
uuuuuaauauucaa

SEQ ID NO: 744205 - RNA, 12 nt, Leptospira interrogans serovar lai str. 56601
uuuuuauuauaa

SEQ ID NO: 744206 - RNA, 13 nt, Leptospira interrogans serovar lai str. 56601
uuuuuauuauaua

SEQ ID NO: 744207 - RNA, 18 nt, Leptospira interrogans serovar lai str. 56601
uuuuuaucauaaaacacu

SEQ ID NO: 744208 - RNA, 16 nt, Leptospira interrogans serovar lai str. 56601
uuuuuauaaaaauaca

SEQ ID NO: 744209 - RNA, 12 nt, Leptospira interrogans serovar lai str. 56601
uuuuuauaaaau

SEQ ID NO: 744210 - RNA, 21 nt, Leptospira interrogans serovar lai str. 56601
uuuuuagacaaaaauacuaaa

SEQ ID NO: 744211 - RNA, 22 nt, Leptospira interrogans serovar lai str. 56601
uuuuuagaguguugacucuuuu

SEQ ID NO: 744212 - RNA, 20 nt, Leptospira interrogans serovar lai str. 56601
uuuuuacaugagacuauaaa

SEQ ID NO: 744213 - RNA, 19 nt, Leptospira interrogans serovar lai str. 56601
uuuuucaaucuaacccauu

SEQ ID NO: 744214 - RNA, 14 nt, Leptospira interrogans serovar lai str. 56601
uuuuucaaaaacuc

SEQ ID NO: 744215 - RNA, 13 nt, Leptospira interrogans serovar lai str. 56601
uuuuucaaaauaa

SEQ ID NO: 744216 - RNA, 13 nt, Leptospira interrogans serovar lai str. 56601
uuuuucaacaacu

SEQ ID NO: 744217 - RNA, 16 nt, Leptospira interrogans serovar lai str. 56601
uuuuucaauaauucua

SEQ ID NO: 744218 - RNA, 16 nt, Leptospira interrogans serovar lai str. 56601
uuuuucacaaguuaaa

SEQ ID NO: 744219 - RNA, 13 nt, Leptospira interrogans serovar lai str. 56601
uuuuucagaaaaa

SEQ ID NO: 744220 - RNA, 23 nt, Leptospira interrogans serovar lai str. 56601
uuuuuccuggcugagaaccauuu

SEQ ID NO: 744221 - RNA, 18 nt, Leptospira interrogans serovar lai str. 56601
uuuuuccgguaauuauaa

SEQ ID NO: 744222 - RNA, 23 nt, Leptospira interrogans serovar lai str. 56601
uuuuucccggucucgaauuguuu

SEQ ID NO: 744223 - RNA, 18 nt, Leptospira interrogans serovar lai str. 56601
uuuuuccagcccauucuu

SEQ ID NO: 744224 - RNA, 15 nt, Leptospira interrogans serovar lai str. 56601
uuuuuccauaaaaaa

SEQ ID NO: 744225 - RNA, 20 nt, Leptospira interrogans serovar lai str. 56601
uuuuuccauaaaaaacauaa

SEQ ID NO: 744226 - RNA, 16 nt, Leptospira interrogans serovar lai str. 56601
uuuuucauucuuucca

SEQ ID NO: 744227 - RNA, 16 nt, Leptospira interrogans serovar lai str. 56601
uuuuauuuuauucacu

SEQ ID NO: 744228 - RNA, 13 nt, Leptospira interrogans serovar lai str. 56601
uuuuauuugcauu

SEQ ID NO: 744229 - RNA, 14 nt, Leptospira interrogans serovar lai str. 56601
uuuucaaaaaauaa

SEQ ID NO: 744230 - RNA, 16 nt, Leptospira interrogans serovar lai str. 56601
uuuucaaaaaauauca

SEQ ID NO: 744231 - RNA, 18 nt, Leptospira interrogans serovar lai str. 56601
uuuuauuuuuuaugaaaa

SEQ ID NO: 744232 - RNA, 21 nt, Leptospira interrogans serovar lai str. 56601
uuuucaaaauaagaauuuucu

SEQ ID NO: 744233 - RNA, 12 nt, Leptospira interrogans serovar lai str. 56601
uuuucaaaaaau

SEQ ID NO: 744234 - RNA, 23 nt, Leptospira interrogans serovar lai str. 56601
uuuucaaacguucguaguuuuug

SEQ ID NO: 744235 - RNA, 19 nt, Leptospira interrogans serovar lai str. 56601
uuuucaaaaguauuuugau

SEQ ID NO: 744236 - RNA, 20 nt, Leptospira interrogans serovar lai str. 56601
uuuucaaucgaagaaauaca

SEQ ID NO: 744237 - RNA, 23 nt, Leptospira interrogans serovar lai str. 56601
uuuucaaucuaacccauucaaca

SEQ ID NO: 744238 - RNA, 19 nt, Leptospira interrogans serovar lai str. 56601
uuuucaacaacucuaauuu

SEQ ID NO: 744239 - RNA, 21 nt, Leptospira interrogans serovar lai str. 56601
uuuucaacaacucuaauuuag

SEQ ID NO: 744240 - RNA, 18 nt, Leptospira interrogans serovar lai str. 56601
uuuucaacaacucuauuu

SEQ ID NO: 744241 - RNA, 21 nt, Leptospira interrogans serovar lai str. 56601
uuuucauaauaaauuuuucug

SEQ ID NO: 744242 - RNA, 19 nt, Leptospira interrogans serovar lai str. 56601
uuuucauagaaaaaauaca

SEQ ID NO: 744243 - RNA, 18 nt, Leptospira interrogans serovar lai str. 56601
uuuucagggaaaaauaag

SEQ ID NO: 744244 - RNA, 17 nt, Leptospira interrogans serovar lai str. 56601
uuuucagucuaucaaac

SEQ ID NO: 744245 - RNA, 19 nt, Leptospira interrogans serovar lai str. 56601
uuuucagugaauaaaauaa

SEQ ID NO: 744246 - RNA, 23 nt, Leptospira interrogans serovar lai str. 56601
uuuucagugaauaaaauaaaaaa

SEQ ID NO: 744247 - RNA, 21 nt, Leptospira interrogans serovar lai str. 56601
uuuucacaaaaaaauucuccu

SEQ ID NO: 744248 - RNA, 16 nt, Leptospira interrogans serovar lai str. 56601
uuuucagauuguuauu

SEQ ID NO: 744249 - RNA, 19 nt, Leptospira interrogans serovar lai str. 56601
uuuuccaaaaagaaaaaca

SEQ ID NO: 744250 - RNA, 14 nt, Leptospira interrogans serovar lai str. 56601
uuuuccaaaaauuu

SEQ ID NO: 744251 - RNA, 15 nt, Leptospira interrogans serovar lai str. 56601
uuuucauuugaauuu

SEQ ID NO: 744252 - RNA, 20 nt, Leptospira interrogans serovar lai str. 56601
uuuucauuugaauuuauaga

SEQ ID NO: 744253 - RNA, 17 nt, Leptospira interrogans serovar lai str. 56601
uuuuccauaaaaaauga

SEQ ID NO: 744254 - RNA, 18 nt, Leptospira interrogans serovar lai str. 56601
uuuuccagcccauucuuu

SEQ ID NO: 744255 - RNA, 14 nt, Leptospira interrogans serovar lai str. 56601
uuuuccuauuuuug

SEQ ID NO: 744256 - RNA, 20 nt, Leptospira interrogans serovar lai str. 56601
uuuuccggacuuuccagaaa

SEQ ID NO: 744257 - RNA, 12 nt, Leptospira interrogans serovar lai str. 56601
uuuuccgguaau

SEQ ID NO: 744258 - RNA, 16 nt, Leptospira interrogans serovar lai str. 56601
uuuuccguaaaaaguu

SEQ ID NO: 744259 - RNA, 14 nt, Leptospira interrogans serovar lai str. 56601
uuuucguauuguuu

SEQ ID NO: 744260 - RNA, 12 nt, Leptospira interrogans serovar lai str. 56601
uuuucuaaaaua

SEQ ID NO: 744261 - RNA, 14 nt, Leptospira interrogans serovar lai str. 56601
uuuucuaaaauaua

SEQ ID NO: 744262 - RNA, 17 nt, Leptospira interrogans serovar lai str. 56601
uuuucguuucugaggaa

SEQ ID NO: 744263 - RNA, 18 nt, Leptospira interrogans serovar lai str. 56601
uuuucgucgacuuugacu

SEQ ID NO: 744264 - RNA, 22 nt, Leptospira interrogans serovar lai str. 56601
uuuucgugauaacaaacuuuua

SEQ ID NO: 744265 - RNA, 16 nt, Leptospira interrogans serovar lai str. 56601
uuuucggaauccgaaa

SEQ ID NO: 744266 - RNA, 20 nt, Leptospira interrogans serovar lai str. 56601
uuuucggaauccgaaaaguu

SEQ ID NO: 744267 - RNA, 11 nt, Leptospira interrogans serovar lai str. 56601
uuuucggaaau

SEQ ID NO: 744268 - RNA, 17 nt, Leptospira interrogans serovar lai str. 56601
uuuucgccgaaacauuc

SEQ ID NO: 744269 - RNA, 19 nt, Leptospira interrogans serovar lai str. 56601
uuuuccuuuaaacuuagau

SEQ ID NO: 744270 - RNA, 14 nt, Leptospira interrogans serovar lai str. 56601
uuuucgaaaagaaa

SEQ ID NO: 744271 - RNA, 16 nt, Leptospira interrogans serovar lai str. 56601
uuuucgaaaagaaaua

SEQ ID NO: 744272 - RNA, 22 nt, Leptospira interrogans serovar lai str. 56601
uuuucgaaaagaaauauuaaaa

SEQ ID NO: 744273 - RNA, 12 nt, Leptospira interrogans serovar lai str. 56601
uuuucgaaacaa

SEQ ID NO: 744274 - RNA, 17 nt, Leptospira interrogans serovar lai str. 56601
uuuucgaaacaaaauca

SEQ ID NO: 744275 - RNA, 21 nt, Leptospira interrogans serovar lai str. 56601
uuuucgaaacaaaaucaaaga

SEQ ID NO: 744276 - RNA, 18 nt, Leptospira interrogans serovar lai str. 56601
uuuuccuggcugagaacc

SEQ ID NO: 744277 - RNA, 14 nt, Leptospira interrogans serovar lai str. 56601
uuuucgcacauucu

SEQ ID NO: 744278 - RNA, 20 nt, Leptospira interrogans serovar lai str. 56601
uuuuauauaaguuaaauuuu

SEQ ID NO: 744279 - RNA, 23 nt, Leptospira interrogans serovar lai str. 56601
uuuuauauaaguuaaauuuuuug

SEQ ID NO: 744280 - RNA, 23 nt, Leptospira interrogans serovar lai str. 56601
uuuuauauagaaccaucucaaaa

SEQ ID NO: 744281 - RNA, 11 nt, Leptospira interrogans serovar lai str. 56601
uuuuaucaaau

SEQ ID NO: 744282 - RNA, 13 nt, Leptospira interrogans serovar lai str. 56601
uuuuaucaaauaa

SEQ ID NO: 744283 - RNA, 15 nt, Leptospira interrogans serovar lai str. 56601
uuuuaucaaauaaag

SEQ ID NO: 744284 - RNA, 15 nt, Leptospira interrogans serovar lai str. 56601
uuuuauauuuuaauu

SEQ ID NO: 744285 - RNA, 21 nt, Leptospira interrogans serovar lai str. 56601
uuuuaucggcguucuacaaaa

SEQ ID NO: 744286 - RNA, 23 nt, Leptospira interrogans serovar lai str. 56601
uuuuaucgcaaaacauuauuuca

SEQ ID NO: 744287 - RNA, 18 nt, Leptospira interrogans serovar lai str. 56601
uuuuaucuaaaauuucau

SEQ ID NO: 744288 - RNA, 17 nt, Leptospira interrogans serovar lai str. 56601
uuuuaugaaaaaauuca

SEQ ID NO: 744289 - RNA, 22 nt, Leptospira interrogans serovar lai str. 56601
uuuuaucuuaauguaaaguucu

SEQ ID NO: 744290 - RNA, 15 nt, Leptospira interrogans serovar lai str. 56601
uuuuaugauuuucuu

SEQ ID NO: 744291 - RNA, 19 nt, Leptospira interrogans serovar lai str. 56601
uuuuaugacuucuuaagua

SEQ ID NO: 744292 - RNA, 21 nt, Leptospira interrogans serovar lai str. 56601
uuuuaugagcuuuguagaaua

SEQ ID NO: 744293 - RNA, 18 nt, Leptospira interrogans serovar lai str. 56601
uuuuauugugaguuuaaa

SEQ ID NO: 744294 - RNA, 12 nt, Leptospira interrogans serovar lai str. 56601
uuuuauuucuaa

SEQ ID NO: 744295 - RNA, 22 nt, Leptospira interrogans serovar lai str. 56601
uuuuauuugauuagaaaaaaag

SEQ ID NO: 744296 - RNA, 15 nt, Leptospira interrogans serovar lai str. 56601
uuuuauguaauauuu

SEQ ID NO: 744297 - RNA, 20 nt, Leptospira interrogans serovar lai str. 56601
uuuuauguagaaauuugauu

SEQ ID NO: 744298 - RNA, 14 nt, Leptospira interrogans serovar lai str. 56601
uuuuauuauauaau

SEQ ID NO: 744299 - RNA, 13 nt, Leptospira interrogans serovar lai str. 56601
uuuuauuauaaau

SEQ ID NO: 744300 - RNA, 23 nt, Leptospira interrogans serovar lai str. 56601
uuuuauuacaauuuuaucuuaau

SEQ ID NO: 744301 - RNA, 12 nt, Leptospira interrogans serovar lai str. 56601
uuuuauuaaaaa

SEQ ID NO: 744302 - RNA, 13 nt, Leptospira interrogans serovar lai str. 56601
uuuuauuaaaaau

SEQ ID NO: 744303 - RNA, 18 nt, Leptospira interrogans serovar lai str. 56601
uuuuagccuggaauucuu

SEQ ID NO: 744304 - RNA, 15 nt, Leptospira interrogans serovar lai str. 56601
uuuuaguaaacuacu

SEQ ID NO: 744305 - RNA, 17 nt, Leptospira interrogans serovar lai str. 56601
uuuuaguucaaaaacau

SEQ ID NO: 744306 - RNA, 18 nt, Leptospira interrogans serovar lai str. 56601
uuuuaguucaaaaacauc

SEQ ID NO: 744307 - RNA, 19 nt, Leptospira interrogans serovar lai str. 56601
uuuuagugcgguauuuuuu

SEQ ID NO: 744308 - RNA, 20 nt, Leptospira interrogans serovar lai str. 56601
uuuuagugcgguauuuuuuu

SEQ ID NO: 744309 - RNA, 13 nt, Leptospira interrogans serovar lai str. 56601
uuuuauaaaaagc

SEQ ID NO: 744310 - RNA, 13 nt, Leptospira interrogans serovar lai str. 56601
uuuuauaaaaagu

SEQ ID NO: 744311 - RNA, 19 nt, Leptospira interrogans serovar lai str. 56601
uuuuauaaaaaguuuguuu

SEQ ID NO: 744312 - RNA, 15 nt, Leptospira interrogans serovar lai str. 56601
uuuuauaaaaauaca

SEQ ID NO: 744313 - RNA, 11 nt, Leptospira interrogans serovar lai str. 56601
uuuuauaaaaa

SEQ ID NO: 744314 - RNA, 19 nt, Leptospira interrogans serovar lai str. 56601
uuuuaguuuuuauuugauu

SEQ ID NO: 744315 - RNA, 14 nt, Leptospira interrogans serovar lai str. 56601
uuuuaguuuuuccu

SEQ ID NO: 744316 - RNA, 13 nt, Leptospira interrogans serovar lai str. 56601
uuuuaguuuuaau

SEQ ID NO: 744317 - RNA, 19 nt, Leptospira interrogans serovar lai str. 56601
uuuuaguuuauuuuaaaaa

SEQ ID NO: 744318 - RNA, 17 nt, Leptospira interrogans serovar lai str. 56601
uuuuaguuucaauuuag

SEQ ID NO: 744319 - RNA, 16 nt, Leptospira interrogans serovar lai str. 56601
uuuuauaaauuauuuu

SEQ ID NO: 744320 - RNA, 13 nt, Leptospira interrogans serovar lai str. 56601
uuuuauaaaauac

SEQ ID NO: 744321 - RNA, 14 nt, Leptospira interrogans serovar lai str. 56601
uuuuauaaaauacc

SEQ ID NO: 744322 - RNA, 15 nt, Leptospira interrogans serovar lai str. 56601
uuuuauaaaauuaag

SEQ ID NO: 744323 - RNA, 14 nt, Leptospira interrogans serovar lai str. 56601
uuuuauaaaauuag

SEQ ID NO: 744324 - RNA, 16 nt, Leptospira interrogans serovar lai str. 56601
uuuuauacauucguuu

SEQ ID NO: 744325 - RNA, 19 nt, Leptospira interrogans serovar lai str. 56601
uuuuauacauucguuuuaa

SEQ ID NO: 744326 - RNA, 14 nt, Leptospira interrogans serovar lai str. 56601
uuuuauacuuuaau

SEQ ID NO: 744327 - RNA, 22 nt, Leptospira interrogans serovar lai str. 56601
uuuuauagaggucgucucaaaa

SEQ ID NO: 744328 - RNA, 14 nt, Leptospira interrogans serovar lai str. 56601
uuuuagaauucucc

SEQ ID NO: 744329 - RNA, 15 nt, Leptospira interrogans serovar lai str. 56601
uuuuagagaaacuuu

SEQ ID NO: 744330 - RNA, 20 nt, Leptospira interrogans serovar lai str. 56601
uuuuagaguuuguuccaaaa

SEQ ID NO: 744331 - RNA, 15 nt, Leptospira interrogans serovar lai str. 56601
uuuuagauaaauaca

SEQ ID NO: 744332 - RNA, 16 nt, Leptospira interrogans serovar lai str. 56601
uuuuagaaaauuuuua

SEQ ID NO: 744333 - RNA, 19 nt, Leptospira interrogans serovar lai str. 56601
uuuuagaaaauuuuuacuc

SEQ ID NO: 744334 - RNA, 19 nt, Leptospira interrogans serovar lai str. 56601
uuuuagaaaaaauuuuucu

SEQ ID NO: 744335 - RNA, 20 nt, Leptospira interrogans serovar lai str. 56601
uuuuagaauauuaugaaaua

SEQ ID NO: 744336 - RNA, 23 nt, Leptospira interrogans serovar lai str. 56601
uuuuagaauauuaugaaauaaag

SEQ ID NO: 744337 - RNA, 17 nt, Leptospira interrogans serovar lai str. 56601
uuuuagaaucaaaauga

SEQ ID NO: 744338 - RNA, 15 nt, Leptospira interrogans serovar lai str. 56601
uuuuagaauuuguuu

SEQ ID NO: 744339 - RNA, 18 nt, Leptospira interrogans serovar lai str. 56601
uuuuagacaaaaaauucu

SEQ ID NO: 744340 - RNA, 16 nt, Leptospira interrogans serovar lai str. 56601
uuuuagacaaaaauac

SEQ ID NO: 744341 - RNA, 21 nt, Leptospira interrogans serovar lai str. 56601
uuuuagacaaaaauacuaaau

SEQ ID NO: 744342 - RNA, 15 nt, Leptospira interrogans serovar lai str. 56601
uuuuacgugaaguag

SEQ ID NO: 744343 - RNA, 13 nt, Leptospira interrogans serovar lai str. 56601
uuuuacuaaaaaa

SEQ ID NO: 744344 - RNA, 15 nt, Leptospira interrogans serovar lai str. 56601
uuuuacuaaaaaaca

SEQ ID NO: 744345 - RNA, 18 nt, Leptospira interrogans serovar lai str. 56601
uuuuacgcguaauuuuuu

SEQ ID NO: 744346 - RNA, 19 nt, Leptospira interrogans serovar lai str. 56601
uuuuacggaucaaaauucu

SEQ ID NO: 744347 - RNA, 23 nt, Leptospira interrogans serovar lai str. 56601
uuuuacggaucaaaauucuuugu

SEQ ID NO: 744348 - RNA, 22 nt, Leptospira interrogans serovar lai str. 56601
uuuuacggaucaauucugaaaa

SEQ ID NO: 744349 - RNA, 22 nt, Leptospira interrogans serovar lai str. 56601
uuuuacggauucucgcauuuuc

SEQ ID NO: 744350 - RNA, 16 nt, Leptospira interrogans serovar lai str. 56601
uuuuacuguaaaauuu

SEQ ID NO: 744351 - RNA, 21 nt, Leptospira interrogans serovar lai str. 56601
uuuuacuguaaaauuuaaauu

SEQ ID NO: 744352 - RNA, 18 nt, Leptospira interrogans serovar lai str. 56601
uuuuacuguaaaauuuag

SEQ ID NO: 744353 - RNA, 17 nt, Leptospira interrogans serovar lai str. 56601
uuuuacuguuguuaaau

SEQ ID NO: 744354 - RNA, 14 nt, Leptospira interrogans serovar lai str. 56601
uuuuacucaugacu

SEQ ID NO: 744355 - RNA, 13 nt, Leptospira interrogans serovar lai str. 56601
uuuuacugaguuu

SEQ ID NO: 744356 - RNA, 22 nt, Leptospira interrogans serovar lai str. 56601
uuuuaaucuccgcucuauuucc

SEQ ID NO: 744357 - RNA, 12 nt, Leptospira interrogans serovar lai str. 56601
uuuuaaugaaaa

SEQ ID NO: 744358 - RNA, 20 nt, Leptospira interrogans serovar lai str. 56601
uuuuaaugaaaaauuucuuu

SEQ ID NO: 744359 - RNA, 14 nt, Leptospira interrogans serovar lai str. 56601
uuuuacaaaaaaau

SEQ ID NO: 744360 - RNA, 17 nt, Leptospira interrogans serovar lai str. 56601
uuuuacaaaaguagaaa

SEQ ID NO: 744361 - RNA, 22 nt, Leptospira interrogans serovar lai str. 56601
uuuuacaaacaaauuccgaaau

SEQ ID NO: 744362 - RNA, 14 nt, Leptospira interrogans serovar lai str. 56601
uuuuacauuguuuu

SEQ ID NO: 744363 - RNA, 19 nt, Leptospira interrogans serovar lai str. 56601
uuuuaccagaucaauucuu

SEQ ID NO: 744364 - RNA, 16 nt, Leptospira interrogans serovar lai str. 56601
uuuuacacguaauucu

SEQ ID NO: 744365 - RNA, 21 nt, Leptospira interrogans serovar lai str. 56601
uuuuacagacguauuuuuaaa

SEQ ID NO: 744366 - RNA, 22 nt, Leptospira interrogans serovar lai str. 56601
uuuuacagacguauuuuuaaau

SEQ ID NO: 744367 - RNA, 21 nt, Leptospira interrogans serovar lai str. 56601
uuuuacaauuaaacuucaaaa

SEQ ID NO: 744368 - RNA, 23 nt, Leptospira interrogans serovar lai str. 56601
uuuuacaauuaaacuucaaaaaa

SEQ ID NO: 744369 - RNA, 18 nt, Leptospira interrogans serovar lai str. 56601
uuuuacagauugauucuu

SEQ ID NO: 744370 - RNA, 22 nt, Leptospira interrogans serovar lai str. 56601
uuuuacagauuuauuuuagaau

SEQ ID NO: 744371 - RNA, 20 nt, Leptospira interrogans serovar lai str. 56601
uuuuacagccaccaucaaaa

SEQ ID NO: 744372 - RNA, 18 nt, Leptospira interrogans serovar lai str. 56601
uuuuacccugguuucaaa

SEQ ID NO: 744373 - RNA, 23 nt, Leptospira interrogans serovar lai str. 56601
uuuuaccgauaagucuagaaaug

SEQ ID NO: 744374 - RNA, 22 nt, Leptospira interrogans serovar lai str. 56601
uuuuacccgaucuuuuuuaauu

SEQ ID NO: 744375 - RNA, 18 nt, Leptospira interrogans serovar lai str. 56601
uuuuacgauuaaauuuug

SEQ ID NO: 744376 - RNA, 18 nt, Leptospira interrogans serovar lai str. 56601
uuuuacgaacaaauucua

SEQ ID NO: 744377 - RNA, 20 nt, Leptospira interrogans serovar lai str. 56601
uuuuacgaacaaauucuaaa

SEQ ID NO: 744378 - RNA, 20 nt, Leptospira interrogans serovar lai str. 56601
uuuuacgaacgaauucuaaa

SEQ ID NO: 744379 - RNA, 17 nt, Leptospira interrogans serovar lai str. 56601
uuuuaccguuuuuaaau

SEQ ID NO: 744380 - RNA, 22 nt, Leptospira interrogans serovar lai str. 56601
uuuuaaguagaaccuaaaaaua

SEQ ID NO: 744381 - RNA, 15 nt, Leptospira interrogans serovar lai str. 56601
uuuuaagauuacauu

SEQ ID NO: 744382 - RNA, 21 nt, Leptospira interrogans serovar lai str. 56601
uuuuaauauacugcaauaguu

SEQ ID NO: 744383 - RNA, 22 nt, Leptospira interrogans serovar lai str. 56601
uuuuaauauacugcaauaguuu

SEQ ID NO: 744384 - RNA, 17 nt, Leptospira interrogans serovar lai str. 56601
uuuuaauaaaauacagu

SEQ ID NO: 744385 - RNA, 15 nt, Leptospira interrogans serovar lai str. 56601
uuuuaauaaaaugca

SEQ ID NO: 744386 - RNA, 21 nt, Leptospira interrogans serovar lai str. 56601
uuuuaauaaaaugcaauaguu

SEQ ID NO: 744387 - RNA, 18 nt, Leptospira interrogans serovar lai str. 56601
uuuuaauaugacuuaauc

SEQ ID NO: 744388 - RNA, 23 nt, Leptospira interrogans serovar lai str. 56601
uuuuaauauuacauucaauaauu

SEQ ID NO: 744389 - RNA, 17 nt, Leptospira interrogans serovar lai str. 56601
uuuuaauauuauuaaau

SEQ ID NO: 744390 - RNA, 12 nt, Leptospira interrogans serovar lai str. 56601
uuuuaauauuuc

SEQ ID NO: 744391 - RNA, 19 nt, Leptospira interrogans serovar lai str. 56601
uuuuaaucauccaauaauu

SEQ ID NO: 744392 - RNA, 20 nt, Leptospira interrogans serovar lai str. 56601
uuuuaaucaugugaauucag

SEQ ID NO: 744393 - RNA, 17 nt, Leptospira interrogans serovar lai str. 56601
uuuuaaccgcaaaauca

SEQ ID NO: 744394 - RNA, 18 nt, Leptospira interrogans serovar lai str. 56601
uuuuaaauuuacuauuuu

SEQ ID NO: 744395 - RNA, 12 nt, Leptospira interrogans serovar lai str. 56601
uuuuaaauuuuu

SEQ ID NO: 744396 - RNA, 12 nt, Leptospira interrogans serovar lai str. 56601
uuuuaaauuuau

SEQ ID NO: 744397 - RNA, 20 nt, Leptospira interrogans serovar lai str. 56601
uuuuaaauuuaucuauaaaa

SEQ ID NO: 744398 - RNA, 16 nt, Leptospira interrogans serovar lai str. 56601
uuuuaacgcaaaauac

SEQ ID NO: 744399 - RNA, 17 nt, Leptospira interrogans serovar lai str. 56601
uuuuaacgcaaaauacu

SEQ ID NO: 744400 - RNA, 17 nt, Leptospira interrogans serovar lai str. 56601
uuuuaacuuuuuuuaaa

SEQ ID NO: 744401 - RNA, 23 nt, Leptospira interrogans serovar lai str. 56601
uuuuaagacucagcaaaaccuuu

SEQ ID NO: 744402 - RNA, 18 nt, Leptospira interrogans serovar lai str. 56601
uuuuaagagccuacaaau

SEQ ID NO: 744403 - RNA, 13 nt, Leptospira interrogans serovar lai str. 56601
uuuuaagaaucuc

SEQ ID NO: 744404 - RNA, 17 nt, Leptospira interrogans serovar lai str. 56601
uuuuaagaaucucaaaa

SEQ ID NO: 744405 - RNA, 16 nt, Leptospira interrogans serovar lai str. 56601
uuuuaagacaaacuuu

SEQ ID NO: 744406 - RNA, 18 nt, Leptospira interrogans serovar lai str. 56601
uuuuaagacaaacuuuua

SEQ ID NO: 744407 - RNA, 21 nt, Leptospira interrogans serovar lai str. 56601
uuuuaagacaaacuuuuagau

SEQ ID NO: 744408 - RNA, 18 nt, Leptospira interrogans serovar lai str. 56601
uuuuaaauacucuaauuu

SEQ ID NO: 744409 - RNA, 16 nt, Leptospira interrogans serovar lai str. 56601
uuuuaaauaaaaagaa

SEQ ID NO: 744410 - RNA, 15 nt, Leptospira interrogans serovar lai str. 56601
uuuuaaaguuuugaa

SEQ ID NO: 744411 - RNA, 20 nt, Leptospira interrogans serovar lai str. 56601
uuuuaaaucgacaaaaugag

SEQ ID NO: 744412 - RNA, 16 nt, Leptospira interrogans serovar lai str. 56601
uuuuaaaugcaccguu

SEQ ID NO: 744413 - RNA, 14 nt, Leptospira interrogans serovar lai str. 56601
uuuuaaaugcagcu

SEQ ID NO: 744414 - RNA, 11 nt, Leptospira interrogans serovar lai str. 56601
uuuuaaaugug

SEQ ID NO: 744415 - RNA, 16 nt, Leptospira interrogans serovar lai str. 56601
uuuuaaauuaauauuu

SEQ ID NO: 744416 - RNA, 16 nt, Leptospira interrogans serovar lai str. 56601
uuuuaaacuuuguuuu

SEQ ID NO: 744417 - RNA, 19 nt, Leptospira interrogans serovar lai str. 56601
uuuuaaacgauuuaaaaga

SEQ ID NO: 744418 - RNA, 19 nt, Leptospira interrogans serovar lai str. 56601
uuuuaaacucauucuaguu

SEQ ID NO: 744419 - RNA, 16 nt, Leptospira interrogans serovar lai str. 56601
uuuuaaaaucaagagc

SEQ ID NO: 744420 - RNA, 22 nt, Leptospira interrogans serovar lai str. 56601
uuuuaaaaucguccgaacuucu

SEQ ID NO: 744421 - RNA, 14 nt, Leptospira interrogans serovar lai str. 56601
uuuuaaaaucuucu

SEQ ID NO: 744422 - RNA, 22 nt, Leptospira interrogans serovar lai str. 56601
uuuuaaacauccaauuauaaaa

SEQ ID NO: 744423 - RNA, 23 nt, Leptospira interrogans serovar lai str. 56601
uuuuaaacgaacgacuaucuacc

SEQ ID NO: 744424 - RNA, 22 nt, Leptospira interrogans serovar lai str. 56601
uuuuaaaauugcagaauguuuu

SEQ ID NO: 744425 - RNA, 15 nt, Leptospira interrogans serovar lai str. 56601
uuuuaaaacuuaaaa

SEQ ID NO: 744426 - RNA, 23 nt, Leptospira interrogans serovar lai str. 56601
uuuuaaaacuuaaaaugugggau

SEQ ID NO: 744427 - RNA, 17 nt, Leptospira interrogans serovar lai str. 56601
uuuuaaaacuuuuaauu

SEQ ID NO: 744428 - RNA, 20 nt, Leptospira interrogans serovar lai str. 56601
uuuuaaaaguagaaucaucu

SEQ ID NO: 744429 - RNA, 14 nt, Leptospira interrogans serovar lai str. 56601
uuuuaaaaauuuug

SEQ ID NO: 744430 - RNA, 15 nt, Leptospira interrogans serovar lai str. 56601
uuuuaaaaggcucuc

SEQ ID NO: 744431 - RNA, 19 nt, Leptospira interrogans serovar lai str. 56601
uuuuaaaaguuauuauuuu

SEQ ID NO: 744432 - RNA, 12 nt, Leptospira interrogans serovar lai str. 56601
uuuuaaaaguuu

SEQ ID NO: 744433 - RNA, 20 nt, Leptospira interrogans serovar lai str. 56601
uuuuaaaaguuugauuucac

SEQ ID NO: 744434 - RNA, 14 nt, Leptospira interrogans serovar lai str. 56601
uuuuaaaaccaaaa

SEQ ID NO: 744435 - RNA, 14 nt, Leptospira interrogans serovar lai str. 56601
uuuuaaaaaugucu

SEQ ID NO: 744436 - RNA, 20 nt, Leptospira interrogans serovar lai str. 56601
uuuuaaaaauucaacuaaau

SEQ ID NO: 744437 - RNA, 23 nt, Leptospira interrogans serovar lai str. 56601
uuuuaaaaauucaacuaaauccu

SEQ ID NO: 744438 - RNA, 14 nt, Leptospira interrogans serovar lai str. 56601
uuuuaaaaaauuca

SEQ ID NO: 744439 - RNA, 13 nt, Leptospira interrogans serovar lai str. 56601
uuuuaaaaaccua

SEQ ID NO: 744440 - RNA, 14 nt, Leptospira interrogans serovar lai str. 56601
uuuuaaaaacuugu

SEQ ID NO: 744441 - RNA, 12 nt, Leptospira interrogans serovar lai str. 56601
uuuuaaaaagaa

SEQ ID NO: 744442 - RNA, 15 nt, Leptospira interrogans serovar lai str. 56601
uuuuaaaaaaauuac

SEQ ID NO: 744443 - RNA, 12 nt, Leptospira interrogans serovar lai str. 56601
uuuguuuuucuu

SEQ ID NO: 744444 - RNA, 15 nt, Leptospira interrogans serovar lai str. 56601
uuuguuuuauucuaa

SEQ ID NO: 744445 - RNA, 13 nt, Leptospira interrogans serovar lai str. 56601
uuuguuuccuucu

SEQ ID NO: 744446 - RNA, 13 nt, Leptospira interrogans serovar lai str. 56601
uuuguuuguaucc

SEQ ID NO: 744447 - RNA, 12 nt, Leptospira interrogans serovar lai str. 56601
uuuguuuuaaaa

SEQ ID NO: 744448 - RNA, 15 nt, Leptospira interrogans serovar lai str. 56601
uuuguugcaauacau

SEQ ID NO: 744449 - RNA, 21 nt, Leptospira interrogans serovar lai str. 56601
uuuguugcguuuaaaaacaga

SEQ ID NO: 744450 - RNA, 18 nt, Leptospira interrogans serovar lai str. 56601
uuuguucuggagaaagau

SEQ ID NO: 744451 - RNA, 18 nt, Leptospira interrogans serovar lai str. 56601
uuuguuccuaaaaaauaa

SEQ ID NO: 744452 - RNA, 13 nt, Leptospira interrogans serovar lai str. 56601
uuuguuagagugc

SEQ ID NO: 744453 - RNA, 22 nt, Leptospira interrogans serovar lai str. 56601
uuuguuaucaauagaaauacca

SEQ ID NO: 744454 - RNA, 19 nt, Leptospira interrogans serovar lai str. 56601
uuuggaucgguuuuagaau

SEQ ID NO: 744455 - RNA, 20 nt, Leptospira interrogans serovar lai str. 56601
uuuggauuuuauaaaguaaa

SEQ ID NO: 744456 - RNA, 21 nt, Leptospira interrogans serovar lai str. 56601
uuuggaauaaaaucauauuuu

SEQ ID NO: 744457 - RNA, 17 nt, Leptospira interrogans serovar lai str. 56601
uuuggagaccaaaaauc

SEQ ID NO: 744458 - RNA, 16 nt, Leptospira interrogans serovar lai str. 56601
uuuggaacaaguugaa

SEQ ID NO: 744459 - RNA, 14 nt, Leptospira interrogans serovar lai str. 56601
uuuggaaauuuuua

SEQ ID NO: 744460 - RNA, 16 nt, Leptospira interrogans serovar lai str. 56601
uuuggaaauuuuuaau

SEQ ID NO: 744461 - RNA, 13 nt, Leptospira interrogans serovar lai str. 56601
uuugcuuuuaaag

SEQ ID NO: 744462 - RNA, 20 nt, Leptospira interrogans serovar lai str. 56601
uuugcuucugaacaagaauu

SEQ ID NO: 744463 - RNA, 16 nt, Leptospira interrogans serovar lai str. 56601
uuugcuucaacacuga

SEQ ID NO: 744464 - RNA, 18 nt, Leptospira interrogans serovar lai str. 56601
uuugcuuccauugucuau

SEQ ID NO: 744465 - RNA, 16 nt, Leptospira interrogans serovar lai str. 56601
uuugggguuguuucau

SEQ ID NO: 744466 - RNA, 15 nt, Leptospira interrogans serovar lai str. 56601
uuugggcuucugaac

SEQ ID NO: 744467 - RNA, 23 nt, Leptospira interrogans serovar lai str. 56601
uuuggggcaugcuguaguuuauu

SEQ ID NO: 744468 - RNA, 16 nt, Leptospira interrogans serovar lai str. 56601
uuuggucgaucguuuu

SEQ ID NO: 744469 - RNA, 18 nt, Leptospira interrogans serovar lai str. 56601
uuuggucgaucguuuuuu

SEQ ID NO: 744470 - RNA, 22 nt, Leptospira interrogans serovar lai str. 56601
uuuggucgaucguuuuuugauc

SEQ ID NO: 744471 - RNA, 23 nt, Leptospira interrogans serovar lai str. 56601
uuuggugcggcgagacauaaaaa

SEQ ID NO: 744472 - RNA, 18 nt, Leptospira interrogans serovar lai str. 56601
uuugguuaucauaaaaau

SEQ ID NO: 744473 - RNA, 22 nt, Leptospira interrogans serovar lai str. 56601
uuugguuaucauaaaaauaaag

SEQ ID NO: 744474 - RNA, 12 nt, Leptospira interrogans serovar lai str. 56601
uuugggaauuuu

SEQ ID NO: 744475 - RNA, 22 nt, Leptospira interrogans serovar lai str. 56601
uuugugaaguuaaaacauuucg

SEQ ID NO: 744476 - RNA, 22 nt, Leptospira interrogans serovar lai str. 56601
uuugucuuugagaaaauucgaa

SEQ ID NO: 744477 - RNA, 14 nt, Leptospira interrogans serovar lai str. 56601
uuugugaacuuuug

SEQ ID NO: 744478 - RNA, 20 nt, Leptospira interrogans serovar lai str. 56601
uuugugacacugaaaacauu

SEQ ID NO: 744479 - RNA, 21 nt, Leptospira interrogans serovar lai str. 56601
uuugugacuaucaacaagaau

SEQ ID NO: 744480 - RNA, 20 nt, Leptospira interrogans serovar lai str. 56601
uuugugagaguuccacauuu

SEQ ID NO: 744481 - RNA, 19 nt, Leptospira interrogans serovar lai str. 56601
uuugugagaguucccacau

SEQ ID NO: 744482 - RNA, 22 nt, Leptospira interrogans serovar lai str. 56601
uuugugagaguucccacauuuu

SEQ ID NO: 744483 - RNA, 19 nt, Leptospira interrogans serovar lai str. 56601
uuugugagaguucccacgu

SEQ ID NO: 744484 - RNA, 21 nt, Leptospira interrogans serovar lai str. 56601
uuugugagaguucccacguuu

SEQ ID NO: 744485 - RNA, 16 nt, Leptospira interrogans serovar lai str. 56601
uuugugggaacucuua

SEQ ID NO: 744486 - RNA, 19 nt, Leptospira interrogans serovar lai str. 56601
uuuguggauuaugaagaau

SEQ ID NO: 744487 - RNA, 12 nt, Leptospira interrogans serovar lai str. 56601
uuuguauauaaa

SEQ ID NO: 744488 - RNA, 15 nt, Leptospira interrogans serovar lai str. 56601
uuuguauccauuucg

SEQ ID NO: 744489 - RNA, 17 nt, Leptospira interrogans serovar lai str. 56601
uuuguaucgaauggaaa

SEQ ID NO: 744490 - RNA, 20 nt, Leptospira interrogans serovar lai str. 56601
uuuguacaucuuaaaaaaua

SEQ ID NO: 744491 - RNA, 21 nt, Leptospira interrogans serovar lai str. 56601
uuuguaauaguucccacaguu

SEQ ID NO: 744492 - RNA, 22 nt, Leptospira interrogans serovar lai str. 56601
uuuguaauaguucccacaguuc

SEQ ID NO: 744493 - RNA, 19 nt, Leptospira interrogans serovar lai str. 56601
uuuguaauaguucccacau

SEQ ID NO: 744494 - RNA, 16 nt, Leptospira interrogans serovar lai str. 56601
uuuguaaguuuuccau

SEQ ID NO: 744495 - RNA, 15 nt, Leptospira interrogans serovar lai str. 56601
uuuguaaguuuugaa

SEQ ID NO: 744496 - RNA, 16 nt, Leptospira interrogans serovar lai str. 56601
uuuguaaguuuugaau

SEQ ID NO: 744497 - RNA, 21 nt, Leptospira interrogans serovar lai str. 56601
uuuguaauaaaaauuuaaaau

SEQ ID NO: 744498 - RNA, 18 nt, Leptospira interrogans serovar lai str. 56601
uuuguaaauauguuuuuu

SEQ ID NO: 744499 - RNA, 20 nt, Leptospira interrogans serovar lai str. 56601
uuuguaaaucuauucuuaaa

SEQ ID NO: 744500 - RNA, 13 nt, Leptospira interrogans serovar lai str. 56601
uuuguaacuuuua

SEQ ID NO: 744501 - RNA, 17 nt, Leptospira interrogans serovar lai str. 56601
uuugguuucaauuuauc

SEQ ID NO: 744502 - RNA, 14 nt, Leptospira interrogans serovar lai str. 56601
uuuguaaaaaaaua

SEQ ID NO: 744503 - RNA, 23 nt, Leptospira interrogans serovar lai str. 56601
uuuguaaaauagugguuuguagu

SEQ ID NO: 744504 - RNA, 15 nt, Leptospira interrogans serovar lai str. 56601
uuuguaaaauccaga

SEQ ID NO: 744505 - RNA, 20 nt, Leptospira interrogans serovar lai str. 56601
aagauaugaauuaauuugua

SEQ ID NO: 744506 - RNA, 13 nt, Leptospira interrogans serovar lai str. 56601
aagauauuaacaa

SEQ ID NO: 744507 - RNA, 14 nt, Leptospira interrogans serovar lai str. 56601
aagauauuuuccuu

SEQ ID NO: 744508 - RNA, 21 nt, Leptospira interrogans serovar lai str. 56601
aagauauuucaauauaaaaau

SEQ ID NO: 744509 - RNA, 19 nt, Leptospira interrogans serovar lai str. 56601
aagauagauuuauaauaaa

SEQ ID NO: 744510 - RNA, 12 nt, Leptospira interrogans serovar lai str. 56601
aagauaccaaau

SEQ ID NO: 744511 - RNA, 21 nt, Leptospira interrogans serovar lai str. 56601
aagauaccaaauaaauauuuc

SEQ ID NO: 744512 - RNA, 21 nt, Leptospira interrogans serovar lai str. 56601
aagaucauucuauuuggauuu

SEQ ID NO: 744513 - RNA, 14 nt, Leptospira interrogans serovar lai str. 56601
aagaucauuuaaaa

SEQ ID NO: 744514 - RNA, 15 nt, Leptospira interrogans serovar lai str. 56601
aagaucuauuccuaa

SEQ ID NO: 744515 - RNA, 22 nt, Leptospira interrogans serovar lai str. 56601
aagaucuuauaauuaacgugaa

SEQ ID NO: 744516 - RNA, 15 nt, Leptospira interrogans serovar lai str. 56601
aagauugauuuuaau

SEQ ID NO: 744517 - RNA, 15 nt, Leptospira interrogans serovar lai str. 56601
aagauugaaugaaau

SEQ ID NO: 744518 - RNA, 14 nt, Leptospira interrogans serovar lai str. 56601
aagauugaauuuuu

SEQ ID NO: 744519 - RNA, 18 nt, Leptospira interrogans serovar lai str. 56601
aagauucuucuccucuuc

SEQ ID NO: 744520 - RNA, 23 nt, Leptospira interrogans serovar lai str. 56601
aagauuaugguaaaauuucauuu

SEQ ID NO: 744521 - RNA, 14 nt, Leptospira interrogans serovar lai str. 56601
aagauuauuuuuga

SEQ ID NO: 744522 - RNA, 13 nt, Leptospira interrogans serovar lai str. 56601
aagauucaaagau

SEQ ID NO: 744523 - RNA, 17 nt, Leptospira interrogans serovar lai str. 56601
aagauucaaagauaaaa

SEQ ID NO: 744524 - RNA, 15 nt, Leptospira interrogans serovar lai str. 56601
aagauuagaaaaacu

SEQ ID NO: 744525 - RNA, 21 nt, Leptospira interrogans serovar lai str. 56601
aagauuauauuauauuucgua

SEQ ID NO: 744526 - RNA, 15 nt, Leptospira interrogans serovar lai str. 56601
aagauuuguugaaaa

SEQ ID NO: 744527 - RNA, 19 nt, Leptospira interrogans serovar lai str. 56601
aagauuuguugaaaaguga

SEQ ID NO: 744528 - RNA, 17 nt, Leptospira interrogans serovar lai str. 56601
aagauuuuacgaacaaa

SEQ ID NO: 744529 - RNA, 22 nt, Leptospira interrogans serovar lai str. 56601
aagauuuuacgaacaaauucua

SEQ ID NO: 744530 - RNA, 13 nt, Leptospira interrogans serovar lai str. 56601
aagauuuuaaaaa

SEQ ID NO: 744531 - RNA, 22 nt, Leptospira interrogans serovar lai str. 56601
aagauuuuaucgaauaagaaau

SEQ ID NO: 744532 - RNA, 17 nt, Leptospira interrogans serovar lai str. 56601
aagauuuucuuugauug

SEQ ID NO: 744533 - RNA, 22 nt, Leptospira interrogans serovar lai str. 56601
aagauuuucuuugauugaauua

SEQ ID NO: 744534 - RNA, 17 nt, Leptospira interrogans serovar lai str. 56601
aagauuuccuaauaacu

SEQ ID NO: 744535 - RNA, 18 nt, Leptospira interrogans serovar lai str. 56601
aagauuucguucggaaaa

SEQ ID NO: 744536 - RNA, 21 nt, Leptospira interrogans serovar lai str. 56601
aagauuucguucggaaaaagu

SEQ ID NO: 744537 - RNA, 16 nt, Leptospira interrogans serovar lai str. 56601
aagauuucuauauuca

SEQ ID NO: 744538 - RNA, 15 nt, Leptospira interrogans serovar lai str. 56601
aagauugucuuuauu

SEQ ID NO: 744539 - RNA, 22 nt, Leptospira interrogans serovar lai str. 56601
aagauuggagggcaaucgauuu

SEQ ID NO: 744540 - RNA, 16 nt, Leptospira interrogans serovar lai str. 56601
aagauuuaauuuagaa

SEQ ID NO: 744541 - RNA, 17 nt, Leptospira interrogans serovar lai str. 56601
aagauuuaauuuagaaa

SEQ ID NO: 744542 - RNA, 19 nt, Leptospira interrogans serovar lai str. 56601
aagauuuaauuuagaaauu

SEQ ID NO: 744543 - RNA, 22 nt, Leptospira interrogans serovar lai str. 56601
aagaugggacuuuuuucguugc

SEQ ID NO: 744544 - RNA, 16 nt, Leptospira interrogans serovar lai str. 56601
aagaugcuuucucuuu

SEQ ID NO: 744545 - RNA, 19 nt, Leptospira interrogans serovar lai str. 56601
aagcauaacgucuugauua

SEQ ID NO: 744546 - RNA, 14 nt, Leptospira interrogans serovar lai str. 56601
aagcauuaaaaaag

SEQ ID NO: 744547 - RNA, 19 nt, Leptospira interrogans serovar lai str. 56601
aagcagcuaaaaagaaagu

SEQ ID NO: 744548 - RNA, 21 nt, Leptospira interrogans serovar lai str. 56601
aagcagcuaaaaagaaaguug

SEQ ID NO: 744549 - RNA, 13 nt, Leptospira interrogans serovar lai str. 56601
aagcagcaaagaa

SEQ ID NO: 744550 - RNA, 16 nt, Leptospira interrogans serovar lai str. 56601
aagcagcaaagaaggc

SEQ ID NO: 744551 - RNA, 13 nt, Leptospira interrogans serovar lai str. 56601
aagcacuguuuua

SEQ ID NO: 744552 - RNA, 12 nt, Leptospira interrogans serovar lai str. 56601
aagcaccuucua

SEQ ID NO: 744553 - RNA, 22 nt, Leptospira interrogans serovar lai str. 56601
aagcacggacauuguuucucga

SEQ ID NO: 744554 - RNA, 20 nt, Leptospira interrogans serovar lai str. 56601
aagcaauucuaagaccuaaa

SEQ ID NO: 744555 - RNA, 19 nt, Leptospira interrogans serovar lai str. 56601
aagcacauccgcauucuca

SEQ ID NO: 744556 - RNA, 16 nt, Leptospira interrogans serovar lai str. 56601
aagauuuuucuuuaaa

SEQ ID NO: 744557 - RNA, 20 nt, Leptospira interrogans serovar lai str. 56601
aagcaaaguuucuuauauaa

SEQ ID NO: 744558 - RNA, 23 nt, Leptospira interrogans serovar lai str. 56601
aagauaaaacguacuuacugaaa

SEQ ID NO: 744559 - RNA, 21 nt, Leptospira interrogans serovar lai str. 56601
aagauaaaacucaaaggaaaa

SEQ ID NO: 744560 - RNA, 15 nt, Leptospira interrogans serovar lai str. 56601
aagauaaauuuagua

SEQ ID NO: 744561 - RNA, 20 nt, Leptospira interrogans serovar lai str. 56601
aagagucauuuuuaaauacu

SEQ ID NO: 744562 - RNA, 21 nt, Leptospira interrogans serovar lai str. 56601
aagagugguuuucaaauauuu

SEQ ID NO: 744563 - RNA, 21 nt, Leptospira interrogans serovar lai str. 56601
aagagugcagauuaaaaaaua

SEQ ID NO: 744564 - RNA, 18 nt, Leptospira interrogans serovar lai str. 56601
aagagucgcaaguugauu

SEQ ID NO: 744565 - RNA, 17 nt, Leptospira interrogans serovar lai str. 56601
aagagucuauauguaaa

SEQ ID NO: 744566 - RNA, 19 nt, Leptospira interrogans serovar lai str. 56601
aagagguacagaaacaaaa

SEQ ID NO: 744567 - RNA, 21 nt, Leptospira interrogans serovar lai str. 56601
aagagccuaauccaauaaaau

SEQ ID NO: 744568 - RNA, 15 nt, Leptospira interrogans serovar lai str. 56601
aagagcgucuuugaa

SEQ ID NO: 744569 - RNA, 17 nt, Leptospira interrogans serovar lai str. 56601
aagacgucuacagauaa

SEQ ID NO: 744570 - RNA, 16 nt, Leptospira interrogans serovar lai str. 56601
aagacgcuuaaaaaug

SEQ ID NO: 744571 - RNA, 19 nt, Leptospira interrogans serovar lai str. 56601
aagacgauuccuaaaaauu

SEQ ID NO: 744572 - RNA, 16 nt, Leptospira interrogans serovar lai str. 56601
aagacuauauucuucg

SEQ ID NO: 744573 - RNA, 16 nt, Leptospira interrogans serovar lai str. 56601
aagacuuaaaagaaga

SEQ ID NO: 744574 - RNA, 20 nt, Leptospira interrogans serovar lai str. 56601
aagacuuaaaagaagauuuu

SEQ ID NO: 744575 - RNA, 23 nt, Leptospira interrogans serovar lai str. 56601
aagacuuaaaagaagauuuuucu

SEQ ID NO: 744576 - RNA, 22 nt, Leptospira interrogans serovar lai str. 56601
aagacuuccacgaauuacauag

SEQ ID NO: 744577 - RNA, 21 nt, Leptospira interrogans serovar lai str. 56601
aagagaaccucuauaaaaucu

SEQ ID NO: 744578 - RNA, 13 nt, Leptospira interrogans serovar lai str. 56601
aagagaacucauu

SEQ ID NO: 744579 - RNA, 14 nt, Leptospira interrogans serovar lai str. 56601
aagacuucuauacu

SEQ ID NO: 744580 - RNA, 17 nt, Leptospira interrogans serovar lai str. 56601
aagacuuuauagucaaa

SEQ ID NO: 744581 - RNA, 18 nt, Leptospira interrogans serovar lai str. 56601
aagacuuuauagucaaau

SEQ ID NO: 744582 - RNA, 21 nt, Leptospira interrogans serovar lai str. 56601
aagacuuuuccuaaaauuuug

SEQ ID NO: 744583 - RNA, 15 nt, Leptospira interrogans serovar lai str. 56601
aagagacauugaaga

SEQ ID NO: 744584 - RNA, 23 nt, Leptospira interrogans serovar lai str. 56601
aagagagauauacacuauaacaa

SEQ ID NO: 744585 - RNA, 20 nt, Leptospira interrogans serovar lai str. 56601
aagagagggucuuucgagau

SEQ ID NO: 744586 - RNA, 19 nt, Leptospira interrogans serovar lai str. 56601
aagagaugugaguuuuaaa

SEQ ID NO: 744587 - RNA, 16 nt, Leptospira interrogans serovar lai str. 56601
aagaccuaaacccuga

SEQ ID NO: 744588 - RNA, 22 nt, Leptospira interrogans serovar lai str. 56601
aagaccuuguguuucagacuga

SEQ ID NO: 744589 - RNA, 14 nt, Leptospira interrogans serovar lai str. 56601
aagacgaaaagaag

SEQ ID NO: 744590 - RNA, 22 nt, Leptospira interrogans serovar lai str. 56601
aagacccuaaaaaauuuuuaga

SEQ ID NO: 744591 - RNA, 19 nt, Leptospira interrogans serovar lai str. 56601
aagacauuggcaaauguua

SEQ ID NO: 744592 - RNA, 13 nt, Leptospira interrogans serovar lai str. 56601
aagaauuuucuaa

SEQ ID NO: 744593 - RNA, 21 nt, Leptospira interrogans serovar lai str. 56601
aagaauucuaaacacagaccu

SEQ ID NO: 744594 - RNA, 16 nt, Leptospira interrogans serovar lai str. 56601
aagaauuauuuacuuu

SEQ ID NO: 744595 - RNA, 18 nt, Leptospira interrogans serovar lai str. 56601
aagaauuuaucauuucuu

SEQ ID NO: 744596 - RNA, 20 nt, Leptospira interrogans serovar lai str. 56601
aagaauuuauuucaaaauuu

SEQ ID NO: 744597 - RNA, 14 nt, Leptospira interrogans serovar lai str. 56601
aagaauuucguuuc

SEQ ID NO: 744598 - RNA, 12 nt, Leptospira interrogans serovar lai str. 56601
aagaauuucuaa

SEQ ID NO: 744599 - RNA, 14 nt, Leptospira interrogans serovar lai str. 56601
aagaauuucuaaaa

SEQ ID NO: 744600 - RNA, 20 nt, Leptospira interrogans serovar lai str. 56601
aagaauuucuaaaaguaaaa

SEQ ID NO: 744601 - RNA, 12 nt, Leptospira interrogans serovar lai str. 56601
aagaauuuuaaa

SEQ ID NO: 744602 - RNA, 13 nt, Leptospira interrogans serovar lai str. 56601
aagaauuuuaaaa

SEQ ID NO: 744603 - RNA, 16 nt, Leptospira interrogans serovar lai str. 56601
aagaauuuuaaaaaau

SEQ ID NO: 744604 - RNA, 19 nt, Leptospira interrogans serovar lai str. 56601
aagaauuuuagaauauaau

SEQ ID NO: 744605 - RNA, 20 nt, Leptospira interrogans serovar lai str. 56601
aaauucugucucuuuauaua

SEQ ID NO: 744606 - RNA, 13 nt, Leptospira interrogans serovar lai str. 56601
aaauucuuuccuu

SEQ ID NO: 744607 - RNA, 21 nt, Leptospira interrogans serovar lai str. 56601
aaauucuuuccuuuccuugaa

SEQ ID NO: 744608 - RNA, 21 nt, Leptospira interrogans serovar lai str. 56601
aaauucuuucguuuuuugcag

SEQ ID NO: 744609 - RNA, 14 nt, Leptospira interrogans serovar lai str. 56601
aaauucuuucucgu

SEQ ID NO: 744610 - RNA, 20 nt, Leptospira interrogans serovar lai str. 56601
aaauugaaacaauuuugcca

SEQ ID NO: 744611 - RNA, 23 nt, Leptospira interrogans serovar lai str. 56601
aaauugaaacuauacuuucaaaa

SEQ ID NO: 744612 - RNA, 20 nt, Leptospira interrogans serovar lai str. 56601
aaauugaauucuuccuucuu

SEQ ID NO: 744613 - RNA, 13 nt, Leptospira interrogans serovar lai str. 56601
aaauugaauuuaa

SEQ ID NO: 744614 - RNA, 15 nt, Leptospira interrogans serovar lai str. 56601
aaauugaauuuaaaa

SEQ ID NO: 744615 - RNA, 23 nt, Leptospira interrogans serovar lai str. 56601
aaauugaauuugcaguaaaaggc

SEQ ID NO: 744616 - RNA, 15 nt, Leptospira interrogans serovar lai str. 56601
aaauugaauaucaua

SEQ ID NO: 744617 - RNA, 19 nt, Leptospira interrogans serovar lai str. 56601
aaauucuuuuuauuuuuac

SEQ ID NO: 744618 - RNA, 15 nt, Leptospira interrogans serovar lai str. 56601
aaauugaacguaaua

SEQ ID NO: 744619 - RNA, 23 nt, Leptospira interrogans serovar lai str. 56601
aaauugaacguaauacaaaauau

SEQ ID NO: 744620 - RNA, 13 nt, Leptospira interrogans serovar lai str. 56601
aagaauaauauuu

SEQ ID NO: 744621 - RNA, 15 nt, Leptospira interrogans serovar lai str. 56601
aagaauaauuuaaac

SEQ ID NO: 744622 - RNA, 13 nt, Leptospira interrogans serovar lai str. 56601
aagaauagauuaa

SEQ ID NO: 744623 - RNA, 17 nt, Leptospira interrogans serovar lai str. 56601
aagaauaccaaaaaagu

SEQ ID NO: 744624 - RNA, 18 nt, Leptospira interrogans serovar lai str. 56601
aagaauaccaaaaaagua

SEQ ID NO: 744625 - RNA, 19 nt, Leptospira interrogans serovar lai str. 56601
aagaaguuuguagauaaag

SEQ ID NO: 744626 - RNA, 20 nt, Leptospira interrogans serovar lai str. 56601
aaauugagauagguuuugua

SEQ ID NO: 744627 - RNA, 17 nt, Leptospira interrogans serovar lai str. 56601
aaauugagaauuuguuu

SEQ ID NO: 744628 - RNA, 22 nt, Leptospira interrogans serovar lai str. 56601
aaauugagaauuuguuuuaaaa

SEQ ID NO: 744629 - RNA, 20 nt, Leptospira interrogans serovar lai str. 56601
aaauugaguaccauaaauuu

SEQ ID NO: 744630 - RNA, 15 nt, Leptospira interrogans serovar lai str. 56601
aaauugaguuuucca

SEQ ID NO: 744631 - RNA, 22 nt, Leptospira interrogans serovar lai str. 56601
aagaaucgauaggaguauaagu

SEQ ID NO: 744632 - RNA, 14 nt, Leptospira interrogans serovar lai str. 56601
aagaaucgaaaaaa

SEQ ID NO: 744633 - RNA, 22 nt, Leptospira interrogans serovar lai str. 56601
aagaaucgucgcucaaucaaau

SEQ ID NO: 744634 - RNA, 14 nt, Leptospira interrogans serovar lai str. 56601
aagaauccgaaaaa

SEQ ID NO: 744635 - RNA, 16 nt, Leptospira interrogans serovar lai str. 56601
aagaauccgaaaaacc

SEQ ID NO: 744636 - RNA, 17 nt, Leptospira interrogans serovar lai str. 56601
aagaauccgaaaaaccu

SEQ ID NO: 744637 - RNA, 22 nt, Leptospira interrogans serovar lai str. 56601
aagaaucauacaaucaaauuuu

SEQ ID NO: 744638 - RNA, 12 nt, Leptospira interrogans serovar lai str. 56601
aagaaucaaauc

SEQ ID NO: 744639 - RNA, 23 nt, Leptospira interrogans serovar lai str. 56601
aagaauaugucguuguauauaaa

SEQ ID NO: 744640 - RNA, 14 nt, Leptospira interrogans serovar lai str. 56601
aagaauauuauaaa

SEQ ID NO: 744641 - RNA, 18 nt, Leptospira interrogans serovar lai str. 56601
aagaauauuauaaauauu

SEQ ID NO: 744642 - RNA, 17 nt, Leptospira interrogans serovar lai str. 56601
aagaauauuauuauauu

SEQ ID NO: 744643 - RNA, 15 nt, Leptospira interrogans serovar lai str. 56601
aagaauauuucuaaa

SEQ ID NO: 744644 - RNA, 14 nt, Leptospira interrogans serovar lai str. 56601
aagaauuaauuuuu

SEQ ID NO: 744645 - RNA, 22 nt, Leptospira interrogans serovar lai str. 56601
aagaauguuuuccagaaaccau

SEQ ID NO: 744646 - RNA, 22 nt, Leptospira interrogans serovar lai str. 56601
aagaaugauaaaucuuggauca

SEQ ID NO: 744647 - RNA, 20 nt, Leptospira interrogans serovar lai str. 56601
aagaaugaucacguaaaacu

SEQ ID NO: 744648 - RNA, 15 nt, Leptospira interrogans serovar lai str. 56601
aagaaugaaaaaacu

SEQ ID NO: 744649 - RNA, 20 nt, Leptospira interrogans serovar lai str. 56601
aagaaucugccccaaaauuu

SEQ ID NO: 744650 - RNA, 16 nt, Leptospira interrogans serovar lai str. 56601
aagaaucuuuuuaaaa

SEQ ID NO: 744651 - RNA, 18 nt, Leptospira interrogans serovar lai str. 56601
aagaaucuuuuuaaaagu

SEQ ID NO: 744652 - RNA, 23 nt, Leptospira interrogans serovar lai str. 56601
aaguaugaguuccuacaauuuua

SEQ ID NO: 744653 - RNA, 16 nt, Leptospira interrogans serovar lai str. 56601
aaguauguuuuucuaa

SEQ ID NO: 744654 - RNA, 16 nt, Leptospira interrogans serovar lai str. 56601
aaguauguuuuucuga

SEQ ID NO: 744655 - RNA, 23 nt, Leptospira interrogans serovar lai str. 56601
aagucacauuguguuuuuuaaca

SEQ ID NO: 744656 - RNA, 22 nt, Leptospira interrogans serovar lai str. 56601
aagucaacgacucguaauuaaa

SEQ ID NO: 744657 - RNA, 16 nt, Leptospira interrogans serovar lai str. 56601
aaguaucuaaaaguuu

SEQ ID NO: 744658 - RNA, 18 nt, Leptospira interrogans serovar lai str. 56601
aagucuagaaauguagga

SEQ ID NO: 744659 - RNA, 19 nt, Leptospira interrogans serovar lai str. 56601
aagucguuguauuuuaaac

SEQ ID NO: 744660 - RNA, 20 nt, Leptospira interrogans serovar lai str. 56601
aagucguuguauuuuaaaca

SEQ ID NO: 744661 - RNA, 14 nt, Leptospira interrogans serovar lai str. 56601
aagucuauuucuaa

SEQ ID NO: 744662 - RNA, 18 nt, Leptospira interrogans serovar lai str. 56601
aagucucaaaaccuguaa

SEQ ID NO: 744663 - RNA, 13 nt, Leptospira interrogans serovar lai str. 56601
aaguccacccaaa

SEQ ID NO: 744664 - RNA, 13 nt, Leptospira interrogans serovar lai str. 56601
aaguccaaugaaa

SEQ ID NO: 744665 - RNA, 20 nt, Leptospira interrogans serovar lai str. 56601
aaguccaauuuuaaaaccaa

SEQ ID NO: 744666 - RNA, 14 nt, Leptospira interrogans serovar lai str. 56601
aagugcaauaucuu

SEQ ID NO: 744667 - RNA, 22 nt, Leptospira interrogans serovar lai str. 56601
aagugauucauucuaagauuuu

SEQ ID NO: 744668 - RNA, 22 nt, Leptospira interrogans serovar lai str. 56601
aagugaagcgcuugaguugcuu

SEQ ID NO: 744669 - RNA, 16 nt, Leptospira interrogans serovar lai str. 56601
aagucuuucuacacca

SEQ ID NO: 744670 - RNA, 15 nt, Leptospira interrogans serovar lai str. 56601
aaguuacuucccuuc

SEQ ID NO: 744671 - RNA, 17 nt, Leptospira interrogans serovar lai str. 56601
aaguuacuucccuucag

SEQ ID NO: 744672 - RNA, 18 nt, Leptospira interrogans serovar lai str. 56601
aaguuacauuaugaauuu

SEQ ID NO: 744673 - RNA, 13 nt, Leptospira interrogans serovar lai str. 56601
aaguuaaauauaa

SEQ ID NO: 744674 - RNA, 13 nt, Leptospira interrogans serovar lai str. 56601
aaguuaagugaaa

SEQ ID NO: 744675 - RNA, 14 nt, Leptospira interrogans serovar lai str. 56601
aaguuaauacaaaa

SEQ ID NO: 744676 - RNA, 14 nt, Leptospira interrogans serovar lai str. 56601
aaguuaauagaguu

SEQ ID NO: 744677 - RNA, 18 nt, Leptospira interrogans serovar lai str. 56601
aaguguuccgacaagaau

SEQ ID NO: 744678 - RNA, 22 nt, Leptospira interrogans serovar lai str. 56601
aaguguuguaucucaagauuaa

SEQ ID NO: 744679 - RNA, 19 nt, Leptospira interrogans serovar lai str. 56601
aaguguuuauaauuuuuac

SEQ ID NO: 744680 - RNA, 14 nt, Leptospira interrogans serovar lai str. 56601
aaguguuuuuguaa

SEQ ID NO: 744681 - RNA, 12 nt, Leptospira interrogans serovar lai str. 56601
aauaaagaaaag

SEQ ID NO: 744682 - RNA, 13 nt, Leptospira interrogans serovar lai str. 56601
aauaaagaaaagg

SEQ ID NO: 744683 - RNA, 15 nt, Leptospira interrogans serovar lai str. 56601
aauaaagaaaaggaa

SEQ ID NO: 744684 - RNA, 15 nt, Leptospira interrogans serovar lai str. 56601
aauaaagaaacuguu

SEQ ID NO: 744685 - RNA, 12 nt, Leptospira interrogans serovar lai str. 56601
aauaaacuuuca

SEQ ID NO: 744686 - RNA, 17 nt, Leptospira interrogans serovar lai str. 56601
aauaaacuuucaaagaa

SEQ ID NO: 744687 - RNA, 19 nt, Leptospira interrogans serovar lai str. 56601
aauaaacuuucaaagaaua

SEQ ID NO: 744688 - RNA, 18 nt, Leptospira interrogans serovar lai str. 56601
aauaaaccgcauaaaaga

SEQ ID NO: 744689 - RNA, 14 nt, Leptospira interrogans serovar lai str. 56601
aauaaacaauaaaa

SEQ ID NO: 744690 - RNA, 16 nt, Leptospira interrogans serovar lai str. 56601
aauaaacaauaaaaua

SEQ ID NO: 744691 - RNA, 20 nt, Leptospira interrogans serovar lai str. 56601
aauaaaauuuucauuuuaua

SEQ ID NO: 744692 - RNA, 16 nt, Leptospira interrogans serovar lai str. 56601
aauaaaauuuuccgga

SEQ ID NO: 744693 - RNA, 17 nt, Leptospira interrogans serovar lai str. 56601
aauaaaauuuuuaaaaa

SEQ ID NO: 744694 - RNA, 19 nt, Leptospira interrogans serovar lai str. 56601
aauaaaauuuuuaaaaaau

SEQ ID NO: 744695 - RNA, 20 nt, Leptospira interrogans serovar lai str. 56601
aauaaaauuuuuaaaaaauu

SEQ ID NO: 744696 - RNA, 14 nt, Leptospira interrogans serovar lai str. 56601
aauaaaauuugauu

SEQ ID NO: 744697 - RNA, 23 nt, Leptospira interrogans serovar lai str. 56601
aauaaaauaccauaaauuuugaa

SEQ ID NO: 744698 - RNA, 11 nt, Leptospira interrogans serovar lai str. 56601
aauaaaaggag

SEQ ID NO: 744699 - RNA, 13 nt, Leptospira interrogans serovar lai str. 56601
aauaaaaacaaua

SEQ ID NO: 744700 - RNA, 12 nt, Leptospira interrogans serovar lai str. 56601
aauaaaaacacu

SEQ ID NO: 744701 - RNA, 15 nt, Leptospira interrogans serovar lai str. 56601
aauaaaaaauuucuu

SEQ ID NO: 744702 - RNA, 16 nt, Leptospira interrogans serovar lai str. 56601
aauaaaaacuacaucg

SEQ ID NO: 744703 - RNA, 21 nt, Leptospira interrogans serovar lai str. 56601
aauaaaaggaguaauucuaaa

SEQ ID NO: 744704 - RNA, 17 nt, Leptospira interrogans serovar lai str. 56601
aauaaaaauuagagaag

SEQ ID NO: 744705 - RNA, 14 nt, Leptospira interrogans serovar lai str. 56601
aauaaaaauuuaaa

SEQ ID NO: 744706 - RNA, 12 nt, Leptospira interrogans serovar lai str. 56601
aauaaaaauuug

SEQ ID NO: 744707 - RNA, 18 nt, Leptospira interrogans serovar lai str. 56601
aaguucuggguaaaaaaa

SEQ ID NO: 744708 - RNA, 21 nt, Leptospira interrogans serovar lai str. 56601
aaguucuggguaaaaaaaaau

SEQ ID NO: 744709 - RNA, 21 nt, Leptospira interrogans serovar lai str. 56601
aaguucucuucauccagauuc

SEQ ID NO: 744710 - RNA, 18 nt, Leptospira interrogans serovar lai str. 56601
aaguuagaaucuaaacuu

SEQ ID NO: 744711 - RNA, 19 nt, Leptospira interrogans serovar lai str. 56601
aaguuagaaucuaaacuuu

SEQ ID NO: 744712 - RNA, 22 nt, Leptospira interrogans serovar lai str. 56601
aaguucuauaaacucaaagaau

SEQ ID NO: 744713 - RNA, 17 nt, Leptospira interrogans serovar lai str. 56601
aaguucgguguaaaaaa

SEQ ID NO: 744714 - RNA, 16 nt, Leptospira interrogans serovar lai str. 56601
aaguucgauuaaaaua

SEQ ID NO: 744715 - RNA, 16 nt, Leptospira interrogans serovar lai str. 56601
aaguugaauaggauuu

SEQ ID NO: 744716 - RNA, 18 nt, Leptospira interrogans serovar lai str. 56601
aaguuuaauugugaaaau

SEQ ID NO: 744717 - RNA, 12 nt, Leptospira interrogans serovar lai str. 56601
aaguuuaaaaac

SEQ ID NO: 744718 - RNA, 23 nt, Leptospira interrogans serovar lai str. 56601
aaguuguauccccauaaacaaac

SEQ ID NO: 744719 - RNA, 23 nt, Leptospira interrogans serovar lai str. 56601
aaguuuacaucaaaaacaaauua

SEQ ID NO: 744720 - RNA, 14 nt, Leptospira interrogans serovar lai str. 56601
aaguuuacaucaaa

SEQ ID NO: 744721 - RNA, 12 nt, Leptospira interrogans serovar lai str. 56601
aaguuuagauuu

SEQ ID NO: 744722 - RNA, 22 nt, Leptospira interrogans serovar lai str. 56601
aaguuuaggcuugauuggauug

SEQ ID NO: 744723 - RNA, 13 nt, Leptospira interrogans serovar lai str. 56601
aaguuuaugaauu

SEQ ID NO: 744724 - RNA, 16 nt, Leptospira interrogans serovar lai str. 56601
aaguuucuuauauaaa

SEQ ID NO: 744725 - RNA, 19 nt, Leptospira interrogans serovar lai str. 56601
aaguuucuuauauaaaagu

SEQ ID NO: 744726 - RNA, 15 nt, Leptospira interrogans serovar lai str. 56601
aaguuuauucaauuu

SEQ ID NO: 744727 - RNA, 13 nt, Leptospira interrogans serovar lai str. 56601
aaguuuuuuaaaa

SEQ ID NO: 744728 - RNA, 15 nt, Leptospira interrogans serovar lai str. 56601
aaguuuuuuaaaaaa

SEQ ID NO: 744729 - RNA, 11 nt, Leptospira interrogans serovar lai str. 56601
aaguuuuccau

SEQ ID NO: 744730 - RNA, 13 nt, Leptospira interrogans serovar lai str. 56601
aaguuuuuaaaua

SEQ ID NO: 744731 - RNA, 11 nt, Leptospira interrogans serovar lai str. 56601
aaguuuucuuu

SEQ ID NO: 744732 - RNA, 21 nt, Leptospira interrogans serovar lai str. 56601
aaguuuucuuuaucagaaaaa

SEQ ID NO: 744733 - RNA, 22 nt, Leptospira interrogans serovar lai str. 56601
aaguuuuacaaagaguuuaaaa

SEQ ID NO: 744734 - RNA, 18 nt, Leptospira interrogans serovar lai str. 56601
aaguuuuacagaggauuu

SEQ ID NO: 744735 - RNA, 22 nt, Leptospira interrogans serovar lai str. 56601
aaguuugggcgaauaaaaaacu

SEQ ID NO: 744736 - RNA, 13 nt, Leptospira interrogans serovar lai str. 56601
aaguuuucaaaaa

SEQ ID NO: 744737 - RNA, 18 nt, Leptospira interrogans serovar lai str. 56601
aaguuuucuaguaaaaau

SEQ ID NO: 744738 - RNA, 13 nt, Leptospira interrogans serovar lai str. 56601
aaggcaaaagacu

SEQ ID NO: 744739 - RNA, 23 nt, Leptospira interrogans serovar lai str. 56601
aaggcaaacuuuuuuagcaaaua

SEQ ID NO: 744740 - RNA, 17 nt, Leptospira interrogans serovar lai str. 56601
aaggcagcuaagaaaaa

SEQ ID NO: 744741 - RNA, 18 nt, Leptospira interrogans serovar lai str. 56601
aagguuagauuauuucaa

SEQ ID NO: 744742 - RNA, 19 nt, Leptospira interrogans serovar lai str. 56601
aagguuccaccggaagggu

SEQ ID NO: 744743 - RNA, 17 nt, Leptospira interrogans serovar lai str. 56601
aagguucggacaauuuu

SEQ ID NO: 744744 - RNA, 10 nt, Leptospira interrogans serovar lai str. 56601
aagguugagc

SEQ ID NO: 744745 - RNA, 20 nt, Leptospira interrogans serovar lai str. 56601
aagguugagcaguaaaaucu

SEQ ID NO: 744746 - RNA, 20 nt, Leptospira interrogans serovar lai str. 56601
aagguugaguaguaaaaucu

SEQ ID NO: 744747 - RNA, 14 nt, Leptospira interrogans serovar lai str. 56601
aagguauaaaauaa

SEQ ID NO: 744748 - RNA, 15 nt, Leptospira interrogans serovar lai str. 56601
aagguauaaaauaaa

SEQ ID NO: 744749 - RNA, 21 nt, Leptospira interrogans serovar lai str. 56601
aagguauaaaauaaaaauuuc

SEQ ID NO: 744750 - RNA, 16 nt, Leptospira interrogans serovar lai str. 56601
aagguagauaaagguu

SEQ ID NO: 744751 - RNA, 19 nt, Leptospira interrogans serovar lai str. 56601
aaggcugucuucagcaguc

SEQ ID NO: 744752 - RNA, 23 nt, Leptospira interrogans serovar lai str. 56601
aaggcugucuucagcagucugug

SEQ ID NO: 744753 - RNA, 15 nt, Leptospira interrogans serovar lai str. 56601
aaggcucgaauuuuu

SEQ ID NO: 744754 - RNA, 22 nt, Leptospira interrogans serovar lai str. 56601
aaggaauacaauugauuuaaaa

SEQ ID NO: 744755 - RNA, 13 nt, Leptospira interrogans serovar lai str. 56601
aaggaauccauga

SEQ ID NO: 744756 - RNA, 14 nt, Leptospira interrogans serovar lai str. 56601
aaggaauccaugau

SEQ ID NO: 744757 - RNA, 21 nt, Leptospira interrogans serovar lai str. 56601
aaggaagccuuccaggaggga

SEQ ID NO: 744758 - RNA, 13 nt, Leptospira interrogans serovar lai str. 56601
aaggaagugaaau

SEQ ID NO: 744759 - RNA, 22 nt, Leptospira interrogans serovar lai str. 56601
aaggaaggaguaucaauagaaa

SEQ ID NO: 744760 - RNA, 21 nt, Leptospira interrogans serovar lai str. 56601
aaggaagaucgauagaaguag

SEQ ID NO: 744761 - RNA, 21 nt, Leptospira interrogans serovar lai str. 56601
aagcuuuuaguuguacaaaaa

SEQ ID NO: 744762 - RNA, 14 nt, Leptospira interrogans serovar lai str. 56601
aaggaguaauucua

SEQ ID NO: 744763 - RNA, 21 nt, Leptospira interrogans serovar lai str. 56601
aaggaauuggaauaucggaau

SEQ ID NO: 744764 - RNA, 19 nt, Leptospira interrogans serovar lai str. 56601
aaggauaacccucaucagu

SEQ ID NO: 744765 - RNA, 13 nt, Leptospira interrogans serovar lai str. 56601
aagcuuuagaaaa

SEQ ID NO: 744766 - RNA, 15 nt, Leptospira interrogans serovar lai str. 56601
aagcuuuaaauucag

SEQ ID NO: 744767 - RNA, 18 nt, Leptospira interrogans serovar lai str. 56601
aagcucuaauauuuuaaa

SEQ ID NO: 744768 - RNA, 23 nt, Leptospira interrogans serovar lai str. 56601
aagcucuaauauuuuaaagaaac

SEQ ID NO: 744769 - RNA, 16 nt, Leptospira interrogans serovar lai str. 56601
aagcuccuccaaccag

SEQ ID NO: 744770 - RNA, 23 nt, Leptospira interrogans serovar lai str. 56601
aagcgugacuaaaauugacaaag

SEQ ID NO: 744771 - RNA, 21 nt, Leptospira interrogans serovar lai str. 56601
aagccaauuccaaaaaucuca

SEQ ID NO: 744772 - RNA, 13 nt, Leptospira interrogans serovar lai str. 56601
aauuaaaaagaua

SEQ ID NO: 744773 - RNA, 14 nt, Leptospira interrogans serovar lai str. 56601
aauuaaaaagauag

SEQ ID NO: 744774 - RNA, 16 nt, Leptospira interrogans serovar lai str. 56601
aauguuuucuacaaau

SEQ ID NO: 744775 - RNA, 15 nt, Leptospira interrogans serovar lai str. 56601
aauuaaaaaaucaua

SEQ ID NO: 744776 - RNA, 18 nt, Leptospira interrogans serovar lai str. 56601
aauuaaaaaaucugcucu

SEQ ID NO: 744777 - RNA, 13 nt, Leptospira interrogans serovar lai str. 56601
aauuaaaaaacuu

SEQ ID NO: 744778 - RNA, 14 nt, Leptospira interrogans serovar lai str. 56601
aauuaaaaaagaga

SEQ ID NO: 744779 - RNA, 18 nt, Leptospira interrogans serovar lai str. 56601
aauuaaaaaagagaaaga

SEQ ID NO: 744780 - RNA, 21 nt, Leptospira interrogans serovar lai str. 56601
aauuaaaaaagagaaagaaaa

SEQ ID NO: 744781 - RNA, 10 nt, Leptospira interrogans serovar lai str. 56601
aauuaaaaaa

SEQ ID NO: 744782 - RNA, 13 nt, Leptospira interrogans serovar lai str. 56601
aauguugaaugaa

SEQ ID NO: 744783 - RNA, 16 nt, Leptospira interrogans serovar lai str. 56601
aauguuguuaaauuuu

SEQ ID NO: 744784 - RNA, 17 nt, Leptospira interrogans serovar lai str. 56601
aauguuugaauuuuuaa

SEQ ID NO: 744785 - RNA, 19 nt, Leptospira interrogans serovar lai str. 56601
aauguuugaauuuuuaaga

SEQ ID NO: 744786 - RNA, 21 nt, Leptospira interrogans serovar lai str. 56601
aauguuugagguuuuaaaagu

SEQ ID NO: 744787 - RNA, 22 nt, Leptospira interrogans serovar lai str. 56601
aauguuucccaguucuuaaaua

SEQ ID NO: 744788 - RNA, 15 nt, Leptospira interrogans serovar lai str. 56601
aauguuaaaaaacua

SEQ ID NO: 744789 - RNA, 19 nt, Leptospira interrogans serovar lai str. 56601
aauguuaaaaaacuauaaa

SEQ ID NO: 744790 - RNA, 15 nt, Leptospira interrogans serovar lai str. 56601
aaugugccuuuuuga

SEQ ID NO: 744791 - RNA, 14 nt, Leptospira interrogans serovar lai str. 56601
aaugugggaacuac

SEQ ID NO: 744792 - RNA, 20 nt, Leptospira interrogans serovar lai str. 56601
aaugugggaacuaccaccaa

SEQ ID NO: 744793 - RNA, 21 nt, Leptospira interrogans serovar lai str. 56601
aaugugggaacuaccaccaaa

SEQ ID NO: 744794 - RNA, 16 nt, Leptospira interrogans serovar lai str. 56601
aaugugggaacuacua

SEQ ID NO: 744795 - RNA, 20 nt, Leptospira interrogans serovar lai str. 56601
aauguuaauuuagaauaaaa

SEQ ID NO: 744796 - RNA, 14 nt, Leptospira interrogans serovar lai str. 56601
aauguucaaauuca

SEQ ID NO: 744797 - RNA, 14 nt, Leptospira interrogans serovar lai str. 56601
aauguuccaaagcc

SEQ ID NO: 744798 - RNA, 22 nt, Leptospira interrogans serovar lai str. 56601
aauguuccaaagccaaggauaa

SEQ ID NO: 744799 - RNA, 15 nt, Leptospira interrogans serovar lai str. 56601
aauguuauugauaaa

SEQ ID NO: 744800 - RNA, 14 nt, Leptospira interrogans serovar lai str. 56601
aauguuauuuugua

SEQ ID NO: 744801 - RNA, 16 nt, Leptospira interrogans serovar lai str. 56601
aauguuauuuuguaua

SEQ ID NO: 744802 - RNA, 20 nt, Leptospira interrogans serovar lai str. 56601
aauguuauuuuguauaaagu

SEQ ID NO: 744803 - RNA, 14 nt, Leptospira interrogans serovar lai str. 56601
aauguuauuuuugc

SEQ ID NO: 744804 - RNA, 19 nt, Leptospira interrogans serovar lai str. 56601
aauuaaagcgucucauuuc

SEQ ID NO: 744805 - RNA, 20 nt, Leptospira interrogans serovar lai str. 56601
aauuaaacuucaaaaaauau

SEQ ID NO: 744806 - RNA, 13 nt, Leptospira interrogans serovar lai str. 56601
aauuaaagaagag

SEQ ID NO: 744807 - RNA, 17 nt, Leptospira interrogans serovar lai str. 56601
aauuaaaauucuagaaa

SEQ ID NO: 744808 - RNA, 17 nt, Leptospira interrogans serovar lai str. 56601
aauuaaacaaagaauaa

SEQ ID NO: 744809 - RNA, 22 nt, Leptospira interrogans serovar lai str. 56601
aauuaaacaaagaauaaauccg

SEQ ID NO: 744810 - RNA, 19 nt, Leptospira interrogans serovar lai str. 56601
aauuaaacccauuuuagaa

SEQ ID NO: 744811 - RNA, 14 nt, Leptospira interrogans serovar lai str. 56601
aauuaacuuugaua

SEQ ID NO: 744812 - RNA, 21 nt, Leptospira interrogans serovar lai str. 56601
aauuaacgguacucaauuuua

SEQ ID NO: 744813 - RNA, 22 nt, Leptospira interrogans serovar lai str. 56601
aauuaagcauuauaaguuuuua

SEQ ID NO: 744814 - RNA, 13 nt, Leptospira interrogans serovar lai str. 56601
aauuaaguuuaaa

SEQ ID NO: 744815 - RNA, 15 nt, Leptospira interrogans serovar lai str. 56601
aauuaaguuuaaaaa

SEQ ID NO: 744816 - RNA, 16 nt, Leptospira interrogans serovar lai str. 56601
aauuacaguuaauaaa

SEQ ID NO: 744817 - RNA, 16 nt, Leptospira interrogans serovar lai str. 56601
aauuaaucuguaaagu

SEQ ID NO: 744818 - RNA, 22 nt, Leptospira interrogans serovar lai str. 56601
aauuaaucuguaaaguuuagau

SEQ ID NO: 744819 - RNA, 16 nt, Leptospira interrogans serovar lai str. 56601
aauuaauauuuauaaa

SEQ ID NO: 744820 - RNA, 19 nt, Leptospira interrogans serovar lai str. 56601
aauuaaucaaauuucugca

SEQ ID NO: 744821 - RNA, 22 nt, Leptospira interrogans serovar lai str. 56601
aauuagaaagaaucuuuuuaaa

SEQ ID NO: 744822 - RNA, 14 nt, Leptospira interrogans serovar lai str. 56601
aauuagaaaugauu

SEQ ID NO: 744823 - RNA, 19 nt, Leptospira interrogans serovar lai str. 56601
aauuagaaaugauuuuuua

SEQ ID NO: 744824 - RNA, 22 nt, Leptospira interrogans serovar lai str. 56601
aauuacuucaauuguccauuuc

SEQ ID NO: 744825 - RNA, 23 nt, Leptospira interrogans serovar lai str. 56601
aauuacccuaaagcuauuuucua

SEQ ID NO: 744826 - RNA, 16 nt, Leptospira interrogans serovar lai str. 56601
aauuacgauuuuuuga

SEQ ID NO: 744827 - RNA, 16 nt, Leptospira interrogans serovar lai str. 56601
aauuacuuagaugaac

SEQ ID NO: 744828 - RNA, 20 nt, Leptospira interrogans serovar lai str. 56601
aauguauccaauccaaaauu

SEQ ID NO: 744829 - RNA, 13 nt, Leptospira interrogans serovar lai str. 56601
aauguauugcuuu

SEQ ID NO: 744830 - RNA, 23 nt, Leptospira interrogans serovar lai str. 56601
aaugucaacaggggcuuugauug

SEQ ID NO: 744831 - RNA, 23 nt, Leptospira interrogans serovar lai str. 56601
aaugucauuugugcuauauucaa

SEQ ID NO: 744832 - RNA, 16 nt, Leptospira interrogans serovar lai str. 56601
aauguccgaaauuuuu

SEQ ID NO: 744833 - RNA, 17 nt, Leptospira interrogans serovar lai str. 56601
aaugucuaugauuaaag

SEQ ID NO: 744834 - RNA, 22 nt, Leptospira interrogans serovar lai str. 56601
aaugugagagaggauacuauac

SEQ ID NO: 744835 - RNA, 20 nt, Leptospira interrogans serovar lai str. 56601
aaugugaguggauugccauc

SEQ ID NO: 744836 - RNA, 23 nt, Leptospira interrogans serovar lai str. 56601
aaugggauuuuguaaugaaaucu

SEQ ID NO: 744837 - RNA, 20 nt, Leptospira interrogans serovar lai str. 56601
aauguauucuauaaaauuug

SEQ ID NO: 744838 - RNA, 14 nt, Leptospira interrogans serovar lai str. 56601
aauguauaccaaua

SEQ ID NO: 744839 - RNA, 15 nt, Leptospira interrogans serovar lai str. 56601
aauguauaccaauaa

SEQ ID NO: 744840 - RNA, 14 nt, Leptospira interrogans serovar lai str. 56601
aaugcucaaaaauu

SEQ ID NO: 744841 - RNA, 20 nt, Leptospira interrogans serovar lai str. 56601
aaugcuauugaauccuuccu

SEQ ID NO: 744842 - RNA, 18 nt, Leptospira interrogans serovar lai str. 56601
aaugcugauuuuucuuua

SEQ ID NO: 744843 - RNA, 21 nt, Leptospira interrogans serovar lai str. 56601
aauggcguauaagaauguuuu

SEQ ID NO: 744844 - RNA, 20 nt, Leptospira interrogans serovar lai str. 56601
aauggauuuuuauguaauau

SEQ ID NO: 744845 - RNA, 19 nt, Leptospira interrogans serovar lai str. 56601
aauggcaaaacgauauuuu

SEQ ID NO: 744846 - RNA, 18 nt, Leptospira interrogans serovar lai str. 56601
aaucgauucuaggaaacu

SEQ ID NO: 744847 - RNA, 20 nt, Leptospira interrogans serovar lai str. 56601
aaucgauucuaggaaacuca

SEQ ID NO: 744848 - RNA, 21 nt, Leptospira interrogans serovar lai str. 56601
aaucgaugguuucaauuuaaa

SEQ ID NO: 744849 - RNA, 22 nt, Leptospira interrogans serovar lai str. 56601
aaucgaugguuucaauuuaaaa

SEQ ID NO: 744850 - RNA, 18 nt, Leptospira interrogans serovar lai str. 56601
aaucgauuucuaaauugu

SEQ ID NO: 744851 - RNA, 15 nt, Leptospira interrogans serovar lai str. 56601
aaucgauuuguaaaa

SEQ ID NO: 744852 - RNA, 19 nt, Leptospira interrogans serovar lai str. 56601
aaucgauuuguaaaauuca

SEQ ID NO: 744853 - RNA, 20 nt, Leptospira interrogans serovar lai str. 56601
aaucgauuuguaaaauucag

SEQ ID NO: 744854 - RNA, 21 nt, Leptospira interrogans serovar lai str. 56601
aaucggaaauaccgcuggaaa

SEQ ID NO: 744855 - RNA, 14 nt, Leptospira interrogans serovar lai str. 56601
aaucggaaauauaa

SEQ ID NO: 744856 - RNA, 23 nt, Leptospira interrogans serovar lai str. 56601
aaucggaacuagggaauuuuuca

SEQ ID NO: 744857 - RNA, 15 nt, Leptospira interrogans serovar lai str. 56601
aaucggaauuuuaau

SEQ ID NO: 744858 - RNA, 22 nt, Leptospira interrogans serovar lai str. 56601
aaucguguuugagauuaaaaag

SEQ ID NO: 744859 - RNA, 20 nt, Leptospira interrogans serovar lai str. 56601
aaucgucuguaaaagaaaaa

SEQ ID NO: 744860 - RNA, 22 nt, Leptospira interrogans serovar lai str. 56601
aaucgaccguuuccauaaaaua

SEQ ID NO: 744861 - RNA, 14 nt, Leptospira interrogans serovar lai str. 56601
aaucgaauccuuuu

SEQ ID NO: 744862 - RNA, 23 nt, Leptospira interrogans serovar lai str. 56601
aaucgaaugguacgaccaaaaca

SEQ ID NO: 744863 - RNA, 12 nt, Leptospira interrogans serovar lai str. 56601
aaucgaauuucc

SEQ ID NO: 744864 - RNA, 15 nt, Leptospira interrogans serovar lai str. 56601
aaucgaauaaaaaag

SEQ ID NO: 744865 - RNA, 20 nt, Leptospira interrogans serovar lai str. 56601
aaucgagauugauauuucuu

SEQ ID NO: 744866 - RNA, 15 nt, Leptospira interrogans serovar lai str. 56601
aaucuaaacuuugua

SEQ ID NO: 744867 - RNA, 14 nt, Leptospira interrogans serovar lai str. 56601
aaucuaaacuugag

SEQ ID NO: 744868 - RNA, 17 nt, Leptospira interrogans serovar lai str. 56601
aaucuaagaucaacaca

SEQ ID NO: 744869 - RNA, 22 nt, Leptospira interrogans serovar lai str. 56601
aaucuaagaucaacacaaauau

SEQ ID NO: 744870 - RNA, 19 nt, Leptospira interrogans serovar lai str. 56601
aaucuaagauugaaugaaa

SEQ ID NO: 744871 - RNA, 12 nt, Leptospira interrogans serovar lai str. 56601
aaucuaacugua

SEQ ID NO: 744872 - RNA, 17 nt, Leptospira interrogans serovar lai str. 56601
aaucuaaauuuguaaua

SEQ ID NO: 744873 - RNA, 14 nt, Leptospira interrogans serovar lai str. 56601
aaucuaaauuuguu

SEQ ID NO: 744874 - RNA, 21 nt, Leptospira interrogans serovar lai str. 56601
aaucuaaauuuuacaauuaaa

SEQ ID NO: 744875 - RNA, 15 nt, Leptospira interrogans serovar lai str. 56601
aaucguuuuaaaaac

SEQ ID NO: 744876 - RNA, 17 nt, Leptospira interrogans serovar lai str. 56601
aaucguuuuaaaaaccu

SEQ ID NO: 744877 - RNA, 17 nt, Leptospira interrogans serovar lai str. 56601
aaucguuuaaagauuaa

SEQ ID NO: 744878 - RNA, 14 nt, Leptospira interrogans serovar lai str. 56601
aaucuaaaagaaac

SEQ ID NO: 744879 - RNA, 16 nt, Leptospira interrogans serovar lai str. 56601
aaucuaaaaagaauca

SEQ ID NO: 744880 - RNA, 14 nt, Leptospira interrogans serovar lai str. 56601
aaucuaaaaaaaau

SEQ ID NO: 744881 - RNA, 22 nt, Leptospira interrogans serovar lai str. 56601
aaucuaaaaaaaaucaccgucc

SEQ ID NO: 744882 - RNA, 21 nt, Leptospira interrogans serovar lai str. 56601
aaucucaauucaguaaauuau

SEQ ID NO: 744883 - RNA, 22 nt, Leptospira interrogans serovar lai str. 56601
aaucucacgguucgguggaaac

SEQ ID NO: 744884 - RNA, 19 nt, Leptospira interrogans serovar lai str. 56601
aaucuccgcucuauuucca

SEQ ID NO: 744885 - RNA, 14 nt, Leptospira interrogans serovar lai str. 56601
aaucuccauuauag

SEQ ID NO: 744886 - RNA, 15 nt, Leptospira interrogans serovar lai str. 56601
aaucugaauuuuaag

SEQ ID NO: 744887 - RNA, 23 nt, Leptospira interrogans serovar lai str. 56601
aaucugaauuuuaagaucuauuc

SEQ ID NO: 744888 - RNA, 21 nt, Leptospira interrogans serovar lai str. 56601
aaucugaacauaaaaucgauu

SEQ ID NO: 744889 - RNA, 18 nt, Leptospira interrogans serovar lai str. 56601
aaucugauugagaaaaua

SEQ ID NO: 744890 - RNA, 13 nt, Leptospira interrogans serovar lai str. 56601
aaucucuuucgga

SEQ ID NO: 744891 - RNA, 14 nt, Leptospira interrogans serovar lai str. 56601
aaucugaacuuuau

SEQ ID NO: 744892 - RNA, 15 nt, Leptospira interrogans serovar lai str. 56601
aaugaucaauagaau

SEQ ID NO: 744893 - RNA, 22 nt, Leptospira interrogans serovar lai str. 56601
aaugauauuugucuauagaugc

SEQ ID NO: 744894 - RNA, 15 nt, Leptospira interrogans serovar lai str. 56601
aaugauagaaauauu

SEQ ID NO: 744895 - RNA, 13 nt, Leptospira interrogans serovar lai str. 56601
aaugauacuauua

SEQ ID NO: 744896 - RNA, 18 nt, Leptospira interrogans serovar lai str. 56601
aaugauaggcuaaucaaa

SEQ ID NO: 744897 - RNA, 22 nt, Leptospira interrogans serovar lai str. 56601
aaugauagugaucuaugauauu

SEQ ID NO: 744898 - RNA, 13 nt, Leptospira interrogans serovar lai str. 56601
aaugcaauauauu

SEQ ID NO: 744899 - RNA, 13 nt, Leptospira interrogans serovar lai str. 56601
aaugauucuaacu

SEQ ID NO: 744900 - RNA, 15 nt, Leptospira interrogans serovar lai str. 56601
aaugacuugcauuua

SEQ ID NO: 744901 - RNA, 18 nt, Leptospira interrogans serovar lai str. 56601
aaugacuugcauuuaaua

SEQ ID NO: 744902 - RNA, 18 nt, Leptospira interrogans serovar lai str. 56601
aaugagucugucccaaaa

SEQ ID NO: 744903 - RNA, 20 nt, Leptospira interrogans serovar lai str. 56601
aaugagucugucccaaaauc

SEQ ID NO: 744904 - RNA, 23 nt, Leptospira interrogans serovar lai str. 56601
aaugaguuauaguaaaagaaaau

SEQ ID NO: 744905 - RNA, 21 nt, Leptospira interrogans serovar lai str. 56601
aaugaguuuuagaauauuaag

SEQ ID NO: 744906 - RNA, 16 nt, Leptospira interrogans serovar lai str. 56601
aaucuuccgcauuuuu

SEQ ID NO: 744907 - RNA, 18 nt, Leptospira interrogans serovar lai str. 56601
aaucugcugaauuuaccu

SEQ ID NO: 744908 - RNA, 17 nt, Leptospira interrogans serovar lai str. 56601
aaucugccccaaaauuu

SEQ ID NO: 744909 - RNA, 18 nt, Leptospira interrogans serovar lai str. 56601
aaucugccccaaaauuua

SEQ ID NO: 744910 - RNA, 19 nt, Leptospira interrogans serovar lai str. 56601
aaucugccccaaaauuuag

SEQ ID NO: 744911 - RNA, 21 nt, Leptospira interrogans serovar lai str. 56601
aaucugccccaaaauuuagaa

SEQ ID NO: 744912 - RNA, 16 nt, Leptospira interrogans serovar lai str. 56601
aaugaaggaauuggaa

SEQ ID NO: 744913 - RNA, 20 nt, Leptospira interrogans serovar lai str. 56601
aaugaaggaauuggaauauc

SEQ ID NO: 744914 - RNA, 18 nt, Leptospira interrogans serovar lai str. 56601
aaugaagaugagcaaaau

SEQ ID NO: 744915 - RNA, 14 nt, Leptospira interrogans serovar lai str. 56601
aaugaauuuuaaau

SEQ ID NO: 744916 - RNA, 19 nt, Leptospira interrogans serovar lai str. 56601
aaugaauuuuuauaaaaau

SEQ ID NO: 744917 - RNA, 20 nt, Leptospira interrogans serovar lai str. 56601
aaugaaguguaaaacccauc

SEQ ID NO: 744918 - RNA, 16 nt, Leptospira interrogans serovar lai str. 56601
aaugaauuuagaaaau

SEQ ID NO: 744919 - RNA, 19 nt, Leptospira interrogans serovar lai str. 56601
aaucuuucacuuuaaaaca

SEQ ID NO: 744920 - RNA, 20 nt, Leptospira interrogans serovar lai str. 56601
aaucuuucacuuuaaaacau

SEQ ID NO: 744921 - RNA, 14 nt, Leptospira interrogans serovar lai str. 56601
aaugaacucaacag

SEQ ID NO: 744922 - RNA, 13 nt, Leptospira interrogans serovar lai str. 56601
aaucuuuaagagc

SEQ ID NO: 744923 - RNA, 13 nt, Leptospira interrogans serovar lai str. 56601
aaucuuuaaguuu

SEQ ID NO: 744924 - RNA, 21 nt, Leptospira interrogans serovar lai str. 56601
aauacaaaauuuuuuccuuua

SEQ ID NO: 744925 - RNA, 21 nt, Leptospira interrogans serovar lai str. 56601
aauaaaguauuuuuaagauaa

SEQ ID NO: 744926 - RNA, 19 nt, Leptospira interrogans serovar lai str. 56601
aauaaagauucacuuagaa

SEQ ID NO: 744927 - RNA, 23 nt, Leptospira interrogans serovar lai str. 56601
aauaaagauucacuuagaaagau

SEQ ID NO: 744928 - RNA, 16 nt, Leptospira interrogans serovar lai str. 56601
aauaaagaagaguuga

SEQ ID NO: 744929 - RNA, 19 nt, Leptospira interrogans serovar lai str. 56601
aauaaagaagaguugaaua

SEQ ID NO: 744930 - RNA, 18 nt, Leptospira interrogans serovar lai str. 56601
aauacaaaguauucuuuc

SEQ ID NO: 744931 - RNA, 15 nt, Leptospira interrogans serovar lai str. 56601
aauacaaaguuugua

SEQ ID NO: 744932 - RNA, 17 nt, Leptospira interrogans serovar lai str. 56601
aauacaacgaaaacaga

SEQ ID NO: 744933 - RNA, 18 nt, Leptospira interrogans serovar lai str. 56601
aauacaacgaaaacagau

SEQ ID NO: 744934 - RNA, 16 nt, Leptospira interrogans serovar lai str. 56601
aauacaccaugccauu

SEQ ID NO: 744935 - RNA, 17 nt, Leptospira interrogans serovar lai str. 56601
aauacaauugauuuaaa

SEQ ID NO: 744936 - RNA, 15 nt, Leptospira interrogans serovar lai str. 56601
aauacaauuugaucu

SEQ ID NO: 744937 - RNA, 17 nt, Leptospira interrogans serovar lai str. 56601
aauacacggagauaaaa

SEQ ID NO: 744938 - RNA, 18 nt, Leptospira interrogans serovar lai str. 56601
aauacacggagauaaaaa

SEQ ID NO: 744939 - RNA, 20 nt, Leptospira interrogans serovar lai str. 56601
aauacacggagauaaaaaag

SEQ ID NO: 744940 - RNA, 23 nt, Leptospira interrogans serovar lai str. 56601
aauacacggagauaaaaaaggau

SEQ ID NO: 744941 - RNA, 17 nt, Leptospira interrogans serovar lai str. 56601
aauacaauaaaaacaga

SEQ ID NO: 744942 - RNA, 15 nt, Leptospira interrogans serovar lai str. 56601
aauacauaaaugaua

SEQ ID NO: 744943 - RNA, 19 nt, Leptospira interrogans serovar lai str. 56601
aauacauaaaaaaauaaua

SEQ ID NO: 744944 - RNA, 17 nt, Leptospira interrogans serovar lai str. 56601
aauacagaauucauuuu

SEQ ID NO: 744945 - RNA, 14 nt, Leptospira interrogans serovar lai str. 56601
aauacaucucuuuu

SEQ ID NO: 744946 - RNA, 13 nt, Leptospira interrogans serovar lai str. 56601
aauacauuuaaac

SEQ ID NO: 744947 - RNA, 20 nt, Leptospira interrogans serovar lai str. 56601
aauacauuagaauuuuauga

SEQ ID NO: 744948 - RNA, 12 nt, Leptospira interrogans serovar lai str. 56601
aauacguuuuga

SEQ ID NO: 744949 - RNA, 21 nt, Leptospira interrogans serovar lai str. 56601
aauacguuuacuccaauuuua

SEQ ID NO: 744950 - RNA, 23 nt, Leptospira interrogans serovar lai str. 56601
aauacguuuacuccaauuuuacc

SEQ ID NO: 744951 - RNA, 17 nt, Leptospira interrogans serovar lai str. 56601
aauacuaaauuaaguuu

SEQ ID NO: 744952 - RNA, 21 nt, Leptospira interrogans serovar lai str. 56601
aauacuuuaccgucaauuuuu

SEQ ID NO: 744953 - RNA, 22 nt, Leptospira interrogans serovar lai str. 56601
aauacuuuacggucggcaagau

SEQ ID NO: 744954 - RNA, 19 nt, Leptospira interrogans serovar lai str. 56601
aauagaaccuuuugaagua

SEQ ID NO: 744955 - RNA, 17 nt, Leptospira interrogans serovar lai str. 56601
aauacuucucuaaagau

SEQ ID NO: 744956 - RNA, 14 nt, Leptospira interrogans serovar lai str. 56601
aauacuuagaauuu

SEQ ID NO: 744957 - RNA, 22 nt, Leptospira interrogans serovar lai str. 56601
aauacgacagauucaauuuuua

SEQ ID NO: 744958 - RNA, 14 nt, Leptospira interrogans serovar lai str. 56601
aauaguauccaaaa

SEQ ID NO: 744959 - RNA, 16 nt, Leptospira interrogans serovar lai str. 56601
aauaguauccaaaauu

SEQ ID NO: 744960 - RNA, 17 nt, Leptospira interrogans serovar lai str. 56601
aauaguauccaaaauua

SEQ ID NO: 744961 - RNA, 23 nt, Leptospira interrogans serovar lai str. 56601
aauaguaagcccccgaagaauua

SEQ ID NO: 744962 - RNA, 21 nt, Leptospira interrogans serovar lai str. 56601
aauagucaauugaagcaguuu

SEQ ID NO: 744963 - RNA, 18 nt, Leptospira interrogans serovar lai str. 56601
aauaguauauuuucugcu

SEQ ID NO: 744964 - RNA, 19 nt, Leptospira interrogans serovar lai str. 56601
aauaguuucuacauuuuug

SEQ ID NO: 744965 - RNA, 16 nt, Leptospira interrogans serovar lai str. 56601
aauaguugaaauucac

SEQ ID NO: 744966 - RNA, 17 nt, Leptospira interrogans serovar lai str. 56601
aauaguucccacaaauu

SEQ ID NO: 744967 - RNA, 21 nt, Leptospira interrogans serovar lai str. 56601
aauaggaucagaauuucuuuc

SEQ ID NO: 744968 - RNA, 17 nt, Leptospira interrogans serovar lai str. 56601
aauagcuucuuuaaaaa

SEQ ID NO: 744969 - RNA, 22 nt, Leptospira interrogans serovar lai str. 56601
aauagcuugucacuauuuuuau

SEQ ID NO: 744970 - RNA, 21 nt, Leptospira interrogans serovar lai str. 56601
aauagcuuaaaagugauuuaa

SEQ ID NO: 744971 - RNA, 15 nt, Leptospira interrogans serovar lai str. 56601
aauagacuaacgauu

SEQ ID NO: 744972 - RNA, 17 nt, Leptospira interrogans serovar lai str. 56601
aauagaauuuuuguaga

SEQ ID NO: 744973 - RNA, 19 nt, Leptospira interrogans serovar lai str. 56601
aauagaauuuuuguagaau

SEQ ID NO: 744974 - RNA, 22 nt, Leptospira interrogans serovar lai str. 56601
aauagaauuuuuguagaauuga

SEQ ID NO: 744975 - RNA, 15 nt, Leptospira interrogans serovar lai str. 56601
aauagaauuguugaa

SEQ ID NO: 744976 - RNA, 21 nt, Leptospira interrogans serovar lai str. 56601
aauagaauuguugaaaaauua

SEQ ID NO: 744977 - RNA, 19 nt, Leptospira interrogans serovar lai str. 56601
aauagaauuuugcaaaaaa

SEQ ID NO: 744978 - RNA, 22 nt, Leptospira interrogans serovar lai str. 56601
aauagaauuuugcaaaaaaaau

SEQ ID NO: 744979 - RNA, 23 nt, Leptospira interrogans serovar lai str. 56601
aauagaauuuugcaaaaaaaaua

SEQ ID NO: 744980 - RNA, 14 nt, Leptospira interrogans serovar lai str. 56601
aauagaauaaauua

SEQ ID NO: 744981 - RNA, 18 nt, Leptospira interrogans serovar lai str. 56601
aauagaguaccauaaauu

SEQ ID NO: 744982 - RNA, 19 nt, Leptospira interrogans serovar lai str. 56601
aauauauuggcgaaagagg

SEQ ID NO: 744983 - RNA, 21 nt, Leptospira interrogans serovar lai str. 56601
aauauauuggcgaaagaggga

SEQ ID NO: 744984 - RNA, 24 nt, Leptospira interrogans serovar lai str. 56601
aauauauugucuugaauuacaauu

SEQ ID NO: 744985 - RNA, 19 nt, Leptospira interrogans serovar lai str. 56601
aauauauuuauaaaacgaa

SEQ ID NO: 744986 - RNA, 15 nt, Leptospira interrogans serovar lai str. 56601
aauauauuagaguuu

SEQ ID NO: 744987 - RNA, 13 nt, Leptospira interrogans serovar lai str. 56601
aauauauuaaaau

SEQ ID NO: 744988 - RNA, 23 nt, Leptospira interrogans serovar lai str. 56601
aauauauucaauuucuuuaauuu

SEQ ID NO: 744989 - RNA, 22 nt, Leptospira interrogans serovar lai str. 56601
aauauauucuuuucugaauaaa

SEQ ID NO: 744990 - RNA, 14 nt, Leptospira interrogans serovar lai str. 56601
aauauaaaaaauaa

SEQ ID NO: 744991 - RNA, 13 nt, Leptospira interrogans serovar lai str. 56601
aauauaaaaacca

SEQ ID NO: 744992 - RNA, 12 nt, Leptospira interrogans serovar lai str. 56601
aauauaaacugu

SEQ ID NO: 744993 - RNA, 15 nt, Leptospira interrogans serovar lai str. 56601
aauauaaaauuuuua

SEQ ID NO: 744994 - RNA, 18 nt, Leptospira interrogans serovar lai str. 56601
aauauaaaucugucggaa

SEQ ID NO: 744995 - RNA, 21 nt, Leptospira interrogans serovar lai str. 56601
aauauaaguuaagugaaaauu

SEQ ID NO: 744996 - RNA, 14 nt, Leptospira interrogans serovar lai str. 56601
aauauaagaaagua

SEQ ID NO: 744997 - RNA, 19 nt, Leptospira interrogans serovar lai str. 56601
aauauaagaaaguauuaau

SEQ ID NO: 744998 - RNA, 13 nt, Leptospira interrogans serovar lai str. 56601
aauauaauaaaau

SEQ ID NO: 744999 - RNA, 14 nt, Leptospira interrogans serovar lai str. 56601
aauaucuaaaaccu

SEQ ID NO: 745000 - RNA, 22 nt, Leptospira interrogans serovar lai str. 56601
aauauuuuuuuuaaucauccaa

SEQ ID NO: 745001 - RNA, 13 nt, Leptospira interrogans serovar lai str. 56601
aauauuuuuucca

SEQ ID NO: 745002 - RNA, 17 nt, Leptospira interrogans serovar lai str. 56601
aauauuuuuuccaaaaa

SEQ ID NO: 745003 - RNA, 23 nt, Leptospira interrogans serovar lai str. 56601
aauauuuuuuccaaaaagaaaaa

SEQ ID NO: 745004 - RNA, 15 nt, Leptospira interrogans serovar lai str. 56601
aauauuuuccaaaaa

SEQ ID NO: 745005 - RNA, 17 nt, Leptospira interrogans serovar lai str. 56601
aauauuuuccaaaaauu

SEQ ID NO: 745006 - RNA, 19 nt, Leptospira interrogans serovar lai str. 56601
aauauuuuccaaaaauuua

SEQ ID NO: 745007 - RNA, 22 nt, Leptospira interrogans serovar lai str. 56601
aauauuuugagcagauucuaaa

SEQ ID NO: 745008 - RNA, 21 nt, Leptospira interrogans serovar lai str. 56601
aauauuuugcaugaaaucagu

SEQ ID NO: 745009 - RNA, 11 nt, Leptospira interrogans serovar lai str. 56601
aauauuuuuaa

SEQ ID NO: 745010 - RNA, 17 nt, Leptospira interrogans serovar lai str. 56601
aauauuuuuaaacucau

SEQ ID NO: 745011 - RNA, 16 nt, Leptospira interrogans serovar lai str. 56601
aauauuuucucaguaa

SEQ ID NO: 745012 - RNA, 13 nt, Leptospira interrogans serovar lai str. 56601
aauauuuucuggu

SEQ ID NO: 745013 - RNA, 15 nt, Leptospira interrogans serovar lai str. 56601
aauauuucgucuuug

SEQ ID NO: 745014 - RNA, 16 nt, Leptospira interrogans serovar lai str. 56601
aauauuucguuuuuag

SEQ ID NO: 745015 - RNA, 14 nt, Leptospira interrogans serovar lai str. 56601
aauauuucuaaaau

SEQ ID NO: 745016 - RNA, 21 nt, Leptospira interrogans serovar lai str. 56601
aauauuucuucguuauuuuua

SEQ ID NO: 745017 - RNA, 22 nt, Leptospira interrogans serovar lai str. 56601
aauauuucuucguuauuuuuau

SEQ ID NO: 745018 - RNA, 15 nt, Leptospira interrogans serovar lai str. 56601
aauauuuuaaagaaa

SEQ ID NO: 745019 - RNA, 18 nt, Leptospira interrogans serovar lai str. 56601
aauauuuuaaagaaacuc

SEQ ID NO: 745020 - RNA, 18 nt, Leptospira interrogans serovar lai str. 56601
aauauuuccaaauuguau

SEQ ID NO: 745021 - RNA, 17 nt, Leptospira interrogans serovar lai str. 56601
aauauuucaaaaauuuu

SEQ ID NO: 745022 - RNA, 14 nt, Leptospira interrogans serovar lai str. 56601
aauauuuaugcuuu

SEQ ID NO: 745023 - RNA, 17 nt, Leptospira interrogans serovar lai str. 56601
aauauuuauaaaacaau

SEQ ID NO: 745024 - RNA, 23 nt, Leptospira interrogans serovar lai str. 56601
aauauuuaguauuuuauuauaua

SEQ ID NO: 745025 - RNA, 23 nt, Leptospira interrogans serovar lai str. 56601
aaucaaauuuauaugauuuuaua

SEQ ID NO: 745026 - RNA, 24 nt, Leptospira interrogans serovar lai str. 56601
aaucaaauuuauaugauuuuauac

SEQ ID NO: 745027 - RNA, 18 nt, Leptospira interrogans serovar lai str. 56601
aaucaacauuauguuaaa

SEQ ID NO: 745028 - RNA, 12 nt, Leptospira interrogans serovar lai str. 56601
aaucaaauauac

SEQ ID NO: 745029 - RNA, 14 nt, Leptospira interrogans serovar lai str. 56601
aaucaaauauacaa

SEQ ID NO: 745030 - RNA, 14 nt, Leptospira interrogans serovar lai str. 56601
aaucaaauuuuuga

SEQ ID NO: 745031 - RNA, 16 nt, Leptospira interrogans serovar lai str. 56601
aaucaaauuuuugaau

SEQ ID NO: 745032 - RNA, 16 nt, Leptospira interrogans serovar lai str. 56601
aaucaaauuuuugcau

SEQ ID NO: 745033 - RNA, 17 nt, Leptospira interrogans serovar lai str. 56601
aaucaaaauuucuuuuu

SEQ ID NO: 745034 - RNA, 14 nt, Leptospira interrogans serovar lai str. 56601
aaucaaaauuuuuu

SEQ ID NO: 745035 - RNA, 12 nt, Leptospira interrogans serovar lai str. 56601
aaucaaaggaaa

SEQ ID NO: 745036 - RNA, 17 nt, Leptospira interrogans serovar lai str. 56601
aaucaaaggaaauaaaa

SEQ ID NO: 745037 - RNA, 20 nt, Leptospira interrogans serovar lai str. 56601
aaucaaaggaaauaaaaaua

SEQ ID NO: 745038 - RNA, 22 nt, Leptospira interrogans serovar lai str. 56601
aaucaaaggaaauaaaaauaua

SEQ ID NO: 745039 - RNA, 12 nt, Leptospira interrogans serovar lai str. 56601
aaucaaaaugaa

SEQ ID NO: 745040 - RNA, 22 nt, Leptospira interrogans serovar lai str. 56601
aaucaaaaaaguccaaaacaaa

SEQ ID NO: 745041 - RNA, 21 nt, Leptospira interrogans serovar lai str. 56601
aauauuuuuauguauuuuaaa

SEQ ID NO: 745042 - RNA, 11 nt, Leptospira interrogans serovar lai str. 56601
aauauuauaaa

SEQ ID NO: 745043 - RNA, 16 nt, Leptospira interrogans serovar lai str. 56601
aauauuauaaauuuaa

SEQ ID NO: 745044 - RNA, 15 nt, Leptospira interrogans serovar lai str. 56601
aauauuauauuuuua

SEQ ID NO: 745045 - RNA, 22 nt, Leptospira interrogans serovar lai str. 56601
aauauuauauuuuuaaaaagua

SEQ ID NO: 745046 - RNA, 16 nt, Leptospira interrogans serovar lai str. 56601
aauauuauuuuaacuu

SEQ ID NO: 745047 - RNA, 19 nt, Leptospira interrogans serovar lai str. 56601
aauauuauuuuaacuugag

SEQ ID NO: 745048 - RNA, 15 nt, Leptospira interrogans serovar lai str. 56601
aauauuaauuauaug

SEQ ID NO: 745049 - RNA, 14 nt, Leptospira interrogans serovar lai str. 56601
aauauuaauuuaaa

SEQ ID NO: 745050 - RNA, 14 nt, Leptospira interrogans serovar lai str. 56601
aauaugaauuuuua

SEQ ID NO: 745051 - RNA, 15 nt, Leptospira interrogans serovar lai str. 56601
aauaugaauuuuuaa

SEQ ID NO: 745052 - RNA, 18 nt, Leptospira interrogans serovar lai str. 56601
aauaugaaguaugaagua

SEQ ID NO: 745053 - RNA, 13 nt, Leptospira interrogans serovar lai str. 56601
aauauuaaauuuu

SEQ ID NO: 745054 - RNA, 21 nt, Leptospira interrogans serovar lai str. 56601
aauaugauguaaauuugcuuu

SEQ ID NO: 745055 - RNA, 16 nt, Leptospira interrogans serovar lai str. 56601
aauauucguaagaaaa

SEQ ID NO: 745056 - RNA, 19 nt, Leptospira interrogans serovar lai str. 56601
aauauucguaagaaaaaau

SEQ ID NO: 745057 - RNA, 22 nt, Leptospira interrogans serovar lai str. 56601
aauauucguguucuauuauaua

SEQ ID NO: 745058 - RNA, 17 nt, Leptospira interrogans serovar lai str. 56601
aauauucgaucaaguaa

SEQ ID NO: 745059 - RNA, 17 nt, Leptospira interrogans serovar lai str. 56601
aauauucacuuuuccaa

SEQ ID NO: 745060 - RNA, 17 nt, Leptospira interrogans serovar lai str. 56601
aauauucuaauuuuaua

SEQ ID NO: 745061 - RNA, 17 nt, Leptospira interrogans serovar lai str. 56601
aauauucuaauuuuuau

SEQ ID NO: 745062 - RNA, 19 nt, Leptospira interrogans serovar lai str. 56601
aauauuuagaauaaaauuu

SEQ ID NO: 745063 - RNA, 16 nt, Leptospira interrogans serovar lai str. 56601
aaucacaaaaaagaua

SEQ ID NO: 745064 - RNA, 13 nt, Leptospira interrogans serovar lai str. 56601
aaucacaauuuua

SEQ ID NO: 745065 - RNA, 16 nt, Leptospira interrogans serovar lai str. 56601
aaucacaauuuuaaga

SEQ ID NO: 745066 - RNA, 19 nt, Leptospira interrogans serovar lai str. 56601
aaucacaauuuuacaaaca

SEQ ID NO: 745067 - RNA, 23 nt, Leptospira interrogans serovar lai str. 56601
aaucaauggaaaauuaauuuuuc

SEQ ID NO: 745068 - RNA, 20 nt, Leptospira interrogans serovar lai str. 56601
aaucacccaaucuuacaagu

SEQ ID NO: 745069 - RNA, 23 nt, Leptospira interrogans serovar lai str. 56601
aaucaauaaauugcacaaaagaa

SEQ ID NO: 745070 - RNA, 23 nt, Leptospira interrogans serovar lai str. 56601
aaucacgauuuuacaaacaaauu

SEQ ID NO: 745071 - RNA, 16 nt, Leptospira interrogans serovar lai str. 56601
aaucacgauuuuacga

SEQ ID NO: 745072 - RNA, 18 nt, Leptospira interrogans serovar lai str. 56601
aaucagaaugaacucaac

SEQ ID NO: 745073 - RNA, 21 nt, Leptospira interrogans serovar lai str. 56601
aaucagagcaucauacaguaa

SEQ ID NO: 745074 - RNA, 23 nt, Leptospira interrogans serovar lai str. 56601
aaucagagucuauuuaauuaugg

SEQ ID NO: 745075 - RNA, 14 nt, Leptospira interrogans serovar lai str. 56601
aaucauauuuucaa

SEQ ID NO: 745076 - RNA, 18 nt, Leptospira interrogans serovar lai str. 56601
aaucauauuuucaaaaaa

SEQ ID NO: 745077 - RNA, 20 nt, Leptospira interrogans serovar lai str. 56601
aaucaguguuuugugauaaa

SEQ ID NO: 745078 - RNA, 14 nt, Leptospira interrogans serovar lai str. 56601
aaucaguuaaaccc

SEQ ID NO: 745079 - RNA, 15 nt, Leptospira interrogans serovar lai str. 56601
aaucaguuaaacccg

SEQ ID NO: 745080 - RNA, 21 nt, Leptospira interrogans serovar lai str. 56601
aaucaguuuuguuaauuuuga

SEQ ID NO: 745081 - RNA, 22 nt, Leptospira interrogans serovar lai str. 56601
aaucaguuuuguuaauuuugaa

SEQ ID NO: 745082 - RNA, 17 nt, Leptospira interrogans serovar lai str. 56601
accgaucaaacucuuuu

SEQ ID NO: 745083 - RNA, 21 nt, Leptospira interrogans serovar lai str. 56601
accgcaaacaucuagauuuua

SEQ ID NO: 745084 - RNA, 19 nt, Leptospira interrogans serovar lai str. 56601
accgauuucaauuuucuca

SEQ ID NO: 745085 - RNA, 15 nt, Leptospira interrogans serovar lai str. 56601
accgcaaaucaagau

SEQ ID NO: 745086 - RNA, 15 nt, Leptospira interrogans serovar lai str. 56601
accgcaaaucacaau

SEQ ID NO: 745087 - RNA, 23 nt, Leptospira interrogans serovar lai str. 56601
acccuagaagccugaguuugaga

SEQ ID NO: 745088 - RNA, 15 nt, Leptospira interrogans serovar lai str. 56601
acccucaucagucau

SEQ ID NO: 745089 - RNA, 19 nt, Leptospira interrogans serovar lai str. 56601
acccuggucaagaaauucu

SEQ ID NO: 745090 - RNA, 18 nt, Leptospira interrogans serovar lai str. 56601
acccugccaaaaucccag

SEQ ID NO: 745091 - RNA, 17 nt, Leptospira interrogans serovar lai str. 56601
accgaaauagaaauaca

SEQ ID NO: 745092 - RNA, 19 nt, Leptospira interrogans serovar lai str. 56601
accgaacucacguuauuuu

SEQ ID NO: 745093 - RNA, 21 nt, Leptospira interrogans serovar lai str. 56601
accgaacucacguuauuuuaa

SEQ ID NO: 745094 - RNA, 23 nt, Leptospira interrogans serovar lai str. 56601
accgaagaauccgaaaaaccuug

SEQ ID NO: 745095 - RNA, 19 nt, Leptospira interrogans serovar lai str. 56601
accgaauuuagguuaaguc

SEQ ID NO: 745096 - RNA, 19 nt, Leptospira interrogans serovar lai str. 56601
accgaaucuggaagccaaa

SEQ ID NO: 745097 - RNA, 14 nt, Leptospira interrogans serovar lai str. 56601
acccauucaacauc

SEQ ID NO: 745098 - RNA, 20 nt, Leptospira interrogans serovar lai str. 56601
acccauucaacaucauucuc

SEQ ID NO: 745099 - RNA, 19 nt, Leptospira interrogans serovar lai str. 56601
acccauggcuuugaaaaag

SEQ ID NO: 745100 - RNA, 13 nt, Leptospira interrogans serovar lai str. 56601
acccauuaacuau

SEQ ID NO: 745101 - RNA, 13 nt, Leptospira interrogans serovar lai str. 56601
acccgaucuuuuu

SEQ ID NO: 745102 - RNA, 20 nt, Leptospira interrogans serovar lai str. 56601
acccgaucuuuuuuaauuau

SEQ ID NO: 745103 - RNA, 17 nt, Leptospira interrogans serovar lai str. 56601
accauggaugaauugau

SEQ ID NO: 745104 - RNA, 15 nt, Leptospira interrogans serovar lai str. 56601
accauggauuuuuac

SEQ ID NO: 745105 - RNA, 13 nt, Leptospira interrogans serovar lai str. 56601
accauuugaaaaa

SEQ ID NO: 745106 - RNA, 17 nt, Leptospira interrogans serovar lai str. 56601
accauuuuguugcguuu

SEQ ID NO: 745107 - RNA, 18 nt, Leptospira interrogans serovar lai str. 56601
accauuuaauagaucuaa

SEQ ID NO: 745108 - RNA, 19 nt, Leptospira interrogans serovar lai str. 56601
accauuucaaguuuucuuu

SEQ ID NO: 745109 - RNA, 14 nt, Leptospira interrogans serovar lai str. 56601
acccagucuucuug

SEQ ID NO: 745110 - RNA, 21 nt, Leptospira interrogans serovar lai str. 56601
acccauacaaaauuuaaaaau

SEQ ID NO: 745111 - RNA, 17 nt, Leptospira interrogans serovar lai str. 56601
accaucucaaaaacacu

SEQ ID NO: 745112 - RNA, 15 nt, Leptospira interrogans serovar lai str. 56601
accaucucaaaaaua

SEQ ID NO: 745113 - RNA, 22 nt, Leptospira interrogans serovar lai str. 56601
accaugccauuuuuaguuuuaa

SEQ ID NO: 745114 - RNA, 19 nt, Leptospira interrogans serovar lai str. 56601
accauauugaguuaauuuu

SEQ ID NO: 745115 - RNA, 15 nt, Leptospira interrogans serovar lai str. 56601
accaucaaaauuuaa

SEQ ID NO: 745116 - RNA, 14 nt, Leptospira interrogans serovar lai str. 56601
accaggaauacuug

SEQ ID NO: 745117 - RNA, 20 nt, Leptospira interrogans serovar lai str. 56601
accagcaaaacacuuuccuu

SEQ ID NO: 745118 - RNA, 12 nt, Leptospira interrogans serovar lai str. 56601
accacaaaucua

SEQ ID NO: 745119 - RNA, 13 nt, Leptospira interrogans serovar lai str. 56601
accacaguuccua

SEQ ID NO: 745120 - RNA, 18 nt, Leptospira interrogans serovar lai str. 56601
accacaguuccuaaaauu

SEQ ID NO: 745121 - RNA, 17 nt, Leptospira interrogans serovar lai str. 56601
accacaauuuacaacca

SEQ ID NO: 745122 - RNA, 12 nt, Leptospira interrogans serovar lai str. 56601
acauuuuagaaa

SEQ ID NO: 745123 - RNA, 15 nt, Leptospira interrogans serovar lai str. 56601
acauuuuauuauaaa

SEQ ID NO: 745124 - RNA, 23 nt, Leptospira interrogans serovar lai str. 56601
acauuuuauugugaguuuaaaga

SEQ ID NO: 745125 - RNA, 15 nt, Leptospira interrogans serovar lai str. 56601
acauuuucauauaua

SEQ ID NO: 745126 - RNA, 20 nt, Leptospira interrogans serovar lai str. 56601
acauuugacaauuugugaac

SEQ ID NO: 745127 - RNA, 15 nt, Leptospira interrogans serovar lai str. 56601
acauuucguuuuuau

SEQ ID NO: 745128 - RNA, 18 nt, Leptospira interrogans serovar lai str. 56601
acauuguuuuacucuuau

SEQ ID NO: 745129 - RNA, 20 nt, Leptospira interrogans serovar lai str. 56601
acauuguguuuuuuaacauu

SEQ ID NO: 745130 - RNA, 22 nt, Leptospira interrogans serovar lai str. 56601
acauuguguuuuuuaacauuug

SEQ ID NO: 745131 - RNA, 17 nt, Leptospira interrogans serovar lai str. 56601
accaaauuguuuucuaa

SEQ ID NO: 745132 - RNA, 14 nt, Leptospira interrogans serovar lai str. 56601
accaacaacaccac

SEQ ID NO: 745133 - RNA, 19 nt, Leptospira interrogans serovar lai str. 56601
acauuuucgaaauuuuaca

SEQ ID NO: 745134 - RNA, 14 nt, Leptospira interrogans serovar lai str. 56601
acaucgaaaaaaca

SEQ ID NO: 745135 - RNA, 16 nt, Leptospira interrogans serovar lai str. 56601
acaucgaaaaaacaaa

SEQ ID NO: 745136 - RNA, 22 nt, Leptospira interrogans serovar lai str. 56601
acaucgggagcuguucuuaguc

SEQ ID NO: 745137 - RNA, 15 nt, Leptospira interrogans serovar lai str. 56601
acaucguguaacaaa

SEQ ID NO: 745138 - RNA, 19 nt, Leptospira interrogans serovar lai str. 56601
acauguucaaaauuuaucu

SEQ ID NO: 745139 - RNA, 18 nt, Leptospira interrogans serovar lai str. 56601
acauguuguuuguggauu

SEQ ID NO: 745140 - RNA, 18 nt, Leptospira interrogans serovar lai str. 56601
acauucgggucgauagaa

SEQ ID NO: 745141 - RNA, 18 nt, Leptospira interrogans serovar lai str. 56601
acauucugaaacuuuuca

SEQ ID NO: 745142 - RNA, 15 nt, Leptospira interrogans serovar lai str. 56601
acauugaagaaaaaa

SEQ ID NO: 745143 - RNA, 18 nt, Leptospira interrogans serovar lai str. 56601
acauugcgagauuuuaag

SEQ ID NO: 745144 - RNA, 17 nt, Leptospira interrogans serovar lai str. 56601
acauuggcaaauguuau

SEQ ID NO: 745145 - RNA, 17 nt, Leptospira interrogans serovar lai str. 56601
acauuggacgauuuuga

SEQ ID NO: 745146 - RNA, 18 nt, Leptospira interrogans serovar lai str. 56601
acauucaagguaauuuau

SEQ ID NO: 745147 - RNA, 16 nt, Leptospira interrogans serovar lai str. 56601
acauucaauuucuuua

SEQ ID NO: 745148 - RNA, 17 nt, Leptospira interrogans serovar lai str. 56601
acauuccgucaaaucau

SEQ ID NO: 745149 - RNA, 18 nt, Leptospira interrogans serovar lai str. 56601
acauuccgucaaaucauc

SEQ ID NO: 745150 - RNA, 15 nt, Leptospira interrogans serovar lai str. 56601
acauuccauaaugaa

SEQ ID NO: 745151 - RNA, 18 nt, Leptospira interrogans serovar lai str. 56601
acauuccauaaugaagau

SEQ ID NO: 745152 - RNA, 16 nt, Leptospira interrogans serovar lai str. 56601
acauuagaacuacuca

SEQ ID NO: 745153 - RNA, 21 nt, Leptospira interrogans serovar lai str. 56601
acauuagaguuguugaaaaau

SEQ ID NO: 745154 - RNA, 18 nt, Leptospira interrogans serovar lai str. 56601
acauuacgaauuuuuaaa

SEQ ID NO: 745155 - RNA, 20 nt, Leptospira interrogans serovar lai str. 56601
acauuacgaauuuuuaaaua

SEQ ID NO: 745156 - RNA, 13 nt, Leptospira interrogans serovar lai str. 56601
acauuauuucaau

SEQ ID NO: 745157 - RNA, 11 nt, Leptospira interrogans serovar lai str. 56601
acauuauacau

SEQ ID NO: 745158 - RNA, 21 nt, Leptospira interrogans serovar lai str. 56601
acauuauauauuuauuaugua

SEQ ID NO: 745159 - RNA, 17 nt, Leptospira interrogans serovar lai str. 56601
acauauauaauuuauuc

SEQ ID NO: 745160 - RNA, 19 nt, Leptospira interrogans serovar lai str. 56601
acaucaauuauuuucguau

SEQ ID NO: 745161 - RNA, 16 nt, Leptospira interrogans serovar lai str. 56601
acaucaauuuuauuuc

SEQ ID NO: 745162 - RNA, 14 nt, Leptospira interrogans serovar lai str. 56601
acaucccuaagacu

SEQ ID NO: 745163 - RNA, 22 nt, Leptospira interrogans serovar lai str. 56601
acauccgcauucucacaaauca

SEQ ID NO: 745164 - RNA, 23 nt, Leptospira interrogans serovar lai str. 56601
acaucauauuauuuguaguuuca

SEQ ID NO: 745165 - RNA, 18 nt, Leptospira interrogans serovar lai str. 56601
acaucauguaauauaagu

SEQ ID NO: 745166 - RNA, 21 nt, Leptospira interrogans serovar lai str. 56601
acauaaguuguuauaaaccaa

SEQ ID NO: 745167 - RNA, 18 nt, Leptospira interrogans serovar lai str. 56601
acauaacuaauaaaaaca

SEQ ID NO: 745168 - RNA, 20 nt, Leptospira interrogans serovar lai str. 56601
acauaagaaagaauuuucua

SEQ ID NO: 745169 - RNA, 15 nt, Leptospira interrogans serovar lai str. 56601
acauaaaaauuuuuu

SEQ ID NO: 745170 - RNA, 18 nt, Leptospira interrogans serovar lai str. 56601
acauaaaaauuuuuuaaa

SEQ ID NO: 745171 - RNA, 10 nt, Leptospira interrogans serovar lai str. 56601
acaguuuuua

SEQ ID NO: 745172 - RNA, 17 nt, Leptospira interrogans serovar lai str. 56601
acaguuuggcauuuaua

SEQ ID NO: 745173 - RNA, 20 nt, Leptospira interrogans serovar lai str. 56601
acagaaauauauucuuuucu

SEQ ID NO: 745174 - RNA, 17 nt, Leptospira interrogans serovar lai str. 56601
acagaacccaauaaaaa

SEQ ID NO: 745175 - RNA, 16 nt, Leptospira interrogans serovar lai str. 56601
acacucccccuuccga

SEQ ID NO: 745176 - RNA, 15 nt, Leptospira interrogans serovar lai str. 56601
acagcaaaaaauuug

SEQ ID NO: 745177 - RNA, 22 nt, Leptospira interrogans serovar lai str. 56601
acagcaucaacaucacgcacau

SEQ ID NO: 745178 - RNA, 19 nt, Leptospira interrogans serovar lai str. 56601
acagacugauuuuuuaaau

SEQ ID NO: 745179 - RNA, 22 nt, Leptospira interrogans serovar lai str. 56601
acagauacgcccguaaauuucu

SEQ ID NO: 745180 - RNA, 23 nt, Leptospira interrogans serovar lai str. 56601
acagauauaguuuugagauuaca

SEQ ID NO: 745181 - RNA, 14 nt, Leptospira interrogans serovar lai str. 56601
acagaauaaauaca

SEQ ID NO: 745182 - RNA, 18 nt, Leptospira interrogans serovar lai str. 56601
acagaagggagaauaucu

SEQ ID NO: 745183 - RNA, 21 nt, Leptospira interrogans serovar lai str. 56601
acaccaauucgguugacucca

SEQ ID NO: 745184 - RNA, 14 nt, Leptospira interrogans serovar lai str. 56601
acacaugagcauuc

SEQ ID NO: 745185 - RNA, 23 nt, Leptospira interrogans serovar lai str. 56601
acacauuuucauucuaaagaagg

SEQ ID NO: 745186 - RNA, 17 nt, Leptospira interrogans serovar lai str. 56601
acacccaaagucgccca

SEQ ID NO: 745187 - RNA, 19 nt, Leptospira interrogans serovar lai str. 56601
acaccaguauucaauucca

SEQ ID NO: 745188 - RNA, 18 nt, Leptospira interrogans serovar lai str. 56601
acaccgugaucuccuaaa

SEQ ID NO: 745189 - RNA, 20 nt, Leptospira interrogans serovar lai str. 56601
acaccuucucuuuuaaaaac

SEQ ID NO: 745190 - RNA, 18 nt, Leptospira interrogans serovar lai str. 56601
acacgaauuccucaauua

SEQ ID NO: 745191 - RNA, 19 nt, Leptospira interrogans serovar lai str. 56601
acacgaauuccucaauuag

SEQ ID NO: 745192 - RNA, 18 nt, Leptospira interrogans serovar lai str. 56601
acaaguuuacacauuuau

SEQ ID NO: 745193 - RNA, 14 nt, Leptospira interrogans serovar lai str. 56601
acaaguuuaaauga

SEQ ID NO: 745194 - RNA, 15 nt, Leptospira interrogans serovar lai str. 56601
acaaguuucuuaaau

SEQ ID NO: 745195 - RNA, 14 nt, Leptospira interrogans serovar lai str. 56601
acaaguuuuuuccg

SEQ ID NO: 745196 - RNA, 16 nt, Leptospira interrogans serovar lai str. 56601
acaauaaaaacuuaug

SEQ ID NO: 745197 - RNA, 14 nt, Leptospira interrogans serovar lai str. 56601
acaaguugaauagg

SEQ ID NO: 745198 - RNA, 14 nt, Leptospira interrogans serovar lai str. 56601
acaauaaauagaau

SEQ ID NO: 745199 - RNA, 12 nt, Leptospira interrogans serovar lai str. 56601
acaauaaaaauu

SEQ ID NO: 745200 - RNA, 19 nt, Leptospira interrogans serovar lai str. 56601
acaaguccucuaugaaacu

SEQ ID NO: 745201 - RNA, 20 nt, Leptospira interrogans serovar lai str. 56601
acaaguccucuaugaaacuu

SEQ ID NO: 745202 - RNA, 17 nt, Leptospira interrogans serovar lai str. 56601
acaaguuccaaauuacu

SEQ ID NO: 745203 - RNA, 17 nt, Leptospira interrogans serovar lai str. 56601
acaagcuuuaaauucag

SEQ ID NO: 745204 - RNA, 14 nt, Leptospira interrogans serovar lai str. 56601
acaagcuuuggauu

SEQ ID NO: 745205 - RNA, 21 nt, Leptospira interrogans serovar lai str. 56601
acaagcucaugauuauuacuc

SEQ ID NO: 745206 - RNA, 22 nt, Leptospira interrogans serovar lai str. 56601
acaaggcuuuguaauaaaaauu

SEQ ID NO: 745207 - RNA, 18 nt, Leptospira interrogans serovar lai str. 56601
acaauagcuucuuuaaaa

SEQ ID NO: 745208 - RNA, 21 nt, Leptospira interrogans serovar lai str. 56601
acaauauuuugucuuuaauuu

SEQ ID NO: 745209 - RNA, 15 nt, Leptospira interrogans serovar lai str. 56601
acaauauucuaauuu

SEQ ID NO: 745210 - RNA, 16 nt, Leptospira interrogans serovar lai str. 56601
acaauauucuaauuuu

SEQ ID NO: 745211 - RNA, 18 nt, Leptospira interrogans serovar lai str. 56601
acaauauucuaauuuuau

SEQ ID NO: 745212 - RNA, 17 nt, Leptospira interrogans serovar lai str. 56601
acaaucaauaaauugca

SEQ ID NO: 745213 - RNA, 15 nt, Leptospira interrogans serovar lai str. 56601
acaaugaauuuuuau

SEQ ID NO: 745214 - RNA, 19 nt, Leptospira interrogans serovar lai str. 56601
acaaugaauuuuuauaaaa

SEQ ID NO: 745215 - RNA, 15 nt, Leptospira interrogans serovar lai str. 56601
acaaucucugauaau

SEQ ID NO: 745216 - RNA, 22 nt, Leptospira interrogans serovar lai str. 56601
acaaucgaacggauucuaauuu

SEQ ID NO: 745217 - RNA, 20 nt, Leptospira interrogans serovar lai str. 56601
acaaucggagucauaacuug

SEQ ID NO: 745218 - RNA, 20 nt, Leptospira interrogans serovar lai str. 56601
acaaucggguaaaaaauacu

SEQ ID NO: 745219 - RNA, 14 nt, Leptospira interrogans serovar lai str. 56601
acaauuaaacuuca

SEQ ID NO: 745220 - RNA, 22 nt, Leptospira interrogans serovar lai str. 56601
acaauuaaacuucaaaaaauau

SEQ ID NO: 745221 - RNA, 22 nt, Leptospira interrogans serovar lai str. 56601
acaauucagauuccguuuuuau

SEQ ID NO: 745222 - RNA, 18 nt, Leptospira interrogans serovar lai str. 56601
acaaugcuuuccaaaagg

SEQ ID NO: 745223 - RNA, 15 nt, Leptospira interrogans serovar lai str. 56601
acaauucaucaccaa

SEQ ID NO: 745224 - RNA, 15 nt, Leptospira interrogans serovar lai str. 56601
acaauugauugcuuu

SEQ ID NO: 745225 - RNA, 17 nt, Leptospira interrogans serovar lai str. 56601
acaauugauugcuuuuu

SEQ ID NO: 745226 - RNA, 17 nt, Leptospira interrogans serovar lai str. 56601
acaauugauuuaaaaac

SEQ ID NO: 745227 - RNA, 14 nt, Leptospira interrogans serovar lai str. 56601
acaauucuagcaaa

SEQ ID NO: 745228 - RNA, 17 nt, Leptospira interrogans serovar lai str. 56601
acaauucucgauagaac

SEQ ID NO: 745229 - RNA, 23 nt, Leptospira interrogans serovar lai str. 56601
acaauucucgauagaacaaucuc

SEQ ID NO: 745230 - RNA, 14 nt, Leptospira interrogans serovar lai str. 56601
acaauucuuccuuu

SEQ ID NO: 745231 - RNA, 20 nt, Leptospira interrogans serovar lai str. 56601
acaauuuaucuaaaacacau

SEQ ID NO: 745232 - RNA, 14 nt, Leptospira interrogans serovar lai str. 56601
acaauuuuagaauu

SEQ ID NO: 745233 - RNA, 16 nt, Leptospira interrogans serovar lai str. 56601
acaauuugcuaaaaua

SEQ ID NO: 745234 - RNA, 15 nt, Leptospira interrogans serovar lai str. 56601
acaauuuuucucuau

SEQ ID NO: 745235 - RNA, 15 nt, Leptospira interrogans serovar lai str. 56601
acaauuuuuugaaaa

SEQ ID NO: 745236 - RNA, 16 nt, Leptospira interrogans serovar lai str. 56601
acaauuuuuugaaaaa

SEQ ID NO: 745237 - RNA, 17 nt, Leptospira interrogans serovar lai str. 56601
acaauuuuuugaaaaag

SEQ ID NO: 745238 - RNA, 23 nt, Leptospira interrogans serovar lai str. 56601
acaauuuugaauauuauagaaaa

SEQ ID NO: 745239 - RNA, 17 nt, Leptospira interrogans serovar lai str. 56601
acacaguuugaauuuua

SEQ ID NO: 745240 - RNA, 15 nt, Leptospira interrogans serovar lai str. 56601
acacaacgcucucua

SEQ ID NO: 745241 - RNA, 17 nt, Leptospira interrogans serovar lai str. 56601
acacaacgcucucuacg

SEQ ID NO: 745242 - RNA, 15 nt, Leptospira interrogans serovar lai str. 56601
acacaacgcucuuua

SEQ ID NO: 745243 - RNA, 15 nt, Leptospira interrogans serovar lai str. 56601
acacaaguuuggaaa

SEQ ID NO: 745244 - RNA, 23 nt, Leptospira interrogans serovar lai str. 56601
acacacuuuauaaaaguauaaua

SEQ ID NO: 745245 - RNA, 22 nt, Leptospira interrogans serovar lai str. 56601
acaacggcucucuccuauguuu

SEQ ID NO: 745246 - RNA, 16 nt, Leptospira interrogans serovar lai str. 56601
acaacguuacuuuuaa

SEQ ID NO: 745247 - RNA, 18 nt, Leptospira interrogans serovar lai str. 56601
acaacguuacuuuuaaga

SEQ ID NO: 745248 - RNA, 21 nt, Leptospira interrogans serovar lai str. 56601
acaacgcucucuccuauguuu

SEQ ID NO: 745249 - RNA, 21 nt, Leptospira interrogans serovar lai str. 56601
acaaccgaaaagguuaaaaau

SEQ ID NO: 745250 - RNA, 22 nt, Leptospira interrogans serovar lai str. 56601
acaaccgaaaagguuaaaaauu

SEQ ID NO: 745251 - RNA, 22 nt, Leptospira interrogans serovar lai str. 56601
acaacagaacaaaauuuacgaa

SEQ ID NO: 745252 - RNA, 19 nt, Leptospira interrogans serovar lai str. 56601
acaacauccuucaaacuuu

SEQ ID NO: 745253 - RNA, 21 nt, Leptospira interrogans serovar lai str. 56601
acaacauuagaauuguuugaa

SEQ ID NO: 745254 - RNA, 19 nt, Leptospira interrogans serovar lai str. 56601
acaacauugaguuugagaa

SEQ ID NO: 745255 - RNA, 20 nt, Leptospira interrogans serovar lai str. 56601
acaacauuaugaaucuuuca

SEQ ID NO: 745256 - RNA, 17 nt, Leptospira interrogans serovar lai str. 56601
acaacucuaauacaaaa

SEQ ID NO: 745257 - RNA, 20 nt, Leptospira interrogans serovar lai str. 56601
acaacucuaauacaaaaaau

SEQ ID NO: 745258 - RNA, 13 nt, Leptospira interrogans serovar lai str. 56601
acaacucuaauga

SEQ ID NO: 745259 - RNA, 17 nt, Leptospira interrogans serovar lai str. 56601
acaacucuauuaaagaa

SEQ ID NO: 745260 - RNA, 13 nt, Leptospira interrogans serovar lai str. 56601
acaacucuauuua

SEQ ID NO: 745261 - RNA, 13 nt, Leptospira interrogans serovar lai str. 56601
acaacucuauuuu

SEQ ID NO: 745262 - RNA, 22 nt, Leptospira interrogans serovar lai str. 56601
acaacucuauuuuauuuuucuu

SEQ ID NO: 745263 - RNA, 12 nt, Leptospira interrogans serovar lai str. 56601
acaacucuucuu

SEQ ID NO: 745264 - RNA, 14 nt, Leptospira interrogans serovar lai str. 56601
acaacuuuuuuaau

SEQ ID NO: 745265 - RNA, 19 nt, Leptospira interrogans serovar lai str. 56601
acaacuuugucguuuucag

SEQ ID NO: 745266 - RNA, 13 nt, Leptospira interrogans serovar lai str. 56601
acaagacaaacaa

SEQ ID NO: 745267 - RNA, 17 nt, Leptospira interrogans serovar lai str. 56601
acaagacaaacaaacau

SEQ ID NO: 745268 - RNA, 12 nt, Leptospira interrogans serovar lai str. 56601
acaagaaugagu

SEQ ID NO: 745269 - RNA, 22 nt, Leptospira interrogans serovar lai str. 56601
acaagacgcuacucgaauuuau

SEQ ID NO: 745270 - RNA, 16 nt, Leptospira interrogans serovar lai str. 56601
acaagacuucuauacu

SEQ ID NO: 745271 - RNA, 22 nt, Leptospira interrogans serovar lai str. 56601
acaagacuucuauacucuucaa

SEQ ID NO: 745272 - RNA, 14 nt, Leptospira interrogans serovar lai str. 56601
acaagauuaacaau

SEQ ID NO: 745273 - RNA, 22 nt, Leptospira interrogans serovar lai str. 56601
acaagauuucguucggaaaaaa

SEQ ID NO: 745274 - RNA, 13 nt, Leptospira interrogans serovar lai str. 56601
acaaaucgaagau

SEQ ID NO: 745275 - RNA, 20 nt, Leptospira interrogans serovar lai str. 56601
acaaaucacgauuuuacaaa

SEQ ID NO: 745276 - RNA, 19 nt, Leptospira interrogans serovar lai str. 56601
acaaaucagguuuuuacag

SEQ ID NO: 745277 - RNA, 22 nt, Leptospira interrogans serovar lai str. 56601
acaaaucauaggauacaaaacu

SEQ ID NO: 745278 - RNA, 22 nt, Leptospira interrogans serovar lai str. 56601
acaaaucaucccgcccaaagua

SEQ ID NO: 745279 - RNA, 15 nt, Leptospira interrogans serovar lai str. 56601
acaaaucuauauuuu

SEQ ID NO: 745280 - RNA, 19 nt, Leptospira interrogans serovar lai str. 56601
acaaaucuauauuuuacag

SEQ ID NO: 745281 - RNA, 20 nt, Leptospira interrogans serovar lai str. 56601
acaaaucuauauuuuacagu

SEQ ID NO: 745282 - RNA, 15 nt, Leptospira interrogans serovar lai str. 56601
acaaaucuaaauuuu

SEQ ID NO: 745283 - RNA, 18 nt, Leptospira interrogans serovar lai str. 56601
acaaaucuaaauuuuaca

SEQ ID NO: 745284 - RNA, 18 nt, Leptospira interrogans serovar lai str. 56601
acaaaucgacgauuuuac

SEQ ID NO: 745285 - RNA, 18 nt, Leptospira interrogans serovar lai str. 56601
acaaaucgugaauuuaca

SEQ ID NO: 745286 - RNA, 20 nt, Leptospira interrogans serovar lai str. 56601
acaaauaaaacuucuccuuu

SEQ ID NO: 745287 - RNA, 14 nt, Leptospira interrogans serovar lai str. 56601
acaaauaaaaggag

SEQ ID NO: 745288 - RNA, 21 nt, Leptospira interrogans serovar lai str. 56601
acaaaucacauccaacccaaa

SEQ ID NO: 745289 - RNA, 21 nt, Leptospira interrogans serovar lai str. 56601
acaaauagagugccaaaauuu

SEQ ID NO: 745290 - RNA, 13 nt, Leptospira interrogans serovar lai str. 56601
acaaauugucaaa

SEQ ID NO: 745291 - RNA, 22 nt, Leptospira interrogans serovar lai str. 56601
acaaauucuaaaguuguaggaa

SEQ ID NO: 745292 - RNA, 21 nt, Leptospira interrogans serovar lai str. 56601
acaaauugaguuucuuuuugc

SEQ ID NO: 745293 - RNA, 15 nt, Leptospira interrogans serovar lai str. 56601
acaaauuaaguuuaa

SEQ ID NO: 745294 - RNA, 21 nt, Leptospira interrogans serovar lai str. 56601
acaaauuccaauuuuucugaa

SEQ ID NO: 745295 - RNA, 22 nt, Leptospira interrogans serovar lai str. 56601
acaaauuccgucauaaguguau

SEQ ID NO: 745296 - RNA, 18 nt, Leptospira interrogans serovar lai str. 56601
acaaauuaugauuucacg

SEQ ID NO: 745297 - RNA, 19 nt, Leptospira interrogans serovar lai str. 56601
acaaauuaguauuuuucuu

SEQ ID NO: 745298 - RNA, 21 nt, Leptospira interrogans serovar lai str. 56601
acaaauuaguauuuuucuuaa

SEQ ID NO: 745299 - RNA, 14 nt, Leptospira interrogans serovar lai str. 56601
acaaauuuuauaua

SEQ ID NO: 745300 - RNA, 15 nt, Leptospira interrogans serovar lai str. 56601
acaaagugaugaaga

SEQ ID NO: 745301 - RNA, 18 nt, Leptospira interrogans serovar lai str. 56601
acaaagugaugaagagaa

SEQ ID NO: 745302 - RNA, 19 nt, Leptospira interrogans serovar lai str. 56601
acaaaguauuuaauuuuaa

SEQ ID NO: 745303 - RNA, 12 nt, Leptospira interrogans serovar lai str. 56601
acaaaguauuuu

SEQ ID NO: 745304 - RNA, 16 nt, Leptospira interrogans serovar lai str. 56601
acaaagaguuuaaaaa

SEQ ID NO: 745305 - RNA, 18 nt, Leptospira interrogans serovar lai str. 56601
acaaagaguuuaaaaaau

SEQ ID NO: 745306 - RNA, 22 nt, Leptospira interrogans serovar lai str. 56601
acaaagccgcacaaaccaaaac

SEQ ID NO: 745307 - RNA, 15 nt, Leptospira interrogans serovar lai str. 56601
acaaagacaaaguau

SEQ ID NO: 745308 - RNA, 19 nt, Leptospira interrogans serovar lai str. 56601
acaaacucuuuauuuuuaa

SEQ ID NO: 745309 - RNA, 14 nt, Leptospira interrogans serovar lai str. 56601
acaaacgguuuuag

SEQ ID NO: 745310 - RNA, 13 nt, Leptospira interrogans serovar lai str. 56601
acaaacuauucua

SEQ ID NO: 745311 - RNA, 14 nt, Leptospira interrogans serovar lai str. 56601
acaaacuauucuau

SEQ ID NO: 745312 - RNA, 18 nt, Leptospira interrogans serovar lai str. 56601
acaaaaaaugcucaaaaa

SEQ ID NO: 745313 - RNA, 15 nt, Leptospira interrogans serovar lai str. 56601
acaaaaaaauucaua

SEQ ID NO: 745314 - RNA, 17 nt, Leptospira interrogans serovar lai str. 56601
acaaaaaaauucuccuc

SEQ ID NO: 745315 - RNA, 16 nt, Leptospira interrogans serovar lai str. 56601
acaaaaaauucuuuuu

SEQ ID NO: 745316 - RNA, 17 nt, Leptospira interrogans serovar lai str. 56601
acaaaaacaaauucacg

SEQ ID NO: 745317 - RNA, 16 nt, Leptospira interrogans serovar lai str. 56601
acaaaaaauguuuaaa

SEQ ID NO: 745318 - RNA, 16 nt, Leptospira interrogans serovar lai str. 56601
acaaaacuacuucaau

SEQ ID NO: 745319 - RNA, 15 nt, Leptospira interrogans serovar lai str. 56601
acaaaacuuaaguuu

SEQ ID NO: 745320 - RNA, 22 nt, Leptospira interrogans serovar lai str. 56601
acaaaaaguguuuauaauuuuu

SEQ ID NO: 745321 - RNA, 14 nt, Leptospira interrogans serovar lai str. 56601
acaaaaauacuuua

SEQ ID NO: 745322 - RNA, 14 nt, Leptospira interrogans serovar lai str. 56601
acaaaaaugagaau

SEQ ID NO: 745323 - RNA, 15 nt, Leptospira interrogans serovar lai str. 56601
acaaaaguagaaaga

SEQ ID NO: 745324 - RNA, 17 nt, Leptospira interrogans serovar lai str. 56601
acaaaagcguuguauaa

SEQ ID NO: 745325 - RNA, 12 nt, Leptospira interrogans serovar lai str. 56601
acaaaaucugaa

SEQ ID NO: 745326 - RNA, 21 nt, Leptospira interrogans serovar lai str. 56601
acaaaaucacgauuuuacgaa

SEQ ID NO: 745327 - RNA, 18 nt, Leptospira interrogans serovar lai str. 56601
acaaaaugcuguaacuca

SEQ ID NO: 745328 - RNA, 15 nt, Leptospira interrogans serovar lai str. 56601
acaaaaugauuuacu

SEQ ID NO: 745329 - RNA, 23 nt, Leptospira interrogans serovar lai str. 56601
acaaaauuuuuuccuuuaaacuu

SEQ ID NO: 745330 - RNA, 11 nt, Leptospira interrogans serovar lai str. 56601
acaaaauuuac

SEQ ID NO: 745331 - RNA, 13 nt, Leptospira interrogans serovar lai str. 56601
acaaaauuuagaa

SEQ ID NO: 745332 - RNA, 13 nt, Leptospira interrogans serovar lai str. 56601
acaaaauuuaaaa

SEQ ID NO: 745333 - RNA, 13 nt, Leptospira interrogans serovar lai str. 56601
aauuuuugaauca

SEQ ID NO: 745334 - RNA, 12 nt, Leptospira interrogans serovar lai str. 56601
aauuuuucuuaa

SEQ ID NO: 745335 - RNA, 13 nt, Leptospira interrogans serovar lai str. 56601
aauuuuucucccu

SEQ ID NO: 745336 - RNA, 23 nt, Leptospira interrogans serovar lai str. 56601
aauuuuucgaaacaaaaucaaag

SEQ ID NO: 745337 - RNA, 16 nt, Leptospira interrogans serovar lai str. 56601
aauuuuuaacgugagu

SEQ ID NO: 745338 - RNA, 16 nt, Leptospira interrogans serovar lai str. 56601
aauuuuuaagaauaau

SEQ ID NO: 745339 - RNA, 16 nt, Leptospira interrogans serovar lai str. 56601
aauuuuuaauaaaaua

SEQ ID NO: 745340 - RNA, 17 nt, Leptospira interrogans serovar lai str. 56601
aauuuuuaauaaaaugc

SEQ ID NO: 745341 - RNA, 13 nt, Leptospira interrogans serovar lai str. 56601
aauuuuuaaucaa

SEQ ID NO: 745342 - RNA, 22 nt, Leptospira interrogans serovar lai str. 56601
aauuuuuacauuuucgaaauuu

SEQ ID NO: 745343 - RNA, 11 nt, Leptospira interrogans serovar lai str. 56601
aauuuuuagag

SEQ ID NO: 745344 - RNA, 14 nt, Leptospira interrogans serovar lai str. 56601
aauuuuuagagugu

SEQ ID NO: 745345 - RNA, 14 nt, Leptospira interrogans serovar lai str. 56601
aauuuuuagaguuu

SEQ ID NO: 745346 - RNA, 16 nt, Leptospira interrogans serovar lai str. 56601
aauuuuuauaaaaaua

SEQ ID NO: 745347 - RNA, 15 nt, Leptospira interrogans serovar lai str. 56601
aauuuuuauaaaaua

SEQ ID NO: 745348 - RNA, 15 nt, Leptospira interrogans serovar lai str. 56601
aauuuuucaaaaacu

SEQ ID NO: 745349 - RNA, 16 nt, Leptospira interrogans serovar lai str. 56601
aauuuuucaaaaacuc

SEQ ID NO: 745350 - RNA, 20 nt, Leptospira interrogans serovar lai str. 56601
aauuuugcucacucauuuuu

SEQ ID NO: 745351 - RNA, 17 nt, Leptospira interrogans serovar lai str. 56601
aauuuuuauuggaaaaa

SEQ ID NO: 745352 - RNA, 20 nt, Leptospira interrogans serovar lai str. 56601
aauuuuuaucauaaaacacu

SEQ ID NO: 745353 - RNA, 17 nt, Leptospira interrogans serovar lai str. 56601
aauuuuuuagaaacuau

SEQ ID NO: 745354 - RNA, 22 nt, Leptospira interrogans serovar lai str. 56601
aauuuuuuagaguuaagagaau

SEQ ID NO: 745355 - RNA, 15 nt, Leptospira interrogans serovar lai str. 56601
aauuuuuguacaaaa

SEQ ID NO: 745356 - RNA, 17 nt, Leptospira interrogans serovar lai str. 56601
aauuuuuucuuuuuagg

SEQ ID NO: 745357 - RNA, 14 nt, Leptospira interrogans serovar lai str. 56601
aauuuuuugaaaaa

SEQ ID NO: 745358 - RNA, 24 nt, Leptospira interrogans serovar lai str. 56601
aauuuuuugagguuuugagacaaa

SEQ ID NO: 745359 - RNA, 22 nt, Leptospira interrogans serovar lai str. 56601
aauuuuuuauuuuaugaauaaa

SEQ ID NO: 745360 - RNA, 17 nt, Leptospira interrogans serovar lai str. 56601
aauuuuuuaaaaauuuu

SEQ ID NO: 745361 - RNA, 19 nt, Leptospira interrogans serovar lai str. 56601
aauuuuuuaacaacucuaa

SEQ ID NO: 745362 - RNA, 20 nt, Leptospira interrogans serovar lai str. 56601
aauuuuuuaacaacucuaau

SEQ ID NO: 745363 - RNA, 15 nt, Leptospira interrogans serovar lai str. 56601
aauuuuuucacaaaa

SEQ ID NO: 745364 - RNA, 17 nt, Leptospira interrogans serovar lai str. 56601
aauuuuuucguuccuuu

SEQ ID NO: 745365 - RNA, 21 nt, Leptospira interrogans serovar lai str. 56601
aauuuuuuuguaaaaaaauag

SEQ ID NO: 745366 - RNA, 22 nt, Leptospira interrogans serovar lai str. 56601
aauuuuuuuguaaaaaaauaga

SEQ ID NO: 745367 - RNA, 15 nt, Leptospira interrogans serovar lai str. 56601
aauuuuuuuguauau

SEQ ID NO: 745368 - RNA, 19 nt, Leptospira interrogans serovar lai str. 56601
aauuuuuuucaguauguuu

SEQ ID NO: 745369 - RNA, 17 nt, Leptospira interrogans serovar lai str. 56601
aauuuuuuucuaaaaua

SEQ ID NO: 745370 - RNA, 15 nt, Leptospira interrogans serovar lai str. 56601
aauuuuuuuaaaaau

SEQ ID NO: 745371 - RNA, 12 nt, Leptospira interrogans serovar lai str. 56601
aauuuuuuuaag

SEQ ID NO: 745372 - RNA, 13 nt, Leptospira interrogans serovar lai str. 56601
aauuuuuuuaaga

SEQ ID NO: 745373 - RNA, 16 nt, Leptospira interrogans serovar lai str. 56601
aauuuuuuuaagaauu

SEQ ID NO: 745374 - RNA, 23 nt, Leptospira interrogans serovar lai str. 56601
aauuuuuuuaagagccuacaaau

SEQ ID NO: 745375 - RNA, 20 nt, Leptospira interrogans serovar lai str. 56601
aauuuuuuggaaauuuuuaa

SEQ ID NO: 745376 - RNA, 13 nt, Leptospira interrogans serovar lai str. 56601
aauuuugaauauu

SEQ ID NO: 745377 - RNA, 18 nt, Leptospira interrogans serovar lai str. 56601
aauuuugaagacuauaaa

SEQ ID NO: 745378 - RNA, 21 nt, Leptospira interrogans serovar lai str. 56601
aauuuugaaggaaauuuuguu

SEQ ID NO: 745379 - RNA, 18 nt, Leptospira interrogans serovar lai str. 56601
aauuuucuuguuuaaauc

SEQ ID NO: 745380 - RNA, 16 nt, Leptospira interrogans serovar lai str. 56601
aauuuucuuuagaaau

SEQ ID NO: 745381 - RNA, 12 nt, Leptospira interrogans serovar lai str. 56601
aauuuuuaaaua

SEQ ID NO: 745382 - RNA, 13 nt, Leptospira interrogans serovar lai str. 56601
aauuuuuaaaaaa

SEQ ID NO: 745383 - RNA, 15 nt, Leptospira interrogans serovar lai str. 56601
aauuuuuaaaaaauu

SEQ ID NO: 745384 - RNA, 13 nt, Leptospira interrogans serovar lai str. 56601
aauuuuuaaaaag

SEQ ID NO: 745385 - RNA, 21 nt, Leptospira interrogans serovar lai str. 56601
aauuuuguuugaauccaaaag

SEQ ID NO: 745386 - RNA, 18 nt, Leptospira interrogans serovar lai str. 56601
aauuuugcuucuaaaaag

SEQ ID NO: 745387 - RNA, 17 nt, Leptospira interrogans serovar lai str. 56601
aauuuuauuuauauaua

SEQ ID NO: 745388 - RNA, 14 nt, Leptospira interrogans serovar lai str. 56601
aauuuucaaaaaau

SEQ ID NO: 745389 - RNA, 21 nt, Leptospira interrogans serovar lai str. 56601
aauuuuccagaucauuuugua

SEQ ID NO: 745390 - RNA, 22 nt, Leptospira interrogans serovar lai str. 56601
aauuuuccgaaccuuaccaccc

SEQ ID NO: 745391 - RNA, 23 nt, Leptospira interrogans serovar lai str. 56601
aauuuuccgccccacccaaaaau

SEQ ID NO: 745392 - RNA, 21 nt, Leptospira interrogans serovar lai str. 56601
aauuuuccggacuuuccagaa

SEQ ID NO: 745393 - RNA, 22 nt, Leptospira interrogans serovar lai str. 56601
aauuuuccggacuuuccagaaa

SEQ ID NO: 745394 - RNA, 16 nt, Leptospira interrogans serovar lai str. 56601
aauuuucucaaaaaau

SEQ ID NO: 745395 - RNA, 18 nt, Leptospira interrogans serovar lai str. 56601
aauuuucgauuuaauaua

SEQ ID NO: 745396 - RNA, 21 nt, Leptospira interrogans serovar lai str. 56601
aauuuucgauuuaauauauuu

SEQ ID NO: 745397 - RNA, 19 nt, Leptospira interrogans serovar lai str. 56601
aauuuucguuuuaguuccc

SEQ ID NO: 745398 - RNA, 15 nt, Leptospira interrogans serovar lai str. 56601
aauuuucuaaaagua

SEQ ID NO: 745399 - RNA, 23 nt, Leptospira interrogans serovar lai str. 56601
aauuugcuucaacacugagucaa

SEQ ID NO: 745400 - RNA, 14 nt, Leptospira interrogans serovar lai str. 56601
aauuugcgaaaaaa

SEQ ID NO: 745401 - RNA, 14 nt, Leptospira interrogans serovar lai str. 56601
aauuugcuaaaaua

SEQ ID NO: 745402 - RNA, 15 nt, Leptospira interrogans serovar lai str. 56601
aauuugcuaaaauaa

SEQ ID NO: 745403 - RNA, 13 nt, Leptospira interrogans serovar lai str. 56601
aauuugaauuuaa

SEQ ID NO: 745404 - RNA, 21 nt, Leptospira interrogans serovar lai str. 56601
aauuugaauauaauaaaauua

SEQ ID NO: 745405 - RNA, 13 nt, Leptospira interrogans serovar lai str. 56601
aauuucuuuuuau

SEQ ID NO: 745406 - RNA, 14 nt, Leptospira interrogans serovar lai str. 56601
aauuucuuuuuaua

SEQ ID NO: 745407 - RNA, 15 nt, Leptospira interrogans serovar lai str. 56601
aauuuuaagaacaau

SEQ ID NO: 745408 - RNA, 22 nt, Leptospira interrogans serovar lai str. 56601
aauuuuacaaacaaauuccgaa

SEQ ID NO: 745409 - RNA, 20 nt, Leptospira interrogans serovar lai str. 56601
aauuuuacacguaauucuuu

SEQ ID NO: 745410 - RNA, 19 nt, Leptospira interrogans serovar lai str. 56601
aauuuuacagauugauucu

SEQ ID NO: 745411 - RNA, 12 nt, Leptospira interrogans serovar lai str. 56601
aauuuuaaauaa

SEQ ID NO: 745412 - RNA, 14 nt, Leptospira interrogans serovar lai str. 56601
aauuuuaaauaaua

SEQ ID NO: 745413 - RNA, 18 nt, Leptospira interrogans serovar lai str. 56601
aauuuuaaaucgacaaaa

SEQ ID NO: 745414 - RNA, 11 nt, Leptospira interrogans serovar lai str. 56601
aauuuuaaaua

SEQ ID NO: 745415 - RNA, 22 nt, Leptospira interrogans serovar lai str. 56601
aauuuguuuuuggaaauguuuu

SEQ ID NO: 745416 - RNA, 19 nt, Leptospira interrogans serovar lai str. 56601
aauuuuaaagaaugaucaa

SEQ ID NO: 745417 - RNA, 23 nt, Leptospira interrogans serovar lai str. 56601
aauuuguggagcucgauuuuaua

SEQ ID NO: 745418 - RNA, 15 nt, Leptospira interrogans serovar lai str. 56601
aauuuguaggaacua

SEQ ID NO: 745419 - RNA, 18 nt, Leptospira interrogans serovar lai str. 56601
aauuuguaggaacuacug

SEQ ID NO: 745420 - RNA, 13 nt, Leptospira interrogans serovar lai str. 56601
aauuuguaggaau

SEQ ID NO: 745421 - RNA, 16 nt, Leptospira interrogans serovar lai str. 56601
aauuuuacccugguuu

SEQ ID NO: 745422 - RNA, 18 nt, Leptospira interrogans serovar lai str. 56601
aauuuuacgcaaucauuc

SEQ ID NO: 745423 - RNA, 23 nt, Leptospira interrogans serovar lai str. 56601
aauuuuacgcaaucauucuuuag

SEQ ID NO: 745424 - RNA, 16 nt, Leptospira interrogans serovar lai str. 56601
aauuuuaauuguaaaa

SEQ ID NO: 745425 - RNA, 12 nt, Leptospira interrogans serovar lai str. 56601
aauuuuacuaaa

SEQ ID NO: 745426 - RNA, 17 nt, Leptospira interrogans serovar lai str. 56601
aauuuuacuuauacaac

SEQ ID NO: 745427 - RNA, 17 nt, Leptospira interrogans serovar lai str. 56601
aauuuuagaauaucuua

SEQ ID NO: 745428 - RNA, 20 nt, Leptospira interrogans serovar lai str. 56601
aauuuuagaauaucuuaaua

SEQ ID NO: 745429 - RNA, 20 nt, Leptospira interrogans serovar lai str. 56601
aauuuuagaauuuauuugua

SEQ ID NO: 745430 - RNA, 22 nt, Leptospira interrogans serovar lai str. 56601
aauuuuagacaaaaaauucuuu

SEQ ID NO: 745431 - RNA, 16 nt, Leptospira interrogans serovar lai str. 56601
aauuuuauguagaaau

SEQ ID NO: 745432 - RNA, 14 nt, Leptospira interrogans serovar lai str. 56601
aauuuuauaguaua

SEQ ID NO: 745433 - RNA, 20 nt, Leptospira interrogans serovar lai str. 56601
aauuuuauauagaacuuuuc

SEQ ID NO: 745434 - RNA, 15 nt, Leptospira interrogans serovar lai str. 56601
aauuucugaaacaau

SEQ ID NO: 745435 - RNA, 13 nt, Leptospira interrogans serovar lai str. 56601
aauuucuucuuuu

SEQ ID NO: 745436 - RNA, 23 nt, Leptospira interrogans serovar lai str. 56601
aauuucuucuuuuguuuuuauaa

SEQ ID NO: 745437 - RNA, 14 nt, Leptospira interrogans serovar lai str. 56601
aauuucugcaugaa

SEQ ID NO: 745438 - RNA, 23 nt, Leptospira interrogans serovar lai str. 56601
aauuucuaauaaaauaugaguuu

SEQ ID NO: 745439 - RNA, 14 nt, Leptospira interrogans serovar lai str. 56601
aauuucuauaaaau

SEQ ID NO: 745440 - RNA, 13 nt, Leptospira interrogans serovar lai str. 56601
aauuucuaaaagu

SEQ ID NO: 745441 - RNA, 12 nt, Leptospira interrogans serovar lai str. 56601
aauuucuaaaau

SEQ ID NO: 745442 - RNA, 14 nt, Leptospira interrogans serovar lai str. 56601
aauuucuaaagaau

SEQ ID NO: 745443 - RNA, 17 nt, Leptospira interrogans serovar lai str. 56601
aauuucauuuuacugcu

SEQ ID NO: 745444 - RNA, 15 nt, Leptospira interrogans serovar lai str. 56601
aauuuccuaaaagua

SEQ ID NO: 745445 - RNA, 19 nt, Leptospira interrogans serovar lai str. 56601
aauuucccgauucucaaaa

SEQ ID NO: 745446 - RNA, 21 nt, Leptospira interrogans serovar lai str. 56601
aauuuccauuaauuacagaau

SEQ ID NO: 745447 - RNA, 16 nt, Leptospira interrogans serovar lai str. 56601
aauuuccauuucugac

SEQ ID NO: 745448 - RNA, 18 nt, Leptospira interrogans serovar lai str. 56601
aauuuccaaacuacaaau

SEQ ID NO: 745449 - RNA, 16 nt, Leptospira interrogans serovar lai str. 56601
aauuuccaaacucaau

SEQ ID NO: 745450 - RNA, 16 nt, Leptospira interrogans serovar lai str. 56601
aauuuccacuucaaaa

SEQ ID NO: 745451 - RNA, 20 nt, Leptospira interrogans serovar lai str. 56601
aauuuccacuucaaaaagac

SEQ ID NO: 745452 - RNA, 19 nt, Leptospira interrogans serovar lai str. 56601
aauuauacuauaaguuuac

SEQ ID NO: 745453 - RNA, 12 nt, Leptospira interrogans serovar lai str. 56601
aauuauacaaaa

SEQ ID NO: 745454 - RNA, 14 nt, Leptospira interrogans serovar lai str. 56601
aauuauaaaauuuu

SEQ ID NO: 745455 - RNA, 10 nt, Leptospira interrogans serovar lai str. 56601
acucuugaag

SEQ ID NO: 745456 - RNA, 12 nt, Leptospira interrogans serovar lai str. 56601
acucuuucaaag

SEQ ID NO: 745457 - RNA, 12 nt, Leptospira interrogans serovar lai str. 56601
acucuucuucua

SEQ ID NO: 745458 - RNA, 18 nt, Leptospira interrogans serovar lai str. 56601
acucuucuucuagauuuu

SEQ ID NO: 745459 - RNA, 13 nt, Leptospira interrogans serovar lai str. 56601
acugaauaaaaag

SEQ ID NO: 745460 - RNA, 21 nt, Leptospira interrogans serovar lai str. 56601
acucgcaaacguccagauaug

SEQ ID NO: 745461 - RNA, 13 nt, Leptospira interrogans serovar lai str. 56601
acucccugauaac

SEQ ID NO: 745462 - RNA, 21 nt, Leptospira interrogans serovar lai str. 56601
acucuauucauaaaugauaau

SEQ ID NO: 745463 - RNA, 16 nt, Leptospira interrogans serovar lai str. 56601
acucuauuuaaguacu

SEQ ID NO: 745464 - RNA, 14 nt, Leptospira interrogans serovar lai str. 56601
acucuauuaaagaa

SEQ ID NO: 745465 - RNA, 21 nt, Leptospira interrogans serovar lai str. 56601
acucguuuuuaguuucuuuuu

SEQ ID NO: 745466 - RNA, 17 nt, Leptospira interrogans serovar lai str. 56601
acucgguguaaaaaaau

SEQ ID NO: 745467 - RNA, 22 nt, Leptospira interrogans serovar lai str. 56601
acucgguguaaaaaaauuuucu

SEQ ID NO: 745468 - RNA, 21 nt, Leptospira interrogans serovar lai str. 56601
acuaugaaauacaaaaagaau

SEQ ID NO: 745469 - RNA, 17 nt, Leptospira interrogans serovar lai str. 56601
acucacaccuucuuuuu

SEQ ID NO: 745470 - RNA, 18 nt, Leptospira interrogans serovar lai str. 56601
acucacaccuucuuuuuu

SEQ ID NO: 745471 - RNA, 16 nt, Leptospira interrogans serovar lai str. 56601
acuaugaaauuuuuca

SEQ ID NO: 745472 - RNA, 11 nt, Leptospira interrogans serovar lai str. 56601
acuaugaagac

SEQ ID NO: 745473 - RNA, 15 nt, Leptospira interrogans serovar lai str. 56601
acuaucgcaaauaau

SEQ ID NO: 745474 - RNA, 16 nt, Leptospira interrogans serovar lai str. 56601
acuaucuacccacucu

SEQ ID NO: 745475 - RNA, 22 nt, Leptospira interrogans serovar lai str. 56601
acucagagcgauauaauaaaau

SEQ ID NO: 745476 - RNA, 15 nt, Leptospira interrogans serovar lai str. 56601
acucacgcuaaaaua

SEQ ID NO: 745477 - RNA, 21 nt, Leptospira interrogans serovar lai str. 56601
acucacguuaaguaggaacua

SEQ ID NO: 745478 - RNA, 19 nt, Leptospira interrogans serovar lai str. 56601
acucacguuauuuuaacuu

SEQ ID NO: 745479 - RNA, 14 nt, Leptospira interrogans serovar lai str. 56601
acucaguaaaacgc

SEQ ID NO: 745480 - RNA, 15 nt, Leptospira interrogans serovar lai str. 56601
acucagaugaaaguu

SEQ ID NO: 745481 - RNA, 19 nt, Leptospira interrogans serovar lai str. 56601
acucccacuuuuaaagaaa

SEQ ID NO: 745482 - RNA, 20 nt, Leptospira interrogans serovar lai str. 56601
acucccacuuuuaaagaaag

SEQ ID NO: 745483 - RNA, 12 nt, Leptospira interrogans serovar lai str. 56601
acuccauucuua

SEQ ID NO: 745484 - RNA, 13 nt, Leptospira interrogans serovar lai str. 56601
acuccauucuuac

SEQ ID NO: 745485 - RNA, 18 nt, Leptospira interrogans serovar lai str. 56601
acucauucaaguaacgag

SEQ ID NO: 745486 - RNA, 12 nt, Leptospira interrogans serovar lai str. 56601
acucauuuuuag

SEQ ID NO: 745487 - RNA, 14 nt, Leptospira interrogans serovar lai str. 56601
acucauuuuuagau

SEQ ID NO: 745488 - RNA, 14 nt, Leptospira interrogans serovar lai str. 56601
acucauucuaguuu

SEQ ID NO: 745489 - RNA, 22 nt, Leptospira interrogans serovar lai str. 56601
acucauucuugucggaacacuu

SEQ ID NO: 745490 - RNA, 18 nt, Leptospira interrogans serovar lai str. 56601
acucauauagaaauuaua

SEQ ID NO: 745491 - RNA, 18 nt, Leptospira interrogans serovar lai str. 56601
acucauacuucuaaaaaa

SEQ ID NO: 745492 - RNA, 13 nt, Leptospira interrogans serovar lai str. 56601
acuauauucuucg

SEQ ID NO: 745493 - RNA, 12 nt, Leptospira interrogans serovar lai str. 56601
acuauagagaaa

SEQ ID NO: 745494 - RNA, 17 nt, Leptospira interrogans serovar lai str. 56601
acuauagagaaauccaa

SEQ ID NO: 745495 - RNA, 16 nt, Leptospira interrogans serovar lai str. 56601
acuacagaauaaagua

SEQ ID NO: 745496 - RNA, 21 nt, Leptospira interrogans serovar lai str. 56601
acuacagaauuuuuuaacaau

SEQ ID NO: 745497 - RNA, 16 nt, Leptospira interrogans serovar lai str. 56601
acuacagacaauccua

SEQ ID NO: 745498 - RNA, 15 nt, Leptospira interrogans serovar lai str. 56601
acuacaaucacuuua

SEQ ID NO: 745499 - RNA, 17 nt, Leptospira interrogans serovar lai str. 56601
acuacaauuaaaaagau

SEQ ID NO: 745500 - RNA, 23 nt, Leptospira interrogans serovar lai str. 56601
acuacaaaucacgauuuuacaaa

SEQ ID NO: 745501 - RNA, 19 nt, Leptospira interrogans serovar lai str. 56601
acuaaucucuauaaaagua

SEQ ID NO: 745502 - RNA, 15 nt, Leptospira interrogans serovar lai str. 56601
acuacaaaaauuuaa

SEQ ID NO: 745503 - RNA, 16 nt, Leptospira interrogans serovar lai str. 56601
acuacaaaaauuuaau

SEQ ID NO: 745504 - RNA, 21 nt, Leptospira interrogans serovar lai str. 56601
acuaauuuguaggaauuacua

SEQ ID NO: 745505 - RNA, 23 nt, Leptospira interrogans serovar lai str. 56601
acuaauuuuaguuuauuuuaaaa

SEQ ID NO: 745506 - RNA, 12 nt, Leptospira interrogans serovar lai str. 56601
acuacuaauuua

SEQ ID NO: 745507 - RNA, 14 nt, Leptospira interrogans serovar lai str. 56601
acuacuacaaaaau

SEQ ID NO: 745508 - RNA, 15 nt, Leptospira interrogans serovar lai str. 56601
acuacuacaaaucac

SEQ ID NO: 745509 - RNA, 16 nt, Leptospira interrogans serovar lai str. 56601
acuacuauaaauuacu

SEQ ID NO: 745510 - RNA, 12 nt, Leptospira interrogans serovar lai str. 56601
acuacuaugaaa

SEQ ID NO: 745511 - RNA, 16 nt, Leptospira interrogans serovar lai str. 56601
acuaaauuauuuucaa

SEQ ID NO: 745512 - RNA, 17 nt, Leptospira interrogans serovar lai str. 56601
acuaaauuauuuucaag

SEQ ID NO: 745513 - RNA, 21 nt, Leptospira interrogans serovar lai str. 56601
acuaaauuaaguuuauucaau

SEQ ID NO: 745514 - RNA, 19 nt, Leptospira interrogans serovar lai str. 56601
acuaaauccuucuuuucuu

SEQ ID NO: 745515 - RNA, 16 nt, Leptospira interrogans serovar lai str. 56601
acuaaaucagaauaau

SEQ ID NO: 745516 - RNA, 13 nt, Leptospira interrogans serovar lai str. 56601
acuaaauuuuucg

SEQ ID NO: 745517 - RNA, 18 nt, Leptospira interrogans serovar lai str. 56601
acuaaguuaagcugaaaa

SEQ ID NO: 745518 - RNA, 12 nt, Leptospira interrogans serovar lai str. 56601
acuaaguuuaac

SEQ ID NO: 745519 - RNA, 12 nt, Leptospira interrogans serovar lai str. 56601
acuaaggcccac

SEQ ID NO: 745520 - RNA, 14 nt, Leptospira interrogans serovar lai str. 56601
acuaauaaaaacaa

SEQ ID NO: 745521 - RNA, 20 nt, Leptospira interrogans serovar lai str. 56601
acuaacuacaucaguauuuu

SEQ ID NO: 745522 - RNA, 17 nt, Leptospira interrogans serovar lai str. 56601
acgggaauaaaaacaaa

SEQ ID NO: 745523 - RNA, 19 nt, Leptospira interrogans serovar lai str. 56601
acguagauuacuaugaaaa

SEQ ID NO: 745524 - RNA, 23 nt, Leptospira interrogans serovar lai str. 56601
acguaggaaaugaaaaagaauuu

SEQ ID NO: 745525 - RNA, 18 nt, Leptospira interrogans serovar lai str. 56601
acgucauaguucccacaa

SEQ ID NO: 745526 - RNA, 20 nt, Leptospira interrogans serovar lai str. 56601
acgucauaguucccacaaau

SEQ ID NO: 745527 - RNA, 19 nt, Leptospira interrogans serovar lai str. 56601
acguauguguaaugauuuc

SEQ ID NO: 745528 - RNA, 23 nt, Leptospira interrogans serovar lai str. 56601
acguauuauccauuucuauaaau

SEQ ID NO: 745529 - RNA, 20 nt, Leptospira interrogans serovar lai str. 56601
acgugucauguuuuaaugaa

SEQ ID NO: 745530 - RNA, 21 nt, Leptospira interrogans serovar lai str. 56601
acgugaauucgacguaaggaa

SEQ ID NO: 745531 - RNA, 21 nt, Leptospira interrogans serovar lai str. 56601
acgugaauuuggcgguuaaaa

SEQ ID NO: 745532 - RNA, 21 nt, Leptospira interrogans serovar lai str. 56601
acgugacaaacuaaauuuuuc

SEQ ID NO: 745533 - RNA, 21 nt, Leptospira interrogans serovar lai str. 56601
acgugauucagaguaaggaaa

SEQ ID NO: 745534 - RNA, 23 nt, Leptospira interrogans serovar lai str. 56601
acgugaguuugacguaaaaaaau

SEQ ID NO: 745535 - RNA, 23 nt, Leptospira interrogans serovar lai str. 56601
acgugagcucuauguaagaaaau

SEQ ID NO: 745536 - RNA, 15 nt, Leptospira interrogans serovar lai str. 56601
acgugaguucagaca

SEQ ID NO: 745537 - RNA, 21 nt, Leptospira interrogans serovar lai str. 56601
acgugaguucgacguaagaau

SEQ ID NO: 745538 - RNA, 13 nt, Leptospira interrogans serovar lai str. 56601
acgugaguucgug

SEQ ID NO: 745539 - RNA, 17 nt, Leptospira interrogans serovar lai str. 56601
acgcgauccguaaaaaa

SEQ ID NO: 745540 - RNA, 16 nt, Leptospira interrogans serovar lai str. 56601
acgcgccguuugcaag

SEQ ID NO: 745541 - RNA, 17 nt, Leptospira interrogans serovar lai str. 56601
acgcucguuauuuagga

SEQ ID NO: 745542 - RNA, 22 nt, Leptospira interrogans serovar lai str. 56601
acgcuugcggauuccauucuuc

SEQ ID NO: 745543 - RNA, 23 nt, Leptospira interrogans serovar lai str. 56601
acgcuugcggauuccauucuuca

SEQ ID NO: 745544 - RNA, 16 nt, Leptospira interrogans serovar lai str. 56601
acgcuuucguaaaaag

SEQ ID NO: 745545 - RNA, 14 nt, Leptospira interrogans serovar lai str. 56601
acggagauaaaaaa

SEQ ID NO: 745546 - RNA, 17 nt, Leptospira interrogans serovar lai str. 56601
acggcuuuaguuugaaa

SEQ ID NO: 745547 - RNA, 19 nt, Leptospira interrogans serovar lai str. 56601
acggcuuuaguuugaaaga

SEQ ID NO: 745548 - RNA, 16 nt, Leptospira interrogans serovar lai str. 56601
acggcucucuccuaug

SEQ ID NO: 745549 - RNA, 19 nt, Leptospira interrogans serovar lai str. 56601
acgcgaauuugacguaaag

SEQ ID NO: 745550 - RNA, 22 nt, Leptospira interrogans serovar lai str. 56601
acgcgaaguauucucccccaac

SEQ ID NO: 745551 - RNA, 17 nt, Leptospira interrogans serovar lai str. 56601
acgccauguuuuuaaaa

SEQ ID NO: 745552 - RNA, 22 nt, Leptospira interrogans serovar lai str. 56601
acgcacaucguuaccagcaagc

SEQ ID NO: 745553 - RNA, 13 nt, Leptospira interrogans serovar lai str. 56601
acgcauacuuuuc

SEQ ID NO: 745554 - RNA, 15 nt, Leptospira interrogans serovar lai str. 56601
acuguaaauccacga

SEQ ID NO: 745555 - RNA, 18 nt, Leptospira interrogans serovar lai str. 56601
acuuaaucugugggaacu

SEQ ID NO: 745556 - RNA, 20 nt, Leptospira interrogans serovar lai str. 56601
acuguuuuaacgcaaaauac

SEQ ID NO: 745557 - RNA, 17 nt, Leptospira interrogans serovar lai str. 56601
acuuaccccgaaauaca

SEQ ID NO: 745558 - RNA, 14 nt, Leptospira interrogans serovar lai str. 56601
acuuacauuaaaua

SEQ ID NO: 745559 - RNA, 14 nt, Leptospira interrogans serovar lai str. 56601
acuuacacuccuca

SEQ ID NO: 745560 - RNA, 20 nt, Leptospira interrogans serovar lai str. 56601
acuuacagauugauuuuuua

SEQ ID NO: 745561 - RNA, 23 nt, Leptospira interrogans serovar lai str. 56601
acuuacagauugauuuuuuaaau

SEQ ID NO: 745562 - RNA, 16 nt, Leptospira interrogans serovar lai str. 56601
acuuaugcuauuuaau

SEQ ID NO: 745563 - RNA, 20 nt, Leptospira interrogans serovar lai str. 56601
acuuacuaaacgauuuuaua

SEQ ID NO: 745564 - RNA, 21 nt, Leptospira interrogans serovar lai str. 56601
acuuagaaagauagagaauga

SEQ ID NO: 745565 - RNA, 15 nt, Leptospira interrogans serovar lai str. 56601
acuucauuguuugaa

SEQ ID NO: 745566 - RNA, 12 nt, Leptospira interrogans serovar lai str. 56601
acuuauuuuuga

SEQ ID NO: 745567 - RNA, 15 nt, Leptospira interrogans serovar lai str. 56601
acuucaaaaaauaua

SEQ ID NO: 745568 - RNA, 16 nt, Leptospira interrogans serovar lai str. 56601
acuuggaaucuuaaaa

SEQ ID NO: 745569 - RNA, 23 nt, Leptospira interrogans serovar lai str. 56601
acuucuuuuuuguaaguuuugaa

SEQ ID NO: 745570 - RNA, 12 nt, Leptospira interrogans serovar lai str. 56601
acuugaaaaaug

SEQ ID NO: 745571 - RNA, 17 nt, Leptospira interrogans serovar lai str. 56601
acuugaaaauaaaaauc

SEQ ID NO: 745572 - RNA, 22 nt, Leptospira interrogans serovar lai str. 56601
acuugaaaauaaaaaucauaaa

SEQ ID NO: 745573 - RNA, 22 nt, Leptospira interrogans serovar lai str. 56601
acuugauuuuaccguuuuuaaa

SEQ ID NO: 745574 - RNA, 15 nt, Leptospira interrogans serovar lai str. 56601
acuugcaaaaaguau

SEQ ID NO: 745575 - RNA, 20 nt, Leptospira interrogans serovar lai str. 56601
acuugauuugagaaucuuca

SEQ ID NO: 745576 - RNA, 14 nt, Leptospira interrogans serovar lai str. 56601
acuugcaauuuuac

SEQ ID NO: 745577 - RNA, 18 nt, Leptospira interrogans serovar lai str. 56601
acuugccauggaaauuuu

SEQ ID NO: 745578 - RNA, 22 nt, Leptospira interrogans serovar lai str. 56601
acuucucuuuucgaaaauucug

SEQ ID NO: 745579 - RNA, 14 nt, Leptospira interrogans serovar lai str. 56601
acuucucuuaaaau

SEQ ID NO: 745580 - RNA, 18 nt, Leptospira interrogans serovar lai str. 56601
acuucucuuaaaauuuag

SEQ ID NO: 745581 - RNA, 21 nt, Leptospira interrogans serovar lai str. 56601
acuucucuuaaaauuuagaaa

SEQ ID NO: 745582 - RNA, 13 nt, Leptospira interrogans serovar lai str. 56601
acuucucacaaau

SEQ ID NO: 745583 - RNA, 17 nt, Leptospira interrogans serovar lai str. 56601
acuucugguuuuuuaau

SEQ ID NO: 745584 - RNA, 19 nt, Leptospira interrogans serovar lai str. 56601
acuucuuaaguagauaaau

SEQ ID NO: 745585 - RNA, 13 nt, Leptospira interrogans serovar lai str. 56601
acuucuucaucuu

SEQ ID NO: 745586 - RNA, 17 nt, Leptospira interrogans serovar lai str. 56601
acuucuugaaaggugau

SEQ ID NO: 745587 - RNA, 16 nt, Leptospira interrogans serovar lai str. 56601
acuucuugaacucaau

SEQ ID NO: 745588 - RNA, 17 nt, Leptospira interrogans serovar lai str. 56601
acuucuugaacucaaug

SEQ ID NO: 745589 - RNA, 13 nt, Leptospira interrogans serovar lai str. 56601
acuucucauucuu

SEQ ID NO: 745590 - RNA, 13 nt, Leptospira interrogans serovar lai str. 56601
acuucuauacucu

SEQ ID NO: 745591 - RNA, 16 nt, Leptospira interrogans serovar lai str. 56601
acuucuauacucuuca

SEQ ID NO: 745592 - RNA, 19 nt, Leptospira interrogans serovar lai str. 56601
acuucgugggcauaggaaa

SEQ ID NO: 745593 - RNA, 19 nt, Leptospira interrogans serovar lai str. 56601
acuucguuauaauuuucau

SEQ ID NO: 745594 - RNA, 13 nt, Leptospira interrogans serovar lai str. 56601
acuucguugaaaa

SEQ ID NO: 745595 - RNA, 18 nt, Leptospira interrogans serovar lai str. 56601
acuucuaaaaaauucuuu

SEQ ID NO: 745596 - RNA, 18 nt, Leptospira interrogans serovar lai str. 56601
acuuugguugaguuuuuu

SEQ ID NO: 745597 - RNA, 15 nt, Leptospira interrogans serovar lai str. 56601
acuuugguuuguaau

SEQ ID NO: 745598 - RNA, 15 nt, Leptospira interrogans serovar lai str. 56601
acuuuuaaaaaauuu

SEQ ID NO: 745599 - RNA, 18 nt, Leptospira interrogans serovar lai str. 56601
acuuuuaaaacuuuuaau

SEQ ID NO: 745600 - RNA, 17 nt, Leptospira interrogans serovar lai str. 56601
acuuuuagaaaaaauuu

SEQ ID NO: 745601 - RNA, 21 nt, Leptospira interrogans serovar lai str. 56601
acuuuuagaaaaaauuuuucu

SEQ ID NO: 745602 - RNA, 20 nt, Leptospira interrogans serovar lai str. 56601
acuuuuagaaaauuuuuacu

SEQ ID NO: 745603 - RNA, 16 nt, Leptospira interrogans serovar lai str. 56601
acuuuuagaagauuuu

SEQ ID NO: 745604 - RNA, 18 nt, Leptospira interrogans serovar lai str. 56601
acuuuuaucgaauggaau

SEQ ID NO: 745605 - RNA, 14 nt, Leptospira interrogans serovar lai str. 56601
acuuuuauaaaauc

SEQ ID NO: 745606 - RNA, 22 nt, Leptospira interrogans serovar lai str. 56601
acuuuuauaaaaucuaaaagaa

SEQ ID NO: 745607 - RNA, 19 nt, Leptospira interrogans serovar lai str. 56601
acuuugaaaauugugggaa

SEQ ID NO: 745608 - RNA, 14 nt, Leptospira interrogans serovar lai str. 56601
acuuugaaaauuuu

SEQ ID NO: 745609 - RNA, 22 nt, Leptospira interrogans serovar lai str. 56601
acuuugaaaauuuuuuuguaau

SEQ ID NO: 745610 - RNA, 22 nt, Leptospira interrogans serovar lai str. 56601
acuuugaccauucuuuguuuug

SEQ ID NO: 745611 - RNA, 12 nt, Leptospira interrogans serovar lai str. 56601
acuuugagaaaa

SEQ ID NO: 745612 - RNA, 18 nt, Leptospira interrogans serovar lai str. 56601
acuuugagaaaauuuuuu

SEQ ID NO: 745613 - RNA, 23 nt, Leptospira interrogans serovar lai str. 56601
acuuugagaaaauuuuuuuguaa

SEQ ID NO: 745614 - RNA, 14 nt, Leptospira interrogans serovar lai str. 56601
acuuucucgaaaau

SEQ ID NO: 745615 - RNA, 18 nt, Leptospira interrogans serovar lai str. 56601
acuuucuuuuacauuacc

SEQ ID NO: 745616 - RNA, 12 nt, Leptospira interrogans serovar lai str. 56601
acuuucuaaaaa

SEQ ID NO: 745617 - RNA, 18 nt, Leptospira interrogans serovar lai str. 56601
acuuuagaaaaauauuau

SEQ ID NO: 745618 - RNA, 21 nt, Leptospira interrogans serovar lai str. 56601
acuuuagaaaaauauuauauu

SEQ ID NO: 745619 - RNA, 22 nt, Leptospira interrogans serovar lai str. 56601
acuuuacggucggcaagaucuu

SEQ ID NO: 745620 - RNA, 18 nt, Leptospira interrogans serovar lai str. 56601
acuuuacgaaaguugaaa

SEQ ID NO: 745621 - RNA, 16 nt, Leptospira interrogans serovar lai str. 56601
acuuuacgaguuuaac

SEQ ID NO: 745622 - RNA, 21 nt, Leptospira interrogans serovar lai str. 56601
acuuuaucuuuucuuaaaauu

SEQ ID NO: 745623 - RNA, 13 nt, Leptospira interrogans serovar lai str. 56601
acuuuauucaaaa

SEQ ID NO: 745624 - RNA, 13 nt, Leptospira interrogans serovar lai str. 56601
acuuuauagaaaa

SEQ ID NO: 745625 - RNA, 22 nt, Leptospira interrogans serovar lai str. 56601
acuuuauaauugaacauuuuua

SEQ ID NO: 745626 - RNA, 21 nt, Leptospira interrogans serovar lai str. 56601
acuuuauuuguauucaagagc

SEQ ID NO: 745627 - RNA, 22 nt, Leptospira interrogans serovar lai str. 56601
acuuuauuuguauucaagagca

SEQ ID NO: 745628 - RNA, 13 nt, Leptospira interrogans serovar lai str. 56601
acuuucaaaaaau

SEQ ID NO: 745629 - RNA, 16 nt, Leptospira interrogans serovar lai str. 56601
acuuucaaaaaauaua

SEQ ID NO: 745630 - RNA, 18 nt, Leptospira interrogans serovar lai str. 56601
acuuucagcuacaaucaa

SEQ ID NO: 745631 - RNA, 16 nt, Leptospira interrogans serovar lai str. 56601
acuugucccaaaauuu

SEQ ID NO: 745632 - RNA, 17 nt, Leptospira interrogans serovar lai str. 56601
acuugucccaaaauuuc

SEQ ID NO: 745633 - RNA, 13 nt, Leptospira interrogans serovar lai str. 56601
acuugucucagaa

SEQ ID NO: 745634 - RNA, 14 nt, Leptospira interrogans serovar lai str. 56601
acuugucucagaac

SEQ ID NO: 745635 - RNA, 17 nt, Leptospira interrogans serovar lai str. 56601
acuugucuuuagaacuu

SEQ ID NO: 745636 - RNA, 16 nt, Leptospira interrogans serovar lai str. 56601
acuuguuccaaaacua

SEQ ID NO: 745637 - RNA, 12 nt, Leptospira interrogans serovar lai str. 56601
acuuuaaaacau

SEQ ID NO: 745638 - RNA, 22 nt, Leptospira interrogans serovar lai str. 56601
acuuuaaaaaugaucuaagauu

SEQ ID NO: 745639 - RNA, 17 nt, Leptospira interrogans serovar lai str. 56601
acuuuaaauacuuuaua

SEQ ID NO: 745640 - RNA, 21 nt, Leptospira interrogans serovar lai str. 56601
acuuuaagaaaauuuaaaaua

SEQ ID NO: 745641 - RNA, 16 nt, Leptospira interrogans serovar lai str. 56601
acuuuaauaauaugaa

SEQ ID NO: 745642 - RNA, 21 nt, Leptospira interrogans serovar lai str. 56601
acuuuaauaauaugaauucau

SEQ ID NO: 745643 - RNA, 16 nt, Leptospira interrogans serovar lai str. 56601
acuuuaauuuucuuag

SEQ ID NO: 745644 - RNA, 14 nt, Leptospira interrogans serovar lai str. 56601
acuuuacauuuuua

SEQ ID NO: 745645 - RNA, 20 nt, Leptospira interrogans serovar lai str. 56601
acuuuacacgauaauuuuua

SEQ ID NO: 745646 - RNA, 21 nt, Leptospira interrogans serovar lai str. 56601
acuuuaccgucaauuuuuagu

SEQ ID NO: 745647 - RNA, 15 nt, Leptospira interrogans serovar lai str. 56601
agaaauauuaaaaaa

SEQ ID NO: 745648 - RNA, 17 nt, Leptospira interrogans serovar lai str. 56601
agaaauauuaaaaaaau

SEQ ID NO: 745649 - RNA, 15 nt, Leptospira interrogans serovar lai str. 56601
agaaauagaaaagca

SEQ ID NO: 745650 - RNA, 16 nt, Leptospira interrogans serovar lai str. 56601
agaaauagaaaagcau

SEQ ID NO: 745651 - RNA, 19 nt, Leptospira interrogans serovar lai str. 56601
agaaauagaaaagcauaau

SEQ ID NO: 745652 - RNA, 15 nt, Leptospira interrogans serovar lai str. 56601
agaaauagaaaccuu

SEQ ID NO: 745653 - RNA, 17 nt, Leptospira interrogans serovar lai str. 56601
agaaaucauauggauua

SEQ ID NO: 745654 - RNA, 23 nt, Leptospira interrogans serovar lai str. 56601
agaaaucgauuuguaaaauucag

SEQ ID NO: 745655 - RNA, 22 nt, Leptospira interrogans serovar lai str. 56601
agaaagacuuuuccuaaaauuu

SEQ ID NO: 745656 - RNA, 13 nt, Leptospira interrogans serovar lai str. 56601
agaaagaacaaga

SEQ ID NO: 745657 - RNA, 20 nt, Leptospira interrogans serovar lai str. 56601
agaaacacuuugagaaagaa

SEQ ID NO: 745658 - RNA, 23 nt, Leptospira interrogans serovar lai str. 56601
agaaacacuuugagaaagaacaa

SEQ ID NO: 745659 - RNA, 22 nt, Leptospira interrogans serovar lai str. 56601
agaaacaauucuuccuuuuuca

SEQ ID NO: 745660 - RNA, 13 nt, Leptospira interrogans serovar lai str. 56601
agaaaguuaguag

SEQ ID NO: 745661 - RNA, 10 nt, Leptospira interrogans serovar lai str. 56601
agaaagauuu

SEQ ID NO: 745662 - RNA, 20 nt, Leptospira interrogans serovar lai str. 56601
agaaaguugcaaagaagaaa

SEQ ID NO: 745663 - RNA, 21 nt, Leptospira interrogans serovar lai str. 56601
agaaaguugcaaagaagaaau

SEQ ID NO: 745664 - RNA, 21 nt, Leptospira interrogans serovar lai str. 56601
agaaauaaguaaaucuagcaa

SEQ ID NO: 745665 - RNA, 14 nt, Leptospira interrogans serovar lai str. 56601
agaaaguuuauaaa

SEQ ID NO: 745666 - RNA, 19 nt, Leptospira interrogans serovar lai str. 56601
agaaaguuuauaaagcaaa

SEQ ID NO: 745667 - RNA, 13 nt, Leptospira interrogans serovar lai str. 56601
agaaaaaauccau

SEQ ID NO: 745668 - RNA, 15 nt, Leptospira interrogans serovar lai str. 56601
agaaaaaauacauaa

SEQ ID NO: 745669 - RNA, 23 nt, Leptospira interrogans serovar lai str. 56601
agaaaaaaguugcuaagaaaaaa

SEQ ID NO: 745670 - RNA, 20 nt, Leptospira interrogans serovar lai str. 56601
agaaaaaacuuucuaaaaau

SEQ ID NO: 745671 - RNA, 23 nt, Leptospira interrogans serovar lai str. 56601
agaaaaaacuuucuaaaaauaag

SEQ ID NO: 745672 - RNA, 13 nt, Leptospira interrogans serovar lai str. 56601
agaaaaaaagauu

SEQ ID NO: 745673 - RNA, 14 nt, Leptospira interrogans serovar lai str. 56601
agaaaaaaagauuu

SEQ ID NO: 745674 - RNA, 14 nt, Leptospira interrogans serovar lai str. 56601
acuuuuccuaaaau

SEQ ID NO: 745675 - RNA, 21 nt, Leptospira interrogans serovar lai str. 56601
acuuuucagggcucaaaguca

SEQ ID NO: 745676 - RNA, 16 nt, Leptospira interrogans serovar lai str. 56601
acuuuucaucauuccc

SEQ ID NO: 745677 - RNA, 15 nt, Leptospira interrogans serovar lai str. 56601
agaaaaacuagggaa

SEQ ID NO: 745678 - RNA, 22 nt, Leptospira interrogans serovar lai str. 56601
agaaaaagagaugguuuagaaa

SEQ ID NO: 745679 - RNA, 15 nt, Leptospira interrogans serovar lai str. 56601
agaaaaccaaauaau

SEQ ID NO: 745680 - RNA, 17 nt, Leptospira interrogans serovar lai str. 56601
agaaaaccaaauaauaa

SEQ ID NO: 745681 - RNA, 11 nt, Leptospira interrogans serovar lai str. 56601
agaaaauaaua

SEQ ID NO: 745682 - RNA, 15 nt, Leptospira interrogans serovar lai str. 56601
agaaaauaaaaaauu

SEQ ID NO: 745683 - RNA, 17 nt, Leptospira interrogans serovar lai str. 56601
agaaaaguguuuuucac

SEQ ID NO: 745684 - RNA, 12 nt, Leptospira interrogans serovar lai str. 56601
agaaaauuuuuu

SEQ ID NO: 745685 - RNA, 15 nt, Leptospira interrogans serovar lai str. 56601
agaaaacuuggguuu

SEQ ID NO: 745686 - RNA, 19 nt, Leptospira interrogans serovar lai str. 56601
agaaaaccuuuccccccac

SEQ ID NO: 745687 - RNA, 19 nt, Leptospira interrogans serovar lai str. 56601
agaaaacucaaaucuacaa

SEQ ID NO: 745688 - RNA, 14 nt, Leptospira interrogans serovar lai str. 56601
agaaaaggaaggag

SEQ ID NO: 745689 - RNA, 15 nt, Leptospira interrogans serovar lai str. 56601
agauaacuucauuuc

SEQ ID NO: 745690 - RNA, 23 nt, Leptospira interrogans serovar lai str. 56601
agauaaaucguuugcuuuucuau

SEQ ID NO: 745691 - RNA, 15 nt, Leptospira interrogans serovar lai str. 56601
agauaaauauuucca

SEQ ID NO: 745692 - RNA, 16 nt, Leptospira interrogans serovar lai str. 56601
agaguucgugaagaaa

SEQ ID NO: 745693 - RNA, 16 nt, Leptospira interrogans serovar lai str. 56601
agaguucguuaagaau

SEQ ID NO: 745694 - RNA, 14 nt, Leptospira interrogans serovar lai str. 56601
agauaaaaaaggau

SEQ ID NO: 745695 - RNA, 16 nt, Leptospira interrogans serovar lai str. 56601
agaguaccauaaauuu

SEQ ID NO: 745696 - RNA, 22 nt, Leptospira interrogans serovar lai str. 56601
agagugcucaauccaauauuua

SEQ ID NO: 745697 - RNA, 19 nt, Leptospira interrogans serovar lai str. 56601
agagugcagauuaaaaaau

SEQ ID NO: 745698 - RNA, 16 nt, Leptospira interrogans serovar lai str. 56601
agagugccaaaauuuu

SEQ ID NO: 745699 - RNA, 19 nt, Leptospira interrogans serovar lai str. 56601
agaguuauugaaaaauuuc

SEQ ID NO: 745700 - RNA, 23 nt, Leptospira interrogans serovar lai str. 56601
agaguucccacauuuuaaagauu

SEQ ID NO: 745701 - RNA, 16 nt, Leptospira interrogans serovar lai str. 56601
agaguguugacucuuu

SEQ ID NO: 745702 - RNA, 17 nt, Leptospira interrogans serovar lai str. 56601
agagugguuuucaaaua

SEQ ID NO: 745703 - RNA, 17 nt, Leptospira interrogans serovar lai str. 56601
agaguuaagagaauuuc

SEQ ID NO: 745704 - RNA, 16 nt, Leptospira interrogans serovar lai str. 56601
agaguuacagaaaaaa

SEQ ID NO: 745705 - RNA, 18 nt, Leptospira interrogans serovar lai str. 56601
agaguaagaaacaucaaa

SEQ ID NO: 745706 - RNA, 14 nt, Leptospira interrogans serovar lai str. 56601
agaggaacaauuug

SEQ ID NO: 745707 - RNA, 21 nt, Leptospira interrogans serovar lai str. 56601
agaggaguccaugauucugaa

SEQ ID NO: 745708 - RNA, 14 nt, Leptospira interrogans serovar lai str. 56601
agagcgucuuugaa

SEQ ID NO: 745709 - RNA, 19 nt, Leptospira interrogans serovar lai str. 56601
agagccuaauccaauaaaa

SEQ ID NO: 745710 - RNA, 18 nt, Leptospira interrogans serovar lai str. 56601
agagcuccuacauuuuau

SEQ ID NO: 745711 - RNA, 13 nt, Leptospira interrogans serovar lai str. 56601
agagcguucugcu

SEQ ID NO: 745712 - RNA, 18 nt, Leptospira interrogans serovar lai str. 56601
agagcaguucaauuuuug

SEQ ID NO: 745713 - RNA, 15 nt, Leptospira interrogans serovar lai str. 56601
agagacgaauuuuuu

SEQ ID NO: 745714 - RNA, 22 nt, Leptospira interrogans serovar lai str. 56601
agagacauugaagaaaaaaaga

SEQ ID NO: 745715 - RNA, 22 nt, Leptospira interrogans serovar lai str. 56601
agagaccgguagcgguaaaaga

SEQ ID NO: 745716 - RNA, 17 nt, Leptospira interrogans serovar lai str. 56601
agacuuuuccuaaaauu

SEQ ID NO: 745717 - RNA, 19 nt, Leptospira interrogans serovar lai str. 56601
agacuuuuccuaaaauuuu

SEQ ID NO: 745718 - RNA, 16 nt, Leptospira interrogans serovar lai str. 56601
agacuuuucaucauuc

SEQ ID NO: 745719 - RNA, 18 nt, Leptospira interrogans serovar lai str. 56601
agacuuccacgaauuaca

SEQ ID NO: 745720 - RNA, 17 nt, Leptospira interrogans serovar lai str. 56601
agacuugauuugagaau

SEQ ID NO: 745721 - RNA, 14 nt, Leptospira interrogans serovar lai str. 56601
agagaaaagcauuc

SEQ ID NO: 745722 - RNA, 12 nt, Leptospira interrogans serovar lai str. 56601
agagaaacuuua

SEQ ID NO: 745723 - RNA, 19 nt, Leptospira interrogans serovar lai str. 56601
agagaaauccaaucauaga

SEQ ID NO: 745724 - RNA, 18 nt, Leptospira interrogans serovar lai str. 56601
agagaauuucuauaaaau

SEQ ID NO: 745725 - RNA, 22 nt, Leptospira interrogans serovar lai str. 56601
agagaaucuguuuuguuuccuu

SEQ ID NO: 745726 - RNA, 16 nt, Leptospira interrogans serovar lai str. 56601
agagaaguuaaaaaau

SEQ ID NO: 745727 - RNA, 15 nt, Leptospira interrogans serovar lai str. 56601
agagaagccuauauu

SEQ ID NO: 745728 - RNA, 17 nt, Leptospira interrogans serovar lai str. 56601
agagaagccuauauuuu

SEQ ID NO: 745729 - RNA, 23 nt, Leptospira interrogans serovar lai str. 56601
agagaacgcgaacuuuuuuauaa

SEQ ID NO: 745730 - RNA, 22 nt, Leptospira interrogans serovar lai str. 56601
agacgcugaguuugaaagauug

SEQ ID NO: 745731 - RNA, 12 nt, Leptospira interrogans serovar lai str. 56601
agacucauucuu

SEQ ID NO: 745732 - RNA, 21 nt, Leptospira interrogans serovar lai str. 56601
agacucaguauguuguucucc

SEQ ID NO: 745733 - RNA, 23 nt, Leptospira interrogans serovar lai str. 56601
agacugauucuuuaaauguggga

SEQ ID NO: 745734 - RNA, 23 nt, Leptospira interrogans serovar lai str. 56601
agacugauuuuuuaaauguggga

SEQ ID NO: 745735 - RNA, 14 nt, Leptospira interrogans serovar lai str. 56601
agacugacugaaaa

SEQ ID NO: 745736 - RNA, 18 nt, Leptospira interrogans serovar lai str. 56601
agacugacugaaaaaaac

SEQ ID NO: 745737 - RNA, 23 nt, Leptospira interrogans serovar lai str. 56601
agacuuaaaagaagauuuuucuu

SEQ ID NO: 745738 - RNA, 16 nt, Leptospira interrogans serovar lai str. 56601
agacgaaaagaagaag

SEQ ID NO: 745739 - RNA, 22 nt, Leptospira interrogans serovar lai str. 56601
agacgaaaagaccauuuuccuu

SEQ ID NO: 745740 - RNA, 15 nt, Leptospira interrogans serovar lai str. 56601
agaccacaguaggcu

SEQ ID NO: 745741 - RNA, 12 nt, Leptospira interrogans serovar lai str. 56601
agaccaauuuuu

SEQ ID NO: 745742 - RNA, 18 nt, Leptospira interrogans serovar lai str. 56601
agaccaauuuuuuuguaa

SEQ ID NO: 745743 - RNA, 14 nt, Leptospira interrogans serovar lai str. 56601
agaccgaacucaca

SEQ ID NO: 745744 - RNA, 17 nt, Leptospira interrogans serovar lai str. 56601
agacccuaaaaaauuuu

SEQ ID NO: 745745 - RNA, 18 nt, Leptospira interrogans serovar lai str. 56601
agacauugaagaaaaaaa

SEQ ID NO: 745746 - RNA, 19 nt, Leptospira interrogans serovar lai str. 56601
agacauugaagaaaaaaag

SEQ ID NO: 745747 - RNA, 20 nt, Leptospira interrogans serovar lai str. 56601
agacauugaagaaaaaaaga

SEQ ID NO: 745748 - RNA, 23 nt, Leptospira interrogans serovar lai str. 56601
agacaugauucauuuuucugaaa

SEQ ID NO: 745749 - RNA, 17 nt, Leptospira interrogans serovar lai str. 56601
agacaaaguauuuucua

SEQ ID NO: 745750 - RNA, 16 nt, Leptospira interrogans serovar lai str. 56601
agacaaauauuucgac

SEQ ID NO: 745751 - RNA, 20 nt, Leptospira interrogans serovar lai str. 56601
agaauuuuuggaacgaagaa

SEQ ID NO: 745752 - RNA, 16 nt, Leptospira interrogans serovar lai str. 56601
agaauuuuuuaacaau

SEQ ID NO: 745753 - RNA, 18 nt, Leptospira interrogans serovar lai str. 56601
agaauuuuucgaaacaaa

SEQ ID NO: 745754 - RNA, 19 nt, Leptospira interrogans serovar lai str. 56601
agaauuuuucgaaacaaaa

SEQ ID NO: 745755 - RNA, 20 nt, Leptospira interrogans serovar lai str. 56601
agacaaacuuuuagauaaga

SEQ ID NO: 745756 - RNA, 12 nt, Leptospira interrogans serovar lai str. 56601
agacaaaaauac

SEQ ID NO: 745757 - RNA, 16 nt, Leptospira interrogans serovar lai str. 56601
agaauuuucaucaaau

SEQ ID NO: 745758 - RNA, 18 nt, Leptospira interrogans serovar lai str. 56601
agaauuuucuaaaaguau

SEQ ID NO: 745759 - RNA, 19 nt, Leptospira interrogans serovar lai str. 56601
agaauuuucuaaaaguaug

SEQ ID NO: 745760 - RNA, 20 nt, Leptospira interrogans serovar lai str. 56601
agaauuuucuaaaaguauga

SEQ ID NO: 745761 - RNA, 18 nt, Leptospira interrogans serovar lai str. 56601
agaauuuucuaaagauuc

SEQ ID NO: 745762 - RNA, 18 nt, Leptospira interrogans serovar lai str. 56601
agaauuuuguuucuaaaa

SEQ ID NO: 745763 - RNA, 17 nt, Leptospira interrogans serovar lai str. 56601
agaauuuuuaaaaauau

SEQ ID NO: 745764 - RNA, 17 nt, Leptospira interrogans serovar lai str. 56601
agaauuuuuacagaaaa

SEQ ID NO: 745765 - RNA, 19 nt, Leptospira interrogans serovar lai str. 56601
agaauuuugaacauuuuca

SEQ ID NO: 745766 - RNA, 14 nt, Leptospira interrogans serovar lai str. 56601
agaauuuugcaaaa

SEQ ID NO: 745767 - RNA, 22 nt, Leptospira interrogans serovar lai str. 56601
agaauuuugcaaaaaaaauacg

SEQ ID NO: 745768 - RNA, 20 nt, Leptospira interrogans serovar lai str. 56601
agaauuauuuacuuuuucca

SEQ ID NO: 745769 - RNA, 23 nt, Leptospira interrogans serovar lai str. 56601
agaauuauuuacuuuuuccaaaa

SEQ ID NO: 745770 - RNA, 21 nt, Leptospira interrogans serovar lai str. 56601
agaauuuguuuguaaaauagu

SEQ ID NO: 745771 - RNA, 17 nt, Leptospira interrogans serovar lai str. 56601
agaauuuguuugucuuu

SEQ ID NO: 745772 - RNA, 21 nt, Leptospira interrogans serovar lai str. 56601
agaauuuguuuuuaaaauugu

SEQ ID NO: 745773 - RNA, 14 nt, Leptospira interrogans serovar lai str. 56601
agaauuuuagaaua

SEQ ID NO: 745774 - RNA, 15 nt, Leptospira interrogans serovar lai str. 56601
agaauuagauuaaau

SEQ ID NO: 745775 - RNA, 15 nt, Leptospira interrogans serovar lai str. 56601
agaauuaauuuuuua

SEQ ID NO: 745776 - RNA, 21 nt, Leptospira interrogans serovar lai str. 56601
agaauuaauuuuuuaaaaauu

SEQ ID NO: 745777 - RNA, 16 nt, Leptospira interrogans serovar lai str. 56601
agaauuaaaaauuaau

SEQ ID NO: 745778 - RNA, 20 nt, Leptospira interrogans serovar lai str. 56601
agacaggcucaauauuuaaa

SEQ ID NO: 745779 - RNA, 13 nt, Leptospira interrogans serovar lai str. 56601
agaauaaauuaua

SEQ ID NO: 745780 - RNA, 13 nt, Leptospira interrogans serovar lai str. 56601
agaauaaaguacc

SEQ ID NO: 745781 - RNA, 15 nt, Leptospira interrogans serovar lai str. 56601
agaauaauauuuuaa

SEQ ID NO: 745782 - RNA, 19 nt, Leptospira interrogans serovar lai str. 56601
agaauaagguuagauuauu

SEQ ID NO: 745783 - RNA, 13 nt, Leptospira interrogans serovar lai str. 56601
agaauauaagaaa

SEQ ID NO: 745784 - RNA, 13 nt, Leptospira interrogans serovar lai str. 56601
agaauauaaaauc

SEQ ID NO: 745785 - RNA, 19 nt, Leptospira interrogans serovar lai str. 56601
agaauaguaguuuucacua

SEQ ID NO: 745786 - RNA, 21 nt, Leptospira interrogans serovar lai str. 56601
agaaucauacaaucaaauuuu

SEQ ID NO: 745787 - RNA, 13 nt, Leptospira interrogans serovar lai str. 56601
agaaucauagguu

SEQ ID NO: 745788 - RNA, 17 nt, Leptospira interrogans serovar lai str. 56601
agaaucagaaugaacuc

SEQ ID NO: 745789 - RNA, 21 nt, Leptospira interrogans serovar lai str. 56601
agaaucagaaugaacucaaca

SEQ ID NO: 745790 - RNA, 20 nt, Leptospira interrogans serovar lai str. 56601
agaaugagaaggaucaaaac

SEQ ID NO: 745791 - RNA, 15 nt, Leptospira interrogans serovar lai str. 56601
agaaugagucuuuuu

SEQ ID NO: 745792 - RNA, 18 nt, Leptospira interrogans serovar lai str. 56601
agaaugagucuuuuuacu

SEQ ID NO: 745793 - RNA, 21 nt, Leptospira interrogans serovar lai str. 56601
agaaugauaaaucuuggauca

SEQ ID NO: 745794 - RNA, 15 nt, Leptospira interrogans serovar lai str. 56601
agaaugaucaauaga

SEQ ID NO: 745795 - RNA, 17 nt, Leptospira interrogans serovar lai str. 56601
agaaugaucaauagaau

SEQ ID NO: 745796 - RNA, 19 nt, Leptospira interrogans serovar lai str. 56601
agaaugaucaauagaauug

SEQ ID NO: 745797 - RNA, 20 nt, Leptospira interrogans serovar lai str. 56601
agaaugaucacguaaaacuu

SEQ ID NO: 745798 - RNA, 22 nt, Leptospira interrogans serovar lai str. 56601
agaauguuugagguuuuaaaag

SEQ ID NO: 745799 - RNA, 23 nt, Leptospira interrogans serovar lai str. 56601
agaauguuugagguuuuaaaagu

SEQ ID NO: 745800 - RNA, 18 nt, Leptospira interrogans serovar lai str. 56601
agaauguuuuccagaaac

SEQ ID NO: 745801 - RNA, 15 nt, Leptospira interrogans serovar lai str. 56601
agaauguuuucuaca

SEQ ID NO: 745802 - RNA, 22 nt, Leptospira interrogans serovar lai str. 56601
agaaaugagggcucccacaauu

SEQ ID NO: 745803 - RNA, 19 nt, Leptospira interrogans serovar lai str. 56601
agaaaugauuuuuuaaaau

SEQ ID NO: 745804 - RNA, 14 nt, Leptospira interrogans serovar lai str. 56601
agaaauuaauuucu

SEQ ID NO: 745805 - RNA, 21 nt, Leptospira interrogans serovar lai str. 56601
agaaauuauaguaacagaaaa

SEQ ID NO: 745806 - RNA, 18 nt, Leptospira interrogans serovar lai str. 56601
agaagaugcuuucucuuu

SEQ ID NO: 745807 - RNA, 18 nt, Leptospira interrogans serovar lai str. 56601
agaagaguuaagcaaaug

SEQ ID NO: 745808 - RNA, 16 nt, Leptospira interrogans serovar lai str. 56601
agaagaguugaauauu

SEQ ID NO: 745809 - RNA, 11 nt, Leptospira interrogans serovar lai str. 56601
agaagauaaaa

SEQ ID NO: 745810 - RNA, 15 nt, Leptospira interrogans serovar lai str. 56601
agaagauaaaacuca

SEQ ID NO: 745811 - RNA, 16 nt, Leptospira interrogans serovar lai str. 56601
agaagagguucugagu

SEQ ID NO: 745812 - RNA, 15 nt, Leptospira interrogans serovar lai str. 56601
agaagggaugaaauu

SEQ ID NO: 745813 - RNA, 20 nt, Leptospira interrogans serovar lai str. 56601
agaaggcagcuaagaaaaaa

SEQ ID NO: 745814 - RNA, 22 nt, Leptospira interrogans serovar lai str. 56601
agaaggcagcuaagaaaaaagu

SEQ ID NO: 745815 - RNA, 21 nt, Leptospira interrogans serovar lai str. 56601
agaagucugguuuauuuuuga

SEQ ID NO: 745816 - RNA, 17 nt, Leptospira interrogans serovar lai str. 56601
agaagggugaauuuuuu

SEQ ID NO: 745817 - RNA, 23 nt, Leptospira interrogans serovar lai str. 56601
agaagccugaguuugagagagag

SEQ ID NO: 745818 - RNA, 18 nt, Leptospira interrogans serovar lai str. 56601
agcaacaauuaacaaaac

SEQ ID NO: 745819 - RNA, 21 nt, Leptospira interrogans serovar lai str. 56601
agcaacguagucguguuguuu

SEQ ID NO: 745820 - RNA, 15 nt, Leptospira interrogans serovar lai str. 56601
agcaauccauucaaa

SEQ ID NO: 745821 - RNA, 21 nt, Leptospira interrogans serovar lai str. 56601
agcaauccauucaaaaaauca

SEQ ID NO: 745822 - RNA, 21 nt, Leptospira interrogans serovar lai str. 56601
agcaaucuguuuagaauauuu

SEQ ID NO: 745823 - RNA, 23 nt, Leptospira interrogans serovar lai str. 56601
agcaaucuuccugggaaguugua

SEQ ID NO: 745824 - RNA, 16 nt, Leptospira interrogans serovar lai str. 56601
agcaauaaaaucaaua

SEQ ID NO: 745825 - RNA, 19 nt, Leptospira interrogans serovar lai str. 56601
agcaaagaaggcagcuaag

SEQ ID NO: 745826 - RNA, 17 nt, Leptospira interrogans serovar lai str. 56601
agcaaacuuuuuauaaa

SEQ ID NO: 745827 - RNA, 19 nt, Leptospira interrogans serovar lai str. 56601
agcaaacuuuuuauaaaaa

SEQ ID NO: 745828 - RNA, 18 nt, Leptospira interrogans serovar lai str. 56601
agcaaauaccaaaccucu

SEQ ID NO: 745829 - RNA, 21 nt, Leptospira interrogans serovar lai str. 56601
agcaaauaacgauuccauuuu

SEQ ID NO: 745830 - RNA, 18 nt, Leptospira interrogans serovar lai str. 56601
agcaaaucacgauuuuac

SEQ ID NO: 745831 - RNA, 12 nt, Leptospira interrogans serovar lai str. 56601
agcaaaaauuuu

SEQ ID NO: 745832 - RNA, 16 nt, Leptospira interrogans serovar lai str. 56601
agcaaaaauuuucuaa

SEQ ID NO: 745833 - RNA, 18 nt, Leptospira interrogans serovar lai str. 56601
agauuuugggacaagcuu

SEQ ID NO: 745834 - RNA, 15 nt, Leptospira interrogans serovar lai str. 56601
agauuuugcacaaaa

SEQ ID NO: 745835 - RNA, 20 nt, Leptospira interrogans serovar lai str. 56601
agauuuugcacguaaacauu

SEQ ID NO: 745836 - RNA, 21 nt, Leptospira interrogans serovar lai str. 56601
agauuuucgucuucuuuacaa

SEQ ID NO: 745837 - RNA, 19 nt, Leptospira interrogans serovar lai str. 56601
agauuuuaagacaaacuuu

SEQ ID NO: 745838 - RNA, 17 nt, Leptospira interrogans serovar lai str. 56601
agauuuuucuuuaaacc

SEQ ID NO: 745839 - RNA, 20 nt, Leptospira interrogans serovar lai str. 56601
agauuuuucguucuaagaau

SEQ ID NO: 745840 - RNA, 14 nt, Leptospira interrogans serovar lai str. 56601
agauuuuugcacaa

SEQ ID NO: 745841 - RNA, 18 nt, Leptospira interrogans serovar lai str. 56601
agauuucagcuccaaaaa

SEQ ID NO: 745842 - RNA, 21 nt, Leptospira interrogans serovar lai str. 56601
agauuucagcuccaaaaaaau

SEQ ID NO: 745843 - RNA, 18 nt, Leptospira interrogans serovar lai str. 56601
agauuuauugaaaaauag

SEQ ID NO: 745844 - RNA, 15 nt, Leptospira interrogans serovar lai str. 56601
agauuuaauuuuucu

SEQ ID NO: 745845 - RNA, 18 nt, Leptospira interrogans serovar lai str. 56601
agauuuauaauaaaucaa

SEQ ID NO: 745846 - RNA, 19 nt, Leptospira interrogans serovar lai str. 56601
agauuuauauugagaucaa

SEQ ID NO: 745847 - RNA, 21 nt, Leptospira interrogans serovar lai str. 56601
agauuuggugauuuaaaaaua

SEQ ID NO: 745848 - RNA, 22 nt, Leptospira interrogans serovar lai str. 56601
agauuuggugauuuaaaaauag

SEQ ID NO: 745849 - RNA, 13 nt, Leptospira interrogans serovar lai str. 56601
agauuuguaaaau

SEQ ID NO: 745850 - RNA, 15 nt, Leptospira interrogans serovar lai str. 56601
agauuuguaaaauug

SEQ ID NO: 745851 - RNA, 16 nt, Leptospira interrogans serovar lai str. 56601
agauuuguguuaguuc

SEQ ID NO: 745852 - RNA, 17 nt, Leptospira interrogans serovar lai str. 56601
agauuuguguuaguucc

SEQ ID NO: 745853 - RNA, 19 nt, Leptospira interrogans serovar lai str. 56601
agauuuguguuaguuccca

SEQ ID NO: 745854 - RNA, 19 nt, Leptospira interrogans serovar lai str. 56601
agauuuguugaaaagugag

SEQ ID NO: 745855 - RNA, 20 nt, Leptospira interrogans serovar lai str. 56601
agauuucguucggaaaaagu

SEQ ID NO: 745856 - RNA, 20 nt, Leptospira interrogans serovar lai str. 56601
agauuucggauucuucccca

SEQ ID NO: 745857 - RNA, 14 nt, Leptospira interrogans serovar lai str. 56601
agauuguuuucuag

SEQ ID NO: 745858 - RNA, 21 nt, Leptospira interrogans serovar lai str. 56601
agauuguuuucuaguuuuccu

SEQ ID NO: 745859 - RNA, 21 nt, Leptospira interrogans serovar lai str. 56601
agauaaugagccagguuaauu

SEQ ID NO: 745860 - RNA, 12 nt, Leptospira interrogans serovar lai str. 56601
agcagcaaagaa

SEQ ID NO: 745861 - RNA, 14 nt, Leptospira interrogans serovar lai str. 56601
agcagcaaagaagg

SEQ ID NO: 745862 - RNA, 16 nt, Leptospira interrogans serovar lai str. 56601
agcagauucuaaaaau

SEQ ID NO: 745863 - RNA, 14 nt, Leptospira interrogans serovar lai str. 56601
agcaccuuuuuuaa

SEQ ID NO: 745864 - RNA, 14 nt, Leptospira interrogans serovar lai str. 56601
agcaauuugugaac

SEQ ID NO: 745865 - RNA, 14 nt, Leptospira interrogans serovar lai str. 56601
agcacaauauauuc

SEQ ID NO: 745866 - RNA, 17 nt, Leptospira interrogans serovar lai str. 56601
agcacaagcuuccuuuu

SEQ ID NO: 745867 - RNA, 20 nt, Leptospira interrogans serovar lai str. 56601
agcauaacgucuugauuauu

SEQ ID NO: 745868 - RNA, 20 nt, Leptospira interrogans serovar lai str. 56601
agcaucaacaucacgcacau

SEQ ID NO: 745869 - RNA, 16 nt, Leptospira interrogans serovar lai str. 56601
agccaugguaagaaga

SEQ ID NO: 745870 - RNA, 12 nt, Leptospira interrogans serovar lai str. 56601
agccaucuuuuu

SEQ ID NO: 745871 - RNA, 14 nt, Leptospira interrogans serovar lai str. 56601
agccaugccaaaca

SEQ ID NO: 745872 - RNA, 15 nt, Leptospira interrogans serovar lai str. 56601
agccaugccaaacac

SEQ ID NO: 745873 - RNA, 18 nt, Leptospira interrogans serovar lai str. 56601
agccaaaaccaauuuuuc

SEQ ID NO: 745874 - RNA, 14 nt, Leptospira interrogans serovar lai str. 56601
agcauuuuuaagau

SEQ ID NO: 745875 - RNA, 18 nt, Leptospira interrogans serovar lai str. 56601
agcauuuuuaagauuaca

SEQ ID NO: 745876 - RNA, 14 nt, Leptospira interrogans serovar lai str. 56601
agcauuuuuuuaau

SEQ ID NO: 745877 - RNA, 19 nt, Leptospira interrogans serovar lai str. 56601
agcauuuuuuuaauacaaa

SEQ ID NO: 745878 - RNA, 21 nt, Leptospira interrogans serovar lai str. 56601
agccaaaauucaaauucuuuu

SEQ ID NO: 745879 - RNA, 18 nt, Leptospira interrogans serovar lai str. 56601
agccaaaucugaaaaaga

SEQ ID NO: 745880 - RNA, 14 nt, Leptospira interrogans serovar lai str. 56601
agccaaaccaaaua

SEQ ID NO: 745881 - RNA, 17 nt, Leptospira interrogans serovar lai str. 56601
agcauuauaaguuuuua

SEQ ID NO: 745882 - RNA, 18 nt, Leptospira interrogans serovar lai str. 56601
agcauuauaaguuuuuau

SEQ ID NO: 745883 - RNA, 16 nt, Leptospira interrogans serovar lai str. 56601
agcaugaaauuuucuu

SEQ ID NO: 745884 - RNA, 19 nt, Leptospira interrogans serovar lai str. 56601
agcaugaaauuuucuuaga

SEQ ID NO: 745885 - RNA, 13 nt, Leptospira interrogans serovar lai str. 56601
agcauggucuguc

SEQ ID NO: 745886 - RNA, 13 nt, Leptospira interrogans serovar lai str. 56601
agcgauauaauaa

SEQ ID NO: 745887 - RNA, 16 nt, Leptospira interrogans serovar lai str. 56601
agcgauauaauaaaau

SEQ ID NO: 745888 - RNA, 18 nt, Leptospira interrogans serovar lai str. 56601
agcgaugaucgauuuuuu

SEQ ID NO: 745889 - RNA, 12 nt, Leptospira interrogans serovar lai str. 56601
agcgcagacucu

SEQ ID NO: 745890 - RNA, 19 nt, Leptospira interrogans serovar lai str. 56601
agcgcuuauugcaaaaccg

SEQ ID NO: 745891 - RNA, 14 nt, Leptospira interrogans serovar lai str. 56601
agcgcuugaaaauu

SEQ ID NO: 745892 - RNA, 16 nt, Leptospira interrogans serovar lai str. 56601
agcgcuugaaaauucu

SEQ ID NO: 745893 - RNA, 12 nt, Leptospira interrogans serovar lai str. 56601
agcuauaaaaua

SEQ ID NO: 745894 - RNA, 13 nt, Leptospira interrogans serovar lai str. 56601
agcuaaaaagaaa

SEQ ID NO: 745895 - RNA, 19 nt, Leptospira interrogans serovar lai str. 56601
agcguuuuguuaauuguug

SEQ ID NO: 745896 - RNA, 14 nt, Leptospira interrogans serovar lai str. 56601
agcguuuugcugag

SEQ ID NO: 745897 - RNA, 18 nt, Leptospira interrogans serovar lai str. 56601
agcuccaaaaaaauaaau

SEQ ID NO: 745898 - RNA, 18 nt, Leptospira interrogans serovar lai str. 56601
agcucgaauaaaaacaaa

SEQ ID NO: 745899 - RNA, 21 nt, Leptospira interrogans serovar lai str. 56601
agcuccuccaaccagagcaua

SEQ ID NO: 745900 - RNA, 23 nt, Leptospira interrogans serovar lai str. 56601
agcuccuacauuuuauuuuuuau

SEQ ID NO: 745901 - RNA, 13 nt, Leptospira interrogans serovar lai str. 56601
agcucuugaauaa

SEQ ID NO: 745902 - RNA, 23 nt, Leptospira interrogans serovar lai str. 56601
agcugaggaguuuuuauaaaauc

SEQ ID NO: 745903 - RNA, 18 nt, Leptospira interrogans serovar lai str. 56601
agcgaacacguuaacaau

SEQ ID NO: 745904 - RNA, 16 nt, Leptospira interrogans serovar lai str. 56601
agccuuucacaucucc

SEQ ID NO: 745905 - RNA, 13 nt, Leptospira interrogans serovar lai str. 56601
agccuucaauuau

SEQ ID NO: 745906 - RNA, 16 nt, Leptospira interrogans serovar lai str. 56601
agccuuaaaucaaucc

SEQ ID NO: 745907 - RNA, 13 nt, Leptospira interrogans serovar lai str. 56601
agccuggaauucu

SEQ ID NO: 745908 - RNA, 15 nt, Leptospira interrogans serovar lai str. 56601
agccuggaauucuuu

SEQ ID NO: 745909 - RNA, 13 nt, Leptospira interrogans serovar lai str. 56601
agccguaaauauu

SEQ ID NO: 745910 - RNA, 15 nt, Leptospira interrogans serovar lai str. 56601
agccguaaauauuuu

SEQ ID NO: 745911 - RNA, 14 nt, Leptospira interrogans serovar lai str. 56601
agccuauauuuuga

SEQ ID NO: 745912 - RNA, 19 nt, Leptospira interrogans serovar lai str. 56601
agccuaauuacgauuuuuu

SEQ ID NO: 745913 - RNA, 18 nt, Leptospira interrogans serovar lai str. 56601
agccuaauuuacuacauc

SEQ ID NO: 745914 - RNA, 23 nt, Leptospira interrogans serovar lai str. 56601
agccugccaaaagaacuuugaga

SEQ ID NO: 745915 - RNA, 22 nt, Leptospira interrogans serovar lai str. 56601
agcccuugcguaucaaaccuuu

SEQ ID NO: 745916 - RNA, 16 nt, Leptospira interrogans serovar lai str. 56601
agccgcacaaaccaaa

SEQ ID NO: 745917 - RNA, 20 nt, Leptospira interrogans serovar lai str. 56601
agccgcgcuuuccuuauuaa

SEQ ID NO: 745918 - RNA, 17 nt, Leptospira interrogans serovar lai str. 56601
agccgcggccaacacac

SEQ ID NO: 745919 - RNA, 16 nt, Leptospira interrogans serovar lai str. 56601
agccgcuucaucaaac

SEQ ID NO: 745920 - RNA, 19 nt, Leptospira interrogans serovar lai str. 56601
agcccucccguuauuuuuu

SEQ ID NO: 745921 - RNA, 22 nt, Leptospira interrogans serovar lai str. 56601
agcccuccuauguuucuugugu

SEQ ID NO: 745922 - RNA, 22 nt, Leptospira interrogans serovar lai str. 56601
agcccucagcuauaaaauaggu

SEQ ID NO: 745923 - RNA, 15 nt, Leptospira interrogans serovar lai str. 56601
agccauucuaauuuc

SEQ ID NO: 745924 - RNA, 17 nt, Leptospira interrogans serovar lai str. 56601
agccauuucaaaaauau

SEQ ID NO: 745925 - RNA, 21 nt, Leptospira interrogans serovar lai str. 56601
agccauuucaaaaauauauua

SEQ ID NO: 745926 - RNA, 16 nt, Leptospira interrogans serovar lai str. 56601
agcccccgaagaauua

SEQ ID NO: 745927 - RNA, 15 nt, Leptospira interrogans serovar lai str. 56601
auaaagaaaaccuuu

SEQ ID NO: 745928 - RNA, 15 nt, Leptospira interrogans serovar lai str. 56601
auaaagaaaaggaag

SEQ ID NO: 745929 - RNA, 20 nt, Leptospira interrogans serovar lai str. 56601
auaaagaaacuguuuaauaa

SEQ ID NO: 745930 - RNA, 18 nt, Leptospira interrogans serovar lai str. 56601
auaaacuuucaaagaaua

SEQ ID NO: 745931 - RNA, 13 nt, Leptospira interrogans serovar lai str. 56601
auaaacgauuauu

SEQ ID NO: 745932 - RNA, 15 nt, Leptospira interrogans serovar lai str. 56601
auaaacgauuauuuu

SEQ ID NO: 745933 - RNA, 20 nt, Leptospira interrogans serovar lai str. 56601
auaaacgauuauuuuuuaaa

SEQ ID NO: 745934 - RNA, 23 nt, Leptospira interrogans serovar lai str. 56601
auaaacgauuauuuuuuaaaaau

SEQ ID NO: 745935 - RNA, 22 nt, Leptospira interrogans serovar lai str. 56601
auaaacgaucauacuuuagaaa

SEQ ID NO: 745936 - RNA, 13 nt, Leptospira interrogans serovar lai str. 56601
auaaacauccuca

SEQ ID NO: 745937 - RNA, 20 nt, Leptospira interrogans serovar lai str. 56601
auaaacagucgcuaaacuca

SEQ ID NO: 745938 - RNA, 12 nt, Leptospira interrogans serovar lai str. 56601
auaaaauuaacg

SEQ ID NO: 745939 - RNA, 16 nt, Leptospira interrogans serovar lai str. 56601
auaaaauuauuaacua

SEQ ID NO: 745940 - RNA, 17 nt, Leptospira interrogans serovar lai str. 56601
auaaaauucaaaaagaa

SEQ ID NO: 745941 - RNA, 22 nt, Leptospira interrogans serovar lai str. 56601
auaaaauuccuagcaguauuuu

SEQ ID NO: 745942 - RNA, 23 nt, Leptospira interrogans serovar lai str. 56601
auaaaauucuaaucacgaaaaau

SEQ ID NO: 745943 - RNA, 18 nt, Leptospira interrogans serovar lai str. 56601
auaaaauucuuagaguaa

SEQ ID NO: 745944 - RNA, 21 nt, Leptospira interrogans serovar lai str. 56601
auaaaauucuuagaguaaaac

SEQ ID NO: 745945 - RNA, 11 nt, Leptospira interrogans serovar lai str. 56601
auaaaauugag

SEQ ID NO: 745946 - RNA, 20 nt, Leptospira interrogans serovar lai str. 56601
auaaaauugaguuucuauaa

SEQ ID NO: 745947 - RNA, 17 nt, Leptospira interrogans serovar lai str. 56601
auaaaauuggaaagaac

SEQ ID NO: 745948 - RNA, 20 nt, Leptospira interrogans serovar lai str. 56601
auaaaauggguuuuuaauuu

SEQ ID NO: 745949 - RNA, 19 nt, Leptospira interrogans serovar lai str. 56601
auaaaaugcaguaguuccu

SEQ ID NO: 745950 - RNA, 22 nt, Leptospira interrogans serovar lai str. 56601
auaaaaugcaguaguuccuaua

SEQ ID NO: 745951 - RNA, 16 nt, Leptospira interrogans serovar lai str. 56601
auaaaaugaaaaauua

SEQ ID NO: 745952 - RNA, 15 nt, Leptospira interrogans serovar lai str. 56601
auaaaaucuuaaauu

SEQ ID NO: 745953 - RNA, 14 nt, Leptospira interrogans serovar lai str. 56601
auaaaaucuaaaaa

SEQ ID NO: 745954 - RNA, 15 nt, Leptospira interrogans serovar lai str. 56601
auaaaaucuaaaaaa

SEQ ID NO: 745955 - RNA, 16 nt, Leptospira interrogans serovar lai str. 56601
auaaaaucuaaaaaaa

SEQ ID NO: 745956 - RNA, 20 nt, Leptospira interrogans serovar lai str. 56601
auaaaaucuaaaaaaaauca

SEQ ID NO: 745957 - RNA, 22 nt, Leptospira interrogans serovar lai str. 56601
auaaaaucuaaaaaaacaauua

SEQ ID NO: 745958 - RNA, 15 nt, Leptospira interrogans serovar lai str. 56601
auaaaaucuaaaaau

SEQ ID NO: 745959 - RNA, 19 nt, Leptospira interrogans serovar lai str. 56601
auaaaaucuaaaagaaacc

SEQ ID NO: 745960 - RNA, 23 nt, Leptospira interrogans serovar lai str. 56601
auaaaaucuagguauuaucuaaa

SEQ ID NO: 745961 - RNA, 23 nt, Leptospira interrogans serovar lai str. 56601
auaaaauaccauaaauuuugaaa

SEQ ID NO: 745962 - RNA, 17 nt, Leptospira interrogans serovar lai str. 56601
auaaaauagaaacaaau

SEQ ID NO: 745963 - RNA, 15 nt, Leptospira interrogans serovar lai str. 56601
auaaaauauaguuaa

SEQ ID NO: 745964 - RNA, 19 nt, Leptospira interrogans serovar lai str. 56601
auaaaagauucguuuuaua

SEQ ID NO: 745965 - RNA, 17 nt, Leptospira interrogans serovar lai str. 56601
auaaaaggaguaauucu

SEQ ID NO: 745966 - RNA, 17 nt, Leptospira interrogans serovar lai str. 56601
auaaaacuucuccuuuc

SEQ ID NO: 745967 - RNA, 16 nt, Leptospira interrogans serovar lai str. 56601
auaaaagaaacauaau

SEQ ID NO: 745968 - RNA, 20 nt, Leptospira interrogans serovar lai str. 56601
auaaaacuguaaauuagauu

SEQ ID NO: 745969 - RNA, 23 nt, Leptospira interrogans serovar lai str. 56601
auaaaacuguaaauuagauuauu

SEQ ID NO: 745970 - RNA, 19 nt, Leptospira interrogans serovar lai str. 56601
auaaaaguaacguaaauuu

SEQ ID NO: 745971 - RNA, 18 nt, Leptospira interrogans serovar lai str. 56601
auaaaaggcugcuuuuuu

SEQ ID NO: 745972 - RNA, 15 nt, Leptospira interrogans serovar lai str. 56601
auaaaauaaaaaaau

SEQ ID NO: 745973 - RNA, 14 nt, Leptospira interrogans serovar lai str. 56601
auaaaauaaaaauu

SEQ ID NO: 745974 - RNA, 13 nt, Leptospira interrogans serovar lai str. 56601
auaaaagugaaca

SEQ ID NO: 745975 - RNA, 18 nt, Leptospira interrogans serovar lai str. 56601
auaaaacccuuagucuga

SEQ ID NO: 745976 - RNA, 17 nt, Leptospira interrogans serovar lai str. 56601
auaaaaccgcugaaaaa

SEQ ID NO: 745977 - RNA, 20 nt, Leptospira interrogans serovar lai str. 56601
auaaaaccgcugaaaaaaaa

SEQ ID NO: 745978 - RNA, 22 nt, Leptospira interrogans serovar lai str. 56601
auaaaaccgcugaaaaaaaaau

SEQ ID NO: 745979 - RNA, 19 nt, Leptospira interrogans serovar lai str. 56601
auaaaacgaaauuauacaa

SEQ ID NO: 745980 - RNA, 18 nt, Leptospira interrogans serovar lai str. 56601
auaaaaccguuuuauaaa

SEQ ID NO: 745981 - RNA, 20 nt, Leptospira interrogans serovar lai str. 56601
auaaaaccguuuuauaaaua

SEQ ID NO: 745982 - RNA, 17 nt, Leptospira interrogans serovar lai str. 56601
auaaaacucaaaggaaa

SEQ ID NO: 745983 - RNA, 22 nt, Leptospira interrogans serovar lai str. 56601
auaaaacucaaaggaaaaugaa

SEQ ID NO: 745984 - RNA, 22 nt, Leptospira interrogans serovar lai str. 56601
auaaaacucuaaauucagaaaa

SEQ ID NO: 745985 - RNA, 18 nt, Leptospira interrogans serovar lai str. 56601
auaaaaacgguauuuaaa

SEQ ID NO: 745986 - RNA, 20 nt, Leptospira interrogans serovar lai str. 56601
auaaaaauuagaaaugauuu

SEQ ID NO: 745987 - RNA, 18 nt, Leptospira interrogans serovar lai str. 56601
auaaaacaaucuucaaau

SEQ ID NO: 745988 - RNA, 21 nt, Leptospira interrogans serovar lai str. 56601
auaaaaauaguauccaaaauu

SEQ ID NO: 745989 - RNA, 18 nt, Leptospira interrogans serovar lai str. 56601
auaaaaauuucagauuuu

SEQ ID NO: 745990 - RNA, 21 nt, Leptospira interrogans serovar lai str. 56601
auaaaaauuucagauuuuauu

SEQ ID NO: 745991 - RNA, 23 nt, Leptospira interrogans serovar lai str. 56601
auaaaaauuucagauuuuauuuu

SEQ ID NO: 745992 - RNA, 16 nt, Leptospira interrogans serovar lai str. 56601
auaaauagggguuuua

SEQ ID NO: 745993 - RNA, 22 nt, Leptospira interrogans serovar lai str. 56601
auaaauaguauauuuucugcuu

SEQ ID NO: 745994 - RNA, 20 nt, Leptospira interrogans serovar lai str. 56601
auaaaguuuuaguuuacaaa

SEQ ID NO: 745995 - RNA, 23 nt, Leptospira interrogans serovar lai str. 56601
auaaauacaucucuuuuuuaaag

SEQ ID NO: 745996 - RNA, 19 nt, Leptospira interrogans serovar lai str. 56601
auaaagucuauuucccaaa

SEQ ID NO: 745997 - RNA, 18 nt, Leptospira interrogans serovar lai str. 56601
auaaaguuaauacaaaaa

SEQ ID NO: 745998 - RNA, 15 nt, Leptospira interrogans serovar lai str. 56601
auaaagaauuuuaaa

SEQ ID NO: 745999 - RNA, 17 nt, Leptospira interrogans serovar lai str. 56601
auaaauucgcaaaaaaa

SEQ ID NO: 746000 - RNA, 19 nt, Leptospira interrogans serovar lai str. 56601
auaaauucgcaaaaaaaau

SEQ ID NO: 746001 - RNA, 19 nt, Leptospira interrogans serovar lai str. 56601
auaaauucgccguaaaaaa

SEQ ID NO: 746002 - RNA, 20 nt, Leptospira interrogans serovar lai str. 56601
auaaauucgccguaaaaaau

SEQ ID NO: 746003 - RNA, 15 nt, Leptospira interrogans serovar lai str. 56601
auaaauuccccaaaa

SEQ ID NO: 746004 - RNA, 16 nt, Leptospira interrogans serovar lai str. 56601
auaaauuccccaaaau

SEQ ID NO: 746005 - RNA, 14 nt, Leptospira interrogans serovar lai str. 56601
auaaauuauuuuuu

SEQ ID NO: 746006 - RNA, 14 nt, Leptospira interrogans serovar lai str. 56601
auaaaugauaauaa

SEQ ID NO: 746007 - RNA, 17 nt, Leptospira interrogans serovar lai str. 56601
auaaaugauaauaauua

SEQ ID NO: 746008 - RNA, 21 nt, Leptospira interrogans serovar lai str. 56601
auaaaugauaauaauuagaaa

SEQ ID NO: 746009 - RNA, 19 nt, Leptospira interrogans serovar lai str. 56601
auaaaugauacuuuguaaa

SEQ ID NO: 746010 - RNA, 17 nt, Leptospira interrogans serovar lai str. 56601
auaaaucaaaaggaaua

SEQ ID NO: 746011 - RNA, 17 nt, Leptospira interrogans serovar lai str. 56601
auaacaaauaaaaggag

SEQ ID NO: 746012 - RNA, 23 nt, Leptospira interrogans serovar lai str. 56601
auaacaaauaaaaggaguaauuc

SEQ ID NO: 746013 - RNA, 22 nt, Leptospira interrogans serovar lai str. 56601
auaacaacgauuucuguagaaa

SEQ ID NO: 746014 - RNA, 14 nt, Leptospira interrogans serovar lai str. 56601
auaacaaacuuuua

SEQ ID NO: 746015 - RNA, 23 nt, Leptospira interrogans serovar lai str. 56601
auaacaauucucgauagaacaau

SEQ ID NO: 746016 - RNA, 17 nt, Leptospira interrogans serovar lai str. 56601
auaacaauagcuuaaaa

SEQ ID NO: 746017 - RNA, 12 nt, Leptospira interrogans serovar lai str. 56601
auaaauuuaaaa

SEQ ID NO: 746018 - RNA, 13 nt, Leptospira interrogans serovar lai str. 56601
auaaauuuaaaaa

SEQ ID NO: 746019 - RNA, 14 nt, Leptospira interrogans serovar lai str. 56601
auaaauuguuucau

SEQ ID NO: 746020 - RNA, 13 nt, Leptospira interrogans serovar lai str. 56601
auaaauuuaguag

SEQ ID NO: 746021 - RNA, 17 nt, Leptospira interrogans serovar lai str. 56601
auaaauuuaguaguaaa

SEQ ID NO: 746022 - RNA, 20 nt, Leptospira interrogans serovar lai str. 56601
auaaauuuaguaguaaauaa

SEQ ID NO: 746023 - RNA, 14 nt, Leptospira interrogans serovar lai str. 56601
auaaauuuauaauu

SEQ ID NO: 746024 - RNA, 18 nt, Leptospira interrogans serovar lai str. 56601
auaaauuuauaauucaaa

SEQ ID NO: 746025 - RNA, 22 nt, Leptospira interrogans serovar lai str. 56601
auaaauuggguaucuaaauauu

SEQ ID NO: 746026 - RNA, 15 nt, Leptospira interrogans serovar lai str. 56601
auaaauugcaucaaa

SEQ ID NO: 746027 - RNA, 14 nt, Leptospira interrogans serovar lai str. 56601
auaaauucuuacua

SEQ ID NO: 746028 - RNA, 15 nt, Leptospira interrogans serovar lai str. 56601
auaaauugaaaguaa

SEQ ID NO: 746029 - RNA, 20 nt, Leptospira interrogans serovar lai str. 56601
auaacgauuccauuuuuuag

SEQ ID NO: 746030 - RNA, 22 nt, Leptospira interrogans serovar lai str. 56601
auaacgauuccauuuuuuagaa

SEQ ID NO: 746031 - RNA, 23 nt, Leptospira interrogans serovar lai str. 56601
auaacgauuccauuuuuuagaau

SEQ ID NO: 746032 - RNA, 18 nt, Leptospira interrogans serovar lai str. 56601
auaaccuuacccacaaau

SEQ ID NO: 746033 - RNA, 20 nt, Leptospira interrogans serovar lai str. 56601
auaaccuuacccacaaauaa

SEQ ID NO: 746034 - RNA, 22 nt, Leptospira interrogans serovar lai str. 56601
auaaccuuacccacaaauaauu

SEQ ID NO: 746035 - RNA, 20 nt, Leptospira interrogans serovar lai str. 56601
aguuuaugugaguucccaua

SEQ ID NO: 746036 - RNA, 18 nt, Leptospira interrogans serovar lai str. 56601
aguuucaauuuaaaacga

SEQ ID NO: 746037 - RNA, 12 nt, Leptospira interrogans serovar lai str. 56601
aguuucacaaaa

SEQ ID NO: 746038 - RNA, 22 nt, Leptospira interrogans serovar lai str. 56601
aguuuccaaaaaagacuuaaaa

SEQ ID NO: 746039 - RNA, 22 nt, Leptospira interrogans serovar lai str. 56601
aguuuuaguuuuuauuugauua

SEQ ID NO: 746040 - RNA, 14 nt, Leptospira interrogans serovar lai str. 56601
aguuuucaaaaaau

SEQ ID NO: 746041 - RNA, 15 nt, Leptospira interrogans serovar lai str. 56601
aguuuucaaaaaaug

SEQ ID NO: 746042 - RNA, 19 nt, Leptospira interrogans serovar lai str. 56601
aguuugggcgaauaaaaaa

SEQ ID NO: 746043 - RNA, 17 nt, Leptospira interrogans serovar lai str. 56601
aguuugguccuuuguga

SEQ ID NO: 746044 - RNA, 23 nt, Leptospira interrogans serovar lai str. 56601
aguuuggcguaaaauggaaaaaa

SEQ ID NO: 746045 - RNA, 14 nt, Leptospira interrogans serovar lai str. 56601
auaaaaaauguauu

SEQ ID NO: 746046 - RNA, 12 nt, Leptospira interrogans serovar lai str. 56601
auaaaaacaucu

SEQ ID NO: 746047 - RNA, 14 nt, Leptospira interrogans serovar lai str. 56601
auaaaaaacucaau

SEQ ID NO: 746048 - RNA, 15 nt, Leptospira interrogans serovar lai str. 56601
auaaaaaagaaagca

SEQ ID NO: 746049 - RNA, 12 nt, Leptospira interrogans serovar lai str. 56601
auaaaaaaggaa

SEQ ID NO: 746050 - RNA, 17 nt, Leptospira interrogans serovar lai str. 56601
aguuuuuucguaaaaaa

SEQ ID NO: 746051 - RNA, 20 nt, Leptospira interrogans serovar lai str. 56601
aguuuucaaucgaagaaaua

SEQ ID NO: 746052 - RNA, 22 nt, Leptospira interrogans serovar lai str. 56601
aguuuucaaucgaagaaauaca

SEQ ID NO: 746053 - RNA, 13 nt, Leptospira interrogans serovar lai str. 56601
aguuuuccuucua

SEQ ID NO: 746054 - RNA, 12 nt, Leptospira interrogans serovar lai str. 56601
aguuuuccauuc

SEQ ID NO: 746055 - RNA, 14 nt, Leptospira interrogans serovar lai str. 56601
aguuuuccauucuc

SEQ ID NO: 746056 - RNA, 13 nt, Leptospira interrogans serovar lai str. 56601
aguuuuucuaaau

SEQ ID NO: 746057 - RNA, 23 nt, Leptospira interrogans serovar lai str. 56601
aguuuuucgguaaaaucauucuu

SEQ ID NO: 746058 - RNA, 12 nt, Leptospira interrogans serovar lai str. 56601
aguuuuuuaaaa

SEQ ID NO: 746059 - RNA, 17 nt, Leptospira interrogans serovar lai str. 56601
aguuuuuuaaaacgaac

SEQ ID NO: 746060 - RNA, 21 nt, Leptospira interrogans serovar lai str. 56601
aguuuuuggccuaaggaucca

SEQ ID NO: 746061 - RNA, 16 nt, Leptospira interrogans serovar lai str. 56601
aguuuuucuuaaaaag

SEQ ID NO: 746062 - RNA, 18 nt, Leptospira interrogans serovar lai str. 56601
aguuuuugaaaaaugaau

SEQ ID NO: 746063 - RNA, 13 nt, Leptospira interrogans serovar lai str. 56601
aguugcuaagaaa

SEQ ID NO: 746064 - RNA, 17 nt, Leptospira interrogans serovar lai str. 56601
aguugagaguuuuucua

SEQ ID NO: 746065 - RNA, 18 nt, Leptospira interrogans serovar lai str. 56601
aguuguauaacagagugc

SEQ ID NO: 746066 - RNA, 21 nt, Leptospira interrogans serovar lai str. 56601
aguuguauaacagagugcuca

SEQ ID NO: 746067 - RNA, 22 nt, Leptospira interrogans serovar lai str. 56601
aguuguaucagauguuuuaaaa

SEQ ID NO: 746068 - RNA, 13 nt, Leptospira interrogans serovar lai str. 56601
aguuguacaaaaa

SEQ ID NO: 746069 - RNA, 14 nt, Leptospira interrogans serovar lai str. 56601
aguuguacaaaaau

SEQ ID NO: 746070 - RNA, 17 nt, Leptospira interrogans serovar lai str. 56601
aguuguacaaaaaugug

SEQ ID NO: 746071 - RNA, 16 nt, Leptospira interrogans serovar lai str. 56601
aguuggggggaauaua

SEQ ID NO: 746072 - RNA, 15 nt, Leptospira interrogans serovar lai str. 56601
aguuuauaaagcaaa

SEQ ID NO: 746073 - RNA, 16 nt, Leptospira interrogans serovar lai str. 56601
aguuuauaaagcaaaa

SEQ ID NO: 746074 - RNA, 22 nt, Leptospira interrogans serovar lai str. 56601
aguuuaguguaagaaagaagug

SEQ ID NO: 746075 - RNA, 18 nt, Leptospira interrogans serovar lai str. 56601
aguuuauuuuaaaaaaau

SEQ ID NO: 746076 - RNA, 20 nt, Leptospira interrogans serovar lai str. 56601
aguuuauuuuucuuuuaaaa

SEQ ID NO: 746077 - RNA, 15 nt, Leptospira interrogans serovar lai str. 56601
aguuucaaacgcuuu

SEQ ID NO: 746078 - RNA, 16 nt, Leptospira interrogans serovar lai str. 56601
aguuucaaacgcuuuc

SEQ ID NO: 746079 - RNA, 12 nt, Leptospira interrogans serovar lai str. 56601
aguuuagaacug

SEQ ID NO: 746080 - RNA, 15 nt, Leptospira interrogans serovar lai str. 56601
aguuuagauuuuaac

SEQ ID NO: 746081 - RNA, 19 nt, Leptospira interrogans serovar lai str. 56601
aguucuacuuuauuaaaaa

SEQ ID NO: 746082 - RNA, 15 nt, Leptospira interrogans serovar lai str. 56601
aguucuauuuuauca

SEQ ID NO: 746083 - RNA, 20 nt, Leptospira interrogans serovar lai str. 56601
aguucucaagaucauucuau

SEQ ID NO: 746084 - RNA, 16 nt, Leptospira interrogans serovar lai str. 56601
aguucuccuacuuggu

SEQ ID NO: 746085 - RNA, 18 nt, Leptospira interrogans serovar lai str. 56601
aguucucuucauccagau

SEQ ID NO: 746086 - RNA, 13 nt, Leptospira interrogans serovar lai str. 56601
aguucuuuucuua

SEQ ID NO: 746087 - RNA, 12 nt, Leptospira interrogans serovar lai str. 56601
aguucauauuuu

SEQ ID NO: 746088 - RNA, 15 nt, Leptospira interrogans serovar lai str. 56601
aguucauauuuuaac

SEQ ID NO: 746089 - RNA, 19 nt, Leptospira interrogans serovar lai str. 56601
aguucagguaguaguugca

SEQ ID NO: 746090 - RNA, 16 nt, Leptospira interrogans serovar lai str. 56601
aguucccauagauuaa

SEQ ID NO: 746091 - RNA, 20 nt, Leptospira interrogans serovar lai str. 56601
aguucauucccuuaaucauu

SEQ ID NO: 746092 - RNA, 16 nt, Leptospira interrogans serovar lai str. 56601
aguucauaagauugga

SEQ ID NO: 746093 - RNA, 14 nt, Leptospira interrogans serovar lai str. 56601
aguuccgaaaauuu

SEQ ID NO: 746094 - RNA, 15 nt, Leptospira interrogans serovar lai str. 56601
aguuccgaaaauuug

SEQ ID NO: 746095 - RNA, 17 nt, Leptospira interrogans serovar lai str. 56601
aguucgauuaaaauaaa

SEQ ID NO: 746096 - RNA, 18 nt, Leptospira interrogans serovar lai str. 56601
aguucgauuaaaauaaac

SEQ ID NO: 746097 - RNA, 22 nt, Leptospira interrogans serovar lai str. 56601
aguuccuaacuuugaaaauuuu

SEQ ID NO: 746098 - RNA, 13 nt, Leptospira interrogans serovar lai str. 56601
aguuccuacaaau

SEQ ID NO: 746099 - RNA, 17 nt, Leptospira interrogans serovar lai str. 56601
aguuccuacauuuuaaa

SEQ ID NO: 746100 - RNA, 18 nt, Leptospira interrogans serovar lai str. 56601
aguuccuacauuuuaaaa

SEQ ID NO: 746101 - RNA, 21 nt, Leptospira interrogans serovar lai str. 56601
aguucagacaugauucauuuu

SEQ ID NO: 746102 - RNA, 23 nt, Leptospira interrogans serovar lai str. 56601
aguucagaugaauugaauuuuuu

SEQ ID NO: 746103 - RNA, 16 nt, Leptospira interrogans serovar lai str. 56601
aguuaugaauaaaaaa

SEQ ID NO: 746104 - RNA, 22 nt, Leptospira interrogans serovar lai str. 56601
aguuaugaauaaaaaauuucuu

SEQ ID NO: 746105 - RNA, 16 nt, Leptospira interrogans serovar lai str. 56601
aguuauuaacagccga

SEQ ID NO: 746106 - RNA, 15 nt, Leptospira interrogans serovar lai str. 56601
aguuaaauauaaaag

SEQ ID NO: 746107 - RNA, 16 nt, Leptospira interrogans serovar lai str. 56601
aguuaaaucaccuuuu

SEQ ID NO: 746108 - RNA, 23 nt, Leptospira interrogans serovar lai str. 56601
aguuaagaagauaaauauuucca

SEQ ID NO: 746109 - RNA, 13 nt, Leptospira interrogans serovar lai str. 56601
aguuaauucuaaa

SEQ ID NO: 746110 - RNA, 22 nt, Leptospira interrogans serovar lai str. 56601
aguuaauuuuaucuuuuucuau

SEQ ID NO: 746111 - RNA, 13 nt, Leptospira interrogans serovar lai str. 56601
aguuaagugaaaa

SEQ ID NO: 746112 - RNA, 15 nt, Leptospira interrogans serovar lai str. 56601
agugccgcaccuuuu

SEQ ID NO: 746113 - RNA, 22 nt, Leptospira interrogans serovar lai str. 56601
agugauuucaugcaaaaauuua

SEQ ID NO: 746114 - RNA, 22 nt, Leptospira interrogans serovar lai str. 56601
agugcaacgcguuuuaguuuua

SEQ ID NO: 746115 - RNA, 13 nt, Leptospira interrogans serovar lai str. 56601
agucuauuuccca

SEQ ID NO: 746116 - RNA, 15 nt, Leptospira interrogans serovar lai str. 56601
agugaaagauuaaag

SEQ ID NO: 746117 - RNA, 19 nt, Leptospira interrogans serovar lai str. 56601
agugaaagauuaaagauuu

SEQ ID NO: 746118 - RNA, 23 nt, Leptospira interrogans serovar lai str. 56601
agugaaaaaucgauuugaucuac

SEQ ID NO: 746119 - RNA, 20 nt, Leptospira interrogans serovar lai str. 56601
agugaaccucuguaaauaca

SEQ ID NO: 746120 - RNA, 24 nt, Leptospira interrogans serovar lai str. 56601
agugaaccucuguaaauacaaaau

SEQ ID NO: 746121 - RNA, 14 nt, Leptospira interrogans serovar lai str. 56601
agugaguuuucuuc

SEQ ID NO: 746122 - RNA, 15 nt, Leptospira interrogans serovar lai str. 56601
agugaugaagagaaa

SEQ ID NO: 746123 - RNA, 16 nt, Leptospira interrogans serovar lai str. 56601
agugauaagaaaaauu

SEQ ID NO: 746124 - RNA, 20 nt, Leptospira interrogans serovar lai str. 56601
aguccuccaaacaauuuuuu

SEQ ID NO: 746125 - RNA, 22 nt, Leptospira interrogans serovar lai str. 56601
agucccuacaauuuuagaauuu

SEQ ID NO: 746126 - RNA, 23 nt, Leptospira interrogans serovar lai str. 56601
agucgaucuacuaaaucagaaua

SEQ ID NO: 746127 - RNA, 19 nt, Leptospira interrogans serovar lai str. 56601
agucauuuuuaaauacuuu

SEQ ID NO: 746128 - RNA, 14 nt, Leptospira interrogans serovar lai str. 56601
agucauuuccucca

SEQ ID NO: 746129 - RNA, 16 nt, Leptospira interrogans serovar lai str. 56601
agucauuuccuccaaa

SEQ ID NO: 746130 - RNA, 12 nt, Leptospira interrogans serovar lai str. 56601
agucauucugua

SEQ ID NO: 746131 - RNA, 12 nt, Leptospira interrogans serovar lai str. 56601
agucauugaagg

SEQ ID NO: 746132 - RNA, 15 nt, Leptospira interrogans serovar lai str. 56601
agucauacauuuugu

SEQ ID NO: 746133 - RNA, 12 nt, Leptospira interrogans serovar lai str. 56601
agucauauaaaa

SEQ ID NO: 746134 - RNA, 23 nt, Leptospira interrogans serovar lai str. 56601
agucauauaaaagugaacagucu

SEQ ID NO: 746135 - RNA, 18 nt, Leptospira interrogans serovar lai str. 56601
aguccaauuuuaaaacca

SEQ ID NO: 746136 - RNA, 15 nt, Leptospira interrogans serovar lai str. 56601
aguccaaaacaaagu

SEQ ID NO: 746137 - RNA, 22 nt, Leptospira interrogans serovar lai str. 56601
aguccaugauucugaaaagaau

SEQ ID NO: 746138 - RNA, 15 nt, Leptospira interrogans serovar lai str. 56601
agucaaauuuggaaa

SEQ ID NO: 746139 - RNA, 22 nt, Leptospira interrogans serovar lai str. 56601
agucaacgacucguaauuaaau

SEQ ID NO: 746140 - RNA, 13 nt, Leptospira interrogans serovar lai str. 56601
aguauuuuucuua

SEQ ID NO: 746141 - RNA, 22 nt, Leptospira interrogans serovar lai str. 56601
agucaaugguugcaaaaaagaa

SEQ ID NO: 746142 - RNA, 22 nt, Leptospira interrogans serovar lai str. 56601
agucaguuuuuucguaaaaaau

SEQ ID NO: 746143 - RNA, 23 nt, Leptospira interrogans serovar lai str. 56601
aguaugaguuccuacaauuuuag

SEQ ID NO: 746144 - RNA, 13 nt, Leptospira interrogans serovar lai str. 56601
aguaucuaaaagu

SEQ ID NO: 746145 - RNA, 15 nt, Leptospira interrogans serovar lai str. 56601
aguaucuaaaaguuu

SEQ ID NO: 746146 - RNA, 14 nt, Leptospira interrogans serovar lai str. 56601
aguauccaaaauua

SEQ ID NO: 746147 - RNA, 15 nt, Leptospira interrogans serovar lai str. 56601
aguauccaaaauuaa

SEQ ID NO: 746148 - RNA, 18 nt, Leptospira interrogans serovar lai str. 56601
aguauguuuuucggaauc

SEQ ID NO: 746149 - RNA, 14 nt, Leptospira interrogans serovar lai str. 56601
aguauguuuuucug

SEQ ID NO: 746150 - RNA, 18 nt, Leptospira interrogans serovar lai str. 56601
aguauguuuuuuugauaa

SEQ ID NO: 746151 - RNA, 16 nt, Leptospira interrogans serovar lai str. 56601
aguauucauuuucuau

SEQ ID NO: 746152 - RNA, 16 nt, Leptospira interrogans serovar lai str. 56601
aguauuauuuuccuuu

SEQ ID NO: 746153 - RNA, 17 nt, Leptospira interrogans serovar lai str. 56601
aguauuauuuuccuuua

SEQ ID NO: 746154 - RNA, 14 nt, Leptospira interrogans serovar lai str. 56601
aguauucaauucca

SEQ ID NO: 746155 - RNA, 20 nt, Leptospira interrogans serovar lai str. 56601
aguauucaauuuuuauagau

SEQ ID NO: 746156 - RNA, 16 nt, Leptospira interrogans serovar lai str. 56601
aguauuaauuuaauca

SEQ ID NO: 746157 - RNA, 18 nt, Leptospira interrogans serovar lai str. 56601
aguauuaauuuuccuauu

SEQ ID NO: 746158 - RNA, 22 nt, Leptospira interrogans serovar lai str. 56601
aguauucucccccaacugaaaa

SEQ ID NO: 746159 - RNA, 19 nt, Leptospira interrogans serovar lai str. 56601
aguauuuugcacugaaaua

SEQ ID NO: 746160 - RNA, 21 nt, Leptospira interrogans serovar lai str. 56601
aguauuuucgcacauucuaua

SEQ ID NO: 746161 - RNA, 19 nt, Leptospira interrogans serovar lai str. 56601
aguauuuucuagauagguu

SEQ ID NO: 746162 - RNA, 22 nt, Leptospira interrogans serovar lai str. 56601
aguauuuugugacuaauuuugu

SEQ ID NO: 746163 - RNA, 12 nt, Leptospira interrogans serovar lai str. 56601
aguauuuuuaag

SEQ ID NO: 746164 - RNA, 14 nt, Leptospira interrogans serovar lai str. 56601
aguauuuuuaagau

SEQ ID NO: 746165 - RNA, 17 nt, Leptospira interrogans serovar lai str. 56601
aguaggauaauacaaau

SEQ ID NO: 746166 - RNA, 13 nt, Leptospira interrogans serovar lai str. 56601
aguaguagucuua

SEQ ID NO: 746167 - RNA, 12 nt, Leptospira interrogans serovar lai str. 56601
aguaguagaaaa

SEQ ID NO: 746168 - RNA, 14 nt, Leptospira interrogans serovar lai str. 56601
aguaggcuauuuua

SEQ ID NO: 746169 - RNA, 18 nt, Leptospira interrogans serovar lai str. 56601
aguagccuuuuuaacucc

SEQ ID NO: 746170 - RNA, 11 nt, Leptospira interrogans serovar lai str. 56601
aguaguuuuuu

SEQ ID NO: 746171 - RNA, 14 nt, Leptospira interrogans serovar lai str. 56601
aguaguuuuuugau

SEQ ID NO: 746172 - RNA, 22 nt, Leptospira interrogans serovar lai str. 56601
aguaguucccacauuuugugaa

SEQ ID NO: 746173 - RNA, 20 nt, Leptospira interrogans serovar lai str. 56601
aguaguuccuacauuuuaaa

SEQ ID NO: 746174 - RNA, 19 nt, Leptospira interrogans serovar lai str. 56601
aguaguuccuacauuuuuu

SEQ ID NO: 746175 - RNA, 19 nt, Leptospira interrogans serovar lai str. 56601
aguagucuuacaauuuuag

SEQ ID NO: 746176 - RNA, 15 nt, Leptospira interrogans serovar lai str. 56601
aguaguaaauuaaca

SEQ ID NO: 746177 - RNA, 22 nt, Leptospira interrogans serovar lai str. 56601
aguagucccacauuuuugugaa

SEQ ID NO: 746178 - RNA, 21 nt, Leptospira interrogans serovar lai str. 56601
aguauaacccaaaacuaaaac

SEQ ID NO: 746179 - RNA, 17 nt, Leptospira interrogans serovar lai str. 56601
aguauaauauuuauuua

SEQ ID NO: 746180 - RNA, 14 nt, Leptospira interrogans serovar lai str. 56601
aguauaaucaaaua

SEQ ID NO: 746181 - RNA, 20 nt, Leptospira interrogans serovar lai str. 56601
aguauaaucaaauacaaaaa

SEQ ID NO: 746182 - RNA, 18 nt, Leptospira interrogans serovar lai str. 56601
aguauauuauaauuuuaa

SEQ ID NO: 746183 - RNA, 18 nt, Leptospira interrogans serovar lai str. 56601
aguagacaacuaaaagac

SEQ ID NO: 746184 - RNA, 15 nt, Leptospira interrogans serovar lai str. 56601
aguagauuccuacau

SEQ ID NO: 746185 - RNA, 19 nt, Leptospira interrogans serovar lai str. 56601
aguacuauauuuuugugaa

SEQ ID NO: 746186 - RNA, 14 nt, Leptospira interrogans serovar lai str. 56601
aguacgaucaaauc

SEQ ID NO: 746187 - RNA, 12 nt, Leptospira interrogans serovar lai str. 56601
aucaaauuuuug

SEQ ID NO: 746188 - RNA, 14 nt, Leptospira interrogans serovar lai str. 56601
aucaaauuuuugaa

SEQ ID NO: 746189 - RNA, 20 nt, Leptospira interrogans serovar lai str. 56601
aucaaauuuuugcauaaaau

SEQ ID NO: 746190 - RNA, 21 nt, Leptospira interrogans serovar lai str. 56601
aucaaauuuuugcauaaaauc

SEQ ID NO: 746191 - RNA, 23 nt, Leptospira interrogans serovar lai str. 56601
aucaaauuuuugcauaaaaucgu

SEQ ID NO: 746192 - RNA, 13 nt, Leptospira interrogans serovar lai str. 56601
aucaacaaaauua

SEQ ID NO: 746193 - RNA, 21 nt, Leptospira interrogans serovar lai str. 56601
aucaacucaucuaguuuuuga

SEQ ID NO: 746194 - RNA, 15 nt, Leptospira interrogans serovar lai str. 56601
aucaacucuguaaau

SEQ ID NO: 746195 - RNA, 18 nt, Leptospira interrogans serovar lai str. 56601
aucaacucuguaaauuca

SEQ ID NO: 746196 - RNA, 20 nt, Leptospira interrogans serovar lai str. 56601
aucaacucuguaaauucaaa

SEQ ID NO: 746197 - RNA, 13 nt, Leptospira interrogans serovar lai str. 56601
aucaauagaaaua

SEQ ID NO: 746198 - RNA, 15 nt, Leptospira interrogans serovar lai str. 56601
aucaauagaaauacu

SEQ ID NO: 746199 - RNA, 23 nt, Leptospira interrogans serovar lai str. 56601
aucaauaaauugcacaaaagaaa

SEQ ID NO: 746200 - RNA, 20 nt, Leptospira interrogans serovar lai str. 56601
aucaagagaacucauuaacu

SEQ ID NO: 746201 - RNA, 13 nt, Leptospira interrogans serovar lai str. 56601
aucaacuuuucca

SEQ ID NO: 746202 - RNA, 15 nt, Leptospira interrogans serovar lai str. 56601
aucaagaagagucaa

SEQ ID NO: 746203 - RNA, 16 nt, Leptospira interrogans serovar lai str. 56601
auauuucuaaaagaag

SEQ ID NO: 746204 - RNA, 22 nt, Leptospira interrogans serovar lai str. 56601
auauuucuaaaagaagaugcuu

SEQ ID NO: 746205 - RNA, 19 nt, Leptospira interrogans serovar lai str. 56601
auauuucucucaaauucuu

SEQ ID NO: 746206 - RNA, 18 nt, Leptospira interrogans serovar lai str. 56601
auauuucauugaaauaug

SEQ ID NO: 746207 - RNA, 11 nt, Leptospira interrogans serovar lai str. 56601
auauuuccaaa

SEQ ID NO: 746208 - RNA, 16 nt, Leptospira interrogans serovar lai str. 56601
auauuucaauauaaaa

SEQ ID NO: 746209 - RNA, 18 nt, Leptospira interrogans serovar lai str. 56601
auauuucaauauaaaaau

SEQ ID NO: 746210 - RNA, 22 nt, Leptospira interrogans serovar lai str. 56601
aucaaaacuuaaaucccauuuu

SEQ ID NO: 746211 - RNA, 18 nt, Leptospira interrogans serovar lai str. 56601
aucaaaacgguuuucuaa

SEQ ID NO: 746212 - RNA, 15 nt, Leptospira interrogans serovar lai str. 56601
auauuugaauuuuau

SEQ ID NO: 746213 - RNA, 16 nt, Leptospira interrogans serovar lai str. 56601
auauuugaauuuuaua

SEQ ID NO: 746214 - RNA, 20 nt, Leptospira interrogans serovar lai str. 56601
auauuucuucguuauuuuua

SEQ ID NO: 746215 - RNA, 13 nt, Leptospira interrogans serovar lai str. 56601
auauuugauauaa

SEQ ID NO: 746216 - RNA, 17 nt, Leptospira interrogans serovar lai str. 56601
aucaaaaggaauacaau

SEQ ID NO: 746217 - RNA, 18 nt, Leptospira interrogans serovar lai str. 56601
aucaaaagguauaaaaua

SEQ ID NO: 746218 - RNA, 20 nt, Leptospira interrogans serovar lai str. 56601
aucaaaagguauaaaauaaa

SEQ ID NO: 746219 - RNA, 14 nt, Leptospira interrogans serovar lai str. 56601
aucaaauacaaaau

SEQ ID NO: 746220 - RNA, 14 nt, Leptospira interrogans serovar lai str. 56601
aucaaauauacaaa

SEQ ID NO: 746221 - RNA, 17 nt, Leptospira interrogans serovar lai str. 56601
aucaaauauacaaaguu

SEQ ID NO: 746222 - RNA, 21 nt, Leptospira interrogans serovar lai str. 56601
aucaaauuucugcaucaaauc

SEQ ID NO: 746223 - RNA, 16 nt, Leptospira interrogans serovar lai str. 56601
aucaaauucacauaaa

SEQ ID NO: 746224 - RNA, 14 nt, Leptospira interrogans serovar lai str. 56601
aucaaauucaugau

SEQ ID NO: 746225 - RNA, 20 nt, Leptospira interrogans serovar lai str. 56601
aucaaauucaugauaguuaa

SEQ ID NO: 746226 - RNA, 21 nt, Leptospira interrogans serovar lai str. 56601
aucaaauucaugauaguuaau

SEQ ID NO: 746227 - RNA, 17 nt, Leptospira interrogans serovar lai str. 56601
aucaaaugcaguaaugc

SEQ ID NO: 746228 - RNA, 18 nt, Leptospira interrogans serovar lai str. 56601
aucaaaucugaaauucau

SEQ ID NO: 746229 - RNA, 16 nt, Leptospira interrogans serovar lai str. 56601
aucaaagagaugauuu

SEQ ID NO: 746230 - RNA, 11 nt, Leptospira interrogans serovar lai str. 56601
aucaaaaugaa

SEQ ID NO: 746231 - RNA, 20 nt, Leptospira interrogans serovar lai str. 56601
aucaaagaaacguuauacaa

SEQ ID NO: 746232 - RNA, 16 nt, Leptospira interrogans serovar lai str. 56601
aucaaaggaaauaaaa

SEQ ID NO: 746233 - RNA, 16 nt, Leptospira interrogans serovar lai str. 56601
auauuuagaauaaaau

SEQ ID NO: 746234 - RNA, 13 nt, Leptospira interrogans serovar lai str. 56601
auauuuauaaaac

SEQ ID NO: 746235 - RNA, 19 nt, Leptospira interrogans serovar lai str. 56601
auauuuauaaaacaaucuu

SEQ ID NO: 746236 - RNA, 15 nt, Leptospira interrogans serovar lai str. 56601
auauuuauaaaacga

SEQ ID NO: 746237 - RNA, 11 nt, Leptospira interrogans serovar lai str. 56601
auauuuauaau

SEQ ID NO: 746238 - RNA, 20 nt, Leptospira interrogans serovar lai str. 56601
auauugaguuaauuuucgau

SEQ ID NO: 746239 - RNA, 18 nt, Leptospira interrogans serovar lai str. 56601
auauugagaucaaauacu

SEQ ID NO: 746240 - RNA, 13 nt, Leptospira interrogans serovar lai str. 56601
auauugagcaaga

SEQ ID NO: 746241 - RNA, 20 nt, Leptospira interrogans serovar lai str. 56601
auauugcugucauaaaccga

SEQ ID NO: 746242 - RNA, 21 nt, Leptospira interrogans serovar lai str. 56601
auauugguuauaccaaauuca

SEQ ID NO: 746243 - RNA, 15 nt, Leptospira interrogans serovar lai str. 56601
auauucuuuuauaua

SEQ ID NO: 746244 - RNA, 18 nt, Leptospira interrogans serovar lai str. 56601
auauucuuuucugaauaa

SEQ ID NO: 746245 - RNA, 14 nt, Leptospira interrogans serovar lai str. 56601
auauuaugaaauaa

SEQ ID NO: 746246 - RNA, 14 nt, Leptospira interrogans serovar lai str. 56601
auauuauauuuuua

SEQ ID NO: 746247 - RNA, 21 nt, Leptospira interrogans serovar lai str. 56601
auauuauauuuuuaaaaagua

SEQ ID NO: 746248 - RNA, 15 nt, Leptospira interrogans serovar lai str. 56601
auauuauaaauacaa

SEQ ID NO: 746249 - RNA, 14 nt, Leptospira interrogans serovar lai str. 56601
auauuauaaauuua

SEQ ID NO: 746250 - RNA, 18 nt, Leptospira interrogans serovar lai str. 56601
auauuauaaauuuaaaaa

SEQ ID NO: 746251 - RNA, 13 nt, Leptospira interrogans serovar lai str. 56601
auauuauaauucu

SEQ ID NO: 746252 - RNA, 15 nt, Leptospira interrogans serovar lai str. 56601
auauuauaauuuuaa

SEQ ID NO: 746253 - RNA, 18 nt, Leptospira interrogans serovar lai str. 56601
auauuauaauuuuaaaua

SEQ ID NO: 746254 - RNA, 13 nt, Leptospira interrogans serovar lai str. 56601
auauuaaguuuuu

SEQ ID NO: 746255 - RNA, 21 nt, Leptospira interrogans serovar lai str. 56601
auauuaaguuuuuuaaauuua

SEQ ID NO: 746256 - RNA, 13 nt, Leptospira interrogans serovar lai str. 56601
auauuaacuuuca

SEQ ID NO: 746257 - RNA, 15 nt, Leptospira interrogans serovar lai str. 56601
auauuaauuuaaaaa

SEQ ID NO: 746258 - RNA, 18 nt, Leptospira interrogans serovar lai str. 56601
auauuaacaaauuuaaaa

SEQ ID NO: 746259 - RNA, 12 nt, Leptospira interrogans serovar lai str. 56601
auauuaaaacac

SEQ ID NO: 746260 - RNA, 23 nt, Leptospira interrogans serovar lai str. 56601
auauuaaagaauaauauuuuaau

SEQ ID NO: 746261 - RNA, 12 nt, Leptospira interrogans serovar lai str. 56601
auauuaaauuaa

SEQ ID NO: 746262 - RNA, 19 nt, Leptospira interrogans serovar lai str. 56601
auauuagaauuguugaaaa

SEQ ID NO: 746263 - RNA, 20 nt, Leptospira interrogans serovar lai str. 56601
auauuagaguuucuaaaaaa

SEQ ID NO: 746264 - RNA, 21 nt, Leptospira interrogans serovar lai str. 56601
auauuagaguuucuaaaaaaa

SEQ ID NO: 746265 - RNA, 21 nt, Leptospira interrogans serovar lai str. 56601
auauuagaguuuuugaaaaau

SEQ ID NO: 746266 - RNA, 12 nt, Leptospira interrogans serovar lai str. 56601
auauuagauuua

SEQ ID NO: 746267 - RNA, 14 nt, Leptospira interrogans serovar lai str. 56601
auauuagauuuaua

SEQ ID NO: 746268 - RNA, 12 nt, Leptospira interrogans serovar lai str. 56601
auauuaauuaua

SEQ ID NO: 746269 - RNA, 21 nt, Leptospira interrogans serovar lai str. 56601
auauguuuagaguauuauaaa

SEQ ID NO: 746270 - RNA, 18 nt, Leptospira interrogans serovar lai str. 56601
auauguuucuuuuguaaa

SEQ ID NO: 746271 - RNA, 19 nt, Leptospira interrogans serovar lai str. 56601
auauguuucuuuuguaaaa

SEQ ID NO: 746272 - RNA, 22 nt, Leptospira interrogans serovar lai str. 56601
auauguuucuuuuguaaaacga

SEQ ID NO: 746273 - RNA, 19 nt, Leptospira interrogans serovar lai str. 56601
auauguuuuuuuucaacaa

SEQ ID NO: 746274 - RNA, 12 nt, Leptospira interrogans serovar lai str. 56601
auauuaaaaaaa

SEQ ID NO: 746275 - RNA, 14 nt, Leptospira interrogans serovar lai str. 56601
auauuaaaaaaaua

SEQ ID NO: 746276 - RNA, 15 nt, Leptospira interrogans serovar lai str. 56601
auauuaaaaaaauaa

SEQ ID NO: 746277 - RNA, 13 nt, Leptospira interrogans serovar lai str. 56601
auauguuauauaa

SEQ ID NO: 746278 - RNA, 23 nt, Leptospira interrogans serovar lai str. 56601
auauggguuuuuacgcaaguaau

SEQ ID NO: 746279 - RNA, 19 nt, Leptospira interrogans serovar lai str. 56601
auauguauuuauucaaaau

SEQ ID NO: 746280 - RNA, 17 nt, Leptospira interrogans serovar lai str. 56601
auaucuccaaaaucauu

SEQ ID NO: 746281 - RNA, 15 nt, Leptospira interrogans serovar lai str. 56601
auaucugaauuuuua

SEQ ID NO: 746282 - RNA, 16 nt, Leptospira interrogans serovar lai str. 56601
auaucugaauuuuuau

SEQ ID NO: 746283 - RNA, 20 nt, Leptospira interrogans serovar lai str. 56601
auaucugaauuuuuauaagu

SEQ ID NO: 746284 - RNA, 13 nt, Leptospira interrogans serovar lai str. 56601
auaugaaaauaau

SEQ ID NO: 746285 - RNA, 21 nt, Leptospira interrogans serovar lai str. 56601
auaugaauuaauuuguaauuc

SEQ ID NO: 746286 - RNA, 20 nt, Leptospira interrogans serovar lai str. 56601
auaugcauccgucucagcaa

SEQ ID NO: 746287 - RNA, 20 nt, Leptospira interrogans serovar lai str. 56601
auauggauuauccaaaacaa

SEQ ID NO: 746288 - RNA, 22 nt, Leptospira interrogans serovar lai str. 56601
auaucauauuguuuaauaccua

SEQ ID NO: 746289 - RNA, 23 nt, Leptospira interrogans serovar lai str. 56601
auauauauuuugaacaaguucua

SEQ ID NO: 746290 - RNA, 14 nt, Leptospira interrogans serovar lai str. 56601
auauaucaguuuug

SEQ ID NO: 746291 - RNA, 15 nt, Leptospira interrogans serovar lai str. 56601
auauaucuucuuugg

SEQ ID NO: 746292 - RNA, 20 nt, Leptospira interrogans serovar lai str. 56601
auaucaguuuuguuaaccaa

SEQ ID NO: 746293 - RNA, 16 nt, Leptospira interrogans serovar lai str. 56601
auaucauaaauuuuua

SEQ ID NO: 746294 - RNA, 15 nt, Leptospira interrogans serovar lai str. 56601
auaucauaacaaaua

SEQ ID NO: 746295 - RNA, 21 nt, Leptospira interrogans serovar lai str. 56601
auaucauaacaaauaaaagga

SEQ ID NO: 746296 - RNA, 22 nt, Leptospira interrogans serovar lai str. 56601
auaucauaacaaauaaaaggag

SEQ ID NO: 746297 - RNA, 17 nt, Leptospira interrogans serovar lai str. 56601
auauccgaaagauaaau

SEQ ID NO: 746298 - RNA, 18 nt, Leptospira interrogans serovar lai str. 56601
auauccgaaagauaaauc

SEQ ID NO: 746299 - RNA, 23 nt, Leptospira interrogans serovar lai str. 56601
auauccgaaagauaaaucgcaaa

SEQ ID NO: 746300 - RNA, 16 nt, Leptospira interrogans serovar lai str. 56601
auauccuugaaguaga

SEQ ID NO: 746301 - RNA, 16 nt, Leptospira interrogans serovar lai str. 56601
auaguuauauaauaaa

SEQ ID NO: 746302 - RNA, 22 nt, Leptospira interrogans serovar lai str. 56601
auaguuaucaguaguuauauua

SEQ ID NO: 746303 - RNA, 16 nt, Leptospira interrogans serovar lai str. 56601
auaguuaugaauaaaa

SEQ ID NO: 746304 - RNA, 19 nt, Leptospira interrogans serovar lai str. 56601
auaguuaugaauaaaaaau

SEQ ID NO: 746305 - RNA, 15 nt, Leptospira interrogans serovar lai str. 56601
auagucuucaaaauu

SEQ ID NO: 746306 - RNA, 12 nt, Leptospira interrogans serovar lai str. 56601
auauaaaauuug

SEQ ID NO: 746307 - RNA, 14 nt, Leptospira interrogans serovar lai str. 56601
auauaaaauuuuua

SEQ ID NO: 746308 - RNA, 19 nt, Leptospira interrogans serovar lai str. 56601
auaguuccuacaauuuuag

SEQ ID NO: 746309 - RNA, 21 nt, Leptospira interrogans serovar lai str. 56601
auaguuccuauauuuuaaauu

SEQ ID NO: 746310 - RNA, 14 nt, Leptospira interrogans serovar lai str. 56601
auaguugaaauuca

SEQ ID NO: 746311 - RNA, 18 nt, Leptospira interrogans serovar lai str. 56601
auaguugaaauucaccuu

SEQ ID NO: 746312 - RNA, 17 nt, Leptospira interrogans serovar lai str. 56601
auaguuacgacauuuua

SEQ ID NO: 746313 - RNA, 11 nt, Leptospira interrogans serovar lai str. 56601
auaguuaaauu

SEQ ID NO: 746314 - RNA, 17 nt, Leptospira interrogans serovar lai str. 56601
auaguucaauuaacaaa

SEQ ID NO: 746315 - RNA, 11 nt, Leptospira interrogans serovar lai str. 56601
auaguucccac

SEQ ID NO: 746316 - RNA, 13 nt, Leptospira interrogans serovar lai str. 56601
auaguucccacaa

SEQ ID NO: 746317 - RNA, 19 nt, Leptospira interrogans serovar lai str. 56601
auaguucccacaaauuacu

SEQ ID NO: 746318 - RNA, 19 nt, Leptospira interrogans serovar lai str. 56601
auaguucccacaaauugag

SEQ ID NO: 746319 - RNA, 13 nt, Leptospira interrogans serovar lai str. 56601
auaguucccacau

SEQ ID NO: 746320 - RNA, 18 nt, Leptospira interrogans serovar lai str. 56601
auauaaacugucggaauu

SEQ ID NO: 746321 - RNA, 23 nt, Leptospira interrogans serovar lai str. 56601
auagccuucaauuaucaaagcaa

SEQ ID NO: 746322 - RNA, 21 nt, Leptospira interrogans serovar lai str. 56601
auagucaaaacucuguguuag

SEQ ID NO: 746323 - RNA, 16 nt, Leptospira interrogans serovar lai str. 56601
auaguauauuuucugc

SEQ ID NO: 746324 - RNA, 21 nt, Leptospira interrogans serovar lai str. 56601
auagucaaugguugcaaaaaa

SEQ ID NO: 746325 - RNA, 22 nt, Leptospira interrogans serovar lai str. 56601
auagucaaugguugcaaaaaag

SEQ ID NO: 746326 - RNA, 14 nt, Leptospira interrogans serovar lai str. 56601
auagucaauugaag

SEQ ID NO: 746327 - RNA, 15 nt, Leptospira interrogans serovar lai str. 56601
auagucauuuugaua

SEQ ID NO: 746328 - RNA, 17 nt, Leptospira interrogans serovar lai str. 56601
auauaguuuugagauua

SEQ ID NO: 746329 - RNA, 21 nt, Leptospira interrogans serovar lai str. 56601
auauaguuuugagauuacaaa

SEQ ID NO: 746330 - RNA, 23 nt, Leptospira interrogans serovar lai str. 56601
auauaguuuugagcauaaaaaaa

SEQ ID NO: 746331 - RNA, 11 nt, Leptospira interrogans serovar lai str. 56601
auauaguuccu

SEQ ID NO: 746332 - RNA, 23 nt, Leptospira interrogans serovar lai str. 56601
auauaguuccuacaauuuuagaa

SEQ ID NO: 746333 - RNA, 20 nt, Leptospira interrogans serovar lai str. 56601
auauauauucacaaaaaaau

SEQ ID NO: 746334 - RNA, 23 nt, Leptospira interrogans serovar lai str. 56601
auauauaguuuugagcauaaaaa

SEQ ID NO: 746335 - RNA, 14 nt, Leptospira interrogans serovar lai str. 56601
auauauaauuuauu

SEQ ID NO: 746336 - RNA, 21 nt, Leptospira interrogans serovar lai str. 56601
auauaggaacuaccacagaaa

SEQ ID NO: 746337 - RNA, 21 nt, Leptospira interrogans serovar lai str. 56601
auauagguucuugcaaaaaua

SEQ ID NO: 746338 - RNA, 18 nt, Leptospira interrogans serovar lai str. 56601
auauagcucuugaauaaa

SEQ ID NO: 746339 - RNA, 13 nt, Leptospira interrogans serovar lai str. 56601
auauacguaaaaa

SEQ ID NO: 746340 - RNA, 18 nt, Leptospira interrogans serovar lai str. 56601
auauacguaaaaauaaua

SEQ ID NO: 746341 - RNA, 22 nt, Leptospira interrogans serovar lai str. 56601
auauaccaguuaaauucaucaa

SEQ ID NO: 746342 - RNA, 13 nt, Leptospira interrogans serovar lai str. 56601
auauaaguuaaau

SEQ ID NO: 746343 - RNA, 14 nt, Leptospira interrogans serovar lai str. 56601
auauaaguuaaauu

SEQ ID NO: 746344 - RNA, 16 nt, Leptospira interrogans serovar lai str. 56601
auauaaguuaaauuuu

SEQ ID NO: 746345 - RNA, 18 nt, Leptospira interrogans serovar lai str. 56601
auauaaguuaaauuuuuu

SEQ ID NO: 746346 - RNA, 15 nt, Leptospira interrogans serovar lai str. 56601
auauaaaucaaucau

SEQ ID NO: 746347 - RNA, 21 nt, Leptospira interrogans serovar lai str. 56601
auauaaucugauugagaaaau

SEQ ID NO: 746348 - RNA, 14 nt, Leptospira interrogans serovar lai str. 56601
auaccauucauuuc

SEQ ID NO: 746349 - RNA, 14 nt, Leptospira interrogans serovar lai str. 56601
auaccaguuaaauu

SEQ ID NO: 746350 - RNA, 17 nt, Leptospira interrogans serovar lai str. 56601
auacauuuuuagaauuu

SEQ ID NO: 746351 - RNA, 12 nt, Leptospira interrogans serovar lai str. 56601
auacauuuugua

SEQ ID NO: 746352 - RNA, 14 nt, Leptospira interrogans serovar lai str. 56601
auaccaaaaaagua

SEQ ID NO: 746353 - RNA, 15 nt, Leptospira interrogans serovar lai str. 56601
auaccaaaaaaguac

SEQ ID NO: 746354 - RNA, 13 nt, Leptospira interrogans serovar lai str. 56601
auacauuuuguau

SEQ ID NO: 746355 - RNA, 16 nt, Leptospira interrogans serovar lai str. 56601
auaccaaauaaauauu

SEQ ID NO: 746356 - RNA, 19 nt, Leptospira interrogans serovar lai str. 56601
auaccaaauaaauauuucc

SEQ ID NO: 746357 - RNA, 12 nt, Leptospira interrogans serovar lai str. 56601
auaccuaaaaug

SEQ ID NO: 746358 - RNA, 14 nt, Leptospira interrogans serovar lai str. 56601
auaccgauuucuau

SEQ ID NO: 746359 - RNA, 16 nt, Leptospira interrogans serovar lai str. 56601
auaccgauuucuauuu

SEQ ID NO: 746360 - RNA, 21 nt, Leptospira interrogans serovar lai str. 56601
auaccgauuucuauuuuaaaa

SEQ ID NO: 746361 - RNA, 20 nt, Leptospira interrogans serovar lai str. 56601
auacuaaaagaguaauucua

SEQ ID NO: 746362 - RNA, 19 nt, Leptospira interrogans serovar lai str. 56601
auacuaauaguuuuacaaa

SEQ ID NO: 746363 - RNA, 18 nt, Leptospira interrogans serovar lai str. 56601
auacuaaauuaaguuuau

SEQ ID NO: 746364 - RNA, 24 nt, Leptospira interrogans serovar lai str. 56601
auacuaaauuaaguuuauucaauu

SEQ ID NO: 746365 - RNA, 17 nt, Leptospira interrogans serovar lai str. 56601
auacgacagauucaauu

SEQ ID NO: 746366 - RNA, 15 nt, Leptospira interrogans serovar lai str. 56601
auagaauccuauaau

SEQ ID NO: 746367 - RNA, 20 nt, Leptospira interrogans serovar lai str. 56601
auagaauuguugaaaaauua

SEQ ID NO: 746368 - RNA, 11 nt, Leptospira interrogans serovar lai str. 56601
auagaauuuaa

SEQ ID NO: 746369 - RNA, 17 nt, Leptospira interrogans serovar lai str. 56601
auagacaacguuacuuu

SEQ ID NO: 746370 - RNA, 22 nt, Leptospira interrogans serovar lai str. 56601
auagacaacguuacuuuuaaga

SEQ ID NO: 746371 - RNA, 18 nt, Leptospira interrogans serovar lai str. 56601
auagaauaaauuauacaa

SEQ ID NO: 746372 - RNA, 16 nt, Leptospira interrogans serovar lai str. 56601
auagaaauacuuaaaa

SEQ ID NO: 746373 - RNA, 17 nt, Leptospira interrogans serovar lai str. 56601
auagaaauacuuaaaau

SEQ ID NO: 746374 - RNA, 21 nt, Leptospira interrogans serovar lai str. 56601
auagaaagcccguucuguuga

SEQ ID NO: 746375 - RNA, 23 nt, Leptospira interrogans serovar lai str. 56601
auagaaccaucucaaaaauaucu

SEQ ID NO: 746376 - RNA, 15 nt, Leptospira interrogans serovar lai str. 56601
auagaaccugcucca

SEQ ID NO: 746377 - RNA, 15 nt, Leptospira interrogans serovar lai str. 56601
auagaacaguuuguu

SEQ ID NO: 746378 - RNA, 15 nt, Leptospira interrogans serovar lai str. 56601
auagaaccuauaucu

SEQ ID NO: 746379 - RNA, 22 nt, Leptospira interrogans serovar lai str. 56601
auagaaauuuucaaaaaauauc

SEQ ID NO: 746380 - RNA, 14 nt, Leptospira interrogans serovar lai str. 56601
auagaaaauuuuuu

SEQ ID NO: 746381 - RNA, 17 nt, Leptospira interrogans serovar lai str. 56601
auagaaagacuuuucau

SEQ ID NO: 746382 - RNA, 21 nt, Leptospira interrogans serovar lai str. 56601
auagaaacggugcauuuaaaa

SEQ ID NO: 746383 - RNA, 22 nt, Leptospira interrogans serovar lai str. 56601
auagaaacggugcauuuaaaaa

SEQ ID NO: 746384 - RNA, 21 nt, Leptospira interrogans serovar lai str. 56601
auacuuuuugcaaguaaaaag

SEQ ID NO: 746385 - RNA, 23 nt, Leptospira interrogans serovar lai str. 56601
auacuuuuugcaaguaaaaagac

SEQ ID NO: 746386 - RNA, 22 nt, Leptospira interrogans serovar lai str. 56601
auacuuagaauuuuuucguucc

SEQ ID NO: 746387 - RNA, 12 nt, Leptospira interrogans serovar lai str. 56601
auacuucaaaau

SEQ ID NO: 746388 - RNA, 14 nt, Leptospira interrogans serovar lai str. 56601
auacuucaaaauua

SEQ ID NO: 746389 - RNA, 16 nt, Leptospira interrogans serovar lai str. 56601
auacuuacacuccuca

SEQ ID NO: 746390 - RNA, 15 nt, Leptospira interrogans serovar lai str. 56601
auacuuaaaaauacc

SEQ ID NO: 746391 - RNA, 13 nt, Leptospira interrogans serovar lai str. 56601
auacuuaauuuca

SEQ ID NO: 746392 - RNA, 17 nt, Leptospira interrogans serovar lai str. 56601
auacuuauaaagaauuu

SEQ ID NO: 746393 - RNA, 20 nt, Leptospira interrogans serovar lai str. 56601
auacuuaucacgaaaauuaa

SEQ ID NO: 746394 - RNA, 17 nt, Leptospira interrogans serovar lai str. 56601
auagauuguaaguuuuu

SEQ ID NO: 746395 - RNA, 14 nt, Leptospira interrogans serovar lai str. 56601
auagcaacaauuaa

SEQ ID NO: 746396 - RNA, 17 nt, Leptospira interrogans serovar lai str. 56601
auagcaacaauuaacaa

SEQ ID NO: 746397 - RNA, 15 nt, Leptospira interrogans serovar lai str. 56601
auagccuaauuuacu

SEQ ID NO: 746398 - RNA, 13 nt, Leptospira interrogans serovar lai str. 56601
auagauagagaau

SEQ ID NO: 746399 - RNA, 15 nt, Leptospira interrogans serovar lai str. 56601
auagauugauuuaaa

SEQ ID NO: 746400 - RNA, 14 nt, Leptospira interrogans serovar lai str. 56601
auagaucaguuaua

SEQ ID NO: 746401 - RNA, 13 nt, Leptospira interrogans serovar lai str. 56601
auacauuugcuuu

SEQ ID NO: 746402 - RNA, 18 nt, Leptospira interrogans serovar lai str. 56601
auacauuugcuuugucau

SEQ ID NO: 746403 - RNA, 16 nt, Leptospira interrogans serovar lai str. 56601
auacauuuguaaauaa

SEQ ID NO: 746404 - RNA, 14 nt, Leptospira interrogans serovar lai str. 56601
auacauucuuauaa

SEQ ID NO: 746405 - RNA, 15 nt, Leptospira interrogans serovar lai str. 56601
auacauucuuauaaa

SEQ ID NO: 746406 - RNA, 15 nt, Leptospira interrogans serovar lai str. 56601
auacauuaagauuau

SEQ ID NO: 746407 - RNA, 16 nt, Leptospira interrogans serovar lai str. 56601
auacauuaagauuaua

SEQ ID NO: 746408 - RNA, 16 nt, Leptospira interrogans serovar lai str. 56601
auacaugauuacucau

SEQ ID NO: 746409 - RNA, 18 nt, Leptospira interrogans serovar lai str. 56601
auacaucucuuuuuuaaa

SEQ ID NO: 746410 - RNA, 18 nt, Leptospira interrogans serovar lai str. 56601
auacaggaaacauuauau

SEQ ID NO: 746411 - RNA, 18 nt, Leptospira interrogans serovar lai str. 56601
auacaggcgguuuaaaag

SEQ ID NO: 746412 - RNA, 16 nt, Leptospira interrogans serovar lai str. 56601
auacauaaaaaaauaa

SEQ ID NO: 746413 - RNA, 18 nt, Leptospira interrogans serovar lai str. 56601
auacaauuugaucuaugu

SEQ ID NO: 746414 - RNA, 19 nt, Leptospira interrogans serovar lai str. 56601
auacaauucuuucuuaaau

SEQ ID NO: 746415 - RNA, 17 nt, Leptospira interrogans serovar lai str. 56601
auacaauugauuuaaaa

SEQ ID NO: 746416 - RNA, 19 nt, Leptospira interrogans serovar lai str. 56601
auacaaugaaaaagcauau

SEQ ID NO: 746417 - RNA, 21 nt, Leptospira interrogans serovar lai str. 56601
auacaccaugccauuuuuagu

SEQ ID NO: 746418 - RNA, 17 nt, Leptospira interrogans serovar lai str. 56601
auacagaauaaauacau

SEQ ID NO: 746419 - RNA, 13 nt, Leptospira interrogans serovar lai str. 56601
auacagaauucau

SEQ ID NO: 746420 - RNA, 17 nt, Leptospira interrogans serovar lai str. 56601
auacaaaauuuuuuccu

SEQ ID NO: 746421 - RNA, 11 nt, Leptospira interrogans serovar lai str. 56601
auacaaaauuu

SEQ ID NO: 746422 - RNA, 15 nt, Leptospira interrogans serovar lai str. 56601
auacaaaauuuaaaa

SEQ ID NO: 746423 - RNA, 18 nt, Leptospira interrogans serovar lai str. 56601
auacaaaacucuuuaaaa

SEQ ID NO: 746424 - RNA, 14 nt, Leptospira interrogans serovar lai str. 56601
auacaaaacuuaaa

SEQ ID NO: 746425 - RNA, 18 nt, Leptospira interrogans serovar lai str. 56601
auacaaaacuuugaccau

SEQ ID NO: 746426 - RNA, 16 nt, Leptospira interrogans serovar lai str. 56601
auacaaaaugaaugau

SEQ ID NO: 746427 - RNA, 14 nt, Leptospira interrogans serovar lai str. 56601
auaauuuuuagaaa

SEQ ID NO: 746428 - RNA, 18 nt, Leptospira interrogans serovar lai str. 56601
auaauuuuuuaaaaaaau

SEQ ID NO: 746429 - RNA, 22 nt, Leptospira interrogans serovar lai str. 56601
auaauuuuuuaaaaaaauuacu

SEQ ID NO: 746430 - RNA, 16 nt, Leptospira interrogans serovar lai str. 56601
auaauuuucaugaacg

SEQ ID NO: 746431 - RNA, 19 nt, Leptospira interrogans serovar lai str. 56601
auaauuuucuuuagaaauu

SEQ ID NO: 746432 - RNA, 21 nt, Leptospira interrogans serovar lai str. 56601
auaauuuucuuuagaaauuuu

SEQ ID NO: 746433 - RNA, 23 nt, Leptospira interrogans serovar lai str. 56601
auaauuuucuuuagaaauuuuua

SEQ ID NO: 746434 - RNA, 15 nt, Leptospira interrogans serovar lai str. 56601
auacaauaaauagaa

SEQ ID NO: 746435 - RNA, 21 nt, Leptospira interrogans serovar lai str. 56601
auacaacuuucagauuaaaac

SEQ ID NO: 746436 - RNA, 14 nt, Leptospira interrogans serovar lai str. 56601
auacaaaguuugua

SEQ ID NO: 746437 - RNA, 22 nt, Leptospira interrogans serovar lai str. 56601
auacaacgaaaacagaucaaga

SEQ ID NO: 746438 - RNA, 15 nt, Leptospira interrogans serovar lai str. 56601
auaauuucuuuuuau

SEQ ID NO: 746439 - RNA, 12 nt, Leptospira interrogans serovar lai str. 56601
auaauuuuagaa

SEQ ID NO: 746440 - RNA, 16 nt, Leptospira interrogans serovar lai str. 56601
auaauuuuaauauuuc

SEQ ID NO: 746441 - RNA, 14 nt, Leptospira interrogans serovar lai str. 56601
auaauuuuaaauaa

SEQ ID NO: 746442 - RNA, 23 nt, Leptospira interrogans serovar lai str. 56601
auaauuuuaaauaauaauauacu

SEQ ID NO: 746443 - RNA, 21 nt, Leptospira interrogans serovar lai str. 56601
auaauuuaaaaucguaaaaaa

SEQ ID NO: 746444 - RNA, 21 nt, Leptospira interrogans serovar lai str. 56601
auaauuuagaguuguuaaaaa

SEQ ID NO: 746445 - RNA, 22 nt, Leptospira interrogans serovar lai str. 56601
auaauuuaacgugauucagagu

SEQ ID NO: 746446 - RNA, 23 nt, Leptospira interrogans serovar lai str. 56601
auaauuuaacucguuagagaaaa

SEQ ID NO: 746447 - RNA, 16 nt, Leptospira interrogans serovar lai str. 56601
auaauuuaaacuuacu

SEQ ID NO: 746448 - RNA, 14 nt, Leptospira interrogans serovar lai str. 56601
auaauucuuuagaa

SEQ ID NO: 746449 - RNA, 15 nt, Leptospira interrogans serovar lai str. 56601
auaauugaacauuuu

SEQ ID NO: 746450 - RNA, 16 nt, Leptospira interrogans serovar lai str. 56601
auaauugaacauuuuu

SEQ ID NO: 746451 - RNA, 18 nt, Leptospira interrogans serovar lai str. 56601
auaauugaacauuuuuaa

SEQ ID NO: 746452 - RNA, 17 nt, Leptospira interrogans serovar lai str. 56601
auaauugauuagaguua

SEQ ID NO: 746453 - RNA, 15 nt, Leptospira interrogans serovar lai str. 56601
auaauucaagacuuu

SEQ ID NO: 746454 - RNA, 14 nt, Leptospira interrogans serovar lai str. 56601
auaauucuuuaaaa

SEQ ID NO: 746455 - RNA, 17 nt, Leptospira interrogans serovar lai str. 56601
auaauucuguaaaaaua

SEQ ID NO: 746456 - RNA, 23 nt, Leptospira interrogans serovar lai str. 56601
auaauucuguaaaaauagaacua

SEQ ID NO: 746457 - RNA, 18 nt, Leptospira interrogans serovar lai str. 56601
auaauucguuuuuuaaaa

SEQ ID NO: 746458 - RNA, 19 nt, Leptospira interrogans serovar lai str. 56601
auaauucguuuuuuaaaau

SEQ ID NO: 746459 - RNA, 16 nt, Leptospira interrogans serovar lai str. 56601
auaacgucuugauuau

SEQ ID NO: 746460 - RNA, 16 nt, Leptospira interrogans serovar lai str. 56601
auaauccuaugaaaau

SEQ ID NO: 746461 - RNA, 17 nt, Leptospira interrogans serovar lai str. 56601
auaaucuuaaauaucga

SEQ ID NO: 746462 - RNA, 22 nt, Leptospira interrogans serovar lai str. 56601
auaaucuuaacuuuaagcaaag

SEQ ID NO: 746463 - RNA, 13 nt, Leptospira interrogans serovar lai str. 56601
auaaucuuaauau

SEQ ID NO: 746464 - RNA, 18 nt, Leptospira interrogans serovar lai str. 56601
auaaucgaauuuccauuu

SEQ ID NO: 746465 - RNA, 20 nt, Leptospira interrogans serovar lai str. 56601
auaaucuaccccaucucuuc

SEQ ID NO: 746466 - RNA, 16 nt, Leptospira interrogans serovar lai str. 56601
auaaucugaaauagaa

SEQ ID NO: 746467 - RNA, 19 nt, Leptospira interrogans serovar lai str. 56601
auaaucugaaauagaauuu

SEQ ID NO: 746468 - RNA, 21 nt, Leptospira interrogans serovar lai str. 56601
auaaucugauugagaaaauaa

SEQ ID NO: 746469 - RNA, 17 nt, Leptospira interrogans serovar lai str. 56601
auaaucuguaauaguua

SEQ ID NO: 746470 - RNA, 20 nt, Leptospira interrogans serovar lai str. 56601
aucgacauuccccaaguaaa

SEQ ID NO: 746471 - RNA, 22 nt, Leptospira interrogans serovar lai str. 56601
aucgaauggaaaucuuuuaaaa

SEQ ID NO: 746472 - RNA, 15 nt, Leptospira interrogans serovar lai str. 56601
aucgaaguugauuuc

SEQ ID NO: 746473 - RNA, 13 nt, Leptospira interrogans serovar lai str. 56601
aucgacaaaacuu

SEQ ID NO: 746474 - RNA, 21 nt, Leptospira interrogans serovar lai str. 56601
aucgaauucacguuaaaauaa

SEQ ID NO: 746475 - RNA, 15 nt, Leptospira interrogans serovar lai str. 56601
aucgaagagaagaug

SEQ ID NO: 746476 - RNA, 23 nt, Leptospira interrogans serovar lai str. 56601
auccuuacuuaccucuauaaaau

SEQ ID NO: 746477 - RNA, 21 nt, Leptospira interrogans serovar lai str. 56601
auccuuaugaaagcaauccau

SEQ ID NO: 746478 - RNA, 13 nt, Leptospira interrogans serovar lai str. 56601
auccuuaaaauga

SEQ ID NO: 746479 - RNA, 21 nt, Leptospira interrogans serovar lai str. 56601
auccuuaaaaugaaaauuaua

SEQ ID NO: 746480 - RNA, 23 nt, Leptospira interrogans serovar lai str. 56601
auccuuaaaaugaaaauuauaag

SEQ ID NO: 746481 - RNA, 19 nt, Leptospira interrogans serovar lai str. 56601
auccuucgcauaacaaaaa

SEQ ID NO: 746482 - RNA, 18 nt, Leptospira interrogans serovar lai str. 56601
auccuugugcaauaauuu

SEQ ID NO: 746483 - RNA, 22 nt, Leptospira interrogans serovar lai str. 56601
auccuugggauaaauauucucu

SEQ ID NO: 746484 - RNA, 23 nt, Leptospira interrogans serovar lai str. 56601
auccuuuccgggucgauuuugau

SEQ ID NO: 746485 - RNA, 14 nt, Leptospira interrogans serovar lai str. 56601
auccuucuuuucuu

SEQ ID NO: 746486 - RNA, 13 nt, Leptospira interrogans serovar lai str. 56601
aucgaucuguaaa

SEQ ID NO: 746487 - RNA, 15 nt, Leptospira interrogans serovar lai str. 56601
aucgauuucuaaauu

SEQ ID NO: 746488 - RNA, 16 nt, Leptospira interrogans serovar lai str. 56601
aucgauucuuuuuacu

SEQ ID NO: 746489 - RNA, 16 nt, Leptospira interrogans serovar lai str. 56601
aucgauuuacuuuaaa

SEQ ID NO: 746490 - RNA, 21 nt, Leptospira interrogans serovar lai str. 56601
aucgcucugaaguaucucuuc

SEQ ID NO: 746491 - RNA, 15 nt, Leptospira interrogans serovar lai str. 56601
aucgcucgcaaauuu

SEQ ID NO: 746492 - RNA, 19 nt, Leptospira interrogans serovar lai str. 56601
aucgcugguuuuauuucug

SEQ ID NO: 746493 - RNA, 22 nt, Leptospira interrogans serovar lai str. 56601
aucgcugguuuuauuucugcug

SEQ ID NO: 746494 - RNA, 24 nt, Leptospira interrogans serovar lai str. 56601
aucgcuucuaugguccucuacagg

SEQ ID NO: 746495 - RNA, 13 nt, Leptospira interrogans serovar lai str. 56601
aucggaaccaaag

SEQ ID NO: 746496 - RNA, 13 nt, Leptospira interrogans serovar lai str. 56601
aucggaaauagug

SEQ ID NO: 746497 - RNA, 18 nt, Leptospira interrogans serovar lai str. 56601
aucggaaaauugaauauu

SEQ ID NO: 746498 - RNA, 23 nt, Leptospira interrogans serovar lai str. 56601
aucgcuuugugacuaucaacaag

SEQ ID NO: 746499 - RNA, 19 nt, Leptospira interrogans serovar lai str. 56601
aucggcauaagcaaaaaua

SEQ ID NO: 746500 - RNA, 19 nt, Leptospira interrogans serovar lai str. 56601
aucguuuaagaauuuuaaa

SEQ ID NO: 746501 - RNA, 23 nt, Leptospira interrogans serovar lai str. 56601
aucguuugcuuuucuaucaaaaa

SEQ ID NO: 746502 - RNA, 19 nt, Leptospira interrogans serovar lai str. 56601
aucguuuuuuguauucuga

SEQ ID NO: 746503 - RNA, 15 nt, Leptospira interrogans serovar lai str. 56601
aucguuuuuuuuguu

SEQ ID NO: 746504 - RNA, 22 nt, Leptospira interrogans serovar lai str. 56601
aucuaaaaaaacaauuaaucaa

SEQ ID NO: 746505 - RNA, 16 nt, Leptospira interrogans serovar lai str. 56601
aucuaaaaagauuauc

SEQ ID NO: 746506 - RNA, 15 nt, Leptospira interrogans serovar lai str. 56601
aucuaaauuuuacaa

SEQ ID NO: 746507 - RNA, 22 nt, Leptospira interrogans serovar lai str. 56601
aucuaaauuuuacaauuaaacu

SEQ ID NO: 746508 - RNA, 18 nt, Leptospira interrogans serovar lai str. 56601
aucuaaauuuucuuuauu

SEQ ID NO: 746509 - RNA, 20 nt, Leptospira interrogans serovar lai str. 56601
aucuaacccauucaacauca

SEQ ID NO: 746510 - RNA, 19 nt, Leptospira interrogans serovar lai str. 56601
aucgucuucuuuuuuuacc

SEQ ID NO: 746511 - RNA, 14 nt, Leptospira interrogans serovar lai str. 56601
aucguacaucuucu

SEQ ID NO: 746512 - RNA, 21 nt, Leptospira interrogans serovar lai str. 56601
aucgguucacguuaauugaga

SEQ ID NO: 746513 - RNA, 18 nt, Leptospira interrogans serovar lai str. 56601
aucguauucggaaauuug

SEQ ID NO: 746514 - RNA, 20 nt, Leptospira interrogans serovar lai str. 56601
aucguaucuugaauacuaau

SEQ ID NO: 746515 - RNA, 12 nt, Leptospira interrogans serovar lai str. 56601
aucgucaaaauu

SEQ ID NO: 746516 - RNA, 21 nt, Leptospira interrogans serovar lai str. 56601
aucguaaaaaagauaaaaaga

SEQ ID NO: 746517 - RNA, 23 nt, Leptospira interrogans serovar lai str. 56601
aucguaaaaaagauaaaaagaga

SEQ ID NO: 746518 - RNA, 15 nt, Leptospira interrogans serovar lai str. 56601
aucggcguucuacaa

SEQ ID NO: 746519 - RNA, 15 nt, Leptospira interrogans serovar lai str. 56601
auccuguaaauucaa

SEQ ID NO: 746520 - RNA, 18 nt, Leptospira interrogans serovar lai str. 56601
auccuguaaauucaaaau

SEQ ID NO: 746521 - RNA, 20 nt, Leptospira interrogans serovar lai str. 56601
auccuguaaauucaaaauaa

SEQ ID NO: 746522 - RNA, 13 nt, Leptospira interrogans serovar lai str. 56601
auccguaaaaauc

SEQ ID NO: 746523 - RNA, 24 nt, Leptospira interrogans serovar lai str. 56601
auccguagccgcuucaaaguugau

SEQ ID NO: 746524 - RNA, 22 nt, Leptospira interrogans serovar lai str. 56601
auccuaaagucgaauuuuuuca

SEQ ID NO: 746525 - RNA, 23 nt, Leptospira interrogans serovar lai str. 56601
auccuaaagucgaauuuuuucac

SEQ ID NO: 746526 - RNA, 13 nt, Leptospira interrogans serovar lai str. 56601
auccguuuuaaaa

SEQ ID NO: 746527 - RNA, 18 nt, Leptospira interrogans serovar lai str. 56601
auccuaaugaaaaagaaa

SEQ ID NO: 746528 - RNA, 19 nt, Leptospira interrogans serovar lai str. 56601
auccucacuccgauacauu

SEQ ID NO: 746529 - RNA, 16 nt, Leptospira interrogans serovar lai str. 56601
auccuagcuauuuuca

SEQ ID NO: 746530 - RNA, 19 nt, Leptospira interrogans serovar lai str. 56601
auccuagcuauuuucagaa

SEQ ID NO: 746531 - RNA, 22 nt, Leptospira interrogans serovar lai str. 56601
aucccuaagacuuggaguucuu

SEQ ID NO: 746532 - RNA, 15 nt, Leptospira interrogans serovar lai str. 56601
auccgaaaaauucca

SEQ ID NO: 746533 - RNA, 22 nt, Leptospira interrogans serovar lai str. 56601
aucccuuccuuccgaucccaac

SEQ ID NO: 746534 - RNA, 20 nt, Leptospira interrogans serovar lai str. 56601
auccauaaauucuacaaauu

SEQ ID NO: 746535 - RNA, 22 nt, Leptospira interrogans serovar lai str. 56601
auccauaaauucuacaaauucu

SEQ ID NO: 746536 - RNA, 15 nt, Leptospira interrogans serovar lai str. 56601
auccaggauuuucac

SEQ ID NO: 746537 - RNA, 18 nt, Leptospira interrogans serovar lai str. 56601
auccauuucguuucccuc

SEQ ID NO: 746538 - RNA, 22 nt, Leptospira interrogans serovar lai str. 56601
aucccaaauucuuuccuuuccu

SEQ ID NO: 746539 - RNA, 12 nt, Leptospira interrogans serovar lai str. 56601
auccauuuuucc

SEQ ID NO: 746540 - RNA, 20 nt, Leptospira interrogans serovar lai str. 56601
aucccaguugagaguuuuuc

SEQ ID NO: 746541 - RNA, 22 nt, Leptospira interrogans serovar lai str. 56601
auccaugauucauuuuucuaaa

SEQ ID NO: 746542 - RNA, 15 nt, Leptospira interrogans serovar lai str. 56601
auccaugauucugaa

SEQ ID NO: 746543 - RNA, 23 nt, Leptospira interrogans serovar lai str. 56601
auccaugauuuguaauaguuccc

SEQ ID NO: 746544 - RNA, 22 nt, Leptospira interrogans serovar lai str. 56601
auccauagaguguuguguugag

SEQ ID NO: 746545 - RNA, 19 nt, Leptospira interrogans serovar lai str. 56601
auccaaguagagagugaaa

SEQ ID NO: 746546 - RNA, 12 nt, Leptospira interrogans serovar lai str. 56601
auccaauacaaa

SEQ ID NO: 746547 - RNA, 15 nt, Leptospira interrogans serovar lai str. 56601
auccaauacaaaaca

SEQ ID NO: 746548 - RNA, 15 nt, Leptospira interrogans serovar lai str. 56601
auccaauauuuaugc

SEQ ID NO: 746549 - RNA, 16 nt, Leptospira interrogans serovar lai str. 56601
auccaauugaauauaa

SEQ ID NO: 746550 - RNA, 20 nt, Leptospira interrogans serovar lai str. 56601
auccaauugaauauaaaauu

SEQ ID NO: 746551 - RNA, 13 nt, Leptospira interrogans serovar lai str. 56601
auccacuaaaaua

SEQ ID NO: 746552 - RNA, 14 nt, Leptospira interrogans serovar lai str. 56601
auccacuacggaag

SEQ ID NO: 746553 - RNA, 14 nt, Leptospira interrogans serovar lai str. 56601
aucauuuaaagcaa

SEQ ID NO: 746554 - RNA, 23 nt, Leptospira interrogans serovar lai str. 56601
aucauuugcauaggugauuaaac

SEQ ID NO: 746555 - RNA, 19 nt, Leptospira interrogans serovar lai str. 56601
aucauucugaaaaaaguug

SEQ ID NO: 746556 - RNA, 21 nt, Leptospira interrogans serovar lai str. 56601
aucauucuuuagaaauuuuua

SEQ ID NO: 746557 - RNA, 15 nt, Leptospira interrogans serovar lai str. 56601
aucauuggaguuuuu

SEQ ID NO: 746558 - RNA, 22 nt, Leptospira interrogans serovar lai str. 56601
aucauucuauuuggauuuuaua

SEQ ID NO: 746559 - RNA, 22 nt, Leptospira interrogans serovar lai str. 56601
auccaaagaaagaaaauacaua

SEQ ID NO: 746560 - RNA, 16 nt, Leptospira interrogans serovar lai str. 56601
auccaacuuaaaacug

SEQ ID NO: 746561 - RNA, 17 nt, Leptospira interrogans serovar lai str. 56601
aucauuuuguaagucca

SEQ ID NO: 746562 - RNA, 22 nt, Leptospira interrogans serovar lai str. 56601
aucauuaaugcgaaaauuuaac

SEQ ID NO: 746563 - RNA, 14 nt, Leptospira interrogans serovar lai str. 56601
aucauguaauauaa

SEQ ID NO: 746564 - RNA, 19 nt, Leptospira interrogans serovar lai str. 56601
aucaugucucaguucaaaa

SEQ ID NO: 746565 - RNA, 21 nt, Leptospira interrogans serovar lai str. 56601
aucaugaaccauggauuuuua

SEQ ID NO: 746566 - RNA, 14 nt, Leptospira interrogans serovar lai str. 56601
aucaugaucaaauu

SEQ ID NO: 746567 - RNA, 17 nt, Leptospira interrogans serovar lai str. 56601
aucaugaucaaauucac

SEQ ID NO: 746568 - RNA, 15 nt, Leptospira interrogans serovar lai str. 56601
aucaucuuacacacu

SEQ ID NO: 746569 - RNA, 15 nt, Leptospira interrogans serovar lai str. 56601
aucaucucaaaaaua

SEQ ID NO: 746570 - RNA, 16 nt, Leptospira interrogans serovar lai str. 56601
aucaucuaucuuuuca

SEQ ID NO: 746571 - RNA, 15 nt, Leptospira interrogans serovar lai str. 56601
aucaucauccaauga

SEQ ID NO: 746572 - RNA, 22 nt, Leptospira interrogans serovar lai str. 56601
aucaucaaaacuuaaaucccau

SEQ ID NO: 746573 - RNA, 21 nt, Leptospira interrogans serovar lai str. 56601
aucauauuguuuaauaccuaa

SEQ ID NO: 746574 - RNA, 13 nt, Leptospira interrogans serovar lai str. 56601
aucauauuuuaau

SEQ ID NO: 746575 - RNA, 18 nt, Leptospira interrogans serovar lai str. 56601
aucauauuuucaaaaaau

SEQ ID NO: 746576 - RNA, 16 nt, Leptospira interrogans serovar lai str. 56601
aucaaucuacuugaau

SEQ ID NO: 746577 - RNA, 15 nt, Leptospira interrogans serovar lai str. 56601
aucaggcuuuauaaa

SEQ ID NO: 746578 - RNA, 16 nt, Leptospira interrogans serovar lai str. 56601
aucaggcuuuauaaaa

SEQ ID NO: 746579 - RNA, 20 nt, Leptospira interrogans serovar lai str. 56601
aucaggcuuuauaaaaugaa

SEQ ID NO: 746580 - RNA, 16 nt, Leptospira interrogans serovar lai str. 56601
aucagguuuuauaaag

SEQ ID NO: 746581 - RNA, 21 nt, Leptospira interrogans serovar lai str. 56601
aucaguaguuauauuaauauu

SEQ ID NO: 746582 - RNA, 18 nt, Leptospira interrogans serovar lai str. 56601
aucauaaaaauaaagaaa

SEQ ID NO: 746583 - RNA, 13 nt, Leptospira interrogans serovar lai str. 56601
aucaguuucuccg

SEQ ID NO: 746584 - RNA, 21 nt, Leptospira interrogans serovar lai str. 56601
aucaguuuuguuaaccaaaaa

SEQ ID NO: 746585 - RNA, 15 nt, Leptospira interrogans serovar lai str. 56601
aucaguuuuguuaau

SEQ ID NO: 746586 - RNA, 13 nt, Leptospira interrogans serovar lai str. 56601
aucaguuauaagu

SEQ ID NO: 746587 - RNA, 22 nt, Leptospira interrogans serovar lai str. 56601
aucaguguuuugugauaaaauu

SEQ ID NO: 746588 - RNA, 23 nt, Leptospira interrogans serovar lai str. 56601
aucaguguuuugugauaaaauua

SEQ ID NO: 746589 - RNA, 20 nt, Leptospira interrogans serovar lai str. 56601
aucaguuaaacuuugaaaau

SEQ ID NO: 746590 - RNA, 22 nt, Leptospira interrogans serovar lai str. 56601
aucagugauucgaaauuuucag

SEQ ID NO: 746591 - RNA, 16 nt, Leptospira interrogans serovar lai str. 56601
aucaguagugaaaaac

SEQ ID NO: 746592 - RNA, 14 nt, Leptospira interrogans serovar lai str. 56601
aucauaacaaauaa

SEQ ID NO: 746593 - RNA, 22 nt, Leptospira interrogans serovar lai str. 56601
aucauaaaggagagguuuuccu

SEQ ID NO: 746594 - RNA, 23 nt, Leptospira interrogans serovar lai str. 56601
aucauaaaggagagguuuuccuc

SEQ ID NO: 746595 - RNA, 21 nt, Leptospira interrogans serovar lai str. 56601
aucauaaaggugcaugaaaau

SEQ ID NO: 746596 - RNA, 18 nt, Leptospira interrogans serovar lai str. 56601
aucauacaguaaaaccac

SEQ ID NO: 746597 - RNA, 16 nt, Leptospira interrogans serovar lai str. 56601
aucauacuuuuaaaaa

SEQ ID NO: 746598 - RNA, 17 nt, Leptospira interrogans serovar lai str. 56601
augcucuaaaagcgacc

SEQ ID NO: 746599 - RNA, 18 nt, Leptospira interrogans serovar lai str. 56601
augcucggcuucuucaau

SEQ ID NO: 746600 - RNA, 19 nt, Leptospira interrogans serovar lai str. 56601
augcuauuuaauuuuguag

SEQ ID NO: 746601 - RNA, 15 nt, Leptospira interrogans serovar lai str. 56601
augcuguaacucaua

SEQ ID NO: 746602 - RNA, 19 nt, Leptospira interrogans serovar lai str. 56601
augcugaaggaccgcagac

SEQ ID NO: 746603 - RNA, 17 nt, Leptospira interrogans serovar lai str. 56601
augcuuuccaaaaggaa

SEQ ID NO: 746604 - RNA, 20 nt, Leptospira interrogans serovar lai str. 56601
augcuuucucuuuuuagaca

SEQ ID NO: 746605 - RNA, 12 nt, Leptospira interrogans serovar lai str. 56601
auggaaaaugaa

SEQ ID NO: 746606 - RNA, 14 nt, Leptospira interrogans serovar lai str. 56601
auggaaaaugaauu

SEQ ID NO: 746607 - RNA, 11 nt, Leptospira interrogans serovar lai str. 56601
auggaaaaaug

SEQ ID NO: 746608 - RNA, 20 nt, Leptospira interrogans serovar lai str. 56601
auggaauauaaaagaaucau

SEQ ID NO: 746609 - RNA, 15 nt, Leptospira interrogans serovar lai str. 56601
auggaaggucucaac

SEQ ID NO: 746610 - RNA, 13 nt, Leptospira interrogans serovar lai str. 56601
auggaauuuuuca

SEQ ID NO: 746611 - RNA, 17 nt, Leptospira interrogans serovar lai str. 56601
auggaauuuuuuaacaa

SEQ ID NO: 746612 - RNA, 23 nt, Leptospira interrogans serovar lai str. 56601
auggaauuuuuuaacaacucuaa

SEQ ID NO: 746613 - RNA, 19 nt, Leptospira interrogans serovar lai str. 56601
auggaauuuuuuaauaacu

SEQ ID NO: 746614 - RNA, 20 nt, Leptospira interrogans serovar lai str. 56601
auggaauuuuuuaauaacuc

SEQ ID NO: 746615 - RNA, 18 nt, Leptospira interrogans serovar lai str. 56601
auggaaaguguuaguucc

SEQ ID NO: 746616 - RNA, 19 nt, Leptospira interrogans serovar lai str. 56601
auggaaaguguuaguuccc

SEQ ID NO: 746617 - RNA, 17 nt, Leptospira interrogans serovar lai str. 56601
auggaaaucuuuuaaaa

SEQ ID NO: 746618 - RNA, 15 nt, Leptospira interrogans serovar lai str. 56601
auggaucaaaagagu

SEQ ID NO: 746619 - RNA, 14 nt, Leptospira interrogans serovar lai str. 56601
auggagaauuaauu

SEQ ID NO: 746620 - RNA, 18 nt, Leptospira interrogans serovar lai str. 56601
auggacugcaaaaucagu

SEQ ID NO: 746621 - RNA, 17 nt, Leptospira interrogans serovar lai str. 56601
auggcgccccaaccaga

SEQ ID NO: 746622 - RNA, 23 nt, Leptospira interrogans serovar lai str. 56601
auggauuuuuugucuuuaaaauu

SEQ ID NO: 746623 - RNA, 15 nt, Leptospira interrogans serovar lai str. 56601
auggauuuuuccaac

SEQ ID NO: 746624 - RNA, 15 nt, Leptospira interrogans serovar lai str. 56601
auggauuuauaauuc

SEQ ID NO: 746625 - RNA, 19 nt, Leptospira interrogans serovar lai str. 56601
auggauuauccaaaacaau

SEQ ID NO: 746626 - RNA, 23 nt, Leptospira interrogans serovar lai str. 56601
augguugcaaaaaagaaagcagc

SEQ ID NO: 746627 - RNA, 23 nt, Leptospira interrogans serovar lai str. 56601
augguuccgauacgaguaaaaau

SEQ ID NO: 746628 - RNA, 15 nt, Leptospira interrogans serovar lai str. 56601
auguaaaguucuuuu

SEQ ID NO: 746629 - RNA, 13 nt, Leptospira interrogans serovar lai str. 56601
auggguauugguu

SEQ ID NO: 746630 - RNA, 15 nt, Leptospira interrogans serovar lai str. 56601
auggucaucucuaua

SEQ ID NO: 746631 - RNA, 22 nt, Leptospira interrogans serovar lai str. 56601
augguaucugcgauuaaagauu

SEQ ID NO: 746632 - RNA, 15 nt, Leptospira interrogans serovar lai str. 56601
auguacaauuaaagu

SEQ ID NO: 746633 - RNA, 17 nt, Leptospira interrogans serovar lai str. 56601
auguaacaguaagaaga

SEQ ID NO: 746634 - RNA, 11 nt, Leptospira interrogans serovar lai str. 56601
auguaaaucgg

SEQ ID NO: 746635 - RNA, 22 nt, Leptospira interrogans serovar lai str. 56601
auguauugcuuuaguaguauuu

SEQ ID NO: 746636 - RNA, 17 nt, Leptospira interrogans serovar lai str. 56601
auguauucuauaaaauu

SEQ ID NO: 746637 - RNA, 21 nt, Leptospira interrogans serovar lai str. 56601
auguagauccuagcuauuuuc

SEQ ID NO: 746638 - RNA, 15 nt, Leptospira interrogans serovar lai str. 56601
auguagaguaaauuu

SEQ ID NO: 746639 - RNA, 23 nt, Leptospira interrogans serovar lai str. 56601
auguacuaaaauuuuauaaaaau

SEQ ID NO: 746640 - RNA, 20 nt, Leptospira interrogans serovar lai str. 56601
auguucguucccacaaauua

SEQ ID NO: 746641 - RNA, 22 nt, Leptospira interrogans serovar lai str. 56601
auguucguucccacaaauuaag

SEQ ID NO: 746642 - RNA, 16 nt, Leptospira interrogans serovar lai str. 56601
auguuauagacaacgu

SEQ ID NO: 746643 - RNA, 14 nt, Leptospira interrogans serovar lai str. 56601
augugguuuccuug

SEQ ID NO: 746644 - RNA, 21 nt, Leptospira interrogans serovar lai str. 56601
auguguaaugauuucagauuc

SEQ ID NO: 746645 - RNA, 21 nt, Leptospira interrogans serovar lai str. 56601
augucuuagaauuuuguuucu

SEQ ID NO: 746646 - RNA, 16 nt, Leptospira interrogans serovar lai str. 56601
augucguuaaauuuuc

SEQ ID NO: 746647 - RNA, 16 nt, Leptospira interrogans serovar lai str. 56601
augaugcauuucugcc

SEQ ID NO: 746648 - RNA, 15 nt, Leptospira interrogans serovar lai str. 56601
augaucuaagauuuu

SEQ ID NO: 746649 - RNA, 18 nt, Leptospira interrogans serovar lai str. 56601
augaucgcguaauauuuc

SEQ ID NO: 746650 - RNA, 16 nt, Leptospira interrogans serovar lai str. 56601
augaucgcauaaaauu

SEQ ID NO: 746651 - RNA, 15 nt, Leptospira interrogans serovar lai str. 56601
augauccauuuuucu

SEQ ID NO: 746652 - RNA, 22 nt, Leptospira interrogans serovar lai str. 56601
augaucauauccgaaagauaaa

SEQ ID NO: 746653 - RNA, 14 nt, Leptospira interrogans serovar lai str. 56601
augcauaaauagaa

SEQ ID NO: 746654 - RNA, 18 nt, Leptospira interrogans serovar lai str. 56601
augcauaaauagaauaag

SEQ ID NO: 746655 - RNA, 22 nt, Leptospira interrogans serovar lai str. 56601
augauugaaacguuuucaaaaa

SEQ ID NO: 746656 - RNA, 15 nt, Leptospira interrogans serovar lai str. 56601
augauucugaaaaaa

SEQ ID NO: 746657 - RNA, 16 nt, Leptospira interrogans serovar lai str. 56601
augauucugaaaagaa

SEQ ID NO: 746658 - RNA, 23 nt, Leptospira interrogans serovar lai str. 56601
augauucugaaaagaauugaaau

SEQ ID NO: 746659 - RNA, 21 nt, Leptospira interrogans serovar lai str. 56601
augauucauuuaaaaauugau

SEQ ID NO: 746660 - RNA, 15 nt, Leptospira interrogans serovar lai str. 56601
augauucauuuuucu

SEQ ID NO: 746661 - RNA, 23 nt, Leptospira interrogans serovar lai str. 56601
augauuuuuggguuaaaguuuac

SEQ ID NO: 746662 - RNA, 13 nt, Leptospira interrogans serovar lai str. 56601
augauuuuuuaaa

SEQ ID NO: 746663 - RNA, 13 nt, Leptospira interrogans serovar lai str. 56601
augauuuuuuaau

SEQ ID NO: 746664 - RNA, 9 nt, Leptospira interrogans serovar lai str. 56601
augauuuuu

SEQ ID NO: 746665 - RNA, 15 nt, Leptospira interrogans serovar lai str. 56601
augcaaaaauuuaau

SEQ ID NO: 746666 - RNA, 19 nt, Leptospira interrogans serovar lai str. 56601
augacacuuaucaaauaga

SEQ ID NO: 746667 - RNA, 22 nt, Leptospira interrogans serovar lai str. 56601
augaauuuuuuauuaagaacuu

SEQ ID NO: 746668 - RNA, 18 nt, Leptospira interrogans serovar lai str. 56601
augaauuuuuaaacauuu

SEQ ID NO: 746669 - RNA, 15 nt, Leptospira interrogans serovar lai str. 56601
augaauuuuuauaaa

SEQ ID NO: 746670 - RNA, 16 nt, Leptospira interrogans serovar lai str. 56601
augaauuuuuauaaaa

SEQ ID NO: 746671 - RNA, 13 nt, Leptospira interrogans serovar lai str. 56601
augaggagaaaaa

SEQ ID NO: 746672 - RNA, 16 nt, Leptospira interrogans serovar lai str. 56601
augagggcucccacaa

SEQ ID NO: 746673 - RNA, 19 nt, Leptospira interrogans serovar lai str. 56601
augauaauaauuagaaaaa

SEQ ID NO: 746674 - RNA, 20 nt, Leptospira interrogans serovar lai str. 56601
augauaauaauuagaaaaau

SEQ ID NO: 746675 - RNA, 23 nt, Leptospira interrogans serovar lai str. 56601
augauaauaauuagaaaaauauu

SEQ ID NO: 746676 - RNA, 13 nt, Leptospira interrogans serovar lai str. 56601
augauaguuaauu

SEQ ID NO: 746677 - RNA, 17 nt, Leptospira interrogans serovar lai str. 56601
augauaguuaauuuuau

SEQ ID NO: 746678 - RNA, 22 nt, Leptospira interrogans serovar lai str. 56601
augagcauucuugagaaaggag

SEQ ID NO: 746679 - RNA, 23 nt, Leptospira interrogans serovar lai str. 56601
augagcauucuugagaaaggaga

SEQ ID NO: 746680 - RNA, 16 nt, Leptospira interrogans serovar lai str. 56601
augagccaucuuuuuu

SEQ ID NO: 746681 - RNA, 22 nt, Leptospira interrogans serovar lai str. 56601
augagcgacucagaaaacucag

SEQ ID NO: 746682 - RNA, 18 nt, Leptospira interrogans serovar lai str. 56601
aucuuuuucuaucaagaa

SEQ ID NO: 746683 - RNA, 16 nt, Leptospira interrogans serovar lai str. 56601
aucuuuuuaaaaguau

SEQ ID NO: 746684 - RNA, 12 nt, Leptospira interrogans serovar lai str. 56601
aucuuuuuaaaa

SEQ ID NO: 746685 - RNA, 19 nt, Leptospira interrogans serovar lai str. 56601
aucuuuuaaaaucaagagc

SEQ ID NO: 746686 - RNA, 21 nt, Leptospira interrogans serovar lai str. 56601
aucuuuggauuuuauuuuuac

SEQ ID NO: 746687 - RNA, 14 nt, Leptospira interrogans serovar lai str. 56601
aucuuuauaaaaau

SEQ ID NO: 746688 - RNA, 15 nt, Leptospira interrogans serovar lai str. 56601
aucuuuauaaaaaug

SEQ ID NO: 746689 - RNA, 16 nt, Leptospira interrogans serovar lai str. 56601
aucuuuauaaaaauga

SEQ ID NO: 746690 - RNA, 17 nt, Leptospira interrogans serovar lai str. 56601
aucuuuauaaaaaugau

SEQ ID NO: 746691 - RNA, 18 nt, Leptospira interrogans serovar lai str. 56601
aucuuuauaaaaaugaua

SEQ ID NO: 746692 - RNA, 11 nt, Leptospira interrogans serovar lai str. 56601
aucuuuagaau

SEQ ID NO: 746693 - RNA, 14 nt, Leptospira interrogans serovar lai str. 56601
augaaauuuuaaaa

SEQ ID NO: 746694 - RNA, 18 nt, Leptospira interrogans serovar lai str. 56601
augaaauuuuaaaacccg

SEQ ID NO: 746695 - RNA, 20 nt, Leptospira interrogans serovar lai str. 56601
augaaauuuuuguacaaaac

SEQ ID NO: 746696 - RNA, 21 nt, Leptospira interrogans serovar lai str. 56601
augaaauuuuuguacaaaacc

SEQ ID NO: 746697 - RNA, 21 nt, Leptospira interrogans serovar lai str. 56601
augaacaaugaauuuuuauaa

SEQ ID NO: 746698 - RNA, 18 nt, Leptospira interrogans serovar lai str. 56601
augaaaagucaaaaaaug

SEQ ID NO: 746699 - RNA, 18 nt, Leptospira interrogans serovar lai str. 56601
augaaaacuaggaacucc

SEQ ID NO: 746700 - RNA, 11 nt, Leptospira interrogans serovar lai str. 56601
augaaaaaauu

SEQ ID NO: 746701 - RNA, 14 nt, Leptospira interrogans serovar lai str. 56601
augaaaaaauucag

SEQ ID NO: 746702 - RNA, 17 nt, Leptospira interrogans serovar lai str. 56601
augaaaaagaauuuuua

SEQ ID NO: 746703 - RNA, 20 nt, Leptospira interrogans serovar lai str. 56601
augaaaaagaauuuuuaaaa

SEQ ID NO: 746704 - RNA, 23 nt, Leptospira interrogans serovar lai str. 56601
augaaaaagaaacggaagaaaau

SEQ ID NO: 746705 - RNA, 19 nt, Leptospira interrogans serovar lai str. 56601
augaaaacgaugucuuuug

SEQ ID NO: 746706 - RNA, 13 nt, Leptospira interrogans serovar lai str. 56601
aucuuuuuuaaaa

SEQ ID NO: 746707 - RNA, 22 nt, Leptospira interrogans serovar lai str. 56601
aucuuuuuuucuagauauuuca

SEQ ID NO: 746708 - RNA, 20 nt, Leptospira interrogans serovar lai str. 56601
aucuuuuuuugccuuucacc

SEQ ID NO: 746709 - RNA, 18 nt, Leptospira interrogans serovar lai str. 56601
aucuuuuuuaauuauguu

SEQ ID NO: 746710 - RNA, 15 nt, Leptospira interrogans serovar lai str. 56601
augaaaaaaaacaaa

SEQ ID NO: 746711 - RNA, 22 nt, Leptospira interrogans serovar lai str. 56601
augaaaaaacuauuuaauauag

SEQ ID NO: 746712 - RNA, 22 nt, Leptospira interrogans serovar lai str. 56601
aucuucuccagcaccuucugaa

SEQ ID NO: 746713 - RNA, 17 nt, Leptospira interrogans serovar lai str. 56601
aucuucauuaauuuuug

SEQ ID NO: 746714 - RNA, 19 nt, Leptospira interrogans serovar lai str. 56601
aucuuccugggaaguugua

SEQ ID NO: 746715 - RNA, 22 nt, Leptospira interrogans serovar lai str. 56601
aucuucgggcuuauuuuuuuau

SEQ ID NO: 746716 - RNA, 15 nt, Leptospira interrogans serovar lai str. 56601
aucuuaaaaaauaca

SEQ ID NO: 746717 - RNA, 19 nt, Leptospira interrogans serovar lai str. 56601
aucuuaaaagaaaaucaca

SEQ ID NO: 746718 - RNA, 13 nt, Leptospira interrogans serovar lai str. 56601
aucuuaaaaugau

SEQ ID NO: 746719 - RNA, 19 nt, Leptospira interrogans serovar lai str. 56601
aucuuaaaucuuuaaaaua

SEQ ID NO: 746720 - RNA, 17 nt, Leptospira interrogans serovar lai str. 56601
aucuuaacuuuaagcaa

SEQ ID NO: 746721 - RNA, 15 nt, Leptospira interrogans serovar lai str. 56601
aucuguuucuugccc

SEQ ID NO: 746722 - RNA, 22 nt, Leptospira interrogans serovar lai str. 56601
aucuuaggacggauuuuagauu

SEQ ID NO: 746723 - RNA, 21 nt, Leptospira interrogans serovar lai str. 56601
aucuuagaaaaccauuuuguu

SEQ ID NO: 746724 - RNA, 13 nt, Leptospira interrogans serovar lai str. 56601
aucuuagaauaau

SEQ ID NO: 746725 - RNA, 18 nt, Leptospira interrogans serovar lai str. 56601
aucuuagaauaauaggaa

SEQ ID NO: 746726 - RNA, 17 nt, Leptospira interrogans serovar lai str. 56601
aucuuagaaugugggaa

SEQ ID NO: 746727 - RNA, 14 nt, Leptospira interrogans serovar lai str. 56601
aucuuaauguaaag

SEQ ID NO: 746728 - RNA, 16 nt, Leptospira interrogans serovar lai str. 56601
aucuuaauguaaaguu

SEQ ID NO: 746729 - RNA, 22 nt, Leptospira interrogans serovar lai str. 56601
aucuuaauguaaaguucuuuuc

SEQ ID NO: 746730 - RNA, 15 nt, Leptospira interrogans serovar lai str. 56601
aucuuaauuaaaaaa

SEQ ID NO: 746731 - RNA, 14 nt, Leptospira interrogans serovar lai str. 56601
aucuuaauaaaauu

SEQ ID NO: 746732 - RNA, 18 nt, Leptospira interrogans serovar lai str. 56601
aucuuaauaaaauuuuca

SEQ ID NO: 746733 - RNA, 13 nt, Leptospira interrogans serovar lai str. 56601
aucuuaauauuuc

SEQ ID NO: 746734 - RNA, 22 nt, Leptospira interrogans serovar lai str. 56601
aucuuaauuuguaagaguucca

SEQ ID NO: 746735 - RNA, 16 nt, Leptospira interrogans serovar lai str. 56601
aucuuauucaauaaaa

SEQ ID NO: 746736 - RNA, 18 nt, Leptospira interrogans serovar lai str. 56601
aucuuauucaauaaaaua

SEQ ID NO: 746737 - RNA, 17 nt, Leptospira interrogans serovar lai str. 56601
aucuuauggacucuauu

SEQ ID NO: 746738 - RNA, 21 nt, Leptospira interrogans serovar lai str. 56601
aucuuauggacucuauuauga

SEQ ID NO: 746739 - RNA, 21 nt, Leptospira interrogans serovar lai str. 56601
aucuuauuuuuacagaaaaau

SEQ ID NO: 746740 - RNA, 13 nt, Leptospira interrogans serovar lai str. 56601
aucuuauuuuuua

SEQ ID NO: 746741 - RNA, 15 nt, Leptospira interrogans serovar lai str. 56601
aucuuauuuuuuaau

SEQ ID NO: 746742 - RNA, 22 nt, Leptospira interrogans serovar lai str. 56601
aucuuauuuuuuaauauucaac

SEQ ID NO: 746743 - RNA, 14 nt, Leptospira interrogans serovar lai str. 56601
aucuucaguucuua

SEQ ID NO: 746744 - RNA, 23 nt, Leptospira interrogans serovar lai str. 56601
aucuucaguucuuauagaaacua

SEQ ID NO: 746745 - RNA, 15 nt, Leptospira interrogans serovar lai str. 56601
aucugcugaauuuac

SEQ ID NO: 746746 - RNA, 12 nt, Leptospira interrogans serovar lai str. 56601
aucuaauuuuuu

SEQ ID NO: 746747 - RNA, 17 nt, Leptospira interrogans serovar lai str. 56601
aucuggucggaauuacg

SEQ ID NO: 746748 - RNA, 19 nt, Leptospira interrogans serovar lai str. 56601
aucugcuuuuuuaaaccuu

SEQ ID NO: 746749 - RNA, 20 nt, Leptospira interrogans serovar lai str. 56601
aucuggaacuuuaauuauug

SEQ ID NO: 746750 - RNA, 14 nt, Leptospira interrogans serovar lai str. 56601
aucuaauucuucua

SEQ ID NO: 746751 - RNA, 14 nt, Leptospira interrogans serovar lai str. 56601
aucuaauuuauaaa

SEQ ID NO: 746752 - RNA, 18 nt, Leptospira interrogans serovar lai str. 56601
aucuacaaaagauuuuua

SEQ ID NO: 746753 - RNA, 19 nt, Leptospira interrogans serovar lai str. 56601
aucuacaaaagauuuuuau

SEQ ID NO: 746754 - RNA, 16 nt, Leptospira interrogans serovar lai str. 56601
aucuaauauuuuucca

SEQ ID NO: 746755 - RNA, 18 nt, Leptospira interrogans serovar lai str. 56601
aucuaagauccaaauuuu

SEQ ID NO: 746756 - RNA, 13 nt, Leptospira interrogans serovar lai str. 56601
aucuaagacgaaa

SEQ ID NO: 746757 - RNA, 14 nt, Leptospira interrogans serovar lai str. 56601
aucugucggaauua

SEQ ID NO: 746758 - RNA, 21 nt, Leptospira interrogans serovar lai str. 56601
aucugugggaacucucacaaa

SEQ ID NO: 746759 - RNA, 14 nt, Leptospira interrogans serovar lai str. 56601
aucuguaaaaugau

SEQ ID NO: 746760 - RNA, 21 nt, Leptospira interrogans serovar lai str. 56601
aucuguaaaaugaugugggaa

SEQ ID NO: 746761 - RNA, 22 nt, Leptospira interrogans serovar lai str. 56601
aucuguaaaaugaugugggaac

SEQ ID NO: 746762 - RNA, 16 nt, Leptospira interrogans serovar lai str. 56601
aucuguaaaauguaga

SEQ ID NO: 746763 - RNA, 21 nt, Leptospira interrogans serovar lai str. 56601
aucuguaaaguuuagauuuua

SEQ ID NO: 746764 - RNA, 14 nt, Leptospira interrogans serovar lai str. 56601
aucuguaaaucaac

SEQ ID NO: 746765 - RNA, 15 nt, Leptospira interrogans serovar lai str. 56601
aucuguaauuuuaca

SEQ ID NO: 746766 - RNA, 19 nt, Leptospira interrogans serovar lai str. 56601
aucuguacuuaaauuuuau

SEQ ID NO: 746767 - RNA, 17 nt, Leptospira interrogans serovar lai str. 56601
auucccucaauaaucca

SEQ ID NO: 746768 - RNA, 15 nt, Leptospira interrogans serovar lai str. 56601
auucccuuaaucauu

SEQ ID NO: 746769 - RNA, 14 nt, Leptospira interrogans serovar lai str. 56601
auucccuucuccug

SEQ ID NO: 746770 - RNA, 17 nt, Leptospira interrogans serovar lai str. 56601
auucccuucuccugcau

SEQ ID NO: 746771 - RNA, 17 nt, Leptospira interrogans serovar lai str. 56601
auucccccgguucuagg

SEQ ID NO: 746772 - RNA, 19 nt, Leptospira interrogans serovar lai str. 56601
auucccauccgaaauccca

SEQ ID NO: 746773 - RNA, 14 nt, Leptospira interrogans serovar lai str. 56601
auucccaguaaauc

SEQ ID NO: 746774 - RNA, 22 nt, Leptospira interrogans serovar lai str. 56601
auucccaguaaauccacaaguu

SEQ ID NO: 746775 - RNA, 19 nt, Leptospira interrogans serovar lai str. 56601
auucccacauuuucaaaau

SEQ ID NO: 746776 - RNA, 16 nt, Leptospira interrogans serovar lai str. 56601
auuccguacuguuuuu

SEQ ID NO: 746777 - RNA, 17 nt, Leptospira interrogans serovar lai str. 56601
auuccgguaaauuuuuu

SEQ ID NO: 746778 - RNA, 22 nt, Leptospira interrogans serovar lai str. 56601
auuccgaucauuugaaguauuu

SEQ ID NO: 746779 - RNA, 16 nt, Leptospira interrogans serovar lai str. 56601
auuccgacccagaaaa

SEQ ID NO: 746780 - RNA, 15 nt, Leptospira interrogans serovar lai str. 56601
auuccgacgauagau

SEQ ID NO: 746781 - RNA, 19 nt, Leptospira interrogans serovar lai str. 56601
auuccuccagugcaauaca

SEQ ID NO: 746782 - RNA, 17 nt, Leptospira interrogans serovar lai str. 56601
auuccuagcaguauuuu

SEQ ID NO: 746783 - RNA, 19 nt, Leptospira interrogans serovar lai str. 56601
auuccuaaaacaccuucuc

SEQ ID NO: 746784 - RNA, 13 nt, Leptospira interrogans serovar lai str. 56601
auuccuaaaaugu

SEQ ID NO: 746785 - RNA, 18 nt, Leptospira interrogans serovar lai str. 56601
auuccuacauuauuuuau

SEQ ID NO: 746786 - RNA, 19 nt, Leptospira interrogans serovar lai str. 56601
auuccuacauucauuuuua

SEQ ID NO: 746787 - RNA, 13 nt, Leptospira interrogans serovar lai str. 56601
auuccuacuuauu

SEQ ID NO: 746788 - RNA, 15 nt, Leptospira interrogans serovar lai str. 56601
auuccuauaaauaaa

SEQ ID NO: 746789 - RNA, 19 nt, Leptospira interrogans serovar lai str. 56601
auuccuauaaauaaauuua

SEQ ID NO: 746790 - RNA, 21 nt, Leptospira interrogans serovar lai str. 56601
auuccuauaaauaaauuuaaa

SEQ ID NO: 746791 - RNA, 19 nt, Leptospira interrogans serovar lai str. 56601
auuccuuuucuuuuuuaaa

SEQ ID NO: 746792 - RNA, 15 nt, Leptospira interrogans serovar lai str. 56601
auuccuuuuucuaau

SEQ ID NO: 746793 - RNA, 16 nt, Leptospira interrogans serovar lai str. 56601
auuccuuuuuguaagg

SEQ ID NO: 746794 - RNA, 20 nt, Leptospira interrogans serovar lai str. 56601
auucgaguaguuaauaaauu

SEQ ID NO: 746795 - RNA, 15 nt, Leptospira interrogans serovar lai str. 56601
auucgaguccuuuuu

SEQ ID NO: 746796 - RNA, 22 nt, Leptospira interrogans serovar lai str. 56601
auucgauauggcaaucggaaau

SEQ ID NO: 746797 - RNA, 16 nt, Leptospira interrogans serovar lai str. 56601
auucgaaucauuuugu

SEQ ID NO: 746798 - RNA, 22 nt, Leptospira interrogans serovar lai str. 56601
auuccuugagaaaaguguuuuu

SEQ ID NO: 746799 - RNA, 20 nt, Leptospira interrogans serovar lai str. 56601
auuccuuacucguuuuuagu

SEQ ID NO: 746800 - RNA, 17 nt, Leptospira interrogans serovar lai str. 56601
auuccuuccaaguuuuu

SEQ ID NO: 746801 - RNA, 16 nt, Leptospira interrogans serovar lai str. 56601
auucgcauugaucuuu

SEQ ID NO: 746802 - RNA, 14 nt, Leptospira interrogans serovar lai str. 56601
auucauuuaaaaau

SEQ ID NO: 746803 - RNA, 12 nt, Leptospira interrogans serovar lai str. 56601
auucauucuaag

SEQ ID NO: 746804 - RNA, 16 nt, Leptospira interrogans serovar lai str. 56601
auucauuuggaucugu

SEQ ID NO: 746805 - RNA, 19 nt, Leptospira interrogans serovar lai str. 56601
auucauuuggaucuguaau

SEQ ID NO: 746806 - RNA, 22 nt, Leptospira interrogans serovar lai str. 56601
auucauuccuauaaauaaauuu

SEQ ID NO: 746807 - RNA, 16 nt, Leptospira interrogans serovar lai str. 56601
auucauuguaagaaau

SEQ ID NO: 746808 - RNA, 17 nt, Leptospira interrogans serovar lai str. 56601
auucauuguaagaaaua

SEQ ID NO: 746809 - RNA, 21 nt, Leptospira interrogans serovar lai str. 56601
auucauuuuuucuaaauuaga

SEQ ID NO: 746810 - RNA, 17 nt, Leptospira interrogans serovar lai str. 56601
auucauuuuuugaaaaa

SEQ ID NO: 746811 - RNA, 18 nt, Leptospira interrogans serovar lai str. 56601
auucauuuuuugaaaaag

SEQ ID NO: 746812 - RNA, 12 nt, Leptospira interrogans serovar lai str. 56601
auuccaaagaua

SEQ ID NO: 746813 - RNA, 15 nt, Leptospira interrogans serovar lai str. 56601
auuccaaagauaaaa

SEQ ID NO: 746814 - RNA, 20 nt, Leptospira interrogans serovar lai str. 56601
auucauuuuacagaauauua

SEQ ID NO: 746815 - RNA, 19 nt, Leptospira interrogans serovar lai str. 56601
auucauuuuucuaaaaaaa

SEQ ID NO: 746816 - RNA, 14 nt, Leptospira interrogans serovar lai str. 56601
auucauuuuucuga

SEQ ID NO: 746817 - RNA, 18 nt, Leptospira interrogans serovar lai str. 56601
auucauuuuucugaaaaa

SEQ ID NO: 746818 - RNA, 19 nt, Leptospira interrogans serovar lai str. 56601
auucauuuuucugaaaaaa

SEQ ID NO: 746819 - RNA, 19 nt, Leptospira interrogans serovar lai str. 56601
auucauuuuucugaaaaag

SEQ ID NO: 746820 - RNA, 18 nt, Leptospira interrogans serovar lai str. 56601
auuccaagcaauucuaag

SEQ ID NO: 746821 - RNA, 15 nt, Leptospira interrogans serovar lai str. 56601
auuccaacuuuuuca

SEQ ID NO: 746822 - RNA, 18 nt, Leptospira interrogans serovar lai str. 56601
auuccaacuuuuucagaa

SEQ ID NO: 746823 - RNA, 13 nt, Leptospira interrogans serovar lai str. 56601
auuccaauuuuuc

SEQ ID NO: 746824 - RNA, 14 nt, Leptospira interrogans serovar lai str. 56601
auuccaauuuuucu

SEQ ID NO: 746825 - RNA, 15 nt, Leptospira interrogans serovar lai str. 56601
auuccauucuucaaa

SEQ ID NO: 746826 - RNA, 21 nt, Leptospira interrogans serovar lai str. 56601
auuccauucuucaaauaacau

SEQ ID NO: 746827 - RNA, 16 nt, Leptospira interrogans serovar lai str. 56601
auuccauugauuuuca

SEQ ID NO: 746828 - RNA, 20 nt, Leptospira interrogans serovar lai str. 56601
auuccauugauuuucauuuu

SEQ ID NO: 746829 - RNA, 17 nt, Leptospira interrogans serovar lai str. 56601
auuccaugguuuuuuca

SEQ ID NO: 746830 - RNA, 18 nt, Leptospira interrogans serovar lai str. 56601
auuccaucguuuauuuuu

SEQ ID NO: 746831 - RNA, 20 nt, Leptospira interrogans serovar lai str. 56601
auuccaucguuuauuuuucu

SEQ ID NO: 746832 - RNA, 18 nt, Leptospira interrogans serovar lai str. 56601
auuccauauagagaauuu

SEQ ID NO: 746833 - RNA, 18 nt, Leptospira interrogans serovar lai str. 56601
auuccauaaugaagauga

SEQ ID NO: 746834 - RNA, 19 nt, Leptospira interrogans serovar lai str. 56601
auuccagaggcaguacaau

SEQ ID NO: 746835 - RNA, 16 nt, Leptospira interrogans serovar lai str. 56601
auuccagcuuuuuuca

SEQ ID NO: 746836 - RNA, 13 nt, Leptospira interrogans serovar lai str. 56601
auuccacuucuca

SEQ ID NO: 746837 - RNA, 15 nt, Leptospira interrogans serovar lai str. 56601
auuccacuucucaca

SEQ ID NO: 746838 - RNA, 17 nt, Leptospira interrogans serovar lai str. 56601
auuccacuucucacaaa

SEQ ID NO: 746839 - RNA, 16 nt, Leptospira interrogans serovar lai str. 56601
auuccagaaguauuuu

SEQ ID NO: 746840 - RNA, 20 nt, Leptospira interrogans serovar lai str. 56601
auuccaccuuggaaagaaaa

SEQ ID NO: 746841 - RNA, 21 nt, Leptospira interrogans serovar lai str. 56601
auuccacuaugaaaguuuuuc

SEQ ID NO: 746842 - RNA, 17 nt, Leptospira interrogans serovar lai str. 56601
auucauacuuuuaaaaa

SEQ ID NO: 746843 - RNA, 16 nt, Leptospira interrogans serovar lai str. 56601
auucauaacuauauaa

SEQ ID NO: 746844 - RNA, 13 nt, Leptospira interrogans serovar lai str. 56601
auucagucucauu

SEQ ID NO: 746845 - RNA, 13 nt, Leptospira interrogans serovar lai str. 56601
auucaguuucaaa

SEQ ID NO: 746846 - RNA, 19 nt, Leptospira interrogans serovar lai str. 56601
auucaguuucaaacugaga

SEQ ID NO: 746847 - RNA, 15 nt, Leptospira interrogans serovar lai str. 56601
auucaguuuccacuc

SEQ ID NO: 746848 - RNA, 18 nt, Leptospira interrogans serovar lai str. 56601
auucaguuuccacucuuu

SEQ ID NO: 746849 - RNA, 22 nt, Leptospira interrogans serovar lai str. 56601
auucaguuuuucggauggaauc

SEQ ID NO: 746850 - RNA, 14 nt, Leptospira interrogans serovar lai str. 56601
auucauaaaugaua

SEQ ID NO: 746851 - RNA, 14 nt, Leptospira interrogans serovar lai str. 56601
auucaucaaauuug

SEQ ID NO: 746852 - RNA, 20 nt, Leptospira interrogans serovar lai str. 56601
auucauauugagauaaaaag

SEQ ID NO: 746853 - RNA, 17 nt, Leptospira interrogans serovar lai str. 56601
auucaucgcuuuuaaau

SEQ ID NO: 746854 - RNA, 16 nt, Leptospira interrogans serovar lai str. 56601
auucauccuaagaauc

SEQ ID NO: 746855 - RNA, 19 nt, Leptospira interrogans serovar lai str. 56601
auuggacgauguuguuuaa

SEQ ID NO: 746856 - RNA, 12 nt, Leptospira interrogans serovar lai str. 56601
auugcuuuuuaa

SEQ ID NO: 746857 - RNA, 15 nt, Leptospira interrogans serovar lai str. 56601
auugcuuuuuaaaag

SEQ ID NO: 746858 - RNA, 16 nt, Leptospira interrogans serovar lai str. 56601
auugcuuuuuaaaaga

SEQ ID NO: 746859 - RNA, 15 nt, Leptospira interrogans serovar lai str. 56601
auugcgguaguuccc

SEQ ID NO: 746860 - RNA, 19 nt, Leptospira interrogans serovar lai str. 56601
auugauccagauuccuucg

SEQ ID NO: 746861 - RNA, 24 nt, Leptospira interrogans serovar lai str. 56601
auugauauucaaauuuacucuuau

SEQ ID NO: 746862 - RNA, 17 nt, Leptospira interrogans serovar lai str. 56601
auugauauuucuuaaau

SEQ ID NO: 746863 - RNA, 15 nt, Leptospira interrogans serovar lai str. 56601
auugauaauuuuugu

SEQ ID NO: 746864 - RNA, 23 nt, Leptospira interrogans serovar lai str. 56601
auugauaaagcgccgauuauuca

SEQ ID NO: 746865 - RNA, 23 nt, Leptospira interrogans serovar lai str. 56601
auugaguuuuuuauucccaaaaa

SEQ ID NO: 746866 - RNA, 18 nt, Leptospira interrogans serovar lai str. 56601
auugauaaaaaaauguuu

SEQ ID NO: 746867 - RNA, 15 nt, Leptospira interrogans serovar lai str. 56601
auugaauuuuuuaaa

SEQ ID NO: 746868 - RNA, 22 nt, Leptospira interrogans serovar lai str. 56601
auugaauuuuuauggaauuguu

SEQ ID NO: 746869 - RNA, 15 nt, Leptospira interrogans serovar lai str. 56601
auugaagauauuuuc

SEQ ID NO: 746870 - RNA, 17 nt, Leptospira interrogans serovar lai str. 56601
auugaagauauuuuccu

SEQ ID NO: 746871 - RNA, 14 nt, Leptospira interrogans serovar lai str. 56601
auugaauuuaaaag

SEQ ID NO: 746872 - RNA, 17 nt, Leptospira interrogans serovar lai str. 56601
auugaauuuaaaaguuu

SEQ ID NO: 746873 - RNA, 21 nt, Leptospira interrogans serovar lai str. 56601
auugauucuauauauugaaau

SEQ ID NO: 746874 - RNA, 19 nt, Leptospira interrogans serovar lai str. 56601
auugaugacaagaagagau

SEQ ID NO: 746875 - RNA, 14 nt, Leptospira interrogans serovar lai str. 56601
auugauuuaaaaac

SEQ ID NO: 746876 - RNA, 23 nt, Leptospira interrogans serovar lai str. 56601
auugauucuuuaaauguagaaac

SEQ ID NO: 746877 - RNA, 20 nt, Leptospira interrogans serovar lai str. 56601
auucuaagguuuugggacaa

SEQ ID NO: 746878 - RNA, 14 nt, Leptospira interrogans serovar lai str. 56601
auucuaaauuauuu

SEQ ID NO: 746879 - RNA, 12 nt, Leptospira interrogans serovar lai str. 56601
auucuaaaaaaa

SEQ ID NO: 746880 - RNA, 17 nt, Leptospira interrogans serovar lai str. 56601
auucuaagaucaaagag

SEQ ID NO: 746881 - RNA, 16 nt, Leptospira interrogans serovar lai str. 56601
auucuaauugugggaa

SEQ ID NO: 746882 - RNA, 17 nt, Leptospira interrogans serovar lai str. 56601
auucuaauugugggaac

SEQ ID NO: 746883 - RNA, 17 nt, Leptospira interrogans serovar lai str. 56601
auucuaauuuuauucca

SEQ ID NO: 746884 - RNA, 20 nt, Leptospira interrogans serovar lai str. 56601
auucuaauuuuauuccaaca

SEQ ID NO: 746885 - RNA, 17 nt, Leptospira interrogans serovar lai str. 56601
auucuacaauuguagga

SEQ ID NO: 746886 - RNA, 17 nt, Leptospira interrogans serovar lai str. 56601
auucuacaccuucuaaa

SEQ ID NO: 746887 - RNA, 15 nt, Leptospira interrogans serovar lai str. 56601
auucuacagauaaaa

SEQ ID NO: 746888 - RNA, 16 nt, Leptospira interrogans serovar lai str. 56601
auucuacagauaaaaa

SEQ ID NO: 746889 - RNA, 21 nt, Leptospira interrogans serovar lai str. 56601
auucuacaaauucuucuuccu

SEQ ID NO: 746890 - RNA, 15 nt, Leptospira interrogans serovar lai str. 56601
auucuaaaaaugaaa

SEQ ID NO: 746891 - RNA, 17 nt, Leptospira interrogans serovar lai str. 56601
auucguuuuauaaaaac

SEQ ID NO: 746892 - RNA, 13 nt, Leptospira interrogans serovar lai str. 56601
auucuaaaauacu

SEQ ID NO: 746893 - RNA, 16 nt, Leptospira interrogans serovar lai str. 56601
auucuaaaauccuauu

SEQ ID NO: 746894 - RNA, 14 nt, Leptospira interrogans serovar lai str. 56601
auucuaaagaaggg

SEQ ID NO: 746895 - RNA, 19 nt, Leptospira interrogans serovar lai str. 56601
auucuaaaauuauaggaac

SEQ ID NO: 746896 - RNA, 12 nt, Leptospira interrogans serovar lai str. 56601
auucuaaaauuu

SEQ ID NO: 746897 - RNA, 13 nt, Leptospira interrogans serovar lai str. 56601
auucuaaaauuug

SEQ ID NO: 746898 - RNA, 14 nt, Leptospira interrogans serovar lai str. 56601
auucguaagaaaaa

SEQ ID NO: 746899 - RNA, 18 nt, Leptospira interrogans serovar lai str. 56601
auucguacaaccaaacag

SEQ ID NO: 746900 - RNA, 19 nt, Leptospira interrogans serovar lai str. 56601
auucguucauagagauaga

SEQ ID NO: 746901 - RNA, 16 nt, Leptospira interrogans serovar lai str. 56601
auucguuccaaauaca

SEQ ID NO: 746902 - RNA, 15 nt, Leptospira interrogans serovar lai str. 56601
auucugaaaauguaa

SEQ ID NO: 746903 - RNA, 14 nt, Leptospira interrogans serovar lai str. 56601
auucugaaagaguu

SEQ ID NO: 746904 - RNA, 19 nt, Leptospira interrogans serovar lai str. 56601
auucugaaauuguuuuaaa

SEQ ID NO: 746905 - RNA, 17 nt, Leptospira interrogans serovar lai str. 56601
auucugaaaaaaguuag

SEQ ID NO: 746906 - RNA, 19 nt, Leptospira interrogans serovar lai str. 56601
auucugaaaaaaguuggga

SEQ ID NO: 746907 - RNA, 17 nt, Leptospira interrogans serovar lai str. 56601
auucugaaaaaguuaga

SEQ ID NO: 746908 - RNA, 13 nt, Leptospira interrogans serovar lai str. 56601
auucuccauccua

SEQ ID NO: 746909 - RNA, 14 nt, Leptospira interrogans serovar lai str. 56601
auucuccaucuauu

SEQ ID NO: 746910 - RNA, 23 nt, Leptospira interrogans serovar lai str. 56601
auucuccaucuauuuuguuuuau

SEQ ID NO: 746911 - RNA, 17 nt, Leptospira interrogans serovar lai str. 56601
auucuccaucuguuucu

SEQ ID NO: 746912 - RNA, 14 nt, Leptospira interrogans serovar lai str. 56601
auucuacuauuaau

SEQ ID NO: 746913 - RNA, 15 nt, Leptospira interrogans serovar lai str. 56601
auucuacuuacagcc

SEQ ID NO: 746914 - RNA, 22 nt, Leptospira interrogans serovar lai str. 56601
auucuagaaccuggaaaagaau

SEQ ID NO: 746915 - RNA, 15 nt, Leptospira interrogans serovar lai str. 56601
auucuagaagaguuu

SEQ ID NO: 746916 - RNA, 20 nt, Leptospira interrogans serovar lai str. 56601
auucuagaauauaaccguaa

SEQ ID NO: 746917 - RNA, 21 nt, Leptospira interrogans serovar lai str. 56601
auucuaauauuauuuuuuucu

SEQ ID NO: 746918 - RNA, 12 nt, Leptospira interrogans serovar lai str. 56601
auucuacaugau

SEQ ID NO: 746919 - RNA, 23 nt, Leptospira interrogans serovar lai str. 56601
auucuacaugauucauuuaaaaa

SEQ ID NO: 746920 - RNA, 15 nt, Leptospira interrogans serovar lai str. 56601
auucuacauucugaa

SEQ ID NO: 746921 - RNA, 23 nt, Leptospira interrogans serovar lai str. 56601
auucuacauucugaaacuuuuca

SEQ ID NO: 746922 - RNA, 17 nt, Leptospira interrogans serovar lai str. 56601
auucuacgaauuucaga

SEQ ID NO: 746923 - RNA, 17 nt, Leptospira interrogans serovar lai str. 56601
auucuuuaaauguggga

SEQ ID NO: 746924 - RNA, 17 nt, Leptospira interrogans serovar lai str. 56601
auucuuuaaaauuuuua

SEQ ID NO: 746925 - RNA, 16 nt, Leptospira interrogans serovar lai str. 56601
auucuuuagaaauuuu

SEQ ID NO: 746926 - RNA, 19 nt, Leptospira interrogans serovar lai str. 56601
auucuuuagaaauuuuuaa

SEQ ID NO: 746927 - RNA, 19 nt, Leptospira interrogans serovar lai str. 56601
auucuuucuuaaauuuuuu

SEQ ID NO: 746928 - RNA, 18 nt, Leptospira interrogans serovar lai str. 56601
auucuuuggaaauuuuua

SEQ ID NO: 746929 - RNA, 21 nt, Leptospira interrogans serovar lai str. 56601
auucuuuucugaauaaaaaua

SEQ ID NO: 746930 - RNA, 20 nt, Leptospira interrogans serovar lai str. 56601
auucuuuugcauaguuuuau

SEQ ID NO: 746931 - RNA, 13 nt, Leptospira interrogans serovar lai str. 56601
auucuuuugugac

SEQ ID NO: 746932 - RNA, 22 nt, Leptospira interrogans serovar lai str. 56601
auugaagaaaaaaagauuuuac

SEQ ID NO: 746933 - RNA, 21 nt, Leptospira interrogans serovar lai str. 56601
auugaacgguaaaaucuuuaa

SEQ ID NO: 746934 - RNA, 23 nt, Leptospira interrogans serovar lai str. 56601
auugaacgguaaaaucuuuaagu

SEQ ID NO: 746935 - RNA, 22 nt, Leptospira interrogans serovar lai str. 56601
auugaacguaaguuaaauauaa

SEQ ID NO: 746936 - RNA, 17 nt, Leptospira interrogans serovar lai str. 56601
auugaacguaauacaaa

SEQ ID NO: 746937 - RNA, 17 nt, Leptospira interrogans serovar lai str. 56601
auugaacauuuuuaaaa

SEQ ID NO: 746938 - RNA, 16 nt, Leptospira interrogans serovar lai str. 56601
auucugauaacuauau

SEQ ID NO: 746939 - RNA, 22 nt, Leptospira interrogans serovar lai str. 56601
auucugauaacuauauaacaaa

SEQ ID NO: 746940 - RNA, 14 nt, Leptospira interrogans serovar lai str. 56601
auucugauuuuaca

SEQ ID NO: 746941 - RNA, 19 nt, Leptospira interrogans serovar lai str. 56601
auucuuccgggaggaauuu

SEQ ID NO: 746942 - RNA, 20 nt, Leptospira interrogans serovar lai str. 56601
auucuuccgggaggaauuuu

SEQ ID NO: 746943 - RNA, 12 nt, Leptospira interrogans serovar lai str. 56601
auucuuccuucu

SEQ ID NO: 746944 - RNA, 13 nt, Leptospira interrogans serovar lai str. 56601
auucuuccuuuuu

SEQ ID NO: 746945 - RNA, 15 nt, Leptospira interrogans serovar lai str. 56601
auucuuccuuuuuca

SEQ ID NO: 746946 - RNA, 16 nt, Leptospira interrogans serovar lai str. 56601
auucuuccuuuuucau

SEQ ID NO: 746947 - RNA, 15 nt, Leptospira interrogans serovar lai str. 56601
auucuucuccucuuc

SEQ ID NO: 746948 - RNA, 17 nt, Leptospira interrogans serovar lai str. 56601
auuuuaauggaaaugga

SEQ ID NO: 746949 - RNA, 15 nt, Leptospira interrogans serovar lai str. 56601
auuuuaaaaaauuua

SEQ ID NO: 746950 - RNA, 14 nt, Leptospira interrogans serovar lai str. 56601
auuuuaaaaaaauu

SEQ ID NO: 746951 - RNA, 15 nt, Leptospira interrogans serovar lai str. 56601
auuuuaaaaaaauuu

SEQ ID NO: 746952 - RNA, 17 nt, Leptospira interrogans serovar lai str. 56601
auuuuaaaaaaauuuuu

SEQ ID NO: 746953 - RNA, 11 nt, Leptospira interrogans serovar lai str. 56601
auuuguuuuau

SEQ ID NO: 746954 - RNA, 17 nt, Leptospira interrogans serovar lai str. 56601
auuuguuugucuuuuuc

SEQ ID NO: 746955 - RNA, 18 nt, Leptospira interrogans serovar lai str. 56601
auuuguuugucuuuuucu

SEQ ID NO: 746956 - RNA, 21 nt, Leptospira interrogans serovar lai str. 56601
auuuguuuguuauaagaauuu

SEQ ID NO: 746957 - RNA, 17 nt, Leptospira interrogans serovar lai str. 56601
auuuguuuuaaaauuua

SEQ ID NO: 746958 - RNA, 17 nt, Leptospira interrogans serovar lai str. 56601
auuuguuucuauuuuau

SEQ ID NO: 746959 - RNA, 17 nt, Leptospira interrogans serovar lai str. 56601
auuuguuuaggaauuuu

SEQ ID NO: 746960 - RNA, 22 nt, Leptospira interrogans serovar lai str. 56601
auuuguuuaggaauuuuuuaaa

SEQ ID NO: 746961 - RNA, 20 nt, Leptospira interrogans serovar lai str. 56601
auuuguuguaucgaacucac

SEQ ID NO: 746962 - RNA, 16 nt, Leptospira interrogans serovar lai str. 56601
auuuguugauuuuuga

SEQ ID NO: 746963 - RNA, 23 nt, Leptospira interrogans serovar lai str. 56601
auuuguugcaauacauucuuaua

SEQ ID NO: 746964 - RNA, 15 nt, Leptospira interrogans serovar lai str. 56601
auuuguaggaacuac

SEQ ID NO: 746965 - RNA, 14 nt, Leptospira interrogans serovar lai str. 56601
auuuguaggaacuc

SEQ ID NO: 746966 - RNA, 15 nt, Leptospira interrogans serovar lai str. 56601
auuuguaauucuuca

SEQ ID NO: 746967 - RNA, 18 nt, Leptospira interrogans serovar lai str. 56601
auuuguaauaguucccac

SEQ ID NO: 746968 - RNA, 17 nt, Leptospira interrogans serovar lai str. 56601
auuuguaaucaguuaaa

SEQ ID NO: 746969 - RNA, 18 nt, Leptospira interrogans serovar lai str. 56601
auuugcuuaaagcauuaa

SEQ ID NO: 746970 - RNA, 20 nt, Leptospira interrogans serovar lai str. 56601
auuugguuuucauucaaaau

SEQ ID NO: 746971 - RNA, 18 nt, Leptospira interrogans serovar lai str. 56601
auuugguuuucauuuuag

SEQ ID NO: 746972 - RNA, 16 nt, Leptospira interrogans serovar lai str. 56601
auuuguaaaaaugagu

SEQ ID NO: 746973 - RNA, 14 nt, Leptospira interrogans serovar lai str. 56601
auuuguaaaauuca

SEQ ID NO: 746974 - RNA, 23 nt, Leptospira interrogans serovar lai str. 56601
auuuggaaucugcaucuuuucua

SEQ ID NO: 746975 - RNA, 18 nt, Leptospira interrogans serovar lai str. 56601
auuugaauuuauagauau

SEQ ID NO: 746976 - RNA, 16 nt, Leptospira interrogans serovar lai str. 56601
auuugacaauuuguga

SEQ ID NO: 746977 - RNA, 14 nt, Leptospira interrogans serovar lai str. 56601
auuugaauuuaaaa

SEQ ID NO: 746978 - RNA, 14 nt, Leptospira interrogans serovar lai str. 56601
auuugcuuccauug

SEQ ID NO: 746979 - RNA, 17 nt, Leptospira interrogans serovar lai str. 56601
auuugcuuccauugucu

SEQ ID NO: 746980 - RNA, 22 nt, Leptospira interrogans serovar lai str. 56601
auuucuaauauuaaaaacacaa

SEQ ID NO: 746981 - RNA, 19 nt, Leptospira interrogans serovar lai str. 56601
auuucucucaaauucuuca

SEQ ID NO: 746982 - RNA, 22 nt, Leptospira interrogans serovar lai str. 56601
auuucucuaauucuaaaaauuu

SEQ ID NO: 746983 - RNA, 23 nt, Leptospira interrogans serovar lai str. 56601
auuucucuaauucuaaaaauuuu

SEQ ID NO: 746984 - RNA, 19 nt, Leptospira interrogans serovar lai str. 56601
auuucuaguuugaauuuag

SEQ ID NO: 746985 - RNA, 18 nt, Leptospira interrogans serovar lai str. 56601
auuucuauaaauugagua

SEQ ID NO: 746986 - RNA, 13 nt, Leptospira interrogans serovar lai str. 56601
auuucuauaaaau

SEQ ID NO: 746987 - RNA, 13 nt, Leptospira interrogans serovar lai str. 56601
auuucuauccauu

SEQ ID NO: 746988 - RNA, 15 nt, Leptospira interrogans serovar lai str. 56601
auuucuauccauucu

SEQ ID NO: 746989 - RNA, 19 nt, Leptospira interrogans serovar lai str. 56601
auuucuauauucaaaaaau

SEQ ID NO: 746990 - RNA, 15 nt, Leptospira interrogans serovar lai str. 56601
auuucugagaguaaa

SEQ ID NO: 746991 - RNA, 13 nt, Leptospira interrogans serovar lai str. 56601
auuucugcugcuu

SEQ ID NO: 746992 - RNA, 20 nt, Leptospira interrogans serovar lai str. 56601
auuucuuaaauucuaaaaaa

SEQ ID NO: 746993 - RNA, 11 nt, Leptospira interrogans serovar lai str. 56601
auuucuuaaaa

SEQ ID NO: 746994 - RNA, 15 nt, Leptospira interrogans serovar lai str. 56601
auuucuguagaaauu

SEQ ID NO: 746995 - RNA, 15 nt, Leptospira interrogans serovar lai str. 56601
auuucuuuaauuuca

SEQ ID NO: 746996 - RNA, 17 nt, Leptospira interrogans serovar lai str. 56601
auuucuuucaaaaauuu

SEQ ID NO: 746997 - RNA, 18 nt, Leptospira interrogans serovar lai str. 56601
auuucuuucgauuuuucg

SEQ ID NO: 746998 - RNA, 18 nt, Leptospira interrogans serovar lai str. 56601
auuucuuuucagguugaa

SEQ ID NO: 746999 - RNA, 20 nt, Leptospira interrogans serovar lai str. 56601
auuucuuuucagguugaauu

SEQ ID NO: 747000 - RNA, 14 nt, Leptospira interrogans serovar lai str. 56601
auuucuuuugauac

SEQ ID NO: 747001 - RNA, 22 nt, Leptospira interrogans serovar lai str. 56601
auuucuuuugauacaauucagc

SEQ ID NO: 747002 - RNA, 15 nt, Leptospira interrogans serovar lai str. 56601
auuuuuaaucaagug

SEQ ID NO: 747003 - RNA, 14 nt, Leptospira interrogans serovar lai str. 56601
auuuuuaaucaaau

SEQ ID NO: 747004 - RNA, 14 nt, Leptospira interrogans serovar lai str. 56601
auuuuuaacgugaa

SEQ ID NO: 747005 - RNA, 14 nt, Leptospira interrogans serovar lai str. 56601
auuuuuaauaaaau

SEQ ID NO: 747006 - RNA, 15 nt, Leptospira interrogans serovar lai str. 56601
auuuuuaauaaaaug

SEQ ID NO: 747007 - RNA, 16 nt, Leptospira interrogans serovar lai str. 56601
auuuuuaauaaaaugc

SEQ ID NO: 747008 - RNA, 17 nt, Leptospira interrogans serovar lai str. 56601
auuuuuaauaaaaugca

SEQ ID NO: 747009 - RNA, 12 nt, Leptospira interrogans serovar lai str. 56601
auuuuuacaaaa

SEQ ID NO: 747010 - RNA, 18 nt, Leptospira interrogans serovar lai str. 56601
auuuuuacaaaaaaauca

SEQ ID NO: 747011 - RNA, 15 nt, Leptospira interrogans serovar lai str. 56601
auuuuuacacauuca

SEQ ID NO: 747012 - RNA, 14 nt, Leptospira interrogans serovar lai str. 56601
auuuuuacagaaaa

SEQ ID NO: 747013 - RNA, 16 nt, Leptospira interrogans serovar lai str. 56601
auuuuuacagaaaaau

SEQ ID NO: 747014 - RNA, 18 nt, Leptospira interrogans serovar lai str. 56601
auuuuuacagaaaaauca

SEQ ID NO: 747015 - RNA, 16 nt, Leptospira interrogans serovar lai str. 56601
auuuuuagaaauuuuu

SEQ ID NO: 747016 - RNA, 13 nt, Leptospira interrogans serovar lai str. 56601
auuuuuagaauuu

SEQ ID NO: 747017 - RNA, 22 nt, Leptospira interrogans serovar lai str. 56601
auuuuuacgcguaauuuuuugg

SEQ ID NO: 747018 - RNA, 19 nt, Leptospira interrogans serovar lai str. 56601
auuuuuacucaaagaaucg

SEQ ID NO: 747019 - RNA, 20 nt, Leptospira interrogans serovar lai str. 56601
auuuuuacgacccaagauuu

SEQ ID NO: 747020 - RNA, 22 nt, Leptospira interrogans serovar lai str. 56601
auuuugcuucuaaaaaggauac

SEQ ID NO: 747021 - RNA, 21 nt, Leptospira interrogans serovar lai str. 56601
auuuuggcccuccucuaaaau

SEQ ID NO: 747022 - RNA, 17 nt, Leptospira interrogans serovar lai str. 56601
auuuuuaagaauaauuu

SEQ ID NO: 747023 - RNA, 15 nt, Leptospira interrogans serovar lai str. 56601
auuuuuaagauaaau

SEQ ID NO: 747024 - RNA, 22 nt, Leptospira interrogans serovar lai str. 56601
auuuuuaagauuacauuuuucu

SEQ ID NO: 747025 - RNA, 22 nt, Leptospira interrogans serovar lai str. 56601
auuuugggauuuuauugaagau

SEQ ID NO: 747026 - RNA, 18 nt, Leptospira interrogans serovar lai str. 56601
auuuugcaugaaaucagu

SEQ ID NO: 747027 - RNA, 20 nt, Leptospira interrogans serovar lai str. 56601
auuuugcucacucauuuuua

SEQ ID NO: 747028 - RNA, 20 nt, Leptospira interrogans serovar lai str. 56601
auuuucuuugaaaaaauuuu

SEQ ID NO: 747029 - RNA, 15 nt, Leptospira interrogans serovar lai str. 56601
auuuugaagguugag

SEQ ID NO: 747030 - RNA, 16 nt, Leptospira interrogans serovar lai str. 56601
auuuugcacguaaaca

SEQ ID NO: 747031 - RNA, 16 nt, Leptospira interrogans serovar lai str. 56601
auuuugcacugaaaua

SEQ ID NO: 747032 - RNA, 18 nt, Leptospira interrogans serovar lai str. 56601
auuuugcacugaaauaga

SEQ ID NO: 747033 - RNA, 22 nt, Leptospira interrogans serovar lai str. 56601
auuuugcacugaaauagaauuu

SEQ ID NO: 747034 - RNA, 19 nt, Leptospira interrogans serovar lai str. 56601
auuuugaacaaguucuaaa

SEQ ID NO: 747035 - RNA, 20 nt, Leptospira interrogans serovar lai str. 56601
auuuugaacaaguucuaaau

SEQ ID NO: 747036 - RNA, 15 nt, Leptospira interrogans serovar lai str. 56601
auuuucucauucuac

SEQ ID NO: 747037 - RNA, 18 nt, Leptospira interrogans serovar lai str. 56601
auuuucuauuuaacguga

SEQ ID NO: 747038 - RNA, 15 nt, Leptospira interrogans serovar lai str. 56601
auuuucuauuuuaau

SEQ ID NO: 747039 - RNA, 18 nt, Leptospira interrogans serovar lai str. 56601
auuuucuauuuuaauaua

SEQ ID NO: 747040 - RNA, 16 nt, Leptospira interrogans serovar lai str. 56601
auuuucucaaaaaaag

SEQ ID NO: 747041 - RNA, 22 nt, Leptospira interrogans serovar lai str. 56601
auuuucuaggauuuuauauaua

SEQ ID NO: 747042 - RNA, 23 nt, Leptospira interrogans serovar lai str. 56601
auuuuauuuuuuaugaaaaacuc

SEQ ID NO: 747043 - RNA, 17 nt, Leptospira interrogans serovar lai str. 56601
auuuucaaaaaauauca

SEQ ID NO: 747044 - RNA, 17 nt, Leptospira interrogans serovar lai str. 56601
auuuuauuuauauauau

SEQ ID NO: 747045 - RNA, 12 nt, Leptospira interrogans serovar lai str. 56601
auuuuauuuuua

SEQ ID NO: 747046 - RNA, 15 nt, Leptospira interrogans serovar lai str. 56601
auuuuauuuuuacaa

SEQ ID NO: 747047 - RNA, 17 nt, Leptospira interrogans serovar lai str. 56601
auuuucuaaugcauuua

SEQ ID NO: 747048 - RNA, 15 nt, Leptospira interrogans serovar lai str. 56601
auuuucuaagaaucu

SEQ ID NO: 747049 - RNA, 20 nt, Leptospira interrogans serovar lai str. 56601
auuuucuaauauaacucacu

SEQ ID NO: 747050 - RNA, 12 nt, Leptospira interrogans serovar lai str. 56601
auuuucuaaaag

SEQ ID NO: 747051 - RNA, 14 nt, Leptospira interrogans serovar lai str. 56601
auuuucuaaaagua

SEQ ID NO: 747052 - RNA, 16 nt, Leptospira interrogans serovar lai str. 56601
auuuucuaaaaguaaa

SEQ ID NO: 747053 - RNA, 20 nt, Leptospira interrogans serovar lai str. 56601
auuuuccgaaccuuaccacc

SEQ ID NO: 747054 - RNA, 22 nt, Leptospira interrogans serovar lai str. 56601
auuuucccaaacaggaaaauuu

SEQ ID NO: 747055 - RNA, 22 nt, Leptospira interrogans serovar lai str. 56601
auuuucccgaaagaacuccacc

SEQ ID NO: 747056 - RNA, 14 nt, Leptospira interrogans serovar lai str. 56601
auuuuccagaucau

SEQ ID NO: 747057 - RNA, 17 nt, Leptospira interrogans serovar lai str. 56601
auuuuccagaucauuuu

SEQ ID NO: 747058 - RNA, 19 nt, Leptospira interrogans serovar lai str. 56601
auuuuaguuuauuuuaaaa

SEQ ID NO: 747059 - RNA, 20 nt, Leptospira interrogans serovar lai str. 56601
auuuuaguuuauuuuaaaaa

SEQ ID NO: 747060 - RNA, 12 nt, Leptospira interrogans serovar lai str. 56601
auuuuauaaaaa

SEQ ID NO: 747061 - RNA, 12 nt, Leptospira interrogans serovar lai str. 56601
auuuuauaaaau

SEQ ID NO: 747062 - RNA, 15 nt, Leptospira interrogans serovar lai str. 56601
auuuuauaaauuauu

SEQ ID NO: 747063 - RNA, 22 nt, Leptospira interrogans serovar lai str. 56601
auuuuauaaucgaauuuccauu

SEQ ID NO: 747064 - RNA, 23 nt, Leptospira interrogans serovar lai str. 56601
auuuuauaaucgaauuuccauuu

SEQ ID NO: 747065 - RNA, 10 nt, Leptospira interrogans serovar lai str. 56601
auuuuauaau

SEQ ID NO: 747066 - RNA, 22 nt, Leptospira interrogans serovar lai str. 56601
auuuuauagaaauacuuaaaau

SEQ ID NO: 747067 - RNA, 22 nt, Leptospira interrogans serovar lai str. 56601
auuuuacgaacaaauucuaaaa

SEQ ID NO: 747068 - RNA, 22 nt, Leptospira interrogans serovar lai str. 56601
auuuuacgaaccaauucuaaaa

SEQ ID NO: 747069 - RNA, 23 nt, Leptospira interrogans serovar lai str. 56601
auuuuacgaaucuaauuuauaaa

SEQ ID NO: 747070 - RNA, 21 nt, Leptospira interrogans serovar lai str. 56601
auuuuaggaaucgaucuguaa

SEQ ID NO: 747071 - RNA, 23 nt, Leptospira interrogans serovar lai str. 56601
auuuuaguaaacuacuaaaucuc

SEQ ID NO: 747072 - RNA, 14 nt, Leptospira interrogans serovar lai str. 56601
auuuuaggauuuuu

SEQ ID NO: 747073 - RNA, 21 nt, Leptospira interrogans serovar lai str. 56601
auuuuagggccgucuauaaaa

SEQ ID NO: 747074 - RNA, 18 nt, Leptospira interrogans serovar lai str. 56601
auuuuaccguuuuuaaau

SEQ ID NO: 747075 - RNA, 23 nt, Leptospira interrogans serovar lai str. 56601
auuuuaccgauaagucuagaaau

SEQ ID NO: 747076 - RNA, 20 nt, Leptospira interrogans serovar lai str. 56601
auuuuaccagaucaauucuu

SEQ ID NO: 747077 - RNA, 22 nt, Leptospira interrogans serovar lai str. 56601
auuuuaccagaucaauucuuaa

SEQ ID NO: 747078 - RNA, 12 nt, Leptospira interrogans serovar lai str. 56601
auuuuacaaaca

SEQ ID NO: 747079 - RNA, 18 nt, Leptospira interrogans serovar lai str. 56601
auuuuacacguaauucuu

SEQ ID NO: 747080 - RNA, 22 nt, Leptospira interrogans serovar lai str. 56601
auuuuacagacguauuuuuaaa

SEQ ID NO: 747081 - RNA, 14 nt, Leptospira interrogans serovar lai str. 56601
auuuuacagauuga

SEQ ID NO: 747082 - RNA, 22 nt, Leptospira interrogans serovar lai str. 56601
auuucgaguuuguucuaaaaac

SEQ ID NO: 747083 - RNA, 20 nt, Leptospira interrogans serovar lai str. 56601
auuucgaaaacgauuuuuca

SEQ ID NO: 747084 - RNA, 22 nt, Leptospira interrogans serovar lai str. 56601
auuucgacaacuuauaauuuuc

SEQ ID NO: 747085 - RNA, 20 nt, Leptospira interrogans serovar lai str. 56601
auuuccuaaaauugugggaa

SEQ ID NO: 747086 - RNA, 12 nt, Leptospira interrogans serovar lai str. 56601
auuuccuggauu

SEQ ID NO: 747087 - RNA, 16 nt, Leptospira interrogans serovar lai str. 56601
auuucccaaaauuuca

SEQ ID NO: 747088 - RNA, 12 nt, Leptospira interrogans serovar lai str. 56601
auuuccauuucu

SEQ ID NO: 747089 - RNA, 23 nt, Leptospira interrogans serovar lai str. 56601
auuuccacuacaaucacuuuaua

SEQ ID NO: 747090 - RNA, 19 nt, Leptospira interrogans serovar lai str. 56601
auuuccaccggaguaaggc

SEQ ID NO: 747091 - RNA, 20 nt, Leptospira interrogans serovar lai str. 56601
auuuccgauaaagaaaguaa

SEQ ID NO: 747092 - RNA, 22 nt, Leptospira interrogans serovar lai str. 56601
auuuccgauaaagaaaguaauu

SEQ ID NO: 747093 - RNA, 23 nt, Leptospira interrogans serovar lai str. 56601
auuuccgauaaagaaaguaauuu

SEQ ID NO: 747094 - RNA, 22 nt, Leptospira interrogans serovar lai str. 56601
auuucccuaguuccaauuaaca

SEQ ID NO: 747095 - RNA, 21 nt, Leptospira interrogans serovar lai str. 56601
auuuccgcuguuauccgauuu

SEQ ID NO: 747096 - RNA, 19 nt, Leptospira interrogans serovar lai str. 56601
auuuccgguaaguaauaua

SEQ ID NO: 747097 - RNA, 16 nt, Leptospira interrogans serovar lai str. 56601
auuuccggaaaacgaa

SEQ ID NO: 747098 - RNA, 23 nt, Leptospira interrogans serovar lai str. 56601
auuuccggaaaacgaauaucaua

SEQ ID NO: 747099 - RNA, 21 nt, Leptospira interrogans serovar lai str. 56601
auuucaauuccuguaguauuu

SEQ ID NO: 747100 - RNA, 15 nt, Leptospira interrogans serovar lai str. 56601
auuucaauuuucuca

SEQ ID NO: 747101 - RNA, 18 nt, Leptospira interrogans serovar lai str. 56601
auuuauguacuuuuaaga

SEQ ID NO: 747102 - RNA, 14 nt, Leptospira interrogans serovar lai str. 56601
auuuaugcuuuaau

SEQ ID NO: 747103 - RNA, 22 nt, Leptospira interrogans serovar lai str. 56601
auuuaugaucuacuauuauaau

SEQ ID NO: 747104 - RNA, 22 nt, Leptospira interrogans serovar lai str. 56601
auuuaugacagcuugaagauua

SEQ ID NO: 747105 - RNA, 20 nt, Leptospira interrogans serovar lai str. 56601
auuuaucuguaaaauuugga

SEQ ID NO: 747106 - RNA, 22 nt, Leptospira interrogans serovar lai str. 56601
auuucauagaccucaaauugua

SEQ ID NO: 747107 - RNA, 15 nt, Leptospira interrogans serovar lai str. 56601
auuucagucaauaaa

SEQ ID NO: 747108 - RNA, 17 nt, Leptospira interrogans serovar lai str. 56601
auuuccaacgaaguucc

SEQ ID NO: 747109 - RNA, 14 nt, Leptospira interrogans serovar lai str. 56601
auuuccaaacuaca

SEQ ID NO: 747110 - RNA, 15 nt, Leptospira interrogans serovar lai str. 56601
auuuccaaacuacaa

SEQ ID NO: 747111 - RNA, 23 nt, Leptospira interrogans serovar lai str. 56601
auuuccaaacucaaugcugcucu

SEQ ID NO: 747112 - RNA, 18 nt, Leptospira interrogans serovar lai str. 56601
auuuccaaauuguaugaa

SEQ ID NO: 747113 - RNA, 15 nt, Leptospira interrogans serovar lai str. 56601
auuucauauccaaaa

SEQ ID NO: 747114 - RNA, 16 nt, Leptospira interrogans serovar lai str. 56601
auuucauaucuaaaau

SEQ ID NO: 747115 - RNA, 18 nt, Leptospira interrogans serovar lai str. 56601
auuucauaguucaauuaa

SEQ ID NO: 747116 - RNA, 18 nt, Leptospira interrogans serovar lai str. 56601
auuuaaaaauaguauuuu

SEQ ID NO: 747117 - RNA, 22 nt, Leptospira interrogans serovar lai str. 56601
auuuaaaacuugucccaaaauu

SEQ ID NO: 747118 - RNA, 14 nt, Leptospira interrogans serovar lai str. 56601
auugguuauaccaa

SEQ ID NO: 747119 - RNA, 17 nt, Leptospira interrogans serovar lai str. 56601
auuguuuucuaaaggaa

SEQ ID NO: 747120 - RNA, 23 nt, Leptospira interrogans serovar lai str. 56601
auuguuuucuaaaggaaaacgau

SEQ ID NO: 747121 - RNA, 15 nt, Leptospira interrogans serovar lai str. 56601
auuguuuucuaguuu

SEQ ID NO: 747122 - RNA, 19 nt, Leptospira interrogans serovar lai str. 56601
auuguuuucuaguuuuccu

SEQ ID NO: 747123 - RNA, 15 nt, Leptospira interrogans serovar lai str. 56601
auuuaaaaaagaaga

SEQ ID NO: 747124 - RNA, 14 nt, Leptospira interrogans serovar lai str. 56601
auuuaaaaaauuca

SEQ ID NO: 747125 - RNA, 22 nt, Leptospira interrogans serovar lai str. 56601
auuguuuugcucaauagauuuu

SEQ ID NO: 747126 - RNA, 21 nt, Leptospira interrogans serovar lai str. 56601
auugguguuguguuaguuccc

SEQ ID NO: 747127 - RNA, 22 nt, Leptospira interrogans serovar lai str. 56601
auuuaacucguuagagaaaagc

SEQ ID NO: 747128 - RNA, 22 nt, Leptospira interrogans serovar lai str. 56601
auuuaacuguaauuagaggaua

SEQ ID NO: 747129 - RNA, 13 nt, Leptospira interrogans serovar lai str. 56601
auuuaagaucuuu

SEQ ID NO: 747130 - RNA, 20 nt, Leptospira interrogans serovar lai str. 56601
auuuaagaucuuuauaaauc

SEQ ID NO: 747131 - RNA, 13 nt, Leptospira interrogans serovar lai str. 56601
auuguuuuuaaau

SEQ ID NO: 747132 - RNA, 19 nt, Leptospira interrogans serovar lai str. 56601
auuuaaaauacucaauccg

SEQ ID NO: 747133 - RNA, 13 nt, Leptospira interrogans serovar lai str. 56601
auuuaauuuuuua

SEQ ID NO: 747134 - RNA, 13 nt, Leptospira interrogans serovar lai str. 56601
auuuaauuuuucu

SEQ ID NO: 747135 - RNA, 21 nt, Leptospira interrogans serovar lai str. 56601
auuuaauuggacgagcuuuau

SEQ ID NO: 747136 - RNA, 21 nt, Leptospira interrogans serovar lai str. 56601
auuuaauaaaauuuuuaaaaa

SEQ ID NO: 747137 - RNA, 17 nt, Leptospira interrogans serovar lai str. 56601
auuuaaguuguguugaa

SEQ ID NO: 747138 - RNA, 12 nt, Leptospira interrogans serovar lai str. 56601
auuuaaguuuuu

SEQ ID NO: 747139 - RNA, 19 nt, Leptospira interrogans serovar lai str. 56601
auuuaauaaaaaaaugaau

SEQ ID NO: 747140 - RNA, 12 nt, Leptospira interrogans serovar lai str. 56601
auuuacauauau

SEQ ID NO: 747141 - RNA, 19 nt, Leptospira interrogans serovar lai str. 56601
auuuacaguuaaacuuuga

SEQ ID NO: 747142 - RNA, 21 nt, Leptospira interrogans serovar lai str. 56601
auuuacacgauaauuuucuuu

SEQ ID NO: 747143 - RNA, 22 nt, Leptospira interrogans serovar lai str. 56601
auuuacacgauaauuuucuuua

SEQ ID NO: 747144 - RNA, 14 nt, Leptospira interrogans serovar lai str. 56601
auuuaccuaaaauu

SEQ ID NO: 747145 - RNA, 14 nt, Leptospira interrogans serovar lai str. 56601
auuuaccuccuccu

SEQ ID NO: 747146 - RNA, 18 nt, Leptospira interrogans serovar lai str. 56601
auuuacgaaaauuuuuua

SEQ ID NO: 747147 - RNA, 21 nt, Leptospira interrogans serovar lai str. 56601
auuuaccuugaaacuuuuaau

SEQ ID NO: 747148 - RNA, 23 nt, Leptospira interrogans serovar lai str. 56601
auuuaccuugaaacuuuuaauaa

SEQ ID NO: 747149 - RNA, 16 nt, Leptospira interrogans serovar lai str. 56601
auuuacggaacuuaau

SEQ ID NO: 747150 - RNA, 17 nt, Leptospira interrogans serovar lai str. 56601
auuuacggaacuuaauu

SEQ ID NO: 747151 - RNA, 20 nt, Leptospira interrogans serovar lai str. 56601
auuuacggcauuuuuuaaau

SEQ ID NO: 747152 - RNA, 22 nt, Leptospira interrogans serovar lai str. 56601
auuuacuacaucuaaugauuuc

SEQ ID NO: 747153 - RNA, 18 nt, Leptospira interrogans serovar lai str. 56601
auuuacuauuuugaugaa

SEQ ID NO: 747154 - RNA, 17 nt, Leptospira interrogans serovar lai str. 56601
auuuacucaaauuaacu

SEQ ID NO: 747155 - RNA, 18 nt, Leptospira interrogans serovar lai str. 56601
auuuacucuuauaaaauu

SEQ ID NO: 747156 - RNA, 19 nt, Leptospira interrogans serovar lai str. 56601
auuuacucuuauaaaauuu

SEQ ID NO: 747157 - RNA, 21 nt, Leptospira interrogans serovar lai str. 56601
auuuacucuuauaaaauuuua

SEQ ID NO: 747158 - RNA, 15 nt, Leptospira interrogans serovar lai str. 56601
auuuaguaaaauuua

SEQ ID NO: 747159 - RNA, 23 nt, Leptospira interrogans serovar lai str. 56601
auuuauauguuucuuuuguaaaa

SEQ ID NO: 747160 - RNA, 13 nt, Leptospira interrogans serovar lai str. 56601
auuuauaguuuuu

SEQ ID NO: 747161 - RNA, 16 nt, Leptospira interrogans serovar lai str. 56601
auuuauaguuuuuaac

SEQ ID NO: 747162 - RNA, 14 nt, Leptospira interrogans serovar lai str. 56601
auuuauauauauuc

SEQ ID NO: 747163 - RNA, 16 nt, Leptospira interrogans serovar lai str. 56601
auuuauauuuuuugaa

SEQ ID NO: 747164 - RNA, 23 nt, Leptospira interrogans serovar lai str. 56601
auuuauauucgcuccguuuugaa

SEQ ID NO: 747165 - RNA, 20 nt, Leptospira interrogans serovar lai str. 56601
auuuauauugagaucaaaua

SEQ ID NO: 747166 - RNA, 15 nt, Leptospira interrogans serovar lai str. 56601
auuuaucauuucuuu

SEQ ID NO: 747167 - RNA, 20 nt, Leptospira interrogans serovar lai str. 56601
auuuagcuaagucuuuaaaa

SEQ ID NO: 747168 - RNA, 21 nt, Leptospira interrogans serovar lai str. 56601
auuuagcuaagucuuuaaaaa

SEQ ID NO: 747169 - RNA, 17 nt, Leptospira interrogans serovar lai str. 56601
auuuagcaauuugugaa

SEQ ID NO: 747170 - RNA, 16 nt, Leptospira interrogans serovar lai str. 56601
auuuagcauuuuuaag

SEQ ID NO: 747171 - RNA, 17 nt, Leptospira interrogans serovar lai str. 56601
auuuagcauuuuuaaga

SEQ ID NO: 747172 - RNA, 16 nt, Leptospira interrogans serovar lai str. 56601
auuuagauucuaaaaa

SEQ ID NO: 747173 - RNA, 17 nt, Leptospira interrogans serovar lai str. 56601
auuuagauucuaaaaaa

SEQ ID NO: 747174 - RNA, 13 nt, Leptospira interrogans serovar lai str. 56601
auuuacuuuuucc

SEQ ID NO: 747175 - RNA, 14 nt, Leptospira interrogans serovar lai str. 56601
auuuagaaaauuag

SEQ ID NO: 747176 - RNA, 14 nt, Leptospira interrogans serovar lai str. 56601
auuuacuucauucg

SEQ ID NO: 747177 - RNA, 16 nt, Leptospira interrogans serovar lai str. 56601
auuuacuuuaaaauuu

SEQ ID NO: 747178 - RNA, 16 nt, Leptospira interrogans serovar lai str. 56601
caaaggaaauaaaaau

SEQ ID NO: 747179 - RNA, 22 nt, Leptospira interrogans serovar lai str. 56601
caaaggagaaggauaaagucua

SEQ ID NO: 747180 - RNA, 10 nt, Leptospira interrogans serovar lai str. 56601
caaauaacau

SEQ ID NO: 747181 - RNA, 12 nt, Leptospira interrogans serovar lai str. 56601
caaauaaaguuu

SEQ ID NO: 747182 - RNA, 18 nt, Leptospira interrogans serovar lai str. 56601
caaauaaaguuuuauacc

SEQ ID NO: 747183 - RNA, 17 nt, Leptospira interrogans serovar lai str. 56601
caaauacuuagaauuuu

SEQ ID NO: 747184 - RNA, 17 nt, Leptospira interrogans serovar lai str. 56601
caaauagaaauaacuua

SEQ ID NO: 747185 - RNA, 13 nt, Leptospira interrogans serovar lai str. 56601
caaauagaaauag

SEQ ID NO: 747186 - RNA, 19 nt, Leptospira interrogans serovar lai str. 56601
caaauagaguaccauaaau

SEQ ID NO: 747187 - RNA, 13 nt, Leptospira interrogans serovar lai str. 56601
caaauaucaugau

SEQ ID NO: 747188 - RNA, 14 nt, Leptospira interrogans serovar lai str. 56601
caaauauuucgaca

SEQ ID NO: 747189 - RNA, 22 nt, Leptospira interrogans serovar lai str. 56601
caaaucaucuaucuuuucaaaa

SEQ ID NO: 747190 - RNA, 14 nt, Leptospira interrogans serovar lai str. 56601
caaauccccaaaag

SEQ ID NO: 747191 - RNA, 20 nt, Leptospira interrogans serovar lai str. 56601
caaacuuagguuuuguaaua

SEQ ID NO: 747192 - RNA, 20 nt, Leptospira interrogans serovar lai str. 56601
caaagacucggaaauucuca

SEQ ID NO: 747193 - RNA, 14 nt, Leptospira interrogans serovar lai str. 56601
caaagaguuguuua

SEQ ID NO: 747194 - RNA, 19 nt, Leptospira interrogans serovar lai str. 56601
caaagauaaaaaagaaagc

SEQ ID NO: 747195 - RNA, 13 nt, Leptospira interrogans serovar lai str. 56601
caaagauaaaaua

SEQ ID NO: 747196 - RNA, 14 nt, Leptospira interrogans serovar lai str. 56601
caaagauaaaauau

SEQ ID NO: 747197 - RNA, 15 nt, Leptospira interrogans serovar lai str. 56601
caaagauaaaauaua

SEQ ID NO: 747198 - RNA, 13 nt, Leptospira interrogans serovar lai str. 56601
caacaaacaaaua

SEQ ID NO: 747199 - RNA, 14 nt, Leptospira interrogans serovar lai str. 56601
caacaaacaaauag

SEQ ID NO: 747200 - RNA, 18 nt, Leptospira interrogans serovar lai str. 56601
caaauuuuugcauaaaau

SEQ ID NO: 747201 - RNA, 20 nt, Leptospira interrogans serovar lai str. 56601
caaauuuuuucguuucugag

SEQ ID NO: 747202 - RNA, 19 nt, Leptospira interrogans serovar lai str. 56601
caacaaaaaauauacuuuu

SEQ ID NO: 747203 - RNA, 17 nt, Leptospira interrogans serovar lai str. 56601
caaauucgucaaaacca

SEQ ID NO: 747204 - RNA, 18 nt, Leptospira interrogans serovar lai str. 56601
caaauuccaauuuuucug

SEQ ID NO: 747205 - RNA, 13 nt, Leptospira interrogans serovar lai str. 56601
caaauucaugaua

SEQ ID NO: 747206 - RNA, 18 nt, Leptospira interrogans serovar lai str. 56601
caaauggagaauuaauuu

SEQ ID NO: 747207 - RNA, 16 nt, Leptospira interrogans serovar lai str. 56601
caaauguuauuuuugc

SEQ ID NO: 747208 - RNA, 18 nt, Leptospira interrogans serovar lai str. 56601
caaaucuuucacuuuaaa

SEQ ID NO: 747209 - RNA, 22 nt, Leptospira interrogans serovar lai str. 56601
caaaucuuucacuuuaaaacau

SEQ ID NO: 747210 - RNA, 22 nt, Leptospira interrogans serovar lai str. 56601
caaaucugaaauucaucaaauu

SEQ ID NO: 747211 - RNA, 20 nt, Leptospira interrogans serovar lai str. 56601
caacaaguuuacacauuuau

SEQ ID NO: 747212 - RNA, 21 nt, Leptospira interrogans serovar lai str. 56601
caacaaguuuacacauuuauu

SEQ ID NO: 747213 - RNA, 13 nt, Leptospira interrogans serovar lai str. 56601
caacaaauugaaa

SEQ ID NO: 747214 - RNA, 23 nt, Leptospira interrogans serovar lai str. 56601
caacaacucuaauacaaaaaaug

SEQ ID NO: 747215 - RNA, 21 nt, Leptospira interrogans serovar lai str. 56601
caacaacucuaauauaaaaac

SEQ ID NO: 747216 - RNA, 17 nt, Leptospira interrogans serovar lai str. 56601
caaacgcuuucguaaaa

SEQ ID NO: 747217 - RNA, 20 nt, Leptospira interrogans serovar lai str. 56601
caaacgaaguuuauuucuaa

SEQ ID NO: 747218 - RNA, 13 nt, Leptospira interrogans serovar lai str. 56601
caaaccucuuuau

SEQ ID NO: 747219 - RNA, 16 nt, Leptospira interrogans serovar lai str. 56601
caaaccucguacuaau

SEQ ID NO: 747220 - RNA, 23 nt, Leptospira interrogans serovar lai str. 56601
caaaccucguacuaauucuuuug

SEQ ID NO: 747221 - RNA, 15 nt, Leptospira interrogans serovar lai str. 56601
caaacucuuuuucuu

SEQ ID NO: 747222 - RNA, 19 nt, Leptospira interrogans serovar lai str. 56601
caaacucuuuuucuucugc

SEQ ID NO: 747223 - RNA, 21 nt, Leptospira interrogans serovar lai str. 56601
caaacucuuuuucuucugcug

SEQ ID NO: 747224 - RNA, 22 nt, Leptospira interrogans serovar lai str. 56601
caaacucuuuuucuucugcugc

SEQ ID NO: 747225 - RNA, 23 nt, Leptospira interrogans serovar lai str. 56601
caaacucuuuuucuucugcugca

SEQ ID NO: 747226 - RNA, 20 nt, Leptospira interrogans serovar lai str. 56601
caaacucacgcuaaaauaaa

SEQ ID NO: 747227 - RNA, 23 nt, Leptospira interrogans serovar lai str. 56601
caaacuauucuauuaguuuuuau

SEQ ID NO: 747228 - RNA, 15 nt, Leptospira interrogans serovar lai str. 56601
caaacucaaugcugc

SEQ ID NO: 747229 - RNA, 17 nt, Leptospira interrogans serovar lai str. 56601
caaacucaaugcugcuc

SEQ ID NO: 747230 - RNA, 19 nt, Leptospira interrogans serovar lai str. 56601
caaacuauacuuguuucua

SEQ ID NO: 747231 - RNA, 14 nt, Leptospira interrogans serovar lai str. 56601
caaacuaaauuuuu

SEQ ID NO: 747232 - RNA, 19 nt, Leptospira interrogans serovar lai str. 56601
caaacgguuuuaguaaaau

SEQ ID NO: 747233 - RNA, 18 nt, Leptospira interrogans serovar lai str. 56601
caaacagccaaagaaaua

SEQ ID NO: 747234 - RNA, 14 nt, Leptospira interrogans serovar lai str. 56601
caaacaggaaaauu

SEQ ID NO: 747235 - RNA, 16 nt, Leptospira interrogans serovar lai str. 56601
caaacaggaaaauuua

SEQ ID NO: 747236 - RNA, 18 nt, Leptospira interrogans serovar lai str. 56601
caaacaggaaaauuuaaa

SEQ ID NO: 747237 - RNA, 19 nt, Leptospira interrogans serovar lai str. 56601
caaacaggaaaauuuaaau

SEQ ID NO: 747238 - RNA, 18 nt, Leptospira interrogans serovar lai str. 56601
caaacacuaaguaaaaau

SEQ ID NO: 747239 - RNA, 19 nt, Leptospira interrogans serovar lai str. 56601
caaacacuaaguaaaaaug

SEQ ID NO: 747240 - RNA, 21 nt, Leptospira interrogans serovar lai str. 56601
caaacacuaaguaaaaaugca

SEQ ID NO: 747241 - RNA, 17 nt, Leptospira interrogans serovar lai str. 56601
caaacacuaauaaaaau

SEQ ID NO: 747242 - RNA, 16 nt, Leptospira interrogans serovar lai str. 56601
caaacacaugagcauu

SEQ ID NO: 747243 - RNA, 22 nt, Leptospira interrogans serovar lai str. 56601
caaaccaaauagaaauagaaac

SEQ ID NO: 747244 - RNA, 21 nt, Leptospira interrogans serovar lai str. 56601
caaacauucaaauuucugaaa

SEQ ID NO: 747245 - RNA, 16 nt, Leptospira interrogans serovar lai str. 56601
caaaauguuuuuauau

SEQ ID NO: 747246 - RNA, 20 nt, Leptospira interrogans serovar lai str. 56601
caaaaugaauuguaaaaaac

SEQ ID NO: 747247 - RNA, 20 nt, Leptospira interrogans serovar lai str. 56601
caaaaugaacaaugaauuuu

SEQ ID NO: 747248 - RNA, 22 nt, Leptospira interrogans serovar lai str. 56601
caaaaugaacaaugaauuuuua

SEQ ID NO: 747249 - RNA, 22 nt, Leptospira interrogans serovar lai str. 56601
caaaaucugaauuuuaccaaau

SEQ ID NO: 747250 - RNA, 18 nt, Leptospira interrogans serovar lai str. 56601
caaaaucguuuuaaaaac

SEQ ID NO: 747251 - RNA, 18 nt, Leptospira interrogans serovar lai str. 56601
caaaaucuuaauaaaauu

SEQ ID NO: 747252 - RNA, 19 nt, Leptospira interrogans serovar lai str. 56601
caaaaucuuaaaagaaaau

SEQ ID NO: 747253 - RNA, 13 nt, Leptospira interrogans serovar lai str. 56601
caaaauuuuauaa

SEQ ID NO: 747254 - RNA, 22 nt, Leptospira interrogans serovar lai str. 56601
caaaauuugcuuccauugucua

SEQ ID NO: 747255 - RNA, 16 nt, Leptospira interrogans serovar lai str. 56601
caaaauuuuuuccuuu

SEQ ID NO: 747256 - RNA, 15 nt, Leptospira interrogans serovar lai str. 56601
caaacaaauagaaau

SEQ ID NO: 747257 - RNA, 16 nt, Leptospira interrogans serovar lai str. 56601
caaaauuuaaauccua

SEQ ID NO: 747258 - RNA, 15 nt, Leptospira interrogans serovar lai str. 56601
caaaauuuaaaaagu

SEQ ID NO: 747259 - RNA, 15 nt, Leptospira interrogans serovar lai str. 56601
caaaauuuaaaaaug

SEQ ID NO: 747260 - RNA, 16 nt, Leptospira interrogans serovar lai str. 56601
caaaauuuagaauugu

SEQ ID NO: 747261 - RNA, 14 nt, Leptospira interrogans serovar lai str. 56601
caaaauuuccaacg

SEQ ID NO: 747262 - RNA, 18 nt, Leptospira interrogans serovar lai str. 56601
caaaauugagaauagaag

SEQ ID NO: 747263 - RNA, 17 nt, Leptospira interrogans serovar lai str. 56601
caaaauucuuaaaaaau

SEQ ID NO: 747264 - RNA, 23 nt, Leptospira interrogans serovar lai str. 56601
caaaauuacuucaauuguccauu

SEQ ID NO: 747265 - RNA, 14 nt, Leptospira interrogans serovar lai str. 56601
caaaauuaagaauc

SEQ ID NO: 747266 - RNA, 18 nt, Leptospira interrogans serovar lai str. 56601
caaaauuaagaaucaaua

SEQ ID NO: 747267 - RNA, 15 nt, Leptospira interrogans serovar lai str. 56601
caaaauucaaauguc

SEQ ID NO: 747268 - RNA, 23 nt, Leptospira interrogans serovar lai str. 56601
caaaauucaaaugucuuuuuaga

SEQ ID NO: 747269 - RNA, 23 nt, Leptospira interrogans serovar lai str. 56601
caaaauagauggagaauuaauuu

SEQ ID NO: 747270 - RNA, 18 nt, Leptospira interrogans serovar lai str. 56601
caaaauacgaucuaauuu

SEQ ID NO: 747271 - RNA, 13 nt, Leptospira interrogans serovar lai str. 56601
caaaauacuuuau

SEQ ID NO: 747272 - RNA, 20 nt, Leptospira interrogans serovar lai str. 56601
caaaauacuuuaucuuuacu

SEQ ID NO: 747273 - RNA, 20 nt, Leptospira interrogans serovar lai str. 56601
caaaaucaaagagcaacucu

SEQ ID NO: 747274 - RNA, 14 nt, Leptospira interrogans serovar lai str. 56601
caaaauauucagaa

SEQ ID NO: 747275 - RNA, 23 nt, Leptospira interrogans serovar lai str. 56601
caaaauaucuggaacuuuaauua

SEQ ID NO: 747276 - RNA, 22 nt, Leptospira interrogans serovar lai str. 56601
caaaauauucguguucuauuau

SEQ ID NO: 747277 - RNA, 13 nt, Leptospira interrogans serovar lai str. 56601
auuuuucaaauuu

SEQ ID NO: 747278 - RNA, 19 nt, Leptospira interrogans serovar lai str. 56601
auuuuucaacaacucuaau

SEQ ID NO: 747279 - RNA, 23 nt, Leptospira interrogans serovar lai str. 56601
auuuuucaacaacucuauuuuau

SEQ ID NO: 747280 - RNA, 12 nt, Leptospira interrogans serovar lai str. 56601
auuuuuauuugc

SEQ ID NO: 747281 - RNA, 23 nt, Leptospira interrogans serovar lai str. 56601
auuuuucaaauaaagaaaaggaa

SEQ ID NO: 747282 - RNA, 15 nt, Leptospira interrogans serovar lai str. 56601
auuuuuaucgcaaaa

SEQ ID NO: 747283 - RNA, 23 nt, Leptospira interrogans serovar lai str. 56601
auuuuuauggaucaaaaccauuu

SEQ ID NO: 747284 - RNA, 14 nt, Leptospira interrogans serovar lai str. 56601
auuuuuaucauaaa

SEQ ID NO: 747285 - RNA, 13 nt, Leptospira interrogans serovar lai str. 56601
auuuuuauaaaaa

SEQ ID NO: 747286 - RNA, 17 nt, Leptospira interrogans serovar lai str. 56601
auuuuuauaaguuuaau

SEQ ID NO: 747287 - RNA, 13 nt, Leptospira interrogans serovar lai str. 56601
auuuuuauaaaga

SEQ ID NO: 747288 - RNA, 17 nt, Leptospira interrogans serovar lai str. 56601
auuuuuauaaagauaaa

SEQ ID NO: 747289 - RNA, 15 nt, Leptospira interrogans serovar lai str. 56601
auuuuucaauaacuc

SEQ ID NO: 747290 - RNA, 18 nt, Leptospira interrogans serovar lai str. 56601
caaaaguuucaucuuuga

SEQ ID NO: 747291 - RNA, 18 nt, Leptospira interrogans serovar lai str. 56601
caaaaguuuauaaacuuc

SEQ ID NO: 747292 - RNA, 22 nt, Leptospira interrogans serovar lai str. 56601
caaaaguuuauaaacuucucaa

SEQ ID NO: 747293 - RNA, 18 nt, Leptospira interrogans serovar lai str. 56601
caaaauaaauaauacauu

SEQ ID NO: 747294 - RNA, 21 nt, Leptospira interrogans serovar lai str. 56601
caaguguuccgacaagaauga

SEQ ID NO: 747295 - RNA, 17 nt, Leptospira interrogans serovar lai str. 56601
caagugcaguaguuccu

SEQ ID NO: 747296 - RNA, 13 nt, Leptospira interrogans serovar lai str. 56601
caaguaauacuua

SEQ ID NO: 747297 - RNA, 20 nt, Leptospira interrogans serovar lai str. 56601
caaguaacgaguagaauucu

SEQ ID NO: 747298 - RNA, 22 nt, Leptospira interrogans serovar lai str. 56601
caaguaacgaguagaauucuca

SEQ ID NO: 747299 - RNA, 21 nt, Leptospira interrogans serovar lai str. 56601
caaguaaagaacgauuuuuua

SEQ ID NO: 747300 - RNA, 22 nt, Leptospira interrogans serovar lai str. 56601
caagguuucacuuuuuuaaagu

SEQ ID NO: 747301 - RNA, 16 nt, Leptospira interrogans serovar lai str. 56601
caagcucuuuaagagu

SEQ ID NO: 747302 - RNA, 20 nt, Leptospira interrogans serovar lai str. 56601
caagcuccuccaaccagagc

SEQ ID NO: 747303 - RNA, 15 nt, Leptospira interrogans serovar lai str. 56601
caagcuuccuuuuuu

SEQ ID NO: 747304 - RNA, 18 nt, Leptospira interrogans serovar lai str. 56601
caagcuuuggauuuugau

SEQ ID NO: 747305 - RNA, 20 nt, Leptospira interrogans serovar lai str. 56601
caagauuucguucggaaaaa

SEQ ID NO: 747306 - RNA, 15 nt, Leptospira interrogans serovar lai str. 56601
caagauuauuuuuga

SEQ ID NO: 747307 - RNA, 14 nt, Leptospira interrogans serovar lai str. 56601
caagauuaacaauc

SEQ ID NO: 747308 - RNA, 21 nt, Leptospira interrogans serovar lai str. 56601
caagauuaacaaucaauugaa

SEQ ID NO: 747309 - RNA, 22 nt, Leptospira interrogans serovar lai str. 56601
caaucaauaaauugcacaaaag

SEQ ID NO: 747310 - RNA, 18 nt, Leptospira interrogans serovar lai str. 56601
caaucaauaccgauuucu

SEQ ID NO: 747311 - RNA, 12 nt, Leptospira interrogans serovar lai str. 56601
caauagaauugu

SEQ ID NO: 747312 - RNA, 21 nt, Leptospira interrogans serovar lai str. 56601
caauagaauuguguuaguucc

SEQ ID NO: 747313 - RNA, 22 nt, Leptospira interrogans serovar lai str. 56601
caauagaauuguugaaaaauua

SEQ ID NO: 747314 - RNA, 15 nt, Leptospira interrogans serovar lai str. 56601
caauagaaauaccau

SEQ ID NO: 747315 - RNA, 13 nt, Leptospira interrogans serovar lai str. 56601
caauagaaauacu

SEQ ID NO: 747316 - RNA, 22 nt, Leptospira interrogans serovar lai str. 56601
caauagagucguugaaaaauua

SEQ ID NO: 747317 - RNA, 18 nt, Leptospira interrogans serovar lai str. 56601
caaguucgauuaaaauaa

SEQ ID NO: 747318 - RNA, 20 nt, Leptospira interrogans serovar lai str. 56601
caaguucgauuaaaauaaac

SEQ ID NO: 747319 - RNA, 19 nt, Leptospira interrogans serovar lai str. 56601
caaguuccgcgauugaaaa

SEQ ID NO: 747320 - RNA, 17 nt, Leptospira interrogans serovar lai str. 56601
caaguuauuaacggcca

SEQ ID NO: 747321 - RNA, 20 nt, Leptospira interrogans serovar lai str. 56601
caaguuauuguaaaacucca

SEQ ID NO: 747322 - RNA, 20 nt, Leptospira interrogans serovar lai str. 56601
caauaauccagcugaaacua

SEQ ID NO: 747323 - RNA, 19 nt, Leptospira interrogans serovar lai str. 56601
caauacauuagaauuuuau

SEQ ID NO: 747324 - RNA, 14 nt, Leptospira interrogans serovar lai str. 56601
caauaccaaacgau

SEQ ID NO: 747325 - RNA, 11 nt, Leptospira interrogans serovar lai str. 56601
caauaagaagc

SEQ ID NO: 747326 - RNA, 20 nt, Leptospira interrogans serovar lai str. 56601
caagaaugagucuuuuuacu

SEQ ID NO: 747327 - RNA, 23 nt, Leptospira interrogans serovar lai str. 56601
caagaccuuguguuucagacuga

SEQ ID NO: 747328 - RNA, 17 nt, Leptospira interrogans serovar lai str. 56601
caagaccucaaauaacu

SEQ ID NO: 747329 - RNA, 18 nt, Leptospira interrogans serovar lai str. 56601
caagagccaaguugaauc

SEQ ID NO: 747330 - RNA, 18 nt, Leptospira interrogans serovar lai str. 56601
caagacgucuacagauaa

SEQ ID NO: 747331 - RNA, 18 nt, Leptospira interrogans serovar lai str. 56601
caagacuucuauacucuu

SEQ ID NO: 747332 - RNA, 19 nt, Leptospira interrogans serovar lai str. 56601
caagagugguuuucaaaua

SEQ ID NO: 747333 - RNA, 19 nt, Leptospira interrogans serovar lai str. 56601
caagaguguucaucuucuc

SEQ ID NO: 747334 - RNA, 17 nt, Leptospira interrogans serovar lai str. 56601
caagaggaacaauuugu

SEQ ID NO: 747335 - RNA, 18 nt, Leptospira interrogans serovar lai str. 56601
caagaggaacaauuugua

SEQ ID NO: 747336 - RNA, 10 nt, Leptospira interrogans serovar lai str. 56601
caacucuaau

SEQ ID NO: 747337 - RNA, 18 nt, Leptospira interrogans serovar lai str. 56601
caacucuaaugaauuuac

SEQ ID NO: 747338 - RNA, 14 nt, Leptospira interrogans serovar lai str. 56601
caacucuaauuuag

SEQ ID NO: 747339 - RNA, 16 nt, Leptospira interrogans serovar lai str. 56601
caacucuauuacuaaa

SEQ ID NO: 747340 - RNA, 22 nt, Leptospira interrogans serovar lai str. 56601
caacucuauucauaaaugauaa

SEQ ID NO: 747341 - RNA, 19 nt, Leptospira interrogans serovar lai str. 56601
caacucuauuuaaguacuu

SEQ ID NO: 747342 - RNA, 20 nt, Leptospira interrogans serovar lai str. 56601
caacucuauuuuauuuuucu

SEQ ID NO: 747343 - RNA, 17 nt, Leptospira interrogans serovar lai str. 56601
caacuuuuugaagaaac

SEQ ID NO: 747344 - RNA, 18 nt, Leptospira interrogans serovar lai str. 56601
caacuuuuucagaaaaau

SEQ ID NO: 747345 - RNA, 12 nt, Leptospira interrogans serovar lai str. 56601
caacuuuuccag

SEQ ID NO: 747346 - RNA, 14 nt, Leptospira interrogans serovar lai str. 56601
caacuuuuccagaa

SEQ ID NO: 747347 - RNA, 16 nt, Leptospira interrogans serovar lai str. 56601
caacuuugucguuuuc

SEQ ID NO: 747348 - RNA, 14 nt, Leptospira interrogans serovar lai str. 56601
caacuuucagauua

SEQ ID NO: 747349 - RNA, 20 nt, Leptospira interrogans serovar lai str. 56601
caacuuuagaaaaauauuau

SEQ ID NO: 747350 - RNA, 13 nt, Leptospira interrogans serovar lai str. 56601
caagaaucaaaac

SEQ ID NO: 747351 - RNA, 15 nt, Leptospira interrogans serovar lai str. 56601
caacuauaauuuccg

SEQ ID NO: 747352 - RNA, 13 nt, Leptospira interrogans serovar lai str. 56601
caacguuacuuuu

SEQ ID NO: 747353 - RNA, 17 nt, Leptospira interrogans serovar lai str. 56601
caacguucaaacaacaa

SEQ ID NO: 747354 - RNA, 21 nt, Leptospira interrogans serovar lai str. 56601
caacgguaacgagcaucuuua

SEQ ID NO: 747355 - RNA, 13 nt, Leptospira interrogans serovar lai str. 56601
caacguaaauaaa

SEQ ID NO: 747356 - RNA, 13 nt, Leptospira interrogans serovar lai str. 56601
caacguaagaaaa

SEQ ID NO: 747357 - RNA, 18 nt, Leptospira interrogans serovar lai str. 56601
caacgcgauccauagagu

SEQ ID NO: 747358 - RNA, 12 nt, Leptospira interrogans serovar lai str. 56601
caacgaaaucaa

SEQ ID NO: 747359 - RNA, 18 nt, Leptospira interrogans serovar lai str. 56601
caacgauuucuguagaaa

SEQ ID NO: 747360 - RNA, 21 nt, Leptospira interrogans serovar lai str. 56601
caacaucucaaucaaaauuuu

SEQ ID NO: 747361 - RNA, 12 nt, Leptospira interrogans serovar lai str. 56601
cacuauuuuuau

SEQ ID NO: 747362 - RNA, 13 nt, Leptospira interrogans serovar lai str. 56601
cacucauuuuuag

SEQ ID NO: 747363 - RNA, 16 nt, Leptospira interrogans serovar lai str. 56601
cacuaccuuauaaaaa

SEQ ID NO: 747364 - RNA, 18 nt, Leptospira interrogans serovar lai str. 56601
cacuacggaaggaaaaaa

SEQ ID NO: 747365 - RNA, 20 nt, Leptospira interrogans serovar lai str. 56601
cacuauggaauuuuuuaaca

SEQ ID NO: 747366 - RNA, 17 nt, Leptospira interrogans serovar lai str. 56601
cacuaugaaaguuuuuc

SEQ ID NO: 747367 - RNA, 21 nt, Leptospira interrogans serovar lai str. 56601
cacuaugaaaguuuuucaaca

SEQ ID NO: 747368 - RNA, 16 nt, Leptospira interrogans serovar lai str. 56601
cacugaaaauuuaauu

SEQ ID NO: 747369 - RNA, 20 nt, Leptospira interrogans serovar lai str. 56601
cacucuuucaauguuuuucg

SEQ ID NO: 747370 - RNA, 18 nt, Leptospira interrogans serovar lai str. 56601
cacucuaaguuuuuaaau

SEQ ID NO: 747371 - RNA, 19 nt, Leptospira interrogans serovar lai str. 56601
cacucuaaguuuuuaaaua

SEQ ID NO: 747372 - RNA, 15 nt, Leptospira interrogans serovar lai str. 56601
cacucgaacuucguu

SEQ ID NO: 747373 - RNA, 15 nt, Leptospira interrogans serovar lai str. 56601
cacuccgauacauuu

SEQ ID NO: 747374 - RNA, 13 nt, Leptospira interrogans serovar lai str. 56601
cacgucccacaaa

SEQ ID NO: 747375 - RNA, 22 nt, Leptospira interrogans serovar lai str. 56601
cacguaauucuuuggaaauuuu

SEQ ID NO: 747376 - RNA, 18 nt, Leptospira interrogans serovar lai str. 56601
cacuacaaucacuuuaua

SEQ ID NO: 747377 - RNA, 19 nt, Leptospira interrogans serovar lai str. 56601
cacuaaaauacuuuuagaa

SEQ ID NO: 747378 - RNA, 17 nt, Leptospira interrogans serovar lai str. 56601
cacguugaauaagauuu

SEQ ID NO: 747379 - RNA, 22 nt, Leptospira interrogans serovar lai str. 56601
cacguugaauaagauuuuagaa

SEQ ID NO: 747380 - RNA, 19 nt, Leptospira interrogans serovar lai str. 56601
cacguuauuuagaucaaau

SEQ ID NO: 747381 - RNA, 17 nt, Leptospira interrogans serovar lai str. 56601
cacguucuuagccuuua

SEQ ID NO: 747382 - RNA, 15 nt, Leptospira interrogans serovar lai str. 56601
cacguuaaaaguaau

SEQ ID NO: 747383 - RNA, 13 nt, Leptospira interrogans serovar lai str. 56601
cacguuaaaauaa

SEQ ID NO: 747384 - RNA, 15 nt, Leptospira interrogans serovar lai str. 56601
cacguuaaguuauau

SEQ ID NO: 747385 - RNA, 22 nt, Leptospira interrogans serovar lai str. 56601
cacgauuuuacgaacaaauucu

SEQ ID NO: 747386 - RNA, 19 nt, Leptospira interrogans serovar lai str. 56601
caccgcacaaaugauagaa

SEQ ID NO: 747387 - RNA, 19 nt, Leptospira interrogans serovar lai str. 56601
caccuuuuuuuaugaaaaa

SEQ ID NO: 747388 - RNA, 13 nt, Leptospira interrogans serovar lai str. 56601
caccuucuuuuuu

SEQ ID NO: 747389 - RNA, 16 nt, Leptospira interrogans serovar lai str. 56601
caccuuuacauaauaa

SEQ ID NO: 747390 - RNA, 15 nt, Leptospira interrogans serovar lai str. 56601
caccuuccaaagauu

SEQ ID NO: 747391 - RNA, 16 nt, Leptospira interrogans serovar lai str. 56601
caccuuccaaagauuu

SEQ ID NO: 747392 - RNA, 21 nt, Leptospira interrogans serovar lai str. 56601
caccuuccaaagauuuuaaaa

SEQ ID NO: 747393 - RNA, 16 nt, Leptospira interrogans serovar lai str. 56601
caccuucaugagaaac

SEQ ID NO: 747394 - RNA, 18 nt, Leptospira interrogans serovar lai str. 56601
caccuucaugagaaacaa

SEQ ID NO: 747395 - RNA, 13 nt, Leptospira interrogans serovar lai str. 56601
caccuaaaaugaa

SEQ ID NO: 747396 - RNA, 15 nt, Leptospira interrogans serovar lai str. 56601
caccuaaaaugaaaa

SEQ ID NO: 747397 - RNA, 16 nt, Leptospira interrogans serovar lai str. 56601
caccuaaaaugaaaaa

SEQ ID NO: 747398 - RNA, 21 nt, Leptospira interrogans serovar lai str. 56601
caccguugcuauaaaaaggau

SEQ ID NO: 747399 - RNA, 23 nt, Leptospira interrogans serovar lai str. 56601
caccguugcuauaaaaaggaucu

SEQ ID NO: 747400 - RNA, 15 nt, Leptospira interrogans serovar lai str. 56601
cacccaccaaaaaua

SEQ ID NO: 747401 - RNA, 21 nt, Leptospira interrogans serovar lai str. 56601
cacccaaaaauagggaaaacu

SEQ ID NO: 747402 - RNA, 19 nt, Leptospira interrogans serovar lai str. 56601
caccaaccgaaacuuucaa

SEQ ID NO: 747403 - RNA, 13 nt, Leptospira interrogans serovar lai str. 56601
cacauuuuaaaga

SEQ ID NO: 747404 - RNA, 15 nt, Leptospira interrogans serovar lai str. 56601
cacauuuuaaagauu

SEQ ID NO: 747405 - RNA, 13 nt, Leptospira interrogans serovar lai str. 56601
cacauuuuaaagu

SEQ ID NO: 747406 - RNA, 21 nt, Leptospira interrogans serovar lai str. 56601
cacauuuuaaaguuuugaaau

SEQ ID NO: 747407 - RNA, 19 nt, Leptospira interrogans serovar lai str. 56601
cacauuguguuuuuuaaca

SEQ ID NO: 747408 - RNA, 19 nt, Leptospira interrogans serovar lai str. 56601
cacauuuuuaaaaguuauu

SEQ ID NO: 747409 - RNA, 22 nt, Leptospira interrogans serovar lai str. 56601
caccaaaaauagggaaaacuca

SEQ ID NO: 747410 - RNA, 23 nt, Leptospira interrogans serovar lai str. 56601
cacauuuuucaaguguuccgaca

SEQ ID NO: 747411 - RNA, 16 nt, Leptospira interrogans serovar lai str. 56601
cacauucauuuuuucu

SEQ ID NO: 747412 - RNA, 20 nt, Leptospira interrogans serovar lai str. 56601
cacauucauuuuuucuaaau

SEQ ID NO: 747413 - RNA, 18 nt, Leptospira interrogans serovar lai str. 56601
cacauuacgaauuuuuaa

SEQ ID NO: 747414 - RNA, 15 nt, Leptospira interrogans serovar lai str. 56601
cacaugagcauucuu

SEQ ID NO: 747415 - RNA, 12 nt, Leptospira interrogans serovar lai str. 56601
cacaucuuuuuu

SEQ ID NO: 747416 - RNA, 19 nt, Leptospira interrogans serovar lai str. 56601
cacaucguuaccagcaagc

SEQ ID NO: 747417 - RNA, 14 nt, Leptospira interrogans serovar lai str. 56601
cacaucgaaaaaac

SEQ ID NO: 747418 - RNA, 16 nt, Leptospira interrogans serovar lai str. 56601
cacauccgcauucuca

SEQ ID NO: 747419 - RNA, 20 nt, Leptospira interrogans serovar lai str. 56601
cacauaaaagaccuucggau

SEQ ID NO: 747420 - RNA, 17 nt, Leptospira interrogans serovar lai str. 56601
cacaguuccuaaaauua

SEQ ID NO: 747421 - RNA, 14 nt, Leptospira interrogans serovar lai str. 56601
cacauaaaguuaau

SEQ ID NO: 747422 - RNA, 16 nt, Leptospira interrogans serovar lai str. 56601
cacaauuuuuuuagaa

SEQ ID NO: 747423 - RNA, 16 nt, Leptospira interrogans serovar lai str. 56601
cacaauuuugaauauu

SEQ ID NO: 747424 - RNA, 22 nt, Leptospira interrogans serovar lai str. 56601
cacacauuccgcaaaaauuccu

SEQ ID NO: 747425 - RNA, 19 nt, Leptospira interrogans serovar lai str. 56601
cacaagcuuccuuuuuuau

SEQ ID NO: 747426 - RNA, 18 nt, Leptospira interrogans serovar lai str. 56601
cacaaucgucaucucgaa

SEQ ID NO: 747427 - RNA, 13 nt, Leptospira interrogans serovar lai str. 56601
cacacuuuauaaa

SEQ ID NO: 747428 - RNA, 15 nt, Leptospira interrogans serovar lai str. 56601
cacacuuuauaaaag

SEQ ID NO: 747429 - RNA, 21 nt, Leptospira interrogans serovar lai str. 56601
cacacuuuauaaaaguauaau

SEQ ID NO: 747430 - RNA, 16 nt, Leptospira interrogans serovar lai str. 56601
cacacccuugaccuca

SEQ ID NO: 747431 - RNA, 20 nt, Leptospira interrogans serovar lai str. 56601
cacaccggauucacauuaaa

SEQ ID NO: 747432 - RNA, 17 nt, Leptospira interrogans serovar lai str. 56601
cacaaauugucaaaugc

SEQ ID NO: 747433 - RNA, 13 nt, Leptospira interrogans serovar lai str. 56601
cacaagacaaaca

SEQ ID NO: 747434 - RNA, 21 nt, Leptospira interrogans serovar lai str. 56601
cacaagacaaacaaacaugca

SEQ ID NO: 747435 - RNA, 14 nt, Leptospira interrogans serovar lai str. 56601
cacaacgcucucua

SEQ ID NO: 747436 - RNA, 21 nt, Leptospira interrogans serovar lai str. 56601
cacaacgcucucuccuauguu

SEQ ID NO: 747437 - RNA, 19 nt, Leptospira interrogans serovar lai str. 56601
cacaacgcucuuuaugaau

SEQ ID NO: 747438 - RNA, 13 nt, Leptospira interrogans serovar lai str. 56601
cacaaaggcaccg

SEQ ID NO: 747439 - RNA, 21 nt, Leptospira interrogans serovar lai str. 56601
cacaaaucaucccgcccaaag

SEQ ID NO: 747440 - RNA, 18 nt, Leptospira interrogans serovar lai str. 56601
cacaaaucauggauuuac

SEQ ID NO: 747441 - RNA, 13 nt, Leptospira interrogans serovar lai str. 56601
cacaaauauuaag

SEQ ID NO: 747442 - RNA, 13 nt, Leptospira interrogans serovar lai str. 56601
cacaaauuccaau

SEQ ID NO: 747443 - RNA, 20 nt, Leptospira interrogans serovar lai str. 56601
cacaaauuccaauuuuucug

SEQ ID NO: 747444 - RNA, 14 nt, Leptospira interrogans serovar lai str. 56601
cacaaauucuaaag

SEQ ID NO: 747445 - RNA, 15 nt, Leptospira interrogans serovar lai str. 56601
caauuuauuauaaaa

SEQ ID NO: 747446 - RNA, 17 nt, Leptospira interrogans serovar lai str. 56601
caauuuauuauaaaacg

SEQ ID NO: 747447 - RNA, 20 nt, Leptospira interrogans serovar lai str. 56601
caauuuaucuaaaacacauc

SEQ ID NO: 747448 - RNA, 16 nt, Leptospira interrogans serovar lai str. 56601
caauuuacgaacuuuc

SEQ ID NO: 747449 - RNA, 18 nt, Leptospira interrogans serovar lai str. 56601
caauuuagaauaaagaga

SEQ ID NO: 747450 - RNA, 20 nt, Leptospira interrogans serovar lai str. 56601
caauuucagaaacauuggaa

SEQ ID NO: 747451 - RNA, 20 nt, Leptospira interrogans serovar lai str. 56601
caauuugcuaaaauaagaau

SEQ ID NO: 747452 - RNA, 16 nt, Leptospira interrogans serovar lai str. 56601
caauuuuaagaacaau

SEQ ID NO: 747453 - RNA, 21 nt, Leptospira interrogans serovar lai str. 56601
caauuuguaauguauaauccu

SEQ ID NO: 747454 - RNA, 22 nt, Leptospira interrogans serovar lai str. 56601
caauuuucuccuccuugaguuu

SEQ ID NO: 747455 - RNA, 20 nt, Leptospira interrogans serovar lai str. 56601
caauuuuaguaaacuacuaa

SEQ ID NO: 747456 - RNA, 15 nt, Leptospira interrogans serovar lai str. 56601
caauuuuaucuuaau

SEQ ID NO: 747457 - RNA, 17 nt, Leptospira interrogans serovar lai str. 56601
caauuuucucaaaaaau

SEQ ID NO: 747458 - RNA, 16 nt, Leptospira interrogans serovar lai str. 56601
cacaaaaacaaauuca

SEQ ID NO: 747459 - RNA, 12 nt, Leptospira interrogans serovar lai str. 56601
cacaaaaaaauu

SEQ ID NO: 747460 - RNA, 15 nt, Leptospira interrogans serovar lai str. 56601
cacaaaaaaauucau

SEQ ID NO: 747461 - RNA, 19 nt, Leptospira interrogans serovar lai str. 56601
caauuuuuuuguaaaaaaa

SEQ ID NO: 747462 - RNA, 21 nt, Leptospira interrogans serovar lai str. 56601
caauuuuuuuguaaaaaaaua

SEQ ID NO: 747463 - RNA, 14 nt, Leptospira interrogans serovar lai str. 56601
caauuuuuugaaaa

SEQ ID NO: 747464 - RNA, 17 nt, Leptospira interrogans serovar lai str. 56601
caauuuuuugaaaaaga

SEQ ID NO: 747465 - RNA, 21 nt, Leptospira interrogans serovar lai str. 56601
caauuuuuugaaaaagaauau

SEQ ID NO: 747466 - RNA, 13 nt, Leptospira interrogans serovar lai str. 56601
caauuuuugaaag

SEQ ID NO: 747467 - RNA, 18 nt, Leptospira interrogans serovar lai str. 56601
caauuaacaaaacuacuu

SEQ ID NO: 747468 - RNA, 18 nt, Leptospira interrogans serovar lai str. 56601
caauuaacaaaacugcuu

SEQ ID NO: 747469 - RNA, 14 nt, Leptospira interrogans serovar lai str. 56601
caauuaaaaagaua

SEQ ID NO: 747470 - RNA, 21 nt, Leptospira interrogans serovar lai str. 56601
caauuaaacgaucggaaggau

SEQ ID NO: 747471 - RNA, 20 nt, Leptospira interrogans serovar lai str. 56601
caauuaaacuucaaaaaaua

SEQ ID NO: 747472 - RNA, 21 nt, Leptospira interrogans serovar lai str. 56601
caauuaaagcgucucauuucu

SEQ ID NO: 747473 - RNA, 18 nt, Leptospira interrogans serovar lai str. 56601
caaucagauuuuuguagu

SEQ ID NO: 747474 - RNA, 13 nt, Leptospira interrogans serovar lai str. 56601
caaucaguaaaau

SEQ ID NO: 747475 - RNA, 15 nt, Leptospira interrogans serovar lai str. 56601
caaucaguaaaaugu

SEQ ID NO: 747476 - RNA, 19 nt, Leptospira interrogans serovar lai str. 56601
caaucacuuuauauugguu

SEQ ID NO: 747477 - RNA, 21 nt, Leptospira interrogans serovar lai str. 56601
caauuauuuuaggauuuuugg

SEQ ID NO: 747478 - RNA, 15 nt, Leptospira interrogans serovar lai str. 56601
caauuauuauaaacu

SEQ ID NO: 747479 - RNA, 20 nt, Leptospira interrogans serovar lai str. 56601
caauuagcguguaugguaaa

SEQ ID NO: 747480 - RNA, 19 nt, Leptospira interrogans serovar lai str. 56601
caauuauaaaauuuuucuc

SEQ ID NO: 747481 - RNA, 15 nt, Leptospira interrogans serovar lai str. 56601
caauuguccauuuca

SEQ ID NO: 747482 - RNA, 14 nt, Leptospira interrogans serovar lai str. 56601
caauuuaaaauaau

SEQ ID NO: 747483 - RNA, 18 nt, Leptospira interrogans serovar lai str. 56601
caauucuuccuuuuucau

SEQ ID NO: 747484 - RNA, 14 nt, Leptospira interrogans serovar lai str. 56601
caauugauuuaaaa

SEQ ID NO: 747485 - RNA, 23 nt, Leptospira interrogans serovar lai str. 56601
caauucuauuagaauaguaguuu

SEQ ID NO: 747486 - RNA, 15 nt, Leptospira interrogans serovar lai str. 56601
caauucuaagaccua

SEQ ID NO: 747487 - RNA, 20 nt, Leptospira interrogans serovar lai str. 56601
caauucuaagaccuaaaccc

SEQ ID NO: 747488 - RNA, 22 nt, Leptospira interrogans serovar lai str. 56601
caauucuaagaccuaaacccug

SEQ ID NO: 747489 - RNA, 16 nt, Leptospira interrogans serovar lai str. 56601
caauucuaauuuuuua

SEQ ID NO: 747490 - RNA, 19 nt, Leptospira interrogans serovar lai str. 56601
caauuccuucggaauuucu

SEQ ID NO: 747491 - RNA, 20 nt, Leptospira interrogans serovar lai str. 56601
caauuccauuucuguaacau

SEQ ID NO: 747492 - RNA, 17 nt, Leptospira interrogans serovar lai str. 56601
caauuccuaaaugccgc

SEQ ID NO: 747493 - RNA, 17 nt, Leptospira interrogans serovar lai str. 56601
caauuccacuaugaaag

SEQ ID NO: 747494 - RNA, 17 nt, Leptospira interrogans serovar lai str. 56601
caauuccaccuuggaaa

SEQ ID NO: 747495 - RNA, 18 nt, Leptospira interrogans serovar lai str. 56601
caauuccaccuuggaaag

SEQ ID NO: 747496 - RNA, 22 nt, Leptospira interrogans serovar lai str. 56601
caauuccaccuuggaaagaaaa

SEQ ID NO: 747497 - RNA, 13 nt, Leptospira interrogans serovar lai str. 56601
caauucacucuua

SEQ ID NO: 747498 - RNA, 14 nt, Leptospira interrogans serovar lai str. 56601
caauucaguaaauu

SEQ ID NO: 747499 - RNA, 16 nt, Leptospira interrogans serovar lai str. 56601
caauucaguaaauuau

SEQ ID NO: 747500 - RNA, 13 nt, Leptospira interrogans serovar lai str. 56601
cauacaaugaaaa

SEQ ID NO: 747501 - RNA, 14 nt, Leptospira interrogans serovar lai str. 56601
cauacaaugaaaaa

SEQ ID NO: 747502 - RNA, 13 nt, Leptospira interrogans serovar lai str. 56601
cauacaauaaagc

SEQ ID NO: 747503 - RNA, 17 nt, Leptospira interrogans serovar lai str. 56601
cauagaaccuaauguug

SEQ ID NO: 747504 - RNA, 16 nt, Leptospira interrogans serovar lai str. 56601
cauacaaaauuuaaaa

SEQ ID NO: 747505 - RNA, 21 nt, Leptospira interrogans serovar lai str. 56601
cauaauguuucaauuccuaaa

SEQ ID NO: 747506 - RNA, 22 nt, Leptospira interrogans serovar lai str. 56601
cauaauguuucaauuccuaaau

SEQ ID NO: 747507 - RNA, 12 nt, Leptospira interrogans serovar lai str. 56601
cauagagaacgc

SEQ ID NO: 747508 - RNA, 19 nt, Leptospira interrogans serovar lai str. 56601
cauagagaacgcgaacuuu

SEQ ID NO: 747509 - RNA, 18 nt, Leptospira interrogans serovar lai str. 56601
cauagaugggguugaauc

SEQ ID NO: 747510 - RNA, 14 nt, Leptospira interrogans serovar lai str. 56601
cauaggauacaaaa

SEQ ID NO: 747511 - RNA, 14 nt, Leptospira interrogans serovar lai str. 56601
cauaggaugaauug

SEQ ID NO: 747512 - RNA, 17 nt, Leptospira interrogans serovar lai str. 56601
cauaggcgcggaaaaau

SEQ ID NO: 747513 - RNA, 22 nt, Leptospira interrogans serovar lai str. 56601
cauauacggauuucuauaaaau

SEQ ID NO: 747514 - RNA, 18 nt, Leptospira interrogans serovar lai str. 56601
cauauacguaaaaauaau

SEQ ID NO: 747515 - RNA, 20 nt, Leptospira interrogans serovar lai str. 56601
cauagugaagauuuguaaaa

SEQ ID NO: 747516 - RNA, 22 nt, Leptospira interrogans serovar lai str. 56601
cauaguuuguuaucaauagaaa

SEQ ID NO: 747517 - RNA, 23 nt, Leptospira interrogans serovar lai str. 56601
cauaguuucuaaguguaaaauua

SEQ ID NO: 747518 - RNA, 13 nt, Leptospira interrogans serovar lai str. 56601
cauaguucaauua

SEQ ID NO: 747519 - RNA, 19 nt, Leptospira interrogans serovar lai str. 56601
cauaguuauauaauaaagc

SEQ ID NO: 747520 - RNA, 17 nt, Leptospira interrogans serovar lai str. 56601
caucaaugucaaaaaaa

SEQ ID NO: 747521 - RNA, 16 nt, Leptospira interrogans serovar lai str. 56601
caucaccaaccccaca

SEQ ID NO: 747522 - RNA, 16 nt, Leptospira interrogans serovar lai str. 56601
cauauugagauaaaaa

SEQ ID NO: 747523 - RNA, 18 nt, Leptospira interrogans serovar lai str. 56601
cauauugagauaaaaagu

SEQ ID NO: 747524 - RNA, 15 nt, Leptospira interrogans serovar lai str. 56601
cauauccgaaagaua

SEQ ID NO: 747525 - RNA, 19 nt, Leptospira interrogans serovar lai str. 56601
cauauccgaaagauaaauc

SEQ ID NO: 747526 - RNA, 18 nt, Leptospira interrogans serovar lai str. 56601
cauauccaauuucaauuu

SEQ ID NO: 747527 - RNA, 14 nt, Leptospira interrogans serovar lai str. 56601
cauaucauauuguu

SEQ ID NO: 747528 - RNA, 16 nt, Leptospira interrogans serovar lai str. 56601
cauaucauauuguuua

SEQ ID NO: 747529 - RNA, 21 nt, Leptospira interrogans serovar lai str. 56601
caucaaaucgcuguuuugugg

SEQ ID NO: 747530 - RNA, 22 nt, Leptospira interrogans serovar lai str. 56601
caucaaauaccgcgaaauaaaa

SEQ ID NO: 747531 - RNA, 22 nt, Leptospira interrogans serovar lai str. 56601
caucaaauuugcuucaacacug

SEQ ID NO: 747532 - RNA, 21 nt, Leptospira interrogans serovar lai str. 56601
caucaaauacaaaauuuuuuc

SEQ ID NO: 747533 - RNA, 13 nt, Leptospira interrogans serovar lai str. 56601
caucucaaaaaca

SEQ ID NO: 747534 - RNA, 16 nt, Leptospira interrogans serovar lai str. 56601
caucucaaaaacacuu

SEQ ID NO: 747535 - RNA, 22 nt, Leptospira interrogans serovar lai str. 56601
caucuacagaacccaauaaaaa

SEQ ID NO: 747536 - RNA, 15 nt, Leptospira interrogans serovar lai str. 56601
caucguuccaaaccc

SEQ ID NO: 747537 - RNA, 19 nt, Leptospira interrogans serovar lai str. 56601
caucguuuagguaaagauu

SEQ ID NO: 747538 - RNA, 22 nt, Leptospira interrogans serovar lai str. 56601
caucguuuauuuuucuaaaaaa

SEQ ID NO: 747539 - RNA, 18 nt, Leptospira interrogans serovar lai str. 56601
caucgcacgucccacaaa

SEQ ID NO: 747540 - RNA, 17 nt, Leptospira interrogans serovar lai str. 56601
cauccgaaaucccaaaa

SEQ ID NO: 747541 - RNA, 16 nt, Leptospira interrogans serovar lai str. 56601
cauccgcauucucaca

SEQ ID NO: 747542 - RNA, 16 nt, Leptospira interrogans serovar lai str. 56601
caucccacuuuuauau

SEQ ID NO: 747543 - RNA, 20 nt, Leptospira interrogans serovar lai str. 56601
caucccagaacaaaacguua

SEQ ID NO: 747544 - RNA, 16 nt, Leptospira interrogans serovar lai str. 56601
cauccaaugaaauuuu

SEQ ID NO: 747545 - RNA, 17 nt, Leptospira interrogans serovar lai str. 56601
cauccaaugaaauuuuu

SEQ ID NO: 747546 - RNA, 12 nt, Leptospira interrogans serovar lai str. 56601
caucauuauuug

SEQ ID NO: 747547 - RNA, 17 nt, Leptospira interrogans serovar lai str. 56601
cauccaacccaaacaca

SEQ ID NO: 747548 - RNA, 13 nt, Leptospira interrogans serovar lai str. 56601
cauuuacucaaau

SEQ ID NO: 747549 - RNA, 20 nt, Leptospira interrogans serovar lai str. 56601
cauuguaagaaauauggcau

SEQ ID NO: 747550 - RNA, 14 nt, Leptospira interrogans serovar lai str. 56601
cauuucaaguuuuc

SEQ ID NO: 747551 - RNA, 19 nt, Leptospira interrogans serovar lai str. 56601
cauuucaaguuuucuuuuu

SEQ ID NO: 747552 - RNA, 18 nt, Leptospira interrogans serovar lai str. 56601
cauuucaauacaauaaaa

SEQ ID NO: 747553 - RNA, 13 nt, Leptospira interrogans serovar lai str. 56601
cauuuauuuuuuu

SEQ ID NO: 747554 - RNA, 23 nt, Leptospira interrogans serovar lai str. 56601
cauuucgaaaacgauuuuucaaa

SEQ ID NO: 747555 - RNA, 13 nt, Leptospira interrogans serovar lai str. 56601
cauuucauuuuuu

SEQ ID NO: 747556 - RNA, 14 nt, Leptospira interrogans serovar lai str. 56601
cauuucauuuuuuu

SEQ ID NO: 747557 - RNA, 15 nt, Leptospira interrogans serovar lai str. 56601
cauucuucaaauaac

SEQ ID NO: 747558 - RNA, 16 nt, Leptospira interrogans serovar lai str. 56601
cauucuucaaauaaca

SEQ ID NO: 747559 - RNA, 18 nt, Leptospira interrogans serovar lai str. 56601
cauucuuuccuauaaaag

SEQ ID NO: 747560 - RNA, 19 nt, Leptospira interrogans serovar lai str. 56601
cauucuugucggaacacuu

SEQ ID NO: 747561 - RNA, 12 nt, Leptospira interrogans serovar lai str. 56601
cauucuuuccau

SEQ ID NO: 747562 - RNA, 14 nt, Leptospira interrogans serovar lai str. 56601
cauucuuuguuuug

SEQ ID NO: 747563 - RNA, 16 nt, Leptospira interrogans serovar lai str. 56601
cauuccgucaaaucau

SEQ ID NO: 747564 - RNA, 21 nt, Leptospira interrogans serovar lai str. 56601
cauuccgcaaaaauuccuuuu

SEQ ID NO: 747565 - RNA, 13 nt, Leptospira interrogans serovar lai str. 56601
cauucauuuuuau

SEQ ID NO: 747566 - RNA, 18 nt, Leptospira interrogans serovar lai str. 56601
cauucauccuaagaauca

SEQ ID NO: 747567 - RNA, 13 nt, Leptospira interrogans serovar lai str. 56601
cauuccaauuucc

SEQ ID NO: 747568 - RNA, 20 nt, Leptospira interrogans serovar lai str. 56601
cauuccaauuuccuaaaauu

SEQ ID NO: 747569 - RNA, 16 nt, Leptospira interrogans serovar lai str. 56601
cauuccauaaugaaga

SEQ ID NO: 747570 - RNA, 14 nt, Leptospira interrogans serovar lai str. 56601
cauucaggauuacu

SEQ ID NO: 747571 - RNA, 16 nt, Leptospira interrogans serovar lai str. 56601
cauucaaaaaaucaaa

SEQ ID NO: 747572 - RNA, 20 nt, Leptospira interrogans serovar lai str. 56601
cauucaaauuucugaaacaa

SEQ ID NO: 747573 - RNA, 21 nt, Leptospira interrogans serovar lai str. 56601
cauuauuucaaugcaaaaaau

SEQ ID NO: 747574 - RNA, 23 nt, Leptospira interrogans serovar lai str. 56601
cauuauuucaaugcaaaaaauug

SEQ ID NO: 747575 - RNA, 16 nt, Leptospira interrogans serovar lai str. 56601
cauuauuuuauggaca

SEQ ID NO: 747576 - RNA, 23 nt, Leptospira interrogans serovar lai str. 56601
cauucaacuuagaacuuguccca

SEQ ID NO: 747577 - RNA, 14 nt, Leptospira interrogans serovar lai str. 56601
cauuauauauuuau

SEQ ID NO: 747578 - RNA, 18 nt, Leptospira interrogans serovar lai str. 56601
cauuacgaauuuuuaaau

SEQ ID NO: 747579 - RNA, 18 nt, Leptospira interrogans serovar lai str. 56601
cauuacuacagacaaucc

SEQ ID NO: 747580 - RNA, 18 nt, Leptospira interrogans serovar lai str. 56601
cauuauaguuuuuucaaa

SEQ ID NO: 747581 - RNA, 16 nt, Leptospira interrogans serovar lai str. 56601
cauuauaaguuuuuau

SEQ ID NO: 747582 - RNA, 23 nt, Leptospira interrogans serovar lai str. 56601
cauuauaaguuuuuauuauaaaa

SEQ ID NO: 747583 - RNA, 22 nt, Leptospira interrogans serovar lai str. 56601
cauuauacaucauauuauuugu

SEQ ID NO: 747584 - RNA, 15 nt, Leptospira interrogans serovar lai str. 56601
cauguauuacucaga

SEQ ID NO: 747585 - RNA, 24 nt, Leptospira interrogans serovar lai str. 56601
cauguaauauaaguuaagugaaaa

SEQ ID NO: 747586 - RNA, 21 nt, Leptospira interrogans serovar lai str. 56601
caugaguucggcguaagaaaa

SEQ ID NO: 747587 - RNA, 17 nt, Leptospira interrogans serovar lai str. 56601
caugauaguuaauuuua

SEQ ID NO: 747588 - RNA, 22 nt, Leptospira interrogans serovar lai str. 56601
caugauccauuuuucugaaaaa

SEQ ID NO: 747589 - RNA, 23 nt, Leptospira interrogans serovar lai str. 56601
caugauccauuuuucugaaaaaa

SEQ ID NO: 747590 - RNA, 17 nt, Leptospira interrogans serovar lai str. 56601
caugagcauucuugaga

SEQ ID NO: 747591 - RNA, 15 nt, Leptospira interrogans serovar lai str. 56601
caugagacuauaaag

SEQ ID NO: 747592 - RNA, 22 nt, Leptospira interrogans serovar lai str. 56601
caugaugauuggacuaaaccac

SEQ ID NO: 747593 - RNA, 19 nt, Leptospira interrogans serovar lai str. 56601
caugauucauuuaaaaauu

SEQ ID NO: 747594 - RNA, 13 nt, Leptospira interrogans serovar lai str. 56601
caugauucauuuu

SEQ ID NO: 747595 - RNA, 23 nt, Leptospira interrogans serovar lai str. 56601
caugauucauuuuucugaaaaaa

SEQ ID NO: 747596 - RNA, 16 nt, Leptospira interrogans serovar lai str. 56601
caugauucugaaaaaa

SEQ ID NO: 747597 - RNA, 20 nt, Leptospira interrogans serovar lai str. 56601
caugcaucaacguaaauaaa

SEQ ID NO: 747598 - RNA, 18 nt, Leptospira interrogans serovar lai str. 56601
caugaauauuuuccaaaa

SEQ ID NO: 747599 - RNA, 16 nt, Leptospira interrogans serovar lai str. 56601
caugaaguugauugac

SEQ ID NO: 747600 - RNA, 21 nt, Leptospira interrogans serovar lai str. 56601
caugaaauugauguuuuguag

SEQ ID NO: 747601 - RNA, 19 nt, Leptospira interrogans serovar lai str. 56601
caucucuucgucucaccaa

SEQ ID NO: 747602 - RNA, 13 nt, Leptospira interrogans serovar lai str. 56601
caugagaaacaaa

SEQ ID NO: 747603 - RNA, 17 nt, Leptospira interrogans serovar lai str. 56601
caguucuaaugucguua

SEQ ID NO: 747604 - RNA, 14 nt, Leptospira interrogans serovar lai str. 56601
caguuuccacucuu

SEQ ID NO: 747605 - RNA, 19 nt, Leptospira interrogans serovar lai str. 56601
caguuuggcauuuauauuc

SEQ ID NO: 747606 - RNA, 20 nt, Leptospira interrogans serovar lai str. 56601
caguuuuacuguaaaauuua

SEQ ID NO: 747607 - RNA, 12 nt, Leptospira interrogans serovar lai str. 56601
cauaaaauaaaa

SEQ ID NO: 747608 - RNA, 17 nt, Leptospira interrogans serovar lai str. 56601
cauaaaauaaaaaacaa

SEQ ID NO: 747609 - RNA, 21 nt, Leptospira interrogans serovar lai str. 56601
cauaaaagaaacauuauacau

SEQ ID NO: 747610 - RNA, 14 nt, Leptospira interrogans serovar lai str. 56601
cauaaaagaacgaa

SEQ ID NO: 747611 - RNA, 17 nt, Leptospira interrogans serovar lai str. 56601
cauaaaauaacuuccau

SEQ ID NO: 747612 - RNA, 20 nt, Leptospira interrogans serovar lai str. 56601
cauaaaauagaaacaaaugg

SEQ ID NO: 747613 - RNA, 16 nt, Leptospira interrogans serovar lai str. 56601
cauaaaacucuaaauu

SEQ ID NO: 747614 - RNA, 17 nt, Leptospira interrogans serovar lai str. 56601
cauaaaacucuaaauuc

SEQ ID NO: 747615 - RNA, 19 nt, Leptospira interrogans serovar lai str. 56601
caguuuuguuaaccaaaaa

SEQ ID NO: 747616 - RNA, 19 nt, Leptospira interrogans serovar lai str. 56601
cauaauaauacagaauuca

SEQ ID NO: 747617 - RNA, 18 nt, Leptospira interrogans serovar lai str. 56601
cauaaguauuauuuuuau

SEQ ID NO: 747618 - RNA, 23 nt, Leptospira interrogans serovar lai str. 56601
cauaaguucgucugagaaaaacu

SEQ ID NO: 747619 - RNA, 20 nt, Leptospira interrogans serovar lai str. 56601
cauaaguguaugaaaaguca

SEQ ID NO: 747620 - RNA, 20 nt, Leptospira interrogans serovar lai str. 56601
cauaaguuguuauaaaccaa

SEQ ID NO: 747621 - RNA, 17 nt, Leptospira interrogans serovar lai str. 56601
cauaaucaaccccacac

SEQ ID NO: 747622 - RNA, 22 nt, Leptospira interrogans serovar lai str. 56601
cauaaaggugcaugaaaauaau

SEQ ID NO: 747623 - RNA, 21 nt, Leptospira interrogans serovar lai str. 56601
cauaaaguuaauacaaaaaac

SEQ ID NO: 747624 - RNA, 22 nt, Leptospira interrogans serovar lai str. 56601
cauaaaguuaauacaaaaaacu

SEQ ID NO: 747625 - RNA, 16 nt, Leptospira interrogans serovar lai str. 56601
cauaagcaaaaauaaa

SEQ ID NO: 747626 - RNA, 17 nt, Leptospira interrogans serovar lai str. 56601
cagugauucgaaauuuu

SEQ ID NO: 747627 - RNA, 14 nt, Leptospira interrogans serovar lai str. 56601
cagugccauuuuuc

SEQ ID NO: 747628 - RNA, 21 nt, Leptospira interrogans serovar lai str. 56601
cagugccauuuuucuucuuug

SEQ ID NO: 747629 - RNA, 19 nt, Leptospira interrogans serovar lai str. 56601
caguuauuauuuaacauga

SEQ ID NO: 747630 - RNA, 21 nt, Leptospira interrogans serovar lai str. 56601
caguuauaaguaaguaauuac

SEQ ID NO: 747631 - RNA, 15 nt, Leptospira interrogans serovar lai str. 56601
caguuaauacaaaac

SEQ ID NO: 747632 - RNA, 15 nt, Leptospira interrogans serovar lai str. 56601
caguucaaaauauuu

SEQ ID NO: 747633 - RNA, 15 nt, Leptospira interrogans serovar lai str. 56601
caguucccacauuuu

SEQ ID NO: 747634 - RNA, 21 nt, Leptospira interrogans serovar lai str. 56601
caguaaugccuacaaaucaaa

SEQ ID NO: 747635 - RNA, 13 nt, Leptospira interrogans serovar lai str. 56601
cagguuuuaaacu

SEQ ID NO: 747636 - RNA, 18 nt, Leptospira interrogans serovar lai str. 56601
cagguuuuauaaagugaa

SEQ ID NO: 747637 - RNA, 19 nt, Leptospira interrogans serovar lai str. 56601
cagguuuuaucaaauaaag

SEQ ID NO: 747638 - RNA, 14 nt, Leptospira interrogans serovar lai str. 56601
caguauucaauuuu

SEQ ID NO: 747639 - RNA, 16 nt, Leptospira interrogans serovar lai str. 56601
caguauucaauuuuua

SEQ ID NO: 747640 - RNA, 19 nt, Leptospira interrogans serovar lai str. 56601
caguauucaauuuuuauag

SEQ ID NO: 747641 - RNA, 16 nt, Leptospira interrogans serovar lai str. 56601
caguauguuguucucc

SEQ ID NO: 747642 - RNA, 15 nt, Leptospira interrogans serovar lai str. 56601
caguauguuuuuuug

SEQ ID NO: 747643 - RNA, 18 nt, Leptospira interrogans serovar lai str. 56601
caguacaagaaucaaaac

SEQ ID NO: 747644 - RNA, 15 nt, Leptospira interrogans serovar lai str. 56601
caguaggcuauuuua

SEQ ID NO: 747645 - RNA, 22 nt, Leptospira interrogans serovar lai str. 56601
caggaugaaucgaauaaaaaag

SEQ ID NO: 747646 - RNA, 15 nt, Leptospira interrogans serovar lai str. 56601
caggaucaaaauccg

SEQ ID NO: 747647 - RNA, 20 nt, Leptospira interrogans serovar lai str. 56601
caggaaaauuuaaauucccu

SEQ ID NO: 747648 - RNA, 14 nt, Leptospira interrogans serovar lai str. 56601
cagcuuuuuuaaau

SEQ ID NO: 747649 - RNA, 12 nt, Leptospira interrogans serovar lai str. 56601
cagcugaaacua

SEQ ID NO: 747650 - RNA, 18 nt, Leptospira interrogans serovar lai str. 56601
cagcucuggucaaguuau

SEQ ID NO: 747651 - RNA, 13 nt, Leptospira interrogans serovar lai str. 56601
cagcuaagaaaaa

SEQ ID NO: 747652 - RNA, 12 nt, Leptospira interrogans serovar lai str. 56601
cagcuaaaaaga

SEQ ID NO: 747653 - RNA, 16 nt, Leptospira interrogans serovar lai str. 56601
cagcuaaaaagaaagu

SEQ ID NO: 747654 - RNA, 23 nt, Leptospira interrogans serovar lai str. 56601
cagcuaaaaagaaaguugcaaag

SEQ ID NO: 747655 - RNA, 18 nt, Leptospira interrogans serovar lai str. 56601
cccauacaaaauuuaaaa

SEQ ID NO: 747656 - RNA, 12 nt, Leptospira interrogans serovar lai str. 56601
cccagucuucuu

SEQ ID NO: 747657 - RNA, 13 nt, Leptospira interrogans serovar lai str. 56601
cccagucuucuug

SEQ ID NO: 747658 - RNA, 12 nt, Leptospira interrogans serovar lai str. 56601
ccccauucuuuu

SEQ ID NO: 747659 - RNA, 15 nt, Leptospira interrogans serovar lai str. 56601
ccccauuaaaaagcu

SEQ ID NO: 747660 - RNA, 21 nt, Leptospira interrogans serovar lai str. 56601
ccccaucucuucgucucacca

SEQ ID NO: 747661 - RNA, 23 nt, Leptospira interrogans serovar lai str. 56601
ccccaucucuucgucucaccaac

SEQ ID NO: 747662 - RNA, 12 nt, Leptospira interrogans serovar lai str. 56601
cccaacugaaaa

SEQ ID NO: 747663 - RNA, 16 nt, Leptospira interrogans serovar lai str. 56601
cccaaugauucuaacu

SEQ ID NO: 747664 - RNA, 23 nt, Leptospira interrogans serovar lai str. 56601
cccacauuuaaauuaaucuguaa

SEQ ID NO: 747665 - RNA, 12 nt, Leptospira interrogans serovar lai str. 56601
cccacauuuauu

SEQ ID NO: 747666 - RNA, 11 nt, Leptospira interrogans serovar lai str. 56601
cccacauuuua

SEQ ID NO: 747667 - RNA, 15 nt, Leptospira interrogans serovar lai str. 56601
cccacauuuuagaaa

SEQ ID NO: 747668 - RNA, 11 nt, Leptospira interrogans serovar lai str. 56601
cccacauuuuc

SEQ ID NO: 747669 - RNA, 13 nt, Leptospira interrogans serovar lai str. 56601
cccagaaaggaac

SEQ ID NO: 747670 - RNA, 19 nt, Leptospira interrogans serovar lai str. 56601
ccauuaacuauauaauaaa

SEQ ID NO: 747671 - RNA, 21 nt, Leptospira interrogans serovar lai str. 56601
ccauuaggugcuacugcaaga

SEQ ID NO: 747672 - RNA, 20 nt, Leptospira interrogans serovar lai str. 56601
ccauucuagaaccuggaaaa

SEQ ID NO: 747673 - RNA, 19 nt, Leptospira interrogans serovar lai str. 56601
ccauggcuuugaaaaaggu

SEQ ID NO: 747674 - RNA, 22 nt, Leptospira interrogans serovar lai str. 56601
ccaugucuucuaaaucuaauuc

SEQ ID NO: 747675 - RNA, 21 nt, Leptospira interrogans serovar lai str. 56601
ccaugauccauuuuucugaaa

SEQ ID NO: 747676 - RNA, 18 nt, Leptospira interrogans serovar lai str. 56601
ccaugauucugaaaaaag

SEQ ID NO: 747677 - RNA, 22 nt, Leptospira interrogans serovar lai str. 56601
ccaugauucugaaaaaaguuag

SEQ ID NO: 747678 - RNA, 13 nt, Leptospira interrogans serovar lai str. 56601
ccaugccaaacac

SEQ ID NO: 747679 - RNA, 16 nt, Leptospira interrogans serovar lai str. 56601
ccaucuacagaaccca

SEQ ID NO: 747680 - RNA, 13 nt, Leptospira interrogans serovar lai str. 56601
ccaucucaaaaau

SEQ ID NO: 747681 - RNA, 14 nt, Leptospira interrogans serovar lai str. 56601
ccaucucuucgucu

SEQ ID NO: 747682 - RNA, 22 nt, Leptospira interrogans serovar lai str. 56601
ccauccaaagaaagaaaauaca

SEQ ID NO: 747683 - RNA, 21 nt, Leptospira interrogans serovar lai str. 56601
ccauauugaguuaauuuucga

SEQ ID NO: 747684 - RNA, 22 nt, Leptospira interrogans serovar lai str. 56601
ccauagaaagguuauccucuga

SEQ ID NO: 747685 - RNA, 17 nt, Leptospira interrogans serovar lai str. 56601
ccauagaguguuguguu

SEQ ID NO: 747686 - RNA, 17 nt, Leptospira interrogans serovar lai str. 56601
ccauaaaaaaugaaugu

SEQ ID NO: 747687 - RNA, 14 nt, Leptospira interrogans serovar lai str. 56601
ccauaaucaacccc

SEQ ID NO: 747688 - RNA, 22 nt, Leptospira interrogans serovar lai str. 56601
ccagcuucuugcgcuaucuuca

SEQ ID NO: 747689 - RNA, 20 nt, Leptospira interrogans serovar lai str. 56601
ccagcuuuuuuaaauuuuua

SEQ ID NO: 747690 - RNA, 19 nt, Leptospira interrogans serovar lai str. 56601
ccagcuuuuuucagaauca

SEQ ID NO: 747691 - RNA, 20 nt, Leptospira interrogans serovar lai str. 56601
ccagguuuuucgaaaagaaa

SEQ ID NO: 747692 - RNA, 21 nt, Leptospira interrogans serovar lai str. 56601
ccagaaagcucuccaucuuuu

SEQ ID NO: 747693 - RNA, 19 nt, Leptospira interrogans serovar lai str. 56601
ccagaaaccauaaaauaaa

SEQ ID NO: 747694 - RNA, 20 nt, Leptospira interrogans serovar lai str. 56601
ccagaaaccauaaaauaaaa

SEQ ID NO: 747695 - RNA, 22 nt, Leptospira interrogans serovar lai str. 56601
ccagaaaccauaaaauaaaaaa

SEQ ID NO: 747696 - RNA, 15 nt, Leptospira interrogans serovar lai str. 56601
ccagaauuagauuaa

SEQ ID NO: 747697 - RNA, 22 nt, Leptospira interrogans serovar lai str. 56601
ccagaauuagauuaaauuuuua

SEQ ID NO: 747698 - RNA, 22 nt, Leptospira interrogans serovar lai str. 56601
ccagaauuuugaacauuuucau

SEQ ID NO: 747699 - RNA, 13 nt, Leptospira interrogans serovar lai str. 56601
ccagaaaaaaccu

SEQ ID NO: 747700 - RNA, 14 nt, Leptospira interrogans serovar lai str. 56601
ccagaaaaaaccuc

SEQ ID NO: 747701 - RNA, 17 nt, Leptospira interrogans serovar lai str. 56601
ccagacguaucaaaaua

SEQ ID NO: 747702 - RNA, 22 nt, Leptospira interrogans serovar lai str. 56601
ccagagcauauaauuaaaaaga

SEQ ID NO: 747703 - RNA, 12 nt, Leptospira interrogans serovar lai str. 56601
ccacaguuccua

SEQ ID NO: 747704 - RNA, 16 nt, Leptospira interrogans serovar lai str. 56601
ccacaucuuuuuucgu

SEQ ID NO: 747705 - RNA, 15 nt, Leptospira interrogans serovar lai str. 56601
ccacauuucaaaguu

SEQ ID NO: 747706 - RNA, 14 nt, Leptospira interrogans serovar lai str. 56601
ccacauuuugugaa

SEQ ID NO: 747707 - RNA, 21 nt, Leptospira interrogans serovar lai str. 56601
ccacauuggacgauuuugaga

SEQ ID NO: 747708 - RNA, 16 nt, Leptospira interrogans serovar lai str. 56601
ccacccaaaccggaga

SEQ ID NO: 747709 - RNA, 23 nt, Leptospira interrogans serovar lai str. 56601
ccaccuuuacauaauaauacaga

SEQ ID NO: 747710 - RNA, 13 nt, Leptospira interrogans serovar lai str. 56601
ccaccuaaaauga

SEQ ID NO: 747711 - RNA, 19 nt, Leptospira interrogans serovar lai str. 56601
ccaccuaaaaugaaaaaaa

SEQ ID NO: 747712 - RNA, 20 nt, Leptospira interrogans serovar lai str. 56601
ccacagguuuuaaacuauag

SEQ ID NO: 747713 - RNA, 18 nt, Leptospira interrogans serovar lai str. 56601
ccacagaaagcuuucucc

SEQ ID NO: 747714 - RNA, 19 nt, Leptospira interrogans serovar lai str. 56601
ccacagaaagcuuucuccu

SEQ ID NO: 747715 - RNA, 18 nt, Leptospira interrogans serovar lai str. 56601
ccaauugaauauaaaauu

SEQ ID NO: 747716 - RNA, 23 nt, Leptospira interrogans serovar lai str. 56601
ccaauugaauauaaaauuuuuau

SEQ ID NO: 747717 - RNA, 13 nt, Leptospira interrogans serovar lai str. 56601
ccaauuccaaaaa

SEQ ID NO: 747718 - RNA, 14 nt, Leptospira interrogans serovar lai str. 56601
ccaauuaacaaaac

SEQ ID NO: 747719 - RNA, 16 nt, Leptospira interrogans serovar lai str. 56601
ccaauuaacaaaacug

SEQ ID NO: 747720 - RNA, 13 nt, Leptospira interrogans serovar lai str. 56601
ccaaugcgaaaua

SEQ ID NO: 747721 - RNA, 15 nt, Leptospira interrogans serovar lai str. 56601
ccaauuucaauuucu

SEQ ID NO: 747722 - RNA, 12 nt, Leptospira interrogans serovar lai str. 56601
ccaauucuaaaa

SEQ ID NO: 747723 - RNA, 22 nt, Leptospira interrogans serovar lai str. 56601
ccaauuuuuuuguaaaaaaaua

SEQ ID NO: 747724 - RNA, 15 nt, Leptospira interrogans serovar lai str. 56601
ccacaaaaacaaauu

SEQ ID NO: 747725 - RNA, 18 nt, Leptospira interrogans serovar lai str. 56601
ccacaaaucuaaauuuua

SEQ ID NO: 747726 - RNA, 16 nt, Leptospira interrogans serovar lai str. 56601
ccacaaauuccugccu

SEQ ID NO: 747727 - RNA, 16 nt, Leptospira interrogans serovar lai str. 56601
ccacaaucaagauggg

SEQ ID NO: 747728 - RNA, 22 nt, Leptospira interrogans serovar lai str. 56601
ccaauaauuucccauaaaaaga

SEQ ID NO: 747729 - RNA, 18 nt, Leptospira interrogans serovar lai str. 56601
ccaaucuuacaaguuaug

SEQ ID NO: 747730 - RNA, 23 nt, Leptospira interrogans serovar lai str. 56601
ccaaucgucuguaaaagaaaaau

SEQ ID NO: 747731 - RNA, 21 nt, Leptospira interrogans serovar lai str. 56601
ccaaucaaauuuuugcauaaa

SEQ ID NO: 747732 - RNA, 11 nt, Leptospira interrogans serovar lai str. 56601
ccaauccaaaa

SEQ ID NO: 747733 - RNA, 15 nt, Leptospira interrogans serovar lai str. 56601
ccaaucauagauaca

SEQ ID NO: 747734 - RNA, 22 nt, Leptospira interrogans serovar lai str. 56601
ccaagauucaaagauaaaauau

SEQ ID NO: 747735 - RNA, 23 nt, Leptospira interrogans serovar lai str. 56601
ccaaguguggucuauuacaaaac

SEQ ID NO: 747736 - RNA, 18 nt, Leptospira interrogans serovar lai str. 56601
ccaaguauaaaagugaau

SEQ ID NO: 747737 - RNA, 22 nt, Leptospira interrogans serovar lai str. 56601
ccaaccgaaacuuucaaaauag

SEQ ID NO: 747738 - RNA, 20 nt, Leptospira interrogans serovar lai str. 56601
ccaaccauuuaauagaucua

SEQ ID NO: 747739 - RNA, 19 nt, Leptospira interrogans serovar lai str. 56601
ccaaauuugcgaaaaaaau

SEQ ID NO: 747740 - RNA, 14 nt, Leptospira interrogans serovar lai str. 56601
ccaaauuuuuuaca

SEQ ID NO: 747741 - RNA, 15 nt, Leptospira interrogans serovar lai str. 56601
ccaaauuuuuuacaa

SEQ ID NO: 747742 - RNA, 12 nt, Leptospira interrogans serovar lai str. 56601
ccaaauucuuuc

SEQ ID NO: 747743 - RNA, 14 nt, Leptospira interrogans serovar lai str. 56601
ccaaauucuuuccu

SEQ ID NO: 747744 - RNA, 19 nt, Leptospira interrogans serovar lai str. 56601
ccaacgguaacgagcaucu

SEQ ID NO: 747745 - RNA, 19 nt, Leptospira interrogans serovar lai str. 56601
ccaacguaccaaaacccau

SEQ ID NO: 747746 - RNA, 23 nt, Leptospira interrogans serovar lai str. 56601
ccaacuuuuucagaaaaaugaau

SEQ ID NO: 747747 - RNA, 21 nt, Leptospira interrogans serovar lai str. 56601
ccaacugaaaaugaccaaaau

SEQ ID NO: 747748 - RNA, 15 nt, Leptospira interrogans serovar lai str. 56601
ccaaaaucauuuaaa

SEQ ID NO: 747749 - RNA, 23 nt, Leptospira interrogans serovar lai str. 56601
ccaaaaguccaauuuuaaaacca

SEQ ID NO: 747750 - RNA, 16 nt, Leptospira interrogans serovar lai str. 56601
ccaaaaucguccaaug

SEQ ID NO: 747751 - RNA, 16 nt, Leptospira interrogans serovar lai str. 56601
ccaaaaugaauuguaa

SEQ ID NO: 747752 - RNA, 23 nt, Leptospira interrogans serovar lai str. 56601
ccaaaauuguuggccuuuuugaa

SEQ ID NO: 747753 - RNA, 22 nt, Leptospira interrogans serovar lai str. 56601
ccaaaauuaacggucaauuuua

SEQ ID NO: 747754 - RNA, 20 nt, Leptospira interrogans serovar lai str. 56601
ccaaaauuuagaauuguuau

SEQ ID NO: 747755 - RNA, 16 nt, Leptospira interrogans serovar lai str. 56601
ccaaaccaaauagaaa

SEQ ID NO: 747756 - RNA, 17 nt, Leptospira interrogans serovar lai str. 56601
ccaaacagccaaagaaa

SEQ ID NO: 747757 - RNA, 19 nt, Leptospira interrogans serovar lai str. 56601
ccaaacacaugagcauucu

SEQ ID NO: 747758 - RNA, 14 nt, Leptospira interrogans serovar lai str. 56601
ccaaacccaaugau

SEQ ID NO: 747759 - RNA, 20 nt, Leptospira interrogans serovar lai str. 56601
ccaaaccccaguaugaaccc

SEQ ID NO: 747760 - RNA, 17 nt, Leptospira interrogans serovar lai str. 56601
ccaaacccugccaaaau

SEQ ID NO: 747761 - RNA, 15 nt, Leptospira interrogans serovar lai str. 56601
ccaaaaagaaaaaca

SEQ ID NO: 747762 - RNA, 13 nt, Leptospira interrogans serovar lai str. 56601
cauuucuaaaaua

SEQ ID NO: 747763 - RNA, 17 nt, Leptospira interrogans serovar lai str. 56601
cauuucguuucccucuu

SEQ ID NO: 747764 - RNA, 21 nt, Leptospira interrogans serovar lai str. 56601
cauuucguuucccucuucuag

SEQ ID NO: 747765 - RNA, 12 nt, Leptospira interrogans serovar lai str. 56601
ccaaaagaacuu

SEQ ID NO: 747766 - RNA, 20 nt, Leptospira interrogans serovar lai str. 56601
ccaaaacuucaaagaaucuu

SEQ ID NO: 747767 - RNA, 18 nt, Leptospira interrogans serovar lai str. 56601
ccaaaaccucaaaaaauu

SEQ ID NO: 747768 - RNA, 13 nt, Leptospira interrogans serovar lai str. 56601
ccaaaaccaauuu

SEQ ID NO: 747769 - RNA, 19 nt, Leptospira interrogans serovar lai str. 56601
ccaaaaauuuaaaaauucg

SEQ ID NO: 747770 - RNA, 13 nt, Leptospira interrogans serovar lai str. 56601
ccaaauaaaaaca

SEQ ID NO: 747771 - RNA, 20 nt, Leptospira interrogans serovar lai str. 56601
ccaaaucgcugguuuuauuu

SEQ ID NO: 747772 - RNA, 22 nt, Leptospira interrogans serovar lai str. 56601
ccaaaucgcugguuuuauuucu

SEQ ID NO: 747773 - RNA, 13 nt, Leptospira interrogans serovar lai str. 56601
ccaaacucaaugc

SEQ ID NO: 747774 - RNA, 22 nt, Leptospira interrogans serovar lai str. 56601
cgaauuguauccgaaaaauucc

SEQ ID NO: 747775 - RNA, 16 nt, Leptospira interrogans serovar lai str. 56601
cgaauuguuuuuaaau

SEQ ID NO: 747776 - RNA, 20 nt, Leptospira interrogans serovar lai str. 56601
cgaauuguuuuuaaauacuc

SEQ ID NO: 747777 - RNA, 22 nt, Leptospira interrogans serovar lai str. 56601
cgaauuuccuuuuguuuuucuu

SEQ ID NO: 747778 - RNA, 20 nt, Leptospira interrogans serovar lai str. 56601
cgaauuucuucauaaaaucg

SEQ ID NO: 747779 - RNA, 13 nt, Leptospira interrogans serovar lai str. 56601
cgaauuuccauuu

SEQ ID NO: 747780 - RNA, 12 nt, Leptospira interrogans serovar lai str. 56601
cgaauuuuaaau

SEQ ID NO: 747781 - RNA, 17 nt, Leptospira interrogans serovar lai str. 56601
cgaauuuuaaauauuaa

SEQ ID NO: 747782 - RNA, 18 nt, Leptospira interrogans serovar lai str. 56601
cgaauuugcgaaaaaaau

SEQ ID NO: 747783 - RNA, 20 nt, Leptospira interrogans serovar lai str. 56601
cgacaaaacuuccauuuuuu

SEQ ID NO: 747784 - RNA, 14 nt, Leptospira interrogans serovar lai str. 56601
cgacaaguccucua

SEQ ID NO: 747785 - RNA, 22 nt, Leptospira interrogans serovar lai str. 56601
cgacagauuuauauugagauca

SEQ ID NO: 747786 - RNA, 20 nt, Leptospira interrogans serovar lai str. 56601
cgaauuacauaguaaacaca

SEQ ID NO: 747787 - RNA, 22 nt, Leptospira interrogans serovar lai str. 56601
cgaauuacauaguaaacacaau

SEQ ID NO: 747788 - RNA, 19 nt, Leptospira interrogans serovar lai str. 56601
cgaaugguacgaccaaaac

SEQ ID NO: 747789 - RNA, 20 nt, Leptospira interrogans serovar lai str. 56601
cgaauucacguuaaaauaau

SEQ ID NO: 747790 - RNA, 23 nt, Leptospira interrogans serovar lai str. 56601
cgaauucauuuaccuaaaauuca

SEQ ID NO: 747791 - RNA, 21 nt, Leptospira interrogans serovar lai str. 56601
cgaauugaguuuuuguuugaa

SEQ ID NO: 747792 - RNA, 23 nt, Leptospira interrogans serovar lai str. 56601
cgaauugaucucauaaagacaau

SEQ ID NO: 747793 - RNA, 20 nt, Leptospira interrogans serovar lai str. 56601
cgaauucuuucuauuuuuuc

SEQ ID NO: 747794 - RNA, 21 nt, Leptospira interrogans serovar lai str. 56601
cgaaucuggaagccaaaacca

SEQ ID NO: 747795 - RNA, 21 nt, Leptospira interrogans serovar lai str. 56601
cgaauauccuugaaguagaua

SEQ ID NO: 747796 - RNA, 15 nt, Leptospira interrogans serovar lai str. 56601
cgaauccuuuuucuu

SEQ ID NO: 747797 - RNA, 15 nt, Leptospira interrogans serovar lai str. 56601
cgaauaagaaauuca

SEQ ID NO: 747798 - RNA, 13 nt, Leptospira interrogans serovar lai str. 56601
cgaauacauuuaa

SEQ ID NO: 747799 - RNA, 22 nt, Leptospira interrogans serovar lai str. 56601
cgaauagaguuguuaaaagugg

SEQ ID NO: 747800 - RNA, 14 nt, Leptospira interrogans serovar lai str. 56601
cgaauaaaaaacuc

SEQ ID NO: 747801 - RNA, 23 nt, Leptospira interrogans serovar lai str. 56601
cgaagauaccaaauaaauauuuc

SEQ ID NO: 747802 - RNA, 14 nt, Leptospira interrogans serovar lai str. 56601
cgaagaauuauuua

SEQ ID NO: 747803 - RNA, 20 nt, Leptospira interrogans serovar lai str. 56601
cgaacuuuuuuauaaaugga

SEQ ID NO: 747804 - RNA, 18 nt, Leptospira interrogans serovar lai str. 56601
cgaacuuuucuauaaaau

SEQ ID NO: 747805 - RNA, 20 nt, Leptospira interrogans serovar lai str. 56601
cgaacuuuucuauaaaaucu

SEQ ID NO: 747806 - RNA, 22 nt, Leptospira interrogans serovar lai str. 56601
cgaacuaaugaaggaauuggaa

SEQ ID NO: 747807 - RNA, 17 nt, Leptospira interrogans serovar lai str. 56601
cgaacuauacaaauaga

SEQ ID NO: 747808 - RNA, 20 nt, Leptospira interrogans serovar lai str. 56601
cgaacggauucuaauuuuau

SEQ ID NO: 747809 - RNA, 19 nt, Leptospira interrogans serovar lai str. 56601
cgacauuuuagagcagaac

SEQ ID NO: 747810 - RNA, 14 nt, Leptospira interrogans serovar lai str. 56601
cgaccuuaaauaau

SEQ ID NO: 747811 - RNA, 21 nt, Leptospira interrogans serovar lai str. 56601
cgaaauuuuuuuaaaaauguc

SEQ ID NO: 747812 - RNA, 19 nt, Leptospira interrogans serovar lai str. 56601
cgaaauuauacaaaacucu

SEQ ID NO: 747813 - RNA, 22 nt, Leptospira interrogans serovar lai str. 56601
cgaaauuuguggagcucgauuu

SEQ ID NO: 747814 - RNA, 19 nt, Leptospira interrogans serovar lai str. 56601
cgaaauuuuacaguaaaau

SEQ ID NO: 747815 - RNA, 21 nt, Leptospira interrogans serovar lai str. 56601
cgaaauuuuacaguaaaaucu

SEQ ID NO: 747816 - RNA, 20 nt, Leptospira interrogans serovar lai str. 56601
cgaacaaauucuaaaauugu

SEQ ID NO: 747817 - RNA, 16 nt, Leptospira interrogans serovar lai str. 56601
cgaaaucaauguugca

SEQ ID NO: 747818 - RNA, 22 nt, Leptospira interrogans serovar lai str. 56601
cgaaagcguuucguucuuuuuu

SEQ ID NO: 747819 - RNA, 14 nt, Leptospira interrogans serovar lai str. 56601
cgaaaggaaaagaa

SEQ ID NO: 747820 - RNA, 16 nt, Leptospira interrogans serovar lai str. 56601
cgaaacuuucaaaaua

SEQ ID NO: 747821 - RNA, 19 nt, Leptospira interrogans serovar lai str. 56601
cgaaacuuuuagaauucuc

SEQ ID NO: 747822 - RNA, 15 nt, Leptospira interrogans serovar lai str. 56601
cgaaagauuuuucau

SEQ ID NO: 747823 - RNA, 17 nt, Leptospira interrogans serovar lai str. 56601
cgaaaccucaaaaaauu

SEQ ID NO: 747824 - RNA, 14 nt, Leptospira interrogans serovar lai str. 56601
ccuuuuuauuucua

SEQ ID NO: 747825 - RNA, 20 nt, Leptospira interrogans serovar lai str. 56601
ccuuuuuauuucuaaguccu

SEQ ID NO: 747826 - RNA, 17 nt, Leptospira interrogans serovar lai str. 56601
ccuuuucuuuuuuaaac

SEQ ID NO: 747827 - RNA, 16 nt, Leptospira interrogans serovar lai str. 56601
ccuuuuucauuuuuaa

SEQ ID NO: 747828 - RNA, 10 nt, Leptospira interrogans serovar lai str. 56601
ccuuuuucua

SEQ ID NO: 747829 - RNA, 19 nt, Leptospira interrogans serovar lai str. 56601
ccuuuuuguaaggauuccu

SEQ ID NO: 747830 - RNA, 16 nt, Leptospira interrogans serovar lai str. 56601
ccuuuuuuauuuuaac

SEQ ID NO: 747831 - RNA, 14 nt, Leptospira interrogans serovar lai str. 56601
ccuuuuuuguaaag

SEQ ID NO: 747832 - RNA, 14 nt, Leptospira interrogans serovar lai str. 56601
cgaaaaaacaaaua

SEQ ID NO: 747833 - RNA, 16 nt, Leptospira interrogans serovar lai str. 56601
cgaaaaaauacaaaca

SEQ ID NO: 747834 - RNA, 12 nt, Leptospira interrogans serovar lai str. 56601
cgaaaaauucca

SEQ ID NO: 747835 - RNA, 20 nt, Leptospira interrogans serovar lai str. 56601
cgaaaagaccauuuuccuuc

SEQ ID NO: 747836 - RNA, 18 nt, Leptospira interrogans serovar lai str. 56601
cgaaaauuugaaaauuga

SEQ ID NO: 747837 - RNA, 22 nt, Leptospira interrogans serovar lai str. 56601
cgaaaauuuaacuacacgagag

SEQ ID NO: 747838 - RNA, 16 nt, Leptospira interrogans serovar lai str. 56601
cgaaaauuaaaaaauc

SEQ ID NO: 747839 - RNA, 19 nt, Leptospira interrogans serovar lai str. 56601
cgaaaauuaacuuugauag

SEQ ID NO: 747840 - RNA, 13 nt, Leptospira interrogans serovar lai str. 56601
cgaaaauuccgaa

SEQ ID NO: 747841 - RNA, 15 nt, Leptospira interrogans serovar lai str. 56601
ccuuucauuuuucca

SEQ ID NO: 747842 - RNA, 15 nt, Leptospira interrogans serovar lai str. 56601
ccuuuccccccaccc

SEQ ID NO: 747843 - RNA, 18 nt, Leptospira interrogans serovar lai str. 56601
ccuuucacaucuccacuu

SEQ ID NO: 747844 - RNA, 22 nt, Leptospira interrogans serovar lai str. 56601
ccuuucaagaauuuauuuacaa

SEQ ID NO: 747845 - RNA, 17 nt, Leptospira interrogans serovar lai str. 56601
ccuuuauuuaaaaaccg

SEQ ID NO: 747846 - RNA, 15 nt, Leptospira interrogans serovar lai str. 56601
ccuuuguauuaauuu

SEQ ID NO: 747847 - RNA, 13 nt, Leptospira interrogans serovar lai str. 56601
ccuugugcaauaa

SEQ ID NO: 747848 - RNA, 23 nt, Leptospira interrogans serovar lai str. 56601
ccuuuacauaauaauacagaauu

SEQ ID NO: 747849 - RNA, 16 nt, Leptospira interrogans serovar lai str. 56601
ccuuuaaauugaauuc

SEQ ID NO: 747850 - RNA, 17 nt, Leptospira interrogans serovar lai str. 56601
ccuuuaaauugaauucu

SEQ ID NO: 747851 - RNA, 21 nt, Leptospira interrogans serovar lai str. 56601
ccuugggcugaauuguuugau

SEQ ID NO: 747852 - RNA, 17 nt, Leptospira interrogans serovar lai str. 56601
ccuugggauaaauauuc

SEQ ID NO: 747853 - RNA, 20 nt, Leptospira interrogans serovar lai str. 56601
ccuugaguuugagaaaucau

SEQ ID NO: 747854 - RNA, 12 nt, Leptospira interrogans serovar lai str. 56601
ccuucuggaaaa

SEQ ID NO: 747855 - RNA, 16 nt, Leptospira interrogans serovar lai str. 56601
ccuucuuuuuucuaaa

SEQ ID NO: 747856 - RNA, 11 nt, Leptospira interrogans serovar lai str. 56601
ccuucuugaaa

SEQ ID NO: 747857 - RNA, 13 nt, Leptospira interrogans serovar lai str. 56601
ccuucuuuacagu

SEQ ID NO: 747858 - RNA, 22 nt, Leptospira interrogans serovar lai str. 56601
cgcaucgaucccuuucgcuuua

SEQ ID NO: 747859 - RNA, 14 nt, Leptospira interrogans serovar lai str. 56601
cgcauuuuccuuuu

SEQ ID NO: 747860 - RNA, 21 nt, Leptospira interrogans serovar lai str. 56601
cgcacaucguuaccagcaagc

SEQ ID NO: 747861 - RNA, 19 nt, Leptospira interrogans serovar lai str. 56601
cgcagacuguaucauagaa

SEQ ID NO: 747862 - RNA, 14 nt, Leptospira interrogans serovar lai str. 56601
cgauauuuuuuaaa

SEQ ID NO: 747863 - RNA, 15 nt, Leptospira interrogans serovar lai str. 56601
cgauuucuguagaaa

SEQ ID NO: 747864 - RNA, 16 nt, Leptospira interrogans serovar lai str. 56601
cgauuucuguagaaau

SEQ ID NO: 747865 - RNA, 16 nt, Leptospira interrogans serovar lai str. 56601
cgauuucuauuuuucg

SEQ ID NO: 747866 - RNA, 23 nt, Leptospira interrogans serovar lai str. 56601
cgauuuuacgaacgaauucuaaa

SEQ ID NO: 747867 - RNA, 21 nt, Leptospira interrogans serovar lai str. 56601
cgauuuucccaaacaggaaaa

SEQ ID NO: 747868 - RNA, 15 nt, Leptospira interrogans serovar lai str. 56601
cgauuuuaaauaaaa

SEQ ID NO: 747869 - RNA, 12 nt, Leptospira interrogans serovar lai str. 56601
cgauuuuuuagc

SEQ ID NO: 747870 - RNA, 12 nt, Leptospira interrogans serovar lai str. 56601
cgauuuaaaaac

SEQ ID NO: 747871 - RNA, 13 nt, Leptospira interrogans serovar lai str. 56601
cgauuguaaaaaa

SEQ ID NO: 747872 - RNA, 18 nt, Leptospira interrogans serovar lai str. 56601
cgauuccauuuuugucau

SEQ ID NO: 747873 - RNA, 14 nt, Leptospira interrogans serovar lai str. 56601
cgauucuaaauuau

SEQ ID NO: 747874 - RNA, 21 nt, Leptospira interrogans serovar lai str. 56601
cgauucucguucaacuuuccu

SEQ ID NO: 747875 - RNA, 17 nt, Leptospira interrogans serovar lai str. 56601
cgagcgaaagccgccuu

SEQ ID NO: 747876 - RNA, 16 nt, Leptospira interrogans serovar lai str. 56601
cgauauuaaaaugagc

SEQ ID NO: 747877 - RNA, 16 nt, Leptospira interrogans serovar lai str. 56601
cgauacagaauaaaua

SEQ ID NO: 747878 - RNA, 16 nt, Leptospira interrogans serovar lai str. 56601
cgauacauuugcuuug

SEQ ID NO: 747879 - RNA, 22 nt, Leptospira interrogans serovar lai str. 56601
cgauagccaugguaagaagaag

SEQ ID NO: 747880 - RNA, 21 nt, Leptospira interrogans serovar lai str. 56601
cgauaauucuuuagaaauuuu

SEQ ID NO: 747881 - RNA, 16 nt, Leptospira interrogans serovar lai str. 56601
cgaguuuaucagaaac

SEQ ID NO: 747882 - RNA, 16 nt, Leptospira interrogans serovar lai str. 56601
cgaguuucacaaaaau

SEQ ID NO: 747883 - RNA, 16 nt, Leptospira interrogans serovar lai str. 56601
cgaguguaauaugaau

SEQ ID NO: 747884 - RNA, 14 nt, Leptospira interrogans serovar lai str. 56601
cgagaaagaauuuc

SEQ ID NO: 747885 - RNA, 22 nt, Leptospira interrogans serovar lai str. 56601
cgacuuuauucaaaauagaaua

SEQ ID NO: 747886 - RNA, 15 nt, Leptospira interrogans serovar lai str. 56601
ccugucaauuuucca

SEQ ID NO: 747887 - RNA, 11 nt, Leptospira interrogans serovar lai str. 56601
ccugccaaaau

SEQ ID NO: 747888 - RNA, 21 nt, Leptospira interrogans serovar lai str. 56601
ccugaaucuauuguaauaaau

SEQ ID NO: 747889 - RNA, 16 nt, Leptospira interrogans serovar lai str. 56601
ccugaaaauuuuccuu

SEQ ID NO: 747890 - RNA, 23 nt, Leptospira interrogans serovar lai str. 56601
ccucuuuauacggaugugaauuc

SEQ ID NO: 747891 - RNA, 20 nt, Leptospira interrogans serovar lai str. 56601
ccucucacuucuugaacuca

SEQ ID NO: 747892 - RNA, 22 nt, Leptospira interrogans serovar lai str. 56601
ccucuaaaaaucggcauucaau

SEQ ID NO: 747893 - RNA, 21 nt, Leptospira interrogans serovar lai str. 56601
ccucuugaagccuuccaucaa

SEQ ID NO: 747894 - RNA, 20 nt, Leptospira interrogans serovar lai str. 56601
ccucuucuagcaaucuuccu

SEQ ID NO: 747895 - RNA, 22 nt, Leptospira interrogans serovar lai str. 56601
ccucgaaaucugaccucuaucc

SEQ ID NO: 747896 - RNA, 18 nt, Leptospira interrogans serovar lai str. 56601
ccuccuauguuucuugug

SEQ ID NO: 747897 - RNA, 19 nt, Leptospira interrogans serovar lai str. 56601
ccuccugaaaauuuuccuu

SEQ ID NO: 747898 - RNA, 20 nt, Leptospira interrogans serovar lai str. 56601
ccuccugaaaauuuuccuuu

SEQ ID NO: 747899 - RNA, 16 nt, Leptospira interrogans serovar lai str. 56601
ccguuuuacguaaauu

SEQ ID NO: 747900 - RNA, 21 nt, Leptospira interrogans serovar lai str. 56601
ccguuuagaaauuaaaguauc

SEQ ID NO: 747901 - RNA, 21 nt, Leptospira interrogans serovar lai str. 56601
ccuaaugcagcuucuuccaaa

SEQ ID NO: 747902 - RNA, 20 nt, Leptospira interrogans serovar lai str. 56601
ccuaaucuuauucaauaaaa

SEQ ID NO: 747903 - RNA, 13 nt, Leptospira interrogans serovar lai str. 56601
ccuaauguugaau

SEQ ID NO: 747904 - RNA, 19 nt, Leptospira interrogans serovar lai str. 56601
ccuaauuacgauuuuuuga

SEQ ID NO: 747905 - RNA, 23 nt, Leptospira interrogans serovar lai str. 56601
ccuaauuacgauuuuuugauuca

SEQ ID NO: 747906 - RNA, 18 nt, Leptospira interrogans serovar lai str. 56601
ccuacaguuuuagaaucu

SEQ ID NO: 747907 - RNA, 13 nt, Leptospira interrogans serovar lai str. 56601
ccgugaaucgaaa

SEQ ID NO: 747908 - RNA, 14 nt, Leptospira interrogans serovar lai str. 56601
ccguagccgcuuca

SEQ ID NO: 747909 - RNA, 20 nt, Leptospira interrogans serovar lai str. 56601
ccguaaauauuuuuuuuaau

SEQ ID NO: 747910 - RNA, 15 nt, Leptospira interrogans serovar lai str. 56601
ccguaaagaagaggu

SEQ ID NO: 747911 - RNA, 12 nt, Leptospira interrogans serovar lai str. 56601
ccguaaaaaauc

SEQ ID NO: 747912 - RNA, 19 nt, Leptospira interrogans serovar lai str. 56601
ccgucucagcaagucuauu

SEQ ID NO: 747913 - RNA, 20 nt, Leptospira interrogans serovar lai str. 56601
ccgucggaagccauaaucaa

SEQ ID NO: 747914 - RNA, 19 nt, Leptospira interrogans serovar lai str. 56601
ccgggaggaauuuuuaaaa

SEQ ID NO: 747915 - RNA, 16 nt, Leptospira interrogans serovar lai str. 56601
ccggguuagaaucaac

SEQ ID NO: 747916 - RNA, 21 nt, Leptospira interrogans serovar lai str. 56601
ccggcuaaaaaacugauuaaa

SEQ ID NO: 747917 - RNA, 16 nt, Leptospira interrogans serovar lai str. 56601
ccgcuuuuaguuuuuc

SEQ ID NO: 747918 - RNA, 18 nt, Leptospira interrogans serovar lai str. 56601
ccgcuuuuaguuuuuccu

SEQ ID NO: 747919 - RNA, 20 nt, Leptospira interrogans serovar lai str. 56601
ccggagaaagcgcagacucu

SEQ ID NO: 747920 - RNA, 21 nt, Leptospira interrogans serovar lai str. 56601
ccggcauuaauauaaaaaaua

SEQ ID NO: 747921 - RNA, 15 nt, Leptospira interrogans serovar lai str. 56601
ccgccuucacccacc

SEQ ID NO: 747922 - RNA, 22 nt, Leptospira interrogans serovar lai str. 56601
ccgauuugguuuucauucaaaa

SEQ ID NO: 747923 - RNA, 20 nt, Leptospira interrogans serovar lai str. 56601
ccgauuuuaaucuccgcucu

SEQ ID NO: 747924 - RNA, 18 nt, Leptospira interrogans serovar lai str. 56601
ccgauuucuauuuuaaaa

SEQ ID NO: 747925 - RNA, 21 nt, Leptospira interrogans serovar lai str. 56601
ccgauucacuuccauuggauu

SEQ ID NO: 747926 - RNA, 19 nt, Leptospira interrogans serovar lai str. 56601
ccgauuccagcacugaucg

SEQ ID NO: 747927 - RNA, 18 nt, Leptospira interrogans serovar lai str. 56601
cccuuccgauucacuucc

SEQ ID NO: 747928 - RNA, 17 nt, Leptospira interrogans serovar lai str. 56601
ccgaaaagguuaaaaau

SEQ ID NO: 747929 - RNA, 12 nt, Leptospira interrogans serovar lai str. 56601
ccgaaaaaccuu

SEQ ID NO: 747930 - RNA, 23 nt, Leptospira interrogans serovar lai str. 56601
ccgaauacaggcgguuuaaaagc

SEQ ID NO: 747931 - RNA, 17 nt, Leptospira interrogans serovar lai str. 56601
ccgaauaggaucagaau

SEQ ID NO: 747932 - RNA, 18 nt, Leptospira interrogans serovar lai str. 56601
ccgaauaggaucagaauu

SEQ ID NO: 747933 - RNA, 18 nt, Leptospira interrogans serovar lai str. 56601
cccugccaaaaucccaga

SEQ ID NO: 747934 - RNA, 17 nt, Leptospira interrogans serovar lai str. 56601
cgguguaaaaaaucaug

SEQ ID NO: 747935 - RNA, 16 nt, Leptospira interrogans serovar lai str. 56601
cguaccccaaagauuu

SEQ ID NO: 747936 - RNA, 20 nt, Leptospira interrogans serovar lai str. 56601
cguaauuuuuuggaaauuuu

SEQ ID NO: 747937 - RNA, 23 nt, Leptospira interrogans serovar lai str. 56601
cguaauucuuuggaaauuuuuaa

SEQ ID NO: 747938 - RNA, 14 nt, Leptospira interrogans serovar lai str. 56601
cguaauaucuaaaa

SEQ ID NO: 747939 - RNA, 16 nt, Leptospira interrogans serovar lai str. 56601
cgguucgguggaaacu

SEQ ID NO: 747940 - RNA, 21 nt, Leptospira interrogans serovar lai str. 56601
cgguucuaaaagucccaauuc

SEQ ID NO: 747941 - RNA, 20 nt, Leptospira interrogans serovar lai str. 56601
cgguucuaguauuauuuucc

SEQ ID NO: 747942 - RNA, 17 nt, Leptospira interrogans serovar lai str. 56601
cguaaaaaguuaauucu

SEQ ID NO: 747943 - RNA, 11 nt, Leptospira interrogans serovar lai str. 56601
cguaaaaaaau

SEQ ID NO: 747944 - RNA, 13 nt, Leptospira interrogans serovar lai str. 56601
cguaaaaaaauau

SEQ ID NO: 747945 - RNA, 21 nt, Leptospira interrogans serovar lai str. 56601
cguaaauucaggauaaacauc

SEQ ID NO: 747946 - RNA, 18 nt, Leptospira interrogans serovar lai str. 56601
cguaaauauuuuuuuuaa

SEQ ID NO: 747947 - RNA, 15 nt, Leptospira interrogans serovar lai str. 56601
cguaacuuucuuuua

SEQ ID NO: 747948 - RNA, 14 nt, Leptospira interrogans serovar lai str. 56601
cguaagaaaaccau

SEQ ID NO: 747949 - RNA, 22 nt, Leptospira interrogans serovar lai str. 56601
cguaagaccagugccauuuuuc

SEQ ID NO: 747950 - RNA, 15 nt, Leptospira interrogans serovar lai str. 56601
cguaagauaugaauu

SEQ ID NO: 747951 - RNA, 19 nt, Leptospira interrogans serovar lai str. 56601
cguaaguaauccauuuuuc

SEQ ID NO: 747952 - RNA, 13 nt, Leptospira interrogans serovar lai str. 56601
cggguaaaaaaua

SEQ ID NO: 747953 - RNA, 21 nt, Leptospira interrogans serovar lai str. 56601
cgguaaaagaauauuauuaua

SEQ ID NO: 747954 - RNA, 15 nt, Leptospira interrogans serovar lai str. 56601
cgguaaaacaaaaaa

SEQ ID NO: 747955 - RNA, 15 nt, Leptospira interrogans serovar lai str. 56601
cgguaaaaggagcca

SEQ ID NO: 747956 - RNA, 19 nt, Leptospira interrogans serovar lai str. 56601
cggguuuuucuuuuuaaau

SEQ ID NO: 747957 - RNA, 22 nt, Leptospira interrogans serovar lai str. 56601
cggguuuuucuuuuuaaauaca

SEQ ID NO: 747958 - RNA, 13 nt, Leptospira interrogans serovar lai str. 56601
cgguaaaaucuuu

SEQ ID NO: 747959 - RNA, 16 nt, Leptospira interrogans serovar lai str. 56601
cggguuccauucuaag

SEQ ID NO: 747960 - RNA, 14 nt, Leptospira interrogans serovar lai str. 56601
cgggacaaaucaua

SEQ ID NO: 747961 - RNA, 14 nt, Leptospira interrogans serovar lai str. 56601
cggcauuaauauaa

SEQ ID NO: 747962 - RNA, 17 nt, Leptospira interrogans serovar lai str. 56601
cggaucaaaauucuuug

SEQ ID NO: 747963 - RNA, 21 nt, Leptospira interrogans serovar lai str. 56601
cgcuuggaaauaucuaaucuu

SEQ ID NO: 747964 - RNA, 19 nt, Leptospira interrogans serovar lai str. 56601
cggaaauucucaaaaaauu

SEQ ID NO: 747965 - RNA, 15 nt, Leptospira interrogans serovar lai str. 56601
cggaauacuuuucuu

SEQ ID NO: 747966 - RNA, 15 nt, Leptospira interrogans serovar lai str. 56601
cggaauaacuuucuu

SEQ ID NO: 747967 - RNA, 16 nt, Leptospira interrogans serovar lai str. 56601
cggaauauuuuuucca

SEQ ID NO: 747968 - RNA, 15 nt, Leptospira interrogans serovar lai str. 56601
cggaaucaauuuuag

SEQ ID NO: 747969 - RNA, 18 nt, Leptospira interrogans serovar lai str. 56601
cggacuuuccgaauagga

SEQ ID NO: 747970 - RNA, 13 nt, Leptospira interrogans serovar lai str. 56601
cggaauuuccaaa

SEQ ID NO: 747971 - RNA, 12 nt, Leptospira interrogans serovar lai str. 56601
cgcguuaauaua

SEQ ID NO: 747972 - RNA, 14 nt, Leptospira interrogans serovar lai str. 56601
cgcguugaaaacca

SEQ ID NO: 747973 - RNA, 19 nt, Leptospira interrogans serovar lai str. 56601
cgcuacaaauucaucacuu

SEQ ID NO: 747974 - RNA, 11 nt, Leptospira interrogans serovar lai str. 56601
cgcucauccuu

SEQ ID NO: 747975 - RNA, 15 nt, Leptospira interrogans serovar lai str. 56601
cgcgcucaaaauucu

SEQ ID NO: 747976 - RNA, 13 nt, Leptospira interrogans serovar lai str. 56601
cgcggaaaaauua

SEQ ID NO: 747977 - RNA, 19 nt, Leptospira interrogans serovar lai str. 56601
cgugaucuccuaaaauaaa

SEQ ID NO: 747978 - RNA, 23 nt, Leptospira interrogans serovar lai str. 56601
cgugaguuugacguaaaaaaauc

SEQ ID NO: 747979 - RNA, 18 nt, Leptospira interrogans serovar lai str. 56601
cgugaccagcguuuugcu

SEQ ID NO: 747980 - RNA, 21 nt, Leptospira interrogans serovar lai str. 56601
cgugaccagcguuuugcugag

SEQ ID NO: 747981 - RNA, 20 nt, Leptospira interrogans serovar lai str. 56601
cgugacgaucacacuuugca

SEQ ID NO: 747982 - RNA, 17 nt, Leptospira interrogans serovar lai str. 56601
cgugaaaugguaccaua

SEQ ID NO: 747983 - RNA, 20 nt, Leptospira interrogans serovar lai str. 56601
cgugaaacuuuccacuuuuc

SEQ ID NO: 747984 - RNA, 13 nt, Leptospira interrogans serovar lai str. 56601
cgucuucuuuuuu

SEQ ID NO: 747985 - RNA, 14 nt, Leptospira interrogans serovar lai str. 56601
cgucucgcuucuau

SEQ ID NO: 747986 - RNA, 15 nt, Leptospira interrogans serovar lai str. 56601
cgucuguaaaagaaa

SEQ ID NO: 747987 - RNA, 14 nt, Leptospira interrogans serovar lai str. 56601
cgucuuaaauucua

SEQ ID NO: 747988 - RNA, 13 nt, Leptospira interrogans serovar lai str. 56601
cgucuaucuuuuu

SEQ ID NO: 747989 - RNA, 14 nt, Leptospira interrogans serovar lai str. 56601
cgucuaucuuuuuu

SEQ ID NO: 747990 - RNA, 15 nt, Leptospira interrogans serovar lai str. 56601
cgucguuaaauuugc

SEQ ID NO: 747991 - RNA, 12 nt, Leptospira interrogans serovar lai str. 56601
cguuuaaaaaac

SEQ ID NO: 747992 - RNA, 14 nt, Leptospira interrogans serovar lai str. 56601
cguuuaaauacauu

SEQ ID NO: 747993 - RNA, 18 nt, Leptospira interrogans serovar lai str. 56601
cguuuaagaauuuuaaaa

SEQ ID NO: 747994 - RNA, 22 nt, Leptospira interrogans serovar lai str. 56601
cguuuaagaauuuuaaaaaaug

SEQ ID NO: 747995 - RNA, 22 nt, Leptospira interrogans serovar lai str. 56601
cguuuaacaucaaagaaucauu

SEQ ID NO: 747996 - RNA, 18 nt, Leptospira interrogans serovar lai str. 56601
cguuuagaaauuaaagua

SEQ ID NO: 747997 - RNA, 17 nt, Leptospira interrogans serovar lai str. 56601
cguuuagguaaagauuu

SEQ ID NO: 747998 - RNA, 21 nt, Leptospira interrogans serovar lai str. 56601
cguuuccaugaaauagaaaac

SEQ ID NO: 747999 - RNA, 14 nt, Leptospira interrogans serovar lai str. 56601
cguucuuuuuuccu

SEQ ID NO: 748000 - RNA, 22 nt, Leptospira interrogans serovar lai str. 56601
cguucuuuuuuccuucuuuaca

SEQ ID NO: 748001 - RNA, 16 nt, Leptospira interrogans serovar lai str. 56601
cguucuuacauugagu

SEQ ID NO: 748002 - RNA, 14 nt, Leptospira interrogans serovar lai str. 56601
cguucugcugaguu

SEQ ID NO: 748003 - RNA, 18 nt, Leptospira interrogans serovar lai str. 56601
cguucugggcuccaaaag

SEQ ID NO: 748004 - RNA, 23 nt, Leptospira interrogans serovar lai str. 56601
cguucuguugaguucauucugau

SEQ ID NO: 748005 - RNA, 15 nt, Leptospira interrogans serovar lai str. 56601
cguucggaaaaagua

SEQ ID NO: 748006 - RNA, 22 nt, Leptospira interrogans serovar lai str. 56601
cguucggaaaaaguauaauuua

SEQ ID NO: 748007 - RNA, 13 nt, Leptospira interrogans serovar lai str. 56601
cuaaaaacucaaa

SEQ ID NO: 748008 - RNA, 10 nt, Leptospira interrogans serovar lai str. 56601
cuaaaaagaa

SEQ ID NO: 748009 - RNA, 14 nt, Leptospira interrogans serovar lai str. 56601
cuaaaaagaaaguu

SEQ ID NO: 748010 - RNA, 15 nt, Leptospira interrogans serovar lai str. 56601
cuaaaaagaaaguug

SEQ ID NO: 748011 - RNA, 16 nt, Leptospira interrogans serovar lai str. 56601
cuaaaaagaaaguugc

SEQ ID NO: 748012 - RNA, 20 nt, Leptospira interrogans serovar lai str. 56601
cuaaaaagaaaguugcaaag

SEQ ID NO: 748013 - RNA, 23 nt, Leptospira interrogans serovar lai str. 56601
cuaaaaagaaaguugcaaagaag

SEQ ID NO: 748014 - RNA, 19 nt, Leptospira interrogans serovar lai str. 56601
cuaaaacacaucuuaaaaa

SEQ ID NO: 748015 - RNA, 21 nt, Leptospira interrogans serovar lai str. 56601
cuaaaacacaucuuaaaaacu

SEQ ID NO: 748016 - RNA, 23 nt, Leptospira interrogans serovar lai str. 56601
cuaaaacacaucuuaaaaacucu

SEQ ID NO: 748017 - RNA, 21 nt, Leptospira interrogans serovar lai str. 56601
cuaaaaccuggauuugucucu

SEQ ID NO: 748018 - RNA, 19 nt, Leptospira interrogans serovar lai str. 56601
cuaaacccugagaauauuu

SEQ ID NO: 748019 - RNA, 13 nt, Leptospira interrogans serovar lai str. 56601
cuaaaaguaaaag

SEQ ID NO: 748020 - RNA, 18 nt, Leptospira interrogans serovar lai str. 56601
cuaaaagucccaauucca

SEQ ID NO: 748021 - RNA, 22 nt, Leptospira interrogans serovar lai str. 56601
cuaaaagaagaugcuuucucuu

SEQ ID NO: 748022 - RNA, 19 nt, Leptospira interrogans serovar lai str. 56601
cuaaaaccucaaaaaauuu

SEQ ID NO: 748023 - RNA, 12 nt, Leptospira interrogans serovar lai str. 56601
cuaaaaaugaaa

SEQ ID NO: 748024 - RNA, 12 nt, Leptospira interrogans serovar lai str. 56601
cguuuuuuaaaa

SEQ ID NO: 748025 - RNA, 12 nt, Leptospira interrogans serovar lai str. 56601
cuaaaaaacaua

SEQ ID NO: 748026 - RNA, 12 nt, Leptospira interrogans serovar lai str. 56601
cuaaaaaauaaa

SEQ ID NO: 748027 - RNA, 14 nt, Leptospira interrogans serovar lai str. 56601
cuaaaaaaaugaac

SEQ ID NO: 748028 - RNA, 11 nt, Leptospira interrogans serovar lai str. 56601
cuaaaaaaaua

SEQ ID NO: 748029 - RNA, 12 nt, Leptospira interrogans serovar lai str. 56601
cuaaaaaaaaua

SEQ ID NO: 748030 - RNA, 12 nt, Leptospira interrogans serovar lai str. 56601
cuaaaaaaaauc

SEQ ID NO: 748031 - RNA, 15 nt, Leptospira interrogans serovar lai str. 56601
cuaaaaaaaauguaa

SEQ ID NO: 748032 - RNA, 13 nt, Leptospira interrogans serovar lai str. 56601
cguuugcauccca

SEQ ID NO: 748033 - RNA, 16 nt, Leptospira interrogans serovar lai str. 56601
cguuuuaaugagaaag

SEQ ID NO: 748034 - RNA, 14 nt, Leptospira interrogans serovar lai str. 56601
cguuuuaaaauugc

SEQ ID NO: 748035 - RNA, 18 nt, Leptospira interrogans serovar lai str. 56601
cuaacgauccuuaggaag

SEQ ID NO: 748036 - RNA, 20 nt, Leptospira interrogans serovar lai str. 56601
cuaacgcaaguuccgcgauu

SEQ ID NO: 748037 - RNA, 21 nt, Leptospira interrogans serovar lai str. 56601
cuaacgauuguaaaaaaacau

SEQ ID NO: 748038 - RNA, 24 nt, Leptospira interrogans serovar lai str. 56601
cuaacugguuuuucuuuaaugcug

SEQ ID NO: 748039 - RNA, 15 nt, Leptospira interrogans serovar lai str. 56601
cuaaguuuuuaaaua

SEQ ID NO: 748040 - RNA, 16 nt, Leptospira interrogans serovar lai str. 56601
cuaaguuuuuaaauaa

SEQ ID NO: 748041 - RNA, 15 nt, Leptospira interrogans serovar lai str. 56601
cuaaguccuuuucuu

SEQ ID NO: 748042 - RNA, 19 nt, Leptospira interrogans serovar lai str. 56601
cuaaguaauuuaaaaaaau

SEQ ID NO: 748043 - RNA, 20 nt, Leptospira interrogans serovar lai str. 56601
cuaaguaauuuaaaaaaauc

SEQ ID NO: 748044 - RNA, 14 nt, Leptospira interrogans serovar lai str. 56601
cuaagaaaaaagca

SEQ ID NO: 748045 - RNA, 17 nt, Leptospira interrogans serovar lai str. 56601
cuaagaaaaaagcagcu

SEQ ID NO: 748046 - RNA, 13 nt, Leptospira interrogans serovar lai str. 56601
cuaagaaauccgu

SEQ ID NO: 748047 - RNA, 18 nt, Leptospira interrogans serovar lai str. 56601
cuaagaaucuugggguuu

SEQ ID NO: 748048 - RNA, 20 nt, Leptospira interrogans serovar lai str. 56601
cuaacaaaaaguguuuauaa

SEQ ID NO: 748049 - RNA, 17 nt, Leptospira interrogans serovar lai str. 56601
cuaaauuuguaauaguu

SEQ ID NO: 748050 - RNA, 13 nt, Leptospira interrogans serovar lai str. 56601
cuaaauuuuacaa

SEQ ID NO: 748051 - RNA, 17 nt, Leptospira interrogans serovar lai str. 56601
cuaaauugugagaacua

SEQ ID NO: 748052 - RNA, 15 nt, Leptospira interrogans serovar lai str. 56601
cuaaauugaaacuaa

SEQ ID NO: 748053 - RNA, 21 nt, Leptospira interrogans serovar lai str. 56601
cuaacaauuuuagaauuuauu

SEQ ID NO: 748054 - RNA, 23 nt, Leptospira interrogans serovar lai str. 56601
cuaaauucagaaaaaaaaagaau

SEQ ID NO: 748055 - RNA, 17 nt, Leptospira interrogans serovar lai str. 56601
cuaaauuauuuucaagu

SEQ ID NO: 748056 - RNA, 21 nt, Leptospira interrogans serovar lai str. 56601
cuaaauuauuuucaaguaaau

SEQ ID NO: 748057 - RNA, 22 nt, Leptospira interrogans serovar lai str. 56601
cuaaauuaaguuuauucaauuu

SEQ ID NO: 748058 - RNA, 14 nt, Leptospira interrogans serovar lai str. 56601
cuaaacuuugcaaa

SEQ ID NO: 748059 - RNA, 18 nt, Leptospira interrogans serovar lai str. 56601
cuaaacuuugcaaaucga

SEQ ID NO: 748060 - RNA, 13 nt, Leptospira interrogans serovar lai str. 56601
cuaaacgaguuuu

SEQ ID NO: 748061 - RNA, 17 nt, Leptospira interrogans serovar lai str. 56601
cuaaacgaguuuuuguu

SEQ ID NO: 748062 - RNA, 14 nt, Leptospira interrogans serovar lai str. 56601
cguuaaguuaucgu

SEQ ID NO: 748063 - RNA, 14 nt, Leptospira interrogans serovar lai str. 56601
cguuaaauagaaac

SEQ ID NO: 748064 - RNA, 19 nt, Leptospira interrogans serovar lai str. 56601
cguuauuuuaacuugaguu

SEQ ID NO: 748065 - RNA, 15 nt, Leptospira interrogans serovar lai str. 56601
cguuauuuagaucaa

SEQ ID NO: 748066 - RNA, 16 nt, Leptospira interrogans serovar lai str. 56601
cguuauuuuuuuuaca

SEQ ID NO: 748067 - RNA, 22 nt, Leptospira interrogans serovar lai str. 56601
cguuauuuuuauaaagauaaau

SEQ ID NO: 748068 - RNA, 22 nt, Leptospira interrogans serovar lai str. 56601
cguggauuuuauguaagaaaaa

SEQ ID NO: 748069 - RNA, 14 nt, Leptospira interrogans serovar lai str. 56601
cucagcuauaaaau

SEQ ID NO: 748070 - RNA, 22 nt, Leptospira interrogans serovar lai str. 56601
cucacuuaugauuuaguaaaau

SEQ ID NO: 748071 - RNA, 15 nt, Leptospira interrogans serovar lai str. 56601
cucagauuuccuuuc

SEQ ID NO: 748072 - RNA, 21 nt, Leptospira interrogans serovar lai str. 56601
cucagagcgauauaauaaaau

SEQ ID NO: 748073 - RNA, 17 nt, Leptospira interrogans serovar lai str. 56601
cucagagaauaucugaa

SEQ ID NO: 748074 - RNA, 22 nt, Leptospira interrogans serovar lai str. 56601
cucagagaauaucugaauuuuu

SEQ ID NO: 748075 - RNA, 13 nt, Leptospira interrogans serovar lai str. 56601
cucacuuuuucgu

SEQ ID NO: 748076 - RNA, 15 nt, Leptospira interrogans serovar lai str. 56601
cucaucuaguuuuug

SEQ ID NO: 748077 - RNA, 19 nt, Leptospira interrogans serovar lai str. 56601
cucauuaacucaucuaauc

SEQ ID NO: 748078 - RNA, 23 nt, Leptospira interrogans serovar lai str. 56601
cucauuagaguuauugaaaaauu

SEQ ID NO: 748079 - RNA, 20 nt, Leptospira interrogans serovar lai str. 56601
cucaguaaaacgcucucuac

SEQ ID NO: 748080 - RNA, 21 nt, Leptospira interrogans serovar lai str. 56601
cucaguaaaacgcucucuacg

SEQ ID NO: 748081 - RNA, 18 nt, Leptospira interrogans serovar lai str. 56601
cucauauuuuuagaaaau

SEQ ID NO: 748082 - RNA, 16 nt, Leptospira interrogans serovar lai str. 56601
cuauuuaauuuuguag

SEQ ID NO: 748083 - RNA, 20 nt, Leptospira interrogans serovar lai str. 56601
cuauuuauaaaauaaaaaaa

SEQ ID NO: 748084 - RNA, 21 nt, Leptospira interrogans serovar lai str. 56601
cuauuuauaaaauaaaaaaau

SEQ ID NO: 748085 - RNA, 14 nt, Leptospira interrogans serovar lai str. 56601
cuauuucccaaaau

SEQ ID NO: 748086 - RNA, 15 nt, Leptospira interrogans serovar lai str. 56601
cuauuacguaaugug

SEQ ID NO: 748087 - RNA, 14 nt, Leptospira interrogans serovar lai str. 56601
cuauuacaaaacuu

SEQ ID NO: 748088 - RNA, 17 nt, Leptospira interrogans serovar lai str. 56601
cuauuuuauuacaauuu

SEQ ID NO: 748089 - RNA, 12 nt, Leptospira interrogans serovar lai str. 56601
cuauuuuauacu

SEQ ID NO: 748090 - RNA, 12 nt, Leptospira interrogans serovar lai str. 56601
cuauuuuauaaa

SEQ ID NO: 748091 - RNA, 20 nt, Leptospira interrogans serovar lai str. 56601
cuauuuucagaaaaaugaau

SEQ ID NO: 748092 - RNA, 19 nt, Leptospira interrogans serovar lai str. 56601
cuauuuucuuugaaaaaau

SEQ ID NO: 748093 - RNA, 20 nt, Leptospira interrogans serovar lai str. 56601
cuauuuucuuugaaaaaauu

SEQ ID NO: 748094 - RNA, 21 nt, Leptospira interrogans serovar lai str. 56601
cuauuuuugagaugauuuaua

SEQ ID NO: 748095 - RNA, 17 nt, Leptospira interrogans serovar lai str. 56601
cuauuuuguuuuauaga

SEQ ID NO: 748096 - RNA, 17 nt, Leptospira interrogans serovar lai str. 56601
cucaaagauuacauaau

SEQ ID NO: 748097 - RNA, 21 nt, Leptospira interrogans serovar lai str. 56601
cucaaaaaauuuuacgcaauc

SEQ ID NO: 748098 - RNA, 14 nt, Leptospira interrogans serovar lai str. 56601
cucaaaaaauuuuu

SEQ ID NO: 748099 - RNA, 13 nt, Leptospira interrogans serovar lai str. 56601
cuauuuuuuuaaa

SEQ ID NO: 748100 - RNA, 17 nt, Leptospira interrogans serovar lai str. 56601
cuauuuuuuuaaaaaau

SEQ ID NO: 748101 - RNA, 18 nt, Leptospira interrogans serovar lai str. 56601
cuauuuuuuuaaaaaauu

SEQ ID NO: 748102 - RNA, 17 nt, Leptospira interrogans serovar lai str. 56601
cucaaugcaucucuucu

SEQ ID NO: 748103 - RNA, 15 nt, Leptospira interrogans serovar lai str. 56601
cucaauucaguaaau

SEQ ID NO: 748104 - RNA, 23 nt, Leptospira interrogans serovar lai str. 56601
cucaauuuugaagacuauaaaac

SEQ ID NO: 748105 - RNA, 16 nt, Leptospira interrogans serovar lai str. 56601
cucaccaacaacacca

SEQ ID NO: 748106 - RNA, 15 nt, Leptospira interrogans serovar lai str. 56601
cucacauuauuuaau

SEQ ID NO: 748107 - RNA, 20 nt, Leptospira interrogans serovar lai str. 56601
cucacauuauuuaaugaauc

SEQ ID NO: 748108 - RNA, 18 nt, Leptospira interrogans serovar lai str. 56601
cucaagguuucacuuuuu

SEQ ID NO: 748109 - RNA, 16 nt, Leptospira interrogans serovar lai str. 56601
cucaaguaaaacguag

SEQ ID NO: 748110 - RNA, 16 nt, Leptospira interrogans serovar lai str. 56601
cucaauccaauauuua

SEQ ID NO: 748111 - RNA, 23 nt, Leptospira interrogans serovar lai str. 56601
cuauaauuuccggaauaucagga

SEQ ID NO: 748112 - RNA, 14 nt, Leptospira interrogans serovar lai str. 56601
cuauaauuaauaaa

SEQ ID NO: 748113 - RNA, 15 nt, Leptospira interrogans serovar lai str. 56601
cuauaauuaauaaaa

SEQ ID NO: 748114 - RNA, 18 nt, Leptospira interrogans serovar lai str. 56601
cuauaacuuuaaaaaaua

SEQ ID NO: 748115 - RNA, 19 nt, Leptospira interrogans serovar lai str. 56601
cuauaacuuuaaaaaauaa

SEQ ID NO: 748116 - RNA, 14 nt, Leptospira interrogans serovar lai str. 56601
cuauaauaacaaaa

SEQ ID NO: 748117 - RNA, 17 nt, Leptospira interrogans serovar lai str. 56601
cuauaauaagauuuguu

SEQ ID NO: 748118 - RNA, 17 nt, Leptospira interrogans serovar lai str. 56601
cuauacuuucaaaaaau

SEQ ID NO: 748119 - RNA, 23 nt, Leptospira interrogans serovar lai str. 56601
cuaggauuuuauauauauuuuga

SEQ ID NO: 748120 - RNA, 18 nt, Leptospira interrogans serovar lai str. 56601
cuaggcauaugaaaauaa

SEQ ID NO: 748121 - RNA, 22 nt, Leptospira interrogans serovar lai str. 56601
cuaggaacugcuuccaaaaaaa

SEQ ID NO: 748122 - RNA, 19 nt, Leptospira interrogans serovar lai str. 56601
cuaggauauuugauauaau

SEQ ID NO: 748123 - RNA, 18 nt, Leptospira interrogans serovar lai str. 56601
cuauaaaugaauuuuaaa

SEQ ID NO: 748124 - RNA, 20 nt, Leptospira interrogans serovar lai str. 56601
cuauaaauuacugauuucaa

SEQ ID NO: 748125 - RNA, 12 nt, Leptospira interrogans serovar lai str. 56601
cuauaaacucaa

SEQ ID NO: 748126 - RNA, 18 nt, Leptospira interrogans serovar lai str. 56601
cuauaaacuucucuuaaa

SEQ ID NO: 748127 - RNA, 14 nt, Leptospira interrogans serovar lai str. 56601
cuauaaauucauaa

SEQ ID NO: 748128 - RNA, 21 nt, Leptospira interrogans serovar lai str. 56601
cuauaaauucaucuaaaaaaa

SEQ ID NO: 748129 - RNA, 20 nt, Leptospira interrogans serovar lai str. 56601
cuauaaauugcaucaaagaa

SEQ ID NO: 748130 - RNA, 21 nt, Leptospira interrogans serovar lai str. 56601
cuauaaaccaucucaaaaaca

SEQ ID NO: 748131 - RNA, 12 nt, Leptospira interrogans serovar lai str. 56601
cuauaaaauuga

SEQ ID NO: 748132 - RNA, 22 nt, Leptospira interrogans serovar lai str. 56601
cuauaaaaucgggauuuguggg

SEQ ID NO: 748133 - RNA, 16 nt, Leptospira interrogans serovar lai str. 56601
cuauaaaaucuaaaaa

SEQ ID NO: 748134 - RNA, 19 nt, Leptospira interrogans serovar lai str. 56601
cuauaaaaucuaaaaaaaa

SEQ ID NO: 748135 - RNA, 19 nt, Leptospira interrogans serovar lai str. 56601
cuauaaaaucuaaaaaaac

SEQ ID NO: 748136 - RNA, 18 nt, Leptospira interrogans serovar lai str. 56601
cuauaaaaucuaaaaaga

SEQ ID NO: 748137 - RNA, 19 nt, Leptospira interrogans serovar lai str. 56601
cuauaaaaucuaaaaagaa

SEQ ID NO: 748138 - RNA, 18 nt, Leptospira interrogans serovar lai str. 56601
cuauaaaauaucuuuaau

SEQ ID NO: 748139 - RNA, 14 nt, Leptospira interrogans serovar lai str. 56601
cuauaaaauucaaa

SEQ ID NO: 748140 - RNA, 19 nt, Leptospira interrogans serovar lai str. 56601
cuauaaaauucaaaaagaa

SEQ ID NO: 748141 - RNA, 16 nt, Leptospira interrogans serovar lai str. 56601
cuauggaauauaaaag

SEQ ID NO: 748142 - RNA, 14 nt, Leptospira interrogans serovar lai str. 56601
cuaucuuguuucug

SEQ ID NO: 748143 - RNA, 20 nt, Leptospira interrogans serovar lai str. 56601
cuaugaaauacaaaaagaau

SEQ ID NO: 748144 - RNA, 20 nt, Leptospira interrogans serovar lai str. 56601
cuaugaaaauuuaauuuuua

SEQ ID NO: 748145 - RNA, 18 nt, Leptospira interrogans serovar lai str. 56601
cuaugaaacgaaauauau

SEQ ID NO: 748146 - RNA, 17 nt, Leptospira interrogans serovar lai str. 56601
cuaugaagagguacaga

SEQ ID NO: 748147 - RNA, 18 nt, Leptospira interrogans serovar lai str. 56601
cuauauauugaaauauua

SEQ ID NO: 748148 - RNA, 18 nt, Leptospira interrogans serovar lai str. 56601
cuauauauccuuaugaaa

SEQ ID NO: 748149 - RNA, 13 nt, Leptospira interrogans serovar lai str. 56601
cuauauaauaucu

SEQ ID NO: 748150 - RNA, 14 nt, Leptospira interrogans serovar lai str. 56601
cuaucgcaaauaau

SEQ ID NO: 748151 - RNA, 20 nt, Leptospira interrogans serovar lai str. 56601
cuagauauuucaagaauuuu

SEQ ID NO: 748152 - RNA, 20 nt, Leptospira interrogans serovar lai str. 56601
cuagauagguucuuagaacu

SEQ ID NO: 748153 - RNA, 13 nt, Leptospira interrogans serovar lai str. 56601
cuacuaggaaaau

SEQ ID NO: 748154 - RNA, 23 nt, Leptospira interrogans serovar lai str. 56601
cuacuaggaaaauuuaacaacau

SEQ ID NO: 748155 - RNA, 21 nt, Leptospira interrogans serovar lai str. 56601
cuacuaaaucucaauucagua

SEQ ID NO: 748156 - RNA, 19 nt, Leptospira interrogans serovar lai str. 56601
cuacuaagauuucuuguuu

SEQ ID NO: 748157 - RNA, 11 nt, Leptospira interrogans serovar lai str. 56601
cuacuaaucuc

SEQ ID NO: 748158 - RNA, 19 nt, Leptospira interrogans serovar lai str. 56601
cuacuaaucucuauaaaag

SEQ ID NO: 748159 - RNA, 20 nt, Leptospira interrogans serovar lai str. 56601
cuacguuucaauuacuuucg

SEQ ID NO: 748160 - RNA, 22 nt, Leptospira interrogans serovar lai str. 56601
cuagaacaauaaccuucggguu

SEQ ID NO: 748161 - RNA, 20 nt, Leptospira interrogans serovar lai str. 56601
cuagaaauguaggaacucau

SEQ ID NO: 748162 - RNA, 19 nt, Leptospira interrogans serovar lai str. 56601
cuagaaccuggaaaagaau

SEQ ID NO: 748163 - RNA, 22 nt, Leptospira interrogans serovar lai str. 56601
cuagaaagaauuuaauaaaaaa

SEQ ID NO: 748164 - RNA, 12 nt, Leptospira interrogans serovar lai str. 56601
cuagaagaguuu

SEQ ID NO: 748165 - RNA, 15 nt, Leptospira interrogans serovar lai str. 56601
cuacgacuaacaaaa

SEQ ID NO: 748166 - RNA, 12 nt, Leptospira interrogans serovar lai str. 56601
cuacggaaggaa

SEQ ID NO: 748167 - RNA, 16 nt, Leptospira interrogans serovar lai str. 56601
cuaaguuuuacagaag

SEQ ID NO: 748168 - RNA, 20 nt, Leptospira interrogans serovar lai str. 56601
cuaaguuuuacagaggauuu

SEQ ID NO: 748169 - RNA, 16 nt, Leptospira interrogans serovar lai str. 56601
cuaauagagaaaaauu

SEQ ID NO: 748170 - RNA, 21 nt, Leptospira interrogans serovar lai str. 56601
cuaauacggauaaccaaaaac

SEQ ID NO: 748171 - RNA, 20 nt, Leptospira interrogans serovar lai str. 56601
cuaauagccgcuauggaagg

SEQ ID NO: 748172 - RNA, 14 nt, Leptospira interrogans serovar lai str. 56601
cuaauauaaaaucu

SEQ ID NO: 748173 - RNA, 14 nt, Leptospira interrogans serovar lai str. 56601
cucguuuuuaggau

SEQ ID NO: 748174 - RNA, 15 nt, Leptospira interrogans serovar lai str. 56601
cucguuuuuaggauu

SEQ ID NO: 748175 - RNA, 12 nt, Leptospira interrogans serovar lai str. 56601
cucuaaaucuua

SEQ ID NO: 748176 - RNA, 17 nt, Leptospira interrogans serovar lai str. 56601
cucuacgguuaucaaua

SEQ ID NO: 748177 - RNA, 14 nt, Leptospira interrogans serovar lai str. 56601
cucgucuaucuuuu

SEQ ID NO: 748178 - RNA, 14 nt, Leptospira interrogans serovar lai str. 56601
cucgucuuuauaaa

SEQ ID NO: 748179 - RNA, 22 nt, Leptospira interrogans serovar lai str. 56601
cucgcguucauaucccaauaag

SEQ ID NO: 748180 - RNA, 19 nt, Leptospira interrogans serovar lai str. 56601
cucgccauuaucgaacagu

SEQ ID NO: 748181 - RNA, 16 nt, Leptospira interrogans serovar lai str. 56601
cuccugcauccacaaa

SEQ ID NO: 748182 - RNA, 20 nt, Leptospira interrogans serovar lai str. 56601
cucgacaaucaaaacuuuuu

SEQ ID NO: 748183 - RNA, 22 nt, Leptospira interrogans serovar lai str. 56601
cuccgaaaguaaauggauaaau

SEQ ID NO: 748184 - RNA, 17 nt, Leptospira interrogans serovar lai str. 56601
cucccuuaccuccuuuu

SEQ ID NO: 748185 - RNA, 12 nt, Leptospira interrogans serovar lai str. 56601
cucccacaauuu

SEQ ID NO: 748186 - RNA, 20 nt, Leptospira interrogans serovar lai str. 56601
cuccauuaggugcuacugca

SEQ ID NO: 748187 - RNA, 15 nt, Leptospira interrogans serovar lai str. 56601
cuccauucuuacucc

SEQ ID NO: 748188 - RNA, 14 nt, Leptospira interrogans serovar lai str. 56601
cuccuaaaauaaaa

SEQ ID NO: 748189 - RNA, 14 nt, Leptospira interrogans serovar lai str. 56601
cuccuauguuucuu

SEQ ID NO: 748190 - RNA, 20 nt, Leptospira interrogans serovar lai str. 56601
cuccuauguuucuuguguca

SEQ ID NO: 748191 - RNA, 16 nt, Leptospira interrogans serovar lai str. 56601
cuccacuauggaauuu

SEQ ID NO: 748192 - RNA, 17 nt, Leptospira interrogans serovar lai str. 56601
cuccacuauggaauuuu

SEQ ID NO: 748193 - RNA, 11 nt, Leptospira interrogans serovar lai str. 56601
cucauuuccau

SEQ ID NO: 748194 - RNA, 19 nt, Leptospira interrogans serovar lai str. 56601
cucauuuccauaacagaau

SEQ ID NO: 748195 - RNA, 13 nt, Leptospira interrogans serovar lai str. 56601
cucauuuuucuua

SEQ ID NO: 748196 - RNA, 13 nt, Leptospira interrogans serovar lai str. 56601
cuccaaaaaaaua

SEQ ID NO: 748197 - RNA, 14 nt, Leptospira interrogans serovar lai str. 56601
cuccaaaaaaauaa

SEQ ID NO: 748198 - RNA, 19 nt, Leptospira interrogans serovar lai str. 56601
cuccaaaaggcacauuuuu

SEQ ID NO: 748199 - RNA, 12 nt, Leptospira interrogans serovar lai str. 56601
cuccaucuguuu

SEQ ID NO: 748200 - RNA, 16 nt, Leptospira interrogans serovar lai str. 56601
cuccaucuguuuucuu

SEQ ID NO: 748201 - RNA, 17 nt, Leptospira interrogans serovar lai str. 56601
cuccaucuuuuuuuucu

SEQ ID NO: 748202 - RNA, 23 nt, Leptospira interrogans serovar lai str. 56601
cuccaucuuuuuuuucuaaaaua

SEQ ID NO: 748203 - RNA, 14 nt, Leptospira interrogans serovar lai str. 56601
cugauauuuuaaau

SEQ ID NO: 748204 - RNA, 17 nt, Leptospira interrogans serovar lai str. 56601
cugauauuuuaaauuga

SEQ ID NO: 748205 - RNA, 22 nt, Leptospira interrogans serovar lai str. 56601
cugauauaauucguuugaacuc

SEQ ID NO: 748206 - RNA, 15 nt, Leptospira interrogans serovar lai str. 56601
cugauaauuuuuuaa

SEQ ID NO: 748207 - RNA, 21 nt, Leptospira interrogans serovar lai str. 56601
cugauaauuuuuuaaaaaaau

SEQ ID NO: 748208 - RNA, 22 nt, Leptospira interrogans serovar lai str. 56601
cugauaaauuccguaaaauuca

SEQ ID NO: 748209 - RNA, 20 nt, Leptospira interrogans serovar lai str. 56601
cugauaaauuucauaucuaa

SEQ ID NO: 748210 - RNA, 22 nt, Leptospira interrogans serovar lai str. 56601
cugauaaauuucauaucuaaaa

SEQ ID NO: 748211 - RNA, 15 nt, Leptospira interrogans serovar lai str. 56601
cugagucuagaauuc

SEQ ID NO: 748212 - RNA, 15 nt, Leptospira interrogans serovar lai str. 56601
cugaguuugagagag

SEQ ID NO: 748213 - RNA, 11 nt, Leptospira interrogans serovar lai str. 56601
cugaguuucaa

SEQ ID NO: 748214 - RNA, 14 nt, Leptospira interrogans serovar lai str. 56601
cugaguaguaaguu

SEQ ID NO: 748215 - RNA, 16 nt, Leptospira interrogans serovar lai str. 56601
cucuauguaagaaaau

SEQ ID NO: 748216 - RNA, 19 nt, Leptospira interrogans serovar lai str. 56601
cucuauucauaaaugauaa

SEQ ID NO: 748217 - RNA, 22 nt, Leptospira interrogans serovar lai str. 56601
cucuauucauaaaugauaauaa

SEQ ID NO: 748218 - RNA, 13 nt, Leptospira interrogans serovar lai str. 56601
cucuauggaauuu

SEQ ID NO: 748219 - RNA, 18 nt, Leptospira interrogans serovar lai str. 56601
cucuaucagaaaaacaua

SEQ ID NO: 748220 - RNA, 20 nt, Leptospira interrogans serovar lai str. 56601
cugcaauucgcauuaaaauu

SEQ ID NO: 748221 - RNA, 21 nt, Leptospira interrogans serovar lai str. 56601
cugcaauaguuucuacauuuu

SEQ ID NO: 748222 - RNA, 15 nt, Leptospira interrogans serovar lai str. 56601
cugauuuaauuauuu

SEQ ID NO: 748223 - RNA, 15 nt, Leptospira interrogans serovar lai str. 56601
cugcaaaguucugaa

SEQ ID NO: 748224 - RNA, 14 nt, Leptospira interrogans serovar lai str. 56601
cugauugagaaaau

SEQ ID NO: 748225 - RNA, 21 nt, Leptospira interrogans serovar lai str. 56601
cugauugagaaaauaaaaaau

SEQ ID NO: 748226 - RNA, 15 nt, Leptospira interrogans serovar lai str. 56601
cugccgcucuuucuu

SEQ ID NO: 748227 - RNA, 23 nt, Leptospira interrogans serovar lai str. 56601
cugccuaugccccauucuuuuug

SEQ ID NO: 748228 - RNA, 20 nt, Leptospira interrogans serovar lai str. 56601
cuggggacuuuauuuuauaa

SEQ ID NO: 748229 - RNA, 14 nt, Leptospira interrogans serovar lai str. 56601
cugucaauuuucca

SEQ ID NO: 748230 - RNA, 21 nt, Leptospira interrogans serovar lai str. 56601
cugucauaaaccgauuuuccc

SEQ ID NO: 748231 - RNA, 15 nt, Leptospira interrogans serovar lai str. 56601
cuguauuuuuaaguu

SEQ ID NO: 748232 - RNA, 23 nt, Leptospira interrogans serovar lai str. 56601
cugucaagcgacgauagaagcga

SEQ ID NO: 748233 - RNA, 16 nt, Leptospira interrogans serovar lai str. 56601
cuguaaaacuuaguuc

SEQ ID NO: 748234 - RNA, 18 nt, Leptospira interrogans serovar lai str. 56601
cuguaaaacuuaguuccc

SEQ ID NO: 748235 - RNA, 13 nt, Leptospira interrogans serovar lai str. 56601
cuguaaaagaaaa

SEQ ID NO: 748236 - RNA, 14 nt, Leptospira interrogans serovar lai str. 56601
cuguaaaagaaaaa

SEQ ID NO: 748237 - RNA, 18 nt, Leptospira interrogans serovar lai str. 56601
cuguaaaauaaauuuaua

SEQ ID NO: 748238 - RNA, 19 nt, Leptospira interrogans serovar lai str. 56601
cuguaaaauaaauuuauaa

SEQ ID NO: 748239 - RNA, 23 nt, Leptospira interrogans serovar lai str. 56601
cuguaaaauaaauuuauaauuca

SEQ ID NO: 748240 - RNA, 22 nt, Leptospira interrogans serovar lai str. 56601
cuguaaaaugaugugggaacuc

SEQ ID NO: 748241 - RNA, 15 nt, Leptospira interrogans serovar lai str. 56601
cugguuuuauuucug

SEQ ID NO: 748242 - RNA, 17 nt, Leptospira interrogans serovar lai str. 56601
cugguuuuauuucugcu

SEQ ID NO: 748243 - RNA, 21 nt, Leptospira interrogans serovar lai str. 56601
cuguaaauucaaaauaagaaa

SEQ ID NO: 748244 - RNA, 22 nt, Leptospira interrogans serovar lai str. 56601
cuguaaaguuuagauuuuaacu

SEQ ID NO: 748245 - RNA, 17 nt, Leptospira interrogans serovar lai str. 56601
cuguaaauacaaaauga

SEQ ID NO: 748246 - RNA, 19 nt, Leptospira interrogans serovar lai str. 56601
cuguaacauccaaacucuu

SEQ ID NO: 748247 - RNA, 14 nt, Leptospira interrogans serovar lai str. 56601
cuguaguauuucca

SEQ ID NO: 748248 - RNA, 16 nt, Leptospira interrogans serovar lai str. 56601
cuguaguuuauuuuuc

SEQ ID NO: 748249 - RNA, 17 nt, Leptospira interrogans serovar lai str. 56601
cuggaauauucuuuuua

SEQ ID NO: 748250 - RNA, 14 nt, Leptospira interrogans serovar lai str. 56601
cuggaagccaaaac

SEQ ID NO: 748251 - RNA, 13 nt, Leptospira interrogans serovar lai str. 56601
cuggaauucuuuu

SEQ ID NO: 748252 - RNA, 15 nt, Leptospira interrogans serovar lai str. 56601
cuggaauucuuuuuu

SEQ ID NO: 748253 - RNA, 16 nt, Leptospira interrogans serovar lai str. 56601
cuggacggucguuuuc

SEQ ID NO: 748254 - RNA, 16 nt, Leptospira interrogans serovar lai str. 56601
cugcucauuuuuucuu

SEQ ID NO: 748255 - RNA, 14 nt, Leptospira interrogans serovar lai str. 56601
cugcuauaauuuaa

SEQ ID NO: 748256 - RNA, 12 nt, Leptospira interrogans serovar lai str. 56601
cuggaaaagaau

SEQ ID NO: 748257 - RNA, 18 nt, Leptospira interrogans serovar lai str. 56601
cuggaaaaguuuuuaaaa

SEQ ID NO: 748258 - RNA, 13 nt, Leptospira interrogans serovar lai str. 56601
cuggaaaaauucc

SEQ ID NO: 748259 - RNA, 12 nt, Leptospira interrogans serovar lai str. 56601
cuuaaaagugau

SEQ ID NO: 748260 - RNA, 15 nt, Leptospira interrogans serovar lai str. 56601
cuuaaaaugugggaa

SEQ ID NO: 748261 - RNA, 17 nt, Leptospira interrogans serovar lai str. 56601
cuuaaaauuugaaaaga

SEQ ID NO: 748262 - RNA, 11 nt, Leptospira interrogans serovar lai str. 56601
cuuaaaaauac

SEQ ID NO: 748263 - RNA, 23 nt, Leptospira interrogans serovar lai str. 56601
cuuaaaaaugagucuuuacucua

SEQ ID NO: 748264 - RNA, 14 nt, Leptospira interrogans serovar lai str. 56601
cuuaaaaauuuaua

SEQ ID NO: 748265 - RNA, 18 nt, Leptospira interrogans serovar lai str. 56601
cuuaaaagaagauuuuuc

SEQ ID NO: 748266 - RNA, 19 nt, Leptospira interrogans serovar lai str. 56601
cuuaaaagaagauuuuucu

SEQ ID NO: 748267 - RNA, 12 nt, Leptospira interrogans serovar lai str. 56601
cuuaaaacugua

SEQ ID NO: 748268 - RNA, 14 nt, Leptospira interrogans serovar lai str. 56601
cuuaaaaaauauuu

SEQ ID NO: 748269 - RNA, 13 nt, Leptospira interrogans serovar lai str. 56601
cuguuuuugaaac

SEQ ID NO: 748270 - RNA, 12 nt, Leptospira interrogans serovar lai str. 56601
cuuaaaaaaauu

SEQ ID NO: 748271 - RNA, 13 nt, Leptospira interrogans serovar lai str. 56601
cuuaaaaaaauug

SEQ ID NO: 748272 - RNA, 22 nt, Leptospira interrogans serovar lai str. 56601
cuguuuccaguguccauuucaa

SEQ ID NO: 748273 - RNA, 15 nt, Leptospira interrogans serovar lai str. 56601
cuguuuuaauuugua

SEQ ID NO: 748274 - RNA, 22 nt, Leptospira interrogans serovar lai str. 56601
cuguuuucuuugaauugaaaug

SEQ ID NO: 748275 - RNA, 14 nt, Leptospira interrogans serovar lai str. 56601
cuguugaaaaaauc

SEQ ID NO: 748276 - RNA, 20 nt, Leptospira interrogans serovar lai str. 56601
cugucucuuuauauaaaauu

SEQ ID NO: 748277 - RNA, 18 nt, Leptospira interrogans serovar lai str. 56601
cuguuguuaaauuuuugu

SEQ ID NO: 748278 - RNA, 16 nt, Leptospira interrogans serovar lai str. 56601
cuuacaauaaaaacuu

SEQ ID NO: 748279 - RNA, 20 nt, Leptospira interrogans serovar lai str. 56601
cuuacaauuuuagaauuugu

SEQ ID NO: 748280 - RNA, 19 nt, Leptospira interrogans serovar lai str. 56601
cuuaauuucucuuauuaga

SEQ ID NO: 748281 - RNA, 21 nt, Leptospira interrogans serovar lai str. 56601
cuuaauuucucuuauuagaac

SEQ ID NO: 748282 - RNA, 22 nt, Leptospira interrogans serovar lai str. 56601
cuuacaaagugaugaagagaaa

SEQ ID NO: 748283 - RNA, 17 nt, Leptospira interrogans serovar lai str. 56601
cuuaauuuuacuauaaa

SEQ ID NO: 748284 - RNA, 19 nt, Leptospira interrogans serovar lai str. 56601
cuuacaaacuccgugaacu

SEQ ID NO: 748285 - RNA, 18 nt, Leptospira interrogans serovar lai str. 56601
cuuacaaagcacuuuuuu

SEQ ID NO: 748286 - RNA, 19 nt, Leptospira interrogans serovar lai str. 56601
cuuacaaagcacuuuuuuc

SEQ ID NO: 748287 - RNA, 21 nt, Leptospira interrogans serovar lai str. 56601
cuuacaaagcacuuuuuuccu

SEQ ID NO: 748288 - RNA, 16 nt, Leptospira interrogans serovar lai str. 56601
cuuaccuccuuuuuca

SEQ ID NO: 748289 - RNA, 16 nt, Leptospira interrogans serovar lai str. 56601
cuuaccucuauaaaau

SEQ ID NO: 748290 - RNA, 14 nt, Leptospira interrogans serovar lai str. 56601
cuuaauuaaaaaau

SEQ ID NO: 748291 - RNA, 22 nt, Leptospira interrogans serovar lai str. 56601
cuuaaagcauuaaaaaagauaa

SEQ ID NO: 748292 - RNA, 13 nt, Leptospira interrogans serovar lai str. 56601
cuuaaauauaucu

SEQ ID NO: 748293 - RNA, 23 nt, Leptospira interrogans serovar lai str. 56601
cuuaaauaucgaauuucuucaua

SEQ ID NO: 748294 - RNA, 15 nt, Leptospira interrogans serovar lai str. 56601
cuuaauauaauaauu

SEQ ID NO: 748295 - RNA, 12 nt, Leptospira interrogans serovar lai str. 56601
cuuaucaaauag

SEQ ID NO: 748296 - RNA, 12 nt, Leptospira interrogans serovar lai str. 56601
cuuauauaaaag

SEQ ID NO: 748297 - RNA, 20 nt, Leptospira interrogans serovar lai str. 56601
cuuagccccaguaaauaaac

SEQ ID NO: 748298 - RNA, 22 nt, Leptospira interrogans serovar lai str. 56601
cuuagaugaacuuuuuuauaua

SEQ ID NO: 748299 - RNA, 18 nt, Leptospira interrogans serovar lai str. 56601
cuuagauucacuuuugcu

SEQ ID NO: 748300 - RNA, 19 nt, Leptospira interrogans serovar lai str. 56601
cuuagauucgaguccuuuu

SEQ ID NO: 748301 - RNA, 19 nt, Leptospira interrogans serovar lai str. 56601
cuuagaguuguccuaaaac

SEQ ID NO: 748302 - RNA, 22 nt, Leptospira interrogans serovar lai str. 56601
cuuagaguuguccuaaaaccuc

SEQ ID NO: 748303 - RNA, 14 nt, Leptospira interrogans serovar lai str. 56601
cuuacuaugaaguc

SEQ ID NO: 748304 - RNA, 17 nt, Leptospira interrogans serovar lai str. 56601
cuuacuaugaagucuua

SEQ ID NO: 748305 - RNA, 19 nt, Leptospira interrogans serovar lai str. 56601
cuuacugauuucuauaaaa

SEQ ID NO: 748306 - RNA, 18 nt, Leptospira interrogans serovar lai str. 56601
cuuauguggaugauaaaa

SEQ ID NO: 748307 - RNA, 15 nt, Leptospira interrogans serovar lai str. 56601
cuucagccgcuucau

SEQ ID NO: 748308 - RNA, 16 nt, Leptospira interrogans serovar lai str. 56601
cuucauaucaaauuca

SEQ ID NO: 748309 - RNA, 21 nt, Leptospira interrogans serovar lai str. 56601
cuucaucaaugguuuuucuuc

SEQ ID NO: 748310 - RNA, 23 nt, Leptospira interrogans serovar lai str. 56601
cuucgauuaucgguuucaucuuu

SEQ ID NO: 748311 - RNA, 17 nt, Leptospira interrogans serovar lai str. 56601
cuuccugauuuggaauc

SEQ ID NO: 748312 - RNA, 24 nt, Leptospira interrogans serovar lai str. 56601
cuuccugauuuggaaucugcaucu

SEQ ID NO: 748313 - RNA, 15 nt, Leptospira interrogans serovar lai str. 56601
cuuccggaagaacaa

SEQ ID NO: 748314 - RNA, 17 nt, Leptospira interrogans serovar lai str. 56601
cuucgcauaacaaaaau

SEQ ID NO: 748315 - RNA, 14 nt, Leptospira interrogans serovar lai str. 56601
cuucgccuauuuuu

SEQ ID NO: 748316 - RNA, 23 nt, Leptospira interrogans serovar lai str. 56601
cuucccagacguaucaaaauagu

SEQ ID NO: 748317 - RNA, 19 nt, Leptospira interrogans serovar lai str. 56601
cuuccauucaacuuagaac

SEQ ID NO: 748318 - RNA, 20 nt, Leptospira interrogans serovar lai str. 56601
cuuccauuggauucugcucu

SEQ ID NO: 748319 - RNA, 14 nt, Leptospira interrogans serovar lai str. 56601
cuuccgaucccaac

SEQ ID NO: 748320 - RNA, 15 nt, Leptospira interrogans serovar lai str. 56601
cuucauuaaacaauu

SEQ ID NO: 748321 - RNA, 23 nt, Leptospira interrogans serovar lai str. 56601
cuucauuaaacaauuuuucaaga

SEQ ID NO: 748322 - RNA, 12 nt, Leptospira interrogans serovar lai str. 56601
cuucauuuccaa

SEQ ID NO: 748323 - RNA, 18 nt, Leptospira interrogans serovar lai str. 56601
cuucauucggcuuuaagu

SEQ ID NO: 748324 - RNA, 14 nt, Leptospira interrogans serovar lai str. 56601
cuuucgcauuuguu

SEQ ID NO: 748325 - RNA, 15 nt, Leptospira interrogans serovar lai str. 56601
cuuucgcauuuguug

SEQ ID NO: 748326 - RNA, 18 nt, Leptospira interrogans serovar lai str. 56601
cuuucgauuuuaaauaaa

SEQ ID NO: 748327 - RNA, 19 nt, Leptospira interrogans serovar lai str. 56601
cuuucgauuuuaaauaaaa

SEQ ID NO: 748328 - RNA, 18 nt, Leptospira interrogans serovar lai str. 56601
cuuucgaccuuaacucuu

SEQ ID NO: 748329 - RNA, 16 nt, Leptospira interrogans serovar lai str. 56601
cuuuccuugaaaaaaa

SEQ ID NO: 748330 - RNA, 21 nt, Leptospira interrogans serovar lai str. 56601
cuuuccuuuucgaauuuccuu

SEQ ID NO: 748331 - RNA, 15 nt, Leptospira interrogans serovar lai str. 56601
cuuucucuuuuuaga

SEQ ID NO: 748332 - RNA, 21 nt, Leptospira interrogans serovar lai str. 56601
cuuucucuuuuuagacaaaaa

SEQ ID NO: 748333 - RNA, 15 nt, Leptospira interrogans serovar lai str. 56601
cuuucugaaauaaaa

SEQ ID NO: 748334 - RNA, 17 nt, Leptospira interrogans serovar lai str. 56601
cuuucaucuacauaaaa

SEQ ID NO: 748335 - RNA, 16 nt, Leptospira interrogans serovar lai str. 56601
cuuucauaggaugaau

SEQ ID NO: 748336 - RNA, 16 nt, Leptospira interrogans serovar lai str. 56601
cuuuauuaaauuauau

SEQ ID NO: 748337 - RNA, 19 nt, Leptospira interrogans serovar lai str. 56601
cuuuauuaaauuauauuuu

SEQ ID NO: 748338 - RNA, 16 nt, Leptospira interrogans serovar lai str. 56601
cuuuauuccuuuucuu

SEQ ID NO: 748339 - RNA, 23 nt, Leptospira interrogans serovar lai str. 56601
cuuuauucaaaauagaauaaauu

SEQ ID NO: 748340 - RNA, 15 nt, Leptospira interrogans serovar lai str. 56601
cuuuauuaaaaaguu

SEQ ID NO: 748341 - RNA, 16 nt, Leptospira interrogans serovar lai str. 56601
cuuucacaucuccacu

SEQ ID NO: 748342 - RNA, 17 nt, Leptospira interrogans serovar lai str. 56601
cuuucaccagaauuuag

SEQ ID NO: 748343 - RNA, 21 nt, Leptospira interrogans serovar lai str. 56601
cuuuauagguucuggauuuaa

SEQ ID NO: 748344 - RNA, 15 nt, Leptospira interrogans serovar lai str. 56601
cuuuauauaaaauuu

SEQ ID NO: 748345 - RNA, 13 nt, Leptospira interrogans serovar lai str. 56601
cuuuauauugguu

SEQ ID NO: 748346 - RNA, 22 nt, Leptospira interrogans serovar lai str. 56601
cuuuaccggguuccauucuaag

SEQ ID NO: 748347 - RNA, 13 nt, Leptospira interrogans serovar lai str. 56601
cuuuauagaauuc

SEQ ID NO: 748348 - RNA, 17 nt, Leptospira interrogans serovar lai str. 56601
cuuuauagaucgauucu

SEQ ID NO: 748349 - RNA, 21 nt, Leptospira interrogans serovar lai str. 56601
cuuuauagaaaauuuuuucuc

SEQ ID NO: 748350 - RNA, 12 nt, Leptospira interrogans serovar lai str. 56601
cuuuaauauuuu

SEQ ID NO: 748351 - RNA, 21 nt, Leptospira interrogans serovar lai str. 56601
cuuuaaugagucugucccaaa

SEQ ID NO: 748352 - RNA, 14 nt, Leptospira interrogans serovar lai str. 56601
cuuuaaucauuuuc

SEQ ID NO: 748353 - RNA, 19 nt, Leptospira interrogans serovar lai str. 56601
cuuuaccauaaauuuuuug

SEQ ID NO: 748354 - RNA, 19 nt, Leptospira interrogans serovar lai str. 56601
cuuuaccgucaauuuuuag

SEQ ID NO: 748355 - RNA, 20 nt, Leptospira interrogans serovar lai str. 56601
cuuuaccgucaauuuuuagu

SEQ ID NO: 748356 - RNA, 11 nt, Leptospira interrogans serovar lai str. 56601
cuugucccaaa

SEQ ID NO: 748357 - RNA, 18 nt, Leptospira interrogans serovar lai str. 56601
cuugucccaaaaacucaa

SEQ ID NO: 748358 - RNA, 13 nt, Leptospira interrogans serovar lai str. 56601
cuugucccaaaau

SEQ ID NO: 748359 - RNA, 14 nt, Leptospira interrogans serovar lai str. 56601
cuugucccaaaauu

SEQ ID NO: 748360 - RNA, 17 nt, Leptospira interrogans serovar lai str. 56601
cuugucccaaaauuuua

SEQ ID NO: 748361 - RNA, 14 nt, Leptospira interrogans serovar lai str. 56601
cuugugagugaacu

SEQ ID NO: 748362 - RNA, 19 nt, Leptospira interrogans serovar lai str. 56601
cuugugagugaacuccauu

SEQ ID NO: 748363 - RNA, 15 nt, Leptospira interrogans serovar lai str. 56601
cuuguguuucagacu

SEQ ID NO: 748364 - RNA, 15 nt, Leptospira interrogans serovar lai str. 56601
cuugugucaagcccu

SEQ ID NO: 748365 - RNA, 16 nt, Leptospira interrogans serovar lai str. 56601
cuugugucaagcccuc

SEQ ID NO: 748366 - RNA, 16 nt, Leptospira interrogans serovar lai str. 56601
cuuuaaaaaauaucuu

SEQ ID NO: 748367 - RNA, 21 nt, Leptospira interrogans serovar lai str. 56601
cuuuaaaaaauuaguuuucuu

SEQ ID NO: 748368 - RNA, 16 nt, Leptospira interrogans serovar lai str. 56601
cuuuaaaauacuuuac

SEQ ID NO: 748369 - RNA, 18 nt, Leptospira interrogans serovar lai str. 56601
cuuuaaaguaaaauuaaa

SEQ ID NO: 748370 - RNA, 13 nt, Leptospira interrogans serovar lai str. 56601
cuuuaaaauuuuu

SEQ ID NO: 748371 - RNA, 19 nt, Leptospira interrogans serovar lai str. 56601
cuuuaaaauuuuuaauaaa

SEQ ID NO: 748372 - RNA, 16 nt, Leptospira interrogans serovar lai str. 56601
cuuuaaacuuucuucc

SEQ ID NO: 748373 - RNA, 15 nt, Leptospira interrogans serovar lai str. 56601
cuuuaaauacuuuau

SEQ ID NO: 748374 - RNA, 22 nt, Leptospira interrogans serovar lai str. 56601
cuuuaaauugaauucuuccuuc

SEQ ID NO: 748375 - RNA, 21 nt, Leptospira interrogans serovar lai str. 56601
cuuuaaaugugggaacuccca

SEQ ID NO: 748376 - RNA, 17 nt, Leptospira interrogans serovar lai str. 56601
cuuuaacaacaucugaa

SEQ ID NO: 748377 - RNA, 14 nt, Leptospira interrogans serovar lai str. 56601
cuuguuguaccauu

SEQ ID NO: 748378 - RNA, 13 nt, Leptospira interrogans serovar lai str. 56601
cuuguuuuuaaau

SEQ ID NO: 748379 - RNA, 15 nt, Leptospira interrogans serovar lai str. 56601
cuuguuuuuaaauua

SEQ ID NO: 748380 - RNA, 16 nt, Leptospira interrogans serovar lai str. 56601
cuuguuuuuaaauuaa

SEQ ID NO: 748381 - RNA, 21 nt, Leptospira interrogans serovar lai str. 56601
cuuguuucuguuugaugaaau

SEQ ID NO: 748382 - RNA, 21 nt, Leptospira interrogans serovar lai str. 56601
cuugaguguaaguuuuuaaau

SEQ ID NO: 748383 - RNA, 17 nt, Leptospira interrogans serovar lai str. 56601
cuugagggguuuuuccu

SEQ ID NO: 748384 - RNA, 19 nt, Leptospira interrogans serovar lai str. 56601
cuugagggguuuuuccuuu

SEQ ID NO: 748385 - RNA, 21 nt, Leptospira interrogans serovar lai str. 56601
cuugagggguuuuuccuuuua

SEQ ID NO: 748386 - RNA, 14 nt, Leptospira interrogans serovar lai str. 56601
cuugauuauuuucu

SEQ ID NO: 748387 - RNA, 12 nt, Leptospira interrogans serovar lai str. 56601
cuugaaacccca

SEQ ID NO: 748388 - RNA, 13 nt, Leptospira interrogans serovar lai str. 56601
cuucuuuuuugca

SEQ ID NO: 748389 - RNA, 19 nt, Leptospira interrogans serovar lai str. 56601
cuugaaaaaugugccuuuu

SEQ ID NO: 748390 - RNA, 13 nt, Leptospira interrogans serovar lai str. 56601
cuucuuuacaauu

SEQ ID NO: 748391 - RNA, 21 nt, Leptospira interrogans serovar lai str. 56601
cuucugaacguaguaguuccu

SEQ ID NO: 748392 - RNA, 14 nt, Leptospira interrogans serovar lai str. 56601
cuucucuuuuaaaa

SEQ ID NO: 748393 - RNA, 13 nt, Leptospira interrogans serovar lai str. 56601
cuucuggaaaaau

SEQ ID NO: 748394 - RNA, 20 nt, Leptospira interrogans serovar lai str. 56601
cuucuccucuuccggaagaa

SEQ ID NO: 748395 - RNA, 23 nt, Leptospira interrogans serovar lai str. 56601
cuucuccucuuccggaagaacaa

SEQ ID NO: 748396 - RNA, 15 nt, Leptospira interrogans serovar lai str. 56601
cuucuguaaaacuua

SEQ ID NO: 748397 - RNA, 17 nt, Leptospira interrogans serovar lai str. 56601
cuucuugcgcuaucuuc

SEQ ID NO: 748398 - RNA, 17 nt, Leptospira interrogans serovar lai str. 56601
cuucuugaaaggugauu

SEQ ID NO: 748399 - RNA, 18 nt, Leptospira interrogans serovar lai str. 56601
cuucuugaaauaaucgaa

SEQ ID NO: 748400 - RNA, 13 nt, Leptospira interrogans serovar lai str. 56601
gaacuuuuauaau

SEQ ID NO: 748401 - RNA, 18 nt, Leptospira interrogans serovar lai str. 56601
gaacuuguuccaaaacua

SEQ ID NO: 748402 - RNA, 21 nt, Leptospira interrogans serovar lai str. 56601
gaacuuuacagacugauuuuu

SEQ ID NO: 748403 - RNA, 19 nt, Leptospira interrogans serovar lai str. 56601
gaacuuuaccggguuccau

SEQ ID NO: 748404 - RNA, 23 nt, Leptospira interrogans serovar lai str. 56601
gaacuuucucgaaaaucucagaa

SEQ ID NO: 748405 - RNA, 14 nt, Leptospira interrogans serovar lai str. 56601
gaagaaaaaaagau

SEQ ID NO: 748406 - RNA, 15 nt, Leptospira interrogans serovar lai str. 56601
gaacuuuuuaucauu

SEQ ID NO: 748407 - RNA, 14 nt, Leptospira interrogans serovar lai str. 56601
gaagaaaaggcugu

SEQ ID NO: 748408 - RNA, 24 nt, Leptospira interrogans serovar lai str. 56601
gaagaaaaggcugucuucagcagu

SEQ ID NO: 748409 - RNA, 15 nt, Leptospira interrogans serovar lai str. 56601
gaagaagcuaaaauu

SEQ ID NO: 748410 - RNA, 16 nt, Leptospira interrogans serovar lai str. 56601
gaagaaugauaaaucu

SEQ ID NO: 748411 - RNA, 21 nt, Leptospira interrogans serovar lai str. 56601
gaagaauuauuuacuuuuucc

SEQ ID NO: 748412 - RNA, 16 nt, Leptospira interrogans serovar lai str. 56601
gaagaauccgaaaaac

SEQ ID NO: 748413 - RNA, 18 nt, Leptospira interrogans serovar lai str. 56601
gaagaauccgaaaaaccu

SEQ ID NO: 748414 - RNA, 24 nt, Leptospira interrogans serovar lai str. 56601
gaagacgcuuaaaaaugagucuuu

SEQ ID NO: 748415 - RNA, 19 nt, Leptospira interrogans serovar lai str. 56601
gaagauuuuucaaucuaac

SEQ ID NO: 748416 - RNA, 16 nt, Leptospira interrogans serovar lai str. 56601
gaagauuuuucuuuaa

SEQ ID NO: 748417 - RNA, 13 nt, Leptospira interrogans serovar lai str. 56601
gaagauuuguaaa

SEQ ID NO: 748418 - RNA, 18 nt, Leptospira interrogans serovar lai str. 56601
gaagcacaagcuuccuuu

SEQ ID NO: 748419 - RNA, 19 nt, Leptospira interrogans serovar lai str. 56601
gaagcacaagcuuccuuuu

SEQ ID NO: 748420 - RNA, 15 nt, Leptospira interrogans serovar lai str. 56601
gaagagucaaacacu

SEQ ID NO: 748421 - RNA, 13 nt, Leptospira interrogans serovar lai str. 56601
gaagauagauuua

SEQ ID NO: 748422 - RNA, 16 nt, Leptospira interrogans serovar lai str. 56601
gaagcaguuuuccccg

SEQ ID NO: 748423 - RNA, 21 nt, Leptospira interrogans serovar lai str. 56601
gaagccuuccaucaaauacaa

SEQ ID NO: 748424 - RNA, 16 nt, Leptospira interrogans serovar lai str. 56601
gaagcuaugaagaggu

SEQ ID NO: 748425 - RNA, 13 nt, Leptospira interrogans serovar lai str. 56601
gaagcuaaaacua

SEQ ID NO: 748426 - RNA, 18 nt, Leptospira interrogans serovar lai str. 56601
gaaggauuagcaugaaau

SEQ ID NO: 748427 - RNA, 18 nt, Leptospira interrogans serovar lai str. 56601
gaaggcagcuaagaaaaa

SEQ ID NO: 748428 - RNA, 21 nt, Leptospira interrogans serovar lai str. 56601
gaaggcagcuaagaaaaaagu

SEQ ID NO: 748429 - RNA, 20 nt, Leptospira interrogans serovar lai str. 56601
gaacucuauauaaagaaaaa

SEQ ID NO: 748430 - RNA, 22 nt, Leptospira interrogans serovar lai str. 56601
gaacucuuacuuugagaaaauu

SEQ ID NO: 748431 - RNA, 13 nt, Leptospira interrogans serovar lai str. 56601
gaacucucacaaa

SEQ ID NO: 748432 - RNA, 17 nt, Leptospira interrogans serovar lai str. 56601
gaacucucacaaaucau

SEQ ID NO: 748433 - RNA, 17 nt, Leptospira interrogans serovar lai str. 56601
gaacucuuucaaagcua

SEQ ID NO: 748434 - RNA, 16 nt, Leptospira interrogans serovar lai str. 56601
gaacucaauguugcuc

SEQ ID NO: 748435 - RNA, 16 nt, Leptospira interrogans serovar lai str. 56601
gaacucacguuaaaua

SEQ ID NO: 748436 - RNA, 23 nt, Leptospira interrogans serovar lai str. 56601
gaacucacguuauuuuaacuuga

SEQ ID NO: 748437 - RNA, 15 nt, Leptospira interrogans serovar lai str. 56601
gaacucccacaauuu

SEQ ID NO: 748438 - RNA, 16 nt, Leptospira interrogans serovar lai str. 56601
gaacucccacaauuua

SEQ ID NO: 748439 - RNA, 18 nt, Leptospira interrogans serovar lai str. 56601
gaacucccacaauuuuga

SEQ ID NO: 748440 - RNA, 19 nt, Leptospira interrogans serovar lai str. 56601
gaacucccacaauuuugaa

SEQ ID NO: 748441 - RNA, 23 nt, Leptospira interrogans serovar lai str. 56601
gaacuaaugaaggaauuggaaua

SEQ ID NO: 748442 - RNA, 14 nt, Leptospira interrogans serovar lai str. 56601
gaacuacuacuuuu

SEQ ID NO: 748443 - RNA, 22 nt, Leptospira interrogans serovar lai str. 56601
gaacuacuacuuuuagaaaaaa

SEQ ID NO: 748444 - RNA, 18 nt, Leptospira interrogans serovar lai str. 56601
gaacuacuauaaauuacu

SEQ ID NO: 748445 - RNA, 19 nt, Leptospira interrogans serovar lai str. 56601
gaacucaacagaacgggcu

SEQ ID NO: 748446 - RNA, 13 nt, Leptospira interrogans serovar lai str. 56601
gaacuaugaaauu

SEQ ID NO: 748447 - RNA, 20 nt, Leptospira interrogans serovar lai str. 56601
gaacuauuauaaaauacaaa

SEQ ID NO: 748448 - RNA, 23 nt, Leptospira interrogans serovar lai str. 56601
gaacuauaauaacaaaaaaugcu

SEQ ID NO: 748449 - RNA, 22 nt, Leptospira interrogans serovar lai str. 56601
gaacggguucuuacaauaaaaa

SEQ ID NO: 748450 - RNA, 22 nt, Leptospira interrogans serovar lai str. 56601
gaacggcuuuaguuugaaagaa

SEQ ID NO: 748451 - RNA, 17 nt, Leptospira interrogans serovar lai str. 56601
gaacggacuguuuuaau

SEQ ID NO: 748452 - RNA, 14 nt, Leptospira interrogans serovar lai str. 56601
gaaccuaaaaauau

SEQ ID NO: 748453 - RNA, 19 nt, Leptospira interrogans serovar lai str. 56601
gaaccucaaagaaauuuua

SEQ ID NO: 748454 - RNA, 15 nt, Leptospira interrogans serovar lai str. 56601
gaaccugauuuccaa

SEQ ID NO: 748455 - RNA, 14 nt, Leptospira interrogans serovar lai str. 56601
gaaccuuaccaccc

SEQ ID NO: 748456 - RNA, 17 nt, Leptospira interrogans serovar lai str. 56601
gaacgauccguaaaaau

SEQ ID NO: 748457 - RNA, 23 nt, Leptospira interrogans serovar lai str. 56601
gaacgcaaucuguugagcgaccc

SEQ ID NO: 748458 - RNA, 19 nt, Leptospira interrogans serovar lai str. 56601
gaaccgggcaauaaugucc

SEQ ID NO: 748459 - RNA, 18 nt, Leptospira interrogans serovar lai str. 56601
gaaccauuugaaaaaggg

SEQ ID NO: 748460 - RNA, 19 nt, Leptospira interrogans serovar lai str. 56601
gaacccaauaaaaacuaau

SEQ ID NO: 748461 - RNA, 14 nt, Leptospira interrogans serovar lai str. 56601
gaaccaucaccaac

SEQ ID NO: 748462 - RNA, 20 nt, Leptospira interrogans serovar lai str. 56601
gaaccaucucaaaaauaucu

SEQ ID NO: 748463 - RNA, 18 nt, Leptospira interrogans serovar lai str. 56601
gaaccaguaucguuuucc

SEQ ID NO: 748464 - RNA, 18 nt, Leptospira interrogans serovar lai str. 56601
gaaccagagauuccgauu

SEQ ID NO: 748465 - RNA, 16 nt, Leptospira interrogans serovar lai str. 56601
gaauuacgacaaaucu

SEQ ID NO: 748466 - RNA, 23 nt, Leptospira interrogans serovar lai str. 56601
gaauuacuacaaaagcguuguau

SEQ ID NO: 748467 - RNA, 15 nt, Leptospira interrogans serovar lai str. 56601
gaauuaauuuuucaa

SEQ ID NO: 748468 - RNA, 22 nt, Leptospira interrogans serovar lai str. 56601
gaauuaauuuuucaauaauucu

SEQ ID NO: 748469 - RNA, 18 nt, Leptospira interrogans serovar lai str. 56601
gaauuaauuuuuuaaaaa

SEQ ID NO: 748470 - RNA, 20 nt, Leptospira interrogans serovar lai str. 56601
gaauuaucguguaaaauuuu

SEQ ID NO: 748471 - RNA, 13 nt, Leptospira interrogans serovar lai str. 56601
gaauuaguaauau

SEQ ID NO: 748472 - RNA, 19 nt, Leptospira interrogans serovar lai str. 56601
gaauuccgacccagaaaaa

SEQ ID NO: 748473 - RNA, 20 nt, Leptospira interrogans serovar lai str. 56601
gaauuccgacccagaaaaaa

SEQ ID NO: 748474 - RNA, 19 nt, Leptospira interrogans serovar lai str. 56601
gaauucauacuuuuaaaaa

SEQ ID NO: 748475 - RNA, 22 nt, Leptospira interrogans serovar lai str. 56601
gaauucauuuuucuacaauuau

SEQ ID NO: 748476 - RNA, 21 nt, Leptospira interrogans serovar lai str. 56601
gaauucccacauuuucaaaau

SEQ ID NO: 748477 - RNA, 15 nt, Leptospira interrogans serovar lai str. 56601
gaauucacaugguua

SEQ ID NO: 748478 - RNA, 18 nt, Leptospira interrogans serovar lai str. 56601
gaauucacguuaaaauaa

SEQ ID NO: 748479 - RNA, 19 nt, Leptospira interrogans serovar lai str. 56601
gaauuguugaaaaauuaau

SEQ ID NO: 748480 - RNA, 17 nt, Leptospira interrogans serovar lai str. 56601
gaauuggcuucuuauua

SEQ ID NO: 748481 - RNA, 18 nt, Leptospira interrogans serovar lai str. 56601
gaauuguuuuuaaauacu

SEQ ID NO: 748482 - RNA, 16 nt, Leptospira interrogans serovar lai str. 56601
gaauuuaggaaauuuu

SEQ ID NO: 748483 - RNA, 16 nt, Leptospira interrogans serovar lai str. 56601
gaauuuauuuguaaaa

SEQ ID NO: 748484 - RNA, 15 nt, Leptospira interrogans serovar lai str. 56601
gaauuucauagucaa

SEQ ID NO: 748485 - RNA, 23 nt, Leptospira interrogans serovar lai str. 56601
gaauugaucucauaaagacaaua

SEQ ID NO: 748486 - RNA, 22 nt, Leptospira interrogans serovar lai str. 56601
gaauugaauuuuuuaaaugcac

SEQ ID NO: 748487 - RNA, 15 nt, Leptospira interrogans serovar lai str. 56601
gaauugaaaucugaa

SEQ ID NO: 748488 - RNA, 13 nt, Leptospira interrogans serovar lai str. 56601
gaauucuaaaaua

SEQ ID NO: 748489 - RNA, 19 nt, Leptospira interrogans serovar lai str. 56601
gaauucucuagaaauuuau

SEQ ID NO: 748490 - RNA, 14 nt, Leptospira interrogans serovar lai str. 56601
gaauucucuaucuu

SEQ ID NO: 748491 - RNA, 23 nt, Leptospira interrogans serovar lai str. 56601
gaaugucuuagaauuuuguuucu

SEQ ID NO: 748492 - RNA, 21 nt, Leptospira interrogans serovar lai str. 56601
gaauguuugagguuuuaaaag

SEQ ID NO: 748493 - RNA, 17 nt, Leptospira interrogans serovar lai str. 56601
gaauguucuuagacuca

SEQ ID NO: 748494 - RNA, 21 nt, Leptospira interrogans serovar lai str. 56601
gaaucuuaaaucuuuaaaaua

SEQ ID NO: 748495 - RNA, 18 nt, Leptospira interrogans serovar lai str. 56601
gaaucuuuuuaaaaguau

SEQ ID NO: 748496 - RNA, 21 nt, Leptospira interrogans serovar lai str. 56601
gaaucuuucauguauuacuca

SEQ ID NO: 748497 - RNA, 13 nt, Leptospira interrogans serovar lai str. 56601
gaaucuuuugccc

SEQ ID NO: 748498 - RNA, 15 nt, Leptospira interrogans serovar lai str. 56601
gaaugagcuagauuu

SEQ ID NO: 748499 - RNA, 15 nt, Leptospira interrogans serovar lai str. 56601
gaaugagucuuuuua

SEQ ID NO: 748500 - RNA, 16 nt, Leptospira interrogans serovar lai str. 56601
gaaugaucaauagaau

SEQ ID NO: 748501 - RNA, 14 nt, Leptospira interrogans serovar lai str. 56601
gaaucuauuuuuga

SEQ ID NO: 748502 - RNA, 15 nt, Leptospira interrogans serovar lai str. 56601
gaaucguuuguaaaa

SEQ ID NO: 748503 - RNA, 20 nt, Leptospira interrogans serovar lai str. 56601
gaaucuaaacucuauagauu

SEQ ID NO: 748504 - RNA, 17 nt, Leptospira interrogans serovar lai str. 56601
gaaucuaaacuuuguaa

SEQ ID NO: 748505 - RNA, 18 nt, Leptospira interrogans serovar lai str. 56601
gaaucuaauuuauaaacu

SEQ ID NO: 748506 - RNA, 14 nt, Leptospira interrogans serovar lai str. 56601
gaaucugaauuuua

SEQ ID NO: 748507 - RNA, 19 nt, Leptospira interrogans serovar lai str. 56601
gaaucugccccaaaauuua

SEQ ID NO: 748508 - RNA, 17 nt, Leptospira interrogans serovar lai str. 56601
gaaucguaaaaaaauau

SEQ ID NO: 748509 - RNA, 13 nt, Leptospira interrogans serovar lai str. 56601
gaaucaugaauuc

SEQ ID NO: 748510 - RNA, 19 nt, Leptospira interrogans serovar lai str. 56601
gaaucaucauccaaugaaa

SEQ ID NO: 748511 - RNA, 21 nt, Leptospira interrogans serovar lai str. 56601
gaaucaucauccaaugaaauu

SEQ ID NO: 748512 - RNA, 19 nt, Leptospira interrogans serovar lai str. 56601
gaaucacccaaucuuacaa

SEQ ID NO: 748513 - RNA, 17 nt, Leptospira interrogans serovar lai str. 56601
gaaucaauuuuagaaua

SEQ ID NO: 748514 - RNA, 14 nt, Leptospira interrogans serovar lai str. 56601
gaaucaaaggaaau

SEQ ID NO: 748515 - RNA, 19 nt, Leptospira interrogans serovar lai str. 56601
gaaucaaaaugaacucaac

SEQ ID NO: 748516 - RNA, 22 nt, Leptospira interrogans serovar lai str. 56601
gaaucaaaaugaacucaacaga

SEQ ID NO: 748517 - RNA, 23 nt, Leptospira interrogans serovar lai str. 56601
gaaucaaaacggcagucauggaa

SEQ ID NO: 748518 - RNA, 17 nt, Leptospira interrogans serovar lai str. 56601
gaaucgagcgaaagccg

SEQ ID NO: 748519 - RNA, 20 nt, Leptospira interrogans serovar lai str. 56601
gaaucgaucuguaaaguuca

SEQ ID NO: 748520 - RNA, 20 nt, Leptospira interrogans serovar lai str. 56601
gaauccuuccuccaaaauau

SEQ ID NO: 748521 - RNA, 13 nt, Leptospira interrogans serovar lai str. 56601
gaaucgaaaaguu

SEQ ID NO: 748522 - RNA, 23 nt, Leptospira interrogans serovar lai str. 56601
gaauccgcuuuggaauuggcuuc

SEQ ID NO: 748523 - RNA, 18 nt, Leptospira interrogans serovar lai str. 56601
gaauccugcuaacugauu

SEQ ID NO: 748524 - RNA, 11 nt, Leptospira interrogans serovar lai str. 56601
gaaucccaaau

SEQ ID NO: 748525 - RNA, 15 nt, Leptospira interrogans serovar lai str. 56601
gaauccgaaaaaccu

SEQ ID NO: 748526 - RNA, 21 nt, Leptospira interrogans serovar lai str. 56601
gaauccgaauacaaagaaccg

SEQ ID NO: 748527 - RNA, 17 nt, Leptospira interrogans serovar lai str. 56601
gaauaaaaucauauuuu

SEQ ID NO: 748528 - RNA, 17 nt, Leptospira interrogans serovar lai str. 56601
gaauaaacaauaaaaua

SEQ ID NO: 748529 - RNA, 14 nt, Leptospira interrogans serovar lai str. 56601
gaauaaaaacaaaa

SEQ ID NO: 748530 - RNA, 15 nt, Leptospira interrogans serovar lai str. 56601
gaauaaaaaacucaa

SEQ ID NO: 748531 - RNA, 16 nt, Leptospira interrogans serovar lai str. 56601
gaaguguuugcugagu

SEQ ID NO: 748532 - RNA, 21 nt, Leptospira interrogans serovar lai str. 56601
gaaguucggaagauuuuucaa

SEQ ID NO: 748533 - RNA, 21 nt, Leptospira interrogans serovar lai str. 56601
gaaguuccaacguaccaaaac

SEQ ID NO: 748534 - RNA, 18 nt, Leptospira interrogans serovar lai str. 56601
gaagucacguauuccaag

SEQ ID NO: 748535 - RNA, 15 nt, Leptospira interrogans serovar lai str. 56601
gaaguauuuucgcac

SEQ ID NO: 748536 - RNA, 18 nt, Leptospira interrogans serovar lai str. 56601
gaaguaguaguucccaca

SEQ ID NO: 748537 - RNA, 14 nt, Leptospira interrogans serovar lai str. 56601
gaagggaugaaauu

SEQ ID NO: 748538 - RNA, 15 nt, Leptospira interrogans serovar lai str. 56601
gaauaauuuaaacuu

SEQ ID NO: 748539 - RNA, 21 nt, Leptospira interrogans serovar lai str. 56601
gaauacauuuaaacuuuucau

SEQ ID NO: 748540 - RNA, 16 nt, Leptospira interrogans serovar lai str. 56601
gaauaccaaaaaagua

SEQ ID NO: 748541 - RNA, 20 nt, Leptospira interrogans serovar lai str. 56601
gaauacgauuuaaucuagga

SEQ ID NO: 748542 - RNA, 16 nt, Leptospira interrogans serovar lai str. 56601
gaauacgauagauuca

SEQ ID NO: 748543 - RNA, 14 nt, Leptospira interrogans serovar lai str. 56601
gaauaacuuucuuc

SEQ ID NO: 748544 - RNA, 13 nt, Leptospira interrogans serovar lai str. 56601
gaauaaagagaag

SEQ ID NO: 748545 - RNA, 14 nt, Leptospira interrogans serovar lai str. 56601
gaauaauaaucuua

SEQ ID NO: 748546 - RNA, 21 nt, Leptospira interrogans serovar lai str. 56601
gaauauaagauuaugguaaaa

SEQ ID NO: 748547 - RNA, 13 nt, Leptospira interrogans serovar lai str. 56601
gaauauaaaaucu

SEQ ID NO: 748548 - RNA, 14 nt, Leptospira interrogans serovar lai str. 56601
gaauauaaaaucuu

SEQ ID NO: 748549 - RNA, 20 nt, Leptospira interrogans serovar lai str. 56601
gaauauaaaaucuuaaauua

SEQ ID NO: 748550 - RNA, 22 nt, Leptospira interrogans serovar lai str. 56601
gaauauaaaaucuuaaauuaga

SEQ ID NO: 748551 - RNA, 17 nt, Leptospira interrogans serovar lai str. 56601
gaauaggauuuuagaau

SEQ ID NO: 748552 - RNA, 21 nt, Leptospira interrogans serovar lai str. 56601
gaauaggauuuuagaaucaaa

SEQ ID NO: 748553 - RNA, 22 nt, Leptospira interrogans serovar lai str. 56601
gaauaggauuuuagaaucagaa

SEQ ID NO: 748554 - RNA, 23 nt, Leptospira interrogans serovar lai str. 56601
gaauagucaaugguugcaaaaaa

SEQ ID NO: 748555 - RNA, 15 nt, Leptospira interrogans serovar lai str. 56601
gaauacguuauucua

SEQ ID NO: 748556 - RNA, 20 nt, Leptospira interrogans serovar lai str. 56601
gaauacuugccguuacauaa

SEQ ID NO: 748557 - RNA, 17 nt, Leptospira interrogans serovar lai str. 56601
gaauagaguuguuaaaa

SEQ ID NO: 748558 - RNA, 14 nt, Leptospira interrogans serovar lai str. 56601
gaauauuuuauccg

SEQ ID NO: 748559 - RNA, 18 nt, Leptospira interrogans serovar lai str. 56601
gaauauuucuaaaauuga

SEQ ID NO: 748560 - RNA, 18 nt, Leptospira interrogans serovar lai str. 56601
gaauauucacuuuuccaa

SEQ ID NO: 748561 - RNA, 15 nt, Leptospira interrogans serovar lai str. 56601
gaauauucauucaga

SEQ ID NO: 748562 - RNA, 18 nt, Leptospira interrogans serovar lai str. 56601
gaauauucguaagaaaaa

SEQ ID NO: 748563 - RNA, 23 nt, Leptospira interrogans serovar lai str. 56601
gaauauucguaagaaaaaauuuc

SEQ ID NO: 748564 - RNA, 22 nt, Leptospira interrogans serovar lai str. 56601
gaauauuaaauuuuauuuauau

SEQ ID NO: 748565 - RNA, 14 nt, Leptospira interrogans serovar lai str. 56601
gaauauuauaaaua

SEQ ID NO: 748566 - RNA, 17 nt, Leptospira interrogans serovar lai str. 56601
gaauauuaugaaauaaa

SEQ ID NO: 748567 - RNA, 17 nt, Leptospira interrogans serovar lai str. 56601
gaauauuauuauauuua

SEQ ID NO: 748568 - RNA, 22 nt, Leptospira interrogans serovar lai str. 56601
gaauaucauaacaaauaaaagg

SEQ ID NO: 748569 - RNA, 22 nt, Leptospira interrogans serovar lai str. 56601
gaauaucuaauauuuuuccagc

SEQ ID NO: 748570 - RNA, 18 nt, Leptospira interrogans serovar lai str. 56601
gaauauagcacaaaugac

SEQ ID NO: 748571 - RNA, 17 nt, Leptospira interrogans serovar lai str. 56601
gaacauuuuuaaaaauu

SEQ ID NO: 748572 - RNA, 19 nt, Leptospira interrogans serovar lai str. 56601
gaacaucaauuuuauuucu

SEQ ID NO: 748573 - RNA, 16 nt, Leptospira interrogans serovar lai str. 56601
gaacacuugaaaaaug

SEQ ID NO: 748574 - RNA, 17 nt, Leptospira interrogans serovar lai str. 56601
gaacacuugaaaaaugu

SEQ ID NO: 748575 - RNA, 14 nt, Leptospira interrogans serovar lai str. 56601
gaacacgucuuaaa

SEQ ID NO: 748576 - RNA, 19 nt, Leptospira interrogans serovar lai str. 56601
gaacaagaugggcacugaa

SEQ ID NO: 748577 - RNA, 21 nt, Leptospira interrogans serovar lai str. 56601
gaacaaugaauuuuuauaaaa

SEQ ID NO: 748578 - RNA, 24 nt, Leptospira interrogans serovar lai str. 56601
gaacaauuuguaauguauaauccu

SEQ ID NO: 748579 - RNA, 15 nt, Leptospira interrogans serovar lai str. 56601
gaacaauuuaaaaua

SEQ ID NO: 748580 - RNA, 16 nt, Leptospira interrogans serovar lai str. 56601
gaaauuaaaauaaagg

SEQ ID NO: 748581 - RNA, 16 nt, Leptospira interrogans serovar lai str. 56601
gaaaugugggaccugg

SEQ ID NO: 748582 - RNA, 16 nt, Leptospira interrogans serovar lai str. 56601
gaaauucauuuuucug

SEQ ID NO: 748583 - RNA, 15 nt, Leptospira interrogans serovar lai str. 56601
gaaauucaaugacaa

SEQ ID NO: 748584 - RNA, 19 nt, Leptospira interrogans serovar lai str. 56601
gaaauucaucaaauuugcu

SEQ ID NO: 748585 - RNA, 17 nt, Leptospira interrogans serovar lai str. 56601
gaaauucguuuuaucuu

SEQ ID NO: 748586 - RNA, 21 nt, Leptospira interrogans serovar lai str. 56601
gaaauuccuacaguuuuagaa

SEQ ID NO: 748587 - RNA, 21 nt, Leptospira interrogans serovar lai str. 56601
gaaauucuuuuccaaaaacuu

SEQ ID NO: 748588 - RNA, 23 nt, Leptospira interrogans serovar lai str. 56601
gaaauucucuuuugaccaaaaga

SEQ ID NO: 748589 - RNA, 19 nt, Leptospira interrogans serovar lai str. 56601
gaaauucucaaaaaauuau

SEQ ID NO: 748590 - RNA, 18 nt, Leptospira interrogans serovar lai str. 56601
gaaauuuuuaauaaaaug

SEQ ID NO: 748591 - RNA, 19 nt, Leptospira interrogans serovar lai str. 56601
gaaauuuuuaauaaaaugc

SEQ ID NO: 748592 - RNA, 17 nt, Leptospira interrogans serovar lai str. 56601
gaaauuuuuaauaacau

SEQ ID NO: 748593 - RNA, 17 nt, Leptospira interrogans serovar lai str. 56601
gaaauuuuuaauauacu

SEQ ID NO: 748594 - RNA, 15 nt, Leptospira interrogans serovar lai str. 56601
gaaauuuuuaaucaa

SEQ ID NO: 748595 - RNA, 20 nt, Leptospira interrogans serovar lai str. 56601
gaaauuuuuaaucaaaugca

SEQ ID NO: 748596 - RNA, 16 nt, Leptospira interrogans serovar lai str. 56601
gaaauuugagaccucu

SEQ ID NO: 748597 - RNA, 19 nt, Leptospira interrogans serovar lai str. 56601
gaaauuuuaaucuucuugu

SEQ ID NO: 748598 - RNA, 15 nt, Leptospira interrogans serovar lai str. 56601
gaaauuuuuguacaa

SEQ ID NO: 748599 - RNA, 11 nt, Leptospira interrogans serovar lai str. 56601
gaacaaauucu

SEQ ID NO: 748600 - RNA, 12 nt, Leptospira interrogans serovar lai str. 56601
gaacaaaauuua

SEQ ID NO: 748601 - RNA, 17 nt, Leptospira interrogans serovar lai str. 56601
gaaauugugagaacuac

SEQ ID NO: 748602 - RNA, 20 nt, Leptospira interrogans serovar lai str. 56601
gaaauugugagaacuacuuu

SEQ ID NO: 748603 - RNA, 23 nt, Leptospira interrogans serovar lai str. 56601
gaaauugaguuucacaaaaauau

SEQ ID NO: 748604 - RNA, 20 nt, Leptospira interrogans serovar lai str. 56601
gaaauuggcgcguaagacca

SEQ ID NO: 748605 - RNA, 17 nt, Leptospira interrogans serovar lai str. 56601
gaaaucgauuuguaaaa

SEQ ID NO: 748606 - RNA, 20 nt, Leptospira interrogans serovar lai str. 56601
gaaaucgauuuguaaaauuc

SEQ ID NO: 748607 - RNA, 18 nt, Leptospira interrogans serovar lai str. 56601
gaaaucagagucuauuua

SEQ ID NO: 748608 - RNA, 18 nt, Leptospira interrogans serovar lai str. 56601
gaaaucuguuuuaucuua

SEQ ID NO: 748609 - RNA, 21 nt, Leptospira interrogans serovar lai str. 56601
gaaaucuuaggacggauuuua

SEQ ID NO: 748610 - RNA, 19 nt, Leptospira interrogans serovar lai str. 56601
gaaaugauuuuuuaaaaua

SEQ ID NO: 748611 - RNA, 21 nt, Leptospira interrogans serovar lai str. 56601
gaaauggauggaaaaugaauu

SEQ ID NO: 748612 - RNA, 21 nt, Leptospira interrogans serovar lai str. 56601
gaaagccccagaacaaauccu

SEQ ID NO: 748613 - RNA, 16 nt, Leptospira interrogans serovar lai str. 56601
gaaagcagcaaagaag

SEQ ID NO: 748614 - RNA, 21 nt, Leptospira interrogans serovar lai str. 56601
gaaagcauaacgucuugauua

SEQ ID NO: 748615 - RNA, 13 nt, Leptospira interrogans serovar lai str. 56601
gaaagcaauccau

SEQ ID NO: 748616 - RNA, 12 nt, Leptospira interrogans serovar lai str. 56601
gaaagauuuucg

SEQ ID NO: 748617 - RNA, 13 nt, Leptospira interrogans serovar lai str. 56601
gaaagauuaaauu

SEQ ID NO: 748618 - RNA, 15 nt, Leptospira interrogans serovar lai str. 56601
gaaagguagcuugga

SEQ ID NO: 748619 - RNA, 13 nt, Leptospira interrogans serovar lai str. 56601
gaaaguaaaaaag

SEQ ID NO: 748620 - RNA, 22 nt, Leptospira interrogans serovar lai str. 56601
gaaaguaaucuuuuuaaaaguu

SEQ ID NO: 748621 - RNA, 17 nt, Leptospira interrogans serovar lai str. 56601
gaaagcgugacuaaaau

SEQ ID NO: 748622 - RNA, 23 nt, Leptospira interrogans serovar lai str. 56601
gaaauaaucgaacccagucuucu

SEQ ID NO: 748623 - RNA, 15 nt, Leptospira interrogans serovar lai str. 56601
gaaauaaagaagagu

SEQ ID NO: 748624 - RNA, 17 nt, Leptospira interrogans serovar lai str. 56601
gaaauaaagaagaguug

SEQ ID NO: 748625 - RNA, 23 nt, Leptospira interrogans serovar lai str. 56601
gaaauaaaaaagcaccuucuaaa

SEQ ID NO: 748626 - RNA, 19 nt, Leptospira interrogans serovar lai str. 56601
gaaaguguuaguucccaca

SEQ ID NO: 748627 - RNA, 19 nt, Leptospira interrogans serovar lai str. 56601
gaaaguuuacaaauuggca

SEQ ID NO: 748628 - RNA, 12 nt, Leptospira interrogans serovar lai str. 56601
gaaaguugcaaa

SEQ ID NO: 748629 - RNA, 18 nt, Leptospira interrogans serovar lai str. 56601
gaaaguugcaaagaagaa

SEQ ID NO: 748630 - RNA, 12 nt, Leptospira interrogans serovar lai str. 56601
gaaaguugaaag

SEQ ID NO: 748631 - RNA, 15 nt, Leptospira interrogans serovar lai str. 56601
gaaaguucguaaacu

SEQ ID NO: 748632 - RNA, 16 nt, Leptospira interrogans serovar lai str. 56601
gaaauauuaaaaaaau

SEQ ID NO: 748633 - RNA, 23 nt, Leptospira interrogans serovar lai str. 56601
gaaauauugaauccaucugagaa

SEQ ID NO: 748634 - RNA, 19 nt, Leptospira interrogans serovar lai str. 56601
gaaauaucguucuagaauu

SEQ ID NO: 748635 - RNA, 21 nt, Leptospira interrogans serovar lai str. 56601
gaaauauuauaaauuuaaaaa

SEQ ID NO: 748636 - RNA, 19 nt, Leptospira interrogans serovar lai str. 56601
gaaauaauuccuccaugaa

SEQ ID NO: 748637 - RNA, 12 nt, Leptospira interrogans serovar lai str. 56601
gaaauagaauuu

SEQ ID NO: 748638 - RNA, 15 nt, Leptospira interrogans serovar lai str. 56601
gaaauagaaagacuu

SEQ ID NO: 748639 - RNA, 14 nt, Leptospira interrogans serovar lai str. 56601
gaaauagaaauaca

SEQ ID NO: 748640 - RNA, 16 nt, Leptospira interrogans serovar lai str. 56601
gaaauacuuaaaauga

SEQ ID NO: 748641 - RNA, 15 nt, Leptospira interrogans serovar lai str. 56601
gaaauacuucuccac

SEQ ID NO: 748642 - RNA, 20 nt, Leptospira interrogans serovar lai str. 56601
gaaacgucauaguucccaca

SEQ ID NO: 748643 - RNA, 15 nt, Leptospira interrogans serovar lai str. 56601
gaaacggaagaaaau

SEQ ID NO: 748644 - RNA, 16 nt, Leptospira interrogans serovar lai str. 56601
gaaacggaagaaaauu

SEQ ID NO: 748645 - RNA, 17 nt, Leptospira interrogans serovar lai str. 56601
gaaacuaaugcaaguuc

SEQ ID NO: 748646 - RNA, 23 nt, Leptospira interrogans serovar lai str. 56601
gaaacuauacuuucaaaaaauau

SEQ ID NO: 748647 - RNA, 23 nt, Leptospira interrogans serovar lai str. 56601
gaaacuauccaaaaguuuauaaa

SEQ ID NO: 748648 - RNA, 21 nt, Leptospira interrogans serovar lai str. 56601
gaaacucauuuuucuaaaaaa

SEQ ID NO: 748649 - RNA, 17 nt, Leptospira interrogans serovar lai str. 56601
gaaacucaguaaacuca

SEQ ID NO: 748650 - RNA, 18 nt, Leptospira interrogans serovar lai str. 56601
gaaacucaguaaacucaa

SEQ ID NO: 748651 - RNA, 19 nt, Leptospira interrogans serovar lai str. 56601
gaaacucaguaaacucaau

SEQ ID NO: 748652 - RNA, 18 nt, Leptospira interrogans serovar lai str. 56601
gaaacucauaaaauaacu

SEQ ID NO: 748653 - RNA, 22 nt, Leptospira interrogans serovar lai str. 56601
gaaagaagauagauuuauaaua

SEQ ID NO: 748654 - RNA, 22 nt, Leptospira interrogans serovar lai str. 56601
gaaagaauguauaccaauaauu

SEQ ID NO: 748655 - RNA, 18 nt, Leptospira interrogans serovar lai str. 56601
gaaagaaucuuuuuaaaa

SEQ ID NO: 748656 - RNA, 19 nt, Leptospira interrogans serovar lai str. 56601
gaaagaacaagauuaacaa

SEQ ID NO: 748657 - RNA, 21 nt, Leptospira interrogans serovar lai str. 56601
gaaagaauuuucuaaaaguau

SEQ ID NO: 748658 - RNA, 12 nt, Leptospira interrogans serovar lai str. 56601
gaaacuuucaaa

SEQ ID NO: 748659 - RNA, 21 nt, Leptospira interrogans serovar lai str. 56601
gaaacuuuuaauaaaacgugg

SEQ ID NO: 748660 - RNA, 15 nt, Leptospira interrogans serovar lai str. 56601
gaaacuuauacuuua

SEQ ID NO: 748661 - RNA, 21 nt, Leptospira interrogans serovar lai str. 56601
gaaacuggaauauucuuuuua

SEQ ID NO: 748662 - RNA, 15 nt, Leptospira interrogans serovar lai str. 56601
gaaaccuuuauagaa

SEQ ID NO: 748663 - RNA, 14 nt, Leptospira interrogans serovar lai str. 56601
gaaaccccaugagc

SEQ ID NO: 748664 - RNA, 22 nt, Leptospira interrogans serovar lai str. 56601
gaaaccucgucuaucuuuuuua

SEQ ID NO: 748665 - RNA, 18 nt, Leptospira interrogans serovar lai str. 56601
gaaacagauggaaaguua

SEQ ID NO: 748666 - RNA, 20 nt, Leptospira interrogans serovar lai str. 56601
gaaacagauggaaaguuagu

SEQ ID NO: 748667 - RNA, 22 nt, Leptospira interrogans serovar lai str. 56601
gaaacauaaugcaauauauugu

SEQ ID NO: 748668 - RNA, 16 nt, Leptospira interrogans serovar lai str. 56601
gaaacaucacuuccau

SEQ ID NO: 748669 - RNA, 18 nt, Leptospira interrogans serovar lai str. 56601
gaaacauuucuaaaauau

SEQ ID NO: 748670 - RNA, 15 nt, Leptospira interrogans serovar lai str. 56601
gaaaauucugaaaga

SEQ ID NO: 748671 - RNA, 16 nt, Leptospira interrogans serovar lai str. 56601
gaaaauucugaaagag

SEQ ID NO: 748672 - RNA, 22 nt, Leptospira interrogans serovar lai str. 56601
gaaaauucuuucuauauauccu

SEQ ID NO: 748673 - RNA, 16 nt, Leptospira interrogans serovar lai str. 56601
gaaaauugaaacaauu

SEQ ID NO: 748674 - RNA, 22 nt, Leptospira interrogans serovar lai str. 56601
gaaaauucuaagaucaaagaga

SEQ ID NO: 748675 - RNA, 12 nt, Leptospira interrogans serovar lai str. 56601
gaaaauuuaaaa

SEQ ID NO: 748676 - RNA, 15 nt, Leptospira interrogans serovar lai str. 56601
gaaaauuuaaaauau

SEQ ID NO: 748677 - RNA, 18 nt, Leptospira interrogans serovar lai str. 56601
gaaaauuuaacgauauua

SEQ ID NO: 748678 - RNA, 22 nt, Leptospira interrogans serovar lai str. 56601
gaaaauuaauuuuucaacaauu

SEQ ID NO: 748679 - RNA, 12 nt, Leptospira interrogans serovar lai str. 56601
gaaaauuauaag

SEQ ID NO: 748680 - RNA, 17 nt, Leptospira interrogans serovar lai str. 56601
gaaaauuauagauaauu

SEQ ID NO: 748681 - RNA, 14 nt, Leptospira interrogans serovar lai str. 56601
gaaaauguaaaagc

SEQ ID NO: 748682 - RNA, 19 nt, Leptospira interrogans serovar lai str. 56601
gaaaauguagccaaaaauu

SEQ ID NO: 748683 - RNA, 14 nt, Leptospira interrogans serovar lai str. 56601
gaaaauuaaaaaau

SEQ ID NO: 748684 - RNA, 12 nt, Leptospira interrogans serovar lai str. 56601
gaaaauuaacaa

SEQ ID NO: 748685 - RNA, 21 nt, Leptospira interrogans serovar lai str. 56601
gaaaaugugagagaggauacu

SEQ ID NO: 748686 - RNA, 21 nt, Leptospira interrogans serovar lai str. 56601
gaaaauuuuuacucagucgaa

SEQ ID NO: 748687 - RNA, 17 nt, Leptospira interrogans serovar lai str. 56601
gaaacaaaaucaaagag

SEQ ID NO: 748688 - RNA, 15 nt, Leptospira interrogans serovar lai str. 56601
gaaacaaaaaugaga

SEQ ID NO: 748689 - RNA, 20 nt, Leptospira interrogans serovar lai str. 56601
gaaacaaaaaugagaaucag

SEQ ID NO: 748690 - RNA, 18 nt, Leptospira interrogans serovar lai str. 56601
gaaaauuuggacgaaucc

SEQ ID NO: 748691 - RNA, 17 nt, Leptospira interrogans serovar lai str. 56601
gaaaauuuuccuuuaaa

SEQ ID NO: 748692 - RNA, 17 nt, Leptospira interrogans serovar lai str. 56601
gaaacaacauugaguuu

SEQ ID NO: 748693 - RNA, 12 nt, Leptospira interrogans serovar lai str. 56601
gaaacaaauucu

SEQ ID NO: 748694 - RNA, 19 nt, Leptospira interrogans serovar lai str. 56601
gaaacaaauucucauuuag

SEQ ID NO: 748695 - RNA, 18 nt, Leptospira interrogans serovar lai str. 56601
gaaacaaguuccaaauua

SEQ ID NO: 748696 - RNA, 12 nt, Leptospira interrogans serovar lai str. 56601
gaaacaaucuaa

SEQ ID NO: 748697 - RNA, 17 nt, Leptospira interrogans serovar lai str. 56601
gaaacaauucuuccuuu

SEQ ID NO: 748698 - RNA, 18 nt, Leptospira interrogans serovar lai str. 56601
gaaacaauucuuccuuuu

SEQ ID NO: 748699 - RNA, 18 nt, Leptospira interrogans serovar lai str. 56601
gaaaauccagucaaguaa

SEQ ID NO: 748700 - RNA, 23 nt, Leptospira interrogans serovar lai str. 56601
gaaaaucggauaguuuaaauucu

SEQ ID NO: 748701 - RNA, 23 nt, Leptospira interrogans serovar lai str. 56601
gaaaaucgaguguaauaugaauu

SEQ ID NO: 748702 - RNA, 13 nt, Leptospira interrogans serovar lai str. 56601
gaaaaucucagaa

SEQ ID NO: 748703 - RNA, 16 nt, Leptospira interrogans serovar lai str. 56601
gaaaaucucagaaaau

SEQ ID NO: 748704 - RNA, 17 nt, Leptospira interrogans serovar lai str. 56601
gaaaaucucagaaaauu

SEQ ID NO: 748705 - RNA, 20 nt, Leptospira interrogans serovar lai str. 56601
gaaaaucuuuucuauaaucu

SEQ ID NO: 748706 - RNA, 9 nt, Leptospira interrogans serovar lai str. 56601
gaaaaugaa

SEQ ID NO: 748707 - RNA, 21 nt, Leptospira interrogans serovar lai str. 56601
gaaaagaauugaaaucugaac

SEQ ID NO: 748708 - RNA, 13 nt, Leptospira interrogans serovar lai str. 56601
gaaaaggaaggag

SEQ ID NO: 748709 - RNA, 13 nt, Leptospira interrogans serovar lai str. 56601
gaaaagaaauauu

SEQ ID NO: 748710 - RNA, 14 nt, Leptospira interrogans serovar lai str. 56601
gaaaagaaauauua

SEQ ID NO: 748711 - RNA, 15 nt, Leptospira interrogans serovar lai str. 56601
gaaaagaaacaguau

SEQ ID NO: 748712 - RNA, 22 nt, Leptospira interrogans serovar lai str. 56601
gaaaagaaaccgaucuuaaaaa

SEQ ID NO: 748713 - RNA, 16 nt, Leptospira interrogans serovar lai str. 56601
gaaaacuuguuuuaga

SEQ ID NO: 748714 - RNA, 20 nt, Leptospira interrogans serovar lai str. 56601
gaaaagaaucguuuuuuuug

SEQ ID NO: 748715 - RNA, 14 nt, Leptospira interrogans serovar lai str. 56601
gaaaagaaucugca

SEQ ID NO: 748716 - RNA, 18 nt, Leptospira interrogans serovar lai str. 56601
gaaaacucaaaucuacaa

SEQ ID NO: 748717 - RNA, 11 nt, Leptospira interrogans serovar lai str. 56601
gaaaacucaac

SEQ ID NO: 748718 - RNA, 14 nt, Leptospira interrogans serovar lai str. 56601
gaaaacucaacaca

SEQ ID NO: 748719 - RNA, 15 nt, Leptospira interrogans serovar lai str. 56601
gaaaacucaacacaa

SEQ ID NO: 748720 - RNA, 19 nt, Leptospira interrogans serovar lai str. 56601
gaaaauacgcuucucuugc

SEQ ID NO: 748721 - RNA, 19 nt, Leptospira interrogans serovar lai str. 56601
gaaaauagauagagaauua

SEQ ID NO: 748722 - RNA, 14 nt, Leptospira interrogans serovar lai str. 56601
gaaaauaauaccaa

SEQ ID NO: 748723 - RNA, 15 nt, Leptospira interrogans serovar lai str. 56601
gaaaauaaaaaucau

SEQ ID NO: 748724 - RNA, 15 nt, Leptospira interrogans serovar lai str. 56601
gaaaaguuuuuaaaa

SEQ ID NO: 748725 - RNA, 13 nt, Leptospira interrogans serovar lai str. 56601
gaaaauaaaaaau

SEQ ID NO: 748726 - RNA, 21 nt, Leptospira interrogans serovar lai str. 56601
gaaaaggcugucuucagcagu

SEQ ID NO: 748727 - RNA, 19 nt, Leptospira interrogans serovar lai str. 56601
gaaaagguuaaaaauuuaa

SEQ ID NO: 748728 - RNA, 16 nt, Leptospira interrogans serovar lai str. 56601
gaaaagucaaaaaaug

SEQ ID NO: 748729 - RNA, 17 nt, Leptospira interrogans serovar lai str. 56601
gaaaagucaaaaaaugg

SEQ ID NO: 748730 - RNA, 16 nt, Leptospira interrogans serovar lai str. 56601
gaaaaaucuucaguuc

SEQ ID NO: 748731 - RNA, 20 nt, Leptospira interrogans serovar lai str. 56601
gaaaaaguuagaaucugaac

SEQ ID NO: 748732 - RNA, 22 nt, Leptospira interrogans serovar lai str. 56601
gaaaaagguuggaaucuaaacu

SEQ ID NO: 748733 - RNA, 19 nt, Leptospira interrogans serovar lai str. 56601
gaaaaauauuauauuuuua

SEQ ID NO: 748734 - RNA, 21 nt, Leptospira interrogans serovar lai str. 56601
gaaaaauaagguuuuauaaaa

SEQ ID NO: 748735 - RNA, 20 nt, Leptospira interrogans serovar lai str. 56601
gaaaaagcgucaacugaaac

SEQ ID NO: 748736 - RNA, 16 nt, Leptospira interrogans serovar lai str. 56601
gaaaaacucagugaau

SEQ ID NO: 748737 - RNA, 21 nt, Leptospira interrogans serovar lai str. 56601
gaaaaacuuuucuaaaaguau

SEQ ID NO: 748738 - RNA, 18 nt, Leptospira interrogans serovar lai str. 56601
gaaaaagaauuuuuaaaa

SEQ ID NO: 748739 - RNA, 22 nt, Leptospira interrogans serovar lai str. 56601
gaaaaagaauuuuuaaaaauau

SEQ ID NO: 748740 - RNA, 15 nt, Leptospira interrogans serovar lai str. 56601
gaaaaagaaacggaa

SEQ ID NO: 748741 - RNA, 21 nt, Leptospira interrogans serovar lai str. 56601
gaaaaagaaacggaagaaaau

SEQ ID NO: 748742 - RNA, 22 nt, Leptospira interrogans serovar lai str. 56601
gaaaaccaugauucugaaaaaa

SEQ ID NO: 748743 - RNA, 20 nt, Leptospira interrogans serovar lai str. 56601
gaaaacgagaaagaauuucc

SEQ ID NO: 748744 - RNA, 16 nt, Leptospira interrogans serovar lai str. 56601
gaaaacagaucaagaa

SEQ ID NO: 748745 - RNA, 21 nt, Leptospira interrogans serovar lai str. 56601
gaaaaauuaaaauucuagaaa

SEQ ID NO: 748746 - RNA, 14 nt, Leptospira interrogans serovar lai str. 56601
gaaaaauuaaaugg

SEQ ID NO: 748747 - RNA, 20 nt, Leptospira interrogans serovar lai str. 56601
gaaaaauuuuauaguagaua

SEQ ID NO: 748748 - RNA, 22 nt, Leptospira interrogans serovar lai str. 56601
cuuuuuuccuucuuuacaguuu

SEQ ID NO: 748749 - RNA, 22 nt, Leptospira interrogans serovar lai str. 56601
cuuuuuucggagucauacauuu

SEQ ID NO: 748750 - RNA, 21 nt, Leptospira interrogans serovar lai str. 56601
cuuuuuucguuucgaaaauuu

SEQ ID NO: 748751 - RNA, 22 nt, Leptospira interrogans serovar lai str. 56601
cuuuuuuguaaguuuugaauuu

SEQ ID NO: 748752 - RNA, 23 nt, Leptospira interrogans serovar lai str. 56601
cuuuuuuaucgaguguaaucuua

SEQ ID NO: 748753 - RNA, 16 nt, Leptospira interrogans serovar lai str. 56601
cuuuuuuauuuuaaca

SEQ ID NO: 748754 - RNA, 13 nt, Leptospira interrogans serovar lai str. 56601
cuuuuuucagaaa

SEQ ID NO: 748755 - RNA, 14 nt, Leptospira interrogans serovar lai str. 56601
cuuuuuucagaauc

SEQ ID NO: 748756 - RNA, 15 nt, Leptospira interrogans serovar lai str. 56601
cuuuuuguaaggauu

SEQ ID NO: 748757 - RNA, 20 nt, Leptospira interrogans serovar lai str. 56601
cuuuuuguaaggauuccuuu

SEQ ID NO: 748758 - RNA, 11 nt, Leptospira interrogans serovar lai str. 56601
cuuuuuuaaac

SEQ ID NO: 748759 - RNA, 12 nt, Leptospira interrogans serovar lai str. 56601
cuuuuuuaaacc

SEQ ID NO: 748760 - RNA, 23 nt, Leptospira interrogans serovar lai str. 56601
cuuuuuuaaagccucaugaaaau

SEQ ID NO: 748761 - RNA, 20 nt, Leptospira interrogans serovar lai str. 56601
cuuuuuuaagaaucucaaaa

SEQ ID NO: 748762 - RNA, 11 nt, Leptospira interrogans serovar lai str. 56601
gaaaaaaagua

SEQ ID NO: 748763 - RNA, 15 nt, Leptospira interrogans serovar lai str. 56601
cuuuuuuuucuaaaa

SEQ ID NO: 748764 - RNA, 19 nt, Leptospira interrogans serovar lai str. 56601
cuuuuuuuucuaaaauauu

SEQ ID NO: 748765 - RNA, 22 nt, Leptospira interrogans serovar lai str. 56601
gaaaaaaaaagaauuucuaaaa

SEQ ID NO: 748766 - RNA, 17 nt, Leptospira interrogans serovar lai str. 56601
cuuuuuuucuuuuaaaa

SEQ ID NO: 748767 - RNA, 15 nt, Leptospira interrogans serovar lai str. 56601
cuuuuuuuaugaaaa

SEQ ID NO: 748768 - RNA, 15 nt, Leptospira interrogans serovar lai str. 56601
cuuuuuuuacuucua

SEQ ID NO: 748769 - RNA, 15 nt, Leptospira interrogans serovar lai str. 56601
cuuuuuuuaaaaaau

SEQ ID NO: 748770 - RNA, 13 nt, Leptospira interrogans serovar lai str. 56601
cuuuuuuuaaaca

SEQ ID NO: 748771 - RNA, 16 nt, Leptospira interrogans serovar lai str. 56601
cuuuuuuuaaacagag

SEQ ID NO: 748772 - RNA, 15 nt, Leptospira interrogans serovar lai str. 56601
gaaaaaauuuuucuu

SEQ ID NO: 748773 - RNA, 12 nt, Leptospira interrogans serovar lai str. 56601
gaaaaacauacu

SEQ ID NO: 748774 - RNA, 11 nt, Leptospira interrogans serovar lai str. 56601
gaaaaaauuca

SEQ ID NO: 748775 - RNA, 16 nt, Leptospira interrogans serovar lai str. 56601
gaaaaaauccauaucu

SEQ ID NO: 748776 - RNA, 17 nt, Leptospira interrogans serovar lai str. 56601
gaaaaaacuuucuaaaa

SEQ ID NO: 748777 - RNA, 16 nt, Leptospira interrogans serovar lai str. 56601
gaaaaaagcagcuaaa

SEQ ID NO: 748778 - RNA, 22 nt, Leptospira interrogans serovar lai str. 56601
gaaaaaagcugaacuuaaaauc

SEQ ID NO: 748779 - RNA, 16 nt, Leptospira interrogans serovar lai str. 56601
gaaaaaaguuagaauu

SEQ ID NO: 748780 - RNA, 20 nt, Leptospira interrogans serovar lai str. 56601
gaaaaaaguugaaaucugaa

SEQ ID NO: 748781 - RNA, 20 nt, Leptospira interrogans serovar lai str. 56601
gaaaaaaguuggaaucugaa

SEQ ID NO: 748782 - RNA, 17 nt, Leptospira interrogans serovar lai str. 56601
gaaaaaaguuggaauuu

SEQ ID NO: 748783 - RNA, 14 nt, Leptospira interrogans serovar lai str. 56601
gaaaaaauaacaau

SEQ ID NO: 748784 - RNA, 14 nt, Leptospira interrogans serovar lai str. 56601
cuuuuguuuuucuu

SEQ ID NO: 748785 - RNA, 19 nt, Leptospira interrogans serovar lai str. 56601
cuuuuuaaaacgauuuuag

SEQ ID NO: 748786 - RNA, 12 nt, Leptospira interrogans serovar lai str. 56601
cuuuuuaaaaga

SEQ ID NO: 748787 - RNA, 12 nt, Leptospira interrogans serovar lai str. 56601
cuuuuuaaauac

SEQ ID NO: 748788 - RNA, 22 nt, Leptospira interrogans serovar lai str. 56601
cuuuuuacucaugacuacagaa

SEQ ID NO: 748789 - RNA, 13 nt, Leptospira interrogans serovar lai str. 56601
cuuuuuauuucua

SEQ ID NO: 748790 - RNA, 14 nt, Leptospira interrogans serovar lai str. 56601
cuuuuucaaguguu

SEQ ID NO: 748791 - RNA, 12 nt, Leptospira interrogans serovar lai str. 56601
cuuuuuauaaaa

SEQ ID NO: 748792 - RNA, 13 nt, Leptospira interrogans serovar lai str. 56601
cuuuuuauaaaaa

SEQ ID NO: 748793 - RNA, 15 nt, Leptospira interrogans serovar lai str. 56601
cuuuuuauaaaaagc

SEQ ID NO: 748794 - RNA, 14 nt, Leptospira interrogans serovar lai str. 56601
cuuuuuauaaagau

SEQ ID NO: 748795 - RNA, 18 nt, Leptospira interrogans serovar lai str. 56601
cuuuuucguuuuuuagaa

SEQ ID NO: 748796 - RNA, 20 nt, Leptospira interrogans serovar lai str. 56601
cuuuuucgaacuauuuuuug

SEQ ID NO: 748797 - RNA, 13 nt, Leptospira interrogans serovar lai str. 56601
cuuuuuccaaaag

SEQ ID NO: 748798 - RNA, 17 nt, Leptospira interrogans serovar lai str. 56601
cuuuuucuagguuuaaa

SEQ ID NO: 748799 - RNA, 23 nt, Leptospira interrogans serovar lai str. 56601
cuuuuucuagguuuaaacuuaua

SEQ ID NO: 748800 - RNA, 18 nt, Leptospira interrogans serovar lai str. 56601
cuuuuugaagaaacaauu

SEQ ID NO: 748801 - RNA, 21 nt, Leptospira interrogans serovar lai str. 56601
cuuuuugaguaauuccacuca

SEQ ID NO: 748802 - RNA, 19 nt, Leptospira interrogans serovar lai str. 56601
cuuuugaucuuuaaaagag

SEQ ID NO: 748803 - RNA, 19 nt, Leptospira interrogans serovar lai str. 56601
cuuuugaacacgucuuaaa

SEQ ID NO: 748804 - RNA, 23 nt, Leptospira interrogans serovar lai str. 56601
cuuuugaaucuaggauauuugau

SEQ ID NO: 748805 - RNA, 18 nt, Leptospira interrogans serovar lai str. 56601
cuuuugagcaguaaaaaa

SEQ ID NO: 748806 - RNA, 14 nt, Leptospira interrogans serovar lai str. 56601
cuuuugcauaguuu

SEQ ID NO: 748807 - RNA, 23 nt, Leptospira interrogans serovar lai str. 56601
cuuuugccccuccguuuacaaaa

SEQ ID NO: 748808 - RNA, 15 nt, Leptospira interrogans serovar lai str. 56601
cuuuuggacagcucu

SEQ ID NO: 748809 - RNA, 15 nt, Leptospira interrogans serovar lai str. 56601
cuuuugcuucuuuua

SEQ ID NO: 748810 - RNA, 13 nt, Leptospira interrogans serovar lai str. 56601
cuuuucuauaaaa

SEQ ID NO: 748811 - RNA, 14 nt, Leptospira interrogans serovar lai str. 56601
cuuuucuauaaaau

SEQ ID NO: 748812 - RNA, 14 nt, Leptospira interrogans serovar lai str. 56601
cuuuucuauaaucu

SEQ ID NO: 748813 - RNA, 17 nt, Leptospira interrogans serovar lai str. 56601
cuuuucuagacuuucuu

SEQ ID NO: 748814 - RNA, 19 nt, Leptospira interrogans serovar lai str. 56601
cuuuucuagacuuucuuug

SEQ ID NO: 748815 - RNA, 18 nt, Leptospira interrogans serovar lai str. 56601
cuuuucuaaauugagaau

SEQ ID NO: 748816 - RNA, 16 nt, Leptospira interrogans serovar lai str. 56601
cuuuucggaacaagau

SEQ ID NO: 748817 - RNA, 15 nt, Leptospira interrogans serovar lai str. 56601
cuuuucuuuuuuaaa

SEQ ID NO: 748818 - RNA, 12 nt, Leptospira interrogans serovar lai str. 56601
cuuuugaaacua

SEQ ID NO: 748819 - RNA, 18 nt, Leptospira interrogans serovar lai str. 56601
cuuuucuucccagauucc

SEQ ID NO: 748820 - RNA, 21 nt, Leptospira interrogans serovar lai str. 56601
cuuuucuucccagauucccuu

SEQ ID NO: 748821 - RNA, 23 nt, Leptospira interrogans serovar lai str. 56601
cuuuucuuauaaccuaucacaaa

SEQ ID NO: 748822 - RNA, 22 nt, Leptospira interrogans serovar lai str. 56601
cuuuucuguucauucuuuaaaa

SEQ ID NO: 748823 - RNA, 14 nt, Leptospira interrogans serovar lai str. 56601
cuuuucuaucaaaa

SEQ ID NO: 748824 - RNA, 18 nt, Leptospira interrogans serovar lai str. 56601
cuuuuacgacuuuauuca

SEQ ID NO: 748825 - RNA, 14 nt, Leptospira interrogans serovar lai str. 56601
cuuuuacggauucu

SEQ ID NO: 748826 - RNA, 14 nt, Leptospira interrogans serovar lai str. 56601
cuuuuaccuuacca

SEQ ID NO: 748827 - RNA, 15 nt, Leptospira interrogans serovar lai str. 56601
cuuuuaccuuaccac

SEQ ID NO: 748828 - RNA, 16 nt, Leptospira interrogans serovar lai str. 56601
cuuuuagaaaaaauuu

SEQ ID NO: 748829 - RNA, 18 nt, Leptospira interrogans serovar lai str. 56601
cuuuuagaaaaaauuuuu

SEQ ID NO: 748830 - RNA, 16 nt, Leptospira interrogans serovar lai str. 56601
cuuuuagaaaauuuuu

SEQ ID NO: 748831 - RNA, 23 nt, Leptospira interrogans serovar lai str. 56601
cuuuuagaaguggaucuugaauc

SEQ ID NO: 748832 - RNA, 15 nt, Leptospira interrogans serovar lai str. 56601
cuuuuagaauucucc

SEQ ID NO: 748833 - RNA, 21 nt, Leptospira interrogans serovar lai str. 56601
cuuuuagaauucuccacaaaa

SEQ ID NO: 748834 - RNA, 16 nt, Leptospira interrogans serovar lai str. 56601
cuuuuaggauuuuaug

SEQ ID NO: 748835 - RNA, 19 nt, Leptospira interrogans serovar lai str. 56601
cuuuuaggauuuuaugaaa

SEQ ID NO: 748836 - RNA, 13 nt, Leptospira interrogans serovar lai str. 56601
cuuuuauaauuca

SEQ ID NO: 748837 - RNA, 13 nt, Leptospira interrogans serovar lai str. 56601
cuuuuauaaaauc

SEQ ID NO: 748838 - RNA, 21 nt, Leptospira interrogans serovar lai str. 56601
cuuuuauaaaaucuaaaagaa

SEQ ID NO: 748839 - RNA, 21 nt, Leptospira interrogans serovar lai str. 56601
cuuuuaguuguacaaaaaugu

SEQ ID NO: 748840 - RNA, 22 nt, Leptospira interrogans serovar lai str. 56601
cuuuuauauaauuuacuucauu

SEQ ID NO: 748841 - RNA, 14 nt, Leptospira interrogans serovar lai str. 56601
cuuuucaaaaucua

SEQ ID NO: 748842 - RNA, 12 nt, Leptospira interrogans serovar lai str. 56601
cuuuucaaaagu

SEQ ID NO: 748843 - RNA, 11 nt, Leptospira interrogans serovar lai str. 56601
cuuuuccuaaa

SEQ ID NO: 748844 - RNA, 17 nt, Leptospira interrogans serovar lai str. 56601
cuuuuccuaaaauuuug

SEQ ID NO: 748845 - RNA, 19 nt, Leptospira interrogans serovar lai str. 56601
cuuuuccccuuuuuuaaua

SEQ ID NO: 748846 - RNA, 15 nt, Leptospira interrogans serovar lai str. 56601
cuuuuccaaaaacuu

SEQ ID NO: 748847 - RNA, 16 nt, Leptospira interrogans serovar lai str. 56601
cuuuuccaaaaacuuu

SEQ ID NO: 748848 - RNA, 22 nt, Leptospira interrogans serovar lai str. 56601
cuuucuuugaacuuuuucaagu

SEQ ID NO: 748849 - RNA, 17 nt, Leptospira interrogans serovar lai str. 56601
cuuuguaauaaaaauuu

SEQ ID NO: 748850 - RNA, 21 nt, Leptospira interrogans serovar lai str. 56601
cuuuguaauaaaaauuuaaaa

SEQ ID NO: 748851 - RNA, 21 nt, Leptospira interrogans serovar lai str. 56601
cuuuguaauaauguauugcuu

SEQ ID NO: 748852 - RNA, 13 nt, Leptospira interrogans serovar lai str. 56601
cuuugaaaaaauu

SEQ ID NO: 748853 - RNA, 17 nt, Leptospira interrogans serovar lai str. 56601
cuuugaaaaaauuuuuu

SEQ ID NO: 748854 - RNA, 19 nt, Leptospira interrogans serovar lai str. 56601
cuuugaaaaagguuggaau

SEQ ID NO: 748855 - RNA, 22 nt, Leptospira interrogans serovar lai str. 56601
cuuugaaacaucacuuccauuu

SEQ ID NO: 748856 - RNA, 20 nt, Leptospira interrogans serovar lai str. 56601
cuuuuaauaauucaaaauuu

SEQ ID NO: 748857 - RNA, 22 nt, Leptospira interrogans serovar lai str. 56601
cuuuuaacuugccguuuuucua

SEQ ID NO: 748858 - RNA, 9 nt, Leptospira interrogans serovar lai str. 56601
cuuuuaaaa

SEQ ID NO: 748859 - RNA, 14 nt, Leptospira interrogans serovar lai str. 56601
cuuuuaaaaacuug

SEQ ID NO: 748860 - RNA, 12 nt, Leptospira interrogans serovar lai str. 56601
cuuuuaaaaagu

SEQ ID NO: 748861 - RNA, 15 nt, Leptospira interrogans serovar lai str. 56601
cuuuuaaacaauuga

SEQ ID NO: 748862 - RNA, 23 nt, Leptospira interrogans serovar lai str. 56601
cuuuuaaacaauugauugcuuuu

SEQ ID NO: 748863 - RNA, 9 nt, Leptospira interrogans serovar lai str. 56601
aaaaaaaau

SEQ ID NO: 748864 - RNA, 12 nt, Leptospira interrogans serovar lai str. 56601
aaaaaaaauacg

SEQ ID NO: 748865 - RNA, 13 nt, Leptospira interrogans serovar lai str. 56601
aaaaaaacaaaga

SEQ ID NO: 748866 - RNA, 14 nt, Leptospira interrogans serovar lai str. 56601
aaaaaaaacaaaga

SEQ ID NO: 748867 - RNA, 11 nt, Leptospira interrogans serovar lai str. 56601
aaaaaaaacag

SEQ ID NO: 748868 - RNA, 13 nt, Leptospira interrogans serovar lai str. 56601
aaaaaagagaaag

SEQ ID NO: 748869 - RNA, 15 nt, Leptospira interrogans serovar lai str. 56601
aaaaaagagaaagaa

SEQ ID NO: 748870 - RNA, 13 nt, Leptospira interrogans serovar lai str. 56601
aaaaaacuuuuua

SEQ ID NO: 748871 - RNA, 18 nt, Leptospira interrogans serovar lai str. 56601
aaaaaacuauaaaucauu

SEQ ID NO: 748872 - RNA, 13 nt, Leptospira interrogans serovar lai str. 56601
aaaaaaaguaauu

SEQ ID NO: 748873 - RNA, 19 nt, Leptospira interrogans serovar lai str. 56601
aaaaaaaguauauauuaaa

SEQ ID NO: 748874 - RNA, 14 nt, Leptospira interrogans serovar lai str. 56601
aaaaaaauaaauca

SEQ ID NO: 748875 - RNA, 13 nt, Leptospira interrogans serovar lai str. 56601
aaaaaaauaacga

SEQ ID NO: 748876 - RNA, 21 nt, Leptospira interrogans serovar lai str. 56601
aaaaaaauaacgauacuuaaa

SEQ ID NO: 748877 - RNA, 14 nt, Leptospira interrogans serovar lai str. 56601
aaaaaaacgucuuu

SEQ ID NO: 748878 - RNA, 13 nt, Leptospira interrogans serovar lai str. 56601
aaaaaauucaauu

SEQ ID NO: 748879 - RNA, 20 nt, Leptospira interrogans serovar lai str. 56601
aaaaaauuucuuaaaagauu

SEQ ID NO: 748880 - RNA, 12 nt, Leptospira interrogans serovar lai str. 56601
aaaaaauuuuac

SEQ ID NO: 748881 - RNA, 13 nt, Leptospira interrogans serovar lai str. 56601
aaaaaauuuuaca

SEQ ID NO: 748882 - RNA, 23 nt, Leptospira interrogans serovar lai str. 56601
aaaaaauuuuacgcaaucauucu

SEQ ID NO: 748883 - RNA, 19 nt, Leptospira interrogans serovar lai str. 56601
aaaaaauuuuacguuauaa

SEQ ID NO: 748884 - RNA, 17 nt, Leptospira interrogans serovar lai str. 56601
aaaaaauuauaucuuau

SEQ ID NO: 748885 - RNA, 18 nt, Leptospira interrogans serovar lai str. 56601
aaaaacaacucuucuucu

SEQ ID NO: 748886 - RNA, 21 nt, Leptospira interrogans serovar lai str. 56601
aaaaacaaacgagucuuuugu

SEQ ID NO: 748887 - RNA, 14 nt, Leptospira interrogans serovar lai str. 56601
aaaaacaaauuaag

SEQ ID NO: 748888 - RNA, 16 nt, Leptospira interrogans serovar lai str. 56601
aaaaacaaauuaaguu

SEQ ID NO: 748889 - RNA, 17 nt, Leptospira interrogans serovar lai str. 56601
aaaaacaaauuaaguuu

SEQ ID NO: 748890 - RNA, 23 nt, Leptospira interrogans serovar lai str. 56601
aaaaacaaauuaaguuuaaaaac

SEQ ID NO: 748891 - RNA, 13 nt, Leptospira interrogans serovar lai str. 56601
aaaaaauuuuuac

SEQ ID NO: 748892 - RNA, 19 nt, Leptospira interrogans serovar lai str. 56601
aaaaaauuuuucuuaauuu

SEQ ID NO: 748893 - RNA, 12 nt, Leptospira interrogans serovar lai str. 56601
aaaaaagaaagc

SEQ ID NO: 748894 - RNA, 13 nt, Leptospira interrogans serovar lai str. 56601
aaaaaagaaagca

SEQ ID NO: 748895 - RNA, 17 nt, Leptospira interrogans serovar lai str. 56601
aaaaaacucaauguguu

SEQ ID NO: 748896 - RNA, 16 nt, Leptospira interrogans serovar lai str. 56601
aaaaaacuuuuuaaaa

SEQ ID NO: 748897 - RNA, 22 nt, Leptospira interrogans serovar lai str. 56601
aaaaaacuuuuuaaaacgauuu

SEQ ID NO: 748898 - RNA, 16 nt, Leptospira interrogans serovar lai str. 56601
aaaaaacuuuuuauaa

SEQ ID NO: 748899 - RNA, 13 nt, Leptospira interrogans serovar lai str. 56601
aaaaaagacuuaa

SEQ ID NO: 748900 - RNA, 14 nt, Leptospira interrogans serovar lai str. 56601
aaaaaagacuuaaa

SEQ ID NO: 748901 - RNA, 16 nt, Leptospira interrogans serovar lai str. 56601
aaaaaagaucuuauaa

SEQ ID NO: 748902 - RNA, 12 nt, Leptospira interrogans serovar lai str. 56601
aaaaaagcagcu

SEQ ID NO: 748903 - RNA, 18 nt, Leptospira interrogans serovar lai str. 56601
aaaaaagcauauugauaa

SEQ ID NO: 748904 - RNA, 13 nt, Leptospira interrogans serovar lai str. 56601
aaaaaauggaaca

SEQ ID NO: 748905 - RNA, 11 nt, Leptospira interrogans serovar lai str. 56601
aaaaaauggag

SEQ ID NO: 748906 - RNA, 15 nt, Leptospira interrogans serovar lai str. 56601
aaaaaagcugaacuu

SEQ ID NO: 748907 - RNA, 18 nt, Leptospira interrogans serovar lai str. 56601
aaaaaagcugaacuuaaa

SEQ ID NO: 748908 - RNA, 14 nt, Leptospira interrogans serovar lai str. 56601
aaaaaauguuuaaa

SEQ ID NO: 748909 - RNA, 19 nt, Leptospira interrogans serovar lai str. 56601
aaaaaauguuuaaagaauu

SEQ ID NO: 748910 - RNA, 17 nt, Leptospira interrogans serovar lai str. 56601
aaaaaguauaauuuaaa

SEQ ID NO: 748911 - RNA, 17 nt, Leptospira interrogans serovar lai str. 56601
aaaaaguauauauuaaa

SEQ ID NO: 748912 - RNA, 13 nt, Leptospira interrogans serovar lai str. 56601
aaaaaguauguuu

SEQ ID NO: 748913 - RNA, 13 nt, Leptospira interrogans serovar lai str. 56601
aaaaaguccaaaa

SEQ ID NO: 748914 - RNA, 16 nt, Leptospira interrogans serovar lai str. 56601
aaaaaguccaaaacaa

SEQ ID NO: 748915 - RNA, 19 nt, Leptospira interrogans serovar lai str. 56601
aaaaagcugaacuuaaaau

SEQ ID NO: 748916 - RNA, 21 nt, Leptospira interrogans serovar lai str. 56601
aaaaagcugaacuuaaaaucu

SEQ ID NO: 748917 - RNA, 14 nt, Leptospira interrogans serovar lai str. 56601
aaaaagacuuaaaa

SEQ ID NO: 748918 - RNA, 16 nt, Leptospira interrogans serovar lai str. 56601
aaaaagaauuucuaaa

SEQ ID NO: 748919 - RNA, 21 nt, Leptospira interrogans serovar lai str. 56601
aaaaagaauuucuaaaauucu

SEQ ID NO: 748920 - RNA, 14 nt, Leptospira interrogans serovar lai str. 56601
aaaaagaauuuuua

SEQ ID NO: 748921 - RNA, 11 nt, Leptospira interrogans serovar lai str. 56601
aaaaagaauug

SEQ ID NO: 748922 - RNA, 13 nt, Leptospira interrogans serovar lai str. 56601
aaaaagaauuguu

SEQ ID NO: 748923 - RNA, 13 nt, Leptospira interrogans serovar lai str. 56601
aaaaagauaaaaa

SEQ ID NO: 748924 - RNA, 15 nt, Leptospira interrogans serovar lai str. 56601
aaaaagauaaaaaga

SEQ ID NO: 748925 - RNA, 17 nt, Leptospira interrogans serovar lai str. 56601
aaaaagagacguaauuu

SEQ ID NO: 748926 - RNA, 23 nt, Leptospira interrogans serovar lai str. 56601
aaaaagagaugguuuagaaaacg

SEQ ID NO: 748927 - RNA, 14 nt, Leptospira interrogans serovar lai str. 56601
aaaaagcacaaaac

SEQ ID NO: 748928 - RNA, 15 nt, Leptospira interrogans serovar lai str. 56601
aaaaagcacaaaacg

SEQ ID NO: 748929 - RNA, 17 nt, Leptospira interrogans serovar lai str. 56601
aaaaagcacaaaacgau

SEQ ID NO: 748930 - RNA, 14 nt, Leptospira interrogans serovar lai str. 56601
aaaaagcagcuaaa

SEQ ID NO: 748931 - RNA, 18 nt, Leptospira interrogans serovar lai str. 56601
aaaaagcagcuaaaaaga

SEQ ID NO: 748932 - RNA, 19 nt, Leptospira interrogans serovar lai str. 56601
aaaaagcagcuaaaaagaa

SEQ ID NO: 748933 - RNA, 21 nt, Leptospira interrogans serovar lai str. 56601
aaaaacuuuuuaaaacgauuu

SEQ ID NO: 748934 - RNA, 12 nt, Leptospira interrogans serovar lai str. 56601
aaaaagaaaaac

SEQ ID NO: 748935 - RNA, 14 nt, Leptospira interrogans serovar lai str. 56601
aaaaagaaaaaucu

SEQ ID NO: 748936 - RNA, 23 nt, Leptospira interrogans serovar lai str. 56601
aaaaagaaaaaucuucaguucuu

SEQ ID NO: 748937 - RNA, 20 nt, Leptospira interrogans serovar lai str. 56601
aaaaacuuuagaauguaaaa

SEQ ID NO: 748938 - RNA, 19 nt, Leptospira interrogans serovar lai str. 56601
aaaaacuuucggaauaaaa

SEQ ID NO: 748939 - RNA, 16 nt, Leptospira interrogans serovar lai str. 56601
aaaaacuuucuaaaaa

SEQ ID NO: 748940 - RNA, 18 nt, Leptospira interrogans serovar lai str. 56601
aaaaacuuucuaaaaaua

SEQ ID NO: 748941 - RNA, 12 nt, Leptospira interrogans serovar lai str. 56601
aaaaagaaaguu

SEQ ID NO: 748942 - RNA, 19 nt, Leptospira interrogans serovar lai str. 56601
aaaaagaaagcaaacuuuu

SEQ ID NO: 748943 - RNA, 15 nt, Leptospira interrogans serovar lai str. 56601
aaaaagaaagcagca

SEQ ID NO: 748944 - RNA, 16 nt, Leptospira interrogans serovar lai str. 56601
aaaaagaaagcagcaa

SEQ ID NO: 748945 - RNA, 15 nt, Leptospira interrogans serovar lai str. 56601
aaaaagaaucauaca

SEQ ID NO: 748946 - RNA, 23 nt, Leptospira interrogans serovar lai str. 56601
aaaaacuaccacaaaucuaaauu

SEQ ID NO: 748947 - RNA, 20 nt, Leptospira interrogans serovar lai str. 56601
aaaaacgucuaguccucuuu

SEQ ID NO: 748948 - RNA, 22 nt, Leptospira interrogans serovar lai str. 56601
aaaaacgucuaguccucuuuuu

SEQ ID NO: 748949 - RNA, 21 nt, Leptospira interrogans serovar lai str. 56601
aaaaacgggcccaaauaaaaa

SEQ ID NO: 748950 - RNA, 14 nt, Leptospira interrogans serovar lai str. 56601
aaaaacucaaagaa

SEQ ID NO: 748951 - RNA, 20 nt, Leptospira interrogans serovar lai str. 56601
aaaaacucagcgaaaauacu

SEQ ID NO: 748952 - RNA, 21 nt, Leptospira interrogans serovar lai str. 56601
aaaaacuaucaguuuucagag

SEQ ID NO: 748953 - RNA, 19 nt, Leptospira interrogans serovar lai str. 56601
aaaaacuauuuaauauagg

SEQ ID NO: 748954 - RNA, 20 nt, Leptospira interrogans serovar lai str. 56601
aaaaacucgguuucuuauau

SEQ ID NO: 748955 - RNA, 18 nt, Leptospira interrogans serovar lai str. 56601
aaaaacccgguaguggaa

SEQ ID NO: 748956 - RNA, 16 nt, Leptospira interrogans serovar lai str. 56601
aaaaaccccauuaaaa

SEQ ID NO: 748957 - RNA, 17 nt, Leptospira interrogans serovar lai str. 56601
aaaaaccccauuaaaaa

SEQ ID NO: 748958 - RNA, 20 nt, Leptospira interrogans serovar lai str. 56601
aaaaaccccauuaaaaagcu

SEQ ID NO: 748959 - RNA, 18 nt, Leptospira interrogans serovar lai str. 56601
aaaaacgguauuuaaaau

SEQ ID NO: 748960 - RNA, 15 nt, Leptospira interrogans serovar lai str. 56601
aaaaacugauuaaaa

SEQ ID NO: 748961 - RNA, 22 nt, Leptospira interrogans serovar lai str. 56601
aaaaacgaugagccaucuuuuu

SEQ ID NO: 748962 - RNA, 21 nt, Leptospira interrogans serovar lai str. 56601
aaaaacaagcucaauuuugaa

SEQ ID NO: 748963 - RNA, 20 nt, Leptospira interrogans serovar lai str. 56601
aaaaacacuuuaucuuuucu

SEQ ID NO: 748964 - RNA, 20 nt, Leptospira interrogans serovar lai str. 56601
aaaaaccgucccaaaacaau

SEQ ID NO: 748965 - RNA, 17 nt, Leptospira interrogans serovar lai str. 56601
aaaaaccgucccaaaau

SEQ ID NO: 748966 - RNA, 20 nt, Leptospira interrogans serovar lai str. 56601
aaaaaccuaguguuuaauuu

SEQ ID NO: 748967 - RNA, 18 nt, Leptospira interrogans serovar lai str. 56601
aaaaaccgaaauagaaau

SEQ ID NO: 748968 - RNA, 24 nt, Leptospira interrogans serovar lai str. 56601
aaaaaccgcaaauuuuacauuguu

SEQ ID NO: 748969 - RNA, 22 nt, Leptospira interrogans serovar lai str. 56601
aaaaaccgcucgcucaaagaag

SEQ ID NO: 748970 - RNA, 16 nt, Leptospira interrogans serovar lai str. 56601
aaaaaccgucccaaaa

SEQ ID NO: 748971 - RNA, 19 nt, Leptospira interrogans serovar lai str. 56601
aaaaaccgucccaaaacaa

SEQ ID NO: 748972 - RNA, 21 nt, Leptospira interrogans serovar lai str. 56601
aaaaaccgucccaaaacaaua

SEQ ID NO: 748973 - RNA, 22 nt, Leptospira interrogans serovar lai str. 56601
aaaaaccgucccaaaacaauag

SEQ ID NO: 748974 - RNA, 18 nt, Leptospira interrogans serovar lai str. 56601
aaaaaccgucccaaaauc

SEQ ID NO: 748975 - RNA, 19 nt, Leptospira interrogans serovar lai str. 56601
aaaaaccgucccaaaaucu

SEQ ID NO: 748976 - RNA, 20 nt, Leptospira interrogans serovar lai str. 56601
aaaaaccgucccaaaaucuu

SEQ ID NO: 748977 - RNA, 19 nt, Leptospira interrogans serovar lai str. 56601
aaaaaccguuccuuucaag

SEQ ID NO: 748978 - RNA, 21 nt, Leptospira interrogans serovar lai str. 56601
aaaaaccguuccuuucaagaa

SEQ ID NO: 748979 - RNA, 17 nt, Leptospira interrogans serovar lai str. 56601
aaaaacuauaaaucauu

SEQ ID NO: 748980 - RNA, 20 nt, Leptospira interrogans serovar lai str. 56601
aaaaacgggcccaaauaaaa

SEQ ID NO: 748981 - RNA, 13 nt, Leptospira interrogans serovar lai str. 56601
aaaaacgucaaaa

SEQ ID NO: 748982 - RNA, 16 nt, Leptospira interrogans serovar lai str. 56601
aaaaacgucaaaauuu

SEQ ID NO: 748983 - RNA, 20 nt, Leptospira interrogans serovar lai str. 56601
aaaaacguuuuguugaguuu

SEQ ID NO: 748984 - RNA, 20 nt, Leptospira interrogans serovar lai str. 56601
aaaaacgguauuuaaaauua

SEQ ID NO: 748985 - RNA, 22 nt, Leptospira interrogans serovar lai str. 56601
aaaaacuaaaauacaaaauguu

SEQ ID NO: 748986 - RNA, 18 nt, Leptospira interrogans serovar lai str. 56601
aaaaacuauuuaauauag

SEQ ID NO: 748987 - RNA, 21 nt, Leptospira interrogans serovar lai str. 56601
aaaaacucagugaaugccucu

SEQ ID NO: 748988 - RNA, 16 nt, Leptospira interrogans serovar lai str. 56601
aaaaacugauuuaauu

SEQ ID NO: 748989 - RNA, 19 nt, Leptospira interrogans serovar lai str. 56601
aaaaacucuaccuuuauuu

SEQ ID NO: 748990 - RNA, 21 nt, Leptospira interrogans serovar lai str. 56601
aaaaacucuauuagaauuguu

SEQ ID NO: 748991 - RNA, 19 nt, Leptospira interrogans serovar lai str. 56601
aaaaauauuucaaaaauuu

SEQ ID NO: 748992 - RNA, 17 nt, Leptospira interrogans serovar lai str. 56601
aaaaaucaaauauacaa

SEQ ID NO: 748993 - RNA, 14 nt, Leptospira interrogans serovar lai str. 56601
aaaaauauuauauu

SEQ ID NO: 748994 - RNA, 19 nt, Leptospira interrogans serovar lai str. 56601
aaaaauauuauauuuuuaa

SEQ ID NO: 748995 - RNA, 17 nt, Leptospira interrogans serovar lai str. 56601
aaaaauaugauuuaaaa

SEQ ID NO: 748996 - RNA, 20 nt, Leptospira interrogans serovar lai str. 56601
aaaaauaugauuuaaaauca

SEQ ID NO: 748997 - RNA, 18 nt, Leptospira interrogans serovar lai str. 56601
aaaaaucggcauucaauu

SEQ ID NO: 748998 - RNA, 21 nt, Leptospira interrogans serovar lai str. 56601
aaaaaucagguuuuauaaagu

SEQ ID NO: 748999 - RNA, 12 nt, Leptospira interrogans serovar lai str. 56601
aaaaaucucuuu

SEQ ID NO: 749000 - RNA, 14 nt, Leptospira interrogans serovar lai str. 56601
aaaaaucucuuuua

SEQ ID NO: 749001 - RNA, 21 nt, Leptospira interrogans serovar lai str. 56601
aaaaaguugcuaagaaaaaag

SEQ ID NO: 749002 - RNA, 22 nt, Leptospira interrogans serovar lai str. 56601
aaaaaguugcuaagaaaaaagc

SEQ ID NO: 749003 - RNA, 21 nt, Leptospira interrogans serovar lai str. 56601
aaaaaguuggaaucuaaacuu

SEQ ID NO: 749004 - RNA, 22 nt, Leptospira interrogans serovar lai str. 56601
aaaaaguugggaucuaaacuuu

SEQ ID NO: 749005 - RNA, 18 nt, Leptospira interrogans serovar lai str. 56601
aaaaaguuuguuuguaaa

SEQ ID NO: 749006 - RNA, 17 nt, Leptospira interrogans serovar lai str. 56601
aaaaaugaugcaaauuc

SEQ ID NO: 749007 - RNA, 22 nt, Leptospira interrogans serovar lai str. 56601
aaaaaugaaagguaauuuugaa

SEQ ID NO: 749008 - RNA, 23 nt, Leptospira interrogans serovar lai str. 56601
aaaaaugaaagguaauuuugaag

SEQ ID NO: 749009 - RNA, 14 nt, Leptospira interrogans serovar lai str. 56601
aaaaaugaaaucua

SEQ ID NO: 749010 - RNA, 15 nt, Leptospira interrogans serovar lai str. 56601
aaaaaugaauguuua

SEQ ID NO: 749011 - RNA, 17 nt, Leptospira interrogans serovar lai str. 56601
aaaaaugaauguuuaaa

SEQ ID NO: 749012 - RNA, 15 nt, Leptospira interrogans serovar lai str. 56601
aaaaaugaauuuuuu

SEQ ID NO: 749013 - RNA, 22 nt, Leptospira interrogans serovar lai str. 56601
aaaaauucgauguuauuuuuaa

SEQ ID NO: 749014 - RNA, 20 nt, Leptospira interrogans serovar lai str. 56601
aaaaauucauaauaaaacua

SEQ ID NO: 749015 - RNA, 22 nt, Leptospira interrogans serovar lai str. 56601
aaaaauucauuccuauaaauaa

SEQ ID NO: 749016 - RNA, 11 nt, Leptospira interrogans serovar lai str. 56601
aaaaauuccau

SEQ ID NO: 749017 - RNA, 21 nt, Leptospira interrogans serovar lai str. 56601
aaaaauuccauagcaacaauu

SEQ ID NO: 749018 - RNA, 22 nt, Leptospira interrogans serovar lai str. 56601
aaaaauuccauagugaagauuu

SEQ ID NO: 749019 - RNA, 14 nt, Leptospira interrogans serovar lai str. 56601
aaaaauguaaaaaa

SEQ ID NO: 749020 - RNA, 21 nt, Leptospira interrogans serovar lai str. 56601
aaaaauguauccaauccaaaa

SEQ ID NO: 749021 - RNA, 22 nt, Leptospira interrogans serovar lai str. 56601
aaaaauguauucuauaaaauuu

SEQ ID NO: 749022 - RNA, 23 nt, Leptospira interrogans serovar lai str. 56601
aaaaauguaaucucgauuucuaa

SEQ ID NO: 749023 - RNA, 16 nt, Leptospira interrogans serovar lai str. 56601
aaaaaugugccuuuuu

SEQ ID NO: 749024 - RNA, 16 nt, Leptospira interrogans serovar lai str. 56601
aaaaauucuaauauaa

SEQ ID NO: 749025 - RNA, 18 nt, Leptospira interrogans serovar lai str. 56601
aaaaauuguugaagaauu

SEQ ID NO: 749026 - RNA, 17 nt, Leptospira interrogans serovar lai str. 56601
aaaaauuguaaacuucu

SEQ ID NO: 749027 - RNA, 18 nt, Leptospira interrogans serovar lai str. 56601
aaaaauucuuaauauacu

SEQ ID NO: 749028 - RNA, 19 nt, Leptospira interrogans serovar lai str. 56601
aaaaauucuuaauauacuu

SEQ ID NO: 749029 - RNA, 21 nt, Leptospira interrogans serovar lai str. 56601
aaaaccuaguguuuaauuuua

SEQ ID NO: 749030 - RNA, 21 nt, Leptospira interrogans serovar lai str. 56601
aaaaccuaucuaacgauccuu

SEQ ID NO: 749031 - RNA, 13 nt, Leptospira interrogans serovar lai str. 56601
aaaaccucaaaaa

SEQ ID NO: 749032 - RNA, 16 nt, Leptospira interrogans serovar lai str. 56601
aaaaccgcaaauuuua

SEQ ID NO: 749033 - RNA, 16 nt, Leptospira interrogans serovar lai str. 56601
aaaaccguuuuauaaa

SEQ ID NO: 749034 - RNA, 14 nt, Leptospira interrogans serovar lai str. 56601
aaaaccgucccaaa

SEQ ID NO: 749035 - RNA, 22 nt, Leptospira interrogans serovar lai str. 56601
aaaaccgucccaaaacaauagc

SEQ ID NO: 749036 - RNA, 19 nt, Leptospira interrogans serovar lai str. 56601
aaaaccgucccaaaaucuu

SEQ ID NO: 749037 - RNA, 14 nt, Leptospira interrogans serovar lai str. 56601
aaaaccccauuaaa

SEQ ID NO: 749038 - RNA, 16 nt, Leptospira interrogans serovar lai str. 56601
aaaaccccauuaaaaa

SEQ ID NO: 749039 - RNA, 15 nt, Leptospira interrogans serovar lai str. 56601
aaaacccaauaccaa

SEQ ID NO: 749040 - RNA, 19 nt, Leptospira interrogans serovar lai str. 56601
aaaacccaauaccaaacga

SEQ ID NO: 749041 - RNA, 21 nt, Leptospira interrogans serovar lai str. 56601
aaaaccaugauucugaaaaaa

SEQ ID NO: 749042 - RNA, 13 nt, Leptospira interrogans serovar lai str. 56601
aaaacaaaaucaa

SEQ ID NO: 749043 - RNA, 16 nt, Leptospira interrogans serovar lai str. 56601
aaaaauuuaauuuuuu

SEQ ID NO: 749044 - RNA, 18 nt, Leptospira interrogans serovar lai str. 56601
aaaaauuuaauuuuuuag

SEQ ID NO: 749045 - RNA, 15 nt, Leptospira interrogans serovar lai str. 56601
aaaacaaaaaaacaa

SEQ ID NO: 749046 - RNA, 21 nt, Leptospira interrogans serovar lai str. 56601
aaaacaaauuaaguuuaaaaa

SEQ ID NO: 749047 - RNA, 15 nt, Leptospira interrogans serovar lai str. 56601
aaaaccacaaaaaca

SEQ ID NO: 749048 - RNA, 18 nt, Leptospira interrogans serovar lai str. 56601
aaaaccacaaaaacaaau

SEQ ID NO: 749049 - RNA, 21 nt, Leptospira interrogans serovar lai str. 56601
aaaacaguauuuguaaaaaug

SEQ ID NO: 749050 - RNA, 18 nt, Leptospira interrogans serovar lai str. 56601
aaaacauaaaaauuuuuu

SEQ ID NO: 749051 - RNA, 15 nt, Leptospira interrogans serovar lai str. 56601
aaaacaggucccaaa

SEQ ID NO: 749052 - RNA, 18 nt, Leptospira interrogans serovar lai str. 56601
aaacauuggaacuuuuua

SEQ ID NO: 749053 - RNA, 22 nt, Leptospira interrogans serovar lai str. 56601
aaacauuggaacuuuuuaucau

SEQ ID NO: 749054 - RNA, 14 nt, Leptospira interrogans serovar lai str. 56601
aaacauuuaacuuu

SEQ ID NO: 749055 - RNA, 14 nt, Leptospira interrogans serovar lai str. 56601
aaacauuucuaaaa

SEQ ID NO: 749056 - RNA, 23 nt, Leptospira interrogans serovar lai str. 56601
aaacauuauuucaaugcaaaaaa

SEQ ID NO: 749057 - RNA, 15 nt, Leptospira interrogans serovar lai str. 56601
aaacauucaaauuuc

SEQ ID NO: 749058 - RNA, 20 nt, Leptospira interrogans serovar lai str. 56601
aaacauucaagguaauuuau

SEQ ID NO: 749059 - RNA, 12 nt, Leptospira interrogans serovar lai str. 56601
aaacauuauauc

SEQ ID NO: 749060 - RNA, 23 nt, Leptospira interrogans serovar lai str. 56601
aaacauuaacguuuucuaucuuu

SEQ ID NO: 749061 - RNA, 24 nt, Leptospira interrogans serovar lai str. 56601
aaacauccucaacggguucuucau

SEQ ID NO: 749062 - RNA, 12 nt, Leptospira interrogans serovar lai str. 56601
aaacaucuagau

SEQ ID NO: 749063 - RNA, 19 nt, Leptospira interrogans serovar lai str. 56601
aaacaugaagaagcuaaaa

SEQ ID NO: 749064 - RNA, 14 nt, Leptospira interrogans serovar lai str. 56601
aaaccaaauagaaa

SEQ ID NO: 749065 - RNA, 14 nt, Leptospira interrogans serovar lai str. 56601
aaaccaaauaauaa

SEQ ID NO: 749066 - RNA, 13 nt, Leptospira interrogans serovar lai str. 56601
aaacauuuugccu

SEQ ID NO: 749067 - RNA, 22 nt, Leptospira interrogans serovar lai str. 56601
aaacauuuugccuuguucauaa

SEQ ID NO: 749068 - RNA, 13 nt, Leptospira interrogans serovar lai str. 56601
aaaccacaaaaac

SEQ ID NO: 749069 - RNA, 15 nt, Leptospira interrogans serovar lai str. 56601
aaaccacacuaccau

SEQ ID NO: 749070 - RNA, 16 nt, Leptospira interrogans serovar lai str. 56601
aaaccaccaaccgaaa

SEQ ID NO: 749071 - RNA, 17 nt, Leptospira interrogans serovar lai str. 56601
aaaccccaguaugaacc

SEQ ID NO: 749072 - RNA, 17 nt, Leptospira interrogans serovar lai str. 56601
aaaccccauuaaaaagc

SEQ ID NO: 749073 - RNA, 18 nt, Leptospira interrogans serovar lai str. 56601
aaacccaucguaaacaaa

SEQ ID NO: 749074 - RNA, 21 nt, Leptospira interrogans serovar lai str. 56601
aaaccaguuuguuuuuuauau

SEQ ID NO: 749075 - RNA, 15 nt, Leptospira interrogans serovar lai str. 56601
aaaccauaaaauaaa

SEQ ID NO: 749076 - RNA, 17 nt, Leptospira interrogans serovar lai str. 56601
aaaccauaaaauaaaaa

SEQ ID NO: 749077 - RNA, 15 nt, Leptospira interrogans serovar lai str. 56601
aaaccaucucaaaaa

SEQ ID NO: 749078 - RNA, 14 nt, Leptospira interrogans serovar lai str. 56601
aaacccugccaaaa

SEQ ID NO: 749079 - RNA, 15 nt, Leptospira interrogans serovar lai str. 56601
aaacccugccaaaau

SEQ ID NO: 749080 - RNA, 16 nt, Leptospira interrogans serovar lai str. 56601
aaacccugccaaaauc

SEQ ID NO: 749081 - RNA, 13 nt, Leptospira interrogans serovar lai str. 56601
aaacccuuucuuu

SEQ ID NO: 749082 - RNA, 22 nt, Leptospira interrogans serovar lai str. 56601
aaaccgaaaaucgucccgauca

SEQ ID NO: 749083 - RNA, 18 nt, Leptospira interrogans serovar lai str. 56601
aaaccggagacaguauuu

SEQ ID NO: 749084 - RNA, 22 nt, Leptospira interrogans serovar lai str. 56601
aaaccggagacaguauuuuccg

SEQ ID NO: 749085 - RNA, 19 nt, Leptospira interrogans serovar lai str. 56601
aaaccgcugaaaaaaaaau

SEQ ID NO: 749086 - RNA, 17 nt, Leptospira interrogans serovar lai str. 56601
aaacaguauuuguaaaa

SEQ ID NO: 749087 - RNA, 22 nt, Leptospira interrogans serovar lai str. 56601
aaacaguauuuguaaaaaugag

SEQ ID NO: 749088 - RNA, 23 nt, Leptospira interrogans serovar lai str. 56601
aaacaguacuuuguaauuaaaau

SEQ ID NO: 749089 - RNA, 20 nt, Leptospira interrogans serovar lai str. 56601
aaacaggucccaaacuuucu

SEQ ID NO: 749090 - RNA, 23 nt, Leptospira interrogans serovar lai str. 56601
aaacaggucccaaacuuucuuuu

SEQ ID NO: 749091 - RNA, 13 nt, Leptospira interrogans serovar lai str. 56601
aaacauaaaaauu

SEQ ID NO: 749092 - RNA, 15 nt, Leptospira interrogans serovar lai str. 56601
aaacauaaaaauuuu

SEQ ID NO: 749093 - RNA, 21 nt, Leptospira interrogans serovar lai str. 56601
aaacauaaaaauuuuuuaaac

SEQ ID NO: 749094 - RNA, 14 nt, Leptospira interrogans serovar lai str. 56601
aaacauaagaauau

SEQ ID NO: 749095 - RNA, 21 nt, Leptospira interrogans serovar lai str. 56601
aaacauaagaauauuauaaau

SEQ ID NO: 749096 - RNA, 12 nt, Leptospira interrogans serovar lai str. 56601
aaacauacuuuu

SEQ ID NO: 749097 - RNA, 17 nt, Leptospira interrogans serovar lai str. 56601
aaacauauuggauaauu

SEQ ID NO: 749098 - RNA, 20 nt, Leptospira interrogans serovar lai str. 56601
aaacagagcuuuacaauaaa

SEQ ID NO: 749099 - RNA, 15 nt, Leptospira interrogans serovar lai str. 56601
aaacagagauaggaa

SEQ ID NO: 749100 - RNA, 23 nt, Leptospira interrogans serovar lai str. 56601
aaacacuuuaucuuuucuuaaaa

SEQ ID NO: 749101 - RNA, 13 nt, Leptospira interrogans serovar lai str. 56601
aaacaggaaaauu

SEQ ID NO: 749102 - RNA, 23 nt, Leptospira interrogans serovar lai str. 56601
aaaauugugauuugcgacaguuc

SEQ ID NO: 749103 - RNA, 23 nt, Leptospira interrogans serovar lai str. 56601
aaacaauagcuucuuuaaaaacu

SEQ ID NO: 749104 - RNA, 22 nt, Leptospira interrogans serovar lai str. 56601
aaacaauauucuaauuuuauaa

SEQ ID NO: 749105 - RNA, 17 nt, Leptospira interrogans serovar lai str. 56601
aaacaauucuuccuuuu

SEQ ID NO: 749106 - RNA, 18 nt, Leptospira interrogans serovar lai str. 56601
aaacaauucuuccuuuuu

SEQ ID NO: 749107 - RNA, 17 nt, Leptospira interrogans serovar lai str. 56601
aaacaauugauugcuuu

SEQ ID NO: 749108 - RNA, 22 nt, Leptospira interrogans serovar lai str. 56601
aaacaaucuuagaaugugggaa

SEQ ID NO: 749109 - RNA, 15 nt, Leptospira interrogans serovar lai str. 56601
aaaauugagcuuguu

SEQ ID NO: 749110 - RNA, 15 nt, Leptospira interrogans serovar lai str. 56601
aaaauugaauuuaaa

SEQ ID NO: 749111 - RNA, 20 nt, Leptospira interrogans serovar lai str. 56601
aaaauugaauuuaaaaguuu

SEQ ID NO: 749112 - RNA, 17 nt, Leptospira interrogans serovar lai str. 56601
aaaauugacaaagaguu

SEQ ID NO: 749113 - RNA, 18 nt, Leptospira interrogans serovar lai str. 56601
aaaauugaauaucauaaa

SEQ ID NO: 749114 - RNA, 21 nt, Leptospira interrogans serovar lai str. 56601
aaaauucuuagaguaaaacuu

SEQ ID NO: 749115 - RNA, 20 nt, Leptospira interrogans serovar lai str. 56601
aaaauucuuuuuauuuuuac

SEQ ID NO: 749116 - RNA, 13 nt, Leptospira interrogans serovar lai str. 56601
aaaauugaaacaa

SEQ ID NO: 749117 - RNA, 16 nt, Leptospira interrogans serovar lai str. 56601
aaaauuguagaaacuu

SEQ ID NO: 749118 - RNA, 20 nt, Leptospira interrogans serovar lai str. 56601
aaaauuguagaaacuuauac

SEQ ID NO: 749119 - RNA, 19 nt, Leptospira interrogans serovar lai str. 56601
aaacaccuucucuuuuaaa

SEQ ID NO: 749120 - RNA, 22 nt, Leptospira interrogans serovar lai str. 56601
aaacacuguuucgacguaaaaa

SEQ ID NO: 749121 - RNA, 16 nt, Leptospira interrogans serovar lai str. 56601
aaacacucuaaaucuu

SEQ ID NO: 749122 - RNA, 23 nt, Leptospira interrogans serovar lai str. 56601
aaacacgggaauaaaaacaaaau

SEQ ID NO: 749123 - RNA, 23 nt, Leptospira interrogans serovar lai str. 56601
aaacacuaaguaaaaaugcaaau

SEQ ID NO: 749124 - RNA, 15 nt, Leptospira interrogans serovar lai str. 56601
aaacacaucuuaaaa

SEQ ID NO: 749125 - RNA, 11 nt, Leptospira interrogans serovar lai str. 56601
aaacaauuuuu

SEQ ID NO: 749126 - RNA, 12 nt, Leptospira interrogans serovar lai str. 56601
aaacaauuuuuu

SEQ ID NO: 749127 - RNA, 15 nt, Leptospira interrogans serovar lai str. 56601
aaacaauuuuuugaa

SEQ ID NO: 749128 - RNA, 15 nt, Leptospira interrogans serovar lai str. 56601
aaaaagaaaaaucuu

SEQ ID NO: 749129 - RNA, 13 nt, Leptospira interrogans serovar lai str. 56601
aaaaagaaaaaca

SEQ ID NO: 749130 - RNA, 21 nt, Leptospira interrogans serovar lai str. 56601
aaaaacuuuuuauaaagauuu

SEQ ID NO: 749131 - RNA, 11 nt, Leptospira interrogans serovar lai str. 56601
aaaaagaaaaa

SEQ ID NO: 749132 - RNA, 20 nt, Leptospira interrogans serovar lai str. 56601
aaaaagaaaguugcaaagaa

SEQ ID NO: 749133 - RNA, 13 nt, Leptospira interrogans serovar lai str. 56601
aaaaagaaagcaa

SEQ ID NO: 749134 - RNA, 18 nt, Leptospira interrogans serovar lai str. 56601
aaaaagaaagcaaacuuu

SEQ ID NO: 749135 - RNA, 13 nt, Leptospira interrogans serovar lai str. 56601
aaaaagaaagcag

SEQ ID NO: 749136 - RNA, 17 nt, Leptospira interrogans serovar lai str. 56601
aaaaacuugauauuucu

SEQ ID NO: 749137 - RNA, 23 nt, Leptospira interrogans serovar lai str. 56601
aaaaacuuucggaauaaaacccu

SEQ ID NO: 749138 - RNA, 20 nt, Leptospira interrogans serovar lai str. 56601
aaaaacuuucuaaaaauaag

SEQ ID NO: 749139 - RNA, 22 nt, Leptospira interrogans serovar lai str. 56601
aaaaacuuaugcuauuuaauuu

SEQ ID NO: 749140 - RNA, 20 nt, Leptospira interrogans serovar lai str. 56601
aaaagcugaacuuaaaaucu

SEQ ID NO: 749141 - RNA, 22 nt, Leptospira interrogans serovar lai str. 56601
aaaagcugaacuuaaaaucuau

SEQ ID NO: 749142 - RNA, 14 nt, Leptospira interrogans serovar lai str. 56601
aaaagcuaauaauc

SEQ ID NO: 749143 - RNA, 22 nt, Leptospira interrogans serovar lai str. 56601
aaaagcuuauacuuuaagaaaa

SEQ ID NO: 749144 - RNA, 23 nt, Leptospira interrogans serovar lai str. 56601
aaaaagacucauucuugucggaa

SEQ ID NO: 749145 - RNA, 15 nt, Leptospira interrogans serovar lai str. 56601
aaaaagacuuaaaag

SEQ ID NO: 749146 - RNA, 22 nt, Leptospira interrogans serovar lai str. 56601
aaaaagacuuaaaagaagauuu

SEQ ID NO: 749147 - RNA, 20 nt, Leptospira interrogans serovar lai str. 56601
aaaaagaauuucuaaaauuc

SEQ ID NO: 749148 - RNA, 16 nt, Leptospira interrogans serovar lai str. 56601
aaaaagaauuuuuaaa

SEQ ID NO: 749149 - RNA, 20 nt, Leptospira interrogans serovar lai str. 56601
aaaaagaauuuuuaaaaaua

SEQ ID NO: 749150 - RNA, 23 nt, Leptospira interrogans serovar lai str. 56601
aaaagcgucaacugaaacucuau

SEQ ID NO: 749151 - RNA, 21 nt, Leptospira interrogans serovar lai str. 56601
aaaacgcgauccguaaaaaac

SEQ ID NO: 749152 - RNA, 16 nt, Leptospira interrogans serovar lai str. 56601
aaaacgcucucuacgg

SEQ ID NO: 749153 - RNA, 22 nt, Leptospira interrogans serovar lai str. 56601
aaaacgauucucguucaacuuu

SEQ ID NO: 749154 - RNA, 16 nt, Leptospira interrogans serovar lai str. 56601
aaaacgauuuuucaaa

SEQ ID NO: 749155 - RNA, 18 nt, Leptospira interrogans serovar lai str. 56601
aaaacgauauuuuuuaaa

SEQ ID NO: 749156 - RNA, 21 nt, Leptospira interrogans serovar lai str. 56601
aaaaccuuuauuuaauaaaau

SEQ ID NO: 749157 - RNA, 20 nt, Leptospira interrogans serovar lai str. 56601
aaaacgaaauuauacaaaac

SEQ ID NO: 749158 - RNA, 14 nt, Leptospira interrogans serovar lai str. 56601
aaaacgaauaucau

SEQ ID NO: 749159 - RNA, 19 nt, Leptospira interrogans serovar lai str. 56601
aaaaggcugucuucagcag

SEQ ID NO: 749160 - RNA, 16 nt, Leptospira interrogans serovar lai str. 56601
aaaaggcucucuuuug

SEQ ID NO: 749161 - RNA, 19 nt, Leptospira interrogans serovar lai str. 56601
aaaaggcucucuuuugaga

SEQ ID NO: 749162 - RNA, 15 nt, Leptospira interrogans serovar lai str. 56601
aaaaguccaauuuua

SEQ ID NO: 749163 - RNA, 17 nt, Leptospira interrogans serovar lai str. 56601
aaaaguccaauuuuaaa

SEQ ID NO: 749164 - RNA, 17 nt, Leptospira interrogans serovar lai str. 56601
aaaaguccuuuugagca

SEQ ID NO: 749165 - RNA, 14 nt, Leptospira interrogans serovar lai str. 56601
aaaagucgaaagaa

SEQ ID NO: 749166 - RNA, 16 nt, Leptospira interrogans serovar lai str. 56601
aaaagucgaaagaauu

SEQ ID NO: 749167 - RNA, 17 nt, Leptospira interrogans serovar lai str. 56601
aaaaguccaaaacaaag

SEQ ID NO: 749168 - RNA, 18 nt, Leptospira interrogans serovar lai str. 56601
aaaagucagguuuuauca

SEQ ID NO: 749169 - RNA, 15 nt, Leptospira interrogans serovar lai str. 56601
aaaaggguuuuuaca

SEQ ID NO: 749170 - RNA, 22 nt, Leptospira interrogans serovar lai str. 56601
aaaaggguuuuuacaauuaaau

SEQ ID NO: 749171 - RNA, 23 nt, Leptospira interrogans serovar lai str. 56601
aaaagguguggauaccuuuaguu

SEQ ID NO: 749172 - RNA, 15 nt, Leptospira interrogans serovar lai str. 56601
aaaagguuaaaaauu

SEQ ID NO: 749173 - RNA, 16 nt, Leptospira interrogans serovar lai str. 56601
aaaagguuaaaaauuu

SEQ ID NO: 749174 - RNA, 17 nt, Leptospira interrogans serovar lai str. 56601
aaaagguuaaaaauuua

SEQ ID NO: 749175 - RNA, 15 nt, Leptospira interrogans serovar lai str. 56601
aaaauaaagaaacug

SEQ ID NO: 749176 - RNA, 22 nt, Leptospira interrogans serovar lai str. 56601
aaaauaaaggcccuuuguagaa

SEQ ID NO: 749177 - RNA, 13 nt, Leptospira interrogans serovar lai str. 56601
aaaauaaaaaaau

SEQ ID NO: 749178 - RNA, 13 nt, Leptospira interrogans serovar lai str. 56601
aaaaguuuucaaa

SEQ ID NO: 749179 - RNA, 14 nt, Leptospira interrogans serovar lai str. 56601
aaaauaaaaaaauu

SEQ ID NO: 749180 - RNA, 14 nt, Leptospira interrogans serovar lai str. 56601
aaaauaaaaaacaa

SEQ ID NO: 749181 - RNA, 17 nt, Leptospira interrogans serovar lai str. 56601
aaaauaaauuccccaaa

SEQ ID NO: 749182 - RNA, 21 nt, Leptospira interrogans serovar lai str. 56601
aaaauaaaucgauuacaauua

SEQ ID NO: 749183 - RNA, 11 nt, Leptospira interrogans serovar lai str. 56601
aaaauaagaaa

SEQ ID NO: 749184 - RNA, 17 nt, Leptospira interrogans serovar lai str. 56601
aaaauaagaaaauaaag

SEQ ID NO: 749185 - RNA, 14 nt, Leptospira interrogans serovar lai str. 56601
aaaauaauuuuuac

SEQ ID NO: 749186 - RNA, 23 nt, Leptospira interrogans serovar lai str. 56601
aaaauacaaaguuuguaguaacu

SEQ ID NO: 749187 - RNA, 24 nt, Leptospira interrogans serovar lai str. 56601
aaaauacaaaguuuguaguaacuc

SEQ ID NO: 749188 - RNA, 18 nt, Leptospira interrogans serovar lai str. 56601
aaaaguuggaaucugaau

SEQ ID NO: 749189 - RNA, 22 nt, Leptospira interrogans serovar lai str. 56601
aaaaguuggaaucugaauuuua

SEQ ID NO: 749190 - RNA, 14 nt, Leptospira interrogans serovar lai str. 56601
aaaaguuggaauuu

SEQ ID NO: 749191 - RNA, 15 nt, Leptospira interrogans serovar lai str. 56601
aaaaguuugguccuu

SEQ ID NO: 749192 - RNA, 20 nt, Leptospira interrogans serovar lai str. 56601
aaaaguuugguccuuuguga

SEQ ID NO: 749193 - RNA, 14 nt, Leptospira interrogans serovar lai str. 56601
aaaaguuuuacaaa

SEQ ID NO: 749194 - RNA, 16 nt, Leptospira interrogans serovar lai str. 56601
aaaaguuuuacaaaga

SEQ ID NO: 749195 - RNA, 23 nt, Leptospira interrogans serovar lai str. 56601
aaaaguuuuacaaagaguuuaaa

SEQ ID NO: 749196 - RNA, 22 nt, Leptospira interrogans serovar lai str. 56601
aaaaguuuuucuaaauuuuaua

SEQ ID NO: 749197 - RNA, 23 nt, Leptospira interrogans serovar lai str. 56601
aaaaguuuuucuaaauuuuauaa

SEQ ID NO: 749198 - RNA, 15 nt, Leptospira interrogans serovar lai str. 56601
aaaauacauaaaaaa

SEQ ID NO: 749199 - RNA, 13 nt, Leptospira interrogans serovar lai str. 56601
aaaauacauagga

SEQ ID NO: 749200 - RNA, 22 nt, Leptospira interrogans serovar lai str. 56601
aaaauauauucagaaaacagaa

SEQ ID NO: 749201 - RNA, 20 nt, Leptospira interrogans serovar lai str. 56601
aaaauacauuuguaaauaaa

SEQ ID NO: 749202 - RNA, 20 nt, Leptospira interrogans serovar lai str. 56601
aaaauaucagaucuauuucu

SEQ ID NO: 749203 - RNA, 20 nt, Leptospira interrogans serovar lai str. 56601
aaaauauucgaucaaguaag

SEQ ID NO: 749204 - RNA, 13 nt, Leptospira interrogans serovar lai str. 56601
aaaauauucagaa

SEQ ID NO: 749205 - RNA, 14 nt, Leptospira interrogans serovar lai str. 56601
aaaauauucagaaa

SEQ ID NO: 749206 - RNA, 17 nt, Leptospira interrogans serovar lai str. 56601
aaaaucuucaaguuugu

SEQ ID NO: 749207 - RNA, 15 nt, Leptospira interrogans serovar lai str. 56601
aaaaucuuuaaguuu

SEQ ID NO: 749208 - RNA, 16 nt, Leptospira interrogans serovar lai str. 56601
aaaaucuuuaaguuug

SEQ ID NO: 749209 - RNA, 17 nt, Leptospira interrogans serovar lai str. 56601
aaaaucuuuaaguuugu

SEQ ID NO: 749210 - RNA, 15 nt, Leptospira interrogans serovar lai str. 56601
aaaaucuuaauaaaa

SEQ ID NO: 749211 - RNA, 16 nt, Leptospira interrogans serovar lai str. 56601
aaaaucuuaauaaaau

SEQ ID NO: 749212 - RNA, 17 nt, Leptospira interrogans serovar lai str. 56601
aaaaucuuaaaagaaaa

SEQ ID NO: 749213 - RNA, 18 nt, Leptospira interrogans serovar lai str. 56601
aaaaucauuuaaagcaaa

SEQ ID NO: 749214 - RNA, 20 nt, Leptospira interrogans serovar lai str. 56601
aaaauauuugcauaaacuuc

SEQ ID NO: 749215 - RNA, 12 nt, Leptospira interrogans serovar lai str. 56601
aaaauauuuuga

SEQ ID NO: 749216 - RNA, 12 nt, Leptospira interrogans serovar lai str. 56601
aaaaucaaagag

SEQ ID NO: 749217 - RNA, 19 nt, Leptospira interrogans serovar lai str. 56601
aaaaucauacuuuuaaaaa

SEQ ID NO: 749218 - RNA, 17 nt, Leptospira interrogans serovar lai str. 56601
aaaaucauauuuucaaa

SEQ ID NO: 749219 - RNA, 20 nt, Leptospira interrogans serovar lai str. 56601
aaaaucauauuuucaaaaaa

SEQ ID NO: 749220 - RNA, 21 nt, Leptospira interrogans serovar lai str. 56601
aaaaucauauuuucaaaaaau

SEQ ID NO: 749221 - RNA, 22 nt, Leptospira interrogans serovar lai str. 56601
aaaaucagguuuuauaaaguga

SEQ ID NO: 749222 - RNA, 15 nt, Leptospira interrogans serovar lai str. 56601
aaaaucaguuaauac

SEQ ID NO: 749223 - RNA, 19 nt, Leptospira interrogans serovar lai str. 56601
aaaaucaguuaauacaaaa

SEQ ID NO: 749224 - RNA, 23 nt, Leptospira interrogans serovar lai str. 56601
aaaauguauucuauaaaauuuga

SEQ ID NO: 749225 - RNA, 14 nt, Leptospira interrogans serovar lai str. 56601
aaaauguaaaaacu

SEQ ID NO: 749226 - RNA, 21 nt, Leptospira interrogans serovar lai str. 56601
aaaauguagccaaaaauuaga

SEQ ID NO: 749227 - RNA, 19 nt, Leptospira interrogans serovar lai str. 56601
aaaaugucuaugauuaaag

SEQ ID NO: 749228 - RNA, 11 nt, Leptospira interrogans serovar lai str. 56601
aaaauguggga

SEQ ID NO: 749229 - RNA, 14 nt, Leptospira interrogans serovar lai str. 56601
aaaaugugggaauu

SEQ ID NO: 749230 - RNA, 13 nt, Leptospira interrogans serovar lai str. 56601
aaaauguuaaaaa

SEQ ID NO: 749231 - RNA, 18 nt, Leptospira interrogans serovar lai str. 56601
aaaauguuaaaaaacuau

SEQ ID NO: 749232 - RNA, 14 nt, Leptospira interrogans serovar lai str. 56601
aaaauuaaaaaauc

SEQ ID NO: 749233 - RNA, 15 nt, Leptospira interrogans serovar lai str. 56601
aaaauuaaaaaaucu

SEQ ID NO: 749234 - RNA, 18 nt, Leptospira interrogans serovar lai str. 56601
aaaauuaaaauucuagaa

SEQ ID NO: 749235 - RNA, 14 nt, Leptospira interrogans serovar lai str. 56601
aaaauguuuaaaga

SEQ ID NO: 749236 - RNA, 13 nt, Leptospira interrogans serovar lai str. 56601
aaaauucuccucc

SEQ ID NO: 749237 - RNA, 13 nt, Leptospira interrogans serovar lai str. 56601
aaaauucuagaaa

SEQ ID NO: 749238 - RNA, 18 nt, Leptospira interrogans serovar lai str. 56601
aaaauucuagaaagaauu

SEQ ID NO: 749239 - RNA, 17 nt, Leptospira interrogans serovar lai str. 56601
aaaauucugaaagaguu

SEQ ID NO: 749240 - RNA, 12 nt, Leptospira interrogans serovar lai str. 56601
aaaauucugcuc

SEQ ID NO: 749241 - RNA, 22 nt, Leptospira interrogans serovar lai str. 56601
aaaauucugucguaaaaaguuu

SEQ ID NO: 749242 - RNA, 15 nt, Leptospira interrogans serovar lai str. 56601
aaaauucuuaaaaaa

SEQ ID NO: 749243 - RNA, 18 nt, Leptospira interrogans serovar lai str. 56601
aaaauucuuaaaaaauau

SEQ ID NO: 749244 - RNA, 12 nt, Leptospira interrogans serovar lai str. 56601
aaaauuaauucu

SEQ ID NO: 749245 - RNA, 24 nt, Leptospira interrogans serovar lai str. 56601
aaaauuaauucuccaucuguuucu

SEQ ID NO: 749246 - RNA, 11 nt, Leptospira interrogans serovar lai str. 56601
aaaauuaagaa

SEQ ID NO: 749247 - RNA, 16 nt, Leptospira interrogans serovar lai str. 56601
aaaauuaauccucuuu

SEQ ID NO: 749248 - RNA, 22 nt, Leptospira interrogans serovar lai str. 56601
aaaauuacgcugauuagaauuc

SEQ ID NO: 749249 - RNA, 15 nt, Leptospira interrogans serovar lai str. 56601
aaaauuagaaagaau

SEQ ID NO: 749250 - RNA, 18 nt, Leptospira interrogans serovar lai str. 56601
aaaauuagaauccuguuu

SEQ ID NO: 749251 - RNA, 13 nt, Leptospira interrogans serovar lai str. 56601
aaaauucuaauau

SEQ ID NO: 749252 - RNA, 14 nt, Leptospira interrogans serovar lai str. 56601
aaaaugggaaguuu

SEQ ID NO: 749253 - RNA, 13 nt, Leptospira interrogans serovar lai str. 56601
aaaaugguuuuuu

SEQ ID NO: 749254 - RNA, 14 nt, Leptospira interrogans serovar lai str. 56601
aaaauguaaaaaaa

SEQ ID NO: 749255 - RNA, 21 nt, Leptospira interrogans serovar lai str. 56601
aaaauggguuuucauuuuuac

SEQ ID NO: 749256 - RNA, 12 nt, Leptospira interrogans serovar lai str. 56601
aaaauggauacu

SEQ ID NO: 749257 - RNA, 15 nt, Leptospira interrogans serovar lai str. 56601
aaaaugaacucaaca

SEQ ID NO: 749258 - RNA, 18 nt, Leptospira interrogans serovar lai str. 56601
aaaaugaacucaacagaa

SEQ ID NO: 749259 - RNA, 15 nt, Leptospira interrogans serovar lai str. 56601
aaaaugaaaucuaca

SEQ ID NO: 749260 - RNA, 14 nt, Leptospira interrogans serovar lai str. 56601
aaaaugaaaauuau

SEQ ID NO: 749261 - RNA, 15 nt, Leptospira interrogans serovar lai str. 56601
aaaaugaaaauuaua

SEQ ID NO: 749262 - RNA, 18 nt, Leptospira interrogans serovar lai str. 56601
aaaaucuuuucuauaauc

SEQ ID NO: 749263 - RNA, 22 nt, Leptospira interrogans serovar lai str. 56601
aaaaucuuuucuauaaucugaa

SEQ ID NO: 749264 - RNA, 13 nt, Leptospira interrogans serovar lai str. 56601
aaaaugaaaaaaa

SEQ ID NO: 749265 - RNA, 17 nt, Leptospira interrogans serovar lai str. 56601
aaaaugaaaaaaaacaa

SEQ ID NO: 749266 - RNA, 14 nt, Leptospira interrogans serovar lai str. 56601
aaaaugaaaaaacu

SEQ ID NO: 749267 - RNA, 13 nt, Leptospira interrogans serovar lai str. 56601
aaaaugaaaaauu

SEQ ID NO: 749268 - RNA, 18 nt, Leptospira interrogans serovar lai str. 56601
aaaaugagaaagaauuuc

SEQ ID NO: 749269 - RNA, 14 nt, Leptospira interrogans serovar lai str. 56601
aaaaugaauucucu

SEQ ID NO: 749270 - RNA, 16 nt, Leptospira interrogans serovar lai str. 56601
aaaaugaauucucuau

SEQ ID NO: 749271 - RNA, 15 nt, Leptospira interrogans serovar lai str. 56601
aaaaugaauuguaaa

SEQ ID NO: 749272 - RNA, 13 nt, Leptospira interrogans serovar lai str. 56601
aaaaugaauguuu

SEQ ID NO: 749273 - RNA, 17 nt, Leptospira interrogans serovar lai str. 56601
aaaaugaauguuuaaaa

SEQ ID NO: 749274 - RNA, 21 nt, Leptospira interrogans serovar lai str. 56601
aaaaugaauguuuaaaauuua

SEQ ID NO: 749275 - RNA, 22 nt, Leptospira interrogans serovar lai str. 56601
aaaaugaauuuuuuauuaagaa

SEQ ID NO: 749276 - RNA, 13 nt, Leptospira interrogans serovar lai str. 56601
aaaaugaccaaaa

SEQ ID NO: 749277 - RNA, 16 nt, Leptospira interrogans serovar lai str. 56601
aaaaugaccaaaauuu

SEQ ID NO: 749278 - RNA, 23 nt, Leptospira interrogans serovar lai str. 56601
aaaaugacuaacuacaucaguau

SEQ ID NO: 749279 - RNA, 22 nt, Leptospira interrogans serovar lai str. 56601
aaagaguaauucuaaguaauuu

SEQ ID NO: 749280 - RNA, 14 nt, Leptospira interrogans serovar lai str. 56601
aaagaucugaguuu

SEQ ID NO: 749281 - RNA, 17 nt, Leptospira interrogans serovar lai str. 56601
aaagauucuauuuugag

SEQ ID NO: 749282 - RNA, 22 nt, Leptospira interrogans serovar lai str. 56601
aaagauucuauuuugagaaaau

SEQ ID NO: 749283 - RNA, 21 nt, Leptospira interrogans serovar lai str. 56601
aaagauugaacgguaaaaucu

SEQ ID NO: 749284 - RNA, 12 nt, Leptospira interrogans serovar lai str. 56601
aaagauugaauu

SEQ ID NO: 749285 - RNA, 20 nt, Leptospira interrogans serovar lai str. 56601
aaagcaacugugggaacuac

SEQ ID NO: 749286 - RNA, 19 nt, Leptospira interrogans serovar lai str. 56601
aaagcaauccauucaaaaa

SEQ ID NO: 749287 - RNA, 20 nt, Leptospira interrogans serovar lai str. 56601
aaagauucacuuagaaagau

SEQ ID NO: 749288 - RNA, 22 nt, Leptospira interrogans serovar lai str. 56601
aaagauucacuuagaaagauag

SEQ ID NO: 749289 - RNA, 15 nt, Leptospira interrogans serovar lai str. 56601
aaagauuagaaaaac

SEQ ID NO: 749290 - RNA, 16 nt, Leptospira interrogans serovar lai str. 56601
aaagauuagaaaaacu

SEQ ID NO: 749291 - RNA, 21 nt, Leptospira interrogans serovar lai str. 56601
aaagauuaaagauuugcucuu

SEQ ID NO: 749292 - RNA, 15 nt, Leptospira interrogans serovar lai str. 56601
aaagaucuuauaauu

SEQ ID NO: 749293 - RNA, 19 nt, Leptospira interrogans serovar lai str. 56601
aaaccguuccauaaauuuu

SEQ ID NO: 749294 - RNA, 19 nt, Leptospira interrogans serovar lai str. 56601
aaaccgucccaaaaucuua

SEQ ID NO: 749295 - RNA, 13 nt, Leptospira interrogans serovar lai str. 56601
aaaccucaaaaaa

SEQ ID NO: 749296 - RNA, 14 nt, Leptospira interrogans serovar lai str. 56601
aaacuuuuuauaaa

SEQ ID NO: 749297 - RNA, 19 nt, Leptospira interrogans serovar lai str. 56601
aaaccucucggaauauuuu

SEQ ID NO: 749298 - RNA, 19 nt, Leptospira interrogans serovar lai str. 56601
aaagaaacauaaugcaaua

SEQ ID NO: 749299 - RNA, 17 nt, Leptospira interrogans serovar lai str. 56601
aaagaaacggaagaaaa

SEQ ID NO: 749300 - RNA, 18 nt, Leptospira interrogans serovar lai str. 56601
aaagaaacggaagaaaau

SEQ ID NO: 749301 - RNA, 13 nt, Leptospira interrogans serovar lai str. 56601
aaagaaacauuau

SEQ ID NO: 749302 - RNA, 20 nt, Leptospira interrogans serovar lai str. 56601
aaagaaaccaaucauaguca

SEQ ID NO: 749303 - RNA, 16 nt, Leptospira interrogans serovar lai str. 56601
aaagaaaccuuuauag

SEQ ID NO: 749304 - RNA, 20 nt, Leptospira interrogans serovar lai str. 56601
aaagaaaccuuuauagaauu

SEQ ID NO: 749305 - RNA, 22 nt, Leptospira interrogans serovar lai str. 56601
aaagaaaccuuuauagaauuca

SEQ ID NO: 749306 - RNA, 17 nt, Leptospira interrogans serovar lai str. 56601
aaagaaaguaauuuuga

SEQ ID NO: 749307 - RNA, 11 nt, Leptospira interrogans serovar lai str. 56601
aaagaaaacca

SEQ ID NO: 749308 - RNA, 11 nt, Leptospira interrogans serovar lai str. 56601
aaagaaaaccu

SEQ ID NO: 749309 - RNA, 20 nt, Leptospira interrogans serovar lai str. 56601
aaacuuuuuuagcaaauaac

SEQ ID NO: 749310 - RNA, 13 nt, Leptospira interrogans serovar lai str. 56601
aaacuuuuuugaa

SEQ ID NO: 749311 - RNA, 19 nt, Leptospira interrogans serovar lai str. 56601
aaagaaaaagagaugguuu

SEQ ID NO: 749312 - RNA, 22 nt, Leptospira interrogans serovar lai str. 56601
aaagaaagcaaacuuuuuauaa

SEQ ID NO: 749313 - RNA, 19 nt, Leptospira interrogans serovar lai str. 56601
aaagaaaguugcaaagaag

SEQ ID NO: 749314 - RNA, 14 nt, Leptospira interrogans serovar lai str. 56601
aaagaaauagaaaa

SEQ ID NO: 749315 - RNA, 14 nt, Leptospira interrogans serovar lai str. 56601
aaagaaauuuaaua

SEQ ID NO: 749316 - RNA, 14 nt, Leptospira interrogans serovar lai str. 56601
aaagaacuuugaga

SEQ ID NO: 749317 - RNA, 15 nt, Leptospira interrogans serovar lai str. 56601
aaagaacgauuuuuu

SEQ ID NO: 749318 - RNA, 16 nt, Leptospira interrogans serovar lai str. 56601
aaagaacgauuuuuua

SEQ ID NO: 749319 - RNA, 21 nt, Leptospira interrogans serovar lai str. 56601
aaagaagagccucaaguaaaa

SEQ ID NO: 749320 - RNA, 23 nt, Leptospira interrogans serovar lai str. 56601
aaagaagauaaaacucaaaggaa

SEQ ID NO: 749321 - RNA, 19 nt, Leptospira interrogans serovar lai str. 56601
aaagaagauagauuuauaa

SEQ ID NO: 749322 - RNA, 21 nt, Leptospira interrogans serovar lai str. 56601
aaagaagauagauuuauaaua

SEQ ID NO: 749323 - RNA, 17 nt, Leptospira interrogans serovar lai str. 56601
aaagaauuucuaaaauu

SEQ ID NO: 749324 - RNA, 14 nt, Leptospira interrogans serovar lai str. 56601
aaagaauuuuaaau

SEQ ID NO: 749325 - RNA, 15 nt, Leptospira interrogans serovar lai str. 56601
aaagaauuuuaaauc

SEQ ID NO: 749326 - RNA, 21 nt, Leptospira interrogans serovar lai str. 56601
aaagaauuuuuacagaaaacc

SEQ ID NO: 749327 - RNA, 15 nt, Leptospira interrogans serovar lai str. 56601
aaagaauuuuuggaa

SEQ ID NO: 749328 - RNA, 20 nt, Leptospira interrogans serovar lai str. 56601
aaagaauuaucauguaaaau

SEQ ID NO: 749329 - RNA, 14 nt, Leptospira interrogans serovar lai str. 56601
aaagaauucauuuu

SEQ ID NO: 749330 - RNA, 15 nt, Leptospira interrogans serovar lai str. 56601
aaagaaucuuuuuaa

SEQ ID NO: 749331 - RNA, 15 nt, Leptospira interrogans serovar lai str. 56601
aaagcgauugaagug

SEQ ID NO: 749332 - RNA, 19 nt, Leptospira interrogans serovar lai str. 56601
aaagcucuccaucuuuuuu

SEQ ID NO: 749333 - RNA, 15 nt, Leptospira interrogans serovar lai str. 56601
aaagcucaucucauc

SEQ ID NO: 749334 - RNA, 19 nt, Leptospira interrogans serovar lai str. 56601
aaagcuauaguuuuuaaca

SEQ ID NO: 749335 - RNA, 17 nt, Leptospira interrogans serovar lai str. 56601
aaagcgggauuuugauu

SEQ ID NO: 749336 - RNA, 18 nt, Leptospira interrogans serovar lai str. 56601
aaagcggucuugaaaauu

SEQ ID NO: 749337 - RNA, 14 nt, Leptospira interrogans serovar lai str. 56601
aaagcgucaacuga

SEQ ID NO: 749338 - RNA, 20 nt, Leptospira interrogans serovar lai str. 56601
aaagccguuuucgaaaacuu

SEQ ID NO: 749339 - RNA, 19 nt, Leptospira interrogans serovar lai str. 56601
aaagcauaacgucuugauu

SEQ ID NO: 749340 - RNA, 10 nt, Leptospira interrogans serovar lai str. 56601
aaaguaaaug

SEQ ID NO: 749341 - RNA, 21 nt, Leptospira interrogans serovar lai str. 56601
aaaguaacaguuccuaacaau

SEQ ID NO: 749342 - RNA, 16 nt, Leptospira interrogans serovar lai str. 56601
aaagguauaaaauaaa

SEQ ID NO: 749343 - RNA, 19 nt, Leptospira interrogans serovar lai str. 56601
aaaggcucucuuuugagag

SEQ ID NO: 749344 - RNA, 21 nt, Leptospira interrogans serovar lai str. 56601
aaaggguuuuuacaauuaaau

SEQ ID NO: 749345 - RNA, 14 nt, Leptospira interrogans serovar lai str. 56601
aaaggaaauaaaaa

SEQ ID NO: 749346 - RNA, 16 nt, Leptospira interrogans serovar lai str. 56601
aaaggauccuuuucuu

SEQ ID NO: 749347 - RNA, 19 nt, Leptospira interrogans serovar lai str. 56601
aaagcuugauuauuauuuu

SEQ ID NO: 749348 - RNA, 21 nt, Leptospira interrogans serovar lai str. 56601
aaagcuuguuucaaaaguuag

SEQ ID NO: 749349 - RNA, 15 nt, Leptospira interrogans serovar lai str. 56601
aaaggaaaagaaacc

SEQ ID NO: 749350 - RNA, 20 nt, Leptospira interrogans serovar lai str. 56601
aaaguugggaucugaauuuu

SEQ ID NO: 749351 - RNA, 17 nt, Leptospira interrogans serovar lai str. 56601
aaaguuuagauuuuaac

SEQ ID NO: 749352 - RNA, 18 nt, Leptospira interrogans serovar lai str. 56601
aaaguuuagauuuuaacu

SEQ ID NO: 749353 - RNA, 20 nt, Leptospira interrogans serovar lai str. 56601
aaaguuuagauuuuaacuuu

SEQ ID NO: 749354 - RNA, 20 nt, Leptospira interrogans serovar lai str. 56601
aaaguuucaucuuugaacuu

SEQ ID NO: 749355 - RNA, 22 nt, Leptospira interrogans serovar lai str. 56601
aaaguuuauaaacuucucaaau

SEQ ID NO: 749356 - RNA, 19 nt, Leptospira interrogans serovar lai str. 56601
aaaguugcuaagaaaaaag

SEQ ID NO: 749357 - RNA, 20 nt, Leptospira interrogans serovar lai str. 56601
aaaguuggaaucugaauuuu

SEQ ID NO: 749358 - RNA, 16 nt, Leptospira interrogans serovar lai str. 56601
aaaguugauucuuccu

SEQ ID NO: 749359 - RNA, 13 nt, Leptospira interrogans serovar lai str. 56601
aaaguugcaaaga

SEQ ID NO: 749360 - RNA, 14 nt, Leptospira interrogans serovar lai str. 56601
aaaguugaaaguuu

SEQ ID NO: 749361 - RNA, 19 nt, Leptospira interrogans serovar lai str. 56601
aaaguugaaaguuuuucuu

SEQ ID NO: 749362 - RNA, 12 nt, Leptospira interrogans serovar lai str. 56601
aaaguucuuuuc

SEQ ID NO: 749363 - RNA, 13 nt, Leptospira interrogans serovar lai str. 56601
aaaguucuuuucu

SEQ ID NO: 749364 - RNA, 14 nt, Leptospira interrogans serovar lai str. 56601
aaaguucuuuucuu

SEQ ID NO: 749365 - RNA, 16 nt, Leptospira interrogans serovar lai str. 56601
aaaguucagauucgaa

SEQ ID NO: 749366 - RNA, 14 nt, Leptospira interrogans serovar lai str. 56601
aaaguucacaaauu

SEQ ID NO: 749367 - RNA, 13 nt, Leptospira interrogans serovar lai str. 56601
aaaguucagauuc

SEQ ID NO: 749368 - RNA, 18 nt, Leptospira interrogans serovar lai str. 56601
aaaguuauugaauagaau

SEQ ID NO: 749369 - RNA, 16 nt, Leptospira interrogans serovar lai str. 56601
aaaguuauuauuuuug

SEQ ID NO: 749370 - RNA, 12 nt, Leptospira interrogans serovar lai str. 56601
aaaguuagaaua

SEQ ID NO: 749371 - RNA, 19 nt, Leptospira interrogans serovar lai str. 56601
aaaguuagaaucugaacuu

SEQ ID NO: 749372 - RNA, 15 nt, Leptospira interrogans serovar lai str. 56601
aaaguuuuuuaaaaa

SEQ ID NO: 749373 - RNA, 22 nt, Leptospira interrogans serovar lai str. 56601
aaaguuuugcuguaaaauuuag

SEQ ID NO: 749374 - RNA, 22 nt, Leptospira interrogans serovar lai str. 56601
aaaguuuuuuuauaaaauuaga

SEQ ID NO: 749375 - RNA, 16 nt, Leptospira interrogans serovar lai str. 56601
aaauaaaaaacaaaca

SEQ ID NO: 749376 - RNA, 17 nt, Leptospira interrogans serovar lai str. 56601
aaaguuuuucuaaauuu

SEQ ID NO: 749377 - RNA, 14 nt, Leptospira interrogans serovar lai str. 56601
aaaguuuuugacaa

SEQ ID NO: 749378 - RNA, 13 nt, Leptospira interrogans serovar lai str. 56601
aaaguuuuuaaaa

SEQ ID NO: 749379 - RNA, 14 nt, Leptospira interrogans serovar lai str. 56601
aaaguuucuuauau

SEQ ID NO: 749380 - RNA, 20 nt, Leptospira interrogans serovar lai str. 56601
aaaguuugggcgaauaaaaa

SEQ ID NO: 749381 - RNA, 19 nt, Leptospira interrogans serovar lai str. 56601
aaaguuuucacaaaaaaau

SEQ ID NO: 749382 - RNA, 18 nt, Leptospira interrogans serovar lai str. 56601
aaaguuuucucaaaaucu

SEQ ID NO: 749383 - RNA, 11 nt, Leptospira interrogans serovar lai str. 56601
aaauaaaaaag

SEQ ID NO: 749384 - RNA, 19 nt, Leptospira interrogans serovar lai str. 56601
aaauaaaaacgucaaaauu

SEQ ID NO: 749385 - RNA, 12 nt, Leptospira interrogans serovar lai str. 56601
aaauaaaaauau

SEQ ID NO: 749386 - RNA, 18 nt, Leptospira interrogans serovar lai str. 56601
aaauaaaaauuucagauu

SEQ ID NO: 749387 - RNA, 15 nt, Leptospira interrogans serovar lai str. 56601
aaauaaauaauacau

SEQ ID NO: 749388 - RNA, 16 nt, Leptospira interrogans serovar lai str. 56601
aaauaaauaauacauu

SEQ ID NO: 749389 - RNA, 21 nt, Leptospira interrogans serovar lai str. 56601
aaauaaaggcccuuuguagaa

SEQ ID NO: 749390 - RNA, 17 nt, Leptospira interrogans serovar lai str. 56601
aaauaaagguuuuauag

SEQ ID NO: 749391 - RNA, 20 nt, Leptospira interrogans serovar lai str. 56601
aaauaaagguuuuauagucu

SEQ ID NO: 749392 - RNA, 16 nt, Leptospira interrogans serovar lai str. 56601
aaauaaaguauuuuua

SEQ ID NO: 749393 - RNA, 12 nt, Leptospira interrogans serovar lai str. 56601
aaauaaagaaaa

SEQ ID NO: 749394 - RNA, 13 nt, Leptospira interrogans serovar lai str. 56601
aaauaaagaaaag

SEQ ID NO: 749395 - RNA, 12 nt, Leptospira interrogans serovar lai str. 56601
aaagugaauuuu

SEQ ID NO: 749396 - RNA, 15 nt, Leptospira interrogans serovar lai str. 56601
aaagugaauuuuugu

SEQ ID NO: 749397 - RNA, 14 nt, Leptospira interrogans serovar lai str. 56601
aaagugguugaagu

SEQ ID NO: 749398 - RNA, 15 nt, Leptospira interrogans serovar lai str. 56601
aaaguuaauacaaaa

SEQ ID NO: 749399 - RNA, 15 nt, Leptospira interrogans serovar lai str. 56601
aaaguguucugcuaa

SEQ ID NO: 749400 - RNA, 18 nt, Leptospira interrogans serovar lai str. 56601
aaaguguuaguucccaca

SEQ ID NO: 749401 - RNA, 14 nt, Leptospira interrogans serovar lai str. 56601
aaaguauaauauuu

SEQ ID NO: 749402 - RNA, 21 nt, Leptospira interrogans serovar lai str. 56601
aaaguauaauauuuauuuagu

SEQ ID NO: 749403 - RNA, 13 nt, Leptospira interrogans serovar lai str. 56601
aaaguauaauuua

SEQ ID NO: 749404 - RNA, 16 nt, Leptospira interrogans serovar lai str. 56601
aaaguauaauuuaaaa

SEQ ID NO: 749405 - RNA, 22 nt, Leptospira interrogans serovar lai str. 56601
aaaguaaucguuuaaagauuaa

SEQ ID NO: 749406 - RNA, 17 nt, Leptospira interrogans serovar lai str. 56601
aaaguaacguaaauuuu

SEQ ID NO: 749407 - RNA, 18 nt, Leptospira interrogans serovar lai str. 56601
aaagucugucuuaaaauu

SEQ ID NO: 749408 - RNA, 23 nt, Leptospira interrogans serovar lai str. 56601
aaagucuauuucccaaaauuuca

SEQ ID NO: 749409 - RNA, 19 nt, Leptospira interrogans serovar lai str. 56601
aaaguauauauuaaaguau

SEQ ID NO: 749410 - RNA, 19 nt, Leptospira interrogans serovar lai str. 56601
aaagucuaacaguaaaacu

SEQ ID NO: 749411 - RNA, 20 nt, Leptospira interrogans serovar lai str. 56601
aaauagaucugauauuuuaa

SEQ ID NO: 749412 - RNA, 21 nt, Leptospira interrogans serovar lai str. 56601
aaauagaucugauauuuuaaa

SEQ ID NO: 749413 - RNA, 22 nt, Leptospira interrogans serovar lai str. 56601
aaauagauucuaauuuuucaaa

SEQ ID NO: 749414 - RNA, 19 nt, Leptospira interrogans serovar lai str. 56601
aaauagauggagaauuaau

SEQ ID NO: 749415 - RNA, 18 nt, Leptospira interrogans serovar lai str. 56601
aaauagauuaguuuaaaa

SEQ ID NO: 749416 - RNA, 20 nt, Leptospira interrogans serovar lai str. 56601
aaauagaauaaauuauacaa

SEQ ID NO: 749417 - RNA, 21 nt, Leptospira interrogans serovar lai str. 56601
aaauagagcuuuguaauaaaa

SEQ ID NO: 749418 - RNA, 22 nt, Leptospira interrogans serovar lai str. 56601
aaauagagcuuuguaauaaaaa

SEQ ID NO: 749419 - RNA, 21 nt, Leptospira interrogans serovar lai str. 56601
aaauagaguaccauaaauuuu

SEQ ID NO: 749420 - RNA, 14 nt, Leptospira interrogans serovar lai str. 56601
aaauauaaaucaau

SEQ ID NO: 749421 - RNA, 19 nt, Leptospira interrogans serovar lai str. 56601
aaauauaacaauucucgau

SEQ ID NO: 749422 - RNA, 13 nt, Leptospira interrogans serovar lai str. 56601
aaauauacaauaa

SEQ ID NO: 749423 - RNA, 18 nt, Leptospira interrogans serovar lai str. 56601
aaauauagugguuuguaa

SEQ ID NO: 749424 - RNA, 14 nt, Leptospira interrogans serovar lai str. 56601
aaauauaguuaaau

SEQ ID NO: 749425 - RNA, 22 nt, Leptospira interrogans serovar lai str. 56601
aaauauauucagaaaacagaau

SEQ ID NO: 749426 - RNA, 19 nt, Leptospira interrogans serovar lai str. 56601
aaauaucaaaugugagagu

SEQ ID NO: 749427 - RNA, 13 nt, Leptospira interrogans serovar lai str. 56601
aaauaucuaaucu

SEQ ID NO: 749428 - RNA, 19 nt, Leptospira interrogans serovar lai str. 56601
aaauaucuaaucuuuugaa

SEQ ID NO: 749429 - RNA, 20 nt, Leptospira interrogans serovar lai str. 56601
aaauaucuaaucuuuugaaa

SEQ ID NO: 749430 - RNA, 20 nt, Leptospira interrogans serovar lai str. 56601
aaauaucguauaauguuuau

SEQ ID NO: 749431 - RNA, 18 nt, Leptospira interrogans serovar lai str. 56601
aaauaucuuagaauaaua

SEQ ID NO: 749432 - RNA, 21 nt, Leptospira interrogans serovar lai str. 56601
aaauaucuggaacuuuaauua

SEQ ID NO: 749433 - RNA, 18 nt, Leptospira interrogans serovar lai str. 56601
aaauauccguaaaaccuc

SEQ ID NO: 749434 - RNA, 14 nt, Leptospira interrogans serovar lai str. 56601
aaauaucauuuaac

SEQ ID NO: 749435 - RNA, 14 nt, Leptospira interrogans serovar lai str. 56601
aaauaauuccucca

SEQ ID NO: 749436 - RNA, 15 nt, Leptospira interrogans serovar lai str. 56601
aaauacauacaauga

SEQ ID NO: 749437 - RNA, 16 nt, Leptospira interrogans serovar lai str. 56601
aaauacacucuuucaa

SEQ ID NO: 749438 - RNA, 17 nt, Leptospira interrogans serovar lai str. 56601
aaauacagugucuugaa

SEQ ID NO: 749439 - RNA, 22 nt, Leptospira interrogans serovar lai str. 56601
aaauacagugucuugaaauucu

SEQ ID NO: 749440 - RNA, 20 nt, Leptospira interrogans serovar lai str. 56601
aaauacauaaaaaaauaaua

SEQ ID NO: 749441 - RNA, 18 nt, Leptospira interrogans serovar lai str. 56601
aaauacauaaacgauuau

SEQ ID NO: 749442 - RNA, 21 nt, Leptospira interrogans serovar lai str. 56601
aaauacauaaaugauacuuug

SEQ ID NO: 749443 - RNA, 15 nt, Leptospira interrogans serovar lai str. 56601
aaauacaaaaagaau

SEQ ID NO: 749444 - RNA, 15 nt, Leptospira interrogans serovar lai str. 56601
aaauacaaaaauucu

SEQ ID NO: 749445 - RNA, 16 nt, Leptospira interrogans serovar lai str. 56601
aaauacaaaguuugua

SEQ ID NO: 749446 - RNA, 13 nt, Leptospira interrogans serovar lai str. 56601
aaauacaaaauga

SEQ ID NO: 749447 - RNA, 19 nt, Leptospira interrogans serovar lai str. 56601
aaauacgaucuaauuugua

SEQ ID NO: 749448 - RNA, 20 nt, Leptospira interrogans serovar lai str. 56601
aaauacgaucuaauuuguaa

SEQ ID NO: 749449 - RNA, 18 nt, Leptospira interrogans serovar lai str. 56601
aaauacuuuauuuguauu

SEQ ID NO: 749450 - RNA, 15 nt, Leptospira interrogans serovar lai str. 56601
aaauacuuugauuau

SEQ ID NO: 749451 - RNA, 17 nt, Leptospira interrogans serovar lai str. 56601
aaauacuuuuagaaaau

SEQ ID NO: 749452 - RNA, 20 nt, Leptospira interrogans serovar lai str. 56601
aaauacuuuuagaaaauuag

SEQ ID NO: 749453 - RNA, 13 nt, Leptospira interrogans serovar lai str. 56601
aaauacuuuugaa

SEQ ID NO: 749454 - RNA, 14 nt, Leptospira interrogans serovar lai str. 56601
aaauagaaagacuu

SEQ ID NO: 749455 - RNA, 19 nt, Leptospira interrogans serovar lai str. 56601
aaauagaaauaacuuagaa

SEQ ID NO: 749456 - RNA, 11 nt, Leptospira interrogans serovar lai str. 56601
aaauagaauuu

SEQ ID NO: 749457 - RNA, 22 nt, Leptospira interrogans serovar lai str. 56601
aaauagaauuuugcaaaaaaaa

SEQ ID NO: 749458 - RNA, 14 nt, Leptospira interrogans serovar lai str. 56601
aaauagaauuuuua

SEQ ID NO: 749459 - RNA, 15 nt, Leptospira interrogans serovar lai str. 56601
aaauaccaauaacuu

SEQ ID NO: 749460 - RNA, 15 nt, Leptospira interrogans serovar lai str. 56601
aaauaccgcacuuuu

SEQ ID NO: 749461 - RNA, 13 nt, Leptospira interrogans serovar lai str. 56601
aaauaccgcgaaa

SEQ ID NO: 749462 - RNA, 16 nt, Leptospira interrogans serovar lai str. 56601
aaauaccgcuggaaau

SEQ ID NO: 749463 - RNA, 19 nt, Leptospira interrogans serovar lai str. 56601
aaauaccgcuggaaauauc

SEQ ID NO: 749464 - RNA, 20 nt, Leptospira interrogans serovar lai str. 56601
aaauaccgcuggaaauauca

SEQ ID NO: 749465 - RNA, 21 nt, Leptospira interrogans serovar lai str. 56601
aaauaccgcuggaaauaucaa

SEQ ID NO: 749466 - RNA, 17 nt, Leptospira interrogans serovar lai str. 56601
aaauuucuaaagaauua

SEQ ID NO: 749467 - RNA, 18 nt, Leptospira interrogans serovar lai str. 56601
aaauuucuaaagaauuau

SEQ ID NO: 749468 - RNA, 20 nt, Leptospira interrogans serovar lai str. 56601
aaauuucuaaagaauuauca

SEQ ID NO: 749469 - RNA, 17 nt, Leptospira interrogans serovar lai str. 56601
aaauuucuaauaaaaua

SEQ ID NO: 749470 - RNA, 18 nt, Leptospira interrogans serovar lai str. 56601
aaauuucuaauaaaauau

SEQ ID NO: 749471 - RNA, 21 nt, Leptospira interrogans serovar lai str. 56601
aaauuucagauuuuauuuuga

SEQ ID NO: 749472 - RNA, 20 nt, Leptospira interrogans serovar lai str. 56601
aaauuucuuugucuuuaugc

SEQ ID NO: 749473 - RNA, 14 nt, Leptospira interrogans serovar lai str. 56601
aaauuugaauuuaa

SEQ ID NO: 749474 - RNA, 16 nt, Leptospira interrogans serovar lai str. 56601
aaauuucuuaaaagau

SEQ ID NO: 749475 - RNA, 15 nt, Leptospira interrogans serovar lai str. 56601
aaauuuggaaauugu

SEQ ID NO: 749476 - RNA, 16 nt, Leptospira interrogans serovar lai str. 56601
aaauuugcgaaaaaaa

SEQ ID NO: 749477 - RNA, 17 nt, Leptospira interrogans serovar lai str. 56601
aaauuugcgaaaaaaau

SEQ ID NO: 749478 - RNA, 18 nt, Leptospira interrogans serovar lai str. 56601
aaauuugcgauauucuau

SEQ ID NO: 749479 - RNA, 21 nt, Leptospira interrogans serovar lai str. 56601
aaauuuuauuuauauauauuc

SEQ ID NO: 749480 - RNA, 13 nt, Leptospira interrogans serovar lai str. 56601
aaauuuuaaguuc

SEQ ID NO: 749481 - RNA, 19 nt, Leptospira interrogans serovar lai str. 56601
aaauuuuaaguucagauuc

SEQ ID NO: 749482 - RNA, 22 nt, Leptospira interrogans serovar lai str. 56601
aaauuuuacacguaauucuuug

SEQ ID NO: 749483 - RNA, 14 nt, Leptospira interrogans serovar lai str. 56601
aaauuuauuuuaaa

SEQ ID NO: 749484 - RNA, 19 nt, Leptospira interrogans serovar lai str. 56601
aaauuuaucuguaaaauuu

SEQ ID NO: 749485 - RNA, 18 nt, Leptospira interrogans serovar lai str. 56601
aaauuuauaaauguagga

SEQ ID NO: 749486 - RNA, 16 nt, Leptospira interrogans serovar lai str. 56601
aaauuuauaguuuuua

SEQ ID NO: 749487 - RNA, 13 nt, Leptospira interrogans serovar lai str. 56601
aaauuuaauaaca

SEQ ID NO: 749488 - RNA, 14 nt, Leptospira interrogans serovar lai str. 56601
aaauuuaauuuuua

SEQ ID NO: 749489 - RNA, 17 nt, Leptospira interrogans serovar lai str. 56601
aaauuuacacgauaauu

SEQ ID NO: 749490 - RNA, 14 nt, Leptospira interrogans serovar lai str. 56601
aaauuuacagauac

SEQ ID NO: 749491 - RNA, 23 nt, Leptospira interrogans serovar lai str. 56601
aaauuuaguaguaaauaaaaaac

SEQ ID NO: 749492 - RNA, 16 nt, Leptospira interrogans serovar lai str. 56601
aaauuuacucuuauaa

SEQ ID NO: 749493 - RNA, 21 nt, Leptospira interrogans serovar lai str. 56601
aaauuuacucuuauaaaauuu

SEQ ID NO: 749494 - RNA, 16 nt, Leptospira interrogans serovar lai str. 56601
aaauuuaaaauacuca

SEQ ID NO: 749495 - RNA, 18 nt, Leptospira interrogans serovar lai str. 56601
aaauuuaaaauacucaau

SEQ ID NO: 749496 - RNA, 16 nt, Leptospira interrogans serovar lai str. 56601
aaauuuaaaauauaaa

SEQ ID NO: 749497 - RNA, 23 nt, Leptospira interrogans serovar lai str. 56601
aaauuuaacgacauuagaacuac

SEQ ID NO: 749498 - RNA, 21 nt, Leptospira interrogans serovar lai str. 56601
aaauuguuuucuaaaggaaaa

SEQ ID NO: 749499 - RNA, 20 nt, Leptospira interrogans serovar lai str. 56601
aaauuguuggccuuuuugaa

SEQ ID NO: 749500 - RNA, 20 nt, Leptospira interrogans serovar lai str. 56601
aaauuguucguuucuuaauu

SEQ ID NO: 749501 - RNA, 17 nt, Leptospira interrogans serovar lai str. 56601
aaauuguugaagaauua

SEQ ID NO: 749502 - RNA, 23 nt, Leptospira interrogans serovar lai str. 56601
aaauugugggaacuauuacaaaa

SEQ ID NO: 749503 - RNA, 18 nt, Leptospira interrogans serovar lai str. 56601
aaauugguuuuuauuaua

SEQ ID NO: 749504 - RNA, 16 nt, Leptospira interrogans serovar lai str. 56601
aaauuguaaaucgguu

SEQ ID NO: 749505 - RNA, 17 nt, Leptospira interrogans serovar lai str. 56601
aaauuguauacaggaaa

SEQ ID NO: 749506 - RNA, 18 nt, Leptospira interrogans serovar lai str. 56601
aaauuguaugaagaaaac

SEQ ID NO: 749507 - RNA, 23 nt, Leptospira interrogans serovar lai str. 56601
aaauuguaugaagaaaaccuaaa

SEQ ID NO: 749508 - RNA, 17 nt, Leptospira interrogans serovar lai str. 56601
aaauuggguaucuaaau

SEQ ID NO: 749509 - RNA, 18 nt, Leptospira interrogans serovar lai str. 56601
aaauuggguaucuaaaua

SEQ ID NO: 749510 - RNA, 20 nt, Leptospira interrogans serovar lai str. 56601
aaauuggcgcguaagaccag

SEQ ID NO: 749511 - RNA, 15 nt, Leptospira interrogans serovar lai str. 56601
aaauuggaaagaacu

SEQ ID NO: 749512 - RNA, 16 nt, Leptospira interrogans serovar lai str. 56601
aaauugcauaaaagaa

SEQ ID NO: 749513 - RNA, 20 nt, Leptospira interrogans serovar lai str. 56601
aaauugcauaaaagaaacau

SEQ ID NO: 749514 - RNA, 12 nt, Leptospira interrogans serovar lai str. 56601
aaauucauuuuu

SEQ ID NO: 749515 - RNA, 22 nt, Leptospira interrogans serovar lai str. 56601
aaauucauuuuucugaaaaaag

SEQ ID NO: 749516 - RNA, 22 nt, Leptospira interrogans serovar lai str. 56601
aaauucaugauaguuaauuuua

SEQ ID NO: 749517 - RNA, 13 nt, Leptospira interrogans serovar lai str. 56601
aaauuccauagca

SEQ ID NO: 749518 - RNA, 20 nt, Leptospira interrogans serovar lai str. 56601
aaauuccauagcaacaauua

SEQ ID NO: 749519 - RNA, 18 nt, Leptospira interrogans serovar lai str. 56601
aaauuccacuucucacaa

SEQ ID NO: 749520 - RNA, 15 nt, Leptospira interrogans serovar lai str. 56601
aaauucaguuucaaa

SEQ ID NO: 749521 - RNA, 17 nt, Leptospira interrogans serovar lai str. 56601
aaauucauaaccuuacc

SEQ ID NO: 749522 - RNA, 13 nt, Leptospira interrogans serovar lai str. 56601
aaauucauaauaa

SEQ ID NO: 749523 - RNA, 15 nt, Leptospira interrogans serovar lai str. 56601
aaauucaucaaauuu

SEQ ID NO: 749524 - RNA, 14 nt, Leptospira interrogans serovar lai str. 56601
aaauucaucacuuc

SEQ ID NO: 749525 - RNA, 22 nt, Leptospira interrogans serovar lai str. 56601
aaauucaaaggccgcuucuuua

SEQ ID NO: 749526 - RNA, 22 nt, Leptospira interrogans serovar lai str. 56601
aaauugagcuuguuuuuaaauu

SEQ ID NO: 749527 - RNA, 20 nt, Leptospira interrogans serovar lai str. 56601
aaauugaguuucacaaaaau

SEQ ID NO: 749528 - RNA, 16 nt, Leptospira interrogans serovar lai str. 56601
aaauugauguuuugua

SEQ ID NO: 749529 - RNA, 13 nt, Leptospira interrogans serovar lai str. 56601
aaauugaauucuu

SEQ ID NO: 749530 - RNA, 16 nt, Leptospira interrogans serovar lai str. 56601
aaauugaauucuuccu

SEQ ID NO: 749531 - RNA, 17 nt, Leptospira interrogans serovar lai str. 56601
aaauugaauucuuccuu

SEQ ID NO: 749532 - RNA, 22 nt, Leptospira interrogans serovar lai str. 56601
aaauugaguaccauaaauuuua

SEQ ID NO: 749533 - RNA, 13 nt, Leptospira interrogans serovar lai str. 56601
aaauugaaaccau

SEQ ID NO: 749534 - RNA, 13 nt, Leptospira interrogans serovar lai str. 56601
aaauugaaacuau

SEQ ID NO: 749535 - RNA, 15 nt, Leptospira interrogans serovar lai str. 56601
aaauuccaauuuuuc

SEQ ID NO: 749536 - RNA, 18 nt, Leptospira interrogans serovar lai str. 56601
aaauucuuuuuauuuuua

SEQ ID NO: 749537 - RNA, 19 nt, Leptospira interrogans serovar lai str. 56601
aaauugaauauucacuuuu

SEQ ID NO: 749538 - RNA, 19 nt, Leptospira interrogans serovar lai str. 56601
aacaagcuuuggauuuuga

SEQ ID NO: 749539 - RNA, 14 nt, Leptospira interrogans serovar lai str. 56601
aacaagaauuuauu

SEQ ID NO: 749540 - RNA, 15 nt, Leptospira interrogans serovar lai str. 56601
aacaagauuaacaau

SEQ ID NO: 749541 - RNA, 13 nt, Leptospira interrogans serovar lai str. 56601
aacaacucuucuu

SEQ ID NO: 749542 - RNA, 15 nt, Leptospira interrogans serovar lai str. 56601
aacaacucuucuucu

SEQ ID NO: 749543 - RNA, 16 nt, Leptospira interrogans serovar lai str. 56601
aacaacucuaauacaa

SEQ ID NO: 749544 - RNA, 20 nt, Leptospira interrogans serovar lai str. 56601
aacaacucuauuaaagaagu

SEQ ID NO: 749545 - RNA, 20 nt, Leptospira interrogans serovar lai str. 56601
aacaacucuauuauuauuuu

SEQ ID NO: 749546 - RNA, 13 nt, Leptospira interrogans serovar lai str. 56601
aacaacucuauuu

SEQ ID NO: 749547 - RNA, 16 nt, Leptospira interrogans serovar lai str. 56601
aacaacgauuucugua

SEQ ID NO: 749548 - RNA, 19 nt, Leptospira interrogans serovar lai str. 56601
aacaacccccguuauuaaa

SEQ ID NO: 749549 - RNA, 13 nt, Leptospira interrogans serovar lai str. 56601
aacaacauuagaa

SEQ ID NO: 749550 - RNA, 22 nt, Leptospira interrogans serovar lai str. 56601
aacaacaguacaagaaucaaaa

SEQ ID NO: 749551 - RNA, 14 nt, Leptospira interrogans serovar lai str. 56601
aacaacaaaaaaua

SEQ ID NO: 749552 - RNA, 13 nt, Leptospira interrogans serovar lai str. 56601
aacaaauucuaca

SEQ ID NO: 749553 - RNA, 15 nt, Leptospira interrogans serovar lai str. 56601
aacaaauaucaugau

SEQ ID NO: 749554 - RNA, 17 nt, Leptospira interrogans serovar lai str. 56601
aacaaaauuacuucaau

SEQ ID NO: 749555 - RNA, 19 nt, Leptospira interrogans serovar lai str. 56601
aacaaaauucaaaugucuu

SEQ ID NO: 749556 - RNA, 13 nt, Leptospira interrogans serovar lai str. 56601
aacaaacaaauag

SEQ ID NO: 749557 - RNA, 18 nt, Leptospira interrogans serovar lai str. 56601
aacaaacaaauagaaaua

SEQ ID NO: 749558 - RNA, 22 nt, Leptospira interrogans serovar lai str. 56601
aacaaaauuuacgaaaauuuuu

SEQ ID NO: 749559 - RNA, 19 nt, Leptospira interrogans serovar lai str. 56601
aacaaacacgggaauaaaa

SEQ ID NO: 749560 - RNA, 23 nt, Leptospira interrogans serovar lai str. 56601
aacaaaaucaaagagcaacucug

SEQ ID NO: 749561 - RNA, 15 nt, Leptospira interrogans serovar lai str. 56601
aacaaagaauaccaa

SEQ ID NO: 749562 - RNA, 14 nt, Leptospira interrogans serovar lai str. 56601
aacaaacaugcaau

SEQ ID NO: 749563 - RNA, 19 nt, Leptospira interrogans serovar lai str. 56601
aacaaacuuuuaucgaaug

SEQ ID NO: 749564 - RNA, 20 nt, Leptospira interrogans serovar lai str. 56601
aaauuuuuacgcguaauuuu

SEQ ID NO: 749565 - RNA, 19 nt, Leptospira interrogans serovar lai str. 56601
aaauuuuuaucauaaaaca

SEQ ID NO: 749566 - RNA, 21 nt, Leptospira interrogans serovar lai str. 56601
aaauuuuuaucauaaaacacu

SEQ ID NO: 749567 - RNA, 16 nt, Leptospira interrogans serovar lai str. 56601
aaauuuuuauaaaaua

SEQ ID NO: 749568 - RNA, 23 nt, Leptospira interrogans serovar lai str. 56601
aaauuuuuauaaaauaccaauaa

SEQ ID NO: 749569 - RNA, 16 nt, Leptospira interrogans serovar lai str. 56601
aaauuuuuauacuuuu

SEQ ID NO: 749570 - RNA, 21 nt, Leptospira interrogans serovar lai str. 56601
aaauuuugcaguaaggauucu

SEQ ID NO: 749571 - RNA, 12 nt, Leptospira interrogans serovar lai str. 56601
aaauuuuuaaaa

SEQ ID NO: 749572 - RNA, 16 nt, Leptospira interrogans serovar lai str. 56601
aaauuuuuaauaaaau

SEQ ID NO: 749573 - RNA, 24 nt, Leptospira interrogans serovar lai str. 56601
aaauuuuuaauaaaaugcaguagu

SEQ ID NO: 749574 - RNA, 16 nt, Leptospira interrogans serovar lai str. 56601
aaauuuuuaauauacu

SEQ ID NO: 749575 - RNA, 18 nt, Leptospira interrogans serovar lai str. 56601
aaauuuuuaaucaaaugc

SEQ ID NO: 749576 - RNA, 12 nt, Leptospira interrogans serovar lai str. 56601
aaauuuuccuuu

SEQ ID NO: 749577 - RNA, 13 nt, Leptospira interrogans serovar lai str. 56601
aaauuuuccuuua

SEQ ID NO: 749578 - RNA, 17 nt, Leptospira interrogans serovar lai str. 56601
aaauuuuccuuuaaauu

SEQ ID NO: 749579 - RNA, 13 nt, Leptospira interrogans serovar lai str. 56601
aaauuuucguuuu

SEQ ID NO: 749580 - RNA, 16 nt, Leptospira interrogans serovar lai str. 56601
aaauuuucuaaaagua

SEQ ID NO: 749581 - RNA, 12 nt, Leptospira interrogans serovar lai str. 56601
aaauuuugaagg

SEQ ID NO: 749582 - RNA, 18 nt, Leptospira interrogans serovar lai str. 56601
aaauuuucaucuuuucca

SEQ ID NO: 749583 - RNA, 15 nt, Leptospira interrogans serovar lai str. 56601
aaauuuucuguuuau

SEQ ID NO: 749584 - RNA, 23 nt, Leptospira interrogans serovar lai str. 56601
aaauuuucuguuuauuuugaaua

SEQ ID NO: 749585 - RNA, 16 nt, Leptospira interrogans serovar lai str. 56601
aaauuuuccguuaaua

SEQ ID NO: 749586 - RNA, 23 nt, Leptospira interrogans serovar lai str. 56601
aaauuuuccguuaauaaaucaau

SEQ ID NO: 749587 - RNA, 23 nt, Leptospira interrogans serovar lai str. 56601
aaauuuuuuagaguuaagagaau

SEQ ID NO: 749588 - RNA, 21 nt, Leptospira interrogans serovar lai str. 56601
aaauuuuuuauuuuaugaaua

SEQ ID NO: 749589 - RNA, 22 nt, Leptospira interrogans serovar lai str. 56601
aaauuuuuuauuuuaugaauaa

SEQ ID NO: 749590 - RNA, 13 nt, Leptospira interrogans serovar lai str. 56601
aaauuuuuuccuu

SEQ ID NO: 749591 - RNA, 13 nt, Leptospira interrogans serovar lai str. 56601
aaauuuuuuugua

SEQ ID NO: 749592 - RNA, 14 nt, Leptospira interrogans serovar lai str. 56601
aacaaaaaaacaac

SEQ ID NO: 749593 - RNA, 19 nt, Leptospira interrogans serovar lai str. 56601
aaauuuuuuucuaaaauau

SEQ ID NO: 749594 - RNA, 21 nt, Leptospira interrogans serovar lai str. 56601
aaauuuuuuucuaaaauauag

SEQ ID NO: 749595 - RNA, 18 nt, Leptospira interrogans serovar lai str. 56601
aaauuuuuuuaaaaaugu

SEQ ID NO: 749596 - RNA, 12 nt, Leptospira interrogans serovar lai str. 56601
aaauuuuuucuu

SEQ ID NO: 749597 - RNA, 15 nt, Leptospira interrogans serovar lai str. 56601
aaauuuuuugcaaaa

SEQ ID NO: 749598 - RNA, 21 nt, Leptospira interrogans serovar lai str. 56601
aaauuuuuugcaaaaaaauaa

SEQ ID NO: 749599 - RNA, 22 nt, Leptospira interrogans serovar lai str. 56601
aaauuuuuugcaaaaaaauaaa

SEQ ID NO: 749600 - RNA, 12 nt, Leptospira interrogans serovar lai str. 56601
aacaaaaaaugc

SEQ ID NO: 749601 - RNA, 19 nt, Leptospira interrogans serovar lai str. 56601
aaauuuuuuugauucaaaa

SEQ ID NO: 749602 - RNA, 18 nt, Leptospira interrogans serovar lai str. 56601
aaaugggaugauagauua

SEQ ID NO: 749603 - RNA, 22 nt, Leptospira interrogans serovar lai str. 56601
aaauggccucuugcuaauuucc

SEQ ID NO: 749604 - RNA, 21 nt, Leptospira interrogans serovar lai str. 56601
aaaugcauucaaaaaguuuua

SEQ ID NO: 749605 - RNA, 20 nt, Leptospira interrogans serovar lai str. 56601
aaaugaguuauaguaaaaga

SEQ ID NO: 749606 - RNA, 17 nt, Leptospira interrogans serovar lai str. 56601
aaaugaguuuuagaaua

SEQ ID NO: 749607 - RNA, 17 nt, Leptospira interrogans serovar lai str. 56601
aaaugaguaaacuauug

SEQ ID NO: 749608 - RNA, 20 nt, Leptospira interrogans serovar lai str. 56601
aaaugauacuuuguaaaaug

SEQ ID NO: 749609 - RNA, 17 nt, Leptospira interrogans serovar lai str. 56601
aaaugauagaaacuaau

SEQ ID NO: 749610 - RNA, 18 nt, Leptospira interrogans serovar lai str. 56601
aaaugcagcaaaaccuuc

SEQ ID NO: 749611 - RNA, 21 nt, Leptospira interrogans serovar lai str. 56601
aaaugucuaugauuaaagccg

SEQ ID NO: 749612 - RNA, 23 nt, Leptospira interrogans serovar lai str. 56601
aaaugucauuugugcuauauuca

SEQ ID NO: 749613 - RNA, 21 nt, Leptospira interrogans serovar lai str. 56601
aaauguauguuuacuugaaaa

SEQ ID NO: 749614 - RNA, 15 nt, Leptospira interrogans serovar lai str. 56601
aaauguuuaaagaau

SEQ ID NO: 749615 - RNA, 16 nt, Leptospira interrogans serovar lai str. 56601
aaauguuuuuauaucu

SEQ ID NO: 749616 - RNA, 13 nt, Leptospira interrogans serovar lai str. 56601
aaauguacaauua

SEQ ID NO: 749617 - RNA, 18 nt, Leptospira interrogans serovar lai str. 56601
aaauguauccaauccaaa

SEQ ID NO: 749618 - RNA, 22 nt, Leptospira interrogans serovar lai str. 56601
aaauguaaaaaaauauuaaaac

SEQ ID NO: 749619 - RNA, 22 nt, Leptospira interrogans serovar lai str. 56601
aaauguaaaaacuaccacaaau

SEQ ID NO: 749620 - RNA, 21 nt, Leptospira interrogans serovar lai str. 56601
aaauguaggaacuacuacuuu

SEQ ID NO: 749621 - RNA, 14 nt, Leptospira interrogans serovar lai str. 56601
aaauguaggaacuc

SEQ ID NO: 749622 - RNA, 18 nt, Leptospira interrogans serovar lai str. 56601
aaauguaggaacucauac

SEQ ID NO: 749623 - RNA, 13 nt, Leptospira interrogans serovar lai str. 56601
aaauggguuuuca

SEQ ID NO: 749624 - RNA, 17 nt, Leptospira interrogans serovar lai str. 56601
aaauggguuuucauuuu

SEQ ID NO: 749625 - RNA, 20 nt, Leptospira interrogans serovar lai str. 56601
aaauggguuuucauuuuuac

SEQ ID NO: 749626 - RNA, 16 nt, Leptospira interrogans serovar lai str. 56601
aaauuauacaaaacuc

SEQ ID NO: 749627 - RNA, 23 nt, Leptospira interrogans serovar lai str. 56601
aaauuauacaaaacucuuuaaaa

SEQ ID NO: 749628 - RNA, 18 nt, Leptospira interrogans serovar lai str. 56601
aaauuauacaauuuaaua

SEQ ID NO: 749629 - RNA, 23 nt, Leptospira interrogans serovar lai str. 56601
aaauuauaguaacagaaaaaugu

SEQ ID NO: 749630 - RNA, 20 nt, Leptospira interrogans serovar lai str. 56601
aaauuauagauaauuuuuac

SEQ ID NO: 749631 - RNA, 22 nt, Leptospira interrogans serovar lai str. 56601
aaauuauagauaauuuuuacuc

SEQ ID NO: 749632 - RNA, 18 nt, Leptospira interrogans serovar lai str. 56601
aaauuauuuucaaguaaa

SEQ ID NO: 749633 - RNA, 13 nt, Leptospira interrogans serovar lai str. 56601
aaauuauuuugaa

SEQ ID NO: 749634 - RNA, 14 nt, Leptospira interrogans serovar lai str. 56601
aaauucaaaauaag

SEQ ID NO: 749635 - RNA, 18 nt, Leptospira interrogans serovar lai str. 56601
aaauucaaaauaagaaaa

SEQ ID NO: 749636 - RNA, 22 nt, Leptospira interrogans serovar lai str. 56601
aaauuauuuuuuguuagauucu

SEQ ID NO: 749637 - RNA, 12 nt, Leptospira interrogans serovar lai str. 56601
aaauucaaaauu

SEQ ID NO: 749638 - RNA, 13 nt, Leptospira interrogans serovar lai str. 56601
aaauucaaaauug

SEQ ID NO: 749639 - RNA, 13 nt, Leptospira interrogans serovar lai str. 56601
aaauuagaaagaa

SEQ ID NO: 749640 - RNA, 20 nt, Leptospira interrogans serovar lai str. 56601
aaauuagaaaugauuuuuua

SEQ ID NO: 749641 - RNA, 21 nt, Leptospira interrogans serovar lai str. 56601
aaauuagagaaguuaaaaaau

SEQ ID NO: 749642 - RNA, 14 nt, Leptospira interrogans serovar lai str. 56601
aaauuagaauuuua

SEQ ID NO: 749643 - RNA, 23 nt, Leptospira interrogans serovar lai str. 56601
aaauuacugauuucaaaaauaaa

SEQ ID NO: 749644 - RNA, 12 nt, Leptospira interrogans serovar lai str. 56601
aaauuagcuuaa

SEQ ID NO: 749645 - RNA, 16 nt, Leptospira interrogans serovar lai str. 56601
aaauuagcuuaagaau

SEQ ID NO: 749646 - RNA, 15 nt, Leptospira interrogans serovar lai str. 56601
aaauuagauuauuua

SEQ ID NO: 749647 - RNA, 18 nt, Leptospira interrogans serovar lai str. 56601
aaauuagauuuauugaaa

SEQ ID NO: 749648 - RNA, 22 nt, Leptospira interrogans serovar lai str. 56601
aaauuagauuuauugaaaaaua

SEQ ID NO: 749649 - RNA, 11 nt, Leptospira interrogans serovar lai str. 56601
aaaaagagaau

SEQ ID NO: 749650 - RNA, 15 nt, Leptospira interrogans serovar lai str. 56601
aaauuaaaaaaaaau

SEQ ID NO: 749651 - RNA, 21 nt, Leptospira interrogans serovar lai str. 56601
aaauuaaaaaaaaauguaaaa

SEQ ID NO: 749652 - RNA, 17 nt, Leptospira interrogans serovar lai str. 56601
aaauuaaaaaagagaaa

SEQ ID NO: 749653 - RNA, 20 nt, Leptospira interrogans serovar lai str. 56601
aaauuaaaaaagagaaagaa

SEQ ID NO: 749654 - RNA, 15 nt, Leptospira interrogans serovar lai str. 56601
aaauuaauauuuaua

SEQ ID NO: 749655 - RNA, 16 nt, Leptospira interrogans serovar lai str. 56601
aaauuaauauuuauaa

SEQ ID NO: 749656 - RNA, 15 nt, Leptospira interrogans serovar lai str. 56601
aaaaagaucuuauaa

SEQ ID NO: 749657 - RNA, 16 nt, Leptospira interrogans serovar lai str. 56601
aaaaagcagcuaaaaa

SEQ ID NO: 749658 - RNA, 14 nt, Leptospira interrogans serovar lai str. 56601
aaauuaaguuuauu

SEQ ID NO: 749659 - RNA, 14 nt, Leptospira interrogans serovar lai str. 56601
aaauuaagaaucaa

SEQ ID NO: 749660 - RNA, 16 nt, Leptospira interrogans serovar lai str. 56601
aaauuaagcauuauaa

SEQ ID NO: 749661 - RNA, 20 nt, Leptospira interrogans serovar lai str. 56601
aaauuaagcauuauaaguuu

SEQ ID NO: 749662 - RNA, 16 nt, Leptospira interrogans serovar lai str. 56601
aaaugaauguuuaaaa

SEQ ID NO: 749663 - RNA, 21 nt, Leptospira interrogans serovar lai str. 56601
aaaugaauguuuaaaauuuau

SEQ ID NO: 749664 - RNA, 12 nt, Leptospira interrogans serovar lai str. 56601
aaaugaccaaaa

SEQ ID NO: 749665 - RNA, 14 nt, Leptospira interrogans serovar lai str. 56601
aaaugaccaaaauu

SEQ ID NO: 749666 - RNA, 14 nt, Leptospira interrogans serovar lai str. 56601
aaaugaauuuagaa

SEQ ID NO: 749667 - RNA, 17 nt, Leptospira interrogans serovar lai str. 56601
aaaugaauuuagaaaau

SEQ ID NO: 749668 - RNA, 15 nt, Leptospira interrogans serovar lai str. 56601
aaaugaauuguaaaa

SEQ ID NO: 749669 - RNA, 14 nt, Leptospira interrogans serovar lai str. 56601
aaaugaauuuuuua

SEQ ID NO: 749670 - RNA, 22 nt, Leptospira interrogans serovar lai str. 56601
aaaugacuaacuacaucaguau

SEQ ID NO: 749671 - RNA, 15 nt, Leptospira interrogans serovar lai str. 56601
aaaugagauuuuguc

SEQ ID NO: 749672 - RNA, 20 nt, Leptospira interrogans serovar lai str. 56601
aaaugagauuuugucuccug

SEQ ID NO: 749673 - RNA, 15 nt, Leptospira interrogans serovar lai str. 56601
aaaucuggauuuuga

SEQ ID NO: 749674 - RNA, 16 nt, Leptospira interrogans serovar lai str. 56601
aaaucuuuagaauuuu

SEQ ID NO: 749675 - RNA, 22 nt, Leptospira interrogans serovar lai str. 56601
aaaucuuuaaguuugugagagu

SEQ ID NO: 749676 - RNA, 21 nt, Leptospira interrogans serovar lai str. 56601
aaaucuuuaagagccuuucac

SEQ ID NO: 749677 - RNA, 19 nt, Leptospira interrogans serovar lai str. 56601
aaaucuuuaaaauacuuua

SEQ ID NO: 749678 - RNA, 23 nt, Leptospira interrogans serovar lai str. 56601
aaaucucuuuuacgacuuuauuc

SEQ ID NO: 749679 - RNA, 17 nt, Leptospira interrogans serovar lai str. 56601
aaaucugaaucucuuuu

SEQ ID NO: 749680 - RNA, 14 nt, Leptospira interrogans serovar lai str. 56601
aaaucugaauuuua

SEQ ID NO: 749681 - RNA, 17 nt, Leptospira interrogans serovar lai str. 56601
aaaucugaauuuuacca

SEQ ID NO: 749682 - RNA, 19 nt, Leptospira interrogans serovar lai str. 56601
aaaucugaauuuuaccaaa

SEQ ID NO: 749683 - RNA, 16 nt, Leptospira interrogans serovar lai str. 56601
aaaucugaacauaaaa

SEQ ID NO: 749684 - RNA, 20 nt, Leptospira interrogans serovar lai str. 56601
aaaucugaacuuugcagacu

SEQ ID NO: 749685 - RNA, 20 nt, Leptospira interrogans serovar lai str. 56601
aaaucgucccgaucauccaa

SEQ ID NO: 749686 - RNA, 15 nt, Leptospira interrogans serovar lai str. 56601
aaauccuauuuuaac

SEQ ID NO: 749687 - RNA, 12 nt, Leptospira interrogans serovar lai str. 56601
aaauccuucuuu

SEQ ID NO: 749688 - RNA, 15 nt, Leptospira interrogans serovar lai str. 56601
aaauccuucuuuucu

SEQ ID NO: 749689 - RNA, 16 nt, Leptospira interrogans serovar lai str. 56601
aaaucgacgauuuuac

SEQ ID NO: 749690 - RNA, 17 nt, Leptospira interrogans serovar lai str. 56601
aaaucgaguuucacaaa

SEQ ID NO: 749691 - RNA, 20 nt, Leptospira interrogans serovar lai str. 56601
aaaucgaagaugguacuuua

SEQ ID NO: 749692 - RNA, 22 nt, Leptospira interrogans serovar lai str. 56601
aaaucgaagaugguacuuuacg

SEQ ID NO: 749693 - RNA, 16 nt, Leptospira interrogans serovar lai str. 56601
aaauccguauacuuua

SEQ ID NO: 749694 - RNA, 21 nt, Leptospira interrogans serovar lai str. 56601
aaauccguauacuuuaaaaaa

SEQ ID NO: 749695 - RNA, 14 nt, Leptospira interrogans serovar lai str. 56601
aaauccgaaaaugu

SEQ ID NO: 749696 - RNA, 20 nt, Leptospira interrogans serovar lai str. 56601
aaauccgaugucguuuaaca

SEQ ID NO: 749697 - RNA, 19 nt, Leptospira interrogans serovar lai str. 56601
aaauccacgauuuguggga

SEQ ID NO: 749698 - RNA, 18 nt, Leptospira interrogans serovar lai str. 56601
aaauccaugauucauuuu

SEQ ID NO: 749699 - RNA, 12 nt, Leptospira interrogans serovar lai str. 56601
aaaucccaaaac

SEQ ID NO: 749700 - RNA, 23 nt, Leptospira interrogans serovar lai str. 56601
aaaucccaaaaccgaaucuggaa

SEQ ID NO: 749701 - RNA, 15 nt, Leptospira interrogans serovar lai str. 56601
aaaucccauuuuaac

SEQ ID NO: 749702 - RNA, 15 nt, Leptospira interrogans serovar lai str. 56601
aaaucccauuuuagc

SEQ ID NO: 749703 - RNA, 15 nt, Leptospira interrogans serovar lai str. 56601
aaauccccaguauuu

SEQ ID NO: 749704 - RNA, 17 nt, Leptospira interrogans serovar lai str. 56601
aaauccaaucauagaua

SEQ ID NO: 749705 - RNA, 13 nt, Leptospira interrogans serovar lai str. 56601
aaauauuaauuua

SEQ ID NO: 749706 - RNA, 16 nt, Leptospira interrogans serovar lai str. 56601
aaauauuaauuuaaaa

SEQ ID NO: 749707 - RNA, 19 nt, Leptospira interrogans serovar lai str. 56601
aaauauuauaaauuuaaaa

SEQ ID NO: 749708 - RNA, 21 nt, Leptospira interrogans serovar lai str. 56601
aaauauuauaaauuuaaaaaa

SEQ ID NO: 749709 - RNA, 15 nt, Leptospira interrogans serovar lai str. 56601
aaauauuaaaaaaau

SEQ ID NO: 749710 - RNA, 13 nt, Leptospira interrogans serovar lai str. 56601
aaauauuaaaaca

SEQ ID NO: 749711 - RNA, 15 nt, Leptospira interrogans serovar lai str. 56601
aaauauuaaaacacu

SEQ ID NO: 749712 - RNA, 23 nt, Leptospira interrogans serovar lai str. 56601
aaauauuaagaauucuaaacaca

SEQ ID NO: 749713 - RNA, 16 nt, Leptospira interrogans serovar lai str. 56601
aagaguugaauauuuu

SEQ ID NO: 749714 - RNA, 15 nt, Leptospira interrogans serovar lai str. 56601
aagaguuuaaaaaau

SEQ ID NO: 749715 - RNA, 19 nt, Leptospira interrogans serovar lai str. 56601
aagauaaaacucaaaggaa

SEQ ID NO: 749716 - RNA, 11 nt, Leptospira interrogans serovar lai str. 56601
aagaguuccua

SEQ ID NO: 749717 - RNA, 17 nt, Leptospira interrogans serovar lai str. 56601
aagagugcagauuaaaa

SEQ ID NO: 749718 - RNA, 18 nt, Leptospira interrogans serovar lai str. 56601
aagagucauuuuuaaaua

SEQ ID NO: 749719 - RNA, 11 nt, Leptospira interrogans serovar lai str. 56601
aagagucgauu

SEQ ID NO: 749720 - RNA, 19 nt, Leptospira interrogans serovar lai str. 56601
aagauaaaucguuugcuuu

SEQ ID NO: 749721 - RNA, 13 nt, Leptospira interrogans serovar lai str. 56601
aagauaaauuuag

SEQ ID NO: 749722 - RNA, 14 nt, Leptospira interrogans serovar lai str. 56601
aagauaaauuauag

SEQ ID NO: 749723 - RNA, 16 nt, Leptospira interrogans serovar lai str. 56601
aagauaaaucgcaaau

SEQ ID NO: 749724 - RNA, 18 nt, Leptospira interrogans serovar lai str. 56601
aagaguuuuauccauaaa

SEQ ID NO: 749725 - RNA, 15 nt, Leptospira interrogans serovar lai str. 56601
aagauauuaacaaau

SEQ ID NO: 749726 - RNA, 20 nt, Leptospira interrogans serovar lai str. 56601
aagauauuaacaaauuuaaa

SEQ ID NO: 749727 - RNA, 21 nt, Leptospira interrogans serovar lai str. 56601
aagauauuaacaaauuuaaaa

SEQ ID NO: 749728 - RNA, 16 nt, Leptospira interrogans serovar lai str. 56601
aagauaugaauuaauu

SEQ ID NO: 749729 - RNA, 20 nt, Leptospira interrogans serovar lai str. 56601
aagauauuucaauauaaaaa

SEQ ID NO: 749730 - RNA, 22 nt, Leptospira interrogans serovar lai str. 56601
aagauauuucaauauaaaaauu

SEQ ID NO: 749731 - RNA, 15 nt, Leptospira interrogans serovar lai str. 56601
aagauagauuuauaa

SEQ ID NO: 749732 - RNA, 15 nt, Leptospira interrogans serovar lai str. 56601
aagauaggucaaaaa

SEQ ID NO: 749733 - RNA, 19 nt, Leptospira interrogans serovar lai str. 56601
aagauaggucaaaaaauua

SEQ ID NO: 749734 - RNA, 20 nt, Leptospira interrogans serovar lai str. 56601
aagauagaaguuuauaauaa

SEQ ID NO: 749735 - RNA, 14 nt, Leptospira interrogans serovar lai str. 56601
aagagaauuucuau

SEQ ID NO: 749736 - RNA, 19 nt, Leptospira interrogans serovar lai str. 56601
aagagaauuucuauaaaau

SEQ ID NO: 749737 - RNA, 15 nt, Leptospira interrogans serovar lai str. 56601
aagagagauauacac

SEQ ID NO: 749738 - RNA, 17 nt, Leptospira interrogans serovar lai str. 56601
aagagccaaguugaauc

SEQ ID NO: 749739 - RNA, 23 nt, Leptospira interrogans serovar lai str. 56601
aagagccuaauccaauaaaauuu

SEQ ID NO: 749740 - RNA, 19 nt, Leptospira interrogans serovar lai str. 56601
aagagcuccuacauuuuau

SEQ ID NO: 749741 - RNA, 21 nt, Leptospira interrogans serovar lai str. 56601
aagaccuuuuagauaaauaca

SEQ ID NO: 749742 - RNA, 22 nt, Leptospira interrogans serovar lai str. 56601
aagacgauccuuuuuuguaaag

SEQ ID NO: 749743 - RNA, 13 nt, Leptospira interrogans serovar lai str. 56601
aagacccuaaaaa

SEQ ID NO: 749744 - RNA, 15 nt, Leptospira interrogans serovar lai str. 56601
aagacccuaaaaaau

SEQ ID NO: 749745 - RNA, 20 nt, Leptospira interrogans serovar lai str. 56601
aagaccagugccauuuuucu

SEQ ID NO: 749746 - RNA, 14 nt, Leptospira interrogans serovar lai str. 56601
aagaccuaaacccu

SEQ ID NO: 749747 - RNA, 16 nt, Leptospira interrogans serovar lai str. 56601
aagaccucaaauaacu

SEQ ID NO: 749748 - RNA, 17 nt, Leptospira interrogans serovar lai str. 56601
aagaccucaaauaacuu

SEQ ID NO: 749749 - RNA, 19 nt, Leptospira interrogans serovar lai str. 56601
aagacuauauucuucgcuu

SEQ ID NO: 749750 - RNA, 18 nt, Leptospira interrogans serovar lai str. 56601
aagacucauauuuuuaga

SEQ ID NO: 749751 - RNA, 19 nt, Leptospira interrogans serovar lai str. 56601
aagacucauauuuuuagaa

SEQ ID NO: 749752 - RNA, 23 nt, Leptospira interrogans serovar lai str. 56601
aagacucauauuuuuagaaaauu

SEQ ID NO: 749753 - RNA, 16 nt, Leptospira interrogans serovar lai str. 56601
aagacuauaaaaccuu

SEQ ID NO: 749754 - RNA, 15 nt, Leptospira interrogans serovar lai str. 56601
aagacuaaaaaguua

SEQ ID NO: 749755 - RNA, 12 nt, Leptospira interrogans serovar lai str. 56601
aagacuuugaaa

SEQ ID NO: 749756 - RNA, 19 nt, Leptospira interrogans serovar lai str. 56601
aagagaaccucuauaaaau

SEQ ID NO: 749757 - RNA, 20 nt, Leptospira interrogans serovar lai str. 56601
aagagaaccucuauaaaauc

SEQ ID NO: 749758 - RNA, 18 nt, Leptospira interrogans serovar lai str. 56601
aagaaugagucuuuuuac

SEQ ID NO: 749759 - RNA, 20 nt, Leptospira interrogans serovar lai str. 56601
aagaaugaucgcauaaaauu

SEQ ID NO: 749760 - RNA, 22 nt, Leptospira interrogans serovar lai str. 56601
aagaaucugccccaaaauuuag

SEQ ID NO: 749761 - RNA, 15 nt, Leptospira interrogans serovar lai str. 56601
aagaaucuuuuuaaa

SEQ ID NO: 749762 - RNA, 16 nt, Leptospira interrogans serovar lai str. 56601
aagaaucgauucagag

SEQ ID NO: 749763 - RNA, 19 nt, Leptospira interrogans serovar lai str. 56601
aagaauugaucuaaagggu

SEQ ID NO: 749764 - RNA, 15 nt, Leptospira interrogans serovar lai str. 56601
aagaaucgaaaaaau

SEQ ID NO: 749765 - RNA, 18 nt, Leptospira interrogans serovar lai str. 56601
aagaaucgaaaaaauaca

SEQ ID NO: 749766 - RNA, 14 nt, Leptospira interrogans serovar lai str. 56601
aagaaauauuaaaa

SEQ ID NO: 749767 - RNA, 18 nt, Leptospira interrogans serovar lai str. 56601
aagaaauauuaaaaaaau

SEQ ID NO: 749768 - RNA, 21 nt, Leptospira interrogans serovar lai str. 56601
aagaaauacacggagauaaaa

SEQ ID NO: 749769 - RNA, 22 nt, Leptospira interrogans serovar lai str. 56601
aagaaauacacggagauaaaaa

SEQ ID NO: 749770 - RNA, 17 nt, Leptospira interrogans serovar lai str. 56601
aagaaauagaaaagcau

SEQ ID NO: 749771 - RNA, 20 nt, Leptospira interrogans serovar lai str. 56601
aagaaauagaucugauauuu

SEQ ID NO: 749772 - RNA, 12 nt, Leptospira interrogans serovar lai str. 56601
aagaaaguuuau

SEQ ID NO: 749773 - RNA, 21 nt, Leptospira interrogans serovar lai str. 56601
aagaaaccgaucuuaaaaacu

SEQ ID NO: 749774 - RNA, 16 nt, Leptospira interrogans serovar lai str. 56601
aagacauuggcaaaug

SEQ ID NO: 749775 - RNA, 19 nt, Leptospira interrogans serovar lai str. 56601
aagaauuucuaaaaguaaa

SEQ ID NO: 749776 - RNA, 15 nt, Leptospira interrogans serovar lai str. 56601
aagaauuuaauaaaa

SEQ ID NO: 749777 - RNA, 16 nt, Leptospira interrogans serovar lai str. 56601
aagaauuuaauaaaaa

SEQ ID NO: 749778 - RNA, 19 nt, Leptospira interrogans serovar lai str. 56601
aagaauuuaauaaaaaaau

SEQ ID NO: 749779 - RNA, 15 nt, Leptospira interrogans serovar lai str. 56601
aagaauuuauuucaa

SEQ ID NO: 749780 - RNA, 22 nt, Leptospira interrogans serovar lai str. 56601
aagaauuuccagucgcaccccc

SEQ ID NO: 749781 - RNA, 17 nt, Leptospira interrogans serovar lai str. 56601
aagaauuuccuaaaagu

SEQ ID NO: 749782 - RNA, 20 nt, Leptospira interrogans serovar lai str. 56601
aagaauuuguucauaaaauc

SEQ ID NO: 749783 - RNA, 17 nt, Leptospira interrogans serovar lai str. 56601
aagaauuuuaaaaaaug

SEQ ID NO: 749784 - RNA, 20 nt, Leptospira interrogans serovar lai str. 56601
aagaauuuuaaaaaauguga

SEQ ID NO: 749785 - RNA, 18 nt, Leptospira interrogans serovar lai str. 56601
aagaauuuuagaauauaa

SEQ ID NO: 749786 - RNA, 12 nt, Leptospira interrogans serovar lai str. 56601
aagaauuuuuaa

SEQ ID NO: 749787 - RNA, 14 nt, Leptospira interrogans serovar lai str. 56601
aagaauuuuuaaaa

SEQ ID NO: 749788 - RNA, 12 nt, Leptospira interrogans serovar lai str. 56601
aagaauuuuuac

SEQ ID NO: 749789 - RNA, 14 nt, Leptospira interrogans serovar lai str. 56601
aagacaaacaaaca

SEQ ID NO: 749790 - RNA, 19 nt, Leptospira interrogans serovar lai str. 56601
aagacaaaguauuuucuag

SEQ ID NO: 749791 - RNA, 14 nt, Leptospira interrogans serovar lai str. 56601
aacucugucagguu

SEQ ID NO: 749792 - RNA, 16 nt, Leptospira interrogans serovar lai str. 56601
aacucuuacauuuuga

SEQ ID NO: 749793 - RNA, 22 nt, Leptospira interrogans serovar lai str. 56601
aacugacauuccagcuucuugc

SEQ ID NO: 749794 - RNA, 14 nt, Leptospira interrogans serovar lai str. 56601
aacugagagaaagu

SEQ ID NO: 749795 - RNA, 23 nt, Leptospira interrogans serovar lai str. 56601
aacugaguaccguuuauuuuuau

SEQ ID NO: 749796 - RNA, 14 nt, Leptospira interrogans serovar lai str. 56601
aacucuaaauucag

SEQ ID NO: 749797 - RNA, 15 nt, Leptospira interrogans serovar lai str. 56601
aacucuaaugaauuu

SEQ ID NO: 749798 - RNA, 19 nt, Leptospira interrogans serovar lai str. 56601
aacucuaaugaauuuacca

SEQ ID NO: 749799 - RNA, 16 nt, Leptospira interrogans serovar lai str. 56601
aacucuaauauaaaaa

SEQ ID NO: 749800 - RNA, 16 nt, Leptospira interrogans serovar lai str. 56601
aacucuaauauaaaau

SEQ ID NO: 749801 - RNA, 19 nt, Leptospira interrogans serovar lai str. 56601
aacucuaucacgaaauuug

SEQ ID NO: 749802 - RNA, 14 nt, Leptospira interrogans serovar lai str. 56601
aacucucacaaauc

SEQ ID NO: 749803 - RNA, 16 nt, Leptospira interrogans serovar lai str. 56601
aacucucacaaaucau

SEQ ID NO: 749804 - RNA, 17 nt, Leptospira interrogans serovar lai str. 56601
aacucucacaaaucgug

SEQ ID NO: 749805 - RNA, 16 nt, Leptospira interrogans serovar lai str. 56601
aacucuauuaaagaag

SEQ ID NO: 749806 - RNA, 22 nt, Leptospira interrogans serovar lai str. 56601
aacucuauuucaguucauuccc

SEQ ID NO: 749807 - RNA, 19 nt, Leptospira interrogans serovar lai str. 56601
aacucucuuguaguucaau

SEQ ID NO: 749808 - RNA, 16 nt, Leptospira interrogans serovar lai str. 56601
aacucucguuguaacu

SEQ ID NO: 749809 - RNA, 17 nt, Leptospira interrogans serovar lai str. 56601
aacucgguguaaaaaaa

SEQ ID NO: 749810 - RNA, 20 nt, Leptospira interrogans serovar lai str. 56601
aacuccagaauuagauuaaa

SEQ ID NO: 749811 - RNA, 19 nt, Leptospira interrogans serovar lai str. 56601
aacucccacaauuuugaau

SEQ ID NO: 749812 - RNA, 19 nt, Leptospira interrogans serovar lai str. 56601
aacucccacuuuuaaagaa

SEQ ID NO: 749813 - RNA, 13 nt, Leptospira interrogans serovar lai str. 56601
aacuauacuuguu

SEQ ID NO: 749814 - RNA, 15 nt, Leptospira interrogans serovar lai str. 56601
aacuaucuuaaaaug

SEQ ID NO: 749815 - RNA, 16 nt, Leptospira interrogans serovar lai str. 56601
aacuaucuuaaaauga

SEQ ID NO: 749816 - RNA, 23 nt, Leptospira interrogans serovar lai str. 56601
aacuauccaaaaguuuauaaacu

SEQ ID NO: 749817 - RNA, 20 nt, Leptospira interrogans serovar lai str. 56601
aacuauucuauuaguuuuua

SEQ ID NO: 749818 - RNA, 15 nt, Leptospira interrogans serovar lai str. 56601
aacuauuauaaaaua

SEQ ID NO: 749819 - RNA, 14 nt, Leptospira interrogans serovar lai str. 56601
aacuauuauaauau

SEQ ID NO: 749820 - RNA, 19 nt, Leptospira interrogans serovar lai str. 56601
aacuauuacaaaaucugaa

SEQ ID NO: 749821 - RNA, 17 nt, Leptospira interrogans serovar lai str. 56601
aacuauuacaaauaggu

SEQ ID NO: 749822 - RNA, 22 nt, Leptospira interrogans serovar lai str. 56601
aacggcuuuaguuugaaagaac

SEQ ID NO: 749823 - RNA, 16 nt, Leptospira interrogans serovar lai str. 56601
aacucacacaaaauua

SEQ ID NO: 749824 - RNA, 21 nt, Leptospira interrogans serovar lai str. 56601
aacucaauguaucgcuucuau

SEQ ID NO: 749825 - RNA, 15 nt, Leptospira interrogans serovar lai str. 56601
aacucaauguguugu

SEQ ID NO: 749826 - RNA, 17 nt, Leptospira interrogans serovar lai str. 56601
aacucaauguugcuccu

SEQ ID NO: 749827 - RNA, 15 nt, Leptospira interrogans serovar lai str. 56601
aacucacguuaagua

SEQ ID NO: 749828 - RNA, 18 nt, Leptospira interrogans serovar lai str. 56601
aacucacguuauuuuaac

SEQ ID NO: 749829 - RNA, 19 nt, Leptospira interrogans serovar lai str. 56601
aacucacguuauuuuaacu

SEQ ID NO: 749830 - RNA, 12 nt, Leptospira interrogans serovar lai str. 56601
aacucaguaaaa

SEQ ID NO: 749831 - RNA, 13 nt, Leptospira interrogans serovar lai str. 56601
aacucaguaaaac

SEQ ID NO: 749832 - RNA, 17 nt, Leptospira interrogans serovar lai str. 56601
aacucaguaaaacgcuc

SEQ ID NO: 749833 - RNA, 21 nt, Leptospira interrogans serovar lai str. 56601
aacucaguaaaacgcucucua

SEQ ID NO: 749834 - RNA, 15 nt, Leptospira interrogans serovar lai str. 56601
aacucaguaaacuca

SEQ ID NO: 749835 - RNA, 21 nt, Leptospira interrogans serovar lai str. 56601
aacucagcgaaaauacuucuc

SEQ ID NO: 749836 - RNA, 20 nt, Leptospira interrogans serovar lai str. 56601
aacucacuucgacaacuuug

SEQ ID NO: 749837 - RNA, 16 nt, Leptospira interrogans serovar lai str. 56601
aacucaugauucugaa

SEQ ID NO: 749838 - RNA, 16 nt, Leptospira interrogans serovar lai str. 56601
aacucaugcaauuuuu

SEQ ID NO: 749839 - RNA, 17 nt, Leptospira interrogans serovar lai str. 56601
aacucaugcaauuuuug

SEQ ID NO: 749840 - RNA, 22 nt, Leptospira interrogans serovar lai str. 56601
aacucauauuuuuagaaaauuu

SEQ ID NO: 749841 - RNA, 22 nt, Leptospira interrogans serovar lai str. 56601
aacucaucacaacgcucuuuau

SEQ ID NO: 749842 - RNA, 20 nt, Leptospira interrogans serovar lai str. 56601
aacucauacuucuaaaaaau

SEQ ID NO: 749843 - RNA, 23 nt, Leptospira interrogans serovar lai str. 56601
aacucauaaaauaacuuccauca

SEQ ID NO: 749844 - RNA, 17 nt, Leptospira interrogans serovar lai str. 56601
aacuguaaacuugauua

SEQ ID NO: 749845 - RNA, 16 nt, Leptospira interrogans serovar lai str. 56601
aacuguauuauaaaga

SEQ ID NO: 749846 - RNA, 15 nt, Leptospira interrogans serovar lai str. 56601
aacuucuauuuuaua

SEQ ID NO: 749847 - RNA, 14 nt, Leptospira interrogans serovar lai str. 56601
aacuucuauuuuga

SEQ ID NO: 749848 - RNA, 15 nt, Leptospira interrogans serovar lai str. 56601
aacuucuauuuugag

SEQ ID NO: 749849 - RNA, 15 nt, Leptospira interrogans serovar lai str. 56601
aacuuccauuuuuua

SEQ ID NO: 749850 - RNA, 20 nt, Leptospira interrogans serovar lai str. 56601
aacuuccauuuuuuauauuu

SEQ ID NO: 749851 - RNA, 14 nt, Leptospira interrogans serovar lai str. 56601
aacuguugaaaaaa

SEQ ID NO: 749852 - RNA, 19 nt, Leptospira interrogans serovar lai str. 56601
aacuguugaaaaaauccau

SEQ ID NO: 749853 - RNA, 20 nt, Leptospira interrogans serovar lai str. 56601
aacuguguuucuaauuuucu

SEQ ID NO: 749854 - RNA, 15 nt, Leptospira interrogans serovar lai str. 56601
aacuguuugauacuu

SEQ ID NO: 749855 - RNA, 18 nt, Leptospira interrogans serovar lai str. 56601
aacuuucgagcaguucua

SEQ ID NO: 749856 - RNA, 16 nt, Leptospira interrogans serovar lai str. 56601
aacuuucgagccauuc

SEQ ID NO: 749857 - RNA, 18 nt, Leptospira interrogans serovar lai str. 56601
aacuuucuuuuagaaaau

SEQ ID NO: 749858 - RNA, 12 nt, Leptospira interrogans serovar lai str. 56601
aacuuuccuuuu

SEQ ID NO: 749859 - RNA, 20 nt, Leptospira interrogans serovar lai str. 56601
aacuuuccacuuuucucauc

SEQ ID NO: 749860 - RNA, 12 nt, Leptospira interrogans serovar lai str. 56601
aacuuucaaaau

SEQ ID NO: 749861 - RNA, 14 nt, Leptospira interrogans serovar lai str. 56601
aacuuucaaagaau

SEQ ID NO: 749862 - RNA, 17 nt, Leptospira interrogans serovar lai str. 56601
aacuuucaaagaauaua

SEQ ID NO: 749863 - RNA, 12 nt, Leptospira interrogans serovar lai str. 56601
aacuuucagauu

SEQ ID NO: 749864 - RNA, 16 nt, Leptospira interrogans serovar lai str. 56601
aacuuucagauuaaaa

SEQ ID NO: 749865 - RNA, 17 nt, Leptospira interrogans serovar lai str. 56601
aacuuucagauuaaaac

SEQ ID NO: 749866 - RNA, 21 nt, Leptospira interrogans serovar lai str. 56601
aacuuuauagaucgauucuuu

SEQ ID NO: 749867 - RNA, 14 nt, Leptospira interrogans serovar lai str. 56601
aacuuuagaaaaau

SEQ ID NO: 749868 - RNA, 16 nt, Leptospira interrogans serovar lai str. 56601
aacuuuagaaaaauau

SEQ ID NO: 749869 - RNA, 20 nt, Leptospira interrogans serovar lai str. 56601
aacuuuagaaaaauauuaua

SEQ ID NO: 749870 - RNA, 15 nt, Leptospira interrogans serovar lai str. 56601
aacuuuagaauguaa

SEQ ID NO: 749871 - RNA, 20 nt, Leptospira interrogans serovar lai str. 56601
aacuucucuuaaaauuuaga

SEQ ID NO: 749872 - RNA, 15 nt, Leptospira interrogans serovar lai str. 56601
aacuuuaaaaaauaa

SEQ ID NO: 749873 - RNA, 15 nt, Leptospira interrogans serovar lai str. 56601
aacuugucccaaaac

SEQ ID NO: 749874 - RNA, 17 nt, Leptospira interrogans serovar lai str. 56601
aacuugucccaaaacuu

SEQ ID NO: 749875 - RNA, 20 nt, Leptospira interrogans serovar lai str. 56601
aacuugucccaaaauuucua

SEQ ID NO: 749876 - RNA, 13 nt, Leptospira interrogans serovar lai str. 56601
aacuuuuccagaa

SEQ ID NO: 749877 - RNA, 16 nt, Leptospira interrogans serovar lai str. 56601
aacuuuuauaauucaa

SEQ ID NO: 749878 - RNA, 20 nt, Leptospira interrogans serovar lai str. 56601
aacuuuuauaauucaagacu

SEQ ID NO: 749879 - RNA, 16 nt, Leptospira interrogans serovar lai str. 56601
aacuuuuacuguaaaa

SEQ ID NO: 749880 - RNA, 17 nt, Leptospira interrogans serovar lai str. 56601
aacuuuuacuguaaaau

SEQ ID NO: 749881 - RNA, 13 nt, Leptospira interrogans serovar lai str. 56601
aacuuugaaaauu

SEQ ID NO: 749882 - RNA, 14 nt, Leptospira interrogans serovar lai str. 56601
aacuuugaaaauuu

SEQ ID NO: 749883 - RNA, 16 nt, Leptospira interrogans serovar lai str. 56601
aacuuuuuucagaaaa

SEQ ID NO: 749884 - RNA, 18 nt, Leptospira interrogans serovar lai str. 56601
aacuuuuuucagaaaaag

SEQ ID NO: 749885 - RNA, 18 nt, Leptospira interrogans serovar lai str. 56601
aacuuuuuuuaaaaaauu

SEQ ID NO: 749886 - RNA, 19 nt, Leptospira interrogans serovar lai str. 56601
aacuuuuuuauaaauggau

SEQ ID NO: 749887 - RNA, 17 nt, Leptospira interrogans serovar lai str. 56601
aacuuuuucagaaucau

SEQ ID NO: 749888 - RNA, 19 nt, Leptospira interrogans serovar lai str. 56601
aagaaacaaagaauaccaa

SEQ ID NO: 749889 - RNA, 21 nt, Leptospira interrogans serovar lai str. 56601
aagaaacacuuugagaaagaa

SEQ ID NO: 749890 - RNA, 18 nt, Leptospira interrogans serovar lai str. 56601
aagaaacauaaugcaaua

SEQ ID NO: 749891 - RNA, 19 nt, Leptospira interrogans serovar lai str. 56601
aacgcgacccauaggaaag

SEQ ID NO: 749892 - RNA, 20 nt, Leptospira interrogans serovar lai str. 56601
aacggccgauugaagcguuu

SEQ ID NO: 749893 - RNA, 19 nt, Leptospira interrogans serovar lai str. 56601
aacgcucucuccuauguuu

SEQ ID NO: 749894 - RNA, 22 nt, Leptospira interrogans serovar lai str. 56601
aacgcuaguuuaguguaagaaa

SEQ ID NO: 749895 - RNA, 22 nt, Leptospira interrogans serovar lai str. 56601
aacgacucauggagaauaaaac

SEQ ID NO: 749896 - RNA, 17 nt, Leptospira interrogans serovar lai str. 56601
aacgagacgcugaauua

SEQ ID NO: 749897 - RNA, 20 nt, Leptospira interrogans serovar lai str. 56601
aacgaauugcacauaaaaga

SEQ ID NO: 749898 - RNA, 16 nt, Leptospira interrogans serovar lai str. 56601
aacgaaucauauuuaa

SEQ ID NO: 749899 - RNA, 14 nt, Leptospira interrogans serovar lai str. 56601
aacgagcaucuuua

SEQ ID NO: 749900 - RNA, 17 nt, Leptospira interrogans serovar lai str. 56601
aacgauaucgauagcca

SEQ ID NO: 749901 - RNA, 23 nt, Leptospira interrogans serovar lai str. 56601
aacgauaucgauagccaguguaa

SEQ ID NO: 749902 - RNA, 17 nt, Leptospira interrogans serovar lai str. 56601
aacgauaagucucucuu

SEQ ID NO: 749903 - RNA, 19 nt, Leptospira interrogans serovar lai str. 56601
aacgauacuuaaaaauacc

SEQ ID NO: 749904 - RNA, 14 nt, Leptospira interrogans serovar lai str. 56601
aaccuucuuuaaga

SEQ ID NO: 749905 - RNA, 21 nt, Leptospira interrogans serovar lai str. 56601
aacgaacuuuucuauaaaauc

SEQ ID NO: 749906 - RNA, 15 nt, Leptospira interrogans serovar lai str. 56601
aacgaagaacggaga

SEQ ID NO: 749907 - RNA, 16 nt, Leptospira interrogans serovar lai str. 56601
aacgaaauauauuaga

SEQ ID NO: 749908 - RNA, 16 nt, Leptospira interrogans serovar lai str. 56601
aacgaaauuauacaaa

SEQ ID NO: 749909 - RNA, 19 nt, Leptospira interrogans serovar lai str. 56601
aacgaaauuauacaaaacu

SEQ ID NO: 749910 - RNA, 21 nt, Leptospira interrogans serovar lai str. 56601
aaccuuuguuuccucuugaag

SEQ ID NO: 749911 - RNA, 14 nt, Leptospira interrogans serovar lai str. 56601
aaccuuuauuuaau

SEQ ID NO: 749912 - RNA, 23 nt, Leptospira interrogans serovar lai str. 56601
aaccugaguucgacguaaguaau

SEQ ID NO: 749913 - RNA, 22 nt, Leptospira interrogans serovar lai str. 56601
aaccugauuuuucuguaaaaau

SEQ ID NO: 749914 - RNA, 23 nt, Leptospira interrogans serovar lai str. 56601
aaccugauuuuucuguaaaaaua

SEQ ID NO: 749915 - RNA, 23 nt, Leptospira interrogans serovar lai str. 56601
aaccucgucuaucuuuuuuaaaa

SEQ ID NO: 749916 - RNA, 17 nt, Leptospira interrogans serovar lai str. 56601
aaccucuguaaauacaa

SEQ ID NO: 749917 - RNA, 18 nt, Leptospira interrogans serovar lai str. 56601
aaccugcuccauaaaagu

SEQ ID NO: 749918 - RNA, 15 nt, Leptospira interrogans serovar lai str. 56601
aaccuuacccacaaa

SEQ ID NO: 749919 - RNA, 18 nt, Leptospira interrogans serovar lai str. 56601
aaccuuacccacaaauaa

SEQ ID NO: 749920 - RNA, 23 nt, Leptospira interrogans serovar lai str. 56601
aacccgccccgauuuuuacugau

SEQ ID NO: 749921 - RNA, 22 nt, Leptospira interrogans serovar lai str. 56601
aaccguccaaugugggaacuac

SEQ ID NO: 749922 - RNA, 19 nt, Leptospira interrogans serovar lai str. 56601
aaccuaauguugaaugaaa

SEQ ID NO: 749923 - RNA, 20 nt, Leptospira interrogans serovar lai str. 56601
aaccuagaauagagucuuua

SEQ ID NO: 749924 - RNA, 23 nt, Leptospira interrogans serovar lai str. 56601
aaccuagaauagagucuuuaaaa

SEQ ID NO: 749925 - RNA, 16 nt, Leptospira interrogans serovar lai str. 56601
aaccucaaaaaauuua

SEQ ID NO: 749926 - RNA, 16 nt, Leptospira interrogans serovar lai str. 56601
aaccucaaaaaauuuu

SEQ ID NO: 749927 - RNA, 21 nt, Leptospira interrogans serovar lai str. 56601
aaccuaauaaacaaaauucaa

SEQ ID NO: 749928 - RNA, 21 nt, Leptospira interrogans serovar lai str. 56601
aaccuccguucccacugauca

SEQ ID NO: 749929 - RNA, 20 nt, Leptospira interrogans serovar lai str. 56601
aaccucaacagaauguucuu

SEQ ID NO: 749930 - RNA, 12 nt, Leptospira interrogans serovar lai str. 56601
aaccccauuaaa

SEQ ID NO: 749931 - RNA, 15 nt, Leptospira interrogans serovar lai str. 56601
aaccaccuuuacaua

SEQ ID NO: 749932 - RNA, 16 nt, Leptospira interrogans serovar lai str. 56601
aaccaccuuuacauaa

SEQ ID NO: 749933 - RNA, 22 nt, Leptospira interrogans serovar lai str. 56601
aaccaccucuauggaauuuuuu

SEQ ID NO: 749934 - RNA, 20 nt, Leptospira interrogans serovar lai str. 56601
aaccacccccaccaaaaaua

SEQ ID NO: 749935 - RNA, 17 nt, Leptospira interrogans serovar lai str. 56601
aacauuuuuaaaaauua

SEQ ID NO: 749936 - RNA, 19 nt, Leptospira interrogans serovar lai str. 56601
aacauuuuuaaaaauuaga

SEQ ID NO: 749937 - RNA, 18 nt, Leptospira interrogans serovar lai str. 56601
aacauuuucauauauagu

SEQ ID NO: 749938 - RNA, 18 nt, Leptospira interrogans serovar lai str. 56601
aacauuuguuuuuuauaa

SEQ ID NO: 749939 - RNA, 15 nt, Leptospira interrogans serovar lai str. 56601
aacauuucuaaaaua

SEQ ID NO: 749940 - RNA, 16 nt, Leptospira interrogans serovar lai str. 56601
aacauuucuaaaauau

SEQ ID NO: 749941 - RNA, 18 nt, Leptospira interrogans serovar lai str. 56601
aacaucucaaucaaaauu

SEQ ID NO: 749942 - RNA, 12 nt, Leptospira interrogans serovar lai str. 56601
aacauaaaaauu

SEQ ID NO: 749943 - RNA, 17 nt, Leptospira interrogans serovar lai str. 56601
aacauaaaaauuuuuua

SEQ ID NO: 749944 - RNA, 13 nt, Leptospira interrogans serovar lai str. 56601
aacauaaaaacau

SEQ ID NO: 749945 - RNA, 15 nt, Leptospira interrogans serovar lai str. 56601
aacaucacuuccauu

SEQ ID NO: 749946 - RNA, 16 nt, Leptospira interrogans serovar lai str. 56601
aacaucacuuccauuu

SEQ ID NO: 749947 - RNA, 20 nt, Leptospira interrogans serovar lai str. 56601
aacaucaauuuuauuucuaa

SEQ ID NO: 749948 - RNA, 14 nt, Leptospira interrogans serovar lai str. 56601
aacagcuaucgcca

SEQ ID NO: 749949 - RNA, 14 nt, Leptospira interrogans serovar lai str. 56601
aacaguacuuugua

SEQ ID NO: 749950 - RNA, 20 nt, Leptospira interrogans serovar lai str. 56601
aacaguacuuuguaauuaaa

SEQ ID NO: 749951 - RNA, 22 nt, Leptospira interrogans serovar lai str. 56601
aacaguacuuuguaauuaaaau

SEQ ID NO: 749952 - RNA, 18 nt, Leptospira interrogans serovar lai str. 56601
aacaguaucgaaaauuaa

SEQ ID NO: 749953 - RNA, 18 nt, Leptospira interrogans serovar lai str. 56601
aacaguauucaauuuuua

SEQ ID NO: 749954 - RNA, 13 nt, Leptospira interrogans serovar lai str. 56601
aacaguauuugua

SEQ ID NO: 749955 - RNA, 20 nt, Leptospira interrogans serovar lai str. 56601
aacaguauuuguaaaaauga

SEQ ID NO: 749956 - RNA, 14 nt, Leptospira interrogans serovar lai str. 56601
aacaguaaaacuuu

SEQ ID NO: 749957 - RNA, 14 nt, Leptospira interrogans serovar lai str. 56601
aagauccaaauuuu

SEQ ID NO: 749958 - RNA, 20 nt, Leptospira interrogans serovar lai str. 56601
aagcgagacgaaaaacucag

SEQ ID NO: 749959 - RNA, 22 nt, Leptospira interrogans serovar lai str. 56601
aagcgacgauagaagcgagaga

SEQ ID NO: 749960 - RNA, 17 nt, Leptospira interrogans serovar lai str. 56601
aaggauguggaaguuuu

SEQ ID NO: 749961 - RNA, 21 nt, Leptospira interrogans serovar lai str. 56601
aaggauuagcaugaaauuuuc

SEQ ID NO: 749962 - RNA, 22 nt, Leptospira interrogans serovar lai str. 56601
aaggcagcuaagaaaaaaguug

SEQ ID NO: 749963 - RNA, 13 nt, Leptospira interrogans serovar lai str. 56601
aaggcuaaagaau

SEQ ID NO: 749964 - RNA, 17 nt, Leptospira interrogans serovar lai str. 56601
aaggccgcuucuuuauu

SEQ ID NO: 749965 - RNA, 16 nt, Leptospira interrogans serovar lai str. 56601
aaggcugucuucagca

SEQ ID NO: 749966 - RNA, 16 nt, Leptospira interrogans serovar lai str. 56601
aaggcucgaauuuuuu

SEQ ID NO: 749967 - RNA, 16 nt, Leptospira interrogans serovar lai str. 56601
aaggaauauucauuca

SEQ ID NO: 749968 - RNA, 15 nt, Leptospira interrogans serovar lai str. 56601
aaggaauccaugauu

SEQ ID NO: 749969 - RNA, 16 nt, Leptospira interrogans serovar lai str. 56601
aaggaaccaucaccaa

SEQ ID NO: 749970 - RNA, 23 nt, Leptospira interrogans serovar lai str. 56601
aaggaagauaaaacguacuuacu

SEQ ID NO: 749971 - RNA, 12 nt, Leptospira interrogans serovar lai str. 56601
aaggaucaaauc

SEQ ID NO: 749972 - RNA, 20 nt, Leptospira interrogans serovar lai str. 56601
aaggauccaauacaaaacaa

SEQ ID NO: 749973 - RNA, 14 nt, Leptospira interrogans serovar lai str. 56601
aagcucaucucauc

SEQ ID NO: 749974 - RNA, 15 nt, Leptospira interrogans serovar lai str. 56601
aagcuuuagaaaaua

SEQ ID NO: 749975 - RNA, 17 nt, Leptospira interrogans serovar lai str. 56601
aagcuuuagaaaauaau

SEQ ID NO: 749976 - RNA, 19 nt, Leptospira interrogans serovar lai str. 56601
aagcuuguuucaaaaguua

SEQ ID NO: 749977 - RNA, 22 nt, Leptospira interrogans serovar lai str. 56601
aaggaaauucauuuuucugaaa

SEQ ID NO: 749978 - RNA, 22 nt, Leptospira interrogans serovar lai str. 56601
aagcuuuauuaaauuauauuuu

SEQ ID NO: 749979 - RNA, 12 nt, Leptospira interrogans serovar lai str. 56601
aaguguuuuugu

SEQ ID NO: 749980 - RNA, 22 nt, Leptospira interrogans serovar lai str. 56601
aaguguuuuucacaaguuaaau

SEQ ID NO: 749981 - RNA, 14 nt, Leptospira interrogans serovar lai str. 56601
aaguuaaaacauuu

SEQ ID NO: 749982 - RNA, 18 nt, Leptospira interrogans serovar lai str. 56601
aaguuaagaagauaaaua

SEQ ID NO: 749983 - RNA, 13 nt, Leptospira interrogans serovar lai str. 56601
aaguuaagaguuu

SEQ ID NO: 749984 - RNA, 15 nt, Leptospira interrogans serovar lai str. 56601
aaguguuugcugagu

SEQ ID NO: 749985 - RNA, 18 nt, Leptospira interrogans serovar lai str. 56601
aaguguggucuauuacaa

SEQ ID NO: 749986 - RNA, 22 nt, Leptospira interrogans serovar lai str. 56601
aaguguggucuauuacaaaacu

SEQ ID NO: 749987 - RNA, 17 nt, Leptospira interrogans serovar lai str. 56601
aaguuacauuaugaauu

SEQ ID NO: 749988 - RNA, 12 nt, Leptospira interrogans serovar lai str. 56601
aaguuaauucua

SEQ ID NO: 749989 - RNA, 14 nt, Leptospira interrogans serovar lai str. 56601
aaguuaauucuaaa

SEQ ID NO: 749990 - RNA, 15 nt, Leptospira interrogans serovar lai str. 56601
aaguuaauaggauuu

SEQ ID NO: 749991 - RNA, 13 nt, Leptospira interrogans serovar lai str. 56601
aaguucaaaaaaa

SEQ ID NO: 749992 - RNA, 14 nt, Leptospira interrogans serovar lai str. 56601
aaguucaaaaaaag

SEQ ID NO: 749993 - RNA, 14 nt, Leptospira interrogans serovar lai str. 56601
aaguuacucauuuc

SEQ ID NO: 749994 - RNA, 12 nt, Leptospira interrogans serovar lai str. 56601
aaguugaaugag

SEQ ID NO: 749995 - RNA, 11 nt, Leptospira interrogans serovar lai str. 56601
aaguugaauag

SEQ ID NO: 749996 - RNA, 14 nt, Leptospira interrogans serovar lai str. 56601
aaguugaauaggau

SEQ ID NO: 749997 - RNA, 22 nt, Leptospira interrogans serovar lai str. 56601
aaguugagaauauaagaaagua

SEQ ID NO: 749998 - RNA, 19 nt, Leptospira interrogans serovar lai str. 56601
aagucuaacaguaaaacuu

SEQ ID NO: 749999 - RNA, 15 nt, Leptospira interrogans serovar lai str. 56601
aagucuagaaaugua

SEQ ID NO: 750000 - RNA, 17 nt, Leptospira interrogans serovar lai str. 56601
aagucuauuucccaaaa

SEQ ID NO: 750001 - RNA, 19 nt, Leptospira interrogans serovar lai str. 56601
aagucuauuucccaaaauu

SEQ ID NO: 750002 - RNA, 22 nt, Leptospira interrogans serovar lai str. 56601
aagucuauuucccaaaauuuca

SEQ ID NO: 750003 - RNA, 15 nt, Leptospira interrogans serovar lai str. 56601
aagugaaaauuacaa

SEQ ID NO: 750004 - RNA, 19 nt, Leptospira interrogans serovar lai str. 56601
aagugaaccucuguaaaua

SEQ ID NO: 750005 - RNA, 22 nt, Leptospira interrogans serovar lai str. 56601
aagugaaccucuguaaauacaa

SEQ ID NO: 750006 - RNA, 20 nt, Leptospira interrogans serovar lai str. 56601
aagucuccagcauuuagaaa

SEQ ID NO: 750007 - RNA, 16 nt, Leptospira interrogans serovar lai str. 56601
aagucagguuuuauca

SEQ ID NO: 750008 - RNA, 22 nt, Leptospira interrogans serovar lai str. 56601
aagucagguuuuaucaaauaaa

SEQ ID NO: 750009 - RNA, 15 nt, Leptospira interrogans serovar lai str. 56601
aaguccaauuuuaaa

SEQ ID NO: 750010 - RNA, 15 nt, Leptospira interrogans serovar lai str. 56601
aaguccacccaaacc

SEQ ID NO: 750011 - RNA, 18 nt, Leptospira interrogans serovar lai str. 56601
aaguccacccaaaccgga

SEQ ID NO: 750012 - RNA, 16 nt, Leptospira interrogans serovar lai str. 56601
aaguccaaaacaaagu

SEQ ID NO: 750013 - RNA, 14 nt, Leptospira interrogans serovar lai str. 56601
aaguccaaaucaaa

SEQ ID NO: 750014 - RNA, 13 nt, Leptospira interrogans serovar lai str. 56601
aagucgaaagaau

SEQ ID NO: 750015 - RNA, 16 nt, Leptospira interrogans serovar lai str. 56601
aaguagcgaugaucga

SEQ ID NO: 750016 - RNA, 18 nt, Leptospira interrogans serovar lai str. 56601
aaguaguaugcgaaauuc

SEQ ID NO: 750017 - RNA, 15 nt, Leptospira interrogans serovar lai str. 56601
aaguaguaacacuca

SEQ ID NO: 750018 - RNA, 17 nt, Leptospira interrogans serovar lai str. 56601
aaguauaaguuccuaca

SEQ ID NO: 750019 - RNA, 15 nt, Leptospira interrogans serovar lai str. 56601
aaguauaauauuuau

SEQ ID NO: 750020 - RNA, 18 nt, Leptospira interrogans serovar lai str. 56601
aaguauauauuaaaguau

SEQ ID NO: 750021 - RNA, 14 nt, Leptospira interrogans serovar lai str. 56601
aaguaucuaaaagu

SEQ ID NO: 750022 - RNA, 17 nt, Leptospira interrogans serovar lai str. 56601
aagucaaaaaaugguuu

SEQ ID NO: 750023 - RNA, 18 nt, Leptospira interrogans serovar lai str. 56601
aaguauuuuacgauucaa

SEQ ID NO: 750024 - RNA, 19 nt, Leptospira interrogans serovar lai str. 56601
aaguauuguuaagauaaau

SEQ ID NO: 750025 - RNA, 21 nt, Leptospira interrogans serovar lai str. 56601
aaguauuguuaagauaaauuu

SEQ ID NO: 750026 - RNA, 15 nt, Leptospira interrogans serovar lai str. 56601
aaguauuugaucuca

SEQ ID NO: 750027 - RNA, 22 nt, Leptospira interrogans serovar lai str. 56601
aaguauuugaucucaauauaaa

SEQ ID NO: 750028 - RNA, 20 nt, Leptospira interrogans serovar lai str. 56601
aaguauuccauauagagaau

SEQ ID NO: 750029 - RNA, 15 nt, Leptospira interrogans serovar lai str. 56601
aaguauuauuuuuau

SEQ ID NO: 750030 - RNA, 19 nt, Leptospira interrogans serovar lai str. 56601
aaguaugaaguaaguuaua

SEQ ID NO: 750031 - RNA, 14 nt, Leptospira interrogans serovar lai str. 56601
aaguauucuauuua

SEQ ID NO: 750032 - RNA, 21 nt, Leptospira interrogans serovar lai str. 56601
aaguauucucccccaacugaa

SEQ ID NO: 750033 - RNA, 13 nt, Leptospira interrogans serovar lai str. 56601
aaguauuauaaau

SEQ ID NO: 750034 - RNA, 19 nt, Leptospira interrogans serovar lai str. 56601
aaguauuauaaauuuugag

SEQ ID NO: 750035 - RNA, 21 nt, Leptospira interrogans serovar lai str. 56601
aaguauguuuuucuaauagag

SEQ ID NO: 750036 - RNA, 22 nt, Leptospira interrogans serovar lai str. 56601
aagucacauuguguuuuuuaac

SEQ ID NO: 750037 - RNA, 17 nt, Leptospira interrogans serovar lai str. 56601
aaguaauuuaaaaaaau

SEQ ID NO: 750038 - RNA, 17 nt, Leptospira interrogans serovar lai str. 56601
aaguaauggauuuuuau

SEQ ID NO: 750039 - RNA, 22 nt, Leptospira interrogans serovar lai str. 56601
aaguaauuuaucuguaauuuua

SEQ ID NO: 750040 - RNA, 20 nt, Leptospira interrogans serovar lai str. 56601
aaguacgaaaccucuauuuu

SEQ ID NO: 750041 - RNA, 15 nt, Leptospira interrogans serovar lai str. 56601
aaguagaaauuuaau

SEQ ID NO: 750042 - RNA, 16 nt, Leptospira interrogans serovar lai str. 56601
aaguagaaagauuaaa

SEQ ID NO: 750043 - RNA, 16 nt, Leptospira interrogans serovar lai str. 56601
aaguagagagugaaaa

SEQ ID NO: 750044 - RNA, 19 nt, Leptospira interrogans serovar lai str. 56601
aaguagagagugaaaaauc

SEQ ID NO: 750045 - RNA, 13 nt, Leptospira interrogans serovar lai str. 56601
aaguagauaaauu

SEQ ID NO: 750046 - RNA, 17 nt, Leptospira interrogans serovar lai str. 56601
aaguagauaaauucuua

SEQ ID NO: 750047 - RNA, 14 nt, Leptospira interrogans serovar lai str. 56601
aaguacuaauucaa

SEQ ID NO: 750048 - RNA, 23 nt, Leptospira interrogans serovar lai str. 56601
aaguacuaauucaauaaguuuac

SEQ ID NO: 750049 - RNA, 14 nt, Leptospira interrogans serovar lai str. 56601
aaguaaaauuaaaa

SEQ ID NO: 750050 - RNA, 15 nt, Leptospira interrogans serovar lai str. 56601
aaguaaaauuaaagu

SEQ ID NO: 750051 - RNA, 22 nt, Leptospira interrogans serovar lai str. 56601
aaguaaaacguagauaauuaaa

SEQ ID NO: 750052 - RNA, 14 nt, Leptospira interrogans serovar lai str. 56601
aaguaaaaaagagc

SEQ ID NO: 750053 - RNA, 16 nt, Leptospira interrogans serovar lai str. 56601
aaaaauguaaaaaaau

SEQ ID NO: 750054 - RNA, 18 nt, Leptospira interrogans serovar lai str. 56601
aaaaauguaaaaaaauau

SEQ ID NO: 750055 - RNA, 22 nt, Leptospira interrogans serovar lai str. 56601
aaaaauguaaaaaaauauuaaa

SEQ ID NO: 750056 - RNA, 23 nt, Leptospira interrogans serovar lai str. 56601
aauaccauucauuucauauccaa

SEQ ID NO: 750057 - RNA, 21 nt, Leptospira interrogans serovar lai str. 56601
aaaaauguauucuauaaaauu

SEQ ID NO: 750058 - RNA, 23 nt, Leptospira interrogans serovar lai str. 56601
aaaaaugaaucaugaauuccuua

SEQ ID NO: 750059 - RNA, 14 nt, Leptospira interrogans serovar lai str. 56601
aaaaaugaauguuu

SEQ ID NO: 750060 - RNA, 17 nt, Leptospira interrogans serovar lai str. 56601
aaaaaugaauucucuau

SEQ ID NO: 750061 - RNA, 15 nt, Leptospira interrogans serovar lai str. 56601
aaaaaugaauuuuuc

SEQ ID NO: 750062 - RNA, 19 nt, Leptospira interrogans serovar lai str. 56601
aaaaaugaauuuuuuauua

SEQ ID NO: 750063 - RNA, 23 nt, Leptospira interrogans serovar lai str. 56601
aaaaaugagaaagaauuucuaaa

SEQ ID NO: 750064 - RNA, 16 nt, Leptospira interrogans serovar lai str. 56601
aaaaaugaguaaacua

SEQ ID NO: 750065 - RNA, 19 nt, Leptospira interrogans serovar lai str. 56601
aaaaaugauacuauuaauu

SEQ ID NO: 750066 - RNA, 20 nt, Leptospira interrogans serovar lai str. 56601
aaaaaugauacuauuaauuu

SEQ ID NO: 750067 - RNA, 18 nt, Leptospira interrogans serovar lai str. 56601
aaaaaugaucuaagauuu

SEQ ID NO: 750068 - RNA, 16 nt, Leptospira interrogans serovar lai str. 56601
aaaaaugcaaaaguuu

SEQ ID NO: 750069 - RNA, 17 nt, Leptospira interrogans serovar lai str. 56601
aaaaaugcaaaaguuuu

SEQ ID NO: 750070 - RNA, 20 nt, Leptospira interrogans serovar lai str. 56601
aaaaaugcaaaaguuuucaa

SEQ ID NO: 750071 - RNA, 18 nt, Leptospira interrogans serovar lai str. 56601
aauacauucuuauaaaga

SEQ ID NO: 750072 - RNA, 23 nt, Leptospira interrogans serovar lai str. 56601
aauacacucuuucaauguuuuuc

SEQ ID NO: 750073 - RNA, 19 nt, Leptospira interrogans serovar lai str. 56601
aauacauuaagauuauauu

SEQ ID NO: 750074 - RNA, 12 nt, Leptospira interrogans serovar lai str. 56601
aauacauuuuag

SEQ ID NO: 750075 - RNA, 11 nt, Leptospira interrogans serovar lai str. 56601
aaaaauaggga

SEQ ID NO: 750076 - RNA, 20 nt, Leptospira interrogans serovar lai str. 56601
aaaaauagggaaaacucaac

SEQ ID NO: 750077 - RNA, 19 nt, Leptospira interrogans serovar lai str. 56601
aaaaauaguauccaaaauu

SEQ ID NO: 750078 - RNA, 12 nt, Leptospira interrogans serovar lai str. 56601
aaaaauagaauu

SEQ ID NO: 750079 - RNA, 21 nt, Leptospira interrogans serovar lai str. 56601
aaaaauagaauuuuuguagaa

SEQ ID NO: 750080 - RNA, 16 nt, Leptospira interrogans serovar lai str. 56601
aaaaauagauguggga

SEQ ID NO: 750081 - RNA, 20 nt, Leptospira interrogans serovar lai str. 56601
aaaaauagcagaugagcauu

SEQ ID NO: 750082 - RNA, 22 nt, Leptospira interrogans serovar lai str. 56601
aaaaauaggaguuccuacauuu

SEQ ID NO: 750083 - RNA, 22 nt, Leptospira interrogans serovar lai str. 56601
aauaauacagaauucauuuuac

SEQ ID NO: 750084 - RNA, 23 nt, Leptospira interrogans serovar lai str. 56601
aauaauacauuggggaaguaauu

SEQ ID NO: 750085 - RNA, 21 nt, Leptospira interrogans serovar lai str. 56601
aaaaaucuucaguucuuauag

SEQ ID NO: 750086 - RNA, 21 nt, Leptospira interrogans serovar lai str. 56601
aauaauuucccauaaaaagag

SEQ ID NO: 750087 - RNA, 17 nt, Leptospira interrogans serovar lai str. 56601
aauaauuuuaauauuuc

SEQ ID NO: 750088 - RNA, 19 nt, Leptospira interrogans serovar lai str. 56601
aauaauuuuaauauuucga

SEQ ID NO: 750089 - RNA, 13 nt, Leptospira interrogans serovar lai str. 56601
aauacaaaaaacu

SEQ ID NO: 750090 - RNA, 17 nt, Leptospira interrogans serovar lai str. 56601
aauacaaaaaauguuua

SEQ ID NO: 750091 - RNA, 20 nt, Leptospira interrogans serovar lai str. 56601
aauacaaaaacgauuauuag

SEQ ID NO: 750092 - RNA, 13 nt, Leptospira interrogans serovar lai str. 56601
aauacaaaaagaa

SEQ ID NO: 750093 - RNA, 15 nt, Leptospira interrogans serovar lai str. 56601
aauacaaaaagaaua

SEQ ID NO: 750094 - RNA, 15 nt, Leptospira interrogans serovar lai str. 56601
aauaauguauugcuu

SEQ ID NO: 750095 - RNA, 16 nt, Leptospira interrogans serovar lai str. 56601
aaaaauccccuuucua

SEQ ID NO: 750096 - RNA, 17 nt, Leptospira interrogans serovar lai str. 56601
aauaaccaauuuuauga

SEQ ID NO: 750097 - RNA, 20 nt, Leptospira interrogans serovar lai str. 56601
aauaagauuuguugaaaagu

SEQ ID NO: 750098 - RNA, 14 nt, Leptospira interrogans serovar lai str. 56601
aauaagauuuuaga

SEQ ID NO: 750099 - RNA, 15 nt, Leptospira interrogans serovar lai str. 56601
aauaagauuuuagaa

SEQ ID NO: 750100 - RNA, 22 nt, Leptospira interrogans serovar lai str. 56601
aauaagaguuacuacaauuuua

SEQ ID NO: 750101 - RNA, 18 nt, Leptospira interrogans serovar lai str. 56601
aauaaauccggaaguaau

SEQ ID NO: 750102 - RNA, 22 nt, Leptospira interrogans serovar lai str. 56601
aauaaauccggaaguaauuaca

SEQ ID NO: 750103 - RNA, 16 nt, Leptospira interrogans serovar lai str. 56601
aauaaaucaaaaggaa

SEQ ID NO: 750104 - RNA, 22 nt, Leptospira interrogans serovar lai str. 56601
aauaaaucaauuuucuuucuaa

SEQ ID NO: 750105 - RNA, 23 nt, Leptospira interrogans serovar lai str. 56601
aaguuuacaauggaaaguguuag

SEQ ID NO: 750106 - RNA, 14 nt, Leptospira interrogans serovar lai str. 56601
aauaaaugugggaa

SEQ ID NO: 750107 - RNA, 19 nt, Leptospira interrogans serovar lai str. 56601
aauaacaugcaguaguucc

SEQ ID NO: 750108 - RNA, 13 nt, Leptospira interrogans serovar lai str. 56601
aaguuuaaaaaca

SEQ ID NO: 750109 - RNA, 21 nt, Leptospira interrogans serovar lai str. 56601
aaguugauugacguccuuaua

SEQ ID NO: 750110 - RNA, 18 nt, Leptospira interrogans serovar lai str. 56601
aauaaguaaaucuagcaa

SEQ ID NO: 750111 - RNA, 20 nt, Leptospira interrogans serovar lai str. 56601
aauaaggagcaccuaacccu

SEQ ID NO: 750112 - RNA, 15 nt, Leptospira interrogans serovar lai str. 56601
aauaaguuuacauca

SEQ ID NO: 750113 - RNA, 14 nt, Leptospira interrogans serovar lai str. 56601
aauaaguuuuauau

SEQ ID NO: 750114 - RNA, 14 nt, Leptospira interrogans serovar lai str. 56601
aauaauaauauuuu

SEQ ID NO: 750115 - RNA, 16 nt, Leptospira interrogans serovar lai str. 56601
aauaauaauauuuuua

SEQ ID NO: 750116 - RNA, 21 nt, Leptospira interrogans serovar lai str. 56601
aaaaaguuuuucuaaauuuua

SEQ ID NO: 750117 - RNA, 14 nt, Leptospira interrogans serovar lai str. 56601
aaaaaguucucuuc

SEQ ID NO: 750118 - RNA, 20 nt, Leptospira interrogans serovar lai str. 56601
aaaaaguugcuaagaaaaaa

SEQ ID NO: 750119 - RNA, 23 nt, Leptospira interrogans serovar lai str. 56601
aaaaaguugcuaagaaaaaagca

SEQ ID NO: 750120 - RNA, 20 nt, Leptospira interrogans serovar lai str. 56601
aaaaaguuuuacaaagaguu

SEQ ID NO: 750121 - RNA, 20 nt, Leptospira interrogans serovar lai str. 56601
aaaaaguuuuauaaacgauu

SEQ ID NO: 750122 - RNA, 23 nt, Leptospira interrogans serovar lai str. 56601
aaaaauaaaugugggaacucuca

SEQ ID NO: 750123 - RNA, 23 nt, Leptospira interrogans serovar lai str. 56601
aaaaauaacaauagcuuaaaagu

SEQ ID NO: 750124 - RNA, 12 nt, Leptospira interrogans serovar lai str. 56601
aaaaauaaauca

SEQ ID NO: 750125 - RNA, 12 nt, Leptospira interrogans serovar lai str. 56601
aaaaauaaaaug

SEQ ID NO: 750126 - RNA, 15 nt, Leptospira interrogans serovar lai str. 56601
aaaaauaaaguauuu

SEQ ID NO: 750127 - RNA, 14 nt, Leptospira interrogans serovar lai str. 56601
aauaagcugaacaa

SEQ ID NO: 750128 - RNA, 21 nt, Leptospira interrogans serovar lai str. 56601
aaaaaguuaauucuaaaucug

SEQ ID NO: 750129 - RNA, 21 nt, Leptospira interrogans serovar lai str. 56601
aaaaaguguuuauaauuuuua

SEQ ID NO: 750130 - RNA, 22 nt, Leptospira interrogans serovar lai str. 56601
aaaaaguguuuauaauuuuuac

SEQ ID NO: 750131 - RNA, 20 nt, Leptospira interrogans serovar lai str. 56601
aauaucggaaucgaggaaau

SEQ ID NO: 750132 - RNA, 15 nt, Leptospira interrogans serovar lai str. 56601
aauaucuaaucuuuu

SEQ ID NO: 750133 - RNA, 15 nt, Leptospira interrogans serovar lai str. 56601
aauaucguucuagaa

SEQ ID NO: 750134 - RNA, 17 nt, Leptospira interrogans serovar lai str. 56601
aauaucugaauuuuuau

SEQ ID NO: 750135 - RNA, 18 nt, Leptospira interrogans serovar lai str. 56601
aauaucugccuucuuuuu

SEQ ID NO: 750136 - RNA, 15 nt, Leptospira interrogans serovar lai str. 56601
aauaucuuagaauaa

SEQ ID NO: 750137 - RNA, 17 nt, Leptospira interrogans serovar lai str. 56601
aauauccguaaaaccuc

SEQ ID NO: 750138 - RNA, 18 nt, Leptospira interrogans serovar lai str. 56601
aauaucauaaauuuuuau

SEQ ID NO: 750139 - RNA, 15 nt, Leptospira interrogans serovar lai str. 56601
aauaucauaacaaau

SEQ ID NO: 750140 - RNA, 16 nt, Leptospira interrogans serovar lai str. 56601
aauaucagaucuauuu

SEQ ID NO: 750141 - RNA, 22 nt, Leptospira interrogans serovar lai str. 56601
aauaucaaugaucauauccgaa

SEQ ID NO: 750142 - RNA, 22 nt, Leptospira interrogans serovar lai str. 56601
aauaucaaaugugagaguuccc

SEQ ID NO: 750143 - RNA, 18 nt, Leptospira interrogans serovar lai str. 56601
aauaucaaaaugaacaau

SEQ ID NO: 750144 - RNA, 16 nt, Leptospira interrogans serovar lai str. 56601
aauauaucuucuuugg

SEQ ID NO: 750145 - RNA, 23 nt, Leptospira interrogans serovar lai str. 56601
aauauauucuuuucugaauaaaa

SEQ ID NO: 750146 - RNA, 16 nt, Leptospira interrogans serovar lai str. 56601
aauauauucaaaagau

SEQ ID NO: 750147 - RNA, 18 nt, Leptospira interrogans serovar lai str. 56601
aauauauucaaaagauug

SEQ ID NO: 750148 - RNA, 15 nt, Leptospira interrogans serovar lai str. 56601
aauauauucaauuuc

SEQ ID NO: 750149 - RNA, 14 nt, Leptospira interrogans serovar lai str. 56601
aauauaucagauug

SEQ ID NO: 750150 - RNA, 23 nt, Leptospira interrogans serovar lai str. 56601
aauauaguauaaauucgcaaaaa

SEQ ID NO: 750151 - RNA, 19 nt, Leptospira interrogans serovar lai str. 56601
aauauagugguuuguaaua

SEQ ID NO: 750152 - RNA, 22 nt, Leptospira interrogans serovar lai str. 56601
aauauagugguuuguaauaguu

SEQ ID NO: 750153 - RNA, 15 nt, Leptospira interrogans serovar lai str. 56601
aauauaguuaaauuu

SEQ ID NO: 750154 - RNA, 23 nt, Leptospira interrogans serovar lai str. 56601
aauauacgugaccaggaauacuu

SEQ ID NO: 750155 - RNA, 19 nt, Leptospira interrogans serovar lai str. 56601
aauauaaguuaagugaaaa

SEQ ID NO: 750156 - RNA, 10 nt, Leptospira interrogans serovar lai str. 56601
aauauaauaa

SEQ ID NO: 750157 - RNA, 14 nt, Leptospira interrogans serovar lai str. 56601
aauauaauaaaauu

SEQ ID NO: 750158 - RNA, 16 nt, Leptospira interrogans serovar lai str. 56601
aauauaauaaaauuau

SEQ ID NO: 750159 - RNA, 17 nt, Leptospira interrogans serovar lai str. 56601
aauauaauaaaauuauu

SEQ ID NO: 750160 - RNA, 18 nt, Leptospira interrogans serovar lai str. 56601
aauauaaccucaacauaa

SEQ ID NO: 750161 - RNA, 14 nt, Leptospira interrogans serovar lai str. 56601
aauagcuuaaaagu

SEQ ID NO: 750162 - RNA, 17 nt, Leptospira interrogans serovar lai str. 56601
aauagcuuaaaagugau

SEQ ID NO: 750163 - RNA, 16 nt, Leptospira interrogans serovar lai str. 56601
aauagagaaaaauuuu

SEQ ID NO: 750164 - RNA, 22 nt, Leptospira interrogans serovar lai str. 56601
aauagauagagaauuaauuuuu

SEQ ID NO: 750165 - RNA, 16 nt, Leptospira interrogans serovar lai str. 56601
aauagaauuuuuauga

SEQ ID NO: 750166 - RNA, 21 nt, Leptospira interrogans serovar lai str. 56601
aauagaauuuuuaugagcuuu

SEQ ID NO: 750167 - RNA, 16 nt, Leptospira interrogans serovar lai str. 56601
aauagaauuuuuguag

SEQ ID NO: 750168 - RNA, 11 nt, Leptospira interrogans serovar lai str. 56601
aauagaauccu

SEQ ID NO: 750169 - RNA, 21 nt, Leptospira interrogans serovar lai str. 56601
aauagaauccuauaauaaaau

SEQ ID NO: 750170 - RNA, 22 nt, Leptospira interrogans serovar lai str. 56601
aauagaauccuauaauaaaauu

SEQ ID NO: 750171 - RNA, 19 nt, Leptospira interrogans serovar lai str. 56601
aauagaagcaauaaaauca

SEQ ID NO: 750172 - RNA, 19 nt, Leptospira interrogans serovar lai str. 56601
aauagaucugauauuuuaa

SEQ ID NO: 750173 - RNA, 21 nt, Leptospira interrogans serovar lai str. 56601
aauagaucugauauuuuaaau

SEQ ID NO: 750174 - RNA, 22 nt, Leptospira interrogans serovar lai str. 56601
aauagaucugauauuuuaaauu

SEQ ID NO: 750175 - RNA, 14 nt, Leptospira interrogans serovar lai str. 56601
aauagauugauaau

SEQ ID NO: 750176 - RNA, 23 nt, Leptospira interrogans serovar lai str. 56601
aauagauggagaauuaauuuuuu

SEQ ID NO: 750177 - RNA, 20 nt, Leptospira interrogans serovar lai str. 56601
aauagaauuguugaaaaauu

SEQ ID NO: 750178 - RNA, 16 nt, Leptospira interrogans serovar lai str. 56601
aauagaauuuggcuuu

SEQ ID NO: 750179 - RNA, 17 nt, Leptospira interrogans serovar lai str. 56601
aauagaauuuggcuuug

SEQ ID NO: 750180 - RNA, 24 nt, Leptospira interrogans serovar lai str. 56601
aaaaauguaaucucgauuucuaaa

SEQ ID NO: 750181 - RNA, 20 nt, Leptospira interrogans serovar lai str. 56601
aauaccuauacaauucuuuc

SEQ ID NO: 750182 - RNA, 21 nt, Leptospira interrogans serovar lai str. 56601
aauaccugcaaccgaagaauc

SEQ ID NO: 750183 - RNA, 22 nt, Leptospira interrogans serovar lai str. 56601
aauaccuaauucucuucguuuu

SEQ ID NO: 750184 - RNA, 16 nt, Leptospira interrogans serovar lai str. 56601
aauauaaaaaauaaua

SEQ ID NO: 750185 - RNA, 12 nt, Leptospira interrogans serovar lai str. 56601
aauauaaaagau

SEQ ID NO: 750186 - RNA, 12 nt, Leptospira interrogans serovar lai str. 56601
aauauaaaaaau

SEQ ID NO: 750187 - RNA, 23 nt, Leptospira interrogans serovar lai str. 56601
aauaguuuauacuuuaauaauau

SEQ ID NO: 750188 - RNA, 21 nt, Leptospira interrogans serovar lai str. 56601
aauauaaaucaaucauauuuu

SEQ ID NO: 750189 - RNA, 12 nt, Leptospira interrogans serovar lai str. 56601
aauauaaaaucu

SEQ ID NO: 750190 - RNA, 13 nt, Leptospira interrogans serovar lai str. 56601
aauauaaaauuuu

SEQ ID NO: 750191 - RNA, 16 nt, Leptospira interrogans serovar lai str. 56601
aauauaaaauuuuuau

SEQ ID NO: 750192 - RNA, 17 nt, Leptospira interrogans serovar lai str. 56601
aauauaaacugucggaa

SEQ ID NO: 750193 - RNA, 19 nt, Leptospira interrogans serovar lai str. 56601
aauaguuacgacauuuuaa

SEQ ID NO: 750194 - RNA, 13 nt, Leptospira interrogans serovar lai str. 56601
aauaguuagaagu

SEQ ID NO: 750195 - RNA, 22 nt, Leptospira interrogans serovar lai str. 56601
aauaguuagaaguugaucuuau

SEQ ID NO: 750196 - RNA, 17 nt, Leptospira interrogans serovar lai str. 56601
aauaguuccuauauuuu

SEQ ID NO: 750197 - RNA, 19 nt, Leptospira interrogans serovar lai str. 56601
aauaguauauuuucugcuu

SEQ ID NO: 750198 - RNA, 20 nt, Leptospira interrogans serovar lai str. 56601
aauaguauauuuucugcuua

SEQ ID NO: 750199 - RNA, 16 nt, Leptospira interrogans serovar lai str. 56601
aauagugauacaaugu

SEQ ID NO: 750200 - RNA, 22 nt, Leptospira interrogans serovar lai str. 56601
aauaguaagcccccgaagaauu

SEQ ID NO: 750201 - RNA, 13 nt, Leptospira interrogans serovar lai str. 56601
aauagggguuuua

SEQ ID NO: 750202 - RNA, 15 nt, Leptospira interrogans serovar lai str. 56601
aauagggaaaacuca

SEQ ID NO: 750203 - RNA, 15 nt, Leptospira interrogans serovar lai str. 56601
aauaggaucagaauu

SEQ ID NO: 750204 - RNA, 17 nt, Leptospira interrogans serovar lai str. 56601
aauaggauuuaaauuuu

SEQ ID NO: 750205 - RNA, 14 nt, Leptospira interrogans serovar lai str. 56601
aauaggauuuuaga

SEQ ID NO: 750206 - RNA, 14 nt, Leptospira interrogans serovar lai str. 56601
aauaggaguuccua

SEQ ID NO: 750207 - RNA, 21 nt, Leptospira interrogans serovar lai str. 56601
aauaggaguuccuacauuuau

SEQ ID NO: 750208 - RNA, 19 nt, Leptospira interrogans serovar lai str. 56601
aauagcuucuuuaaaaacu

SEQ ID NO: 750209 - RNA, 14 nt, Leptospira interrogans serovar lai str. 56601
accacccccaccaa

SEQ ID NO: 750210 - RNA, 18 nt, Leptospira interrogans serovar lai str. 56601
accaccucuauggaauuu

SEQ ID NO: 750211 - RNA, 15 nt, Leptospira interrogans serovar lai str. 56601
accacuggaauauaa

SEQ ID NO: 750212 - RNA, 15 nt, Leptospira interrogans serovar lai str. 56601
accaaggauguggaa

SEQ ID NO: 750213 - RNA, 14 nt, Leptospira interrogans serovar lai str. 56601
accaaccucucacu

SEQ ID NO: 750214 - RNA, 21 nt, Leptospira interrogans serovar lai str. 56601
acauuuccaacuguuuauaua

SEQ ID NO: 750215 - RNA, 14 nt, Leptospira interrogans serovar lai str. 56601
accaccaacagcau

SEQ ID NO: 750216 - RNA, 14 nt, Leptospira interrogans serovar lai str. 56601
accaauugauaauu

SEQ ID NO: 750217 - RNA, 17 nt, Leptospira interrogans serovar lai str. 56601
accaauuuuuuuguaaa

SEQ ID NO: 750218 - RNA, 22 nt, Leptospira interrogans serovar lai str. 56601
accaauuuuuuuguaaaaaaau

SEQ ID NO: 750219 - RNA, 12 nt, Leptospira interrogans serovar lai str. 56601
acaucuuuuuuc

SEQ ID NO: 750220 - RNA, 15 nt, Leptospira interrogans serovar lai str. 56601
acaucgaaaaaacaa

SEQ ID NO: 750221 - RNA, 22 nt, Leptospira interrogans serovar lai str. 56601
acaucgaaaaaacaaauaucau

SEQ ID NO: 750222 - RNA, 19 nt, Leptospira interrogans serovar lai str. 56601
acauguuguuuguggauua

SEQ ID NO: 750223 - RNA, 22 nt, Leptospira interrogans serovar lai str. 56601
acauguuguuuguggauuauga

SEQ ID NO: 750224 - RNA, 16 nt, Leptospira interrogans serovar lai str. 56601
acauguucaaaauuua

SEQ ID NO: 750225 - RNA, 17 nt, Leptospira interrogans serovar lai str. 56601
acauguucaaaauuuau

SEQ ID NO: 750226 - RNA, 14 nt, Leptospira interrogans serovar lai str. 56601
acaugauucauuua

SEQ ID NO: 750227 - RNA, 21 nt, Leptospira interrogans serovar lai str. 56601
acaugauucauuuaaaaauug

SEQ ID NO: 750228 - RNA, 13 nt, Leptospira interrogans serovar lai str. 56601
acauuuauuuuua

SEQ ID NO: 750229 - RNA, 14 nt, Leptospira interrogans serovar lai str. 56601
acauuuauuuuuac

SEQ ID NO: 750230 - RNA, 16 nt, Leptospira interrogans serovar lai str. 56601
acauuucaaaguuuug

SEQ ID NO: 750231 - RNA, 18 nt, Leptospira interrogans serovar lai str. 56601
acauuucaaaguuuugcu

SEQ ID NO: 750232 - RNA, 13 nt, Leptospira interrogans serovar lai str. 56601
acauugcgagauu

SEQ ID NO: 750233 - RNA, 14 nt, Leptospira interrogans serovar lai str. 56601
acauucguuuuaau

SEQ ID NO: 750234 - RNA, 17 nt, Leptospira interrogans serovar lai str. 56601
acauucuauaaaguuga

SEQ ID NO: 750235 - RNA, 19 nt, Leptospira interrogans serovar lai str. 56601
acauucugaaacuuuucaa

SEQ ID NO: 750236 - RNA, 15 nt, Leptospira interrogans serovar lai str. 56601
acauucccauccgaa

SEQ ID NO: 750237 - RNA, 17 nt, Leptospira interrogans serovar lai str. 56601
acauuccccaaguaaaa

SEQ ID NO: 750238 - RNA, 22 nt, Leptospira interrogans serovar lai str. 56601
acauuccgcaaaaauuccuuuu

SEQ ID NO: 750239 - RNA, 16 nt, Leptospira interrogans serovar lai str. 56601
acauuaugaauuuuua

SEQ ID NO: 750240 - RNA, 20 nt, Leptospira interrogans serovar lai str. 56601
acauuaaaauaggauuuaaa

SEQ ID NO: 750241 - RNA, 13 nt, Leptospira interrogans serovar lai str. 56601
acauucauuuuua

SEQ ID NO: 750242 - RNA, 14 nt, Leptospira interrogans serovar lai str. 56601
acauucauuuuuau

SEQ ID NO: 750243 - RNA, 14 nt, Leptospira interrogans serovar lai str. 56601
acauucauuuuuuc

SEQ ID NO: 750244 - RNA, 17 nt, Leptospira interrogans serovar lai str. 56601
acauucauuuuuucuaa

SEQ ID NO: 750245 - RNA, 22 nt, Leptospira interrogans serovar lai str. 56601
acauuauuucaaugcaaaaaau

SEQ ID NO: 750246 - RNA, 21 nt, Leptospira interrogans serovar lai str. 56601
acauucaauuucuuuaauuuc

SEQ ID NO: 750247 - RNA, 22 nt, Leptospira interrogans serovar lai str. 56601
acauagaacucacguuauauua

SEQ ID NO: 750248 - RNA, 17 nt, Leptospira interrogans serovar lai str. 56601
acauacuuuuugcaagu

SEQ ID NO: 750249 - RNA, 22 nt, Leptospira interrogans serovar lai str. 56601
acauacuuuuugcaaguaaaaa

SEQ ID NO: 750250 - RNA, 14 nt, Leptospira interrogans serovar lai str. 56601
acauacaaugaaaa

SEQ ID NO: 750251 - RNA, 23 nt, Leptospira interrogans serovar lai str. 56601
acauauuuauuuuuuuuaauaua

SEQ ID NO: 750252 - RNA, 14 nt, Leptospira interrogans serovar lai str. 56601
acauaugcauccgu

SEQ ID NO: 750253 - RNA, 15 nt, Leptospira interrogans serovar lai str. 56601
acauauauaauuuau

SEQ ID NO: 750254 - RNA, 14 nt, Leptospira interrogans serovar lai str. 56601
acaucaaaaacaaa

SEQ ID NO: 750255 - RNA, 19 nt, Leptospira interrogans serovar lai str. 56601
acagcugaggaguuuuuau

SEQ ID NO: 750256 - RNA, 17 nt, Leptospira interrogans serovar lai str. 56601
acagauggaaaguuagu

SEQ ID NO: 750257 - RNA, 19 nt, Leptospira interrogans serovar lai str. 56601
acagauggaaaguuaguuu

SEQ ID NO: 750258 - RNA, 13 nt, Leptospira interrogans serovar lai str. 56601
acagauaaaaaua

SEQ ID NO: 750259 - RNA, 14 nt, Leptospira interrogans serovar lai str. 56601
acagauaaaaauag

SEQ ID NO: 750260 - RNA, 18 nt, Leptospira interrogans serovar lai str. 56601
acagagauaggaauguuu

SEQ ID NO: 750261 - RNA, 17 nt, Leptospira interrogans serovar lai str. 56601
acagauucaauuuuuau

SEQ ID NO: 750262 - RNA, 21 nt, Leptospira interrogans serovar lai str. 56601
acagauucagucucauuucaa

SEQ ID NO: 750263 - RNA, 23 nt, Leptospira interrogans serovar lai str. 56601
acacuucuuguaaguuguguuua

SEQ ID NO: 750264 - RNA, 13 nt, Leptospira interrogans serovar lai str. 56601
acacuugaaaaau

SEQ ID NO: 750265 - RNA, 16 nt, Leptospira interrogans serovar lai str. 56601
acagaacaaaauuuac

SEQ ID NO: 750266 - RNA, 18 nt, Leptospira interrogans serovar lai str. 56601
acagaacccaauaaaaac

SEQ ID NO: 750267 - RNA, 18 nt, Leptospira interrogans serovar lai str. 56601
acagacguauuuuuaaau

SEQ ID NO: 750268 - RNA, 14 nt, Leptospira interrogans serovar lai str. 56601
acagacugauuuuu

SEQ ID NO: 750269 - RNA, 15 nt, Leptospira interrogans serovar lai str. 56601
acagacugauuuuuu

SEQ ID NO: 750270 - RNA, 14 nt, Leptospira interrogans serovar lai str. 56601
acagaauugaguuu

SEQ ID NO: 750271 - RNA, 23 nt, Leptospira interrogans serovar lai str. 56601
acagaauguucuuagacucagua

SEQ ID NO: 750272 - RNA, 23 nt, Leptospira interrogans serovar lai str. 56601
acagaaugucuuagaauuuuguu

SEQ ID NO: 750273 - RNA, 16 nt, Leptospira interrogans serovar lai str. 56601
acacguugaauaagau

SEQ ID NO: 750274 - RNA, 15 nt, Leptospira interrogans serovar lai str. 56601
acacguuuuccuaau

SEQ ID NO: 750275 - RNA, 16 nt, Leptospira interrogans serovar lai str. 56601
acacuaaguaaaaaug

SEQ ID NO: 750276 - RNA, 20 nt, Leptospira interrogans serovar lai str. 56601
acacuaaguaaaaaugcaaa

SEQ ID NO: 750277 - RNA, 18 nt, Leptospira interrogans serovar lai str. 56601
acacucaacgauaagaau

SEQ ID NO: 750278 - RNA, 15 nt, Leptospira interrogans serovar lai str. 56601
acacuccucaaagau

SEQ ID NO: 750279 - RNA, 18 nt, Leptospira interrogans serovar lai str. 56601
acacuguuaguuugcaau

SEQ ID NO: 750280 - RNA, 16 nt, Leptospira interrogans serovar lai str. 56601
acacuguguucuuuuu

SEQ ID NO: 750281 - RNA, 14 nt, Leptospira interrogans serovar lai str. 56601
acacuuaucaaaua

SEQ ID NO: 750282 - RNA, 15 nt, Leptospira interrogans serovar lai str. 56601
acacaugagcauucu

SEQ ID NO: 750283 - RNA, 17 nt, Leptospira interrogans serovar lai str. 56601
acacaugagcauucuug

SEQ ID NO: 750284 - RNA, 17 nt, Leptospira interrogans serovar lai str. 56601
acacacucuguuuuuag

SEQ ID NO: 750285 - RNA, 18 nt, Leptospira interrogans serovar lai str. 56601
acacacuuuauaaaagua

SEQ ID NO: 750286 - RNA, 15 nt, Leptospira interrogans serovar lai str. 56601
acaaugaaaaagcau

SEQ ID NO: 750287 - RNA, 19 nt, Leptospira interrogans serovar lai str. 56601
acaaugcuuuccaaaagga

SEQ ID NO: 750288 - RNA, 19 nt, Leptospira interrogans serovar lai str. 56601
acaaucuuagaauguggga

SEQ ID NO: 750289 - RNA, 16 nt, Leptospira interrogans serovar lai str. 56601
acaaucuucaaauucu

SEQ ID NO: 750290 - RNA, 13 nt, Leptospira interrogans serovar lai str. 56601
acaauuguaggaa

SEQ ID NO: 750291 - RNA, 15 nt, Leptospira interrogans serovar lai str. 56601
acaauuaaaaagaua

SEQ ID NO: 750292 - RNA, 20 nt, Leptospira interrogans serovar lai str. 56601
acaauuaaacuucaaaaaau

SEQ ID NO: 750293 - RNA, 18 nt, Leptospira interrogans serovar lai str. 56601
acaauuaaucaaauuucu

SEQ ID NO: 750294 - RNA, 22 nt, Leptospira interrogans serovar lai str. 56601
acaauuaaucaaauuucugcau

SEQ ID NO: 750295 - RNA, 17 nt, Leptospira interrogans serovar lai str. 56601
acacaaguuuggaaauu

SEQ ID NO: 750296 - RNA, 13 nt, Leptospira interrogans serovar lai str. 56601
acaauuuauaaag

SEQ ID NO: 750297 - RNA, 17 nt, Leptospira interrogans serovar lai str. 56601
acaauuuaucuaaaaca

SEQ ID NO: 750298 - RNA, 14 nt, Leptospira interrogans serovar lai str. 56601
acaauuuaaaauaa

SEQ ID NO: 750299 - RNA, 15 nt, Leptospira interrogans serovar lai str. 56601
acaauuuaaaauaau

SEQ ID NO: 750300 - RNA, 14 nt, Leptospira interrogans serovar lai str. 56601
acaauuuaauaguu

SEQ ID NO: 750301 - RNA, 22 nt, Leptospira interrogans serovar lai str. 56601
acaauuuaauaguuuauacuuu

SEQ ID NO: 750302 - RNA, 18 nt, Leptospira interrogans serovar lai str. 56601
acaauuuacaaccacugg

SEQ ID NO: 750303 - RNA, 15 nt, Leptospira interrogans serovar lai str. 56601
acaacucuaauacaa

SEQ ID NO: 750304 - RNA, 16 nt, Leptospira interrogans serovar lai str. 56601
acaacucuaaugaauu

SEQ ID NO: 750305 - RNA, 14 nt, Leptospira interrogans serovar lai str. 56601
acaacucuaauuaa

SEQ ID NO: 750306 - RNA, 15 nt, Leptospira interrogans serovar lai str. 56601
acaacucuauuacua

SEQ ID NO: 750307 - RNA, 19 nt, Leptospira interrogans serovar lai str. 56601
acaacucuauuuaaguacu

SEQ ID NO: 750308 - RNA, 23 nt, Leptospira interrogans serovar lai str. 56601
acaacucuauuuaaguacuuaau

SEQ ID NO: 750309 - RNA, 13 nt, Leptospira interrogans serovar lai str. 56601
acaacucuauuuc

SEQ ID NO: 750310 - RNA, 21 nt, Leptospira interrogans serovar lai str. 56601
acaacuuuugaaacuauccaa

SEQ ID NO: 750311 - RNA, 13 nt, Leptospira interrogans serovar lai str. 56601
acaacuuucagau

SEQ ID NO: 750312 - RNA, 21 nt, Leptospira interrogans serovar lai str. 56601
acaacuuauaauuuucuuaau

SEQ ID NO: 750313 - RNA, 20 nt, Leptospira interrogans serovar lai str. 56601
aauuuuuguaaaauccagaa

SEQ ID NO: 750314 - RNA, 17 nt, Leptospira interrogans serovar lai str. 56601
aauuuuuguuuguaaaa

SEQ ID NO: 750315 - RNA, 16 nt, Leptospira interrogans serovar lai str. 56601
aauuuuuuaaaaauuu

SEQ ID NO: 750316 - RNA, 19 nt, Leptospira interrogans serovar lai str. 56601
aauuuuucauuuuguuucu

SEQ ID NO: 750317 - RNA, 21 nt, Leptospira interrogans serovar lai str. 56601
aauuuuuuauuaagaacuuuc

SEQ ID NO: 750318 - RNA, 23 nt, Leptospira interrogans serovar lai str. 56601
aauuuuuuagaaacuauucuaua

SEQ ID NO: 750319 - RNA, 15 nt, Leptospira interrogans serovar lai str. 56601
aauuuuuuauuaaga

SEQ ID NO: 750320 - RNA, 14 nt, Leptospira interrogans serovar lai str. 56601
aauuuuuuggaaau

SEQ ID NO: 750321 - RNA, 19 nt, Leptospira interrogans serovar lai str. 56601
aauuuuuuggaaauuuuua

SEQ ID NO: 750322 - RNA, 11 nt, Leptospira interrogans serovar lai str. 56601
aauuuuuuccc

SEQ ID NO: 750323 - RNA, 13 nt, Leptospira interrogans serovar lai str. 56601
aauuuuuuccuuu

SEQ ID NO: 750324 - RNA, 13 nt, Leptospira interrogans serovar lai str. 56601
aauuuuuugaaaa

SEQ ID NO: 750325 - RNA, 17 nt, Leptospira interrogans serovar lai str. 56601
aauuuuuugaaaaagaa

SEQ ID NO: 750326 - RNA, 19 nt, Leptospira interrogans serovar lai str. 56601
aauuuuuugaaaaagaaua

SEQ ID NO: 750327 - RNA, 11 nt, Leptospira interrogans serovar lai str. 56601
aauuuuuguag

SEQ ID NO: 750328 - RNA, 14 nt, Leptospira interrogans serovar lai str. 56601
acaacgcucucuac

SEQ ID NO: 750329 - RNA, 20 nt, Leptospira interrogans serovar lai str. 56601
aauuuuuuuaagaauuuguu

SEQ ID NO: 750330 - RNA, 22 nt, Leptospira interrogans serovar lai str. 56601
aauuuuuuuaagagccuacaaa

SEQ ID NO: 750331 - RNA, 19 nt, Leptospira interrogans serovar lai str. 56601
aauuuuuuucuaaaauaua

SEQ ID NO: 750332 - RNA, 17 nt, Leptospira interrogans serovar lai str. 56601
acaacgcugcuuuccua

SEQ ID NO: 750333 - RNA, 15 nt, Leptospira interrogans serovar lai str. 56601
acaauaguucuauuu

SEQ ID NO: 750334 - RNA, 20 nt, Leptospira interrogans serovar lai str. 56601
acaauaguucuauuuuauca

SEQ ID NO: 750335 - RNA, 12 nt, Leptospira interrogans serovar lai str. 56601
acaauagcuuaa

SEQ ID NO: 750336 - RNA, 18 nt, Leptospira interrogans serovar lai str. 56601
acaauagcuuaaaaguga

SEQ ID NO: 750337 - RNA, 16 nt, Leptospira interrogans serovar lai str. 56601
acaauagcuucuuuaa

SEQ ID NO: 750338 - RNA, 19 nt, Leptospira interrogans serovar lai str. 56601
acaauagaguuguugaaaa

SEQ ID NO: 750339 - RNA, 15 nt, Leptospira interrogans serovar lai str. 56601
acaauaaaaauuaga

SEQ ID NO: 750340 - RNA, 12 nt, Leptospira interrogans serovar lai str. 56601
acaauaaaaacu

SEQ ID NO: 750341 - RNA, 15 nt, Leptospira interrogans serovar lai str. 56601
acaauaaaaacuuau

SEQ ID NO: 750342 - RNA, 14 nt, Leptospira interrogans serovar lai str. 56601
acaagacaaacaaa

SEQ ID NO: 750343 - RNA, 13 nt, Leptospira interrogans serovar lai str. 56601
acaagaaucaaaa

SEQ ID NO: 750344 - RNA, 14 nt, Leptospira interrogans serovar lai str. 56601
acaagaauuuauuu

SEQ ID NO: 750345 - RNA, 23 nt, Leptospira interrogans serovar lai str. 56601
acaagacgcuacucgaauuuaua

SEQ ID NO: 750346 - RNA, 15 nt, Leptospira interrogans serovar lai str. 56601
aauucuaaaucugaa

SEQ ID NO: 750347 - RNA, 18 nt, Leptospira interrogans serovar lai str. 56601
aauucuaaguaauuuaaa

SEQ ID NO: 750348 - RNA, 19 nt, Leptospira interrogans serovar lai str. 56601
aauucuaaucacgaaaaau

SEQ ID NO: 750349 - RNA, 14 nt, Leptospira interrogans serovar lai str. 56601
aauucuaaaauacu

SEQ ID NO: 750350 - RNA, 14 nt, Leptospira interrogans serovar lai str. 56601
aauucuaaaaucau

SEQ ID NO: 750351 - RNA, 15 nt, Leptospira interrogans serovar lai str. 56601
aauucuaaaauugua

SEQ ID NO: 750352 - RNA, 16 nt, Leptospira interrogans serovar lai str. 56601
aauucuaaaauuguag

SEQ ID NO: 750353 - RNA, 22 nt, Leptospira interrogans serovar lai str. 56601
aauucuaaaauuguagaaacuu

SEQ ID NO: 750354 - RNA, 14 nt, Leptospira interrogans serovar lai str. 56601
aauucuaaaauuug

SEQ ID NO: 750355 - RNA, 17 nt, Leptospira interrogans serovar lai str. 56601
aauucuaaagccauuua

SEQ ID NO: 750356 - RNA, 15 nt, Leptospira interrogans serovar lai str. 56601
aauucuuaaaaaaua

SEQ ID NO: 750357 - RNA, 17 nt, Leptospira interrogans serovar lai str. 56601
aauucuuaaaaaauauu

SEQ ID NO: 750358 - RNA, 20 nt, Leptospira interrogans serovar lai str. 56601
aauucuuaaaaaauauuuuc

SEQ ID NO: 750359 - RNA, 19 nt, Leptospira interrogans serovar lai str. 56601
aauucuaagaccuaaaccc

SEQ ID NO: 750360 - RNA, 23 nt, Leptospira interrogans serovar lai str. 56601
aauucuuccgggaggaauuuuua

SEQ ID NO: 750361 - RNA, 18 nt, Leptospira interrogans serovar lai str. 56601
aauucuuccuucuugaaa

SEQ ID NO: 750362 - RNA, 19 nt, Leptospira interrogans serovar lai str. 56601
aauucuuacaacuuuugaa

SEQ ID NO: 750363 - RNA, 13 nt, Leptospira interrogans serovar lai str. 56601
aauucuuaaaaau

SEQ ID NO: 750364 - RNA, 17 nt, Leptospira interrogans serovar lai str. 56601
aauucuuaaaaauuuau

SEQ ID NO: 750365 - RNA, 17 nt, Leptospira interrogans serovar lai str. 56601
aauucuaaaaauuuuuu

SEQ ID NO: 750366 - RNA, 20 nt, Leptospira interrogans serovar lai str. 56601
aauucguuuuuuaaaaugua

SEQ ID NO: 750367 - RNA, 15 nt, Leptospira interrogans serovar lai str. 56601
aauucguuccaaaua

SEQ ID NO: 750368 - RNA, 21 nt, Leptospira interrogans serovar lai str. 56601
aauucgucaaaaccaaaacau

SEQ ID NO: 750369 - RNA, 10 nt, Leptospira interrogans serovar lai str. 56601
aauucguuaa

SEQ ID NO: 750370 - RNA, 18 nt, Leptospira interrogans serovar lai str. 56601
aauucaaaggccgcuucu

SEQ ID NO: 750371 - RNA, 15 nt, Leptospira interrogans serovar lai str. 56601
aauucaaaauaagaa

SEQ ID NO: 750372 - RNA, 16 nt, Leptospira interrogans serovar lai str. 56601
aauucaaaauaagaaa

SEQ ID NO: 750373 - RNA, 19 nt, Leptospira interrogans serovar lai str. 56601
aauucaaaauaagaaaaua

SEQ ID NO: 750374 - RNA, 21 nt, Leptospira interrogans serovar lai str. 56601
aauucaagacuuuauagucaa

SEQ ID NO: 750375 - RNA, 13 nt, Leptospira interrogans serovar lai str. 56601
aauucaaguuaau

SEQ ID NO: 750376 - RNA, 14 nt, Leptospira interrogans serovar lai str. 56601
aauucacauaaagu

SEQ ID NO: 750377 - RNA, 18 nt, Leptospira interrogans serovar lai str. 56601
aauucacauaaaguuaau

SEQ ID NO: 750378 - RNA, 19 nt, Leptospira interrogans serovar lai str. 56601
aauucacauuauauauuua

SEQ ID NO: 750379 - RNA, 21 nt, Leptospira interrogans serovar lai str. 56601
aauuccuacauucauuuuuau

SEQ ID NO: 750380 - RNA, 22 nt, Leptospira interrogans serovar lai str. 56601
aauucgauacugccaaugauga

SEQ ID NO: 750381 - RNA, 21 nt, Leptospira interrogans serovar lai str. 56601
aauucgauccaggaucagaac

SEQ ID NO: 750382 - RNA, 19 nt, Leptospira interrogans serovar lai str. 56601
aauuccgacccagaaaaaa

SEQ ID NO: 750383 - RNA, 23 nt, Leptospira interrogans serovar lai str. 56601
aauuccgacccagaaaaaaccuc

SEQ ID NO: 750384 - RNA, 18 nt, Leptospira interrogans serovar lai str. 56601
aauugauuuuucaacaac

SEQ ID NO: 750385 - RNA, 20 nt, Leptospira interrogans serovar lai str. 56601
aauugauuuuucaacaacuc

SEQ ID NO: 750386 - RNA, 21 nt, Leptospira interrogans serovar lai str. 56601
aauugauaaaaccguuuuaua

SEQ ID NO: 750387 - RNA, 11 nt, Leptospira interrogans serovar lai str. 56601
aaaaauuuuuu

SEQ ID NO: 750388 - RNA, 14 nt, Leptospira interrogans serovar lai str. 56601
aaaaauuuuuuaaa

SEQ ID NO: 750389 - RNA, 18 nt, Leptospira interrogans serovar lai str. 56601
aaaaauuuuuuaaacuua

SEQ ID NO: 750390 - RNA, 13 nt, Leptospira interrogans serovar lai str. 56601
aauugaucucaua

SEQ ID NO: 750391 - RNA, 18 nt, Leptospira interrogans serovar lai str. 56601
aaaaauuuuucuuaauuu

SEQ ID NO: 750392 - RNA, 22 nt, Leptospira interrogans serovar lai str. 56601
aaaaauuuuucuuaauuucucu

SEQ ID NO: 750393 - RNA, 22 nt, Leptospira interrogans serovar lai str. 56601
aauucuuucguuuuuugcagau

SEQ ID NO: 750394 - RNA, 19 nt, Leptospira interrogans serovar lai str. 56601
aauucuuuggaaauuuuua

SEQ ID NO: 750395 - RNA, 20 nt, Leptospira interrogans serovar lai str. 56601
aauucuuuggaaauuuuuaa

SEQ ID NO: 750396 - RNA, 19 nt, Leptospira interrogans serovar lai str. 56601
aauucuuuagaaauuuuua

SEQ ID NO: 750397 - RNA, 20 nt, Leptospira interrogans serovar lai str. 56601
aauucuuuagaaauuuuuaa

SEQ ID NO: 750398 - RNA, 15 nt, Leptospira interrogans serovar lai str. 56601
aauucuuuaaaauuu

SEQ ID NO: 750399 - RNA, 18 nt, Leptospira interrogans serovar lai str. 56601
aauucuuuaaaauuuuua

SEQ ID NO: 750400 - RNA, 12 nt, Leptospira interrogans serovar lai str. 56601
aauucuuuaaau

SEQ ID NO: 750401 - RNA, 13 nt, Leptospira interrogans serovar lai str. 56601
aauucuuuaaaug

SEQ ID NO: 750402 - RNA, 20 nt, Leptospira interrogans serovar lai str. 56601
aauucuuccuuuuucauuuu

SEQ ID NO: 750403 - RNA, 20 nt, Leptospira interrogans serovar lai str. 56601
aauucuucguuagaagacaa

SEQ ID NO: 750404 - RNA, 15 nt, Leptospira interrogans serovar lai str. 56601
aauucuucuuccuuu

SEQ ID NO: 750405 - RNA, 18 nt, Leptospira interrogans serovar lai str. 56601
aauugaauuuuuuaaaug

SEQ ID NO: 750406 - RNA, 23 nt, Leptospira interrogans serovar lai str. 56601
aauugagauuuggugauuuaaaa

SEQ ID NO: 750407 - RNA, 17 nt, Leptospira interrogans serovar lai str. 56601
aauugagaauagaagca

SEQ ID NO: 750408 - RNA, 22 nt, Leptospira interrogans serovar lai str. 56601
aauugagaauuuguuuuaaaau

SEQ ID NO: 750409 - RNA, 13 nt, Leptospira interrogans serovar lai str. 56601
aauugacuuucug

SEQ ID NO: 750410 - RNA, 17 nt, Leptospira interrogans serovar lai str. 56601
aauuagcuuaagaauuu

SEQ ID NO: 750411 - RNA, 19 nt, Leptospira interrogans serovar lai str. 56601
aauuaugauuucacgaaca

SEQ ID NO: 750412 - RNA, 23 nt, Leptospira interrogans serovar lai str. 56601
aauuaugauuucacgaacacaaa

SEQ ID NO: 750413 - RNA, 22 nt, Leptospira interrogans serovar lai str. 56601
aauuauggcacuuauucuuaua

SEQ ID NO: 750414 - RNA, 19 nt, Leptospira interrogans serovar lai str. 56601
aauuacuucuagcaccuaa

SEQ ID NO: 750415 - RNA, 22 nt, Leptospira interrogans serovar lai str. 56601
aauuagaauccuguuugaaaaa

SEQ ID NO: 750416 - RNA, 12 nt, Leptospira interrogans serovar lai str. 56601
aauuagaaagcg

SEQ ID NO: 750417 - RNA, 18 nt, Leptospira interrogans serovar lai str. 56601
aauuacuucaauugucca

SEQ ID NO: 750418 - RNA, 21 nt, Leptospira interrogans serovar lai str. 56601
aauuagaaaauuauaaacaaa

SEQ ID NO: 750419 - RNA, 23 nt, Leptospira interrogans serovar lai str. 56601
aauuagcguguaugguaaaaaua

SEQ ID NO: 750420 - RNA, 21 nt, Leptospira interrogans serovar lai str. 56601
aauuagauuuauugaaaaaua

SEQ ID NO: 750421 - RNA, 13 nt, Leptospira interrogans serovar lai str. 56601
aauuacuacaaaa

SEQ ID NO: 750422 - RNA, 23 nt, Leptospira interrogans serovar lai str. 56601
aauuacuacauuugauuaaaaau

SEQ ID NO: 750423 - RNA, 23 nt, Leptospira interrogans serovar lai str. 56601
aauuacugauuucaaaaauaaau

SEQ ID NO: 750424 - RNA, 18 nt, Leptospira interrogans serovar lai str. 56601
aauuaauuucuaaacaau

SEQ ID NO: 750425 - RNA, 20 nt, Leptospira interrogans serovar lai str. 56601
aauuaauuuuuuaaaaauuu

SEQ ID NO: 750426 - RNA, 14 nt, Leptospira interrogans serovar lai str. 56601
aauuaauucagcau

SEQ ID NO: 750427 - RNA, 15 nt, Leptospira interrogans serovar lai str. 56601
aauuaauuccuaacu

SEQ ID NO: 750428 - RNA, 21 nt, Leptospira interrogans serovar lai str. 56601
aauuaauuccuaacuaauaaa

SEQ ID NO: 750429 - RNA, 23 nt, Leptospira interrogans serovar lai str. 56601
aauuaaugaauaacuuuacaaaa

SEQ ID NO: 750430 - RNA, 21 nt, Leptospira interrogans serovar lai str. 56601
aauuaaugaggagaaaaaaua

SEQ ID NO: 750431 - RNA, 20 nt, Leptospira interrogans serovar lai str. 56601
aauuaaucuguaaaguuuag

SEQ ID NO: 750432 - RNA, 17 nt, Leptospira interrogans serovar lai str. 56601
aauuaauauuuauaaua

SEQ ID NO: 750433 - RNA, 24 nt, Leptospira interrogans serovar lai str. 56601
aauuacccuaaagcuauuuucuag

SEQ ID NO: 750434 - RNA, 18 nt, Leptospira interrogans serovar lai str. 56601
aauuacaguuaauaaauu

SEQ ID NO: 750435 - RNA, 21 nt, Leptospira interrogans serovar lai str. 56601
aauuacaguuaauaaauugua

SEQ ID NO: 750436 - RNA, 15 nt, Leptospira interrogans serovar lai str. 56601
aauuacauaguaaac

SEQ ID NO: 750437 - RNA, 21 nt, Leptospira interrogans serovar lai str. 56601
aauuacgaaaacuauuuuucu

SEQ ID NO: 750438 - RNA, 14 nt, Leptospira interrogans serovar lai str. 56601
aauuaaguuacauu

SEQ ID NO: 750439 - RNA, 17 nt, Leptospira interrogans serovar lai str. 56601
aauuaaguuuaaaaaca

SEQ ID NO: 750440 - RNA, 16 nt, Leptospira interrogans serovar lai str. 56601
aauuaaguuuauucaa

SEQ ID NO: 750441 - RNA, 17 nt, Leptospira interrogans serovar lai str. 56601
aauguauucuauaaaau

SEQ ID NO: 750442 - RNA, 19 nt, Leptospira interrogans serovar lai str. 56601
aauguauucuauaaaauuu

SEQ ID NO: 750443 - RNA, 20 nt, Leptospira interrogans serovar lai str. 56601
aauuaaguaguuuuuugauu

SEQ ID NO: 750444 - RNA, 22 nt, Leptospira interrogans serovar lai str. 56601
aauguauguuuacuugaaaaua

SEQ ID NO: 750445 - RNA, 16 nt, Leptospira interrogans serovar lai str. 56601
aauguaucgcuucuau

SEQ ID NO: 750446 - RNA, 21 nt, Leptospira interrogans serovar lai str. 56601
aauguauccaauccaaaauug

SEQ ID NO: 750447 - RNA, 13 nt, Leptospira interrogans serovar lai str. 56601
aauguauaauccu

SEQ ID NO: 750448 - RNA, 14 nt, Leptospira interrogans serovar lai str. 56601
aauguauaauccuu

SEQ ID NO: 750449 - RNA, 20 nt, Leptospira interrogans serovar lai str. 56601
aauguauaauccuuucccuu

SEQ ID NO: 750450 - RNA, 16 nt, Leptospira interrogans serovar lai str. 56601
aauguagccaaaaauu

SEQ ID NO: 750451 - RNA, 19 nt, Leptospira interrogans serovar lai str. 56601
aaugguaucugcgauuaaa

SEQ ID NO: 750452 - RNA, 10 nt, Leptospira interrogans serovar lai str. 56601
aauuuaaaga

SEQ ID NO: 750453 - RNA, 14 nt, Leptospira interrogans serovar lai str. 56601
aauuuacucuuaua

SEQ ID NO: 750454 - RNA, 17 nt, Leptospira interrogans serovar lai str. 56601
aauuuagaaaauuagaa

SEQ ID NO: 750455 - RNA, 13 nt, Leptospira interrogans serovar lai str. 56601
aauuuagaaauag

SEQ ID NO: 750456 - RNA, 22 nt, Leptospira interrogans serovar lai str. 56601
aauuuagaguuguuaaaaaauu

SEQ ID NO: 750457 - RNA, 15 nt, Leptospira interrogans serovar lai str. 56601
aauuuacuucauucg

SEQ ID NO: 750458 - RNA, 15 nt, Leptospira interrogans serovar lai str. 56601
aauuuacuugaucag

SEQ ID NO: 750459 - RNA, 18 nt, Leptospira interrogans serovar lai str. 56601
aauuuagaaauagauaua

SEQ ID NO: 750460 - RNA, 13 nt, Leptospira interrogans serovar lai str. 56601
aauuuagaauaaa

SEQ ID NO: 750461 - RNA, 12 nt, Leptospira interrogans serovar lai str. 56601
aauuuagaauug

SEQ ID NO: 750462 - RNA, 19 nt, Leptospira interrogans serovar lai str. 56601
aauuuacgaaaauuuuuua

SEQ ID NO: 750463 - RNA, 16 nt, Leptospira interrogans serovar lai str. 56601
aauuuacuacaucuaa

SEQ ID NO: 750464 - RNA, 18 nt, Leptospira interrogans serovar lai str. 56601
aauuuacuauuuugauga

SEQ ID NO: 750465 - RNA, 23 nt, Leptospira interrogans serovar lai str. 56601
aauuuacuauuuugaugaaugaa

SEQ ID NO: 750466 - RNA, 18 nt, Leptospira interrogans serovar lai str. 56601
aauuuaaaucccauuuua

SEQ ID NO: 750467 - RNA, 12 nt, Leptospira interrogans serovar lai str. 56601
aauuuaaaugua

SEQ ID NO: 750468 - RNA, 21 nt, Leptospira interrogans serovar lai str. 56601
aauuuaaauguuuuuguauuu

SEQ ID NO: 750469 - RNA, 20 nt, Leptospira interrogans serovar lai str. 56601
aauuuaacgacauuagaacu

SEQ ID NO: 750470 - RNA, 13 nt, Leptospira interrogans serovar lai str. 56601
aauuuaacgugau

SEQ ID NO: 750471 - RNA, 13 nt, Leptospira interrogans serovar lai str. 56601
aauuuaacaacau

SEQ ID NO: 750472 - RNA, 20 nt, Leptospira interrogans serovar lai str. 56601
aauuuaacaacauuagaauu

SEQ ID NO: 750473 - RNA, 18 nt, Leptospira interrogans serovar lai str. 56601
aauuuauauuuuuugaaa

SEQ ID NO: 750474 - RNA, 16 nt, Leptospira interrogans serovar lai str. 56601
aauuuaucuauaaaau

SEQ ID NO: 750475 - RNA, 13 nt, Leptospira interrogans serovar lai str. 56601
aauuuaucuguaa

SEQ ID NO: 750476 - RNA, 20 nt, Leptospira interrogans serovar lai str. 56601
aauuuaucuguaauuuuaca

SEQ ID NO: 750477 - RNA, 16 nt, Leptospira interrogans serovar lai str. 56601
aauuuaucauuucuuu

SEQ ID NO: 750478 - RNA, 16 nt, Leptospira interrogans serovar lai str. 56601
aauuuaucgauuuaaa

SEQ ID NO: 750479 - RNA, 18 nt, Leptospira interrogans serovar lai str. 56601
aauuuaucgauuuaaaaa

SEQ ID NO: 750480 - RNA, 20 nt, Leptospira interrogans serovar lai str. 56601
aauuuaucgauuuaaaaacu

SEQ ID NO: 750481 - RNA, 21 nt, Leptospira interrogans serovar lai str. 56601
aauuuaucgauuuaaaaacua

SEQ ID NO: 750482 - RNA, 15 nt, Leptospira interrogans serovar lai str. 56601
aauuuauucucuauc

SEQ ID NO: 750483 - RNA, 13 nt, Leptospira interrogans serovar lai str. 56601
aauuuauuauaga

SEQ ID NO: 750484 - RNA, 19 nt, Leptospira interrogans serovar lai str. 56601
aauuuauguuucaguauuc

SEQ ID NO: 750485 - RNA, 20 nt, Leptospira interrogans serovar lai str. 56601
aauuuaugaucuacuauuau

SEQ ID NO: 750486 - RNA, 22 nt, Leptospira interrogans serovar lai str. 56601
aauuuaugaucuacuauuauaa

SEQ ID NO: 750487 - RNA, 19 nt, Leptospira interrogans serovar lai str. 56601
aauuucuaaaauucuuccg

SEQ ID NO: 750488 - RNA, 15 nt, Leptospira interrogans serovar lai str. 56601
aauuucuaaagaauu

SEQ ID NO: 750489 - RNA, 22 nt, Leptospira interrogans serovar lai str. 56601
aauuuccuuuuguuuuucuuua

SEQ ID NO: 750490 - RNA, 21 nt, Leptospira interrogans serovar lai str. 56601
aauuucccgauucucaaaaug

SEQ ID NO: 750491 - RNA, 14 nt, Leptospira interrogans serovar lai str. 56601
aauuuccuggauug

SEQ ID NO: 750492 - RNA, 17 nt, Leptospira interrogans serovar lai str. 56601
aauuuccgauaaagaaa

SEQ ID NO: 750493 - RNA, 18 nt, Leptospira interrogans serovar lai str. 56601
aauuucuauaaaaucuaa

SEQ ID NO: 750494 - RNA, 20 nt, Leptospira interrogans serovar lai str. 56601
aauuucuucauaucaaauuc

SEQ ID NO: 750495 - RNA, 22 nt, Leptospira interrogans serovar lai str. 56601
aauuucuucauaucaaauucau

SEQ ID NO: 750496 - RNA, 14 nt, Leptospira interrogans serovar lai str. 56601
aauuucugaaacaa

SEQ ID NO: 750497 - RNA, 18 nt, Leptospira interrogans serovar lai str. 56601
aauuucauaaaauucuua

SEQ ID NO: 750498 - RNA, 14 nt, Leptospira interrogans serovar lai str. 56601
aauuucauaguuca

SEQ ID NO: 750499 - RNA, 18 nt, Leptospira interrogans serovar lai str. 56601
aauuucauaguucaauua

SEQ ID NO: 750500 - RNA, 20 nt, Leptospira interrogans serovar lai str. 56601
aauuuccaugauaugagagu

SEQ ID NO: 750501 - RNA, 18 nt, Leptospira interrogans serovar lai str. 56601
aauuucccauaaaaagag

SEQ ID NO: 750502 - RNA, 21 nt, Leptospira interrogans serovar lai str. 56601
aauuuccaaacuacaaauuca

SEQ ID NO: 750503 - RNA, 17 nt, Leptospira interrogans serovar lai str. 56601
aauuuccacuucaaaaa

SEQ ID NO: 750504 - RNA, 21 nt, Leptospira interrogans serovar lai str. 56601
aauuucagucaauaaauugua

SEQ ID NO: 750505 - RNA, 23 nt, Leptospira interrogans serovar lai str. 56601
aauuucagucaauaaauuguaua

SEQ ID NO: 750506 - RNA, 19 nt, Leptospira interrogans serovar lai str. 56601
aauuucagauauuuucgcc

SEQ ID NO: 750507 - RNA, 23 nt, Leptospira interrogans serovar lai str. 56601
aauuuuacgugauaauucuuuag

SEQ ID NO: 750508 - RNA, 12 nt, Leptospira interrogans serovar lai str. 56601
aauuuuaccaaa

SEQ ID NO: 750509 - RNA, 15 nt, Leptospira interrogans serovar lai str. 56601
aauuuuaccaaaaau

SEQ ID NO: 750510 - RNA, 20 nt, Leptospira interrogans serovar lai str. 56601
aauuuuaccaaaaaugcaaa

SEQ ID NO: 750511 - RNA, 13 nt, Leptospira interrogans serovar lai str. 56601
aauuuuacaguaa

SEQ ID NO: 750512 - RNA, 21 nt, Leptospira interrogans serovar lai str. 56601
aauuuuacacguaauucuuug

SEQ ID NO: 750513 - RNA, 21 nt, Leptospira interrogans serovar lai str. 56601
aauuuuacacuauaauucuuu

SEQ ID NO: 750514 - RNA, 14 nt, Leptospira interrogans serovar lai str. 56601
aauuuuacagagau

SEQ ID NO: 750515 - RNA, 15 nt, Leptospira interrogans serovar lai str. 56601
aauuuuaauuguaaa

SEQ ID NO: 750516 - RNA, 12 nt, Leptospira interrogans serovar lai str. 56601
aauuuuacaaac

SEQ ID NO: 750517 - RNA, 14 nt, Leptospira interrogans serovar lai str. 56601
aauuuuaagaacaa

SEQ ID NO: 750518 - RNA, 23 nt, Leptospira interrogans serovar lai str. 56601
aauuuuaagaacaauuuaaaaua

SEQ ID NO: 750519 - RNA, 13 nt, Leptospira interrogans serovar lai str. 56601
aauuuuaaguuca

SEQ ID NO: 750520 - RNA, 12 nt, Leptospira interrogans serovar lai str. 56601
aauuuuaaauau

SEQ ID NO: 750521 - RNA, 17 nt, Leptospira interrogans serovar lai str. 56601
aauuuguuuuucuugcu

SEQ ID NO: 750522 - RNA, 20 nt, Leptospira interrogans serovar lai str. 56601
aauuuguuuuuggaaauguu

SEQ ID NO: 750523 - RNA, 13 nt, Leptospira interrogans serovar lai str. 56601
aauuuguucuuaa

SEQ ID NO: 750524 - RNA, 22 nt, Leptospira interrogans serovar lai str. 56601
aauuuuaaaucgacaaaaugag

SEQ ID NO: 750525 - RNA, 14 nt, Leptospira interrogans serovar lai str. 56601
aauuuuaaaaccaa

SEQ ID NO: 750526 - RNA, 15 nt, Leptospira interrogans serovar lai str. 56601
aauuuuaaaaccaau

SEQ ID NO: 750527 - RNA, 13 nt, Leptospira interrogans serovar lai str. 56601
aauuuuaaauauu

SEQ ID NO: 750528 - RNA, 21 nt, Leptospira interrogans serovar lai str. 56601
aauuugugcucacuuaugauu

SEQ ID NO: 750529 - RNA, 19 nt, Leptospira interrogans serovar lai str. 56601
aauuuguggagcucgauuu

SEQ ID NO: 750530 - RNA, 18 nt, Leptospira interrogans serovar lai str. 56601
aauuugugguaguuccua

SEQ ID NO: 750531 - RNA, 20 nt, Leptospira interrogans serovar lai str. 56601
aauuuguuuguaaaauagug

SEQ ID NO: 750532 - RNA, 22 nt, Leptospira interrogans serovar lai str. 56601
aauuuguuuguuauaagaauuu

SEQ ID NO: 750533 - RNA, 19 nt, Leptospira interrogans serovar lai str. 56601
aauuuguuuuaaaauuuau

SEQ ID NO: 750534 - RNA, 15 nt, Leptospira interrogans serovar lai str. 56601
aauuugugaacuuuc

SEQ ID NO: 750535 - RNA, 15 nt, Leptospira interrogans serovar lai str. 56601
aauuugugaacuuuu

SEQ ID NO: 750536 - RNA, 14 nt, Leptospira interrogans serovar lai str. 56601
aauuuguaaauucu

SEQ ID NO: 750537 - RNA, 16 nt, Leptospira interrogans serovar lai str. 56601
aauuuguaauaguucc

SEQ ID NO: 750538 - RNA, 16 nt, Leptospira interrogans serovar lai str. 56601
aauuugaggagaaucu

SEQ ID NO: 750539 - RNA, 14 nt, Leptospira interrogans serovar lai str. 56601
aauuugaauuuuuu

SEQ ID NO: 750540 - RNA, 20 nt, Leptospira interrogans serovar lai str. 56601
aauuugaaaagaaaccaauc

SEQ ID NO: 750541 - RNA, 21 nt, Leptospira interrogans serovar lai str. 56601
aauuugaaaagaaaccaauca

SEQ ID NO: 750542 - RNA, 17 nt, Leptospira interrogans serovar lai str. 56601
aauuugaauauaauaaa

SEQ ID NO: 750543 - RNA, 18 nt, Leptospira interrogans serovar lai str. 56601
aauuugauuccaagauuu

SEQ ID NO: 750544 - RNA, 16 nt, Leptospira interrogans serovar lai str. 56601
aauuugcgaaaaaaau

SEQ ID NO: 750545 - RNA, 16 nt, Leptospira interrogans serovar lai str. 56601
aauuugcgauauucua

SEQ ID NO: 750546 - RNA, 18 nt, Leptospira interrogans serovar lai str. 56601
aauuugcgauauucuauu

SEQ ID NO: 750547 - RNA, 14 nt, Leptospira interrogans serovar lai str. 56601
aauuuuuauagaau

SEQ ID NO: 750548 - RNA, 16 nt, Leptospira interrogans serovar lai str. 56601
aauuuuuauagaauuu

SEQ ID NO: 750549 - RNA, 17 nt, Leptospira interrogans serovar lai str. 56601
aauuuuuaucauguuuu

SEQ ID NO: 750550 - RNA, 11 nt, Leptospira interrogans serovar lai str. 56601
aauuuuuauga

SEQ ID NO: 750551 - RNA, 19 nt, Leptospira interrogans serovar lai str. 56601
aauuuuuauaaaauaccaa

SEQ ID NO: 750552 - RNA, 18 nt, Leptospira interrogans serovar lai str. 56601
aauuuuuauaaguuuaau

SEQ ID NO: 750553 - RNA, 13 nt, Leptospira interrogans serovar lai str. 56601
aauuuuucaaaaa

SEQ ID NO: 750554 - RNA, 17 nt, Leptospira interrogans serovar lai str. 56601
aauuuuuacucaaagaa

SEQ ID NO: 750555 - RNA, 22 nt, Leptospira interrogans serovar lai str. 56601
aauuuuuacucaaagaaucgag

SEQ ID NO: 750556 - RNA, 15 nt, Leptospira interrogans serovar lai str. 56601
aauuuuuaagaauaa

SEQ ID NO: 750557 - RNA, 13 nt, Leptospira interrogans serovar lai str. 56601
aauuuuuaauaaa

SEQ ID NO: 750558 - RNA, 21 nt, Leptospira interrogans serovar lai str. 56601
aauuuuuaaaaguagaaucau

SEQ ID NO: 750559 - RNA, 22 nt, Leptospira interrogans serovar lai str. 56601
aauuuuucgguaggauccugac

SEQ ID NO: 750560 - RNA, 12 nt, Leptospira interrogans serovar lai str. 56601
aauuuuucuagu

SEQ ID NO: 750561 - RNA, 17 nt, Leptospira interrogans serovar lai str. 56601
aauuuuucuggaaaagu

SEQ ID NO: 750562 - RNA, 20 nt, Leptospira interrogans serovar lai str. 56601
aauuuuucucuaucagaaaa

SEQ ID NO: 750563 - RNA, 18 nt, Leptospira interrogans serovar lai str. 56601
aauuuuucugaaaaguuu

SEQ ID NO: 750564 - RNA, 19 nt, Leptospira interrogans serovar lai str. 56601
aauuuuucaacaacucuaa

SEQ ID NO: 750565 - RNA, 20 nt, Leptospira interrogans serovar lai str. 56601
aauuuuucaacaacucuaau

SEQ ID NO: 750566 - RNA, 14 nt, Leptospira interrogans serovar lai str. 56601
aauuuuucaacaau

SEQ ID NO: 750567 - RNA, 16 nt, Leptospira interrogans serovar lai str. 56601
aauuuuucaacaauuc

SEQ ID NO: 750568 - RNA, 10 nt, Leptospira interrogans serovar lai str. 56601
aauuuugcuu

SEQ ID NO: 750569 - RNA, 17 nt, Leptospira interrogans serovar lai str. 56601
aauuuugcuucuaaaaa

SEQ ID NO: 750570 - RNA, 22 nt, Leptospira interrogans serovar lai str. 56601
aauuuugcaguaaggauucuuu

SEQ ID NO: 750571 - RNA, 20 nt, Leptospira interrogans serovar lai str. 56601
aauuuugaacuacagaauuu

SEQ ID NO: 750572 - RNA, 19 nt, Leptospira interrogans serovar lai str. 56601
aauuuuguaggaauuagua

SEQ ID NO: 750573 - RNA, 15 nt, Leptospira interrogans serovar lai str. 56601
aauuuuuaaaaagaa

SEQ ID NO: 750574 - RNA, 16 nt, Leptospira interrogans serovar lai str. 56601
aauuuuuaaaaagaau

SEQ ID NO: 750575 - RNA, 17 nt, Leptospira interrogans serovar lai str. 56601
aauuuuuaaaaagaauu

SEQ ID NO: 750576 - RNA, 13 nt, Leptospira interrogans serovar lai str. 56601
aauuuuuaaaaau

SEQ ID NO: 750577 - RNA, 16 nt, Leptospira interrogans serovar lai str. 56601
aauuuucuuguuuaaa

SEQ ID NO: 750578 - RNA, 13 nt, Leptospira interrogans serovar lai str. 56601
aauuuugauuaca

SEQ ID NO: 750579 - RNA, 14 nt, Leptospira interrogans serovar lai str. 56601
aauuuugaaacaaa

SEQ ID NO: 750580 - RNA, 14 nt, Leptospira interrogans serovar lai str. 56601
aauuuuauuaaaua

SEQ ID NO: 750581 - RNA, 23 nt, Leptospira interrogans serovar lai str. 56601
aauuuuaucuuaauguaaaguuc

SEQ ID NO: 750582 - RNA, 15 nt, Leptospira interrogans serovar lai str. 56601
aauuuuaugaccuaa

SEQ ID NO: 750583 - RNA, 17 nt, Leptospira interrogans serovar lai str. 56601
aauuuuaugauuuucuu

SEQ ID NO: 750584 - RNA, 20 nt, Leptospira interrogans serovar lai str. 56601
aauuuuaugauuuucuuuuc

SEQ ID NO: 750585 - RNA, 21 nt, Leptospira interrogans serovar lai str. 56601
aauuuuauagauugauucuuu

SEQ ID NO: 750586 - RNA, 14 nt, Leptospira interrogans serovar lai str. 56601
aauuuuacuuauac

SEQ ID NO: 750587 - RNA, 15 nt, Leptospira interrogans serovar lai str. 56601
aauuuuacuaaaaau

SEQ ID NO: 750588 - RNA, 19 nt, Leptospira interrogans serovar lai str. 56601
aauuuuagaauauuaugaa

SEQ ID NO: 750589 - RNA, 20 nt, Leptospira interrogans serovar lai str. 56601
aauuuuagaauauuaugaaa

SEQ ID NO: 750590 - RNA, 23 nt, Leptospira interrogans serovar lai str. 56601
aauuuuagaauuuguuuguaaaa

SEQ ID NO: 750591 - RNA, 17 nt, Leptospira interrogans serovar lai str. 56601
aauuuuagacaaaaaau

SEQ ID NO: 750592 - RNA, 19 nt, Leptospira interrogans serovar lai str. 56601
aauuuuaguucucucgaaa

SEQ ID NO: 750593 - RNA, 19 nt, Leptospira interrogans serovar lai str. 56601
aauuuuaguuuauuuuaaa

SEQ ID NO: 750594 - RNA, 21 nt, Leptospira interrogans serovar lai str. 56601
aauuuuauaaaaaucuaggaa

SEQ ID NO: 750595 - RNA, 23 nt, Leptospira interrogans serovar lai str. 56601
aauuuuauaaaaaucuaggaacu

SEQ ID NO: 750596 - RNA, 15 nt, Leptospira interrogans serovar lai str. 56601
aauuuuauauagaac

SEQ ID NO: 750597 - RNA, 21 nt, Leptospira interrogans serovar lai str. 56601
aauuuuccgaaccuuaccacc

SEQ ID NO: 750598 - RNA, 13 nt, Leptospira interrogans serovar lai str. 56601
aauuuuccguuaa

SEQ ID NO: 750599 - RNA, 22 nt, Leptospira interrogans serovar lai str. 56601
aauuuuccucccggcauuaaua

SEQ ID NO: 750600 - RNA, 14 nt, Leptospira interrogans serovar lai str. 56601
aauuuucuaaagau

SEQ ID NO: 750601 - RNA, 14 nt, Leptospira interrogans serovar lai str. 56601
aauuuuccuuuaaa

SEQ ID NO: 750602 - RNA, 19 nt, Leptospira interrogans serovar lai str. 56601
aauuuucguaauaguuccc

SEQ ID NO: 750603 - RNA, 14 nt, Leptospira interrogans serovar lai str. 56601
aauuuucuaaaagu

SEQ ID NO: 750604 - RNA, 14 nt, Leptospira interrogans serovar lai str. 56601
aauuuuauuguguu

SEQ ID NO: 750605 - RNA, 15 nt, Leptospira interrogans serovar lai str. 56601
aauuuucauuuuaua

SEQ ID NO: 750606 - RNA, 13 nt, Leptospira interrogans serovar lai str. 56601
aauuuucaugaac

SEQ ID NO: 750607 - RNA, 23 nt, Leptospira interrogans serovar lai str. 56601
aauuuucaugaacgaauuuuuca

SEQ ID NO: 750608 - RNA, 13 nt, Leptospira interrogans serovar lai str. 56601
aauuuucaaaauc

SEQ ID NO: 750609 - RNA, 15 nt, Leptospira interrogans serovar lai str. 56601
aauuuucaucaaaua

SEQ ID NO: 750610 - RNA, 20 nt, Leptospira interrogans serovar lai str. 56601
aauuuucagugaauaaaaua

SEQ ID NO: 750611 - RNA, 14 nt, Leptospira interrogans serovar lai str. 56601
aaugcaucucuucu

SEQ ID NO: 750612 - RNA, 15 nt, Leptospira interrogans serovar lai str. 56601
aaugccgcaccuaau

SEQ ID NO: 750613 - RNA, 23 nt, Leptospira interrogans serovar lai str. 56601
aaugaugugggaacuauuacaaa

SEQ ID NO: 750614 - RNA, 19 nt, Leptospira interrogans serovar lai str. 56601
aaugauaggcuaaucaaau

SEQ ID NO: 750615 - RNA, 19 nt, Leptospira interrogans serovar lai str. 56601
aaugggaguucguaugagu

SEQ ID NO: 750616 - RNA, 21 nt, Leptospira interrogans serovar lai str. 56601
aaugggauuuuguaaugaaau

SEQ ID NO: 750617 - RNA, 17 nt, Leptospira interrogans serovar lai str. 56601
aauggauggaaaaugaa

SEQ ID NO: 750618 - RNA, 18 nt, Leptospira interrogans serovar lai str. 56601
aauggauggaaaaugaau

SEQ ID NO: 750619 - RNA, 15 nt, Leptospira interrogans serovar lai str. 56601
aaugcugaauugcuc

SEQ ID NO: 750620 - RNA, 13 nt, Leptospira interrogans serovar lai str. 56601
aaugcugauuuuu

SEQ ID NO: 750621 - RNA, 21 nt, Leptospira interrogans serovar lai str. 56601
aaugcucgguacucuauuaua

SEQ ID NO: 750622 - RNA, 20 nt, Leptospira interrogans serovar lai str. 56601
aaugacacuuaucaaauaga

SEQ ID NO: 750623 - RNA, 12 nt, Leptospira interrogans serovar lai str. 56601
aaugaauucucu

SEQ ID NO: 750624 - RNA, 18 nt, Leptospira interrogans serovar lai str. 56601
aaugaauccuauaaacua

SEQ ID NO: 750625 - RNA, 18 nt, Leptospira interrogans serovar lai str. 56601
aaugaauuuuuauaaaaa

SEQ ID NO: 750626 - RNA, 13 nt, Leptospira interrogans serovar lai str. 56601
aaugaauuuuuca

SEQ ID NO: 750627 - RNA, 20 nt, Leptospira interrogans serovar lai str. 56601
aaugaauuuuucauuuuguu

SEQ ID NO: 750628 - RNA, 14 nt, Leptospira interrogans serovar lai str. 56601
aaugacuugcauuu

SEQ ID NO: 750629 - RNA, 21 nt, Leptospira interrogans serovar lai str. 56601
aaugagaguucgugaagaaau

SEQ ID NO: 750630 - RNA, 16 nt, Leptospira interrogans serovar lai str. 56601
aaugagauuaaaacug

SEQ ID NO: 750631 - RNA, 16 nt, Leptospira interrogans serovar lai str. 56601
aaugaguaaacuauug

SEQ ID NO: 750632 - RNA, 19 nt, Leptospira interrogans serovar lai str. 56601
aaugagucugucccaaaau

SEQ ID NO: 750633 - RNA, 22 nt, Leptospira interrogans serovar lai str. 56601
aaugagucugucccaaaaucug

SEQ ID NO: 750634 - RNA, 13 nt, Leptospira interrogans serovar lai str. 56601
aaugagucuuuuu

SEQ ID NO: 750635 - RNA, 15 nt, Leptospira interrogans serovar lai str. 56601
aaugagucuuuuuac

SEQ ID NO: 750636 - RNA, 22 nt, Leptospira interrogans serovar lai str. 56601
aaugaguuauaguaaaagaaaa

SEQ ID NO: 750637 - RNA, 13 nt, Leptospira interrogans serovar lai str. 56601
aaugaguuuuaga

SEQ ID NO: 750638 - RNA, 15 nt, Leptospira interrogans serovar lai str. 56601
aaugauacuuuguaa

SEQ ID NO: 750639 - RNA, 17 nt, Leptospira interrogans serovar lai str. 56601
aaugauagaaacuaauu

SEQ ID NO: 750640 - RNA, 13 nt, Leptospira interrogans serovar lai str. 56601
aaugaaauuuuug

SEQ ID NO: 750641 - RNA, 22 nt, Leptospira interrogans serovar lai str. 56601
aaugaacaaugaauuuuuauaa

SEQ ID NO: 750642 - RNA, 23 nt, Leptospira interrogans serovar lai str. 56601
aaugaaagguaauuuugaaguau

SEQ ID NO: 750643 - RNA, 23 nt, Leptospira interrogans serovar lai str. 56601
aaugaaaucuacaaaacuguuuu

SEQ ID NO: 750644 - RNA, 13 nt, Leptospira interrogans serovar lai str. 56601
aaugaacucaaca

SEQ ID NO: 750645 - RNA, 17 nt, Leptospira interrogans serovar lai str. 56601
aaugaacucaacagaac

SEQ ID NO: 750646 - RNA, 22 nt, Leptospira interrogans serovar lai str. 56601
aaugaaauuuuuguacaaaacc

SEQ ID NO: 750647 - RNA, 21 nt, Leptospira interrogans serovar lai str. 56601
aaugaaguguaaaacccaucg

SEQ ID NO: 750648 - RNA, 12 nt, Leptospira interrogans serovar lai str. 56601
aaugaauguuua

SEQ ID NO: 750649 - RNA, 15 nt, Leptospira interrogans serovar lai str. 56601
aaugaauguuuaaaa

SEQ ID NO: 750650 - RNA, 13 nt, Leptospira interrogans serovar lai str. 56601
aaugaauuguaaa

SEQ ID NO: 750651 - RNA, 14 nt, Leptospira interrogans serovar lai str. 56601
aaugaauuguaaaa

SEQ ID NO: 750652 - RNA, 16 nt, Leptospira interrogans serovar lai str. 56601
aaugaauuguaaaaaa

SEQ ID NO: 750653 - RNA, 18 nt, Leptospira interrogans serovar lai str. 56601
aaugaauuguaaaaaacc

SEQ ID NO: 750654 - RNA, 17 nt, Leptospira interrogans serovar lai str. 56601
aaugaauuuagaaaauu

SEQ ID NO: 750655 - RNA, 20 nt, Leptospira interrogans serovar lai str. 56601
aaugaauuuagcauuuuuaa

SEQ ID NO: 750656 - RNA, 15 nt, Leptospira interrogans serovar lai str. 56601
aaugaaucguaaaaa

SEQ ID NO: 750657 - RNA, 14 nt, Leptospira interrogans serovar lai str. 56601
aaugaaucaugaau

SEQ ID NO: 750658 - RNA, 14 nt, Leptospira interrogans serovar lai str. 56601
aaucuuuuuaaaag

SEQ ID NO: 750659 - RNA, 17 nt, Leptospira interrogans serovar lai str. 56601
aaucuuuuuaaaaguuu

SEQ ID NO: 750660 - RNA, 22 nt, Leptospira interrogans serovar lai str. 56601
aaucuuuuuaaaaguuugauuu

SEQ ID NO: 750661 - RNA, 13 nt, Leptospira interrogans serovar lai str. 56601
aaucuuuuuaacg

SEQ ID NO: 750662 - RNA, 14 nt, Leptospira interrogans serovar lai str. 56601
aaucuuuuaaaaaa

SEQ ID NO: 750663 - RNA, 17 nt, Leptospira interrogans serovar lai str. 56601
aaugaaaagauuucaaa

SEQ ID NO: 750664 - RNA, 10 nt, Leptospira interrogans serovar lai str. 56601
aaugaaaaaa

SEQ ID NO: 750665 - RNA, 16 nt, Leptospira interrogans serovar lai str. 56601
aaucuuuucuauaauc

SEQ ID NO: 750666 - RNA, 15 nt, Leptospira interrogans serovar lai str. 56601
aaugaaaaagaauuu

SEQ ID NO: 750667 - RNA, 16 nt, Leptospira interrogans serovar lai str. 56601
aaugaaaaaaaacaaa

SEQ ID NO: 750668 - RNA, 21 nt, Leptospira interrogans serovar lai str. 56601
aaugaaaaaacuauuuaauau

SEQ ID NO: 750669 - RNA, 19 nt, Leptospira interrogans serovar lai str. 56601
aaucuugggguuuuuguaa

SEQ ID NO: 750670 - RNA, 18 nt, Leptospira interrogans serovar lai str. 56601
aaucuuggaucauccuuu

SEQ ID NO: 750671 - RNA, 20 nt, Leptospira interrogans serovar lai str. 56601
aaucuuucauguauuacuca

SEQ ID NO: 750672 - RNA, 23 nt, Leptospira interrogans serovar lai str. 56601
aaucuuuauagguuucuucgccu

SEQ ID NO: 750673 - RNA, 17 nt, Leptospira interrogans serovar lai str. 56601
aaucuuucacuuuaaaa

SEQ ID NO: 750674 - RNA, 20 nt, Leptospira interrogans serovar lai str. 56601
aaucuuuaaaauacuuuacc

SEQ ID NO: 750675 - RNA, 14 nt, Leptospira interrogans serovar lai str. 56601
aaucuuuagaauuu

SEQ ID NO: 750676 - RNA, 18 nt, Leptospira interrogans serovar lai str. 56601
aaucuuuagaauuuuucg

SEQ ID NO: 750677 - RNA, 23 nt, Leptospira interrogans serovar lai str. 56601
aaucgacguuauguggaaaacuu

SEQ ID NO: 750678 - RNA, 17 nt, Leptospira interrogans serovar lai str. 56601
aaucgacgauuuuacga

SEQ ID NO: 750679 - RNA, 17 nt, Leptospira interrogans serovar lai str. 56601
aaucgaaaaaauacaaa

SEQ ID NO: 750680 - RNA, 21 nt, Leptospira interrogans serovar lai str. 56601
aaucgaagaugguacuuuacg

SEQ ID NO: 750681 - RNA, 22 nt, Leptospira interrogans serovar lai str. 56601
aaucgaagaugguacuuuacga

SEQ ID NO: 750682 - RNA, 16 nt, Leptospira interrogans serovar lai str. 56601
aaucgaauguauuuag

SEQ ID NO: 750683 - RNA, 21 nt, Leptospira interrogans serovar lai str. 56601
aaucgaauguauuuagcgcuu

SEQ ID NO: 750684 - RNA, 14 nt, Leptospira interrogans serovar lai str. 56601
aaucgaauuuccau

SEQ ID NO: 750685 - RNA, 16 nt, Leptospira interrogans serovar lai str. 56601
aaaaauuuuucuuaau

SEQ ID NO: 750686 - RNA, 21 nt, Leptospira interrogans serovar lai str. 56601
aaaaauuuuuacgcguaauuu

SEQ ID NO: 750687 - RNA, 23 nt, Leptospira interrogans serovar lai str. 56601
aaaaauuuuuagaguuuguucca

SEQ ID NO: 750688 - RNA, 23 nt, Leptospira interrogans serovar lai str. 56601
aaaaauuucccuaguuccaauua

SEQ ID NO: 750689 - RNA, 18 nt, Leptospira interrogans serovar lai str. 56601
aaaaauuucuuaaaagau

SEQ ID NO: 750690 - RNA, 17 nt, Leptospira interrogans serovar lai str. 56601
aaaaauuucuucaauug

SEQ ID NO: 750691 - RNA, 20 nt, Leptospira interrogans serovar lai str. 56601
aaaaauuucuuugucuuuau

SEQ ID NO: 750692 - RNA, 11 nt, Leptospira interrogans serovar lai str. 56601
aaaaauuuuau

SEQ ID NO: 750693 - RNA, 16 nt, Leptospira interrogans serovar lai str. 56601
aaaaauuuuauuaaau

SEQ ID NO: 750694 - RNA, 17 nt, Leptospira interrogans serovar lai str. 56601
aaaaauuuuauuaaaua

SEQ ID NO: 750695 - RNA, 22 nt, Leptospira interrogans serovar lai str. 56601
aaucgccgcuauggaauuuuuc

SEQ ID NO: 750696 - RNA, 23 nt, Leptospira interrogans serovar lai str. 56601
aaucgccgcuauggaauuuuuca

SEQ ID NO: 750697 - RNA, 18 nt, Leptospira interrogans serovar lai str. 56601
aaucccggaucguuuuuc

SEQ ID NO: 750698 - RNA, 22 nt, Leptospira interrogans serovar lai str. 56601
aauccauaucuacaaaagauuu

SEQ ID NO: 750699 - RNA, 22 nt, Leptospira interrogans serovar lai str. 56601
aauccugcuaacugauuauaaa

SEQ ID NO: 750700 - RNA, 15 nt, Leptospira interrogans serovar lai str. 56601
aauccuguaaauuca

SEQ ID NO: 750701 - RNA, 15 nt, Leptospira interrogans serovar lai str. 56601
aaucguaaaaaagau

SEQ ID NO: 750702 - RNA, 22 nt, Leptospira interrogans serovar lai str. 56601
aaucguaguuuuacagccaucc

SEQ ID NO: 750703 - RNA, 17 nt, Leptospira interrogans serovar lai str. 56601
aaucguaggcacgugga

SEQ ID NO: 750704 - RNA, 20 nt, Leptospira interrogans serovar lai str. 56601
aaucgguucuauaaaagccg

SEQ ID NO: 750705 - RNA, 15 nt, Leptospira interrogans serovar lai str. 56601
aaucggagaauuuaa

SEQ ID NO: 750706 - RNA, 23 nt, Leptospira interrogans serovar lai str. 56601
aaucgcugguuuuauuucugcug

SEQ ID NO: 750707 - RNA, 17 nt, Leptospira interrogans serovar lai str. 56601
aaucgcucgcaaauuuu

SEQ ID NO: 750708 - RNA, 16 nt, Leptospira interrogans serovar lai str. 56601
aaucuaagaagagguu

SEQ ID NO: 750709 - RNA, 16 nt, Leptospira interrogans serovar lai str. 56601
aaucuaggaacugcuu

SEQ ID NO: 750710 - RNA, 12 nt, Leptospira interrogans serovar lai str. 56601
aaucuaaaaaua

SEQ ID NO: 750711 - RNA, 15 nt, Leptospira interrogans serovar lai str. 56601
aaucuaaaaaaacaa

SEQ ID NO: 750712 - RNA, 17 nt, Leptospira interrogans serovar lai str. 56601
aaucuaucucaaaauac

SEQ ID NO: 750713 - RNA, 17 nt, Leptospira interrogans serovar lai str. 56601
aaucuauucuuaaaaug

SEQ ID NO: 750714 - RNA, 19 nt, Leptospira interrogans serovar lai str. 56601
aaucucguuaaauuuucgu

SEQ ID NO: 750715 - RNA, 20 nt, Leptospira interrogans serovar lai str. 56601
aaucuccccaaaaucuuuag

SEQ ID NO: 750716 - RNA, 16 nt, Leptospira interrogans serovar lai str. 56601
aauccagucaaguaaa

SEQ ID NO: 750717 - RNA, 13 nt, Leptospira interrogans serovar lai str. 56601
aauccaauauuua

SEQ ID NO: 750718 - RNA, 19 nt, Leptospira interrogans serovar lai str. 56601
aauccaauauuuaugcuuu

SEQ ID NO: 750719 - RNA, 22 nt, Leptospira interrogans serovar lai str. 56601
aaucaucuaucuuuucaaaagu

SEQ ID NO: 750720 - RNA, 17 nt, Leptospira interrogans serovar lai str. 56601
aaucaugucucaguuca

SEQ ID NO: 750721 - RNA, 23 nt, Leptospira interrogans serovar lai str. 56601
aaucaugucucaguucaaaauau

SEQ ID NO: 750722 - RNA, 17 nt, Leptospira interrogans serovar lai str. 56601
aaucaugugaauucaga

SEQ ID NO: 750723 - RNA, 22 nt, Leptospira interrogans serovar lai str. 56601
aaucaugugaauucagaaaaaa

SEQ ID NO: 750724 - RNA, 19 nt, Leptospira interrogans serovar lai str. 56601
aaucauccaauaauuuaac

SEQ ID NO: 750725 - RNA, 20 nt, Leptospira interrogans serovar lai str. 56601
aaaaauuccacuucucacaa

SEQ ID NO: 750726 - RNA, 23 nt, Leptospira interrogans serovar lai str. 56601
aaaaauucuccuccugaaaauuu

SEQ ID NO: 750727 - RNA, 14 nt, Leptospira interrogans serovar lai str. 56601
aaaaauucuaauau

SEQ ID NO: 750728 - RNA, 18 nt, Leptospira interrogans serovar lai str. 56601
aaaaauucaacuuguaaa

SEQ ID NO: 750729 - RNA, 23 nt, Leptospira interrogans serovar lai str. 56601
aaaaauucaacuuguaaaacagc

SEQ ID NO: 750730 - RNA, 10 nt, Leptospira interrogans serovar lai str. 56601
aaaaauucau

SEQ ID NO: 750731 - RNA, 17 nt, Leptospira interrogans serovar lai str. 56601
aaaaauucauaauaaaa

SEQ ID NO: 750732 - RNA, 18 nt, Leptospira interrogans serovar lai str. 56601
aaaaauucauaauaaaac

SEQ ID NO: 750733 - RNA, 21 nt, Leptospira interrogans serovar lai str. 56601
aaaaauucauuccuauaaaua

SEQ ID NO: 750734 - RNA, 17 nt, Leptospira interrogans serovar lai str. 56601
aaucauauuuaacugua

SEQ ID NO: 750735 - RNA, 20 nt, Leptospira interrogans serovar lai str. 56601
aaucauauuuuaauuuucua

SEQ ID NO: 750736 - RNA, 16 nt, Leptospira interrogans serovar lai str. 56601
aaucauauuuucaaaa

SEQ ID NO: 750737 - RNA, 17 nt, Leptospira interrogans serovar lai str. 56601
aaucauauuuucaaaaa

SEQ ID NO: 750738 - RNA, 19 nt, Leptospira interrogans serovar lai str. 56601
aaucauauuuucaaaaaau

SEQ ID NO: 750739 - RNA, 18 nt, Leptospira interrogans serovar lai str. 56601
aauaugaauuacuacaaa

SEQ ID NO: 750740 - RNA, 19 nt, Leptospira interrogans serovar lai str. 56601
aauaugagugaauggagcu

SEQ ID NO: 750741 - RNA, 17 nt, Leptospira interrogans serovar lai str. 56601
aauaugaaguaugaagu

SEQ ID NO: 750742 - RNA, 22 nt, Leptospira interrogans serovar lai str. 56601
aaucagguuuuuacagauuuau

SEQ ID NO: 750743 - RNA, 13 nt, Leptospira interrogans serovar lai str. 56601
aaaaauguuuaaa

SEQ ID NO: 750744 - RNA, 22 nt, Leptospira interrogans serovar lai str. 56601
aaaaauguuuagacuucucuuu

SEQ ID NO: 750745 - RNA, 19 nt, Leptospira interrogans serovar lai str. 56601
aaaaaugugggaacuauaa

SEQ ID NO: 750746 - RNA, 17 nt, Leptospira interrogans serovar lai str. 56601
aaucauagucauuuuga

SEQ ID NO: 750747 - RNA, 19 nt, Leptospira interrogans serovar lai str. 56601
aaucauauggauuauccaa

SEQ ID NO: 750748 - RNA, 23 nt, Leptospira interrogans serovar lai str. 56601
aaucauauggauuauccaaaaca

SEQ ID NO: 750749 - RNA, 19 nt, Leptospira interrogans serovar lai str. 56601
aaucauauccaauuucaau

SEQ ID NO: 750750 - RNA, 15 nt, Leptospira interrogans serovar lai str. 56601
aaaaauuaaaauucu

SEQ ID NO: 750751 - RNA, 19 nt, Leptospira interrogans serovar lai str. 56601
aaaaauuaaaauucuagaa

SEQ ID NO: 750752 - RNA, 14 nt, Leptospira interrogans serovar lai str. 56601
aaaaauuaauuuua

SEQ ID NO: 750753 - RNA, 18 nt, Leptospira interrogans serovar lai str. 56601
aaaaauuagaaaugauuu

SEQ ID NO: 750754 - RNA, 23 nt, Leptospira interrogans serovar lai str. 56601
aaucaguguuuugugauaaaauu

SEQ ID NO: 750755 - RNA, 19 nt, Leptospira interrogans serovar lai str. 56601
aaucaguuaauacaaaacu

SEQ ID NO: 750756 - RNA, 16 nt, Leptospira interrogans serovar lai str. 56601
aaucauagauacauaa

SEQ ID NO: 750757 - RNA, 21 nt, Leptospira interrogans serovar lai str. 56601
acucuuacgcaugauaaaaau

SEQ ID NO: 750758 - RNA, 15 nt, Leptospira interrogans serovar lai str. 56601
acucuuacuuugaga

SEQ ID NO: 750759 - RNA, 17 nt, Leptospira interrogans serovar lai str. 56601
acucuuauuuauauuuc

SEQ ID NO: 750760 - RNA, 19 nt, Leptospira interrogans serovar lai str. 56601
acucuuauuuauauuucua

SEQ ID NO: 750761 - RNA, 21 nt, Leptospira interrogans serovar lai str. 56601
acucugguuauuaaauuguau

SEQ ID NO: 750762 - RNA, 18 nt, Leptospira interrogans serovar lai str. 56601
acucuuauaaaauuuuag

SEQ ID NO: 750763 - RNA, 14 nt, Leptospira interrogans serovar lai str. 56601
acucuugaacagaa

SEQ ID NO: 750764 - RNA, 17 nt, Leptospira interrogans serovar lai str. 56601
acucuucuucuagauuu

SEQ ID NO: 750765 - RNA, 21 nt, Leptospira interrogans serovar lai str. 56601
acucuucuucuagauuuuaaa

SEQ ID NO: 750766 - RNA, 22 nt, Leptospira interrogans serovar lai str. 56601
acucuucuucuagauuuuaaau

SEQ ID NO: 750767 - RNA, 20 nt, Leptospira interrogans serovar lai str. 56601
acucugcaaaauuuaaaaag

SEQ ID NO: 750768 - RNA, 23 nt, Leptospira interrogans serovar lai str. 56601
acucuaauguacaacauccuuca

SEQ ID NO: 750769 - RNA, 17 nt, Leptospira interrogans serovar lai str. 56601
acucuaaguuuuuaaau

SEQ ID NO: 750770 - RNA, 18 nt, Leptospira interrogans serovar lai str. 56601
acucuaagcuauuuuuga

SEQ ID NO: 750771 - RNA, 13 nt, Leptospira interrogans serovar lai str. 56601
acucuaauuuuuu

SEQ ID NO: 750772 - RNA, 20 nt, Leptospira interrogans serovar lai str. 56601
acucguuuuuaguuucuuuu

SEQ ID NO: 750773 - RNA, 20 nt, Leptospira interrogans serovar lai str. 56601
acuccggcuaaaaaacugau

SEQ ID NO: 750774 - RNA, 23 nt, Leptospira interrogans serovar lai str. 56601
acuauuuuuuguaugaguuccua

SEQ ID NO: 750775 - RNA, 19 nt, Leptospira interrogans serovar lai str. 56601
acuauuuugaugaaugaau

SEQ ID NO: 750776 - RNA, 15 nt, Leptospira interrogans serovar lai str. 56601
acuauuuuauuacaa

SEQ ID NO: 750777 - RNA, 16 nt, Leptospira interrogans serovar lai str. 56601
acucaaaaaauuuuua

SEQ ID NO: 750778 - RNA, 17 nt, Leptospira interrogans serovar lai str. 56601
acucggcguaagaaagu

SEQ ID NO: 750779 - RNA, 18 nt, Leptospira interrogans serovar lai str. 56601
acucguuagagaaaagca

SEQ ID NO: 750780 - RNA, 20 nt, Leptospira interrogans serovar lai str. 56601
acucguuagagaaaagcauu

SEQ ID NO: 750781 - RNA, 17 nt, Leptospira interrogans serovar lai str. 56601
acuccuagauguuuugu

SEQ ID NO: 750782 - RNA, 14 nt, Leptospira interrogans serovar lai str. 56601
acucgacaaaacac

SEQ ID NO: 750783 - RNA, 12 nt, Leptospira interrogans serovar lai str. 56601
acugcauuuuau

SEQ ID NO: 750784 - RNA, 19 nt, Leptospira interrogans serovar lai str. 56601
acugcauuuuauuaaaaau

SEQ ID NO: 750785 - RNA, 21 nt, Leptospira interrogans serovar lai str. 56601
acugcauuuuauuaaaaauau

SEQ ID NO: 750786 - RNA, 20 nt, Leptospira interrogans serovar lai str. 56601
acugcauuuuauuaaagaau

SEQ ID NO: 750787 - RNA, 16 nt, Leptospira interrogans serovar lai str. 56601
acuggaauauucuuuu

SEQ ID NO: 750788 - RNA, 20 nt, Leptospira interrogans serovar lai str. 56601
acugcucgaaaguucacaaa

SEQ ID NO: 750789 - RNA, 21 nt, Leptospira interrogans serovar lai str. 56601
acugcucgaaaguucacaaau

SEQ ID NO: 750790 - RNA, 17 nt, Leptospira interrogans serovar lai str. 56601
acucuuuuuauuuuuug

SEQ ID NO: 750791 - RNA, 18 nt, Leptospira interrogans serovar lai str. 56601
acucuuuuucuucugcug

SEQ ID NO: 750792 - RNA, 20 nt, Leptospira interrogans serovar lai str. 56601
acucuuuuucuucugcugca

SEQ ID NO: 750793 - RNA, 15 nt, Leptospira interrogans serovar lai str. 56601
acucuuucaaagcua

SEQ ID NO: 750794 - RNA, 16 nt, Leptospira interrogans serovar lai str. 56601
acucuuugacccauaa

SEQ ID NO: 750795 - RNA, 16 nt, Leptospira interrogans serovar lai str. 56601
acucuuuauuuuuaac

SEQ ID NO: 750796 - RNA, 19 nt, Leptospira interrogans serovar lai str. 56601
acucuuuuaccuuaccacc

SEQ ID NO: 750797 - RNA, 20 nt, Leptospira interrogans serovar lai str. 56601
acucuuuuaccuuaccaccg

SEQ ID NO: 750798 - RNA, 13 nt, Leptospira interrogans serovar lai str. 56601
acugaaaaugacc

SEQ ID NO: 750799 - RNA, 20 nt, Leptospira interrogans serovar lai str. 56601
acugagauuugucucaaaau

SEQ ID NO: 750800 - RNA, 14 nt, Leptospira interrogans serovar lai str. 56601
acugauuuuuuaaa

SEQ ID NO: 750801 - RNA, 23 nt, Leptospira interrogans serovar lai str. 56601
acugcaaaaucaguuaauacaaa

SEQ ID NO: 750802 - RNA, 19 nt, Leptospira interrogans serovar lai str. 56601
acugauuucaaaaauaaau

SEQ ID NO: 750803 - RNA, 17 nt, Leptospira interrogans serovar lai str. 56601
acugauuucuauaaaau

SEQ ID NO: 750804 - RNA, 16 nt, Leptospira interrogans serovar lai str. 56601
acugauuuaauuauuu

SEQ ID NO: 750805 - RNA, 13 nt, Leptospira interrogans serovar lai str. 56601
acugauuuagaga

SEQ ID NO: 750806 - RNA, 14 nt, Leptospira interrogans serovar lai str. 56601
acugaguuucaaac

SEQ ID NO: 750807 - RNA, 23 nt, Leptospira interrogans serovar lai str. 56601
acuucauucggcuuuaagugaac

SEQ ID NO: 750808 - RNA, 19 nt, Leptospira interrogans serovar lai str. 56601
acuucauccgggcuuuucu

SEQ ID NO: 750809 - RNA, 21 nt, Leptospira interrogans serovar lai str. 56601
acuucauccgggcuuuucuuu

SEQ ID NO: 750810 - RNA, 22 nt, Leptospira interrogans serovar lai str. 56601
acuucaucaaugguuuuucuuc

SEQ ID NO: 750811 - RNA, 19 nt, Leptospira interrogans serovar lai str. 56601
acuuccauuggauucugcu

SEQ ID NO: 750812 - RNA, 15 nt, Leptospira interrogans serovar lai str. 56601
acuuccauuuuuuau

SEQ ID NO: 750813 - RNA, 17 nt, Leptospira interrogans serovar lai str. 56601
acuuccaucagaauaga

SEQ ID NO: 750814 - RNA, 16 nt, Leptospira interrogans serovar lai str. 56601
acuucgaucauuuuac

SEQ ID NO: 750815 - RNA, 15 nt, Leptospira interrogans serovar lai str. 56601
acuucggaacauaag

SEQ ID NO: 750816 - RNA, 18 nt, Leptospira interrogans serovar lai str. 56601
acuucuuaaguagauaaa

SEQ ID NO: 750817 - RNA, 16 nt, Leptospira interrogans serovar lai str. 56601
acuucucuuaaaauuu

SEQ ID NO: 750818 - RNA, 17 nt, Leptospira interrogans serovar lai str. 56601
acuucucuuaaaauuua

SEQ ID NO: 750819 - RNA, 20 nt, Leptospira interrogans serovar lai str. 56601
acuucuaaaaaauucuuucu

SEQ ID NO: 750820 - RNA, 20 nt, Leptospira interrogans serovar lai str. 56601
acuucgucuaagggaauuug

SEQ ID NO: 750821 - RNA, 16 nt, Leptospira interrogans serovar lai str. 56601
acuucucacaaaucau

SEQ ID NO: 750822 - RNA, 12 nt, Leptospira interrogans serovar lai str. 56601
acuucucuaaag

SEQ ID NO: 750823 - RNA, 13 nt, Leptospira interrogans serovar lai str. 56601
acuucuuuuuugu

SEQ ID NO: 750824 - RNA, 19 nt, Leptospira interrogans serovar lai str. 56601
acuugaaaaagcggucuug

SEQ ID NO: 750825 - RNA, 20 nt, Leptospira interrogans serovar lai str. 56601
acuugaaaauaaaaaucaua

SEQ ID NO: 750826 - RNA, 20 nt, Leptospira interrogans serovar lai str. 56601
acuugagauuccuuuuaaga

SEQ ID NO: 750827 - RNA, 22 nt, Leptospira interrogans serovar lai str. 56601
acuugagaagggugaauuuuuu

SEQ ID NO: 750828 - RNA, 21 nt, Leptospira interrogans serovar lai str. 56601
acuuaugcuauuuaauuuugu

SEQ ID NO: 750829 - RNA, 23 nt, Leptospira interrogans serovar lai str. 56601
acuuaugauuuaguaaaauuuaa

SEQ ID NO: 750830 - RNA, 17 nt, Leptospira interrogans serovar lai str. 56601
acuuauuucuauaaaau

SEQ ID NO: 750831 - RNA, 14 nt, Leptospira interrogans serovar lai str. 56601
acuuauuuuugaaa

SEQ ID NO: 750832 - RNA, 16 nt, Leptospira interrogans serovar lai str. 56601
acuuauuuuugaaaag

SEQ ID NO: 750833 - RNA, 14 nt, Leptospira interrogans serovar lai str. 56601
acuuagaauuuuuu

SEQ ID NO: 750834 - RNA, 15 nt, Leptospira interrogans serovar lai str. 56601
acuucaauuaucuau

SEQ ID NO: 750835 - RNA, 21 nt, Leptospira interrogans serovar lai str. 56601
acuuaaauucggaaauuuuaa

SEQ ID NO: 750836 - RNA, 12 nt, Leptospira interrogans serovar lai str. 56601
acuuaaaaugag

SEQ ID NO: 750837 - RNA, 13 nt, Leptospira interrogans serovar lai str. 56601
acuuaaaaaugau

SEQ ID NO: 750838 - RNA, 13 nt, Leptospira interrogans serovar lai str. 56601
acuuaauuuuucu

SEQ ID NO: 750839 - RNA, 19 nt, Leptospira interrogans serovar lai str. 56601
acuuacaaagcacuuuuuu

SEQ ID NO: 750840 - RNA, 23 nt, Leptospira interrogans serovar lai str. 56601
acuuacaaagcacuuuuuuccuc

SEQ ID NO: 750841 - RNA, 17 nt, Leptospira interrogans serovar lai str. 56601
acuuacagauugauuuu

SEQ ID NO: 750842 - RNA, 19 nt, Leptospira interrogans serovar lai str. 56601
acuuaccccgaaauacaua

SEQ ID NO: 750843 - RNA, 20 nt, Leptospira interrogans serovar lai str. 56601
acuuacugaaagcuugaaag

SEQ ID NO: 750844 - RNA, 13 nt, Leptospira interrogans serovar lai str. 56601
acuaaaaaacaua

SEQ ID NO: 750845 - RNA, 14 nt, Leptospira interrogans serovar lai str. 56601
acuaaaaaacauaa

SEQ ID NO: 750846 - RNA, 15 nt, Leptospira interrogans serovar lai str. 56601
acguuuuauuauaua

SEQ ID NO: 750847 - RNA, 16 nt, Leptospira interrogans serovar lai str. 56601
acuaaaauuaaaaauu

SEQ ID NO: 750848 - RNA, 14 nt, Leptospira interrogans serovar lai str. 56601
acuaaaauuuuaua

SEQ ID NO: 750849 - RNA, 18 nt, Leptospira interrogans serovar lai str. 56601
acuaaacgauuuuauaca

SEQ ID NO: 750850 - RNA, 22 nt, Leptospira interrogans serovar lai str. 56601
acuaaaccaccaaccgaaacuu

SEQ ID NO: 750851 - RNA, 20 nt, Leptospira interrogans serovar lai str. 56601
acuaaauccuucuuuucuuc

SEQ ID NO: 750852 - RNA, 23 nt, Leptospira interrogans serovar lai str. 56601
acuaaaucucaauucaguaaauu

SEQ ID NO: 750853 - RNA, 18 nt, Leptospira interrogans serovar lai str. 56601
acguuuccagaaagcucu

SEQ ID NO: 750854 - RNA, 12 nt, Leptospira interrogans serovar lai str. 56601
acguauaaaaac

SEQ ID NO: 750855 - RNA, 16 nt, Leptospira interrogans serovar lai str. 56601
acguaggaaaugaaaa

SEQ ID NO: 750856 - RNA, 22 nt, Leptospira interrogans serovar lai str. 56601
acgucuucuaaauuuguaaauu

SEQ ID NO: 750857 - RNA, 13 nt, Leptospira interrogans serovar lai str. 56601
acgugaauuguca

SEQ ID NO: 750858 - RNA, 12 nt, Leptospira interrogans serovar lai str. 56601
acguuacuuuua

SEQ ID NO: 750859 - RNA, 18 nt, Leptospira interrogans serovar lai str. 56601
acguuauaaaauuggaaa

SEQ ID NO: 750860 - RNA, 19 nt, Leptospira interrogans serovar lai str. 56601
acguugaauaagauuuuag

SEQ ID NO: 750861 - RNA, 18 nt, Leptospira interrogans serovar lai str. 56601
acguucuuagccuuuaaa

SEQ ID NO: 750862 - RNA, 15 nt, Leptospira interrogans serovar lai str. 56601
acguucaaacaacaa

SEQ ID NO: 750863 - RNA, 13 nt, Leptospira interrogans serovar lai str. 56601
acguuauucuauu

SEQ ID NO: 750864 - RNA, 17 nt, Leptospira interrogans serovar lai str. 56601
acuaacgcucauuucca

SEQ ID NO: 750865 - RNA, 22 nt, Leptospira interrogans serovar lai str. 56601
acuaaauuuuucggaaauagaa

SEQ ID NO: 750866 - RNA, 19 nt, Leptospira interrogans serovar lai str. 56601
acuaacaaaaugauuuuau

SEQ ID NO: 750867 - RNA, 11 nt, Leptospira interrogans serovar lai str. 56601
acuaaauuagu

SEQ ID NO: 750868 - RNA, 15 nt, Leptospira interrogans serovar lai str. 56601
acuaaauuaguucuu

SEQ ID NO: 750869 - RNA, 16 nt, Leptospira interrogans serovar lai str. 56601
acuaacacaguuugaa

SEQ ID NO: 750870 - RNA, 15 nt, Leptospira interrogans serovar lai str. 56601
acuaauaaaaacaau

SEQ ID NO: 750871 - RNA, 13 nt, Leptospira interrogans serovar lai str. 56601
acuaauaaaaaug

SEQ ID NO: 750872 - RNA, 23 nt, Leptospira interrogans serovar lai str. 56601
acuaaggcccacaucgaaaaaac

SEQ ID NO: 750873 - RNA, 14 nt, Leptospira interrogans serovar lai str. 56601
acuaaguaaaaaug

SEQ ID NO: 750874 - RNA, 19 nt, Leptospira interrogans serovar lai str. 56601
acuaaguaaaaaugcaaau

SEQ ID NO: 750875 - RNA, 14 nt, Leptospira interrogans serovar lai str. 56601
acuaauauguuuag

SEQ ID NO: 750876 - RNA, 21 nt, Leptospira interrogans serovar lai str. 56601
acuacacgagagcugcuugaa

SEQ ID NO: 750877 - RNA, 15 nt, Leptospira interrogans serovar lai str. 56601
acuacacguuuuccu

SEQ ID NO: 750878 - RNA, 16 nt, Leptospira interrogans serovar lai str. 56601
acuacaagauuucguu

SEQ ID NO: 750879 - RNA, 15 nt, Leptospira interrogans serovar lai str. 56601
acuacaauuaaaaag

SEQ ID NO: 750880 - RNA, 16 nt, Leptospira interrogans serovar lai str. 56601
acuacaauuuuagaau

SEQ ID NO: 750881 - RNA, 15 nt, Leptospira interrogans serovar lai str. 56601
acuacagaauaaagu

SEQ ID NO: 750882 - RNA, 16 nt, Leptospira interrogans serovar lai str. 56601
acuaauuuuaguuuau

SEQ ID NO: 750883 - RNA, 20 nt, Leptospira interrogans serovar lai str. 56601
acuaauuuaucgauuuaaaa

SEQ ID NO: 750884 - RNA, 17 nt, Leptospira interrogans serovar lai str. 56601
acuaauucuuuugcaua

SEQ ID NO: 750885 - RNA, 20 nt, Leptospira interrogans serovar lai str. 56601
acuaauugugucguauuaaa

SEQ ID NO: 750886 - RNA, 15 nt, Leptospira interrogans serovar lai str. 56601
acuaccgcaaaucaa

SEQ ID NO: 750887 - RNA, 23 nt, Leptospira interrogans serovar lai str. 56601
acuaccacagaaagcuuucuccu

SEQ ID NO: 750888 - RNA, 18 nt, Leptospira interrogans serovar lai str. 56601
acuaccaccaaaguauga

SEQ ID NO: 750889 - RNA, 18 nt, Leptospira interrogans serovar lai str. 56601
acuauaauaacaaaaaau

SEQ ID NO: 750890 - RNA, 15 nt, Leptospira interrogans serovar lai str. 56601
acuauaaaguuuuag

SEQ ID NO: 750891 - RNA, 13 nt, Leptospira interrogans serovar lai str. 56601
acuauaaaucauu

SEQ ID NO: 750892 - RNA, 15 nt, Leptospira interrogans serovar lai str. 56601
acuauuacaaaaucu

SEQ ID NO: 750893 - RNA, 23 nt, Leptospira interrogans serovar lai str. 56601
acuauuaucuuucgauuuuaaau

SEQ ID NO: 750894 - RNA, 20 nt, Leptospira interrogans serovar lai str. 56601
acuauucuauuaguuuuuau

SEQ ID NO: 750895 - RNA, 16 nt, Leptospira interrogans serovar lai str. 56601
acuaucacaaaucuau

SEQ ID NO: 750896 - RNA, 15 nt, Leptospira interrogans serovar lai str. 56601
acuaucaacaagaau

SEQ ID NO: 750897 - RNA, 20 nt, Leptospira interrogans serovar lai str. 56601
acuaucaacaagaaugaaaa

SEQ ID NO: 750898 - RNA, 14 nt, Leptospira interrogans serovar lai str. 56601
acuauuauaaaaua

SEQ ID NO: 750899 - RNA, 13 nt, Leptospira interrogans serovar lai str. 56601
acuauuauaauag

SEQ ID NO: 750900 - RNA, 16 nt, Leptospira interrogans serovar lai str. 56601
acuauuuauaaaauaa

SEQ ID NO: 750901 - RNA, 22 nt, Leptospira interrogans serovar lai str. 56601
acuauuuauaaaauaaaaaaau

SEQ ID NO: 750902 - RNA, 18 nt, Leptospira interrogans serovar lai str. 56601
acuauacuuguuucuaau

SEQ ID NO: 750903 - RNA, 18 nt, Leptospira interrogans serovar lai str. 56601
acuauacuuucaaaaaau

SEQ ID NO: 750904 - RNA, 21 nt, Leptospira interrogans serovar lai str. 56601
acuauacuuucaaaaaauaua

SEQ ID NO: 750905 - RNA, 22 nt, Leptospira interrogans serovar lai str. 56601
acuauacuuucaaaaaauauaa

SEQ ID NO: 750906 - RNA, 17 nt, Leptospira interrogans serovar lai str. 56601
acguaaguuaaauauaa

SEQ ID NO: 750907 - RNA, 15 nt, Leptospira interrogans serovar lai str. 56601
acguaaaacuucuuu

SEQ ID NO: 750908 - RNA, 16 nt, Leptospira interrogans serovar lai str. 56601
acggugcauuuaaaaa

SEQ ID NO: 750909 - RNA, 17 nt, Leptospira interrogans serovar lai str. 56601
acggugcauuuaaaaaa

SEQ ID NO: 750910 - RNA, 17 nt, Leptospira interrogans serovar lai str. 56601
acgguaaaaggagccaa

SEQ ID NO: 750911 - RNA, 16 nt, Leptospira interrogans serovar lai str. 56601
acgggcccaaauaaaa

SEQ ID NO: 750912 - RNA, 20 nt, Leptospira interrogans serovar lai str. 56601
acggcuuuaguuugaaagaa

SEQ ID NO: 750913 - RNA, 15 nt, Leptospira interrogans serovar lai str. 56601
acgcugaguuugaaa

SEQ ID NO: 750914 - RNA, 21 nt, Leptospira interrogans serovar lai str. 56601
acgcugaguuugaaagauugu

SEQ ID NO: 750915 - RNA, 15 nt, Leptospira interrogans serovar lai str. 56601
acgcugaguuugaga

SEQ ID NO: 750916 - RNA, 19 nt, Leptospira interrogans serovar lai str. 56601
acgcugaguuugagagagc

SEQ ID NO: 750917 - RNA, 17 nt, Leptospira interrogans serovar lai str. 56601
acggauuucuauaaaau

SEQ ID NO: 750918 - RNA, 16 nt, Leptospira interrogans serovar lai str. 56601
acggauugccuaaauu

SEQ ID NO: 750919 - RNA, 13 nt, Leptospira interrogans serovar lai str. 56601
acggauguaacag

SEQ ID NO: 750920 - RNA, 24 nt, Leptospira interrogans serovar lai str. 56601
acggaugugaauucucuagaaauu

SEQ ID NO: 750921 - RNA, 21 nt, Leptospira interrogans serovar lai str. 56601
acggaucgcguuugaaacuca

SEQ ID NO: 750922 - RNA, 23 nt, Leptospira interrogans serovar lai str. 56601
acggaucgcguuugaaacucagu

SEQ ID NO: 750923 - RNA, 13 nt, Leptospira interrogans serovar lai str. 56601
acggaagaaaauu

SEQ ID NO: 750924 - RNA, 13 nt, Leptospira interrogans serovar lai str. 56601
acgcaugauaaaa

SEQ ID NO: 750925 - RNA, 15 nt, Leptospira interrogans serovar lai str. 56601
acgcaugauaaaaau

SEQ ID NO: 750926 - RNA, 23 nt, Leptospira interrogans serovar lai str. 56601
acgcaggcuuguuugaauuuuuc

SEQ ID NO: 750927 - RNA, 23 nt, Leptospira interrogans serovar lai str. 56601
acgcagauuugauguaaagaaaa

SEQ ID NO: 750928 - RNA, 18 nt, Leptospira interrogans serovar lai str. 56601
acgcagagucuauaaaau

SEQ ID NO: 750929 - RNA, 19 nt, Leptospira interrogans serovar lai str. 56601
acgcaaucauucuuuagaa

SEQ ID NO: 750930 - RNA, 15 nt, Leptospira interrogans serovar lai str. 56601
acgaacgaauucuaa

SEQ ID NO: 750931 - RNA, 14 nt, Leptospira interrogans serovar lai str. 56601
acgagaaagaauuu

SEQ ID NO: 750932 - RNA, 17 nt, Leptospira interrogans serovar lai str. 56601
acgacuuuauucaaaau

SEQ ID NO: 750933 - RNA, 15 nt, Leptospira interrogans serovar lai str. 56601
acgauaauuuucuuu

SEQ ID NO: 750934 - RNA, 20 nt, Leptospira interrogans serovar lai str. 56601
acgagcuuuauuuggcuuua

SEQ ID NO: 750935 - RNA, 14 nt, Leptospira interrogans serovar lai str. 56601
acgaguagaauucu

SEQ ID NO: 750936 - RNA, 13 nt, Leptospira interrogans serovar lai str. 56601
acgaguaguucuu

SEQ ID NO: 750937 - RNA, 20 nt, Leptospira interrogans serovar lai str. 56601
acgauuuuuugauucauuca

SEQ ID NO: 750938 - RNA, 23 nt, Leptospira interrogans serovar lai str. 56601
acgauuuuuugauucauucagga

SEQ ID NO: 750939 - RNA, 12 nt, Leptospira interrogans serovar lai str. 56601
acgauuggaagg

SEQ ID NO: 750940 - RNA, 22 nt, Leptospira interrogans serovar lai str. 56601
acgauuugcaucgacaaaacuu

SEQ ID NO: 750941 - RNA, 13 nt, Leptospira interrogans serovar lai str. 56601
acgauuuucuccu

SEQ ID NO: 750942 - RNA, 17 nt, Leptospira interrogans serovar lai str. 56601
acgauuuuacaaacaaa

SEQ ID NO: 750943 - RNA, 16 nt, Leptospira interrogans serovar lai str. 56601
acgauuaaauuuugaa

SEQ ID NO: 750944 - RNA, 14 nt, Leptospira interrogans serovar lai str. 56601
acgauuauuuuuua

SEQ ID NO: 750945 - RNA, 16 nt, Leptospira interrogans serovar lai str. 56601
acgauuauuuuuuaaa

SEQ ID NO: 750946 - RNA, 19 nt, Leptospira interrogans serovar lai str. 56601
acgauuauuuuuuaaaaau

SEQ ID NO: 750947 - RNA, 15 nt, Leptospira interrogans serovar lai str. 56601
acgauucaguuuuac

SEQ ID NO: 750948 - RNA, 22 nt, Leptospira interrogans serovar lai str. 56601
acgauucaguuuuacuguaaaa

SEQ ID NO: 750949 - RNA, 19 nt, Leptospira interrogans serovar lai str. 56601
acgauugauuuuggaaaga

SEQ ID NO: 750950 - RNA, 16 nt, Leptospira interrogans serovar lai str. 56601
acgauuccauuuuuua

SEQ ID NO: 750951 - RNA, 20 nt, Leptospira interrogans serovar lai str. 56601
acgauucgaaagauuuuuca

SEQ ID NO: 750952 - RNA, 21 nt, Leptospira interrogans serovar lai str. 56601
acgauucgaaagauuuuucau

SEQ ID NO: 750953 - RNA, 15 nt, Leptospira interrogans serovar lai str. 56601
acgauacuuaaaaau

SEQ ID NO: 750954 - RNA, 19 nt, Leptospira interrogans serovar lai str. 56601
accuguuuuaguucaaaaa

SEQ ID NO: 750955 - RNA, 22 nt, Leptospira interrogans serovar lai str. 56601
accuguuuuaguucaaaaacau

SEQ ID NO: 750956 - RNA, 18 nt, Leptospira interrogans serovar lai str. 56601
accuuccuacuccggcua

SEQ ID NO: 750957 - RNA, 16 nt, Leptospira interrogans serovar lai str. 56601
accuuuaguuuccaaa

SEQ ID NO: 750958 - RNA, 17 nt, Leptospira interrogans serovar lai str. 56601
accuuuaguuuccaaaa

SEQ ID NO: 750959 - RNA, 22 nt, Leptospira interrogans serovar lai str. 56601
acgaaaaaauugacuuaggaua

SEQ ID NO: 750960 - RNA, 19 nt, Leptospira interrogans serovar lai str. 56601
acgaaaagaccauuuuccu

SEQ ID NO: 750961 - RNA, 14 nt, Leptospira interrogans serovar lai str. 56601
accuuuuuuauuuu

SEQ ID NO: 750962 - RNA, 19 nt, Leptospira interrogans serovar lai str. 56601
accuuuuuuuaugaaaaaa

SEQ ID NO: 750963 - RNA, 17 nt, Leptospira interrogans serovar lai str. 56601
accuuuauuuaaaaacc

SEQ ID NO: 750964 - RNA, 23 nt, Leptospira interrogans serovar lai str. 56601
accuuuauuuaauaaaauuuuua

SEQ ID NO: 750965 - RNA, 19 nt, Leptospira interrogans serovar lai str. 56601
acgaacacauucuaaaauu

SEQ ID NO: 750966 - RNA, 19 nt, Leptospira interrogans serovar lai str. 56601
acgaacaaauucuaaaauu

SEQ ID NO: 750967 - RNA, 14 nt, Leptospira interrogans serovar lai str. 56601
accuagaggagcca

SEQ ID NO: 750968 - RNA, 18 nt, Leptospira interrogans serovar lai str. 56601
accuaguguuuaauuuua

SEQ ID NO: 750969 - RNA, 13 nt, Leptospira interrogans serovar lai str. 56601
accuauacuagaa

SEQ ID NO: 750970 - RNA, 20 nt, Leptospira interrogans serovar lai str. 56601
accuaucacaaacuauucua

SEQ ID NO: 750971 - RNA, 14 nt, Leptospira interrogans serovar lai str. 56601
accuccggaaaaaa

SEQ ID NO: 750972 - RNA, 17 nt, Leptospira interrogans serovar lai str. 56601
accugaaucuauuguaa

SEQ ID NO: 750973 - RNA, 17 nt, Leptospira interrogans serovar lai str. 56601
accucgucuaucuuuuu

SEQ ID NO: 750974 - RNA, 17 nt, Leptospira interrogans serovar lai str. 56601
accucuauaaaaucuaa

SEQ ID NO: 750975 - RNA, 19 nt, Leptospira interrogans serovar lai str. 56601
accucuauccacuaaaaua

SEQ ID NO: 750976 - RNA, 18 nt, Leptospira interrogans serovar lai str. 56601
accucguacuaauucuuu

SEQ ID NO: 750977 - RNA, 23 nt, Leptospira interrogans serovar lai str. 56601
accgcaaaucacaauuuuacaaa

SEQ ID NO: 750978 - RNA, 13 nt, Leptospira interrogans serovar lai str. 56601
accgaucuuaaaa

SEQ ID NO: 750979 - RNA, 17 nt, Leptospira interrogans serovar lai str. 56601
acccuaaaaaauuuuua

SEQ ID NO: 750980 - RNA, 18 nt, Leptospira interrogans serovar lai str. 56601
acccuaaaaaauuuuuag

SEQ ID NO: 750981 - RNA, 19 nt, Leptospira interrogans serovar lai str. 56601
accggauucacauuaaaau

SEQ ID NO: 750982 - RNA, 23 nt, Leptospira interrogans serovar lai str. 56601
accgggccuuuuuuauuucugag

SEQ ID NO: 750983 - RNA, 20 nt, Leptospira interrogans serovar lai str. 56601
acccauggcuuugaaaaagg

SEQ ID NO: 750984 - RNA, 14 nt, Leptospira interrogans serovar lai str. 56601
accccuuuuuuaag

SEQ ID NO: 750985 - RNA, 21 nt, Leptospira interrogans serovar lai str. 56601
acccgcuacuauucuacagau

SEQ ID NO: 750986 - RNA, 14 nt, Leptospira interrogans serovar lai str. 56601
acccaaugauucua

SEQ ID NO: 750987 - RNA, 16 nt, Leptospira interrogans serovar lai str. 56601
acccaaugauucuaac

SEQ ID NO: 750988 - RNA, 15 nt, Leptospira interrogans serovar lai str. 56601
acccaauaagaagcc

SEQ ID NO: 750989 - RNA, 11 nt, Leptospira interrogans serovar lai str. 56601
accauuuuugc

SEQ ID NO: 750990 - RNA, 13 nt, Leptospira interrogans serovar lai str. 56601
acccaaaaauagg

SEQ ID NO: 750991 - RNA, 15 nt, Leptospira interrogans serovar lai str. 56601
acccaaaaauguagu

SEQ ID NO: 750992 - RNA, 14 nt, Leptospira interrogans serovar lai str. 56601
accauuucaaguuu

SEQ ID NO: 750993 - RNA, 14 nt, Leptospira interrogans serovar lai str. 56601
accagaaaguuagu

SEQ ID NO: 750994 - RNA, 15 nt, Leptospira interrogans serovar lai str. 56601
accauaaauuuuuau

SEQ ID NO: 750995 - RNA, 19 nt, Leptospira interrogans serovar lai str. 56601
accauaaauuuuuauuaca

SEQ ID NO: 750996 - RNA, 15 nt, Leptospira interrogans serovar lai str. 56601
accauaaauuuuuug

SEQ ID NO: 750997 - RNA, 21 nt, Leptospira interrogans serovar lai str. 56601
accaucaaugucaaaaaaaau

SEQ ID NO: 750998 - RNA, 12 nt, Leptospira interrogans serovar lai str. 56601
accaucaaaauu

SEQ ID NO: 750999 - RNA, 22 nt, Leptospira interrogans serovar lai str. 56601
accaucaaaauuuaaaucccau

SEQ ID NO: 751000 - RNA, 18 nt, Leptospira interrogans serovar lai str. 56601
accaugauucugaaaaaa

SEQ ID NO: 751001 - RNA, 17 nt, Leptospira interrogans serovar lai str. 56601
agcaugaaauuuucuua

SEQ ID NO: 751002 - RNA, 14 nt, Leptospira interrogans serovar lai str. 56601
agcagcuaaaaaga

SEQ ID NO: 751003 - RNA, 16 nt, Leptospira interrogans serovar lai str. 56601
agcagcuaaaaagaaa

SEQ ID NO: 751004 - RNA, 13 nt, Leptospira interrogans serovar lai str. 56601
agcaguaaaaaag

SEQ ID NO: 751005 - RNA, 21 nt, Leptospira interrogans serovar lai str. 56601
agcaguaaaaucuuuaaguuu

SEQ ID NO: 751006 - RNA, 21 nt, Leptospira interrogans serovar lai str. 56601
agcaccuucuaaauuccaaaa

SEQ ID NO: 751007 - RNA, 23 nt, Leptospira interrogans serovar lai str. 56601
agcacuuuuuuccucgaauucag

SEQ ID NO: 751008 - RNA, 13 nt, Leptospira interrogans serovar lai str. 56601
agcagcaaagaag

SEQ ID NO: 751009 - RNA, 19 nt, Leptospira interrogans serovar lai str. 56601
agcagauucuaaaaaugaa

SEQ ID NO: 751010 - RNA, 17 nt, Leptospira interrogans serovar lai str. 56601
agccccagucuauaaau

SEQ ID NO: 751011 - RNA, 16 nt, Leptospira interrogans serovar lai str. 56601
agccauuuagguugua

SEQ ID NO: 751012 - RNA, 17 nt, Leptospira interrogans serovar lai str. 56601
agccaugguaagaagaa

SEQ ID NO: 751013 - RNA, 23 nt, Leptospira interrogans serovar lai str. 56601
agccaucguucucucaauuaaag

SEQ ID NO: 751014 - RNA, 22 nt, Leptospira interrogans serovar lai str. 56601
agcaugaggcaacggaauuuuu

SEQ ID NO: 751015 - RNA, 16 nt, Leptospira interrogans serovar lai str. 56601
agcucaucauucugaa

SEQ ID NO: 751016 - RNA, 22 nt, Leptospira interrogans serovar lai str. 56601
agcucaucauucugaaaaaagu

SEQ ID NO: 751017 - RNA, 19 nt, Leptospira interrogans serovar lai str. 56601
agcucaugauuauuacucg

SEQ ID NO: 751018 - RNA, 17 nt, Leptospira interrogans serovar lai str. 56601
agcuccaaaaaaauaaa

SEQ ID NO: 751019 - RNA, 22 nt, Leptospira interrogans serovar lai str. 56601
agcuccaaaaaaauaaaucaug

SEQ ID NO: 751020 - RNA, 22 nt, Leptospira interrogans serovar lai str. 56601
agcuaucgccaucgucagggaa

SEQ ID NO: 751021 - RNA, 18 nt, Leptospira interrogans serovar lai str. 56601
agcuauuuucagaaaaau

SEQ ID NO: 751022 - RNA, 21 nt, Leptospira interrogans serovar lai str. 56601
agcuauuuucagaaaaaugaa

SEQ ID NO: 751023 - RNA, 23 nt, Leptospira interrogans serovar lai str. 56601
agcuauuuuuuucgcaaauucua

SEQ ID NO: 751024 - RNA, 21 nt, Leptospira interrogans serovar lai str. 56601
agcguuuuguuaauuguugcu

SEQ ID NO: 751025 - RNA, 12 nt, Leptospira interrogans serovar lai str. 56601
agcuaaaaagaa

SEQ ID NO: 751026 - RNA, 23 nt, Leptospira interrogans serovar lai str. 56601
agcuaaaaagaaaguugcaaaga

SEQ ID NO: 751027 - RNA, 15 nt, Leptospira interrogans serovar lai str. 56601
agcguuuuacugagu

SEQ ID NO: 751028 - RNA, 23 nt, Leptospira interrogans serovar lai str. 56601
agcguuucguucuuuuuuccuuc

SEQ ID NO: 751029 - RNA, 21 nt, Leptospira interrogans serovar lai str. 56601
agcguucuaaguccacccaaa

SEQ ID NO: 751030 - RNA, 22 nt, Leptospira interrogans serovar lai str. 56601
agcuacagcugaggaguuuuua

SEQ ID NO: 751031 - RNA, 13 nt, Leptospira interrogans serovar lai str. 56601
agcgugacuaaaa

SEQ ID NO: 751032 - RNA, 22 nt, Leptospira interrogans serovar lai str. 56601
agcguaagguguuuauaaaaac

SEQ ID NO: 751033 - RNA, 12 nt, Leptospira interrogans serovar lai str. 56601
agcgggaauuua

SEQ ID NO: 751034 - RNA, 17 nt, Leptospira interrogans serovar lai str. 56601
agcgggaccgggcucuc

SEQ ID NO: 751035 - RNA, 24 nt, Leptospira interrogans serovar lai str. 56601
agcgaaagaauguauaccaauaau

SEQ ID NO: 751036 - RNA, 13 nt, Leptospira interrogans serovar lai str. 56601
agccugauaaauu

SEQ ID NO: 751037 - RNA, 17 nt, Leptospira interrogans serovar lai str. 56601
agccugaguuugagaga

SEQ ID NO: 751038 - RNA, 19 nt, Leptospira interrogans serovar lai str. 56601
agccugaguuugagagaga

SEQ ID NO: 751039 - RNA, 18 nt, Leptospira interrogans serovar lai str. 56601
agcaaaaauuuucuaaaa

SEQ ID NO: 751040 - RNA, 15 nt, Leptospira interrogans serovar lai str. 56601
agcaaaaauaaagua

SEQ ID NO: 751041 - RNA, 20 nt, Leptospira interrogans serovar lai str. 56601
agcaaacuuuuuauaaaaag

SEQ ID NO: 751042 - RNA, 16 nt, Leptospira interrogans serovar lai str. 56601
agcaaaggaucaaauc

SEQ ID NO: 751043 - RNA, 18 nt, Leptospira interrogans serovar lai str. 56601
agcaaauaacgauuccau

SEQ ID NO: 751044 - RNA, 19 nt, Leptospira interrogans serovar lai str. 56601
agcaaaguuacuucccuuc

SEQ ID NO: 751045 - RNA, 19 nt, Leptospira interrogans serovar lai str. 56601
agcaaaguuucuuauauaa

SEQ ID NO: 751046 - RNA, 18 nt, Leptospira interrogans serovar lai str. 56601
agcaaauucugauuuuac

SEQ ID NO: 751047 - RNA, 19 nt, Leptospira interrogans serovar lai str. 56601
agcaaauucugauuuuaca

SEQ ID NO: 751048 - RNA, 22 nt, Leptospira interrogans serovar lai str. 56601
agcaaauucugauuuuacagac

SEQ ID NO: 751049 - RNA, 15 nt, Leptospira interrogans serovar lai str. 56601
agcaaauuuacuuca

SEQ ID NO: 751050 - RNA, 23 nt, Leptospira interrogans serovar lai str. 56601
agauuuguguuaguucccacauu

SEQ ID NO: 751051 - RNA, 17 nt, Leptospira interrogans serovar lai str. 56601
agauuugucucaaaauu

SEQ ID NO: 751052 - RNA, 19 nt, Leptospira interrogans serovar lai str. 56601
agauuugucucaaaauuua

SEQ ID NO: 751053 - RNA, 20 nt, Leptospira interrogans serovar lai str. 56601
agauuugucucaaaauuuaa

SEQ ID NO: 751054 - RNA, 16 nt, Leptospira interrogans serovar lai str. 56601
agauuugcucuuaaug

SEQ ID NO: 751055 - RNA, 20 nt, Leptospira interrogans serovar lai str. 56601
agauuugauguaaagaaaac

SEQ ID NO: 751056 - RNA, 18 nt, Leptospira interrogans serovar lai str. 56601
agauuuguugaaaaguga

SEQ ID NO: 751057 - RNA, 13 nt, Leptospira interrogans serovar lai str. 56601
agauuuuaaaaau

SEQ ID NO: 751058 - RNA, 16 nt, Leptospira interrogans serovar lai str. 56601
agauuuuaaaaauuca

SEQ ID NO: 751059 - RNA, 20 nt, Leptospira interrogans serovar lai str. 56601
agauuuuaaaaauucaacua

SEQ ID NO: 751060 - RNA, 23 nt, Leptospira interrogans serovar lai str. 56601
agauuucuuguuuuuuagaaaau

SEQ ID NO: 751061 - RNA, 18 nt, Leptospira interrogans serovar lai str. 56601
agauuucuauauucaaaa

SEQ ID NO: 751062 - RNA, 14 nt, Leptospira interrogans serovar lai str. 56601
agauuuauugaaaa

SEQ ID NO: 751063 - RNA, 15 nt, Leptospira interrogans serovar lai str. 56601
agauuucgaaaaaaa

SEQ ID NO: 751064 - RNA, 23 nt, Leptospira interrogans serovar lai str. 56601
agauuucguucggaaaaaauaug

SEQ ID NO: 751065 - RNA, 19 nt, Leptospira interrogans serovar lai str. 56601
agauuucguucggaaaaag

SEQ ID NO: 751066 - RNA, 21 nt, Leptospira interrogans serovar lai str. 56601
agauuuugcacguaaacauuc

SEQ ID NO: 751067 - RNA, 14 nt, Leptospira interrogans serovar lai str. 56601
agauuuucucaaaa

SEQ ID NO: 751068 - RNA, 17 nt, Leptospira interrogans serovar lai str. 56601
agauuuucucaaaaaaa

SEQ ID NO: 751069 - RNA, 18 nt, Leptospira interrogans serovar lai str. 56601
agauuuucucaaaaaaag

SEQ ID NO: 751070 - RNA, 21 nt, Leptospira interrogans serovar lai str. 56601
agauuuucucaaaaaaaguaa

SEQ ID NO: 751071 - RNA, 19 nt, Leptospira interrogans serovar lai str. 56601
agauuuuacgaacaaauuc

SEQ ID NO: 751072 - RNA, 21 nt, Leptospira interrogans serovar lai str. 56601
agauuuuacgauuaaauuuug

SEQ ID NO: 751073 - RNA, 14 nt, Leptospira interrogans serovar lai str. 56601
agauuuuagaauca

SEQ ID NO: 751074 - RNA, 18 nt, Leptospira interrogans serovar lai str. 56601
agauuuuagaaucagaau

SEQ ID NO: 751075 - RNA, 15 nt, Leptospira interrogans serovar lai str. 56601
agauuuuauuuugau

SEQ ID NO: 751076 - RNA, 22 nt, Leptospira interrogans serovar lai str. 56601
agauuuuauuuugauuccaaag

SEQ ID NO: 751077 - RNA, 16 nt, Leptospira interrogans serovar lai str. 56601
agauuuuugcacaaaa

SEQ ID NO: 751078 - RNA, 14 nt, Leptospira interrogans serovar lai str. 56601
agauuuuuguaguu

SEQ ID NO: 751079 - RNA, 21 nt, Leptospira interrogans serovar lai str. 56601
agauuuucuuugauugaauua

SEQ ID NO: 751080 - RNA, 14 nt, Leptospira interrogans serovar lai str. 56601
agauuguaaguuuu

SEQ ID NO: 751081 - RNA, 15 nt, Leptospira interrogans serovar lai str. 56601
agauuguaaguuuuu

SEQ ID NO: 751082 - RNA, 16 nt, Leptospira interrogans serovar lai str. 56601
agauuguaaguuuuug

SEQ ID NO: 751083 - RNA, 15 nt, Leptospira interrogans serovar lai str. 56601
agauuuauuuuagaa

SEQ ID NO: 751084 - RNA, 18 nt, Leptospira interrogans serovar lai str. 56601
agauuuauuuuagaaugu

SEQ ID NO: 751085 - RNA, 20 nt, Leptospira interrogans serovar lai str. 56601
agauuuauauguuucuuuug

SEQ ID NO: 751086 - RNA, 23 nt, Leptospira interrogans serovar lai str. 56601
agauuuaugacagcuugaagauu

SEQ ID NO: 751087 - RNA, 20 nt, Leptospira interrogans serovar lai str. 56601
agauuucagcuccaaaaaaa

SEQ ID NO: 751088 - RNA, 16 nt, Leptospira interrogans serovar lai str. 56601
agauuuagauucuaaa

SEQ ID NO: 751089 - RNA, 22 nt, Leptospira interrogans serovar lai str. 56601
agauuuagagccaaauuuuuag

SEQ ID NO: 751090 - RNA, 14 nt, Leptospira interrogans serovar lai str. 56601
agauuuaauuuuuc

SEQ ID NO: 751091 - RNA, 14 nt, Leptospira interrogans serovar lai str. 56601
agauucuaaaaaaa

SEQ ID NO: 751092 - RNA, 16 nt, Leptospira interrogans serovar lai str. 56601
agauucuaaaaaaagu

SEQ ID NO: 751093 - RNA, 15 nt, Leptospira interrogans serovar lai str. 56601
agauucuaaaaauga

SEQ ID NO: 751094 - RNA, 22 nt, Leptospira interrogans serovar lai str. 56601
agauucccuuuugaucuuuaaa

SEQ ID NO: 751095 - RNA, 16 nt, Leptospira interrogans serovar lai str. 56601
agauucuaauuuuuca

SEQ ID NO: 751096 - RNA, 19 nt, Leptospira interrogans serovar lai str. 56601
agauucuaauuuuucaaaa

SEQ ID NO: 751097 - RNA, 22 nt, Leptospira interrogans serovar lai str. 56601
agauucuaauuuuucaaaaacu

SEQ ID NO: 751098 - RNA, 14 nt, Leptospira interrogans serovar lai str. 56601
agauugaauuuuua

SEQ ID NO: 751099 - RNA, 17 nt, Leptospira interrogans serovar lai str. 56601
agauugauuuuucuaag

SEQ ID NO: 751100 - RNA, 23 nt, Leptospira interrogans serovar lai str. 56601
agauugauuuuuuaaauguggga

SEQ ID NO: 751101 - RNA, 19 nt, Leptospira interrogans serovar lai str. 56601
agauugauuuuaauuuguu

SEQ ID NO: 751102 - RNA, 13 nt, Leptospira interrogans serovar lai str. 56601
agauugauuuaaa

SEQ ID NO: 751103 - RNA, 15 nt, Leptospira interrogans serovar lai str. 56601
agauugauuuaaaug

SEQ ID NO: 751104 - RNA, 20 nt, Leptospira interrogans serovar lai str. 56601
agauugauuuaaauguggga

SEQ ID NO: 751105 - RNA, 14 nt, Leptospira interrogans serovar lai str. 56601
agauugauucuuua

SEQ ID NO: 751106 - RNA, 14 nt, Leptospira interrogans serovar lai str. 56601
agaugucuuugagg

SEQ ID NO: 751107 - RNA, 17 nt, Leptospira interrogans serovar lai str. 56601
agauuaccuaacuaugu

SEQ ID NO: 751108 - RNA, 13 nt, Leptospira interrogans serovar lai str. 56601
agauuaauuuuua

SEQ ID NO: 751109 - RNA, 20 nt, Leptospira interrogans serovar lai str. 56601
agauuacauaacuaauaaaa

SEQ ID NO: 751110 - RNA, 22 nt, Leptospira interrogans serovar lai str. 56601
agauuacauaacuaauaaaaac

SEQ ID NO: 751111 - RNA, 15 nt, Leptospira interrogans serovar lai str. 56601
agauuacuaugaaaa

SEQ ID NO: 751112 - RNA, 23 nt, Leptospira interrogans serovar lai str. 56601
agauuacuaugaaaauucuuucu

SEQ ID NO: 751113 - RNA, 18 nt, Leptospira interrogans serovar lai str. 56601
agauuacucuacuauaaa

SEQ ID NO: 751114 - RNA, 20 nt, Leptospira interrogans serovar lai str. 56601
agauggagaauuaauuuuuu

SEQ ID NO: 751115 - RNA, 20 nt, Leptospira interrogans serovar lai str. 56601
agauggagaauucauuuuuc

SEQ ID NO: 751116 - RNA, 14 nt, Leptospira interrogans serovar lai str. 56601
agauggaucuauau

SEQ ID NO: 751117 - RNA, 22 nt, Leptospira interrogans serovar lai str. 56601
aaaacccaucguaaacaaaagu

SEQ ID NO: 751118 - RNA, 17 nt, Leptospira interrogans serovar lai str. 56601
aaaaccaucuuugauau

SEQ ID NO: 751119 - RNA, 19 nt, Leptospira interrogans serovar lai str. 56601
aaaacccuuagucugaaau

SEQ ID NO: 751120 - RNA, 19 nt, Leptospira interrogans serovar lai str. 56601
aaaacccuuucuuugaaga

SEQ ID NO: 751121 - RNA, 16 nt, Leptospira interrogans serovar lai str. 56601
agaugagcaaaauuug

SEQ ID NO: 751122 - RNA, 14 nt, Leptospira interrogans serovar lai str. 56601
agaugaauugaauu

SEQ ID NO: 751123 - RNA, 17 nt, Leptospira interrogans serovar lai str. 56601
agaugaauugaauuuuu

SEQ ID NO: 751124 - RNA, 18 nt, Leptospira interrogans serovar lai str. 56601
agaugaauugaauuuuuu

SEQ ID NO: 751125 - RNA, 22 nt, Leptospira interrogans serovar lai str. 56601
agaugaauugaauuuuuuaaau

SEQ ID NO: 751126 - RNA, 17 nt, Leptospira interrogans serovar lai str. 56601
aaaaccgcugaaaaaaa

SEQ ID NO: 751127 - RNA, 17 nt, Leptospira interrogans serovar lai str. 56601
agaguaccauaaauuuu

SEQ ID NO: 751128 - RNA, 10 nt, Leptospira interrogans serovar lai str. 56601
agaguuccua

SEQ ID NO: 751129 - RNA, 14 nt, Leptospira interrogans serovar lai str. 56601
agaguuacagaaaa

SEQ ID NO: 751130 - RNA, 18 nt, Leptospira interrogans serovar lai str. 56601
agaguuacagaaaaaauc

SEQ ID NO: 751131 - RNA, 22 nt, Leptospira interrogans serovar lai str. 56601
agaguuccacauuuuaaagguu

SEQ ID NO: 751132 - RNA, 19 nt, Leptospira interrogans serovar lai str. 56601
agaguucccacauuuugaa

SEQ ID NO: 751133 - RNA, 23 nt, Leptospira interrogans serovar lai str. 56601
agaguucccacguuuuaaagguu

SEQ ID NO: 751134 - RNA, 15 nt, Leptospira interrogans serovar lai str. 56601
agaguguucaucuuc

SEQ ID NO: 751135 - RNA, 21 nt, Leptospira interrogans serovar lai str. 56601
agauaaauauuuccaaauugu

SEQ ID NO: 751136 - RNA, 16 nt, Leptospira interrogans serovar lai str. 56601
agauaaagguaaaaga

SEQ ID NO: 751137 - RNA, 20 nt, Leptospira interrogans serovar lai str. 56601
agauacgcccguaaauuucu

SEQ ID NO: 751138 - RNA, 21 nt, Leptospira interrogans serovar lai str. 56601
agauauuaguaaaacuguuuc

SEQ ID NO: 751139 - RNA, 15 nt, Leptospira interrogans serovar lai str. 56601
agauauuucaagaau

SEQ ID NO: 751140 - RNA, 22 nt, Leptospira interrogans serovar lai str. 56601
agauauuucaagaauuuuagaa

SEQ ID NO: 751141 - RNA, 16 nt, Leptospira interrogans serovar lai str. 56601
agauauugagcaagac

SEQ ID NO: 751142 - RNA, 16 nt, Leptospira interrogans serovar lai str. 56601
agauauugcacaugau

SEQ ID NO: 751143 - RNA, 15 nt, Leptospira interrogans serovar lai str. 56601
agauccaaauuuuuu

SEQ ID NO: 751144 - RNA, 17 nt, Leptospira interrogans serovar lai str. 56601
agaucauuaaugcgaaa

SEQ ID NO: 751145 - RNA, 22 nt, Leptospira interrogans serovar lai str. 56601
agaucauuaaugcgaaaauuua

SEQ ID NO: 751146 - RNA, 19 nt, Leptospira interrogans serovar lai str. 56601
agaucauucuauuuggauu

SEQ ID NO: 751147 - RNA, 21 nt, Leptospira interrogans serovar lai str. 56601
agauccuacacucuaaguuuu

SEQ ID NO: 751148 - RNA, 14 nt, Leptospira interrogans serovar lai str. 56601
agaggugaaauuuc

SEQ ID NO: 751149 - RNA, 20 nt, Leptospira interrogans serovar lai str. 56601
agaggucgucucaaaaauau

SEQ ID NO: 751150 - RNA, 18 nt, Leptospira interrogans serovar lai str. 56601
agaggaaacguauuuuua

SEQ ID NO: 751151 - RNA, 17 nt, Leptospira interrogans serovar lai str. 56601
agagcuuaccacaguga

SEQ ID NO: 751152 - RNA, 10 nt, Leptospira interrogans serovar lai str. 56601
aaaaccaaaa

SEQ ID NO: 751153 - RNA, 15 nt, Leptospira interrogans serovar lai str. 56601
aaaaccaaaacaucu

SEQ ID NO: 751154 - RNA, 18 nt, Leptospira interrogans serovar lai str. 56601
agacuaacgauuguaaaa

SEQ ID NO: 751155 - RNA, 21 nt, Leptospira interrogans serovar lai str. 56601
agacuaacgauuguaaaaaaa

SEQ ID NO: 751156 - RNA, 16 nt, Leptospira interrogans serovar lai str. 56601
agacuaaaaaaaugaa

SEQ ID NO: 751157 - RNA, 12 nt, Leptospira interrogans serovar lai str. 56601
agacuaaaaagu

SEQ ID NO: 751158 - RNA, 15 nt, Leptospira interrogans serovar lai str. 56601
agacguaucaaaaua

SEQ ID NO: 751159 - RNA, 18 nt, Leptospira interrogans serovar lai str. 56601
agacgucuacagauaaac

SEQ ID NO: 751160 - RNA, 15 nt, Leptospira interrogans serovar lai str. 56601
agagaugguuuagaa

SEQ ID NO: 751161 - RNA, 21 nt, Leptospira interrogans serovar lai str. 56601
agagaugguuuagaaaacgga

SEQ ID NO: 751162 - RNA, 19 nt, Leptospira interrogans serovar lai str. 56601
agagaugugaguuuuaaaa

SEQ ID NO: 751163 - RNA, 24 nt, Leptospira interrogans serovar lai str. 56601
agagcuggaugaagcuaugaagag

SEQ ID NO: 751164 - RNA, 13 nt, Leptospira interrogans serovar lai str. 56601
agagccuuuuuau

SEQ ID NO: 751165 - RNA, 16 nt, Leptospira interrogans serovar lai str. 56601
agagccguaaauauuu

SEQ ID NO: 751166 - RNA, 17 nt, Leptospira interrogans serovar lai str. 56601
agacauaaaaaaauuaa

SEQ ID NO: 751167 - RNA, 22 nt, Leptospira interrogans serovar lai str. 56601
agacauuguuuuacucuuauuu

SEQ ID NO: 751168 - RNA, 17 nt, Leptospira interrogans serovar lai str. 56601
agacauugaagaaaaaa

SEQ ID NO: 751169 - RNA, 21 nt, Leptospira interrogans serovar lai str. 56601
agacauugaagaaaaaaagau

SEQ ID NO: 751170 - RNA, 22 nt, Leptospira interrogans serovar lai str. 56601
agaccacaguaggcuauuuuac

SEQ ID NO: 751171 - RNA, 20 nt, Leptospira interrogans serovar lai str. 56601
agaccaauuuuuuuguaaaa

SEQ ID NO: 751172 - RNA, 23 nt, Leptospira interrogans serovar lai str. 56601
agaccaauuuuuuuguaaaaaaa

SEQ ID NO: 751173 - RNA, 20 nt, Leptospira interrogans serovar lai str. 56601
agaccagugccauuuuucuu

SEQ ID NO: 751174 - RNA, 12 nt, Leptospira interrogans serovar lai str. 56601
aaaacauaaaaa

SEQ ID NO: 751175 - RNA, 14 nt, Leptospira interrogans serovar lai str. 56601
aaaacauaaaaauu

SEQ ID NO: 751176 - RNA, 19 nt, Leptospira interrogans serovar lai str. 56601
aaaacaggucccaaacuuu

SEQ ID NO: 751177 - RNA, 15 nt, Leptospira interrogans serovar lai str. 56601
agacgauuccuaaaa

SEQ ID NO: 751178 - RNA, 22 nt, Leptospira interrogans serovar lai str. 56601
agacguaggaaaugaaaaagaa

SEQ ID NO: 751179 - RNA, 14 nt, Leptospira interrogans serovar lai str. 56601
agacgccauguuuu

SEQ ID NO: 751180 - RNA, 14 nt, Leptospira interrogans serovar lai str. 56601
agaccauuuuccuu

SEQ ID NO: 751181 - RNA, 15 nt, Leptospira interrogans serovar lai str. 56601
agaccauuuuccuuc

SEQ ID NO: 751182 - RNA, 15 nt, Leptospira interrogans serovar lai str. 56601
agaauuuuuaaaaau

SEQ ID NO: 751183 - RNA, 16 nt, Leptospira interrogans serovar lai str. 56601
agaauuuuuaaaaaua

SEQ ID NO: 751184 - RNA, 18 nt, Leptospira interrogans serovar lai str. 56601
agaauuuucaucaaauac

SEQ ID NO: 751185 - RNA, 18 nt, Leptospira interrogans serovar lai str. 56601
agaauuuaucauuucuuu

SEQ ID NO: 751186 - RNA, 18 nt, Leptospira interrogans serovar lai str. 56601
agaauuuauuucaaaauu

SEQ ID NO: 751187 - RNA, 20 nt, Leptospira interrogans serovar lai str. 56601
agaauuuauuucaaaauuua

SEQ ID NO: 751188 - RNA, 16 nt, Leptospira interrogans serovar lai str. 56601
agaauuuauuuguaaa

SEQ ID NO: 751189 - RNA, 14 nt, Leptospira interrogans serovar lai str. 56601
agaauuuauuuuca

SEQ ID NO: 751190 - RNA, 15 nt, Leptospira interrogans serovar lai str. 56601
agaauuuauuuucau

SEQ ID NO: 751191 - RNA, 12 nt, Leptospira interrogans serovar lai str. 56601
agacaaaaaauu

SEQ ID NO: 751192 - RNA, 17 nt, Leptospira interrogans serovar lai str. 56601
agacaaaaauacuaaau

SEQ ID NO: 751193 - RNA, 20 nt, Leptospira interrogans serovar lai str. 56601
agaauuuuucgaaacaaaau

SEQ ID NO: 751194 - RNA, 17 nt, Leptospira interrogans serovar lai str. 56601
agacaaauauuucgaca

SEQ ID NO: 751195 - RNA, 14 nt, Leptospira interrogans serovar lai str. 56601
agacaaaguauuuu

SEQ ID NO: 751196 - RNA, 12 nt, Leptospira interrogans serovar lai str. 56601
agacaagaagaa

SEQ ID NO: 751197 - RNA, 14 nt, Leptospira interrogans serovar lai str. 56601
agaauuguugaaaa

SEQ ID NO: 751198 - RNA, 17 nt, Leptospira interrogans serovar lai str. 56601
agaauuguugaaaaacu

SEQ ID NO: 751199 - RNA, 18 nt, Leptospira interrogans serovar lai str. 56601
agaauuguugaaaaacuc

SEQ ID NO: 751200 - RNA, 20 nt, Leptospira interrogans serovar lai str. 56601
agaauuguugaaaaacucca

SEQ ID NO: 751201 - RNA, 16 nt, Leptospira interrogans serovar lai str. 56601
agaauuguugaaaaau

SEQ ID NO: 751202 - RNA, 17 nt, Leptospira interrogans serovar lai str. 56601
agaauuguugaaaaauu

SEQ ID NO: 751203 - RNA, 18 nt, Leptospira interrogans serovar lai str. 56601
agaauuguugaaaaauua

SEQ ID NO: 751204 - RNA, 20 nt, Leptospira interrogans serovar lai str. 56601
agaauuguugaaaaauuaau

SEQ ID NO: 751205 - RNA, 14 nt, Leptospira interrogans serovar lai str. 56601
agaauugaucuaaa

SEQ ID NO: 751206 - RNA, 14 nt, Leptospira interrogans serovar lai str. 56601
agaauugaaagaag

SEQ ID NO: 751207 - RNA, 19 nt, Leptospira interrogans serovar lai str. 56601
agaauugaaagaagauaga

SEQ ID NO: 751208 - RNA, 16 nt, Leptospira interrogans serovar lai str. 56601
agaauugaaaucugaa

SEQ ID NO: 751209 - RNA, 20 nt, Leptospira interrogans serovar lai str. 56601
agaauugaguuuuuuauucc

SEQ ID NO: 751210 - RNA, 13 nt, Leptospira interrogans serovar lai str. 56601
agaauuaaaaauu

SEQ ID NO: 751211 - RNA, 14 nt, Leptospira interrogans serovar lai str. 56601
agaauguucuuaga

SEQ ID NO: 751212 - RNA, 22 nt, Leptospira interrogans serovar lai str. 56601
agaauguucuuagacucaguau

SEQ ID NO: 751213 - RNA, 21 nt, Leptospira interrogans serovar lai str. 56601
agaauguuugagguuuuaaaa

SEQ ID NO: 751214 - RNA, 14 nt, Leptospira interrogans serovar lai str. 56601
agaauguuuucuac

SEQ ID NO: 751215 - RNA, 20 nt, Leptospira interrogans serovar lai str. 56601
agaauguuuucuacaaauaa

SEQ ID NO: 751216 - RNA, 22 nt, Leptospira interrogans serovar lai str. 56601
agaaugaucaauagaauuguug

SEQ ID NO: 751217 - RNA, 23 nt, Leptospira interrogans serovar lai str. 56601
agaaugaucaauagaauuguuga

SEQ ID NO: 751218 - RNA, 14 nt, Leptospira interrogans serovar lai str. 56601
agaaugagcugagu

SEQ ID NO: 751219 - RNA, 22 nt, Leptospira interrogans serovar lai str. 56601
agaaugagucuuuuuacuugca

SEQ ID NO: 751220 - RNA, 15 nt, Leptospira interrogans serovar lai str. 56601
agaaucuuuuuaaaa

SEQ ID NO: 751221 - RNA, 18 nt, Leptospira interrogans serovar lai str. 56601
agaaugaaaaaacggccg

SEQ ID NO: 751222 - RNA, 14 nt, Leptospira interrogans serovar lai str. 56601
agaaugaaaaaacu

SEQ ID NO: 751223 - RNA, 17 nt, Leptospira interrogans serovar lai str. 56601
agaaugaaaaaacuauu

SEQ ID NO: 751224 - RNA, 16 nt, Leptospira interrogans serovar lai str. 56601
agaaugaacucaacag

SEQ ID NO: 751225 - RNA, 23 nt, Leptospira interrogans serovar lai str. 56601
agaaguauuuucgcacauucuau

SEQ ID NO: 751226 - RNA, 11 nt, Leptospira interrogans serovar lai str. 56601
agaaguauucc

SEQ ID NO: 751227 - RNA, 19 nt, Leptospira interrogans serovar lai str. 56601
agaauccuguuugaaaaaa

SEQ ID NO: 751228 - RNA, 23 nt, Leptospira interrogans serovar lai str. 56601
agaauccuguuugaaaaaaugua

SEQ ID NO: 751229 - RNA, 14 nt, Leptospira interrogans serovar lai str. 56601
agaaucgaaaaaau

SEQ ID NO: 751230 - RNA, 22 nt, Leptospira interrogans serovar lai str. 56601
agaacacugcauuuuauuaaaa

SEQ ID NO: 751231 - RNA, 23 nt, Leptospira interrogans serovar lai str. 56601
agaacacugcauuuuauuaaaaa

SEQ ID NO: 751232 - RNA, 22 nt, Leptospira interrogans serovar lai str. 56601
agaacaucaauuuuauuucuaa

SEQ ID NO: 751233 - RNA, 16 nt, Leptospira interrogans serovar lai str. 56601
agaacccaauaaaaac

SEQ ID NO: 751234 - RNA, 12 nt, Leptospira interrogans serovar lai str. 56601
agaaauacuuug

SEQ ID NO: 751235 - RNA, 22 nt, Leptospira interrogans serovar lai str. 56601
agaaauacuuugauuauaaccu

SEQ ID NO: 751236 - RNA, 14 nt, Leptospira interrogans serovar lai str. 56601
agaaauacuuaaaa

SEQ ID NO: 751237 - RNA, 17 nt, Leptospira interrogans serovar lai str. 56601
agaaauacuuaaaauga

SEQ ID NO: 751238 - RNA, 18 nt, Leptospira interrogans serovar lai str. 56601
agaaauacuuaaaaugag

SEQ ID NO: 751239 - RNA, 19 nt, Leptospira interrogans serovar lai str. 56601
aaaacaaucuucaaauucu

SEQ ID NO: 751240 - RNA, 15 nt, Leptospira interrogans serovar lai str. 56601
aaaacaauauucuaa

SEQ ID NO: 751241 - RNA, 20 nt, Leptospira interrogans serovar lai str. 56601
aaaacaauauucuaauuuua

SEQ ID NO: 751242 - RNA, 12 nt, Leptospira interrogans serovar lai str. 56601
agaaauauuaaa

SEQ ID NO: 751243 - RNA, 14 nt, Leptospira interrogans serovar lai str. 56601
agaaauauuuagaa

SEQ ID NO: 751244 - RNA, 23 nt, Leptospira interrogans serovar lai str. 56601
agaaauuauaguaacagaaaaau

SEQ ID NO: 751245 - RNA, 22 nt, Leptospira interrogans serovar lai str. 56601
agaaauuaauuucuaaacaauu

SEQ ID NO: 751246 - RNA, 14 nt, Leptospira interrogans serovar lai str. 56601
aaaacacaaaggaa

SEQ ID NO: 751247 - RNA, 20 nt, Leptospira interrogans serovar lai str. 56601
agaacuuaccccgaaauaca

SEQ ID NO: 751248 - RNA, 15 nt, Leptospira interrogans serovar lai str. 56601
agaacuggauucaaa

SEQ ID NO: 751249 - RNA, 21 nt, Leptospira interrogans serovar lai str. 56601
agaacugagagaaaguaaaga

SEQ ID NO: 751250 - RNA, 18 nt, Leptospira interrogans serovar lai str. 56601
agaaccgggcaauaaugu

SEQ ID NO: 751251 - RNA, 13 nt, Leptospira interrogans serovar lai str. 56601
agaaccuaaaaau

SEQ ID NO: 751252 - RNA, 14 nt, Leptospira interrogans serovar lai str. 56601
agaaccuaaaaaua

SEQ ID NO: 751253 - RNA, 17 nt, Leptospira interrogans serovar lai str. 56601
agaaccuaauguugaau

SEQ ID NO: 751254 - RNA, 16 nt, Leptospira interrogans serovar lai str. 56601
agaacuacuuuuauaa

SEQ ID NO: 751255 - RNA, 17 nt, Leptospira interrogans serovar lai str. 56601
agaacuacuuuuauaaa

SEQ ID NO: 751256 - RNA, 18 nt, Leptospira interrogans serovar lai str. 56601
agaacuacuuuuauaaaa

SEQ ID NO: 751257 - RNA, 13 nt, Leptospira interrogans serovar lai str. 56601
agaagauuuuuac

SEQ ID NO: 751258 - RNA, 16 nt, Leptospira interrogans serovar lai str. 56601
agaagauuuuuacuca

SEQ ID NO: 751259 - RNA, 19 nt, Leptospira interrogans serovar lai str. 56601
agaagauuuuuacucacac

SEQ ID NO: 751260 - RNA, 14 nt, Leptospira interrogans serovar lai str. 56601
agaagcuaaaauug

SEQ ID NO: 751261 - RNA, 20 nt, Leptospira interrogans serovar lai str. 56601
agaagcuuuauuaaauuaua

SEQ ID NO: 751262 - RNA, 23 nt, Leptospira interrogans serovar lai str. 56601
agaagcuuuuaguuguacaaaaa

SEQ ID NO: 751263 - RNA, 15 nt, Leptospira interrogans serovar lai str. 56601
agaaaguuuauaaag

SEQ ID NO: 751264 - RNA, 16 nt, Leptospira interrogans serovar lai str. 56601
agaaaguugcaaagaa

SEQ ID NO: 751265 - RNA, 17 nt, Leptospira interrogans serovar lai str. 56601
agaaaguugcaaagaag

SEQ ID NO: 751266 - RNA, 18 nt, Leptospira interrogans serovar lai str. 56601
agaaaguugcaaagaaga

SEQ ID NO: 751267 - RNA, 22 nt, Leptospira interrogans serovar lai str. 56601
agaaaguugcaaagaagaaaua

SEQ ID NO: 751268 - RNA, 14 nt, Leptospira interrogans serovar lai str. 56601
agaaaguauuaauu

SEQ ID NO: 751269 - RNA, 20 nt, Leptospira interrogans serovar lai str. 56601
agaaauaccauucauuucau

SEQ ID NO: 751270 - RNA, 23 nt, Leptospira interrogans serovar lai str. 56601
agaaauacacggagauaaaaaag

SEQ ID NO: 751271 - RNA, 19 nt, Leptospira interrogans serovar lai str. 56601
agaaaggaacuaaguuuaa

SEQ ID NO: 751272 - RNA, 21 nt, Leptospira interrogans serovar lai str. 56601
agaaaggcggagaaauuaauu

SEQ ID NO: 751273 - RNA, 18 nt, Leptospira interrogans serovar lai str. 56601
agaaagcgacuccuauau

SEQ ID NO: 751274 - RNA, 15 nt, Leptospira interrogans serovar lai str. 56601
agaaagaauuucuaa

SEQ ID NO: 751275 - RNA, 17 nt, Leptospira interrogans serovar lai str. 56601
agaaagaauuucuaaaa

SEQ ID NO: 751276 - RNA, 18 nt, Leptospira interrogans serovar lai str. 56601
agaaagaauuuucuaaaa

SEQ ID NO: 751277 - RNA, 13 nt, Leptospira interrogans serovar lai str. 56601
agaaagaauuuaa

SEQ ID NO: 751278 - RNA, 21 nt, Leptospira interrogans serovar lai str. 56601
agaaagcccguucuguugagu

SEQ ID NO: 751279 - RNA, 22 nt, Leptospira interrogans serovar lai str. 56601
agaaagcccguucuguugaguu

SEQ ID NO: 751280 - RNA, 22 nt, Leptospira interrogans serovar lai str. 56601
agaaagcaaacuuuuuauaaaa

SEQ ID NO: 751281 - RNA, 15 nt, Leptospira interrogans serovar lai str. 56601
agaaagcagcaaaga

SEQ ID NO: 751282 - RNA, 16 nt, Leptospira interrogans serovar lai str. 56601
agaaagcagcaaagaa

SEQ ID NO: 751283 - RNA, 17 nt, Leptospira interrogans serovar lai str. 56601
agaaagcagcaaagaag

SEQ ID NO: 751284 - RNA, 17 nt, Leptospira interrogans serovar lai str. 56601
agaaacuuuaaauacuu

SEQ ID NO: 751285 - RNA, 22 nt, Leptospira interrogans serovar lai str. 56601
agaaacuuauacuuuauagaaa

SEQ ID NO: 751286 - RNA, 14 nt, Leptospira interrogans serovar lai str. 56601
agaaaccaguaaua

SEQ ID NO: 751287 - RNA, 15 nt, Leptospira interrogans serovar lai str. 56601
agaaaccauaaaaua

SEQ ID NO: 751288 - RNA, 19 nt, Leptospira interrogans serovar lai str. 56601
agaaaccgaucuuaaaaac

SEQ ID NO: 751289 - RNA, 21 nt, Leptospira interrogans serovar lai str. 56601
agaaaccgaucuuaaaaacuu

SEQ ID NO: 751290 - RNA, 12 nt, Leptospira interrogans serovar lai str. 56601
acuugauuuuac

SEQ ID NO: 751291 - RNA, 23 nt, Leptospira interrogans serovar lai str. 56601
acuugauuuuaccguuuuuaaau

SEQ ID NO: 751292 - RNA, 19 nt, Leptospira interrogans serovar lai str. 56601
acuugauauuucuggaaau

SEQ ID NO: 751293 - RNA, 21 nt, Leptospira interrogans serovar lai str. 56601
acuuuuuaaacgaucagaaaa

SEQ ID NO: 751294 - RNA, 16 nt, Leptospira interrogans serovar lai str. 56601
agaaaaaugaauuccu

SEQ ID NO: 751295 - RNA, 14 nt, Leptospira interrogans serovar lai str. 56601
agaaaaagugaauu

SEQ ID NO: 751296 - RNA, 11 nt, Leptospira interrogans serovar lai str. 56601
agaaaaagcac

SEQ ID NO: 751297 - RNA, 13 nt, Leptospira interrogans serovar lai str. 56601
agaaaaagcacaa

SEQ ID NO: 751298 - RNA, 14 nt, Leptospira interrogans serovar lai str. 56601
agaaaauaaaaaau

SEQ ID NO: 751299 - RNA, 16 nt, Leptospira interrogans serovar lai str. 56601
agaaaaguguuuuuca

SEQ ID NO: 751300 - RNA, 15 nt, Leptospira interrogans serovar lai str. 56601
agaaaauaauaauau

SEQ ID NO: 751301 - RNA, 16 nt, Leptospira interrogans serovar lai str. 56601
agaaaauaauaauauu

SEQ ID NO: 751302 - RNA, 20 nt, Leptospira interrogans serovar lai str. 56601
agaaaagguguggauaccuu

SEQ ID NO: 751303 - RNA, 18 nt, Leptospira interrogans serovar lai str. 56601
agaaacaguauauuauaa

SEQ ID NO: 751304 - RNA, 18 nt, Leptospira interrogans serovar lai str. 56601
agaaaacucaaaucuaca

SEQ ID NO: 751305 - RNA, 22 nt, Leptospira interrogans serovar lai str. 56601
agaaaacucaaaucuacaaaac

SEQ ID NO: 751306 - RNA, 19 nt, Leptospira interrogans serovar lai str. 56601
agaaaaccuaaaauagauc

SEQ ID NO: 751307 - RNA, 17 nt, Leptospira interrogans serovar lai str. 56601
agaaaacgagaaagaau

SEQ ID NO: 751308 - RNA, 13 nt, Leptospira interrogans serovar lai str. 56601
agaaaaccaaaua

SEQ ID NO: 751309 - RNA, 16 nt, Leptospira interrogans serovar lai str. 56601
agaaaaccacccccac

SEQ ID NO: 751310 - RNA, 20 nt, Leptospira interrogans serovar lai str. 56601
agaaaacagaauguauuaaa

SEQ ID NO: 751311 - RNA, 14 nt, Leptospira interrogans serovar lai str. 56601
aggaacuuuuauaa

SEQ ID NO: 751312 - RNA, 22 nt, Leptospira interrogans serovar lai str. 56601
aggaacugcuuccaaaaaaagu

SEQ ID NO: 751313 - RNA, 21 nt, Leptospira interrogans serovar lai str. 56601
aggaacucuuacuuugagaaa

SEQ ID NO: 751314 - RNA, 20 nt, Leptospira interrogans serovar lai str. 56601
aggaacucauacuucuaaaa

SEQ ID NO: 751315 - RNA, 20 nt, Leptospira interrogans serovar lai str. 56601
aggaacuacuacuuuuagaa

SEQ ID NO: 751316 - RNA, 15 nt, Leptospira interrogans serovar lai str. 56601
aggaacuacugcauu

SEQ ID NO: 751317 - RNA, 18 nt, Leptospira interrogans serovar lai str. 56601
aggaaccaucaccaaccc

SEQ ID NO: 751318 - RNA, 20 nt, Leptospira interrogans serovar lai str. 56601
aggaacccauacaaaauuua

SEQ ID NO: 751319 - RNA, 18 nt, Leptospira interrogans serovar lai str. 56601
aggaaaugaaaaagaauu

SEQ ID NO: 751320 - RNA, 20 nt, Leptospira interrogans serovar lai str. 56601
aggaaauucuaugucgaaau

SEQ ID NO: 751321 - RNA, 13 nt, Leptospira interrogans serovar lai str. 56601
aggaaauacaaaa

SEQ ID NO: 751322 - RNA, 16 nt, Leptospira interrogans serovar lai str. 56601
aggaaauacaaaaaga

SEQ ID NO: 751323 - RNA, 18 nt, Leptospira interrogans serovar lai str. 56601
agcuuuuaguuguacaaa

SEQ ID NO: 751324 - RNA, 23 nt, Leptospira interrogans serovar lai str. 56601
agcuuuuaguuguacaaaaaugu

SEQ ID NO: 751325 - RNA, 14 nt, Leptospira interrogans serovar lai str. 56601
aggaauuuuuaaaa

SEQ ID NO: 751326 - RNA, 15 nt, Leptospira interrogans serovar lai str. 56601
aggaauuuuuaaaaa

SEQ ID NO: 751327 - RNA, 17 nt, Leptospira interrogans serovar lai str. 56601
aggaauuuuuaaaaaga

SEQ ID NO: 751328 - RNA, 23 nt, Leptospira interrogans serovar lai str. 56601
aggaauucauacuuuuaaaaagu

SEQ ID NO: 751329 - RNA, 17 nt, Leptospira interrogans serovar lai str. 56601
aggaaguguuugcugag

SEQ ID NO: 751330 - RNA, 17 nt, Leptospira interrogans serovar lai str. 56601
aggaagugaaauugagu

SEQ ID NO: 751331 - RNA, 23 nt, Leptospira interrogans serovar lai str. 56601
agcuuauacuuuaagaaaauuua

SEQ ID NO: 751332 - RNA, 16 nt, Leptospira interrogans serovar lai str. 56601
agcugcauaauagauu

SEQ ID NO: 751333 - RNA, 15 nt, Leptospira interrogans serovar lai str. 56601
aggcgauuuuacaaa

SEQ ID NO: 751334 - RNA, 14 nt, Leptospira interrogans serovar lai str. 56601
aggcgcggaaaaau

SEQ ID NO: 751335 - RNA, 16 nt, Leptospira interrogans serovar lai str. 56601
aggauuuuagaaucaa

SEQ ID NO: 751336 - RNA, 19 nt, Leptospira interrogans serovar lai str. 56601
aggauuuuagaaucaaaau

SEQ ID NO: 751337 - RNA, 13 nt, Leptospira interrogans serovar lai str. 56601
aggcaaaagacuc

SEQ ID NO: 751338 - RNA, 17 nt, Leptospira interrogans serovar lai str. 56601
aggcacauuuuucaagu

SEQ ID NO: 751339 - RNA, 12 nt, Leptospira interrogans serovar lai str. 56601
aggauuccauuu

SEQ ID NO: 751340 - RNA, 22 nt, Leptospira interrogans serovar lai str. 56601
aggauuccuuuccgauuucuuu

SEQ ID NO: 751341 - RNA, 16 nt, Leptospira interrogans serovar lai str. 56601
aggagcucaucauucu

SEQ ID NO: 751342 - RNA, 18 nt, Leptospira interrogans serovar lai str. 56601
aggagcucaucauucuga

SEQ ID NO: 751343 - RNA, 18 nt, Leptospira interrogans serovar lai str. 56601
aggucuacguccguuccc

SEQ ID NO: 751344 - RNA, 13 nt, Leptospira interrogans serovar lai str. 56601
aggucucaacaac

SEQ ID NO: 751345 - RNA, 17 nt, Leptospira interrogans serovar lai str. 56601
aggucccacaaucaaga

SEQ ID NO: 751346 - RNA, 23 nt, Leptospira interrogans serovar lai str. 56601
aggucauuuuucaaauaaagaaa

SEQ ID NO: 751347 - RNA, 17 nt, Leptospira interrogans serovar lai str. 56601
agguauaaaauaaaaau

SEQ ID NO: 751348 - RNA, 15 nt, Leptospira interrogans serovar lai str. 56601
agggguuuuuccuuu

SEQ ID NO: 751349 - RNA, 14 nt, Leptospira interrogans serovar lai str. 56601
agggaauuugaauu

SEQ ID NO: 751350 - RNA, 21 nt, Leptospira interrogans serovar lai str. 56601
agggaauucccacauuuucaa

SEQ ID NO: 751351 - RNA, 18 nt, Leptospira interrogans serovar lai str. 56601
agggagaauaucuacuuu

SEQ ID NO: 751352 - RNA, 20 nt, Leptospira interrogans serovar lai str. 56601
agggaguuuguaaagguaga

SEQ ID NO: 751353 - RNA, 14 nt, Leptospira interrogans serovar lai str. 56601
agggaaaguuauuu

SEQ ID NO: 751354 - RNA, 15 nt, Leptospira interrogans serovar lai str. 56601
agggaaaguuuuuua

SEQ ID NO: 751355 - RNA, 18 nt, Leptospira interrogans serovar lai str. 56601
agggaaaguuuuuuaaaa

SEQ ID NO: 751356 - RNA, 19 nt, Leptospira interrogans serovar lai str. 56601
agggaaaacucaacacaac

SEQ ID NO: 751357 - RNA, 20 nt, Leptospira interrogans serovar lai str. 56601
aggcuuguuugaauuuuucg

SEQ ID NO: 751358 - RNA, 13 nt, Leptospira interrogans serovar lai str. 56601
aguauuauaaaca

SEQ ID NO: 751359 - RNA, 17 nt, Leptospira interrogans serovar lai str. 56601
aguauuauaaauuuuga

SEQ ID NO: 751360 - RNA, 17 nt, Leptospira interrogans serovar lai str. 56601
aguauuaauuuaaucaa

SEQ ID NO: 751361 - RNA, 20 nt, Leptospira interrogans serovar lai str. 56601
aguauuaauuuaaucaaaau

SEQ ID NO: 751362 - RNA, 15 nt, Leptospira interrogans serovar lai str. 56601
aguauguuuuucuaa

SEQ ID NO: 751363 - RNA, 13 nt, Leptospira interrogans serovar lai str. 56601
aguaugauuuuac

SEQ ID NO: 751364 - RNA, 22 nt, Leptospira interrogans serovar lai str. 56601
aguaugauuuuaccgauaaguc

SEQ ID NO: 751365 - RNA, 17 nt, Leptospira interrogans serovar lai str. 56601
aguauuuguaaaaauga

SEQ ID NO: 751366 - RNA, 18 nt, Leptospira interrogans serovar lai str. 56601
aguauuguuaagauaaau

SEQ ID NO: 751367 - RNA, 15 nt, Leptospira interrogans serovar lai str. 56601
aguauucaauuuuua

SEQ ID NO: 751368 - RNA, 11 nt, Leptospira interrogans serovar lai str. 56601
aguauucuuuc

SEQ ID NO: 751369 - RNA, 17 nt, Leptospira interrogans serovar lai str. 56601
aguauaagucgaucuac

SEQ ID NO: 751370 - RNA, 14 nt, Leptospira interrogans serovar lai str. 56601
aguauaauuuaaaa

SEQ ID NO: 751371 - RNA, 15 nt, Leptospira interrogans serovar lai str. 56601
aguauauuaacuuuc

SEQ ID NO: 751372 - RNA, 14 nt, Leptospira interrogans serovar lai str. 56601
aguaucguuuucca

SEQ ID NO: 751373 - RNA, 14 nt, Leptospira interrogans serovar lai str. 56601
aguaucuaaaaguu

SEQ ID NO: 751374 - RNA, 13 nt, Leptospira interrogans serovar lai str. 56601
aguagauuccuac

SEQ ID NO: 751375 - RNA, 21 nt, Leptospira interrogans serovar lai str. 56601
aguagauuccuacauuauuuu

SEQ ID NO: 751376 - RNA, 18 nt, Leptospira interrogans serovar lai str. 56601
aguaccauaaauuuuuau

SEQ ID NO: 751377 - RNA, 17 nt, Leptospira interrogans serovar lai str. 56601
aguagucauauaaaagu

SEQ ID NO: 751378 - RNA, 15 nt, Leptospira interrogans serovar lai str. 56601
aguaguaguucccac

SEQ ID NO: 751379 - RNA, 19 nt, Leptospira interrogans serovar lai str. 56601
aguaguucucacauuuaag

SEQ ID NO: 751380 - RNA, 16 nt, Leptospira interrogans serovar lai str. 56601
aguaguucccacaaau

SEQ ID NO: 751381 - RNA, 14 nt, Leptospira interrogans serovar lai str. 56601
aguaguucccacag

SEQ ID NO: 751382 - RNA, 23 nt, Leptospira interrogans serovar lai str. 56601
aguaguuccuacauuuuaaaaau

SEQ ID NO: 751383 - RNA, 16 nt, Leptospira interrogans serovar lai str. 56601
aguaguagaaaaugug

SEQ ID NO: 751384 - RNA, 21 nt, Leptospira interrogans serovar lai str. 56601
aguaguaaaaucuucaaguuu

SEQ ID NO: 751385 - RNA, 16 nt, Leptospira interrogans serovar lai str. 56601
aguaguaaauaaaaaa

SEQ ID NO: 751386 - RNA, 17 nt, Leptospira interrogans serovar lai str. 56601
aguaggugguugggaac

SEQ ID NO: 751387 - RNA, 23 nt, Leptospira interrogans serovar lai str. 56601
aguaggugguugggaacaauccg

SEQ ID NO: 751388 - RNA, 16 nt, Leptospira interrogans serovar lai str. 56601
agguugagcaguaaaa

SEQ ID NO: 751389 - RNA, 19 nt, Leptospira interrogans serovar lai str. 56601
agguugagcaguaaaaucu

SEQ ID NO: 751390 - RNA, 22 nt, Leptospira interrogans serovar lai str. 56601
aguaaaaucuucaaguuuguga

SEQ ID NO: 751391 - RNA, 23 nt, Leptospira interrogans serovar lai str. 56601
aguaaaaucuuuaaguuugugag

SEQ ID NO: 751392 - RNA, 14 nt, Leptospira interrogans serovar lai str. 56601
aguaaaauuaaaag

SEQ ID NO: 751393 - RNA, 18 nt, Leptospira interrogans serovar lai str. 56601
aguaaaauuuaaaauucu

SEQ ID NO: 751394 - RNA, 15 nt, Leptospira interrogans serovar lai str. 56601
aguaaaaucuaaauu

SEQ ID NO: 751395 - RNA, 16 nt, Leptospira interrogans serovar lai str. 56601
aguaaaacgcucucua

SEQ ID NO: 751396 - RNA, 18 nt, Leptospira interrogans serovar lai str. 56601
aguaaaacgcucucuacg

SEQ ID NO: 751397 - RNA, 13 nt, Leptospira interrogans serovar lai str. 56601
aguaaaacuguuu

SEQ ID NO: 751398 - RNA, 14 nt, Leptospira interrogans serovar lai str. 56601
aguaaaacuuuggu

SEQ ID NO: 751399 - RNA, 19 nt, Leptospira interrogans serovar lai str. 56601
aguaaaacuuugguuugua

SEQ ID NO: 751400 - RNA, 15 nt, Leptospira interrogans serovar lai str. 56601
aguaaaacuuuuaaa

SEQ ID NO: 751401 - RNA, 16 nt, Leptospira interrogans serovar lai str. 56601
aguaaaacuuuuaaag

SEQ ID NO: 751402 - RNA, 17 nt, Leptospira interrogans serovar lai str. 56601
aguaaaacuuuuaaaga

SEQ ID NO: 751403 - RNA, 13 nt, Leptospira interrogans serovar lai str. 56601
aguaaaagaaaau

SEQ ID NO: 751404 - RNA, 13 nt, Leptospira interrogans serovar lai str. 56601
aguaaaaauggau

SEQ ID NO: 751405 - RNA, 21 nt, Leptospira interrogans serovar lai str. 56601
aguaauucuaaagccauuuag

SEQ ID NO: 751406 - RNA, 16 nt, Leptospira interrogans serovar lai str. 56601
aguaaucguuuaaaga

SEQ ID NO: 751407 - RNA, 18 nt, Leptospira interrogans serovar lai str. 56601
aguaaucguuuaaagauu

SEQ ID NO: 751408 - RNA, 17 nt, Leptospira interrogans serovar lai str. 56601
aguaauaugauuaugug

SEQ ID NO: 751409 - RNA, 16 nt, Leptospira interrogans serovar lai str. 56601
aguaauccauuuuucc

SEQ ID NO: 751410 - RNA, 14 nt, Leptospira interrogans serovar lai str. 56601
aguaauuuaaaaaa

SEQ ID NO: 751411 - RNA, 15 nt, Leptospira interrogans serovar lai str. 56601
aguaauuuaaaaaaa

SEQ ID NO: 751412 - RNA, 16 nt, Leptospira interrogans serovar lai str. 56601
aguaauuuaaaaaaau

SEQ ID NO: 751413 - RNA, 18 nt, Leptospira interrogans serovar lai str. 56601
aguaauuuaauauauuaa

SEQ ID NO: 751414 - RNA, 20 nt, Leptospira interrogans serovar lai str. 56601
aguaaacuauugcagauaag

SEQ ID NO: 751415 - RNA, 14 nt, Leptospira interrogans serovar lai str. 56601
aguaaagauggauc

SEQ ID NO: 751416 - RNA, 22 nt, Leptospira interrogans serovar lai str. 56601
aguaaagguuucacaaauuuua

SEQ ID NO: 751417 - RNA, 22 nt, Leptospira interrogans serovar lai str. 56601
agucaaauuuggaaauugugag

SEQ ID NO: 751418 - RNA, 15 nt, Leptospira interrogans serovar lai str. 56601
agucaaaaggcggga

SEQ ID NO: 751419 - RNA, 18 nt, Leptospira interrogans serovar lai str. 56601
aguauuuugcacugaaau

SEQ ID NO: 751420 - RNA, 14 nt, Leptospira interrogans serovar lai str. 56601
aguauuuucuagau

SEQ ID NO: 751421 - RNA, 23 nt, Leptospira interrogans serovar lai str. 56601
aguauuuuccguaccccaaagau

SEQ ID NO: 751422 - RNA, 21 nt, Leptospira interrogans serovar lai str. 56601
aguauuuuauuauauaaccau

SEQ ID NO: 751423 - RNA, 23 nt, Leptospira interrogans serovar lai str. 56601
agucuccauuaggugcuacugca

SEQ ID NO: 751424 - RNA, 13 nt, Leptospira interrogans serovar lai str. 56601
agucuuuaaaaaa

SEQ ID NO: 751425 - RNA, 15 nt, Leptospira interrogans serovar lai str. 56601
agucucuguuuucau

SEQ ID NO: 751426 - RNA, 15 nt, Leptospira interrogans serovar lai str. 56601
agucugaaauaaauu

SEQ ID NO: 751427 - RNA, 18 nt, Leptospira interrogans serovar lai str. 56601
agucuuuuguuuaaaauu

SEQ ID NO: 751428 - RNA, 15 nt, Leptospira interrogans serovar lai str. 56601
agucuuuuuugacuu

SEQ ID NO: 751429 - RNA, 23 nt, Leptospira interrogans serovar lai str. 56601
agugaagauuuguaaaauugcuu

SEQ ID NO: 751430 - RNA, 13 nt, Leptospira interrogans serovar lai str. 56601
agugccaaaauuu

SEQ ID NO: 751431 - RNA, 20 nt, Leptospira interrogans serovar lai str. 56601
agugcauucgcugaguuuuc

SEQ ID NO: 751432 - RNA, 14 nt, Leptospira interrogans serovar lai str. 56601
agugccauuuuucu

SEQ ID NO: 751433 - RNA, 16 nt, Leptospira interrogans serovar lai str. 56601
agugccauuuuucuuc

SEQ ID NO: 751434 - RNA, 16 nt, Leptospira interrogans serovar lai str. 56601
agugauucgaaauuuu

SEQ ID NO: 751435 - RNA, 17 nt, Leptospira interrogans serovar lai str. 56601
agugaugaagagaaagu

SEQ ID NO: 751436 - RNA, 22 nt, Leptospira interrogans serovar lai str. 56601
agugaucgcguuuaaaccuucu

SEQ ID NO: 751437 - RNA, 15 nt, Leptospira interrogans serovar lai str. 56601
agugaauuaaaagaa

SEQ ID NO: 751438 - RNA, 17 nt, Leptospira interrogans serovar lai str. 56601
agugaauuaaaagaaac

SEQ ID NO: 751439 - RNA, 12 nt, Leptospira interrogans serovar lai str. 56601
agugaauaaaau

SEQ ID NO: 751440 - RNA, 22 nt, Leptospira interrogans serovar lai str. 56601
aguggauugccauccacaaagg

SEQ ID NO: 751441 - RNA, 20 nt, Leptospira interrogans serovar lai str. 56601
aguggauuuaucaguuaaac

SEQ ID NO: 751442 - RNA, 21 nt, Leptospira interrogans serovar lai str. 56601
aguuugagagagaguucuacu

SEQ ID NO: 751443 - RNA, 22 nt, Leptospira interrogans serovar lai str. 56601
aguuugaguuucuuuuugauua

SEQ ID NO: 751444 - RNA, 17 nt, Leptospira interrogans serovar lai str. 56601
aguuucuugaacucaau

SEQ ID NO: 751445 - RNA, 14 nt, Leptospira interrogans serovar lai str. 56601
aguuucuuuaaagu

SEQ ID NO: 751446 - RNA, 22 nt, Leptospira interrogans serovar lai str. 56601
aguuugaaagagcguucugcua

SEQ ID NO: 751447 - RNA, 21 nt, Leptospira interrogans serovar lai str. 56601
aguuuuacaaauuaguauuuu

SEQ ID NO: 751448 - RNA, 21 nt, Leptospira interrogans serovar lai str. 56601
aguuuuacagaagauuuuguc

SEQ ID NO: 751449 - RNA, 16 nt, Leptospira interrogans serovar lai str. 56601
aguuuguuccaaaaac

SEQ ID NO: 751450 - RNA, 21 nt, Leptospira interrogans serovar lai str. 56601
aguuuguuccaaaaccucaaa

SEQ ID NO: 751451 - RNA, 19 nt, Leptospira interrogans serovar lai str. 56601
aguuuguuagagugccgca

SEQ ID NO: 751452 - RNA, 18 nt, Leptospira interrogans serovar lai str. 56601
aguuugugagaguuccca

SEQ ID NO: 751453 - RNA, 14 nt, Leptospira interrogans serovar lai str. 56601
aguuuguagauaaa

SEQ ID NO: 751454 - RNA, 15 nt, Leptospira interrogans serovar lai str. 56601
aguuuguagauaaag

SEQ ID NO: 751455 - RNA, 12 nt, Leptospira interrogans serovar lai str. 56601
aguuucuaaaaa

SEQ ID NO: 751456 - RNA, 15 nt, Leptospira interrogans serovar lai str. 56601
aguuucucauuuuau

SEQ ID NO: 751457 - RNA, 20 nt, Leptospira interrogans serovar lai str. 56601
aguuucuacauuuuugugaa

SEQ ID NO: 751458 - RNA, 18 nt, Leptospira interrogans serovar lai str. 56601
aguuucaaacacaaucug

SEQ ID NO: 751459 - RNA, 15 nt, Leptospira interrogans serovar lai str. 56601
aguuucaauuuaaaa

SEQ ID NO: 751460 - RNA, 13 nt, Leptospira interrogans serovar lai str. 56601
aguuucaucuuug

SEQ ID NO: 751461 - RNA, 16 nt, Leptospira interrogans serovar lai str. 56601
aguuguauccccauaa

SEQ ID NO: 751462 - RNA, 23 nt, Leptospira interrogans serovar lai str. 56601
aguuguuauaaaccaauaaccaa

SEQ ID NO: 751463 - RNA, 23 nt, Leptospira interrogans serovar lai str. 56601
aguuguuaaaaguggagauuagc

SEQ ID NO: 751464 - RNA, 19 nt, Leptospira interrogans serovar lai str. 56601
aguuguugaaaaauuuuau

SEQ ID NO: 751465 - RNA, 11 nt, Leptospira interrogans serovar lai str. 56601
aguuuaaaaac

SEQ ID NO: 751466 - RNA, 15 nt, Leptospira interrogans serovar lai str. 56601
aguuuaauugugaaa

SEQ ID NO: 751467 - RNA, 17 nt, Leptospira interrogans serovar lai str. 56601
aguuuaagaaacucagu

SEQ ID NO: 751468 - RNA, 18 nt, Leptospira interrogans serovar lai str. 56601
aguuuacaucaaaaacaa

SEQ ID NO: 751469 - RNA, 14 nt, Leptospira interrogans serovar lai str. 56601
aguuuauaaagcaa

SEQ ID NO: 751470 - RNA, 22 nt, Leptospira interrogans serovar lai str. 56601
aguuuagaacugagagaaagua

SEQ ID NO: 751471 - RNA, 21 nt, Leptospira interrogans serovar lai str. 56601
aguuucaaacgcgaucuaucg

SEQ ID NO: 751472 - RNA, 22 nt, Leptospira interrogans serovar lai str. 56601
aguuucaaacgcgaucuaucga

SEQ ID NO: 751473 - RNA, 13 nt, Leptospira interrogans serovar lai str. 56601
aguuuauuuuucu

SEQ ID NO: 751474 - RNA, 21 nt, Leptospira interrogans serovar lai str. 56601
aguuuauuuuaaaaaaauuuu

SEQ ID NO: 751475 - RNA, 23 nt, Leptospira interrogans serovar lai str. 56601
aguuuauuuuaaaaaaauuuuua

SEQ ID NO: 751476 - RNA, 22 nt, Leptospira interrogans serovar lai str. 56601
aguucuauaaacucaaagaauu

SEQ ID NO: 751477 - RNA, 16 nt, Leptospira interrogans serovar lai str. 56601
aguucuaaaucgaauc

SEQ ID NO: 751478 - RNA, 18 nt, Leptospira interrogans serovar lai str. 56601
aguucuaauguuguuaaa

SEQ ID NO: 751479 - RNA, 16 nt, Leptospira interrogans serovar lai str. 56601
aguucgugaagaaauu

SEQ ID NO: 751480 - RNA, 17 nt, Leptospira interrogans serovar lai str. 56601
aguucgguguaaggaau

SEQ ID NO: 751481 - RNA, 16 nt, Leptospira interrogans serovar lai str. 56601
aguucggcguaagaaa

SEQ ID NO: 751482 - RNA, 18 nt, Leptospira interrogans serovar lai str. 56601
aguuccacuuuaaaaaug

SEQ ID NO: 751483 - RNA, 15 nt, Leptospira interrogans serovar lai str. 56601
aguuccaacguacca

SEQ ID NO: 751484 - RNA, 19 nt, Leptospira interrogans serovar lai str. 56601
aguuccaacguaccaaaac

SEQ ID NO: 751485 - RNA, 13 nt, Leptospira interrogans serovar lai str. 56601
aguucauucugau

SEQ ID NO: 751486 - RNA, 16 nt, Leptospira interrogans serovar lai str. 56601
aguucggaagauuuuu

SEQ ID NO: 751487 - RNA, 18 nt, Leptospira interrogans serovar lai str. 56601
aguucggaagauuuuuca

SEQ ID NO: 751488 - RNA, 19 nt, Leptospira interrogans serovar lai str. 56601
aguuccacauuuauuuuua

SEQ ID NO: 751489 - RNA, 18 nt, Leptospira interrogans serovar lai str. 56601
aguucuggguaaaaaaaa

SEQ ID NO: 751490 - RNA, 23 nt, Leptospira interrogans serovar lai str. 56601
aguucuggguaaaaaaaaaugag

SEQ ID NO: 751491 - RNA, 15 nt, Leptospira interrogans serovar lai str. 56601
aguucuuaaauaaaa

SEQ ID NO: 751492 - RNA, 19 nt, Leptospira interrogans serovar lai str. 56601
aguucugaaaucuuaggac

SEQ ID NO: 751493 - RNA, 17 nt, Leptospira interrogans serovar lai str. 56601
aguucucacauuuaagg

SEQ ID NO: 751494 - RNA, 21 nt, Leptospira interrogans serovar lai str. 56601
aguucuaaccggaauuuccaa

SEQ ID NO: 751495 - RNA, 17 nt, Leptospira interrogans serovar lai str. 56601
aguugcaaagaagaaau

SEQ ID NO: 751496 - RNA, 22 nt, Leptospira interrogans serovar lai str. 56601
aguugauuucagaucauaaagg

SEQ ID NO: 751497 - RNA, 15 nt, Leptospira interrogans serovar lai str. 56601
aguugauucuuccua

SEQ ID NO: 751498 - RNA, 23 nt, Leptospira interrogans serovar lai str. 56601
aguucuucggcguugaguuuuug

SEQ ID NO: 751499 - RNA, 20 nt, Leptospira interrogans serovar lai str. 56601
aguucacuucuugaaaggug

SEQ ID NO: 751500 - RNA, 15 nt, Leptospira interrogans serovar lai str. 56601
aguuauucuaugaaa

SEQ ID NO: 751501 - RNA, 22 nt, Leptospira interrogans serovar lai str. 56601
aguuauuauuuuuguuaaacaa

SEQ ID NO: 751502 - RNA, 13 nt, Leptospira interrogans serovar lai str. 56601
aguuagaauauac

SEQ ID NO: 751503 - RNA, 20 nt, Leptospira interrogans serovar lai str. 56601
aguuaugaauaaaaaauuuc

SEQ ID NO: 751504 - RNA, 21 nt, Leptospira interrogans serovar lai str. 56601
aguuaugaauaaaaaauuucu

SEQ ID NO: 751505 - RNA, 17 nt, Leptospira interrogans serovar lai str. 56601
aguuaugacccaagauu

SEQ ID NO: 751506 - RNA, 19 nt, Leptospira interrogans serovar lai str. 56601
aguuauuaauuauauucuu

SEQ ID NO: 751507 - RNA, 15 nt, Leptospira interrogans serovar lai str. 56601
aguuacauuaugaau

SEQ ID NO: 751508 - RNA, 20 nt, Leptospira interrogans serovar lai str. 56601
aguuacauuaugaauuuuua

SEQ ID NO: 751509 - RNA, 15 nt, Leptospira interrogans serovar lai str. 56601
aguuacaauuuauua

SEQ ID NO: 751510 - RNA, 17 nt, Leptospira interrogans serovar lai str. 56601
aguuaauuuucgauuua

SEQ ID NO: 751511 - RNA, 19 nt, Leptospira interrogans serovar lai str. 56601
aguuaccuagaggagccau

SEQ ID NO: 751512 - RNA, 21 nt, Leptospira interrogans serovar lai str. 56601
aguuacuuauuuuugaaaaga

SEQ ID NO: 751513 - RNA, 19 nt, Leptospira interrogans serovar lai str. 56601
auacaaaguaaguucaaau

SEQ ID NO: 751514 - RNA, 14 nt, Leptospira interrogans serovar lai str. 56601
auacaaaguuuaua

SEQ ID NO: 751515 - RNA, 15 nt, Leptospira interrogans serovar lai str. 56601
auacaacuuucagau

SEQ ID NO: 751516 - RNA, 24 nt, Leptospira interrogans serovar lai str. 56601
auacaacuuucagauuaaaaccgu

SEQ ID NO: 751517 - RNA, 15 nt, Leptospira interrogans serovar lai str. 56601
auacaacuuuuuuaa

SEQ ID NO: 751518 - RNA, 15 nt, Leptospira interrogans serovar lai str. 56601
auacaagacuucuau

SEQ ID NO: 751519 - RNA, 19 nt, Leptospira interrogans serovar lai str. 56601
auacaaucaaauuuuugca

SEQ ID NO: 751520 - RNA, 14 nt, Leptospira interrogans serovar lai str. 56601
auacaaugaaaaag

SEQ ID NO: 751521 - RNA, 11 nt, Leptospira interrogans serovar lai str. 56601
auacacucuuu

SEQ ID NO: 751522 - RNA, 15 nt, Leptospira interrogans serovar lai str. 56601
auaauuuaguuuuug

SEQ ID NO: 751523 - RNA, 17 nt, Leptospira interrogans serovar lai str. 56601
auaauucuguaaaauaa

SEQ ID NO: 751524 - RNA, 19 nt, Leptospira interrogans serovar lai str. 56601
auaauucuguaaaauaaau

SEQ ID NO: 751525 - RNA, 18 nt, Leptospira interrogans serovar lai str. 56601
auaauucuuuaaaauuuu

SEQ ID NO: 751526 - RNA, 21 nt, Leptospira interrogans serovar lai str. 56601
auaauucuuuaaaauuuuuaa

SEQ ID NO: 751527 - RNA, 17 nt, Leptospira interrogans serovar lai str. 56601
auaauucuuuagaaauu

SEQ ID NO: 751528 - RNA, 19 nt, Leptospira interrogans serovar lai str. 56601
auaauucuuuagaaauuuu

SEQ ID NO: 751529 - RNA, 14 nt, Leptospira interrogans serovar lai str. 56601
auaauugaacauuu

SEQ ID NO: 751530 - RNA, 17 nt, Leptospira interrogans serovar lai str. 56601
auaauugaacauuuuua

SEQ ID NO: 751531 - RNA, 19 nt, Leptospira interrogans serovar lai str. 56601
auaauugaacauuuuuaaa

SEQ ID NO: 751532 - RNA, 21 nt, Leptospira interrogans serovar lai str. 56601
auaauuucuaguuugaauuua

SEQ ID NO: 751533 - RNA, 16 nt, Leptospira interrogans serovar lai str. 56601
auaauuucccauaaaa

SEQ ID NO: 751534 - RNA, 18 nt, Leptospira interrogans serovar lai str. 56601
auaauuucccauaaaaag

SEQ ID NO: 751535 - RNA, 19 nt, Leptospira interrogans serovar lai str. 56601
auaauuucccauaaaaaga

SEQ ID NO: 751536 - RNA, 20 nt, Leptospira interrogans serovar lai str. 56601
auaauuuuagaauauuauga

SEQ ID NO: 751537 - RNA, 12 nt, Leptospira interrogans serovar lai str. 56601
auaauuuuauaa

SEQ ID NO: 751538 - RNA, 16 nt, Leptospira interrogans serovar lai str. 56601
auaauuuuauaauauu

SEQ ID NO: 751539 - RNA, 16 nt, Leptospira interrogans serovar lai str. 56601
auaauuuuaaauaaua

SEQ ID NO: 751540 - RNA, 17 nt, Leptospira interrogans serovar lai str. 56601
auaauuuuaaauaauaa

SEQ ID NO: 751541 - RNA, 20 nt, Leptospira interrogans serovar lai str. 56601
auaauuuuuacucaaagaau

SEQ ID NO: 751542 - RNA, 16 nt, Leptospira interrogans serovar lai str. 56601
auaauuuuuagaaauu

SEQ ID NO: 751543 - RNA, 21 nt, Leptospira interrogans serovar lai str. 56601
auaauuuucuuaauaaacuuu

SEQ ID NO: 751544 - RNA, 23 nt, Leptospira interrogans serovar lai str. 56601
auacaaaacuuaaauucggaaau

SEQ ID NO: 751545 - RNA, 18 nt, Leptospira interrogans serovar lai str. 56601
auacaaaagaaucaucau

SEQ ID NO: 751546 - RNA, 14 nt, Leptospira interrogans serovar lai str. 56601
auaauuuuuguuug

SEQ ID NO: 751547 - RNA, 19 nt, Leptospira interrogans serovar lai str. 56601
auaauuuuuguuuguaaaa

SEQ ID NO: 751548 - RNA, 17 nt, Leptospira interrogans serovar lai str. 56601
auaauuuuuuaaaaaaa

SEQ ID NO: 751549 - RNA, 19 nt, Leptospira interrogans serovar lai str. 56601
auaauuuuuuaaaaaaauu

SEQ ID NO: 751550 - RNA, 13 nt, Leptospira interrogans serovar lai str. 56601
auacaaaaaaugu

SEQ ID NO: 751551 - RNA, 13 nt, Leptospira interrogans serovar lai str. 56601
auacaaaaagaau

SEQ ID NO: 751552 - RNA, 22 nt, Leptospira interrogans serovar lai str. 56601
auaauaauuuuagaauauuaug

SEQ ID NO: 751553 - RNA, 13 nt, Leptospira interrogans serovar lai str. 56601
auaauaaaauuaa

SEQ ID NO: 751554 - RNA, 14 nt, Leptospira interrogans serovar lai str. 56601
auaauaaaauuauu

SEQ ID NO: 751555 - RNA, 19 nt, Leptospira interrogans serovar lai str. 56601
auaauaaaauuauuaacua

SEQ ID NO: 751556 - RNA, 15 nt, Leptospira interrogans serovar lai str. 56601
auaauaaaguaccua

SEQ ID NO: 751557 - RNA, 13 nt, Leptospira interrogans serovar lai str. 56601
auaauaaaguacu

SEQ ID NO: 751558 - RNA, 13 nt, Leptospira interrogans serovar lai str. 56601
auaauaaauugaa

SEQ ID NO: 751559 - RNA, 14 nt, Leptospira interrogans serovar lai str. 56601
auaauaacaaaaaa

SEQ ID NO: 751560 - RNA, 16 nt, Leptospira interrogans serovar lai str. 56601
auaaguuccuuaaaag

SEQ ID NO: 751561 - RNA, 20 nt, Leptospira interrogans serovar lai str. 56601
auaaguucgguguaaaaaau

SEQ ID NO: 751562 - RNA, 21 nt, Leptospira interrogans serovar lai str. 56601
auaaguucgucugagaaaaac

SEQ ID NO: 751563 - RNA, 16 nt, Leptospira interrogans serovar lai str. 56601
auaaguuguuauaaac

SEQ ID NO: 751564 - RNA, 19 nt, Leptospira interrogans serovar lai str. 56601
auaaguuguuauaaaccaa

SEQ ID NO: 751565 - RNA, 17 nt, Leptospira interrogans serovar lai str. 56601
auaaguuuacaucaacu

SEQ ID NO: 751566 - RNA, 13 nt, Leptospira interrogans serovar lai str. 56601
auaaguuaaauuu

SEQ ID NO: 751567 - RNA, 16 nt, Leptospira interrogans serovar lai str. 56601
auaaguuaagugaaaa

SEQ ID NO: 751568 - RNA, 21 nt, Leptospira interrogans serovar lai str. 56601
auaaguuaagugaaaauuaca

SEQ ID NO: 751569 - RNA, 15 nt, Leptospira interrogans serovar lai str. 56601
auaaguguaugaaaa

SEQ ID NO: 751570 - RNA, 22 nt, Leptospira interrogans serovar lai str. 56601
auaagucgaucuacuaaaucag

SEQ ID NO: 751571 - RNA, 19 nt, Leptospira interrogans serovar lai str. 56601
auaagucuaacgugagcuc

SEQ ID NO: 751572 - RNA, 17 nt, Leptospira interrogans serovar lai str. 56601
auaacuuacugauuucu

SEQ ID NO: 751573 - RNA, 22 nt, Leptospira interrogans serovar lai str. 56601
auaaucgaacccagucuucuug

SEQ ID NO: 751574 - RNA, 17 nt, Leptospira interrogans serovar lai str. 56601
auaaucgaauuuccauu

SEQ ID NO: 751575 - RNA, 13 nt, Leptospira interrogans serovar lai str. 56601
auaaucuuaacuu

SEQ ID NO: 751576 - RNA, 16 nt, Leptospira interrogans serovar lai str. 56601
auaaucuguaauaguu

SEQ ID NO: 751577 - RNA, 17 nt, Leptospira interrogans serovar lai str. 56601
auaaugauagaaauauu

SEQ ID NO: 751578 - RNA, 22 nt, Leptospira interrogans serovar lai str. 56601
auaaugaaucguaaaaaaauau

SEQ ID NO: 751579 - RNA, 11 nt, Leptospira interrogans serovar lai str. 56601
auaaugaagac

SEQ ID NO: 751580 - RNA, 21 nt, Leptospira interrogans serovar lai str. 56601
auaacuuagaaucuaucucaa

SEQ ID NO: 751581 - RNA, 20 nt, Leptospira interrogans serovar lai str. 56601
auaacuuagucuuuguuuau

SEQ ID NO: 751582 - RNA, 22 nt, Leptospira interrogans serovar lai str. 56601
auaacggaguuucucauuuuau

SEQ ID NO: 751583 - RNA, 22 nt, Leptospira interrogans serovar lai str. 56601
auaacgugacaaacuaaauuuu

SEQ ID NO: 751584 - RNA, 14 nt, Leptospira interrogans serovar lai str. 56601
auaaccuaaaauuu

SEQ ID NO: 751585 - RNA, 16 nt, Leptospira interrogans serovar lai str. 56601
auaaccguaauuagcu

SEQ ID NO: 751586 - RNA, 22 nt, Leptospira interrogans serovar lai str. 56601
auaaccccuaagcguucuaagu

SEQ ID NO: 751587 - RNA, 19 nt, Leptospira interrogans serovar lai str. 56601
auaaaucuguacuuaaauu

SEQ ID NO: 751588 - RNA, 17 nt, Leptospira interrogans serovar lai str. 56601
auaaauuuuagaauauc

SEQ ID NO: 751589 - RNA, 18 nt, Leptospira interrogans serovar lai str. 56601
auaaauuuuagaauaucu

SEQ ID NO: 751590 - RNA, 23 nt, Leptospira interrogans serovar lai str. 56601
auaaaucguuugcuuuucuauca

SEQ ID NO: 751591 - RNA, 12 nt, Leptospira interrogans serovar lai str. 56601
auaaauuuugug

SEQ ID NO: 751592 - RNA, 16 nt, Leptospira interrogans serovar lai str. 56601
auaaauuuugaaacaa

SEQ ID NO: 751593 - RNA, 17 nt, Leptospira interrogans serovar lai str. 56601
auaaauuuugaaacaaa

SEQ ID NO: 751594 - RNA, 14 nt, Leptospira interrogans serovar lai str. 56601
auaaauuuuuauua

SEQ ID NO: 751595 - RNA, 22 nt, Leptospira interrogans serovar lai str. 56601
auaaauuuuucuggaaaaguuu

SEQ ID NO: 751596 - RNA, 21 nt, Leptospira interrogans serovar lai str. 56601
auaaauccggaaguaauuaca

SEQ ID NO: 751597 - RNA, 17 nt, Leptospira interrogans serovar lai str. 56601
auaaaucgaagagaaga

SEQ ID NO: 751598 - RNA, 17 nt, Leptospira interrogans serovar lai str. 56601
auaaaucgauuacaauu

SEQ ID NO: 751599 - RNA, 16 nt, Leptospira interrogans serovar lai str. 56601
auaaaucgcaaauaca

SEQ ID NO: 751600 - RNA, 20 nt, Leptospira interrogans serovar lai str. 56601
auaacaaccaccuuuacaua

SEQ ID NO: 751601 - RNA, 14 nt, Leptospira interrogans serovar lai str. 56601
auaacaaauaaaag

SEQ ID NO: 751602 - RNA, 13 nt, Leptospira interrogans serovar lai str. 56601
auaacaaaguauu

SEQ ID NO: 751603 - RNA, 14 nt, Leptospira interrogans serovar lai str. 56601
auaacaaaaauacu

SEQ ID NO: 751604 - RNA, 18 nt, Leptospira interrogans serovar lai str. 56601
auaaccaaccccacaagu

SEQ ID NO: 751605 - RNA, 20 nt, Leptospira interrogans serovar lai str. 56601
auaaccaaccccacaaguau

SEQ ID NO: 751606 - RNA, 21 nt, Leptospira interrogans serovar lai str. 56601
auaacagagugcucaauccaa

SEQ ID NO: 751607 - RNA, 20 nt, Leptospira interrogans serovar lai str. 56601
auaacacgauacucaauauu

SEQ ID NO: 751608 - RNA, 12 nt, Leptospira interrogans serovar lai str. 56601
auaaaucaugau

SEQ ID NO: 751609 - RNA, 14 nt, Leptospira interrogans serovar lai str. 56601
auaaaucaugauca

SEQ ID NO: 751610 - RNA, 20 nt, Leptospira interrogans serovar lai str. 56601
auaaaucaugaucaaauuca

SEQ ID NO: 751611 - RNA, 22 nt, Leptospira interrogans serovar lai str. 56601
auaaauagggaauauuccauuu

SEQ ID NO: 751612 - RNA, 22 nt, Leptospira interrogans serovar lai str. 56601
auaaauagggcucgguaaaaag

SEQ ID NO: 751613 - RNA, 16 nt, Leptospira interrogans serovar lai str. 56601
auaaagucguuuuuaa

SEQ ID NO: 751614 - RNA, 20 nt, Leptospira interrogans serovar lai str. 56601
auaaagucuauuucccaaaa

SEQ ID NO: 751615 - RNA, 21 nt, Leptospira interrogans serovar lai str. 56601
auaaagucuauuucccaaaau

SEQ ID NO: 751616 - RNA, 15 nt, Leptospira interrogans serovar lai str. 56601
auaaauaaauuuaaa

SEQ ID NO: 751617 - RNA, 19 nt, Leptospira interrogans serovar lai str. 56601
auaaaguauuuuuaagaua

SEQ ID NO: 751618 - RNA, 22 nt, Leptospira interrogans serovar lai str. 56601
auaaaguauuuuuaagauaaau

SEQ ID NO: 751619 - RNA, 15 nt, Leptospira interrogans serovar lai str. 56601
auaaaguaaaauuaa

SEQ ID NO: 751620 - RNA, 17 nt, Leptospira interrogans serovar lai str. 56601
auaaauacauacaauga

SEQ ID NO: 751621 - RNA, 14 nt, Leptospira interrogans serovar lai str. 56601
auaaauacaaaaau

SEQ ID NO: 751622 - RNA, 15 nt, Leptospira interrogans serovar lai str. 56601
auaaauaaugaaaac

SEQ ID NO: 751623 - RNA, 21 nt, Leptospira interrogans serovar lai str. 56601
auaaaguauagaacaguuugu

SEQ ID NO: 751624 - RNA, 20 nt, Leptospira interrogans serovar lai str. 56601
auaaaggugcaugaaaauaa

SEQ ID NO: 751625 - RNA, 17 nt, Leptospira interrogans serovar lai str. 56601
auaaagcgauucuacuu

SEQ ID NO: 751626 - RNA, 21 nt, Leptospira interrogans serovar lai str. 56601
auaaagauuuccuaauaacuu

SEQ ID NO: 751627 - RNA, 17 nt, Leptospira interrogans serovar lai str. 56601
auaaacgauuauuuuuu

SEQ ID NO: 751628 - RNA, 21 nt, Leptospira interrogans serovar lai str. 56601
auaaacgauuauuuuuuaaaa

SEQ ID NO: 751629 - RNA, 13 nt, Leptospira interrogans serovar lai str. 56601
auaaaccgauuuu

SEQ ID NO: 751630 - RNA, 21 nt, Leptospira interrogans serovar lai str. 56601
auaaaccgauuuucccaaaca

SEQ ID NO: 751631 - RNA, 13 nt, Leptospira interrogans serovar lai str. 56601
auaaaauuuuucu

SEQ ID NO: 751632 - RNA, 18 nt, Leptospira interrogans serovar lai str. 56601
auaaaauuuuuaaaaaau

SEQ ID NO: 751633 - RNA, 22 nt, Leptospira interrogans serovar lai str. 56601
auaaaauuuuuaaaaaauuaau

SEQ ID NO: 751634 - RNA, 14 nt, Leptospira interrogans serovar lai str. 56601
auaaaauuugaaag

SEQ ID NO: 751635 - RNA, 12 nt, Leptospira interrogans serovar lai str. 56601
auaaaauuuuag

SEQ ID NO: 751636 - RNA, 15 nt, Leptospira interrogans serovar lai str. 56601
auaaaauuuuagaua

SEQ ID NO: 751637 - RNA, 14 nt, Leptospira interrogans serovar lai str. 56601
auaaaauuuuauaa

SEQ ID NO: 751638 - RNA, 16 nt, Leptospira interrogans serovar lai str. 56601
auaaacaauaaaauaa

SEQ ID NO: 751639 - RNA, 19 nt, Leptospira interrogans serovar lai str. 56601
auaaacaauaaaauaacua

SEQ ID NO: 751640 - RNA, 19 nt, Leptospira interrogans serovar lai str. 56601
auaaacaauaugaaaggaa

SEQ ID NO: 751641 - RNA, 14 nt, Leptospira interrogans serovar lai str. 56601
auaaaauguaggaa

SEQ ID NO: 751642 - RNA, 12 nt, Leptospira interrogans serovar lai str. 56601
auaaaaugcaau

SEQ ID NO: 751643 - RNA, 13 nt, Leptospira interrogans serovar lai str. 56601
auaaaaugcaaua

SEQ ID NO: 751644 - RNA, 21 nt, Leptospira interrogans serovar lai str. 56601
auaaaauucuccgauuugguu

SEQ ID NO: 751645 - RNA, 12 nt, Leptospira interrogans serovar lai str. 56601
auaaaauugagu

SEQ ID NO: 751646 - RNA, 19 nt, Leptospira interrogans serovar lai str. 56601
auaaaauugaguguuuuua

SEQ ID NO: 751647 - RNA, 17 nt, Leptospira interrogans serovar lai str. 56601
auaaaauuaagcauuau

SEQ ID NO: 751648 - RNA, 20 nt, Leptospira interrogans serovar lai str. 56601
auaaaauuauuaacuaauuu

SEQ ID NO: 751649 - RNA, 14 nt, Leptospira interrogans serovar lai str. 56601
auaaaauucaaaaa

SEQ ID NO: 751650 - RNA, 18 nt, Leptospira interrogans serovar lai str. 56601
auaaaauucuaaucacga

SEQ ID NO: 751651 - RNA, 14 nt, Leptospira interrogans serovar lai str. 56601
aguuuuaugugggu

SEQ ID NO: 751652 - RNA, 21 nt, Leptospira interrogans serovar lai str. 56601
aguuuuauauguauuuauuca

SEQ ID NO: 751653 - RNA, 16 nt, Leptospira interrogans serovar lai str. 56601
aguuuuacuguaaaau

SEQ ID NO: 751654 - RNA, 16 nt, Leptospira interrogans serovar lai str. 56601
aguuuuacuaaaagua

SEQ ID NO: 751655 - RNA, 13 nt, Leptospira interrogans serovar lai str. 56601
aguuuucaaaaau

SEQ ID NO: 751656 - RNA, 16 nt, Leptospira interrogans serovar lai str. 56601
aguuuuauccauaaau

SEQ ID NO: 751657 - RNA, 15 nt, Leptospira interrogans serovar lai str. 56601
aguuuucauuacaaa

SEQ ID NO: 751658 - RNA, 16 nt, Leptospira interrogans serovar lai str. 56601
aguuuucauuacaaaa

SEQ ID NO: 751659 - RNA, 16 nt, Leptospira interrogans serovar lai str. 56601
auaaaaucgauuacuc

SEQ ID NO: 751660 - RNA, 23 nt, Leptospira interrogans serovar lai str. 56601
auaaaauccccaguauuuugcac

SEQ ID NO: 751661 - RNA, 13 nt, Leptospira interrogans serovar lai str. 56601
auaaaaucuaaaa

SEQ ID NO: 751662 - RNA, 18 nt, Leptospira interrogans serovar lai str. 56601
auaaaaucuaaaaaaaau

SEQ ID NO: 751663 - RNA, 17 nt, Leptospira interrogans serovar lai str. 56601
auaaaaucuaaaaagaa

SEQ ID NO: 751664 - RNA, 18 nt, Leptospira interrogans serovar lai str. 56601
auaaaaucuaaaaagaau

SEQ ID NO: 751665 - RNA, 17 nt, Leptospira interrogans serovar lai str. 56601
auaaaaucuaaaaauaa

SEQ ID NO: 751666 - RNA, 12 nt, Leptospira interrogans serovar lai str. 56601
auaaaaucuuaa

SEQ ID NO: 751667 - RNA, 13 nt, Leptospira interrogans serovar lai str. 56601
auaaaaucuuaaa

SEQ ID NO: 751668 - RNA, 18 nt, Leptospira interrogans serovar lai str. 56601
auaaaaucuuaaauuaga

SEQ ID NO: 751669 - RNA, 20 nt, Leptospira interrogans serovar lai str. 56601
auaaaaucuuaaauuagaua

SEQ ID NO: 751670 - RNA, 18 nt, Leptospira interrogans serovar lai str. 56601
auaaaauauaguuaaauu

SEQ ID NO: 751671 - RNA, 15 nt, Leptospira interrogans serovar lai str. 56601
auaaaauacaaaaga

SEQ ID NO: 751672 - RNA, 17 nt, Leptospira interrogans serovar lai str. 56601
auaaaauacaaaagaau

SEQ ID NO: 751673 - RNA, 23 nt, Leptospira interrogans serovar lai str. 56601
auaaaauacaaaagaaucaucau

SEQ ID NO: 751674 - RNA, 12 nt, Leptospira interrogans serovar lai str. 56601
auaaaauaccaa

SEQ ID NO: 751675 - RNA, 16 nt, Leptospira interrogans serovar lai str. 56601
auaaaauaccauaaau

SEQ ID NO: 751676 - RNA, 21 nt, Leptospira interrogans serovar lai str. 56601
auaaaauaucuuuaauugaau

SEQ ID NO: 751677 - RNA, 19 nt, Leptospira interrogans serovar lai str. 56601
auaaaaucauauuuucaaa

SEQ ID NO: 751678 - RNA, 20 nt, Leptospira interrogans serovar lai str. 56601
auaaaaucauauuuucaaaa

SEQ ID NO: 751679 - RNA, 16 nt, Leptospira interrogans serovar lai str. 56601
aucaaugguuuuucuu

SEQ ID NO: 751680 - RNA, 18 nt, Leptospira interrogans serovar lai str. 56601
aucaaugucaaaaaaaau

SEQ ID NO: 751681 - RNA, 13 nt, Leptospira interrogans serovar lai str. 56601
aucacgcacaucg

SEQ ID NO: 751682 - RNA, 15 nt, Leptospira interrogans serovar lai str. 56601
aucacgccgaaauua

SEQ ID NO: 751683 - RNA, 19 nt, Leptospira interrogans serovar lai str. 56601
aucacuuccauuuuuugau

SEQ ID NO: 751684 - RNA, 17 nt, Leptospira interrogans serovar lai str. 56601
aucacuuuauauugguu

SEQ ID NO: 751685 - RNA, 13 nt, Leptospira interrogans serovar lai str. 56601
aucagaaaaacaa

SEQ ID NO: 751686 - RNA, 13 nt, Leptospira interrogans serovar lai str. 56601
aucagaaaaacau

SEQ ID NO: 751687 - RNA, 15 nt, Leptospira interrogans serovar lai str. 56601
aucagauguuuuaaa

SEQ ID NO: 751688 - RNA, 19 nt, Leptospira interrogans serovar lai str. 56601
aucagauuuugcacaaaac

SEQ ID NO: 751689 - RNA, 12 nt, Leptospira interrogans serovar lai str. 56601
aucagaucuauu

SEQ ID NO: 751690 - RNA, 21 nt, Leptospira interrogans serovar lai str. 56601
aucagagucuauuuaauuaug

SEQ ID NO: 751691 - RNA, 15 nt, Leptospira interrogans serovar lai str. 56601
aucagccauuaaauu

SEQ ID NO: 751692 - RNA, 15 nt, Leptospira interrogans serovar lai str. 56601
aaaacuaaaacgacu

SEQ ID NO: 751693 - RNA, 14 nt, Leptospira interrogans serovar lai str. 56601
aaaacuaaaaccga

SEQ ID NO: 751694 - RNA, 13 nt, Leptospira interrogans serovar lai str. 56601
aaaacuaaaacga

SEQ ID NO: 751695 - RNA, 18 nt, Leptospira interrogans serovar lai str. 56601
aucaucccgcccaaagua

SEQ ID NO: 751696 - RNA, 15 nt, Leptospira interrogans serovar lai str. 56601
aucauauuguuuaau

SEQ ID NO: 751697 - RNA, 17 nt, Leptospira interrogans serovar lai str. 56601
aucauauuuaacuguaa

SEQ ID NO: 751698 - RNA, 21 nt, Leptospira interrogans serovar lai str. 56601
aucauauccaauuucaauuuc

SEQ ID NO: 751699 - RNA, 20 nt, Leptospira interrogans serovar lai str. 56601
aaaacgcgauccguaaaaaa

SEQ ID NO: 751700 - RNA, 21 nt, Leptospira interrogans serovar lai str. 56601
aaaacgauucugcacuuuuua

SEQ ID NO: 751701 - RNA, 16 nt, Leptospira interrogans serovar lai str. 56601
aaaacgauauuuuuua

SEQ ID NO: 751702 - RNA, 22 nt, Leptospira interrogans serovar lai str. 56601
aucauaaaggugcaugaaaaua

SEQ ID NO: 751703 - RNA, 15 nt, Leptospira interrogans serovar lai str. 56601
aucauagauacauaa

SEQ ID NO: 751704 - RNA, 12 nt, Leptospira interrogans serovar lai str. 56601
aucauaaaaaua

SEQ ID NO: 751705 - RNA, 14 nt, Leptospira interrogans serovar lai str. 56601
aucaguguuuugug

SEQ ID NO: 751706 - RNA, 14 nt, Leptospira interrogans serovar lai str. 56601
aucaauagaauugu

SEQ ID NO: 751707 - RNA, 15 nt, Leptospira interrogans serovar lai str. 56601
aucaauagaauuguu

SEQ ID NO: 751708 - RNA, 21 nt, Leptospira interrogans serovar lai str. 56601
aucaauagagucguugaaaaa

SEQ ID NO: 751709 - RNA, 18 nt, Leptospira interrogans serovar lai str. 56601
aucaauaccgauuucuau

SEQ ID NO: 751710 - RNA, 20 nt, Leptospira interrogans serovar lai str. 56601
aucaauccuguaaauucaaa

SEQ ID NO: 751711 - RNA, 23 nt, Leptospira interrogans serovar lai str. 56601
aucaauccuguaaauucaaaaua

SEQ ID NO: 751712 - RNA, 14 nt, Leptospira interrogans serovar lai str. 56601
aucaauagaaauac

SEQ ID NO: 751713 - RNA, 13 nt, Leptospira interrogans serovar lai str. 56601
aucaaucugcaaa

SEQ ID NO: 751714 - RNA, 17 nt, Leptospira interrogans serovar lai str. 56601
aucaauccucuuugaaa

SEQ ID NO: 751715 - RNA, 19 nt, Leptospira interrogans serovar lai str. 56601
aucaauggaaaauuaauuu

SEQ ID NO: 751716 - RNA, 22 nt, Leptospira interrogans serovar lai str. 56601
aucaauggaaaauuaauuuuuc

SEQ ID NO: 751717 - RNA, 15 nt, Leptospira interrogans serovar lai str. 56601
aucaacaaaauuacu

SEQ ID NO: 751718 - RNA, 21 nt, Leptospira interrogans serovar lai str. 56601
aucaaaccuuucuuucugaua

SEQ ID NO: 751719 - RNA, 22 nt, Leptospira interrogans serovar lai str. 56601
aucaaacggucuuucuucugua

SEQ ID NO: 751720 - RNA, 17 nt, Leptospira interrogans serovar lai str. 56601
aucaaacucuuuuucuu

SEQ ID NO: 751721 - RNA, 16 nt, Leptospira interrogans serovar lai str. 56601
aucaacacaaauauua

SEQ ID NO: 751722 - RNA, 19 nt, Leptospira interrogans serovar lai str. 56601
aucaacaagaaugaaaaaa

SEQ ID NO: 751723 - RNA, 21 nt, Leptospira interrogans serovar lai str. 56601
aucaacaaguuuacacauuua

SEQ ID NO: 751724 - RNA, 14 nt, Leptospira interrogans serovar lai str. 56601
aucaaaauuucuuu

SEQ ID NO: 751725 - RNA, 17 nt, Leptospira interrogans serovar lai str. 56601
aucaaaauuuuuuugaa

SEQ ID NO: 751726 - RNA, 16 nt, Leptospira interrogans serovar lai str. 56601
aucaaaaggaauacaa

SEQ ID NO: 751727 - RNA, 13 nt, Leptospira interrogans serovar lai str. 56601
aucaaaacuuaaa

SEQ ID NO: 751728 - RNA, 16 nt, Leptospira interrogans serovar lai str. 56601
aucaaaagguauaaaa

SEQ ID NO: 751729 - RNA, 17 nt, Leptospira interrogans serovar lai str. 56601
aucaaaagguauaaaau

SEQ ID NO: 751730 - RNA, 12 nt, Leptospira interrogans serovar lai str. 56601
aucaagauuuua

SEQ ID NO: 751731 - RNA, 17 nt, Leptospira interrogans serovar lai str. 56601
aucaacuuuuggaacaa

SEQ ID NO: 751732 - RNA, 11 nt, Leptospira interrogans serovar lai str. 56601
aucaagaauua

SEQ ID NO: 751733 - RNA, 13 nt, Leptospira interrogans serovar lai str. 56601
aucaagaauuaau

SEQ ID NO: 751734 - RNA, 21 nt, Leptospira interrogans serovar lai str. 56601
auauugagcuaauucuuaaaa

SEQ ID NO: 751735 - RNA, 22 nt, Leptospira interrogans serovar lai str. 56601
auauugagcuaauucuuaaaaa

SEQ ID NO: 751736 - RNA, 14 nt, Leptospira interrogans serovar lai str. 56601
auauugagauaaaa

SEQ ID NO: 751737 - RNA, 15 nt, Leptospira interrogans serovar lai str. 56601
auauucuuuuuagac

SEQ ID NO: 751738 - RNA, 16 nt, Leptospira interrogans serovar lai str. 56601
auauugcacaugauau

SEQ ID NO: 751739 - RNA, 15 nt, Leptospira interrogans serovar lai str. 56601
auauucacaaaaaaa

SEQ ID NO: 751740 - RNA, 19 nt, Leptospira interrogans serovar lai str. 56601
auauucacaaaaaaauuca

SEQ ID NO: 751741 - RNA, 17 nt, Leptospira interrogans serovar lai str. 56601
auauucaacuuuuugaa

SEQ ID NO: 751742 - RNA, 21 nt, Leptospira interrogans serovar lai str. 56601
auaugauuuuauaccuugggc

SEQ ID NO: 751743 - RNA, 20 nt, Leptospira interrogans serovar lai str. 56601
auaugauuuaaaaucacaaa

SEQ ID NO: 751744 - RNA, 22 nt, Leptospira interrogans serovar lai str. 56601
auaugauuuaaaaucacaaaaa

SEQ ID NO: 751745 - RNA, 14 nt, Leptospira interrogans serovar lai str. 56601
auauuccagaagua

SEQ ID NO: 751746 - RNA, 18 nt, Leptospira interrogans serovar lai str. 56601
auauuccagaaguauuuu

SEQ ID NO: 751747 - RNA, 15 nt, Leptospira interrogans serovar lai str. 56601
auauucacuuuucca

SEQ ID NO: 751748 - RNA, 18 nt, Leptospira interrogans serovar lai str. 56601
auauucaguauucauuuu

SEQ ID NO: 751749 - RNA, 12 nt, Leptospira interrogans serovar lai str. 56601
aucaaaaccauu

SEQ ID NO: 751750 - RNA, 16 nt, Leptospira interrogans serovar lai str. 56601
auauuuuguuuuuagu

SEQ ID NO: 751751 - RNA, 17 nt, Leptospira interrogans serovar lai str. 56601
auauuuuuaaaaaguag

SEQ ID NO: 751752 - RNA, 20 nt, Leptospira interrogans serovar lai str. 56601
auauuuuccaaaaauuuaaa

SEQ ID NO: 751753 - RNA, 21 nt, Leptospira interrogans serovar lai str. 56601
auauuuugagcagauucuaaa

SEQ ID NO: 751754 - RNA, 17 nt, Leptospira interrogans serovar lai str. 56601
auauuuugauaaagaau

SEQ ID NO: 751755 - RNA, 21 nt, Leptospira interrogans serovar lai str. 56601
auauuuugaucuaauaauaua

SEQ ID NO: 751756 - RNA, 21 nt, Leptospira interrogans serovar lai str. 56601
auauuugauauaaucuuaaua

SEQ ID NO: 751757 - RNA, 15 nt, Leptospira interrogans serovar lai str. 56601
auauuuuaauuuuau

SEQ ID NO: 751758 - RNA, 15 nt, Leptospira interrogans serovar lai str. 56601
auauuuucaaaaaau

SEQ ID NO: 751759 - RNA, 19 nt, Leptospira interrogans serovar lai str. 56601
auauuuucaaaaaauaaaa

SEQ ID NO: 751760 - RNA, 21 nt, Leptospira interrogans serovar lai str. 56601
auauuuauuuuuuuuaauaua

SEQ ID NO: 751761 - RNA, 12 nt, Leptospira interrogans serovar lai str. 56601
auauuucaaaaa

SEQ ID NO: 751762 - RNA, 16 nt, Leptospira interrogans serovar lai str. 56601
auauuucaaaaauuuu

SEQ ID NO: 751763 - RNA, 16 nt, Leptospira interrogans serovar lai str. 56601
auauuucaauuccugu

SEQ ID NO: 751764 - RNA, 13 nt, Leptospira interrogans serovar lai str. 56601
auauuucauucuu

SEQ ID NO: 751765 - RNA, 16 nt, Leptospira interrogans serovar lai str. 56601
auauuucaagaauuuu

SEQ ID NO: 751766 - RNA, 17 nt, Leptospira interrogans serovar lai str. 56601
auauuuaacuguaauua

SEQ ID NO: 751767 - RNA, 20 nt, Leptospira interrogans serovar lai str. 56601
auauuuaacuguaauuagag

SEQ ID NO: 751768 - RNA, 13 nt, Leptospira interrogans serovar lai str. 56601
auaucuccaaaau

SEQ ID NO: 751769 - RNA, 18 nt, Leptospira interrogans serovar lai str. 56601
auaucuaaucuuuugaaa

SEQ ID NO: 751770 - RNA, 18 nt, Leptospira interrogans serovar lai str. 56601
auaucgugaaacuuucca

SEQ ID NO: 751771 - RNA, 19 nt, Leptospira interrogans serovar lai str. 56601
auaucgugaaacuuuccac

SEQ ID NO: 751772 - RNA, 14 nt, Leptospira interrogans serovar lai str. 56601
auaucuacaaaaga

SEQ ID NO: 751773 - RNA, 20 nt, Leptospira interrogans serovar lai str. 56601
auaucuacaaaagauuuuua

SEQ ID NO: 751774 - RNA, 21 nt, Leptospira interrogans serovar lai str. 56601
auaucuacaaaagauuuuuau

SEQ ID NO: 751775 - RNA, 16 nt, Leptospira interrogans serovar lai str. 56601
auaucugcaaaauaac

SEQ ID NO: 751776 - RNA, 21 nt, Leptospira interrogans serovar lai str. 56601
auaucucguauugaauuuuuu

SEQ ID NO: 751777 - RNA, 22 nt, Leptospira interrogans serovar lai str. 56601
auaucucguauugaauuuuuuc

SEQ ID NO: 751778 - RNA, 21 nt, Leptospira interrogans serovar lai str. 56601
auaucuggaacuuuaauuauu

SEQ ID NO: 751779 - RNA, 24 nt, Leptospira interrogans serovar lai str. 56601
auaucuggaacuuuaauuauugau

SEQ ID NO: 751780 - RNA, 22 nt, Leptospira interrogans serovar lai str. 56601
auaucugccuucuuuuuucuaa

SEQ ID NO: 751781 - RNA, 21 nt, Leptospira interrogans serovar lai str. 56601
auaucuuaauauaauaauucc

SEQ ID NO: 751782 - RNA, 15 nt, Leptospira interrogans serovar lai str. 56601
auaucuuaauuaaaa

SEQ ID NO: 751783 - RNA, 16 nt, Leptospira interrogans serovar lai str. 56601
auaucuuaauuaaaaa

SEQ ID NO: 751784 - RNA, 13 nt, Leptospira interrogans serovar lai str. 56601
auaugaauuuuua

SEQ ID NO: 751785 - RNA, 15 nt, Leptospira interrogans serovar lai str. 56601
auaugaauuuuuaau

SEQ ID NO: 751786 - RNA, 12 nt, Leptospira interrogans serovar lai str. 56601
auaugagagucu

SEQ ID NO: 751787 - RNA, 15 nt, Leptospira interrogans serovar lai str. 56601
auaugagugaaugga

SEQ ID NO: 751788 - RNA, 15 nt, Leptospira interrogans serovar lai str. 56601
auaucggaauaacuu

SEQ ID NO: 751789 - RNA, 19 nt, Leptospira interrogans serovar lai str. 56601
auaucggaauaacuuucuu

SEQ ID NO: 751790 - RNA, 13 nt, Leptospira interrogans serovar lai str. 56601
auauccgaaagau

SEQ ID NO: 751791 - RNA, 21 nt, Leptospira interrogans serovar lai str. 56601
auauccgaaagauaaaucgca

SEQ ID NO: 751792 - RNA, 16 nt, Leptospira interrogans serovar lai str. 56601
auaucgaauacauuua

SEQ ID NO: 751793 - RNA, 18 nt, Leptospira interrogans serovar lai str. 56601
auaucgaauacauuuaaa

SEQ ID NO: 751794 - RNA, 23 nt, Leptospira interrogans serovar lai str. 56601
auaucgaauuucuucauaaaauc

SEQ ID NO: 751795 - RNA, 23 nt, Leptospira interrogans serovar lai str. 56601
auauauucuuuucugaauaaaaa

SEQ ID NO: 751796 - RNA, 15 nt, Leptospira interrogans serovar lai str. 56601
auauauugaaauauu

SEQ ID NO: 751797 - RNA, 18 nt, Leptospira interrogans serovar lai str. 56601
auauauugaaauauuaua

SEQ ID NO: 751798 - RNA, 12 nt, Leptospira interrogans serovar lai str. 56601
auauauuuuuaa

SEQ ID NO: 751799 - RNA, 16 nt, Leptospira interrogans serovar lai str. 56601
auaucauauuguuuaa

SEQ ID NO: 751800 - RNA, 14 nt, Leptospira interrogans serovar lai str. 56601
auaucauaaauuuu

SEQ ID NO: 751801 - RNA, 22 nt, Leptospira interrogans serovar lai str. 56601
auauaaucuaagauugaaugaa

SEQ ID NO: 751802 - RNA, 15 nt, Leptospira interrogans serovar lai str. 56601
auauaauuaaaaaga

SEQ ID NO: 751803 - RNA, 18 nt, Leptospira interrogans serovar lai str. 56601
auauaauucuguaaaaua

SEQ ID NO: 751804 - RNA, 13 nt, Leptospira interrogans serovar lai str. 56601
auauaauaaaauc

SEQ ID NO: 751805 - RNA, 15 nt, Leptospira interrogans serovar lai str. 56601
auauaagaucuaucu

SEQ ID NO: 751806 - RNA, 19 nt, Leptospira interrogans serovar lai str. 56601
auauaaagucguuuuuaag

SEQ ID NO: 751807 - RNA, 18 nt, Leptospira interrogans serovar lai str. 56601
auauaacuuuuucagaau

SEQ ID NO: 751808 - RNA, 17 nt, Leptospira interrogans serovar lai str. 56601
auauauauucacaaaaa

SEQ ID NO: 751809 - RNA, 17 nt, Leptospira interrogans serovar lai str. 56601
auauauccuuaugaaag

SEQ ID NO: 751810 - RNA, 15 nt, Leptospira interrogans serovar lai str. 56601
auauagaaauuuuca

SEQ ID NO: 751811 - RNA, 23 nt, Leptospira interrogans serovar lai str. 56601
auauagaaccaucucaaaaauau

SEQ ID NO: 751812 - RNA, 12 nt, Leptospira interrogans serovar lai str. 56601
auauagaacuuu

SEQ ID NO: 751813 - RNA, 13 nt, Leptospira interrogans serovar lai str. 56601
auauacuuauaaa

SEQ ID NO: 751814 - RNA, 13 nt, Leptospira interrogans serovar lai str. 56601
auauacuugauau

SEQ ID NO: 751815 - RNA, 21 nt, Leptospira interrogans serovar lai str. 56601
auauacggauuucuauaaaau

SEQ ID NO: 751816 - RNA, 15 nt, Leptospira interrogans serovar lai str. 56601
auauacguaaaaaua

SEQ ID NO: 751817 - RNA, 17 nt, Leptospira interrogans serovar lai str. 56601
auauacguaaaaauaau

SEQ ID NO: 751818 - RNA, 21 nt, Leptospira interrogans serovar lai str. 56601
auauacgugaccaggaauacu

SEQ ID NO: 751819 - RNA, 19 nt, Leptospira interrogans serovar lai str. 56601
auaguuuugagauuacaaa

SEQ ID NO: 751820 - RNA, 21 nt, Leptospira interrogans serovar lai str. 56601
auaguuuugagcauaaaaaaa

SEQ ID NO: 751821 - RNA, 22 nt, Leptospira interrogans serovar lai str. 56601
auaguuuugagcauaaaaaaau

SEQ ID NO: 751822 - RNA, 19 nt, Leptospira interrogans serovar lai str. 56601
auaguuucuacauuuuugu

SEQ ID NO: 751823 - RNA, 12 nt, Leptospira interrogans serovar lai str. 56601
auaguuuacaua

SEQ ID NO: 751824 - RNA, 12 nt, Leptospira interrogans serovar lai str. 56601
auauaaaauuuu

SEQ ID NO: 751825 - RNA, 14 nt, Leptospira interrogans serovar lai str. 56601
auauaaagaaaaac

SEQ ID NO: 751826 - RNA, 18 nt, Leptospira interrogans serovar lai str. 56601
auaguuuuuaguauucuc

SEQ ID NO: 751827 - RNA, 16 nt, Leptospira interrogans serovar lai str. 56601
auaguuuuuucaaaaa

SEQ ID NO: 751828 - RNA, 20 nt, Leptospira interrogans serovar lai str. 56601
auaguuuuuucaaaaauucc

SEQ ID NO: 751829 - RNA, 14 nt, Leptospira interrogans serovar lai str. 56601
auagugaucgcguu

SEQ ID NO: 751830 - RNA, 13 nt, Leptospira interrogans serovar lai str. 56601
auagugcacugcu

SEQ ID NO: 751831 - RNA, 17 nt, Leptospira interrogans serovar lai str. 56601
auagugauacaauguuc

SEQ ID NO: 751832 - RNA, 18 nt, Leptospira interrogans serovar lai str. 56601
auagucuucaaaauugag

SEQ ID NO: 751833 - RNA, 15 nt, Leptospira interrogans serovar lai str. 56601
auaguucccacaaau

SEQ ID NO: 751834 - RNA, 20 nt, Leptospira interrogans serovar lai str. 56601
auaguucccacaaauugagu

SEQ ID NO: 751835 - RNA, 13 nt, Leptospira interrogans serovar lai str. 56601
auaguucccacag

SEQ ID NO: 751836 - RNA, 14 nt, Leptospira interrogans serovar lai str. 56601
auaguucccacagu

SEQ ID NO: 751837 - RNA, 15 nt, Leptospira interrogans serovar lai str. 56601
auaguuccuacaauu

SEQ ID NO: 751838 - RNA, 16 nt, Leptospira interrogans serovar lai str. 56601
auagccguagggauga

SEQ ID NO: 751839 - RNA, 18 nt, Leptospira interrogans serovar lai str. 56601
auagcgauacuuaaaaau

SEQ ID NO: 751840 - RNA, 14 nt, Leptospira interrogans serovar lai str. 56601
auagcaaaaaaauc

SEQ ID NO: 751841 - RNA, 22 nt, Leptospira interrogans serovar lai str. 56601
auagcagauuuucucaaaaaaa

SEQ ID NO: 751842 - RNA, 21 nt, Leptospira interrogans serovar lai str. 56601
auagaucgauucuuuaaaugu

SEQ ID NO: 751843 - RNA, 17 nt, Leptospira interrogans serovar lai str. 56601
auagaucaguuauaagu

SEQ ID NO: 751844 - RNA, 12 nt, Leptospira interrogans serovar lai str. 56601
auagauccaaau

SEQ ID NO: 751845 - RNA, 15 nt, Leptospira interrogans serovar lai str. 56601
auagaguuguuaaaa

SEQ ID NO: 751846 - RNA, 20 nt, Leptospira interrogans serovar lai str. 56601
auagagucguugaaaaauua

SEQ ID NO: 751847 - RNA, 16 nt, Leptospira interrogans serovar lai str. 56601
auagauugauuuaaau

SEQ ID NO: 751848 - RNA, 16 nt, Leptospira interrogans serovar lai str. 56601
auagauucaaaagucu

SEQ ID NO: 751849 - RNA, 18 nt, Leptospira interrogans serovar lai str. 56601
auagauucaauuauuaua

SEQ ID NO: 751850 - RNA, 15 nt, Leptospira interrogans serovar lai str. 56601
auagauucuuaaugu

SEQ ID NO: 751851 - RNA, 18 nt, Leptospira interrogans serovar lai str. 56601
auagauuaguuuaaaaac

SEQ ID NO: 751852 - RNA, 15 nt, Leptospira interrogans serovar lai str. 56601
auagauuaauuuuua

SEQ ID NO: 751853 - RNA, 16 nt, Leptospira interrogans serovar lai str. 56601
auagauuaauuuuuau

SEQ ID NO: 751854 - RNA, 13 nt, Leptospira interrogans serovar lai str. 56601
auagaugcugaaa

SEQ ID NO: 751855 - RNA, 14 nt, Leptospira interrogans serovar lai str. 56601
auagaugcugaaaa

SEQ ID NO: 751856 - RNA, 23 nt, Leptospira interrogans serovar lai str. 56601
auagaucuugagauccaauuauu

SEQ ID NO: 751857 - RNA, 11 nt, Leptospira interrogans serovar lai str. 56601
auacuuuucuu

SEQ ID NO: 751858 - RNA, 12 nt, Leptospira interrogans serovar lai str. 56601
auacuuuucuuc

SEQ ID NO: 751859 - RNA, 12 nt, Leptospira interrogans serovar lai str. 56601
auacuuuuaaaa

SEQ ID NO: 751860 - RNA, 14 nt, Leptospira interrogans serovar lai str. 56601
auacuuuuaaaaag

SEQ ID NO: 751861 - RNA, 17 nt, Leptospira interrogans serovar lai str. 56601
auacuuuuaaaaaguuc

SEQ ID NO: 751862 - RNA, 17 nt, Leptospira interrogans serovar lai str. 56601
auacuuuagaaauuucu

SEQ ID NO: 751863 - RNA, 21 nt, Leptospira interrogans serovar lai str. 56601
auacuuuuagaaaauuagaaa

SEQ ID NO: 751864 - RNA, 19 nt, Leptospira interrogans serovar lai str. 56601
auacuuuuagaagauuuuu

SEQ ID NO: 751865 - RNA, 20 nt, Leptospira interrogans serovar lai str. 56601
auacuuuuagauaauuauuc

SEQ ID NO: 751866 - RNA, 14 nt, Leptospira interrogans serovar lai str. 56601
auagaaaaaauaca

SEQ ID NO: 751867 - RNA, 21 nt, Leptospira interrogans serovar lai str. 56601
auagaaaaaauacauaaaaaa

SEQ ID NO: 751868 - RNA, 22 nt, Leptospira interrogans serovar lai str. 56601
auacuuuuugcaaguaaaaaga

SEQ ID NO: 751869 - RNA, 15 nt, Leptospira interrogans serovar lai str. 56601
auacuuuuuugauac

SEQ ID NO: 751870 - RNA, 12 nt, Leptospira interrogans serovar lai str. 56601
auagaaaagcau

SEQ ID NO: 751871 - RNA, 22 nt, Leptospira interrogans serovar lai str. 56601
auagacuaacgauuguaaaaaa

SEQ ID NO: 751872 - RNA, 15 nt, Leptospira interrogans serovar lai str. 56601
auagaaaccgauuuu

SEQ ID NO: 751873 - RNA, 16 nt, Leptospira interrogans serovar lai str. 56601
auagaaacaaauggag

SEQ ID NO: 751874 - RNA, 17 nt, Leptospira interrogans serovar lai str. 56601
auagaggcuuuacauuu

SEQ ID NO: 751875 - RNA, 23 nt, Leptospira interrogans serovar lai str. 56601
auagaggucgucucaaaaauauu

SEQ ID NO: 751876 - RNA, 13 nt, Leptospira interrogans serovar lai str. 56601
auagagaaaaauu

SEQ ID NO: 751877 - RNA, 22 nt, Leptospira interrogans serovar lai str. 56601
auacgaauuuaacuaguuccuu

SEQ ID NO: 751878 - RNA, 21 nt, Leptospira interrogans serovar lai str. 56601
auaccuguuuuaguucaaaaa

SEQ ID NO: 751879 - RNA, 17 nt, Leptospira interrogans serovar lai str. 56601
auacaggcgguuuaaaa

SEQ ID NO: 751880 - RNA, 16 nt, Leptospira interrogans serovar lai str. 56601
auaccgggccuuuuuu

SEQ ID NO: 751881 - RNA, 21 nt, Leptospira interrogans serovar lai str. 56601
auacucaauuugauaugaauc

SEQ ID NO: 751882 - RNA, 18 nt, Leptospira interrogans serovar lai str. 56601
auacucauaaaauuugcu

SEQ ID NO: 751883 - RNA, 14 nt, Leptospira interrogans serovar lai str. 56601
auacucaauauuuu

SEQ ID NO: 751884 - RNA, 17 nt, Leptospira interrogans serovar lai str. 56601
auacucuaauuuuuuau

SEQ ID NO: 751885 - RNA, 23 nt, Leptospira interrogans serovar lai str. 56601
auacuagggaaagaugauuuugu

SEQ ID NO: 751886 - RNA, 20 nt, Leptospira interrogans serovar lai str. 56601
auacuauaacuuuaaaaaau

SEQ ID NO: 751887 - RNA, 22 nt, Leptospira interrogans serovar lai str. 56601
auacuauacaacucaguuuuac

SEQ ID NO: 751888 - RNA, 13 nt, Leptospira interrogans serovar lai str. 56601
auacgcuucucuu

SEQ ID NO: 751889 - RNA, 15 nt, Leptospira interrogans serovar lai str. 56601
auacuagaacaauaa

SEQ ID NO: 751890 - RNA, 12 nt, Leptospira interrogans serovar lai str. 56601
auacucuuaaaa

SEQ ID NO: 751891 - RNA, 19 nt, Leptospira interrogans serovar lai str. 56601
auacuuagaauuuuuucgu

SEQ ID NO: 751892 - RNA, 22 nt, Leptospira interrogans serovar lai str. 56601
auacuuaucacgaaaauuaaaa

SEQ ID NO: 751893 - RNA, 13 nt, Leptospira interrogans serovar lai str. 56601
auacuucucuaaa

SEQ ID NO: 751894 - RNA, 16 nt, Leptospira interrogans serovar lai str. 56601
auacuuucaaaaaaua

SEQ ID NO: 751895 - RNA, 17 nt, Leptospira interrogans serovar lai str. 56601
auacuuguuucuaauuc

SEQ ID NO: 751896 - RNA, 17 nt, Leptospira interrogans serovar lai str. 56601
auacuugccguuacaua

SEQ ID NO: 751897 - RNA, 17 nt, Leptospira interrogans serovar lai str. 56601
aucgaguguaauaugaa

SEQ ID NO: 751898 - RNA, 15 nt, Leptospira interrogans serovar lai str. 56601
aucgaauaagaaauu

SEQ ID NO: 751899 - RNA, 13 nt, Leptospira interrogans serovar lai str. 56601
aucgaaucuuuug

SEQ ID NO: 751900 - RNA, 17 nt, Leptospira interrogans serovar lai str. 56601
aucgaauuuauguuuca

SEQ ID NO: 751901 - RNA, 21 nt, Leptospira interrogans serovar lai str. 56601
aucgaauuucuucauaaaauc

SEQ ID NO: 751902 - RNA, 14 nt, Leptospira interrogans serovar lai str. 56601
aucgacgauuuuac

SEQ ID NO: 751903 - RNA, 23 nt, Leptospira interrogans serovar lai str. 56601
aucgacgauuuuacgaacaaauu

SEQ ID NO: 751904 - RNA, 17 nt, Leptospira interrogans serovar lai str. 56601
aucgaacagcccaaaaa

SEQ ID NO: 751905 - RNA, 20 nt, Leptospira interrogans serovar lai str. 56601
aucgaaauuaaaauaaaggc

SEQ ID NO: 751906 - RNA, 21 nt, Leptospira interrogans serovar lai str. 56601
auccugcuaacugauuauaaa

SEQ ID NO: 751907 - RNA, 22 nt, Leptospira interrogans serovar lai str. 56601
aucgggauggagauuacuuuuu

SEQ ID NO: 751908 - RNA, 15 nt, Leptospira interrogans serovar lai str. 56601
aucgguuuaaaacua

SEQ ID NO: 751909 - RNA, 14 nt, Leptospira interrogans serovar lai str. 56601
aucgguuuuagaau

SEQ ID NO: 751910 - RNA, 15 nt, Leptospira interrogans serovar lai str. 56601
aucguaaaaaaauau

SEQ ID NO: 751911 - RNA, 23 nt, Leptospira interrogans serovar lai str. 56601
aucguaaaaaaauauuucaaaaa

SEQ ID NO: 751912 - RNA, 18 nt, Leptospira interrogans serovar lai str. 56601
aucgcucgcaaauuuuau

SEQ ID NO: 751913 - RNA, 17 nt, Leptospira interrogans serovar lai str. 56601
aucggaauaacuuucuu

SEQ ID NO: 751914 - RNA, 14 nt, Leptospira interrogans serovar lai str. 56601
aucggaaccaaagg

SEQ ID NO: 751915 - RNA, 18 nt, Leptospira interrogans serovar lai str. 56601
aucggaaccaaaggauaa

SEQ ID NO: 751916 - RNA, 14 nt, Leptospira interrogans serovar lai str. 56601
aucccuuucgcauu

SEQ ID NO: 751917 - RNA, 11 nt, Leptospira interrogans serovar lai str. 56601
aucccuuuggc

SEQ ID NO: 751918 - RNA, 15 nt, Leptospira interrogans serovar lai str. 56601
auccgaaagauaaau

SEQ ID NO: 751919 - RNA, 16 nt, Leptospira interrogans serovar lai str. 56601
auccgaaaucccaaaa

SEQ ID NO: 751920 - RNA, 21 nt, Leptospira interrogans serovar lai str. 56601
aucccuuuugcauugaaauca

SEQ ID NO: 751921 - RNA, 13 nt, Leptospira interrogans serovar lai str. 56601
auccgaaaaugua

SEQ ID NO: 751922 - RNA, 13 nt, Leptospira interrogans serovar lai str. 56601
auccgaaaaaccu

SEQ ID NO: 751923 - RNA, 23 nt, Leptospira interrogans serovar lai str. 56601
aucccuaagacuuggaguucuua

SEQ ID NO: 751924 - RNA, 12 nt, Leptospira interrogans serovar lai str. 56601
auccgcauucuc

SEQ ID NO: 751925 - RNA, 14 nt, Leptospira interrogans serovar lai str. 56601
auccgcauucucac

SEQ ID NO: 751926 - RNA, 20 nt, Leptospira interrogans serovar lai str. 56601
auccgaauuuuuacacacuc

SEQ ID NO: 751927 - RNA, 16 nt, Leptospira interrogans serovar lai str. 56601
aucccggaucguuuuu

SEQ ID NO: 751928 - RNA, 13 nt, Leptospira interrogans serovar lai str. 56601
aucccaguugaga

SEQ ID NO: 751929 - RNA, 21 nt, Leptospira interrogans serovar lai str. 56601
auccauuucuauaaauugagu

SEQ ID NO: 751930 - RNA, 17 nt, Leptospira interrogans serovar lai str. 56601
auccauuuuuccguaaa

SEQ ID NO: 751931 - RNA, 21 nt, Leptospira interrogans serovar lai str. 56601
auccauuuuuccguaaaaagu

SEQ ID NO: 751932 - RNA, 17 nt, Leptospira interrogans serovar lai str. 56601
auccauuuuucugaaaa

SEQ ID NO: 751933 - RNA, 18 nt, Leptospira interrogans serovar lai str. 56601
auccauuuuucugaaaaa

SEQ ID NO: 751934 - RNA, 16 nt, Leptospira interrogans serovar lai str. 56601
auccaugucuucuaaa

SEQ ID NO: 751935 - RNA, 17 nt, Leptospira interrogans serovar lai str. 56601
auccauucaaaaaauca

SEQ ID NO: 751936 - RNA, 14 nt, Leptospira interrogans serovar lai str. 56601
auccagaauaauaa

SEQ ID NO: 751937 - RNA, 22 nt, Leptospira interrogans serovar lai str. 56601
auccagaauaauaaucuuaaau

SEQ ID NO: 751938 - RNA, 19 nt, Leptospira interrogans serovar lai str. 56601
auccaaucauagauacaua

SEQ ID NO: 751939 - RNA, 15 nt, Leptospira interrogans serovar lai str. 56601
auccaauccaaaauu

SEQ ID NO: 751940 - RNA, 21 nt, Leptospira interrogans serovar lai str. 56601
auccaauuauaaaauuuuucu

SEQ ID NO: 751941 - RNA, 12 nt, Leptospira interrogans serovar lai str. 56601
auccaauuauuu

SEQ ID NO: 751942 - RNA, 16 nt, Leptospira interrogans serovar lai str. 56601
auccaauuauuuaugg

SEQ ID NO: 751943 - RNA, 18 nt, Leptospira interrogans serovar lai str. 56601
aucauuuucaauuuuuau

SEQ ID NO: 751944 - RNA, 14 nt, Leptospira interrogans serovar lai str. 56601
auccaaaacaaucu

SEQ ID NO: 751945 - RNA, 12 nt, Leptospira interrogans serovar lai str. 56601
aaaagaaaauua

SEQ ID NO: 751946 - RNA, 14 nt, Leptospira interrogans serovar lai str. 56601
aaaagaaaauuauc

SEQ ID NO: 751947 - RNA, 18 nt, Leptospira interrogans serovar lai str. 56601
aaaacuuuuuauaaagau

SEQ ID NO: 751948 - RNA, 11 nt, Leptospira interrogans serovar lai str. 56601
aaaagaaaaac

SEQ ID NO: 751949 - RNA, 19 nt, Leptospira interrogans serovar lai str. 56601
aaaagaaagcagcaaagaa

SEQ ID NO: 751950 - RNA, 15 nt, Leptospira interrogans serovar lai str. 56601
aaaagaaacuuaaua

SEQ ID NO: 751951 - RNA, 19 nt, Leptospira interrogans serovar lai str. 56601
aaaagaaacggaagaaaau

SEQ ID NO: 751952 - RNA, 21 nt, Leptospira interrogans serovar lai str. 56601
aaaagaaacggaagaaaauua

SEQ ID NO: 751953 - RNA, 14 nt, Leptospira interrogans serovar lai str. 56601
aaaagaaaccaauc

SEQ ID NO: 751954 - RNA, 18 nt, Leptospira interrogans serovar lai str. 56601
aaaacuuugaccauucuu

SEQ ID NO: 751955 - RNA, 19 nt, Leptospira interrogans serovar lai str. 56601
aaaacuuugagauguggga

SEQ ID NO: 751956 - RNA, 19 nt, Leptospira interrogans serovar lai str. 56601
aaaacuugucccaaaauuu

SEQ ID NO: 751957 - RNA, 12 nt, Leptospira interrogans serovar lai str. 56601
aaaacuuucgga

SEQ ID NO: 751958 - RNA, 22 nt, Leptospira interrogans serovar lai str. 56601
aaaacuuucggaauaaaacccu

SEQ ID NO: 751959 - RNA, 20 nt, Leptospira interrogans serovar lai str. 56601
aaaacuuucuaaaaauaaga

SEQ ID NO: 751960 - RNA, 18 nt, Leptospira interrogans serovar lai str. 56601
aaaacuuaaugagauuaa

SEQ ID NO: 751961 - RNA, 21 nt, Leptospira interrogans serovar lai str. 56601
aaaacuuaaugagauuaaaac

SEQ ID NO: 751962 - RNA, 22 nt, Leptospira interrogans serovar lai str. 56601
aaaacuuaaugagauuaaaacu

SEQ ID NO: 751963 - RNA, 20 nt, Leptospira interrogans serovar lai str. 56601
aaaacuacaucgucuucuuu

SEQ ID NO: 751964 - RNA, 15 nt, Leptospira interrogans serovar lai str. 56601
aucuucaaguuugug

SEQ ID NO: 751965 - RNA, 23 nt, Leptospira interrogans serovar lai str. 56601
aucuucauuuugggauuuuauug

SEQ ID NO: 751966 - RNA, 18 nt, Leptospira interrogans serovar lai str. 56601
aucuucauuaauuuuuga

SEQ ID NO: 751967 - RNA, 13 nt, Leptospira interrogans serovar lai str. 56601
aucuuaauaaaau

SEQ ID NO: 751968 - RNA, 18 nt, Leptospira interrogans serovar lai str. 56601
aucuuagaaugugggaac

SEQ ID NO: 751969 - RNA, 18 nt, Leptospira interrogans serovar lai str. 56601
aucuuaggacggauuuua

SEQ ID NO: 751970 - RNA, 19 nt, Leptospira interrogans serovar lai str. 56601
aucuuaggacggauuuuag

SEQ ID NO: 751971 - RNA, 20 nt, Leptospira interrogans serovar lai str. 56601
aucuuaagaauugaucuaaa

SEQ ID NO: 751972 - RNA, 13 nt, Leptospira interrogans serovar lai str. 56601
aucuuaauuaaaa

SEQ ID NO: 751973 - RNA, 14 nt, Leptospira interrogans serovar lai str. 56601
aucuuaauuaaaaa

SEQ ID NO: 751974 - RNA, 22 nt, Leptospira interrogans serovar lai str. 56601
aucuuacaaguuaugauuucau

SEQ ID NO: 751975 - RNA, 22 nt, Leptospira interrogans serovar lai str. 56601
aucuucaaacgucacuuuacaa

SEQ ID NO: 751976 - RNA, 13 nt, Leptospira interrogans serovar lai str. 56601
aucuuauuuuuac

SEQ ID NO: 751977 - RNA, 12 nt, Leptospira interrogans serovar lai str. 56601
aucuuauuucca

SEQ ID NO: 751978 - RNA, 18 nt, Leptospira interrogans serovar lai str. 56601
aucuuauacucuuaaaau

SEQ ID NO: 751979 - RNA, 20 nt, Leptospira interrogans serovar lai str. 56601
aucuuauacucuuaaaauua

SEQ ID NO: 751980 - RNA, 14 nt, Leptospira interrogans serovar lai str. 56601
aucuuauucaauaa

SEQ ID NO: 751981 - RNA, 17 nt, Leptospira interrogans serovar lai str. 56601
aucuuauucaauaaaau

SEQ ID NO: 751982 - RNA, 14 nt, Leptospira interrogans serovar lai str. 56601
aucuuaaaaugauu

SEQ ID NO: 751983 - RNA, 23 nt, Leptospira interrogans serovar lai str. 56601
aucuuaaauaucgaauuucuuca

SEQ ID NO: 751984 - RNA, 20 nt, Leptospira interrogans serovar lai str. 56601
aucuuaaaucuuuaaaauac

SEQ ID NO: 751985 - RNA, 12 nt, Leptospira interrogans serovar lai str. 56601
aucuguuuucuu

SEQ ID NO: 751986 - RNA, 17 nt, Leptospira interrogans serovar lai str. 56601
aucuguuuuguuuccuu

SEQ ID NO: 751987 - RNA, 18 nt, Leptospira interrogans serovar lai str. 56601
aucuguuuagaauauuuu

SEQ ID NO: 751988 - RNA, 20 nt, Leptospira interrogans serovar lai str. 56601
aucuguuuagaauauuuucu

SEQ ID NO: 751989 - RNA, 21 nt, Leptospira interrogans serovar lai str. 56601
aucuguuucuauuuuauguaa

SEQ ID NO: 751990 - RNA, 16 nt, Leptospira interrogans serovar lai str. 56601
aucugggcaaauuuag

SEQ ID NO: 751991 - RNA, 20 nt, Leptospira interrogans serovar lai str. 56601
aucugcgauuaaagauuuuu

SEQ ID NO: 751992 - RNA, 14 nt, Leptospira interrogans serovar lai str. 56601
aucugaaucucuuu

SEQ ID NO: 751993 - RNA, 13 nt, Leptospira interrogans serovar lai str. 56601
aucugaauuuuua

SEQ ID NO: 751994 - RNA, 21 nt, Leptospira interrogans serovar lai str. 56601
aucuccacuauggaauuuuuu

SEQ ID NO: 751995 - RNA, 22 nt, Leptospira interrogans serovar lai str. 56601
aucuccacuauggaauuuuuua

SEQ ID NO: 751996 - RNA, 18 nt, Leptospira interrogans serovar lai str. 56601
aucuccacuuaauuuuuc

SEQ ID NO: 751997 - RNA, 19 nt, Leptospira interrogans serovar lai str. 56601
aucuccacuuaauuuuucu

SEQ ID NO: 751998 - RNA, 13 nt, Leptospira interrogans serovar lai str. 56601
aucuccuaaaaua

SEQ ID NO: 751999 - RNA, 15 nt, Leptospira interrogans serovar lai str. 56601
aucuccuaaaauaaa

SEQ ID NO: 752000 - RNA, 13 nt, Leptospira interrogans serovar lai str. 56601
aucucuuuuucuc

SEQ ID NO: 752001 - RNA, 19 nt, Leptospira interrogans serovar lai str. 56601
aucucuuuuacgacuuuau

SEQ ID NO: 752002 - RNA, 23 nt, Leptospira interrogans serovar lai str. 56601
aucucuuuuacgacuuuauucaa

SEQ ID NO: 752003 - RNA, 23 nt, Leptospira interrogans serovar lai str. 56601
aucucugauaauuuuuuaaaaaa

SEQ ID NO: 752004 - RNA, 15 nt, Leptospira interrogans serovar lai str. 56601
aucucgauuccuaaa

SEQ ID NO: 752005 - RNA, 17 nt, Leptospira interrogans serovar lai str. 56601
aucucgauuccuaaaau

SEQ ID NO: 752006 - RNA, 17 nt, Leptospira interrogans serovar lai str. 56601
aucucgauuucuaaaau

SEQ ID NO: 752007 - RNA, 14 nt, Leptospira interrogans serovar lai str. 56601
aucguccaaucucu

SEQ ID NO: 752008 - RNA, 21 nt, Leptospira interrogans serovar lai str. 56601
aucuacagaacccaauaaaaa

SEQ ID NO: 752009 - RNA, 24 nt, Leptospira interrogans serovar lai str. 56601
aucuacagaacccaauaaaaacua

SEQ ID NO: 752010 - RNA, 14 nt, Leptospira interrogans serovar lai str. 56601
aucuacauaaaaaa

SEQ ID NO: 752011 - RNA, 14 nt, Leptospira interrogans serovar lai str. 56601
aucgucaaaauuua

SEQ ID NO: 752012 - RNA, 19 nt, Leptospira interrogans serovar lai str. 56601
aucgucagggaagcaguuu

SEQ ID NO: 752013 - RNA, 21 nt, Leptospira interrogans serovar lai str. 56601
aucuaguucaacguaagaaaa

SEQ ID NO: 752014 - RNA, 16 nt, Leptospira interrogans serovar lai str. 56601
aucuaggguauugagg

SEQ ID NO: 752015 - RNA, 15 nt, Leptospira interrogans serovar lai str. 56601
aucuaggauugugga

SEQ ID NO: 752016 - RNA, 14 nt, Leptospira interrogans serovar lai str. 56601
aucuauauuuuaca

SEQ ID NO: 752017 - RNA, 21 nt, Leptospira interrogans serovar lai str. 56601
aucuaugauauugcugucaua

SEQ ID NO: 752018 - RNA, 17 nt, Leptospira interrogans serovar lai str. 56601
aucuaugauucugaaaa

SEQ ID NO: 752019 - RNA, 16 nt, Leptospira interrogans serovar lai str. 56601
aucucagaaaauuuua

SEQ ID NO: 752020 - RNA, 17 nt, Leptospira interrogans serovar lai str. 56601
aucucagaaaauuuuac

SEQ ID NO: 752021 - RNA, 12 nt, Leptospira interrogans serovar lai str. 56601
augauaaaaaac

SEQ ID NO: 752022 - RNA, 15 nt, Leptospira interrogans serovar lai str. 56601
augaguuuuagaaua

SEQ ID NO: 752023 - RNA, 20 nt, Leptospira interrogans serovar lai str. 56601
augaguuuuagaauauuaag

SEQ ID NO: 752024 - RNA, 18 nt, Leptospira interrogans serovar lai str. 56601
augaguuccuacauguuc

SEQ ID NO: 752025 - RNA, 19 nt, Leptospira interrogans serovar lai str. 56601
augaguuccuacauuuuca

SEQ ID NO: 752026 - RNA, 23 nt, Leptospira interrogans serovar lai str. 56601
augaguucacuucuugaaaggug

SEQ ID NO: 752027 - RNA, 15 nt, Leptospira interrogans serovar lai str. 56601
augaguuauaguaaa

SEQ ID NO: 752028 - RNA, 21 nt, Leptospira interrogans serovar lai str. 56601
augaguuauaguaaaagaaaa

SEQ ID NO: 752029 - RNA, 22 nt, Leptospira interrogans serovar lai str. 56601
augaguuauaguaaaagaaaau

SEQ ID NO: 752030 - RNA, 14 nt, Leptospira interrogans serovar lai str. 56601
augaguucccacau

SEQ ID NO: 752031 - RNA, 21 nt, Leptospira interrogans serovar lai str. 56601
augaguucccacauuugauuu

SEQ ID NO: 752032 - RNA, 21 nt, Leptospira interrogans serovar lai str. 56601
augaguucccacauuuuuaaa

SEQ ID NO: 752033 - RNA, 23 nt, Leptospira interrogans serovar lai str. 56601
augaguucccacauuuuuaaaag

SEQ ID NO: 752034 - RNA, 22 nt, Leptospira interrogans serovar lai str. 56601
augauaacguauguguaaugau

SEQ ID NO: 752035 - RNA, 23 nt, Leptospira interrogans serovar lai str. 56601
augauccauuuuucugaaaaaag

SEQ ID NO: 752036 - RNA, 19 nt, Leptospira interrogans serovar lai str. 56601
augaucaacuacuaaucuc

SEQ ID NO: 752037 - RNA, 13 nt, Leptospira interrogans serovar lai str. 56601
augaucaaauuca

SEQ ID NO: 752038 - RNA, 23 nt, Leptospira interrogans serovar lai str. 56601
augaucaaauucacauaaaguua

SEQ ID NO: 752039 - RNA, 14 nt, Leptospira interrogans serovar lai str. 56601
augauagucaaaac

SEQ ID NO: 752040 - RNA, 21 nt, Leptospira interrogans serovar lai str. 56601
augauauaccaguuaaauuca

SEQ ID NO: 752041 - RNA, 17 nt, Leptospira interrogans serovar lai str. 56601
augagcuuacuuuaauu

SEQ ID NO: 752042 - RNA, 21 nt, Leptospira interrogans serovar lai str. 56601
augagcuuuuuuagaaaaagc

SEQ ID NO: 752043 - RNA, 18 nt, Leptospira interrogans serovar lai str. 56601
augagucugucccaaaau

SEQ ID NO: 752044 - RNA, 20 nt, Leptospira interrogans serovar lai str. 56601
augagucugucccaaaaucu

SEQ ID NO: 752045 - RNA, 20 nt, Leptospira interrogans serovar lai str. 56601
augacuuaaucugugggaac

SEQ ID NO: 752046 - RNA, 23 nt, Leptospira interrogans serovar lai str. 56601
augacuuaaucugugggaacucu

SEQ ID NO: 752047 - RNA, 16 nt, Leptospira interrogans serovar lai str. 56601
augaaucgaauaaaaa

SEQ ID NO: 752048 - RNA, 23 nt, Leptospira interrogans serovar lai str. 56601
augaauaaacaauaaaauaacua

SEQ ID NO: 752049 - RNA, 14 nt, Leptospira interrogans serovar lai str. 56601
augaauauuuucca

SEQ ID NO: 752050 - RNA, 22 nt, Leptospira interrogans serovar lai str. 56601
augaaguuuuacuaaaaguaac

SEQ ID NO: 752051 - RNA, 13 nt, Leptospira interrogans serovar lai str. 56601
augaauuuuaaau

SEQ ID NO: 752052 - RNA, 14 nt, Leptospira interrogans serovar lai str. 56601
augaauuuucaaaa

SEQ ID NO: 752053 - RNA, 15 nt, Leptospira interrogans serovar lai str. 56601
augaauuuucaaaau

SEQ ID NO: 752054 - RNA, 12 nt, Leptospira interrogans serovar lai str. 56601
augaauuuuuca

SEQ ID NO: 752055 - RNA, 18 nt, Leptospira interrogans serovar lai str. 56601
augaauuuuucauuuugu

SEQ ID NO: 752056 - RNA, 11 nt, Leptospira interrogans serovar lai str. 56601
augaauuuuuu

SEQ ID NO: 752057 - RNA, 14 nt, Leptospira interrogans serovar lai str. 56601
augaauuuuuaaac

SEQ ID NO: 752058 - RNA, 15 nt, Leptospira interrogans serovar lai str. 56601
augaauuuuuaaaca

SEQ ID NO: 752059 - RNA, 18 nt, Leptospira interrogans serovar lai str. 56601
augaauuuuuauaaaaau

SEQ ID NO: 752060 - RNA, 19 nt, Leptospira interrogans serovar lai str. 56601
augaauuuuuauaaaaaua

SEQ ID NO: 752061 - RNA, 20 nt, Leptospira interrogans serovar lai str. 56601
augaauuuuuauaaaaauac

SEQ ID NO: 752062 - RNA, 21 nt, Leptospira interrogans serovar lai str. 56601
augaauuuuuauaaaaauaca

SEQ ID NO: 752063 - RNA, 13 nt, Leptospira interrogans serovar lai str. 56601
augaauuuagaaa

SEQ ID NO: 752064 - RNA, 22 nt, Leptospira interrogans serovar lai str. 56601
augaauuuagaaaauuagaaag

SEQ ID NO: 752065 - RNA, 13 nt, Leptospira interrogans serovar lai str. 56601
augaaauuuuaaa

SEQ ID NO: 752066 - RNA, 15 nt, Leptospira interrogans serovar lai str. 56601
augaaauuuuaaaac

SEQ ID NO: 752067 - RNA, 13 nt, Leptospira interrogans serovar lai str. 56601
augaaauuuucuu

SEQ ID NO: 752068 - RNA, 18 nt, Leptospira interrogans serovar lai str. 56601
augaaauuuucuuagaaa

SEQ ID NO: 752069 - RNA, 13 nt, Leptospira interrogans serovar lai str. 56601
augaaauuuuuca

SEQ ID NO: 752070 - RNA, 12 nt, Leptospira interrogans serovar lai str. 56601
augaaauuuuug

SEQ ID NO: 752071 - RNA, 23 nt, Leptospira interrogans serovar lai str. 56601
augaaaugugggaccuggcucuc

SEQ ID NO: 752072 - RNA, 15 nt, Leptospira interrogans serovar lai str. 56601
augaaccauggauuu

SEQ ID NO: 752073 - RNA, 15 nt, Leptospira interrogans serovar lai str. 56601
augaacucaacagaa

SEQ ID NO: 752074 - RNA, 16 nt, Leptospira interrogans serovar lai str. 56601
augaacgaauuuuuca

SEQ ID NO: 752075 - RNA, 20 nt, Leptospira interrogans serovar lai str. 56601
augaacgaauuuuucaacaa

SEQ ID NO: 752076 - RNA, 13 nt, Leptospira interrogans serovar lai str. 56601
aucuuuauuuaau

SEQ ID NO: 752077 - RNA, 16 nt, Leptospira interrogans serovar lai str. 56601
aucuuucacuuuaaaa

SEQ ID NO: 752078 - RNA, 18 nt, Leptospira interrogans serovar lai str. 56601
aucuuucgauuuuaaaua

SEQ ID NO: 752079 - RNA, 15 nt, Leptospira interrogans serovar lai str. 56601
aucuuuuaaaaucaa

SEQ ID NO: 752080 - RNA, 18 nt, Leptospira interrogans serovar lai str. 56601
aucuuuuaaaaucaagag

SEQ ID NO: 752081 - RNA, 21 nt, Leptospira interrogans serovar lai str. 56601
aucuucgguuuaauauacuaa

SEQ ID NO: 752082 - RNA, 23 nt, Leptospira interrogans serovar lai str. 56601
aucuucuaauuaaauucuacauu

SEQ ID NO: 752083 - RNA, 20 nt, Leptospira interrogans serovar lai str. 56601
aucuuccugggaaguuguau

SEQ ID NO: 752084 - RNA, 17 nt, Leptospira interrogans serovar lai str. 56601
aucuuccgcauuuuuau

SEQ ID NO: 752085 - RNA, 18 nt, Leptospira interrogans serovar lai str. 56601
augaaaaauuucuuuguc

SEQ ID NO: 752086 - RNA, 19 nt, Leptospira interrogans serovar lai str. 56601
augaaaaagaauuuuuaaa

SEQ ID NO: 752087 - RNA, 23 nt, Leptospira interrogans serovar lai str. 56601
augaaaaagaauuuuuaaaaaua

SEQ ID NO: 752088 - RNA, 19 nt, Leptospira interrogans serovar lai str. 56601
aucuuuucaaaaguauuuu

SEQ ID NO: 752089 - RNA, 18 nt, Leptospira interrogans serovar lai str. 56601
augaaaucuacaaaacug

SEQ ID NO: 752090 - RNA, 17 nt, Leptospira interrogans serovar lai str. 56601
augaaagguaauuuuga

SEQ ID NO: 752091 - RNA, 20 nt, Leptospira interrogans serovar lai str. 56601
auuaaauuguaugaaagaaa

SEQ ID NO: 752092 - RNA, 22 nt, Leptospira interrogans serovar lai str. 56601
auuaaauuuuauuuauauauau

SEQ ID NO: 752093 - RNA, 15 nt, Leptospira interrogans serovar lai str. 56601
auuaaauuuugaaaa

SEQ ID NO: 752094 - RNA, 22 nt, Leptospira interrogans serovar lai str. 56601
auuaaauuuugaaaaauuccau

SEQ ID NO: 752095 - RNA, 15 nt, Leptospira interrogans serovar lai str. 56601
auuaaauaaagguuu

SEQ ID NO: 752096 - RNA, 20 nt, Leptospira interrogans serovar lai str. 56601
auuaaauaaagguuuuauag

SEQ ID NO: 752097 - RNA, 15 nt, Leptospira interrogans serovar lai str. 56601
auuaaaguuguugaa

SEQ ID NO: 752098 - RNA, 21 nt, Leptospira interrogans serovar lai str. 56601
auuaaaguuguugaaaaauua

SEQ ID NO: 752099 - RNA, 13 nt, Leptospira interrogans serovar lai str. 56601
auuaaaccgguaa

SEQ ID NO: 752100 - RNA, 16 nt, Leptospira interrogans serovar lai str. 56601
auuaaaguauccauuc

SEQ ID NO: 752101 - RNA, 16 nt, Leptospira interrogans serovar lai str. 56601
auuaaaguauuaauuu

SEQ ID NO: 752102 - RNA, 16 nt, Leptospira interrogans serovar lai str. 56601
auuaaacuucaaaaaa

SEQ ID NO: 752103 - RNA, 17 nt, Leptospira interrogans serovar lai str. 56601
auuaaacuucaaaaaau

SEQ ID NO: 752104 - RNA, 19 nt, Leptospira interrogans serovar lai str. 56601
auuaaaaaacuuuuuaaaa

SEQ ID NO: 752105 - RNA, 14 nt, Leptospira interrogans serovar lai str. 56601
auuaaaaaaauaau

SEQ ID NO: 752106 - RNA, 22 nt, Leptospira interrogans serovar lai str. 56601
auguuuuuuccgguaauuauaa

SEQ ID NO: 752107 - RNA, 22 nt, Leptospira interrogans serovar lai str. 56601
auguuuuuggguuuuacuaaaa

SEQ ID NO: 752108 - RNA, 15 nt, Leptospira interrogans serovar lai str. 56601
auguuuuuguauuuu

SEQ ID NO: 752109 - RNA, 17 nt, Leptospira interrogans serovar lai str. 56601
auguuugaauuuuuaag

SEQ ID NO: 752110 - RNA, 22 nt, Leptospira interrogans serovar lai str. 56601
auguuucuugugucaagcccuc

SEQ ID NO: 752111 - RNA, 17 nt, Leptospira interrogans serovar lai str. 56601
auguuucuuuuguaaaa

SEQ ID NO: 752112 - RNA, 23 nt, Leptospira interrogans serovar lai str. 56601
auguuuuucugauagagaaaaau

SEQ ID NO: 752113 - RNA, 16 nt, Leptospira interrogans serovar lai str. 56601
auguuuuuaaaaucuu

SEQ ID NO: 752114 - RNA, 22 nt, Leptospira interrogans serovar lai str. 56601
auguuuuguagagucaaaaguu

SEQ ID NO: 752115 - RNA, 14 nt, Leptospira interrogans serovar lai str. 56601
auuaaaaaaucaua

SEQ ID NO: 752116 - RNA, 20 nt, Leptospira interrogans serovar lai str. 56601
auuaaaaucuaucucaaaaa

SEQ ID NO: 752117 - RNA, 22 nt, Leptospira interrogans serovar lai str. 56601
auuaaaaucuaucucaaaaaua

SEQ ID NO: 752118 - RNA, 11 nt, Leptospira interrogans serovar lai str. 56601
auuaaaauuuc

SEQ ID NO: 752119 - RNA, 16 nt, Leptospira interrogans serovar lai str. 56601
auuaaacaauuuuuca

SEQ ID NO: 752120 - RNA, 21 nt, Leptospira interrogans serovar lai str. 56601
auguuucccaguucuuaaaua

SEQ ID NO: 752121 - RNA, 17 nt, Leptospira interrogans serovar lai str. 56601
auguuuagaguauuaua

SEQ ID NO: 752122 - RNA, 18 nt, Leptospira interrogans serovar lai str. 56601
auguuuaaagaauuuuua

SEQ ID NO: 752123 - RNA, 16 nt, Leptospira interrogans serovar lai str. 56601
auguuuacuugaaaau

SEQ ID NO: 752124 - RNA, 17 nt, Leptospira interrogans serovar lai str. 56601
auguuguucuccaacuu

SEQ ID NO: 752125 - RNA, 18 nt, Leptospira interrogans serovar lai str. 56601
auguuguuaaauuuuucu

SEQ ID NO: 752126 - RNA, 13 nt, Leptospira interrogans serovar lai str. 56601
auguucaaaauuu

SEQ ID NO: 752127 - RNA, 23 nt, Leptospira interrogans serovar lai str. 56601
auguucaaaauuuaucuguaaaa

SEQ ID NO: 752128 - RNA, 22 nt, Leptospira interrogans serovar lai str. 56601
auguccuuuuuuucuuuuaaaa

SEQ ID NO: 752129 - RNA, 19 nt, Leptospira interrogans serovar lai str. 56601
auguucaaauucaucaauu

SEQ ID NO: 752130 - RNA, 11 nt, Leptospira interrogans serovar lai str. 56601
auguccggguu

SEQ ID NO: 752131 - RNA, 19 nt, Leptospira interrogans serovar lai str. 56601
auguccggguuagaaucaa

SEQ ID NO: 752132 - RNA, 16 nt, Leptospira interrogans serovar lai str. 56601
auuaauuuaaaaacaa

SEQ ID NO: 752133 - RNA, 20 nt, Leptospira interrogans serovar lai str. 56601
auuaauucuccauccuauuu

SEQ ID NO: 752134 - RNA, 17 nt, Leptospira interrogans serovar lai str. 56601
auuaauuuaaucaaaau

SEQ ID NO: 752135 - RNA, 14 nt, Leptospira interrogans serovar lai str. 56601
auuaauuuacuuau

SEQ ID NO: 752136 - RNA, 16 nt, Leptospira interrogans serovar lai str. 56601
auuaauuugaauauaa

SEQ ID NO: 752137 - RNA, 22 nt, Leptospira interrogans serovar lai str. 56601
auuaauuuuccuauuuucgaaa

SEQ ID NO: 752138 - RNA, 22 nt, Leptospira interrogans serovar lai str. 56601
auuaaugcgaaaauuuaacuac

SEQ ID NO: 752139 - RNA, 22 nt, Leptospira interrogans serovar lai str. 56601
auuacagaagggagaauaucua

SEQ ID NO: 752140 - RNA, 22 nt, Leptospira interrogans serovar lai str. 56601
auuaccaauugauaauuuguuu

SEQ ID NO: 752141 - RNA, 16 nt, Leptospira interrogans serovar lai str. 56601
auuaauuuuuuaaaaa

SEQ ID NO: 752142 - RNA, 24 nt, Leptospira interrogans serovar lai str. 56601
auuacaaaaaaugaauuuagcauu

SEQ ID NO: 752143 - RNA, 12 nt, Leptospira interrogans serovar lai str. 56601
auuaauuuuuca

SEQ ID NO: 752144 - RNA, 22 nt, Leptospira interrogans serovar lai str. 56601
auuaauuuuucaacaacucuaa

SEQ ID NO: 752145 - RNA, 13 nt, Leptospira interrogans serovar lai str. 56601
auuacaaagcacu

SEQ ID NO: 752146 - RNA, 15 nt, Leptospira interrogans serovar lai str. 56601
auuaaucuguaaauc

SEQ ID NO: 752147 - RNA, 15 nt, Leptospira interrogans serovar lai str. 56601
auuaaugaauaacuu

SEQ ID NO: 752148 - RNA, 17 nt, Leptospira interrogans serovar lai str. 56601
aaaagcagcuaaaaaga

SEQ ID NO: 752149 - RNA, 20 nt, Leptospira interrogans serovar lai str. 56601
aaaagcagcuaaaaagaaag

SEQ ID NO: 752150 - RNA, 20 nt, Leptospira interrogans serovar lai str. 56601
auuaaucagauuuuugcaca

SEQ ID NO: 752151 - RNA, 23 nt, Leptospira interrogans serovar lai str. 56601
aaaagccagaauuuugaacauuu

SEQ ID NO: 752152 - RNA, 14 nt, Leptospira interrogans serovar lai str. 56601
auuaauauuuauaa

SEQ ID NO: 752153 - RNA, 17 nt, Leptospira interrogans serovar lai str. 56601
auuaauauuuauaaaac

SEQ ID NO: 752154 - RNA, 21 nt, Leptospira interrogans serovar lai str. 56601
auuaaguauuguuaagauaaa

SEQ ID NO: 752155 - RNA, 18 nt, Leptospira interrogans serovar lai str. 56601
auuaaguuacauuaugaa

SEQ ID NO: 752156 - RNA, 12 nt, Leptospira interrogans serovar lai str. 56601
aaaagcacaaaa

SEQ ID NO: 752157 - RNA, 16 nt, Leptospira interrogans serovar lai str. 56601
auuaaguuuaaaaaca

SEQ ID NO: 752158 - RNA, 22 nt, Leptospira interrogans serovar lai str. 56601
auuaaguuuaaaaacaguauuu

SEQ ID NO: 752159 - RNA, 14 nt, Leptospira interrogans serovar lai str. 56601
auuaacaaaacugc

SEQ ID NO: 752160 - RNA, 15 nt, Leptospira interrogans serovar lai str. 56601
auuaacaaaacugcu

SEQ ID NO: 752161 - RNA, 17 nt, Leptospira interrogans serovar lai str. 56601
auuaacaaauuuaaaau

SEQ ID NO: 752162 - RNA, 20 nt, Leptospira interrogans serovar lai str. 56601
auuaacaaauuuaaaauaac

SEQ ID NO: 752163 - RNA, 16 nt, Leptospira interrogans serovar lai str. 56601
auuaaauuuuuauaaa

SEQ ID NO: 752164 - RNA, 19 nt, Leptospira interrogans serovar lai str. 56601
auuaaauuuuuauaaaaua

SEQ ID NO: 752165 - RNA, 21 nt, Leptospira interrogans serovar lai str. 56601
auuaaauuuuuauaaaauacc

SEQ ID NO: 752166 - RNA, 18 nt, Leptospira interrogans serovar lai str. 56601
auuaaauuuuuauacuuu

SEQ ID NO: 752167 - RNA, 15 nt, Leptospira interrogans serovar lai str. 56601
auucaauaauuuuaa

SEQ ID NO: 752168 - RNA, 19 nt, Leptospira interrogans serovar lai str. 56601
auucaaauuuacucuuaua

SEQ ID NO: 752169 - RNA, 21 nt, Leptospira interrogans serovar lai str. 56601
auucaaauuuacucuuauaaa

SEQ ID NO: 752170 - RNA, 16 nt, Leptospira interrogans serovar lai str. 56601
auucaaaugucuuuuu

SEQ ID NO: 752171 - RNA, 23 nt, Leptospira interrogans serovar lai str. 56601
auuauugaucucuauaaaaucaa

SEQ ID NO: 752172 - RNA, 16 nt, Leptospira interrogans serovar lai str. 56601
auucaauuuuuauaaa

SEQ ID NO: 752173 - RNA, 18 nt, Leptospira interrogans serovar lai str. 56601
auucaauuuuuauagauc

SEQ ID NO: 752174 - RNA, 12 nt, Leptospira interrogans serovar lai str. 56601
auucacaaaaaa

SEQ ID NO: 752175 - RNA, 13 nt, Leptospira interrogans serovar lai str. 56601
auucaauuucuuu

SEQ ID NO: 752176 - RNA, 22 nt, Leptospira interrogans serovar lai str. 56601
auucaauuucuuuaauuucaau

SEQ ID NO: 752177 - RNA, 23 nt, Leptospira interrogans serovar lai str. 56601
auucaauuucuuuaauuucaaua

SEQ ID NO: 752178 - RNA, 15 nt, Leptospira interrogans serovar lai str. 56601
auucacauuaaaaua

SEQ ID NO: 752179 - RNA, 17 nt, Leptospira interrogans serovar lai str. 56601
auucacauuaaaauagg

SEQ ID NO: 752180 - RNA, 18 nt, Leptospira interrogans serovar lai str. 56601
auucacauaaaguuaaua

SEQ ID NO: 752181 - RNA, 21 nt, Leptospira interrogans serovar lai str. 56601
auucaggugggaguuuagaac

SEQ ID NO: 752182 - RNA, 13 nt, Leptospira interrogans serovar lai str. 56601
auucaggauuacu

SEQ ID NO: 752183 - RNA, 14 nt, Leptospira interrogans serovar lai str. 56601
auucacuuccauug

SEQ ID NO: 752184 - RNA, 15 nt, Leptospira interrogans serovar lai str. 56601
auucacuuagaaaga

SEQ ID NO: 752185 - RNA, 19 nt, Leptospira interrogans serovar lai str. 56601
auucacuuagaaagauaga

SEQ ID NO: 752186 - RNA, 19 nt, Leptospira interrogans serovar lai str. 56601
auucagaaaaaaaaagaau

SEQ ID NO: 752187 - RNA, 17 nt, Leptospira interrogans serovar lai str. 56601
auucacucuuaaauacu

SEQ ID NO: 752188 - RNA, 15 nt, Leptospira interrogans serovar lai str. 56601
auucacugaaaauuu

SEQ ID NO: 752189 - RNA, 16 nt, Leptospira interrogans serovar lai str. 56601
auucacugaaaauuua

SEQ ID NO: 752190 - RNA, 15 nt, Leptospira interrogans serovar lai str. 56601
auucacguuaaaaua

SEQ ID NO: 752191 - RNA, 17 nt, Leptospira interrogans serovar lai str. 56601
auucacguuaacuaacu

SEQ ID NO: 752192 - RNA, 13 nt, Leptospira interrogans serovar lai str. 56601
auucacguucaac

SEQ ID NO: 752193 - RNA, 20 nt, Leptospira interrogans serovar lai str. 56601
auucacgaccuuaaauaaua

SEQ ID NO: 752194 - RNA, 21 nt, Leptospira interrogans serovar lai str. 56601
auuauauuuugagguauuuua

SEQ ID NO: 752195 - RNA, 15 nt, Leptospira interrogans serovar lai str. 56601
auuauauuuuuaaaa

SEQ ID NO: 752196 - RNA, 16 nt, Leptospira interrogans serovar lai str. 56601
auuauauuuuuaaaaa

SEQ ID NO: 752197 - RNA, 14 nt, Leptospira interrogans serovar lai str. 56601
auuaucaaaauuua

SEQ ID NO: 752198 - RNA, 24 nt, Leptospira interrogans serovar lai str. 56601
auuaucaaaauuuaaaucccauuu

SEQ ID NO: 752199 - RNA, 17 nt, Leptospira interrogans serovar lai str. 56601
auuaucauguaaaauuu

SEQ ID NO: 752200 - RNA, 20 nt, Leptospira interrogans serovar lai str. 56601
auuauccauuucuauaaauu

SEQ ID NO: 752201 - RNA, 23 nt, Leptospira interrogans serovar lai str. 56601
auuauccauuucuauaaauugag

SEQ ID NO: 752202 - RNA, 23 nt, Leptospira interrogans serovar lai str. 56601
auuaucccaguugagaguuuuuc

SEQ ID NO: 752203 - RNA, 14 nt, Leptospira interrogans serovar lai str. 56601
auuauccuuaaaau

SEQ ID NO: 752204 - RNA, 17 nt, Leptospira interrogans serovar lai str. 56601
auuaugauuuuuuugaa

SEQ ID NO: 752205 - RNA, 21 nt, Leptospira interrogans serovar lai str. 56601
auuauuaguuauguuuuaaaa

SEQ ID NO: 752206 - RNA, 21 nt, Leptospira interrogans serovar lai str. 56601
auuauuacucggauguauaaa

SEQ ID NO: 752207 - RNA, 21 nt, Leptospira interrogans serovar lai str. 56601
auuauuagaguuguugaaaaa

SEQ ID NO: 752208 - RNA, 14 nt, Leptospira interrogans serovar lai str. 56601
auuaucuuuauauu

SEQ ID NO: 752209 - RNA, 11 nt, Leptospira interrogans serovar lai str. 56601
auuaugaagaa

SEQ ID NO: 752210 - RNA, 12 nt, Leptospira interrogans serovar lai str. 56601
auuaugaagaau

SEQ ID NO: 752211 - RNA, 13 nt, Leptospira interrogans serovar lai str. 56601
auuaugaagaaug

SEQ ID NO: 752212 - RNA, 15 nt, Leptospira interrogans serovar lai str. 56601
auuaugaauuuuuaa

SEQ ID NO: 752213 - RNA, 22 nt, Leptospira interrogans serovar lai str. 56601
auuaugaauuuuuaaacauuua

SEQ ID NO: 752214 - RNA, 23 nt, Leptospira interrogans serovar lai str. 56601
auuaugaauuuuuaaacauuuau

SEQ ID NO: 752215 - RNA, 18 nt, Leptospira interrogans serovar lai str. 56601
auuaugcaguauuuugua

SEQ ID NO: 752216 - RNA, 13 nt, Leptospira interrogans serovar lai str. 56601
auuauaaaaacaa

SEQ ID NO: 752217 - RNA, 16 nt, Leptospira interrogans serovar lai str. 56601
auuauaaaaacaaguu

SEQ ID NO: 752218 - RNA, 13 nt, Leptospira interrogans serovar lai str. 56601
auuaguuuucuuc

SEQ ID NO: 752219 - RNA, 22 nt, Leptospira interrogans serovar lai str. 56601
auuaguuuucuucuauuucuua

SEQ ID NO: 752220 - RNA, 17 nt, Leptospira interrogans serovar lai str. 56601
auuauaaaauacaaaag

SEQ ID NO: 752221 - RNA, 16 nt, Leptospira interrogans serovar lai str. 56601
auuauaaauacaaaaa

SEQ ID NO: 752222 - RNA, 17 nt, Leptospira interrogans serovar lai str. 56601
auuauaaauuuaaaaaa

SEQ ID NO: 752223 - RNA, 24 nt, Leptospira interrogans serovar lai str. 56601
auuauaaauuuauaaauguaggaa

SEQ ID NO: 752224 - RNA, 17 nt, Leptospira interrogans serovar lai str. 56601
auuauaaauuuugagcc

SEQ ID NO: 752225 - RNA, 17 nt, Leptospira interrogans serovar lai str. 56601
auuauaauauauauaaa

SEQ ID NO: 752226 - RNA, 19 nt, Leptospira interrogans serovar lai str. 56601
auuauaauucucuuuuugg

SEQ ID NO: 752227 - RNA, 17 nt, Leptospira interrogans serovar lai str. 56601
auuauaauugauucgau

SEQ ID NO: 752228 - RNA, 15 nt, Leptospira interrogans serovar lai str. 56601
auuauaauuuuaaau

SEQ ID NO: 752229 - RNA, 16 nt, Leptospira interrogans serovar lai str. 56601
auuauaauuuuaaaua

SEQ ID NO: 752230 - RNA, 19 nt, Leptospira interrogans serovar lai str. 56601
auuauaauuuuaaauaaua

SEQ ID NO: 752231 - RNA, 12 nt, Leptospira interrogans serovar lai str. 56601
auuauacaaaac

SEQ ID NO: 752232 - RNA, 21 nt, Leptospira interrogans serovar lai str. 56601
auuauacaaaacucuuuaaaa

SEQ ID NO: 752233 - RNA, 15 nt, Leptospira interrogans serovar lai str. 56601
auuauacaauuuaau

SEQ ID NO: 752234 - RNA, 21 nt, Leptospira interrogans serovar lai str. 56601
auuauacuauaaguuuacaau

SEQ ID NO: 752235 - RNA, 15 nt, Leptospira interrogans serovar lai str. 56601
auuacgaauuuuuaa

SEQ ID NO: 752236 - RNA, 17 nt, Leptospira interrogans serovar lai str. 56601
auuacgaauuuuuaaau

SEQ ID NO: 752237 - RNA, 18 nt, Leptospira interrogans serovar lai str. 56601
auuacgaauuuuuaaaua

SEQ ID NO: 752238 - RNA, 20 nt, Leptospira interrogans serovar lai str. 56601
auuacgaaaacuauuuuucu

SEQ ID NO: 752239 - RNA, 22 nt, Leptospira interrogans serovar lai str. 56601
auuacgaaaacuauuuuucuuu

SEQ ID NO: 752240 - RNA, 18 nt, Leptospira interrogans serovar lai str. 56601
aaaagcugaacuuaaaau

SEQ ID NO: 752241 - RNA, 21 nt, Leptospira interrogans serovar lai str. 56601
auuagcguguaugguaaaaau

SEQ ID NO: 752242 - RNA, 22 nt, Leptospira interrogans serovar lai str. 56601
auuagcguguaugguaaaaaua

SEQ ID NO: 752243 - RNA, 16 nt, Leptospira interrogans serovar lai str. 56601
auuacgacgcgauuca

SEQ ID NO: 752244 - RNA, 20 nt, Leptospira interrogans serovar lai str. 56601
auguauccaauccaaaauug

SEQ ID NO: 752245 - RNA, 14 nt, Leptospira interrogans serovar lai str. 56601
aaaagauagaaguu

SEQ ID NO: 752246 - RNA, 16 nt, Leptospira interrogans serovar lai str. 56601
auguauaaaaauaaua

SEQ ID NO: 752247 - RNA, 15 nt, Leptospira interrogans serovar lai str. 56601
auguauauaaauuua

SEQ ID NO: 752248 - RNA, 23 nt, Leptospira interrogans serovar lai str. 56601
aaaagauuaucuucuaauuaaau

SEQ ID NO: 752249 - RNA, 18 nt, Leptospira interrogans serovar lai str. 56601
aaaagauuucaaaaaacu

SEQ ID NO: 752250 - RNA, 18 nt, Leptospira interrogans serovar lai str. 56601
aaaagauuuguuuuauaa

SEQ ID NO: 752251 - RNA, 19 nt, Leptospira interrogans serovar lai str. 56601
auguauggcucauuuuucu

SEQ ID NO: 752252 - RNA, 20 nt, Leptospira interrogans serovar lai str. 56601
auguauuacucagaguuaua

SEQ ID NO: 752253 - RNA, 11 nt, Leptospira interrogans serovar lai str. 56601
augucaacagg

SEQ ID NO: 752254 - RNA, 16 nt, Leptospira interrogans serovar lai str. 56601
augucacagacuucuu

SEQ ID NO: 752255 - RNA, 13 nt, Leptospira interrogans serovar lai str. 56601
auguagaaauuug

SEQ ID NO: 752256 - RNA, 14 nt, Leptospira interrogans serovar lai str. 56601
auguagauccuagc

SEQ ID NO: 752257 - RNA, 20 nt, Leptospira interrogans serovar lai str. 56601
auguagauccuagcuauuuu

SEQ ID NO: 752258 - RNA, 15 nt, Leptospira interrogans serovar lai str. 56601
auguaguaacuacua

SEQ ID NO: 752259 - RNA, 12 nt, Leptospira interrogans serovar lai str. 56601
auguagccaaau

SEQ ID NO: 752260 - RNA, 21 nt, Leptospira interrogans serovar lai str. 56601
auguaauaugagugaauggag

SEQ ID NO: 752261 - RNA, 15 nt, Leptospira interrogans serovar lai str. 56601
auguaaucuauaaua

SEQ ID NO: 752262 - RNA, 23 nt, Leptospira interrogans serovar lai str. 56601
auguaaucucgauuucuaaaaug

SEQ ID NO: 752263 - RNA, 15 nt, Leptospira interrogans serovar lai str. 56601
auguaagaguuccua

SEQ ID NO: 752264 - RNA, 22 nt, Leptospira interrogans serovar lai str. 56601
auguaagcucucguaauaucua

SEQ ID NO: 752265 - RNA, 14 nt, Leptospira interrogans serovar lai str. 56601
auguaauuccagag

SEQ ID NO: 752266 - RNA, 23 nt, Leptospira interrogans serovar lai str. 56601
augguuuuggaugaugggaccaa

SEQ ID NO: 752267 - RNA, 22 nt, Leptospira interrogans serovar lai str. 56601
auguaaaagcuuuugcuuuuaa

SEQ ID NO: 752268 - RNA, 19 nt, Leptospira interrogans serovar lai str. 56601
augguccaaucagauuuuu

SEQ ID NO: 752269 - RNA, 14 nt, Leptospira interrogans serovar lai str. 56601
auggcuuugaaaaa

SEQ ID NO: 752270 - RNA, 23 nt, Leptospira interrogans serovar lai str. 56601
augggaauuuuuguaaaauccag

SEQ ID NO: 752271 - RNA, 15 nt, Leptospira interrogans serovar lai str. 56601
auggcguauaagaau

SEQ ID NO: 752272 - RNA, 19 nt, Leptospira interrogans serovar lai str. 56601
auggccuucuggaaaaauu

SEQ ID NO: 752273 - RNA, 18 nt, Leptospira interrogans serovar lai str. 56601
auggauuuacaguuaaac

SEQ ID NO: 752274 - RNA, 20 nt, Leptospira interrogans serovar lai str. 56601
augcuguaguuuauuuuucu

SEQ ID NO: 752275 - RNA, 23 nt, Leptospira interrogans serovar lai str. 56601
auggauuugauuuuucgaaaauu

SEQ ID NO: 752276 - RNA, 14 nt, Leptospira interrogans serovar lai str. 56601
auggauuuuuaugu

SEQ ID NO: 752277 - RNA, 21 nt, Leptospira interrogans serovar lai str. 56601
augcuguaacucauauagaaa

SEQ ID NO: 752278 - RNA, 20 nt, Leptospira interrogans serovar lai str. 56601
aaaagagacauugaagaaaa

SEQ ID NO: 752279 - RNA, 22 nt, Leptospira interrogans serovar lai str. 56601
aaaagagacauugaagaaaaaa

SEQ ID NO: 752280 - RNA, 22 nt, Leptospira interrogans serovar lai str. 56601
aaaagacucacaccuucuuuuu

SEQ ID NO: 752281 - RNA, 17 nt, Leptospira interrogans serovar lai str. 56601
aaaagaguauuaucuuu

SEQ ID NO: 752282 - RNA, 12 nt, Leptospira interrogans serovar lai str. 56601
aaaagauaaaaa

SEQ ID NO: 752283 - RNA, 16 nt, Leptospira interrogans serovar lai str. 56601
aaaagauaaaaagaga

SEQ ID NO: 752284 - RNA, 18 nt, Leptospira interrogans serovar lai str. 56601
augcugaaggaccgcaga

SEQ ID NO: 752285 - RNA, 19 nt, Leptospira interrogans serovar lai str. 56601
augcgcaaucucaagugau

SEQ ID NO: 752286 - RNA, 15 nt, Leptospira interrogans serovar lai str. 56601
augcgaguaauauuu

SEQ ID NO: 752287 - RNA, 14 nt, Leptospira interrogans serovar lai str. 56601
augccccauucuuu

SEQ ID NO: 752288 - RNA, 16 nt, Leptospira interrogans serovar lai str. 56601
augccccauucuuuuu

SEQ ID NO: 752289 - RNA, 18 nt, Leptospira interrogans serovar lai str. 56601
augccauuuuuaguuuua

SEQ ID NO: 752290 - RNA, 12 nt, Leptospira interrogans serovar lai str. 56601
augcauuuaggu

SEQ ID NO: 752291 - RNA, 15 nt, Leptospira interrogans serovar lai str. 56601
augcagcuauuuuuu

SEQ ID NO: 752292 - RNA, 19 nt, Leptospira interrogans serovar lai str. 56601
augaucuaagauuuucuuu

SEQ ID NO: 752293 - RNA, 15 nt, Leptospira interrogans serovar lai str. 56601
augaucgauuuuuua

SEQ ID NO: 752294 - RNA, 23 nt, Leptospira interrogans serovar lai str. 56601
augaucgcaaaacgguaauuuca

SEQ ID NO: 752295 - RNA, 19 nt, Leptospira interrogans serovar lai str. 56601
augaucgcguaauauuuca

SEQ ID NO: 752296 - RNA, 21 nt, Leptospira interrogans serovar lai str. 56601
augaucgcguaauauuucaau

SEQ ID NO: 752297 - RNA, 22 nt, Leptospira interrogans serovar lai str. 56601
augcaugaauuuguuuuucuug

SEQ ID NO: 752298 - RNA, 18 nt, Leptospira interrogans serovar lai str. 56601
augcauccaaucaugaau

SEQ ID NO: 752299 - RNA, 20 nt, Leptospira interrogans serovar lai str. 56601
augcaguaaugccuacaaau

SEQ ID NO: 752300 - RNA, 19 nt, Leptospira interrogans serovar lai str. 56601
augcaguaguuccuacaau

SEQ ID NO: 752301 - RNA, 13 nt, Leptospira interrogans serovar lai str. 56601
augcaguauuuug

SEQ ID NO: 752302 - RNA, 20 nt, Leptospira interrogans serovar lai str. 56601
augcaguugugaucagugau

SEQ ID NO: 752303 - RNA, 15 nt, Leptospira interrogans serovar lai str. 56601
auucuagcgucuaaa

SEQ ID NO: 752304 - RNA, 17 nt, Leptospira interrogans serovar lai str. 56601
auucuagcgucuaaaaa

SEQ ID NO: 752305 - RNA, 15 nt, Leptospira interrogans serovar lai str. 56601
auucuagaaagaauu

SEQ ID NO: 752306 - RNA, 23 nt, Leptospira interrogans serovar lai str. 56601
auucuagaaagaauuuaauaaaa

SEQ ID NO: 752307 - RNA, 14 nt, Leptospira interrogans serovar lai str. 56601
auucuagaauauaa

SEQ ID NO: 752308 - RNA, 16 nt, Leptospira interrogans serovar lai str. 56601
auucuaguuuguuuau

SEQ ID NO: 752309 - RNA, 17 nt, Leptospira interrogans serovar lai str. 56601
auucuauaaaauuugaa

SEQ ID NO: 752310 - RNA, 15 nt, Leptospira interrogans serovar lai str. 56601
auucuccaucuauuu

SEQ ID NO: 752311 - RNA, 19 nt, Leptospira interrogans serovar lai str. 56601
auucuccaucuguuucuau

SEQ ID NO: 752312 - RNA, 18 nt, Leptospira interrogans serovar lai str. 56601
auucuccaucuguuuucu

SEQ ID NO: 752313 - RNA, 19 nt, Leptospira interrogans serovar lai str. 56601
auucuccaucuguuuucuu

SEQ ID NO: 752314 - RNA, 13 nt, Leptospira interrogans serovar lai str. 56601
auucuccauucuu

SEQ ID NO: 752315 - RNA, 19 nt, Leptospira interrogans serovar lai str. 56601
auucuccauuuguuucuau

SEQ ID NO: 752316 - RNA, 21 nt, Leptospira interrogans serovar lai str. 56601
auucuccauuuguuucuauuu

SEQ ID NO: 752317 - RNA, 20 nt, Leptospira interrogans serovar lai str. 56601
auucucccccaacugaaaau

SEQ ID NO: 752318 - RNA, 16 nt, Leptospira interrogans serovar lai str. 56601
auucugucguaaaaag

SEQ ID NO: 752319 - RNA, 14 nt, Leptospira interrogans serovar lai str. 56601
auucuguuuuacaa

SEQ ID NO: 752320 - RNA, 18 nt, Leptospira interrogans serovar lai str. 56601
auucuuaaaaaauauuuu

SEQ ID NO: 752321 - RNA, 14 nt, Leptospira interrogans serovar lai str. 56601
auucuuacauuaga

SEQ ID NO: 752322 - RNA, 14 nt, Leptospira interrogans serovar lai str. 56601
auucuuaaaaauuu

SEQ ID NO: 752323 - RNA, 15 nt, Leptospira interrogans serovar lai str. 56601
auucuuaaaaauuua

SEQ ID NO: 752324 - RNA, 13 nt, Leptospira interrogans serovar lai str. 56601
auucuuaaaaugu

SEQ ID NO: 752325 - RNA, 18 nt, Leptospira interrogans serovar lai str. 56601
auucuuaaaaugugggaa

SEQ ID NO: 752326 - RNA, 17 nt, Leptospira interrogans serovar lai str. 56601
auucuuuccaaccauuu

SEQ ID NO: 752327 - RNA, 21 nt, Leptospira interrogans serovar lai str. 56601
auucuuuccaaccauuuaaua

SEQ ID NO: 752328 - RNA, 20 nt, Leptospira interrogans serovar lai str. 56601
auucuuuccaucguuuaaga

SEQ ID NO: 752329 - RNA, 14 nt, Leptospira interrogans serovar lai str. 56601
auucuuuccuuucc

SEQ ID NO: 752330 - RNA, 16 nt, Leptospira interrogans serovar lai str. 56601
auucuuucuauuuuuu

SEQ ID NO: 752331 - RNA, 19 nt, Leptospira interrogans serovar lai str. 56601
auucuuucuauuuuuuccg

SEQ ID NO: 752332 - RNA, 16 nt, Leptospira interrogans serovar lai str. 56601
auucuuugagauuuug

SEQ ID NO: 752333 - RNA, 15 nt, Leptospira interrogans serovar lai str. 56601
auucuuaauagaauc

SEQ ID NO: 752334 - RNA, 17 nt, Leptospira interrogans serovar lai str. 56601
auucuuauguuuuuuau

SEQ ID NO: 752335 - RNA, 17 nt, Leptospira interrogans serovar lai str. 56601
auucuucaaauaacauu

SEQ ID NO: 752336 - RNA, 16 nt, Leptospira interrogans serovar lai str. 56601
auugaaauauuauaaa

SEQ ID NO: 752337 - RNA, 15 nt, Leptospira interrogans serovar lai str. 56601
auugaaaucagaguc

SEQ ID NO: 752338 - RNA, 22 nt, Leptospira interrogans serovar lai str. 56601
auugaaaucugaacuuugcaga

SEQ ID NO: 752339 - RNA, 21 nt, Leptospira interrogans serovar lai str. 56601
auugaaaguaucagaaucaaa

SEQ ID NO: 752340 - RNA, 12 nt, Leptospira interrogans serovar lai str. 56601
auucuuuguuuu

SEQ ID NO: 752341 - RNA, 16 nt, Leptospira interrogans serovar lai str. 56601
auucuuuucugaauaa

SEQ ID NO: 752342 - RNA, 23 nt, Leptospira interrogans serovar lai str. 56601
auucuuuucugaauaaaaauacu

SEQ ID NO: 752343 - RNA, 20 nt, Leptospira interrogans serovar lai str. 56601
auucuuuucccgcuaaaagu

SEQ ID NO: 752344 - RNA, 16 nt, Leptospira interrogans serovar lai str. 56601
auugaauuuuuuaaau

SEQ ID NO: 752345 - RNA, 19 nt, Leptospira interrogans serovar lai str. 56601
auugaauuuuuuaaaugca

SEQ ID NO: 752346 - RNA, 23 nt, Leptospira interrogans serovar lai str. 56601
auugaauuuuuucguaucuaaag

SEQ ID NO: 752347 - RNA, 22 nt, Leptospira interrogans serovar lai str. 56601
auugaauccaucugagaauuuc

SEQ ID NO: 752348 - RNA, 22 nt, Leptospira interrogans serovar lai str. 56601
auugaauccuuccuccaaaaua

SEQ ID NO: 752349 - RNA, 19 nt, Leptospira interrogans serovar lai str. 56601
auugaagcaguuuugcuaa

SEQ ID NO: 752350 - RNA, 17 nt, Leptospira interrogans serovar lai str. 56601
auugaagcaguuuuguc

SEQ ID NO: 752351 - RNA, 17 nt, Leptospira interrogans serovar lai str. 56601
auugaagcaguuuuguu

SEQ ID NO: 752352 - RNA, 19 nt, Leptospira interrogans serovar lai str. 56601
auugaagcaguuuuguuaa

SEQ ID NO: 752353 - RNA, 23 nt, Leptospira interrogans serovar lai str. 56601
auugaacguaaguuaaauauaaa

SEQ ID NO: 752354 - RNA, 13 nt, Leptospira interrogans serovar lai str. 56601
auugaagaaaaaa

SEQ ID NO: 752355 - RNA, 18 nt, Leptospira interrogans serovar lai str. 56601
auugacuuucuguauuuu

SEQ ID NO: 752356 - RNA, 17 nt, Leptospira interrogans serovar lai str. 56601
auugagaaaauaaaaaa

SEQ ID NO: 752357 - RNA, 18 nt, Leptospira interrogans serovar lai str. 56601
auugaguuucacaaaaau

SEQ ID NO: 752358 - RNA, 19 nt, Leptospira interrogans serovar lai str. 56601
auugaguuucacaaaaaua

SEQ ID NO: 752359 - RNA, 17 nt, Leptospira interrogans serovar lai str. 56601
auugaguuucuauaaau

SEQ ID NO: 752360 - RNA, 21 nt, Leptospira interrogans serovar lai str. 56601
auugaguuucuugaacucaau

SEQ ID NO: 752361 - RNA, 17 nt, Leptospira interrogans serovar lai str. 56601
auugagcuaauucuuaa

SEQ ID NO: 752362 - RNA, 18 nt, Leptospira interrogans serovar lai str. 56601
auuccuguaguauuucca

SEQ ID NO: 752363 - RNA, 19 nt, Leptospira interrogans serovar lai str. 56601
auucgaguaguuaauaaau

SEQ ID NO: 752364 - RNA, 12 nt, Leptospira interrogans serovar lai str. 56601
auucgaguccuu

SEQ ID NO: 752365 - RNA, 15 nt, Leptospira interrogans serovar lai str. 56601
auucgaaagauuuuu

SEQ ID NO: 752366 - RNA, 17 nt, Leptospira interrogans serovar lai str. 56601
auucgaaagauuuuuca

SEQ ID NO: 752367 - RNA, 20 nt, Leptospira interrogans serovar lai str. 56601
auucgaucaaguaagaaucc

SEQ ID NO: 752368 - RNA, 17 nt, Leptospira interrogans serovar lai str. 56601
auucgauagaauccaau

SEQ ID NO: 752369 - RNA, 23 nt, Leptospira interrogans serovar lai str. 56601
auucgccguaaaaaauccaugau

SEQ ID NO: 752370 - RNA, 22 nt, Leptospira interrogans serovar lai str. 56601
auucgcccacuucugguuuuuu

SEQ ID NO: 752371 - RNA, 21 nt, Leptospira interrogans serovar lai str. 56601
auucuaaacuacuuccgucuu

SEQ ID NO: 752372 - RNA, 13 nt, Leptospira interrogans serovar lai str. 56601
auucuaaagaagg

SEQ ID NO: 752373 - RNA, 12 nt, Leptospira interrogans serovar lai str. 56601
auucuaaaaaug

SEQ ID NO: 752374 - RNA, 16 nt, Leptospira interrogans serovar lai str. 56601
auucuaaaaaugaaau

SEQ ID NO: 752375 - RNA, 12 nt, Leptospira interrogans serovar lai str. 56601
auucuaaaaauu

SEQ ID NO: 752376 - RNA, 16 nt, Leptospira interrogans serovar lai str. 56601
auucuaaaaauuuuuu

SEQ ID NO: 752377 - RNA, 14 nt, Leptospira interrogans serovar lai str. 56601
auucuaaaaucaua

SEQ ID NO: 752378 - RNA, 14 nt, Leptospira interrogans serovar lai str. 56601
auucuaaaauccua

SEQ ID NO: 752379 - RNA, 18 nt, Leptospira interrogans serovar lai str. 56601
auucuaaaauccuauuca

SEQ ID NO: 752380 - RNA, 12 nt, Leptospira interrogans serovar lai str. 56601
auucuaaaauug

SEQ ID NO: 752381 - RNA, 17 nt, Leptospira interrogans serovar lai str. 56601
auucuaaaauuguagaa

SEQ ID NO: 752382 - RNA, 13 nt, Leptospira interrogans serovar lai str. 56601
auucuaaacaaaa

SEQ ID NO: 752383 - RNA, 20 nt, Leptospira interrogans serovar lai str. 56601
auucguuuuaaugagaaagg

SEQ ID NO: 752384 - RNA, 15 nt, Leptospira interrogans serovar lai str. 56601
auucguuuuuuaaaa

SEQ ID NO: 752385 - RNA, 17 nt, Leptospira interrogans serovar lai str. 56601
auucuacauuugauaua

SEQ ID NO: 752386 - RNA, 13 nt, Leptospira interrogans serovar lai str. 56601
auucuaaauuauu

SEQ ID NO: 752387 - RNA, 13 nt, Leptospira interrogans serovar lai str. 56601
auucuacgaauuu

SEQ ID NO: 752388 - RNA, 14 nt, Leptospira interrogans serovar lai str. 56601
auucggaaauuuua

SEQ ID NO: 752389 - RNA, 17 nt, Leptospira interrogans serovar lai str. 56601
auucggacgauuucuau

SEQ ID NO: 752390 - RNA, 16 nt, Leptospira interrogans serovar lai str. 56601
auucccaguaaaucca

SEQ ID NO: 752391 - RNA, 14 nt, Leptospira interrogans serovar lai str. 56601
auuccccaaaauga

SEQ ID NO: 752392 - RNA, 19 nt, Leptospira interrogans serovar lai str. 56601
auuccaguaggauaauaca

SEQ ID NO: 752393 - RNA, 15 nt, Leptospira interrogans serovar lai str. 56601
auucaguuuuucgga

SEQ ID NO: 752394 - RNA, 18 nt, Leptospira interrogans serovar lai str. 56601
auuccagaggcaguacaa

SEQ ID NO: 752395 - RNA, 18 nt, Leptospira interrogans serovar lai str. 56601
auucauacuuuuaaaaag

SEQ ID NO: 752396 - RNA, 19 nt, Leptospira interrogans serovar lai str. 56601
auucauacuuuuaaaaagu

SEQ ID NO: 752397 - RNA, 17 nt, Leptospira interrogans serovar lai str. 56601
auuccgcaaaaauuccu

SEQ ID NO: 752398 - RNA, 21 nt, Leptospira interrogans serovar lai str. 56601
auuccgcaaaaauuccuuuuu

SEQ ID NO: 752399 - RNA, 13 nt, Leptospira interrogans serovar lai str. 56601
auuccgaaggaau

SEQ ID NO: 752400 - RNA, 14 nt, Leptospira interrogans serovar lai str. 56601
auuccgaaggaauu

SEQ ID NO: 752401 - RNA, 17 nt, Leptospira interrogans serovar lai str. 56601
auuccgacccagaaaaa

SEQ ID NO: 752402 - RNA, 21 nt, Leptospira interrogans serovar lai str. 56601
auucccuuuugaucuuuaaaa

SEQ ID NO: 752403 - RNA, 16 nt, Leptospira interrogans serovar lai str. 56601
auucccuuaaucauuu

SEQ ID NO: 752404 - RNA, 14 nt, Leptospira interrogans serovar lai str. 56601
auugcgagauuuua

SEQ ID NO: 752405 - RNA, 15 nt, Leptospira interrogans serovar lai str. 56601
auugaguuuuccaau

SEQ ID NO: 752406 - RNA, 23 nt, Leptospira interrogans serovar lai str. 56601
auugauaauuuuuguuuguaaaa

SEQ ID NO: 752407 - RNA, 15 nt, Leptospira interrogans serovar lai str. 56601
auugauacugcauca

SEQ ID NO: 752408 - RNA, 22 nt, Leptospira interrogans serovar lai str. 56601
auugcuuuaguaguauuuaaga

SEQ ID NO: 752409 - RNA, 22 nt, Leptospira interrogans serovar lai str. 56601
auugcuuuaucuuuauaaaaau

SEQ ID NO: 752410 - RNA, 14 nt, Leptospira interrogans serovar lai str. 56601
auugcuuuuuaaaa

SEQ ID NO: 752411 - RNA, 16 nt, Leptospira interrogans serovar lai str. 56601
auugcuuuuugagaga

SEQ ID NO: 752412 - RNA, 19 nt, Leptospira interrogans serovar lai str. 56601
auuggaaagaaggauugau

SEQ ID NO: 752413 - RNA, 12 nt, Leptospira interrogans serovar lai str. 56601
auuggaauaucg

SEQ ID NO: 752414 - RNA, 17 nt, Leptospira interrogans serovar lai str. 56601
auuggauaauuccacac

SEQ ID NO: 752415 - RNA, 18 nt, Leptospira interrogans serovar lai str. 56601
auuggacgauuuugagac

SEQ ID NO: 752416 - RNA, 18 nt, Leptospira interrogans serovar lai str. 56601
auuggacgguuuugggac

SEQ ID NO: 752417 - RNA, 21 nt, Leptospira interrogans serovar lai str. 56601
auugggucuacaauaaaggaa

SEQ ID NO: 752418 - RNA, 21 nt, Leptospira interrogans serovar lai str. 56601
aaaaguacauggcauccagga

SEQ ID NO: 752419 - RNA, 19 nt, Leptospira interrogans serovar lai str. 56601
aaaaguacgggcucauaca

SEQ ID NO: 752420 - RNA, 14 nt, Leptospira interrogans serovar lai str. 56601
aaaaguagaaagau

SEQ ID NO: 752421 - RNA, 20 nt, Leptospira interrogans serovar lai str. 56601
auuguauccgaaaaauucca

SEQ ID NO: 752422 - RNA, 20 nt, Leptospira interrogans serovar lai str. 56601
auuguauuuucccgaaagaa

SEQ ID NO: 752423 - RNA, 22 nt, Leptospira interrogans serovar lai str. 56601
auuguauuuucccgaaagaacu

SEQ ID NO: 752424 - RNA, 18 nt, Leptospira interrogans serovar lai str. 56601
aaaaguaacaguuccuaa

SEQ ID NO: 752425 - RNA, 21 nt, Leptospira interrogans serovar lai str. 56601
aaaaguaaaacccaauaccaa

SEQ ID NO: 752426 - RNA, 20 nt, Leptospira interrogans serovar lai str. 56601
aaaaguaacguaaauuuuua

SEQ ID NO: 752427 - RNA, 22 nt, Leptospira interrogans serovar lai str. 56601
aaaaggugaucuuagaaaacca

SEQ ID NO: 752428 - RNA, 13 nt, Leptospira interrogans serovar lai str. 56601
aaaagguuaaaaa

SEQ ID NO: 752429 - RNA, 18 nt, Leptospira interrogans serovar lai str. 56601
aaaagguuaaaaauuuaa

SEQ ID NO: 752430 - RNA, 20 nt, Leptospira interrogans serovar lai str. 56601
auuuaaguuuuucuuaaaaa

SEQ ID NO: 752431 - RNA, 16 nt, Leptospira interrogans serovar lai str. 56601
auuuaauuuagaaauu

SEQ ID NO: 752432 - RNA, 21 nt, Leptospira interrogans serovar lai str. 56601
auuuaagaaucaucuugcucu

SEQ ID NO: 752433 - RNA, 16 nt, Leptospira interrogans serovar lai str. 56601
auuuaagauugauuuu

SEQ ID NO: 752434 - RNA, 15 nt, Leptospira interrogans serovar lai str. 56601
auuuaacgugaguuc

SEQ ID NO: 752435 - RNA, 22 nt, Leptospira interrogans serovar lai str. 56601
auuuaaaaucacaaaaaagaua

SEQ ID NO: 752436 - RNA, 19 nt, Leptospira interrogans serovar lai str. 56601
auuuaaaaucguaaaaaag

SEQ ID NO: 752437 - RNA, 17 nt, Leptospira interrogans serovar lai str. 56601
auuguuuucuaguuuuc

SEQ ID NO: 752438 - RNA, 22 nt, Leptospira interrogans serovar lai str. 56601
auuuaaaaacuaucaguuuuca

SEQ ID NO: 752439 - RNA, 12 nt, Leptospira interrogans serovar lai str. 56601
auuuaaaauacu

SEQ ID NO: 752440 - RNA, 11 nt, Leptospira interrogans serovar lai str. 56601
auuuaaaaagu

SEQ ID NO: 752441 - RNA, 11 nt, Leptospira interrogans serovar lai str. 56601
auuuaaaaaua

SEQ ID NO: 752442 - RNA, 16 nt, Leptospira interrogans serovar lai str. 56601
auuguggagauuuguc

SEQ ID NO: 752443 - RNA, 14 nt, Leptospira interrogans serovar lai str. 56601
auugugaauauuuc

SEQ ID NO: 752444 - RNA, 22 nt, Leptospira interrogans serovar lai str. 56601
auugugagaacuacuuuuauaa

SEQ ID NO: 752445 - RNA, 16 nt, Leptospira interrogans serovar lai str. 56601
auuuacgaaaauuuuu

SEQ ID NO: 752446 - RNA, 19 nt, Leptospira interrogans serovar lai str. 56601
auuuacgauucuaaauuau

SEQ ID NO: 752447 - RNA, 17 nt, Leptospira interrogans serovar lai str. 56601
auuuaccuaaaauucag

SEQ ID NO: 752448 - RNA, 21 nt, Leptospira interrogans serovar lai str. 56601
auuuacuacgucuucuaaauu

SEQ ID NO: 752449 - RNA, 13 nt, Leptospira interrogans serovar lai str. 56601
auuuacuauuuug

SEQ ID NO: 752450 - RNA, 21 nt, Leptospira interrogans serovar lai str. 56601
auuuacuauuuugaugaauga

SEQ ID NO: 752451 - RNA, 18 nt, Leptospira interrogans serovar lai str. 56601
auuuacacgauaauuuuc

SEQ ID NO: 752452 - RNA, 19 nt, Leptospira interrogans serovar lai str. 56601
auuuacauauauaauuuau

SEQ ID NO: 752453 - RNA, 22 nt, Leptospira interrogans serovar lai str. 56601
auuuacaaccacuggaauauaa

SEQ ID NO: 752454 - RNA, 19 nt, Leptospira interrogans serovar lai str. 56601
auuuagagccaaauuuuua

SEQ ID NO: 752455 - RNA, 21 nt, Leptospira interrogans serovar lai str. 56601
auuuagaauuguuaucuguga

SEQ ID NO: 752456 - RNA, 20 nt, Leptospira interrogans serovar lai str. 56601
auuuagaaaauuagaaagaa

SEQ ID NO: 752457 - RNA, 18 nt, Leptospira interrogans serovar lai str. 56601
auuuagaaauuuauacua

SEQ ID NO: 752458 - RNA, 16 nt, Leptospira interrogans serovar lai str. 56601
auuuacuuuuuccaaa

SEQ ID NO: 752459 - RNA, 15 nt, Leptospira interrogans serovar lai str. 56601
auuuagauucuaaaa

SEQ ID NO: 752460 - RNA, 19 nt, Leptospira interrogans serovar lai str. 56601
auuuagauucuaaaaaaag

SEQ ID NO: 752461 - RNA, 17 nt, Leptospira interrogans serovar lai str. 56601
auuuagauuuguguuag

SEQ ID NO: 752462 - RNA, 21 nt, Leptospira interrogans serovar lai str. 56601
auuuagauuuguguuaguucc

SEQ ID NO: 752463 - RNA, 22 nt, Leptospira interrogans serovar lai str. 56601
auuuagauuuguguuaguuccc

SEQ ID NO: 752464 - RNA, 14 nt, Leptospira interrogans serovar lai str. 56601
auuuagaucaaaua

SEQ ID NO: 752465 - RNA, 16 nt, Leptospira interrogans serovar lai str. 56601
auuuaggaaauuuuca

SEQ ID NO: 752466 - RNA, 17 nt, Leptospira interrogans serovar lai str. 56601
auuuaggaaauuuucaa

SEQ ID NO: 752467 - RNA, 13 nt, Leptospira interrogans serovar lai str. 56601
auuuaggaaguaa

SEQ ID NO: 752468 - RNA, 22 nt, Leptospira interrogans serovar lai str. 56601
auuuagccuaauuacgauuuuu

SEQ ID NO: 752469 - RNA, 15 nt, Leptospira interrogans serovar lai str. 56601
auuuagcaauuugug

SEQ ID NO: 752470 - RNA, 17 nt, Leptospira interrogans serovar lai str. 56601
auuuucuuucuaaauga

SEQ ID NO: 752471 - RNA, 13 nt, Leptospira interrogans serovar lai str. 56601
auuuugaaggaaa

SEQ ID NO: 752472 - RNA, 18 nt, Leptospira interrogans serovar lai str. 56601
auuuugaauaaguuuuau

SEQ ID NO: 752473 - RNA, 15 nt, Leptospira interrogans serovar lai str. 56601
auuuugaacauuuuc

SEQ ID NO: 752474 - RNA, 16 nt, Leptospira interrogans serovar lai str. 56601
auuuugaagguugagc

SEQ ID NO: 752475 - RNA, 21 nt, Leptospira interrogans serovar lai str. 56601
auuuucuuuagaaauuuuuaa

SEQ ID NO: 752476 - RNA, 18 nt, Leptospira interrogans serovar lai str. 56601
auuuugaagacuauaaaa

SEQ ID NO: 752477 - RNA, 15 nt, Leptospira interrogans serovar lai str. 56601
auuuugauaauuuca

SEQ ID NO: 752478 - RNA, 10 nt, Leptospira interrogans serovar lai str. 56601
auuuugauuc

SEQ ID NO: 752479 - RNA, 16 nt, Leptospira interrogans serovar lai str. 56601
auuuugaucuaauaau

SEQ ID NO: 752480 - RNA, 18 nt, Leptospira interrogans serovar lai str. 56601
auuuugcacguaaacauu

SEQ ID NO: 752481 - RNA, 17 nt, Leptospira interrogans serovar lai str. 56601
auuuugcacugaaauag

SEQ ID NO: 752482 - RNA, 20 nt, Leptospira interrogans serovar lai str. 56601
auuuugagcagauucuaaaa

SEQ ID NO: 752483 - RNA, 21 nt, Leptospira interrogans serovar lai str. 56601
auuuugagcagauucuaaaaa

SEQ ID NO: 752484 - RNA, 23 nt, Leptospira interrogans serovar lai str. 56601
auuuugaguagccaauugaauau

SEQ ID NO: 752485 - RNA, 15 nt, Leptospira interrogans serovar lai str. 56601
auuuuguaaugaaau

SEQ ID NO: 752486 - RNA, 18 nt, Leptospira interrogans serovar lai str. 56601
auuuuguaaugaaaucua

SEQ ID NO: 752487 - RNA, 21 nt, Leptospira interrogans serovar lai str. 56601
auuuuguauugaaauagaauc

SEQ ID NO: 752488 - RNA, 23 nt, Leptospira interrogans serovar lai str. 56601
auuuuuacacauucauuuuuucu

SEQ ID NO: 752489 - RNA, 19 nt, Leptospira interrogans serovar lai str. 56601
auuuuuacaccaaacucac

SEQ ID NO: 752490 - RNA, 16 nt, Leptospira interrogans serovar lai str. 56601
auuuuuacaaaaaaau

SEQ ID NO: 752491 - RNA, 17 nt, Leptospira interrogans serovar lai str. 56601
auuuuuagaaaauuuuu

SEQ ID NO: 752492 - RNA, 12 nt, Leptospira interrogans serovar lai str. 56601
auuuuuagaaaa

SEQ ID NO: 752493 - RNA, 22 nt, Leptospira interrogans serovar lai str. 56601
auuuuuacgacccaagauuuuu

SEQ ID NO: 752494 - RNA, 20 nt, Leptospira interrogans serovar lai str. 56601
auuuuuacggaucaaaauuc

SEQ ID NO: 752495 - RNA, 16 nt, Leptospira interrogans serovar lai str. 56601
auuuuuacugauuuuc

SEQ ID NO: 752496 - RNA, 13 nt, Leptospira interrogans serovar lai str. 56601
auuuucauuuuau

SEQ ID NO: 752497 - RNA, 18 nt, Leptospira interrogans serovar lai str. 56601
auuuucagguuuuaaaac

SEQ ID NO: 752498 - RNA, 16 nt, Leptospira interrogans serovar lai str. 56601
auuuuccaaaaauuua

SEQ ID NO: 752499 - RNA, 17 nt, Leptospira interrogans serovar lai str. 56601
auuuucagggaaaaaua

SEQ ID NO: 752500 - RNA, 19 nt, Leptospira interrogans serovar lai str. 56601
auuuucagugaauaaaaua

SEQ ID NO: 752501 - RNA, 20 nt, Leptospira interrogans serovar lai str. 56601
auuuucagugaauaaaauaa

SEQ ID NO: 752502 - RNA, 23 nt, Leptospira interrogans serovar lai str. 56601
auuuucagugaauaaaauaaaaa

SEQ ID NO: 752503 - RNA, 19 nt, Leptospira interrogans serovar lai str. 56601
auuuucuuaauaaacuuuc

SEQ ID NO: 752504 - RNA, 23 nt, Leptospira interrogans serovar lai str. 56601
auuuucuuaguuuuguacuuuac

SEQ ID NO: 752505 - RNA, 22 nt, Leptospira interrogans serovar lai str. 56601
auuuuccguaccccaaagauuu

SEQ ID NO: 752506 - RNA, 11 nt, Leptospira interrogans serovar lai str. 56601
auuuuccuucg

SEQ ID NO: 752507 - RNA, 13 nt, Leptospira interrogans serovar lai str. 56601
auuuucucaguaa

SEQ ID NO: 752508 - RNA, 16 nt, Leptospira interrogans serovar lai str. 56601
auuuuaugaauaaaaa

SEQ ID NO: 752509 - RNA, 20 nt, Leptospira interrogans serovar lai str. 56601
auuuuaaauuagcuuaagaa

SEQ ID NO: 752510 - RNA, 13 nt, Leptospira interrogans serovar lai str. 56601
auuuuaaauaaaa

SEQ ID NO: 752511 - RNA, 15 nt, Leptospira interrogans serovar lai str. 56601
auuuuaaauauuaau

SEQ ID NO: 752512 - RNA, 19 nt, Leptospira interrogans serovar lai str. 56601
auuuuaaauauuaauuaua

SEQ ID NO: 752513 - RNA, 18 nt, Leptospira interrogans serovar lai str. 56601
auuuuaaauaaaaagaag

SEQ ID NO: 752514 - RNA, 17 nt, Leptospira interrogans serovar lai str. 56601
auuuuaaaguuuugaaa

SEQ ID NO: 752515 - RNA, 23 nt, Leptospira interrogans serovar lai str. 56601
auuuguuguaucgaacucacguu

SEQ ID NO: 752516 - RNA, 18 nt, Leptospira interrogans serovar lai str. 56601
auuuucagaaaaaugaau

SEQ ID NO: 752517 - RNA, 16 nt, Leptospira interrogans serovar lai str. 56601
auuuuauuuauauaua

SEQ ID NO: 752518 - RNA, 20 nt, Leptospira interrogans serovar lai str. 56601
auuuuauucacugaaaauuu

SEQ ID NO: 752519 - RNA, 12 nt, Leptospira interrogans serovar lai str. 56601
auuuuauuaaaa

SEQ ID NO: 752520 - RNA, 19 nt, Leptospira interrogans serovar lai str. 56601
auuuuauuaaaaauuuuua

SEQ ID NO: 752521 - RNA, 17 nt, Leptospira interrogans serovar lai str. 56601
auuuuauuaaagaauua

SEQ ID NO: 752522 - RNA, 17 nt, Leptospira interrogans serovar lai str. 56601
auuuuauuauauaacca

SEQ ID NO: 752523 - RNA, 15 nt, Leptospira interrogans serovar lai str. 56601
auuuuaugauuuucu

SEQ ID NO: 752524 - RNA, 13 nt, Leptospira interrogans serovar lai str. 56601
auuuuuuuaaaaa

SEQ ID NO: 752525 - RNA, 22 nt, Leptospira interrogans serovar lai str. 56601
auuuuuuguaugaguuccuaca

SEQ ID NO: 752526 - RNA, 17 nt, Leptospira interrogans serovar lai str. 56601
auuuuuugucuuuaaaa

SEQ ID NO: 752527 - RNA, 18 nt, Leptospira interrogans serovar lai str. 56601
auuuuuugucuuuaaaau

SEQ ID NO: 752528 - RNA, 15 nt, Leptospira interrogans serovar lai str. 56601
auuuuuuuagaauca

SEQ ID NO: 752529 - RNA, 23 nt, Leptospira interrogans serovar lai str. 56601
auuuuuuucgaauugaguuuuug

SEQ ID NO: 752530 - RNA, 17 nt, Leptospira interrogans serovar lai str. 56601
auuuuuuuguaaaaaaa

SEQ ID NO: 752531 - RNA, 17 nt, Leptospira interrogans serovar lai str. 56601
auuuuuuuguauauaaa

SEQ ID NO: 752532 - RNA, 22 nt, Leptospira interrogans serovar lai str. 56601
caaaaaacucagcgaaaauacu

SEQ ID NO: 752533 - RNA, 14 nt, Leptospira interrogans serovar lai str. 56601
caaaaaauuuuuac

SEQ ID NO: 752534 - RNA, 17 nt, Leptospira interrogans serovar lai str. 56601
caaaaaagauaaaaaga

SEQ ID NO: 752535 - RNA, 15 nt, Leptospira interrogans serovar lai str. 56601
caaaaaagaaagcag

SEQ ID NO: 752536 - RNA, 22 nt, Leptospira interrogans serovar lai str. 56601
caaaaaagaaagcagcaaagaa

SEQ ID NO: 752537 - RNA, 23 nt, Leptospira interrogans serovar lai str. 56601
auuuuuauguaauauuucuuucg

SEQ ID NO: 752538 - RNA, 16 nt, Leptospira interrogans serovar lai str. 56601
auuuuuauguauuuua

SEQ ID NO: 752539 - RNA, 18 nt, Leptospira interrogans serovar lai str. 56601
auuuuuaucauaaaacac

SEQ ID NO: 752540 - RNA, 20 nt, Leptospira interrogans serovar lai str. 56601
auuuuuagucauuuccucca

SEQ ID NO: 752541 - RNA, 18 nt, Leptospira interrogans serovar lai str. 56601
auuuuuaguuuuaauaua

SEQ ID NO: 752542 - RNA, 15 nt, Leptospira interrogans serovar lai str. 56601
auuuuuauaaaaaua

SEQ ID NO: 752543 - RNA, 16 nt, Leptospira interrogans serovar lai str. 56601
auuuuuauaaaauacc

SEQ ID NO: 752544 - RNA, 18 nt, Leptospira interrogans serovar lai str. 56601
auuuuuauaaagauaaau

SEQ ID NO: 752545 - RNA, 19 nt, Leptospira interrogans serovar lai str. 56601
auuuuuauaauuuagaguu

SEQ ID NO: 752546 - RNA, 17 nt, Leptospira interrogans serovar lai str. 56601
auuuuuauuggaaaaag

SEQ ID NO: 752547 - RNA, 18 nt, Leptospira interrogans serovar lai str. 56601
auuuuuuaaaugugggaa

SEQ ID NO: 752548 - RNA, 22 nt, Leptospira interrogans serovar lai str. 56601
auuuuuuaaauuuaucuauaaa

SEQ ID NO: 752549 - RNA, 13 nt, Leptospira interrogans serovar lai str. 56601
auuuuuuaaaaua

SEQ ID NO: 752550 - RNA, 11 nt, Leptospira interrogans serovar lai str. 56601
auuuuuuaaac

SEQ ID NO: 752551 - RNA, 23 nt, Leptospira interrogans serovar lai str. 56601
auuuuuuaaacuuuguuuuugcu

SEQ ID NO: 752552 - RNA, 20 nt, Leptospira interrogans serovar lai str. 56601
auuuuuguguaaaauuacac

SEQ ID NO: 752553 - RNA, 21 nt, Leptospira interrogans serovar lai str. 56601
auuuuuguuaaacaacgugaa

SEQ ID NO: 752554 - RNA, 22 nt, Leptospira interrogans serovar lai str. 56601
auuuuuguuuguaaaauuuaaa

SEQ ID NO: 752555 - RNA, 13 nt, Leptospira interrogans serovar lai str. 56601
auuuuuuaaaaaa

SEQ ID NO: 752556 - RNA, 23 nt, Leptospira interrogans serovar lai str. 56601
auuuuuuaaaaauauaaaucaau

SEQ ID NO: 752557 - RNA, 17 nt, Leptospira interrogans serovar lai str. 56601
auuuuuuaaaaauuuua

SEQ ID NO: 752558 - RNA, 19 nt, Leptospira interrogans serovar lai str. 56601
auuuuuuggaaaucgaaaa

SEQ ID NO: 752559 - RNA, 23 nt, Leptospira interrogans serovar lai str. 56601
auuuuuugcaaaaaaauaaaaug

SEQ ID NO: 752560 - RNA, 15 nt, Leptospira interrogans serovar lai str. 56601
auuuuuuaaucaaug

SEQ ID NO: 752561 - RNA, 15 nt, Leptospira interrogans serovar lai str. 56601
auuuuuuaauaacuc

SEQ ID NO: 752562 - RNA, 14 nt, Leptospira interrogans serovar lai str. 56601
caaaaacacuuuau

SEQ ID NO: 752563 - RNA, 15 nt, Leptospira interrogans serovar lai str. 56601
caaaaauagaauuuu

SEQ ID NO: 752564 - RNA, 19 nt, Leptospira interrogans serovar lai str. 56601
caaaaauagggaaaacuca

SEQ ID NO: 752565 - RNA, 13 nt, Leptospira interrogans serovar lai str. 56601
caaaaauauauua

SEQ ID NO: 752566 - RNA, 17 nt, Leptospira interrogans serovar lai str. 56601
caaaaauaucuuagaau

SEQ ID NO: 752567 - RNA, 23 nt, Leptospira interrogans serovar lai str. 56601
caaaaaguguuuauaauuuuuac

SEQ ID NO: 752568 - RNA, 21 nt, Leptospira interrogans serovar lai str. 56601
caaaaaguuuuauaaacgauu

SEQ ID NO: 752569 - RNA, 15 nt, Leptospira interrogans serovar lai str. 56601
caaaaauaaaguauu

SEQ ID NO: 752570 - RNA, 19 nt, Leptospira interrogans serovar lai str. 56601
caaaaauaaaguauuuuua

SEQ ID NO: 752571 - RNA, 21 nt, Leptospira interrogans serovar lai str. 56601
caaaaauaaaguauuuuuaag

SEQ ID NO: 752572 - RNA, 19 nt, Leptospira interrogans serovar lai str. 56601
caaaacaauagcuucuuua

SEQ ID NO: 752573 - RNA, 16 nt, Leptospira interrogans serovar lai str. 56601
caaaaauuuucuaaaa

SEQ ID NO: 752574 - RNA, 15 nt, Leptospira interrogans serovar lai str. 56601
caaaaauuuaaaaau

SEQ ID NO: 752575 - RNA, 16 nt, Leptospira interrogans serovar lai str. 56601
caaaaauuuaaaaauu

SEQ ID NO: 752576 - RNA, 16 nt, Leptospira interrogans serovar lai str. 56601
caaaaauuuaauaaca

SEQ ID NO: 752577 - RNA, 14 nt, Leptospira interrogans serovar lai str. 56601
caaaaauucuaaua

SEQ ID NO: 752578 - RNA, 22 nt, Leptospira interrogans serovar lai str. 56601
caaaaauguauccaauccaaaa

SEQ ID NO: 752579 - RNA, 21 nt, Leptospira interrogans serovar lai str. 56601
caaaaaugugggaacuauaau

SEQ ID NO: 752580 - RNA, 15 nt, Leptospira interrogans serovar lai str. 56601
caaaaauuauaaauc

SEQ ID NO: 752581 - RNA, 22 nt, Leptospira interrogans serovar lai str. 56601
caaaaauuauaaaucauacaau

SEQ ID NO: 752582 - RNA, 16 nt, Leptospira interrogans serovar lai str. 56601
caaaaaugaaaaaacu

SEQ ID NO: 752583 - RNA, 21 nt, Leptospira interrogans serovar lai str. 56601
caaaaaugaaaaaacuuuuua

SEQ ID NO: 752584 - RNA, 18 nt, Leptospira interrogans serovar lai str. 56601
auuugcggggaguuccca

SEQ ID NO: 752585 - RNA, 20 nt, Leptospira interrogans serovar lai str. 56601
auuugauuccaagauuuuuu

SEQ ID NO: 752586 - RNA, 16 nt, Leptospira interrogans serovar lai str. 56601
auuugauuaaaaauuu

SEQ ID NO: 752587 - RNA, 14 nt, Leptospira interrogans serovar lai str. 56601
auuugauuagaaaa

SEQ ID NO: 752588 - RNA, 15 nt, Leptospira interrogans serovar lai str. 56601
auuugauuagaaaaa

SEQ ID NO: 752589 - RNA, 16 nt, Leptospira interrogans serovar lai str. 56601
auuugauuagaaaaaa

SEQ ID NO: 752590 - RNA, 19 nt, Leptospira interrogans serovar lai str. 56601
auuugcauaggugauuaaa

SEQ ID NO: 752591 - RNA, 17 nt, Leptospira interrogans serovar lai str. 56601
auuugcaucgacaaaac

SEQ ID NO: 752592 - RNA, 15 nt, Leptospira interrogans serovar lai str. 56601
auuucuuucaaaaau

SEQ ID NO: 752593 - RNA, 19 nt, Leptospira interrogans serovar lai str. 56601
auuucuuucucucgaaaua

SEQ ID NO: 752594 - RNA, 15 nt, Leptospira interrogans serovar lai str. 56601
auuugaauauaauaa

SEQ ID NO: 752595 - RNA, 13 nt, Leptospira interrogans serovar lai str. 56601
auuugaauuuuuu

SEQ ID NO: 752596 - RNA, 17 nt, Leptospira interrogans serovar lai str. 56601
auuugacaauuugugaa

SEQ ID NO: 752597 - RNA, 21 nt, Leptospira interrogans serovar lai str. 56601
auuugaauuuaagaucuuuau

SEQ ID NO: 752598 - RNA, 16 nt, Leptospira interrogans serovar lai str. 56601
auuuggauuuauguuc

SEQ ID NO: 752599 - RNA, 23 nt, Leptospira interrogans serovar lai str. 56601
auuugcucuuaauggaucaaaag

SEQ ID NO: 752600 - RNA, 14 nt, Leptospira interrogans serovar lai str. 56601
auuuguaaauaaac

SEQ ID NO: 752601 - RNA, 18 nt, Leptospira interrogans serovar lai str. 56601
auuuguaagaguuccaca

SEQ ID NO: 752602 - RNA, 23 nt, Leptospira interrogans serovar lai str. 56601
auuuguaagaacacugcauuuua

SEQ ID NO: 752603 - RNA, 14 nt, Leptospira interrogans serovar lai str. 56601
auuuguaauaguuc

SEQ ID NO: 752604 - RNA, 19 nt, Leptospira interrogans serovar lai str. 56601
auuuggaucgguuuuagaa

SEQ ID NO: 752605 - RNA, 17 nt, Leptospira interrogans serovar lai str. 56601
auuuguaggaacuacug

SEQ ID NO: 752606 - RNA, 17 nt, Leptospira interrogans serovar lai str. 56601
auuuguaggaauuacua

SEQ ID NO: 752607 - RNA, 16 nt, Leptospira interrogans serovar lai str. 56601
auuuguagagauugau

SEQ ID NO: 752608 - RNA, 21 nt, Leptospira interrogans serovar lai str. 56601
auuuguagagauugauauuca

SEQ ID NO: 752609 - RNA, 22 nt, Leptospira interrogans serovar lai str. 56601
auuuguaauucugucuuuugaa

SEQ ID NO: 752610 - RNA, 17 nt, Leptospira interrogans serovar lai str. 56601
auuuguugaaaagugag

SEQ ID NO: 752611 - RNA, 14 nt, Leptospira interrogans serovar lai str. 56601
auuuguugauuuuu

SEQ ID NO: 752612 - RNA, 20 nt, Leptospira interrogans serovar lai str. 56601
auuuguugcaauacauucuu

SEQ ID NO: 752613 - RNA, 22 nt, Leptospira interrogans serovar lai str. 56601
auuuguugcaauacauucuuau

SEQ ID NO: 752614 - RNA, 15 nt, Leptospira interrogans serovar lai str. 56601
auuuguuaauuuuua

SEQ ID NO: 752615 - RNA, 21 nt, Leptospira interrogans serovar lai str. 56601
auuuguguuaguucccacauu

SEQ ID NO: 752616 - RNA, 17 nt, Leptospira interrogans serovar lai str. 56601
auuugugcaaaaauuuu

SEQ ID NO: 752617 - RNA, 20 nt, Leptospira interrogans serovar lai str. 56601
auuugugcaaaaauuuuuua

SEQ ID NO: 752618 - RNA, 17 nt, Leptospira interrogans serovar lai str. 56601
auuugugguaguuccua

SEQ ID NO: 752619 - RNA, 16 nt, Leptospira interrogans serovar lai str. 56601
auuugucucaaaauuu

SEQ ID NO: 752620 - RNA, 13 nt, Leptospira interrogans serovar lai str. 56601
auuucaaauuuau

SEQ ID NO: 752621 - RNA, 17 nt, Leptospira interrogans serovar lai str. 56601
auuuauaaaauaaaaaa

SEQ ID NO: 752622 - RNA, 16 nt, Leptospira interrogans serovar lai str. 56601
auuucaacuuuuuuca

SEQ ID NO: 752623 - RNA, 23 nt, Leptospira interrogans serovar lai str. 56601
auuucaacuuuuuucagaaaaag

SEQ ID NO: 752624 - RNA, 23 nt, Leptospira interrogans serovar lai str. 56601
auuucaaguuuucuuuuuuucuc

SEQ ID NO: 752625 - RNA, 13 nt, Leptospira interrogans serovar lai str. 56601
auuucaauacaac

SEQ ID NO: 752626 - RNA, 13 nt, Leptospira interrogans serovar lai str. 56601
auuucaauacaau

SEQ ID NO: 752627 - RNA, 22 nt, Leptospira interrogans serovar lai str. 56601
auuuauaaaacaaucuucaaau

SEQ ID NO: 752628 - RNA, 21 nt, Leptospira interrogans serovar lai str. 56601
auuuagguuguaacucaaaau

SEQ ID NO: 752629 - RNA, 22 nt, Leptospira interrogans serovar lai str. 56601
auuuagguuugugguaguuccc

SEQ ID NO: 752630 - RNA, 15 nt, Leptospira interrogans serovar lai str. 56601
auuuaguaguaaaua

SEQ ID NO: 752631 - RNA, 17 nt, Leptospira interrogans serovar lai str. 56601
auuuaguaguaaauaaa

SEQ ID NO: 752632 - RNA, 14 nt, Leptospira interrogans serovar lai str. 56601
auuucaguucugag

SEQ ID NO: 752633 - RNA, 16 nt, Leptospira interrogans serovar lai str. 56601
auuucauaaaauucuu

SEQ ID NO: 752634 - RNA, 17 nt, Leptospira interrogans serovar lai str. 56601
auuucauuauuagaguu

SEQ ID NO: 752635 - RNA, 15 nt, Leptospira interrogans serovar lai str. 56601
auuucaugcaaaaau

SEQ ID NO: 752636 - RNA, 18 nt, Leptospira interrogans serovar lai str. 56601
auuucaugcaaaaauuua

SEQ ID NO: 752637 - RNA, 19 nt, Leptospira interrogans serovar lai str. 56601
auuucaugcaaaaauuuaa

SEQ ID NO: 752638 - RNA, 20 nt, Leptospira interrogans serovar lai str. 56601
auuucaugcaaaaauuuaau

SEQ ID NO: 752639 - RNA, 15 nt, Leptospira interrogans serovar lai str. 56601
auuucuauauucaaa

SEQ ID NO: 752640 - RNA, 22 nt, Leptospira interrogans serovar lai str. 56601
auuucuauauucaaaaaaugga

SEQ ID NO: 752641 - RNA, 12 nt, Leptospira interrogans serovar lai str. 56601
auuucuauuuuu

SEQ ID NO: 752642 - RNA, 14 nt, Leptospira interrogans serovar lai str. 56601
auuucuauuuuucg

SEQ ID NO: 752643 - RNA, 14 nt, Leptospira interrogans serovar lai str. 56601
auuucuaguuuaaa

SEQ ID NO: 752644 - RNA, 14 nt, Leptospira interrogans serovar lai str. 56601
auuucuaguuugaa

SEQ ID NO: 752645 - RNA, 17 nt, Leptospira interrogans serovar lai str. 56601
auuucuauaaaauugag

SEQ ID NO: 752646 - RNA, 21 nt, Leptospira interrogans serovar lai str. 56601
auuuccuuuucgacuauuucu

SEQ ID NO: 752647 - RNA, 24 nt, Leptospira interrogans serovar lai str. 56601
auuuccuuuucgacuauuucuucc

SEQ ID NO: 752648 - RNA, 20 nt, Leptospira interrogans serovar lai str. 56601
auuuccuuuuguuuuucuuu

SEQ ID NO: 752649 - RNA, 18 nt, Leptospira interrogans serovar lai str. 56601
auuucgaaaacgauuuuu

SEQ ID NO: 752650 - RNA, 13 nt, Leptospira interrogans serovar lai str. 56601
auuucuaauagau

SEQ ID NO: 752651 - RNA, 21 nt, Leptospira interrogans serovar lai str. 56601
auuucuaauaguugaaauuca

SEQ ID NO: 752652 - RNA, 20 nt, Leptospira interrogans serovar lai str. 56601
auuucuaauauuaaaaacac

SEQ ID NO: 752653 - RNA, 21 nt, Leptospira interrogans serovar lai str. 56601
auuucuaauauucaaauuuua

SEQ ID NO: 752654 - RNA, 13 nt, Leptospira interrogans serovar lai str. 56601
auuuccuaaaagu

SEQ ID NO: 752655 - RNA, 19 nt, Leptospira interrogans serovar lai str. 56601
auuuccguuauauuaaaau

SEQ ID NO: 752656 - RNA, 22 nt, Leptospira interrogans serovar lai str. 56601
auuuccguuauauuaaaaugua

SEQ ID NO: 752657 - RNA, 14 nt, Leptospira interrogans serovar lai str. 56601
auuucauugaaaua

SEQ ID NO: 752658 - RNA, 12 nt, Leptospira interrogans serovar lai str. 56601
auuucauuuuac

SEQ ID NO: 752659 - RNA, 15 nt, Leptospira interrogans serovar lai str. 56601
auuuccaaauuguau

SEQ ID NO: 752660 - RNA, 19 nt, Leptospira interrogans serovar lai str. 56601
auuuccaacuguuuauaua

SEQ ID NO: 752661 - RNA, 15 nt, Leptospira interrogans serovar lai str. 56601
auuuccaaacucaau

SEQ ID NO: 752662 - RNA, 18 nt, Leptospira interrogans serovar lai str. 56601
auuuccacuacaaucacu

SEQ ID NO: 752663 - RNA, 13 nt, Leptospira interrogans serovar lai str. 56601
auuuccacauucc

SEQ ID NO: 752664 - RNA, 21 nt, Leptospira interrogans serovar lai str. 56601
aaaauauagugguuuguaaua

SEQ ID NO: 752665 - RNA, 23 nt, Leptospira interrogans serovar lai str. 56601
cacgaucauucuuuagaaauuuu

SEQ ID NO: 752666 - RNA, 21 nt, Leptospira interrogans serovar lai str. 56601
caccuuuuuuuaugaaaaaau

SEQ ID NO: 752667 - RNA, 23 nt, Leptospira interrogans serovar lai str. 56601
cacgauaauuuuuagaaauuuuu

SEQ ID NO: 752668 - RNA, 14 nt, Leptospira interrogans serovar lai str. 56601
cacgacgucuauga

SEQ ID NO: 752669 - RNA, 18 nt, Leptospira interrogans serovar lai str. 56601
caccuuccaaagauuuua

SEQ ID NO: 752670 - RNA, 13 nt, Leptospira interrogans serovar lai str. 56601
aaaauaagaaaau

SEQ ID NO: 752671 - RNA, 15 nt, Leptospira interrogans serovar lai str. 56601
aaaauaauauuauaa

SEQ ID NO: 752672 - RNA, 19 nt, Leptospira interrogans serovar lai str. 56601
aaaauaauacaauucugaa

SEQ ID NO: 752673 - RNA, 13 nt, Leptospira interrogans serovar lai str. 56601
aaaauaauaccaa

SEQ ID NO: 752674 - RNA, 13 nt, Leptospira interrogans serovar lai str. 56601
aaaauaauacuac

SEQ ID NO: 752675 - RNA, 13 nt, Leptospira interrogans serovar lai str. 56601
aaaauaauaauau

SEQ ID NO: 752676 - RNA, 22 nt, Leptospira interrogans serovar lai str. 56601
aaaauaacgauacuuaaaaaua

SEQ ID NO: 752677 - RNA, 19 nt, Leptospira interrogans serovar lai str. 56601
aaaauaagguuuuauaaaa

SEQ ID NO: 752678 - RNA, 19 nt, Leptospira interrogans serovar lai str. 56601
caccucuauggaauuuuuu

SEQ ID NO: 752679 - RNA, 23 nt, Leptospira interrogans serovar lai str. 56601
cacccaaagucgcccaaacccca

SEQ ID NO: 752680 - RNA, 24 nt, Leptospira interrogans serovar lai str. 56601
caccgcaagaaccguaacugacau

SEQ ID NO: 752681 - RNA, 14 nt, Leptospira interrogans serovar lai str. 56601
aaaaguuuauaaac

SEQ ID NO: 752682 - RNA, 22 nt, Leptospira interrogans serovar lai str. 56601
aaaaguugggaucugaauuuua

SEQ ID NO: 752683 - RNA, 18 nt, Leptospira interrogans serovar lai str. 56601
aaaaguugcuaagaaaaa

SEQ ID NO: 752684 - RNA, 21 nt, Leptospira interrogans serovar lai str. 56601
aaaaguuggaaucuaaacuuu

SEQ ID NO: 752685 - RNA, 17 nt, Leptospira interrogans serovar lai str. 56601
aaaaguuggaauuugaa

SEQ ID NO: 752686 - RNA, 14 nt, Leptospira interrogans serovar lai str. 56601
aaaaguuagaaucu

SEQ ID NO: 752687 - RNA, 15 nt, Leptospira interrogans serovar lai str. 56601
aaaaguuagaaucua

SEQ ID NO: 752688 - RNA, 16 nt, Leptospira interrogans serovar lai str. 56601
aaaaguuuucucaaaa

SEQ ID NO: 752689 - RNA, 18 nt, Leptospira interrogans serovar lai str. 56601
aaaaguuuucucaaaauc

SEQ ID NO: 752690 - RNA, 22 nt, Leptospira interrogans serovar lai str. 56601
aaaaguuuucucaaaaucuuaa

SEQ ID NO: 752691 - RNA, 14 nt, Leptospira interrogans serovar lai str. 56601
aaaaguuuuuaaaa

SEQ ID NO: 752692 - RNA, 14 nt, Leptospira interrogans serovar lai str. 56601
aaaaguuuuucuaa

SEQ ID NO: 752693 - RNA, 21 nt, Leptospira interrogans serovar lai str. 56601
aaaaguuuuucuaaauuuuau

SEQ ID NO: 752694 - RNA, 12 nt, Leptospira interrogans serovar lai str. 56601
aaaauaaaaaaa

SEQ ID NO: 752695 - RNA, 12 nt, Leptospira interrogans serovar lai str. 56601
aaaauaaaaaau

SEQ ID NO: 752696 - RNA, 15 nt, Leptospira interrogans serovar lai str. 56601
aaaaguuuucaaaaa

SEQ ID NO: 752697 - RNA, 18 nt, Leptospira interrogans serovar lai str. 56601
aaaaguuuucaaaaaugu

SEQ ID NO: 752698 - RNA, 18 nt, Leptospira interrogans serovar lai str. 56601
aaaaguuuguuuguaaag

SEQ ID NO: 752699 - RNA, 22 nt, Leptospira interrogans serovar lai str. 56601
aaaaguuuguuuguaaagcaac

SEQ ID NO: 752700 - RNA, 13 nt, Leptospira interrogans serovar lai str. 56601
aaaaguuuuacaa

SEQ ID NO: 752701 - RNA, 13 nt, Leptospira interrogans serovar lai str. 56601
aaaaguuuuauaa

SEQ ID NO: 752702 - RNA, 19 nt, Leptospira interrogans serovar lai str. 56601
cacauaaaguuaauacaaa

SEQ ID NO: 752703 - RNA, 17 nt, Leptospira interrogans serovar lai str. 56601
cacaucguaucuugaau

SEQ ID NO: 752704 - RNA, 22 nt, Leptospira interrogans serovar lai str. 56601
cacaucguuaccagcaagcaca

SEQ ID NO: 752705 - RNA, 17 nt, Leptospira interrogans serovar lai str. 56601
cacaucuuauuuuuaca

SEQ ID NO: 752706 - RNA, 18 nt, Leptospira interrogans serovar lai str. 56601
cacaugauucugaaaaaa

SEQ ID NO: 752707 - RNA, 14 nt, Leptospira interrogans serovar lai str. 56601
cacauuuaaauuaa

SEQ ID NO: 752708 - RNA, 22 nt, Leptospira interrogans serovar lai str. 56601
cacacccuugaccucauaucaa

SEQ ID NO: 752709 - RNA, 15 nt, Leptospira interrogans serovar lai str. 56601
cacaauuuacaacca

SEQ ID NO: 752710 - RNA, 13 nt, Leptospira interrogans serovar lai str. 56601
cacaaaucuaaau

SEQ ID NO: 752711 - RNA, 21 nt, Leptospira interrogans serovar lai str. 56601
cacaaauuaggucacauuuga

SEQ ID NO: 752712 - RNA, 18 nt, Leptospira interrogans serovar lai str. 56601
cacaaauuccaauuuuuc

SEQ ID NO: 752713 - RNA, 19 nt, Leptospira interrogans serovar lai str. 56601
cacaaauuccaauuuuucu

SEQ ID NO: 752714 - RNA, 18 nt, Leptospira interrogans serovar lai str. 56601
cacaaauucuaaaguugu

SEQ ID NO: 752715 - RNA, 12 nt, Leptospira interrogans serovar lai str. 56601
cacaaauuguca

SEQ ID NO: 752716 - RNA, 15 nt, Leptospira interrogans serovar lai str. 56601
cacaaaucauggauu

SEQ ID NO: 752717 - RNA, 14 nt, Leptospira interrogans serovar lai str. 56601
cacaaauuuuauau

SEQ ID NO: 752718 - RNA, 13 nt, Leptospira interrogans serovar lai str. 56601
cacagacuucuuu

SEQ ID NO: 752719 - RNA, 14 nt, Leptospira interrogans serovar lai str. 56601
cacagacuucuuuu

SEQ ID NO: 752720 - RNA, 21 nt, Leptospira interrogans serovar lai str. 56601
cacagaguacauacugacaga

SEQ ID NO: 752721 - RNA, 21 nt, Leptospira interrogans serovar lai str. 56601
caauuaaauuguaugaaagaa

SEQ ID NO: 752722 - RNA, 11 nt, Leptospira interrogans serovar lai str. 56601
caauuaacaaa

SEQ ID NO: 752723 - RNA, 14 nt, Leptospira interrogans serovar lai str. 56601
caauuaacaaaacu

SEQ ID NO: 752724 - RNA, 17 nt, Leptospira interrogans serovar lai str. 56601
caauuaacaaaacuacu

SEQ ID NO: 752725 - RNA, 19 nt, Leptospira interrogans serovar lai str. 56601
caauuaaacuucaaaaaau

SEQ ID NO: 752726 - RNA, 19 nt, Leptospira interrogans serovar lai str. 56601
caauucaguaaauuaugga

SEQ ID NO: 752727 - RNA, 23 nt, Leptospira interrogans serovar lai str. 56601
caauugaaaguaucagaaucaaa

SEQ ID NO: 752728 - RNA, 16 nt, Leptospira interrogans serovar lai str. 56601
caauucuuuaaaugug

SEQ ID NO: 752729 - RNA, 22 nt, Leptospira interrogans serovar lai str. 56601
caauugauugcuuuuugagaga

SEQ ID NO: 752730 - RNA, 17 nt, Leptospira interrogans serovar lai str. 56601
caauugauuuaaaaacc

SEQ ID NO: 752731 - RNA, 14 nt, Leptospira interrogans serovar lai str. 56601
caauugacuuucug

SEQ ID NO: 752732 - RNA, 16 nt, Leptospira interrogans serovar lai str. 56601
caauugaauauaaaau

SEQ ID NO: 752733 - RNA, 17 nt, Leptospira interrogans serovar lai str. 56601
caauugaauauaaaauu

SEQ ID NO: 752734 - RNA, 22 nt, Leptospira interrogans serovar lai str. 56601
caauugaauauaaaauuuuuau

SEQ ID NO: 752735 - RNA, 14 nt, Leptospira interrogans serovar lai str. 56601
caauuauauuaaau

SEQ ID NO: 752736 - RNA, 16 nt, Leptospira interrogans serovar lai str. 56601
caauuauaaaauuuuu

SEQ ID NO: 752737 - RNA, 16 nt, Leptospira interrogans serovar lai str. 56601
caauuuuuugaaaaag

SEQ ID NO: 752738 - RNA, 16 nt, Leptospira interrogans serovar lai str. 56601
caauuuuuuuguaaaa

SEQ ID NO: 752739 - RNA, 20 nt, Leptospira interrogans serovar lai str. 56601
caauuuuuuuguaaaaaaau

SEQ ID NO: 752740 - RNA, 13 nt, Leptospira interrogans serovar lai str. 56601
caauuuuuauaaa

SEQ ID NO: 752741 - RNA, 16 nt, Leptospira interrogans serovar lai str. 56601
caauuuuuauaaacuu

SEQ ID NO: 752742 - RNA, 11 nt, Leptospira interrogans serovar lai str. 56601
cacaaaaaaau

SEQ ID NO: 752743 - RNA, 14 nt, Leptospira interrogans serovar lai str. 56601
cacaaaaaaauuca

SEQ ID NO: 752744 - RNA, 20 nt, Leptospira interrogans serovar lai str. 56601
cacaaaaaaauucauaauaa

SEQ ID NO: 752745 - RNA, 14 nt, Leptospira interrogans serovar lai str. 56601
cacaaaaacaaauu

SEQ ID NO: 752746 - RNA, 14 nt, Leptospira interrogans serovar lai str. 56601
caauuuuagaauuu

SEQ ID NO: 752747 - RNA, 16 nt, Leptospira interrogans serovar lai str. 56601
caauuuuaguaaacua

SEQ ID NO: 752748 - RNA, 14 nt, Leptospira interrogans serovar lai str. 56601
caauuuuccagauc

SEQ ID NO: 752749 - RNA, 17 nt, Leptospira interrogans serovar lai str. 56601
caauuuuccauuucaau

SEQ ID NO: 752750 - RNA, 19 nt, Leptospira interrogans serovar lai str. 56601
caauuuguuccuaaaaaau

SEQ ID NO: 752751 - RNA, 14 nt, Leptospira interrogans serovar lai str. 56601
caauuuuauuucua

SEQ ID NO: 752752 - RNA, 21 nt, Leptospira interrogans serovar lai str. 56601
caauuuugagaccuuaaguuu

SEQ ID NO: 752753 - RNA, 12 nt, Leptospira interrogans serovar lai str. 56601
caauuuuggaaa

SEQ ID NO: 752754 - RNA, 14 nt, Leptospira interrogans serovar lai str. 56601
caauuguuggcuuu

SEQ ID NO: 752755 - RNA, 14 nt, Leptospira interrogans serovar lai str. 56601
caauuuauaaacgg

SEQ ID NO: 752756 - RNA, 14 nt, Leptospira interrogans serovar lai str. 56601
caauuuauaaaguu

SEQ ID NO: 752757 - RNA, 19 nt, Leptospira interrogans serovar lai str. 56601
caauuuauaaaguuuaacu

SEQ ID NO: 752758 - RNA, 10 nt, Leptospira interrogans serovar lai str. 56601
caauuuagaa

SEQ ID NO: 752759 - RNA, 19 nt, Leptospira interrogans serovar lai str. 56601
caauaauguccgaaauuuu

SEQ ID NO: 752760 - RNA, 12 nt, Leptospira interrogans serovar lai str. 56601
caauaauuuaac

SEQ ID NO: 752761 - RNA, 17 nt, Leptospira interrogans serovar lai str. 56601
caaguugaauaggauuu

SEQ ID NO: 752762 - RNA, 21 nt, Leptospira interrogans serovar lai str. 56601
caaguugaaugagcuagauuu

SEQ ID NO: 752763 - RNA, 15 nt, Leptospira interrogans serovar lai str. 56601
caaguugaaagggga

SEQ ID NO: 752764 - RNA, 15 nt, Leptospira interrogans serovar lai str. 56601
caaguugauuaugau

SEQ ID NO: 752765 - RNA, 23 nt, Leptospira interrogans serovar lai str. 56601
caauaccgauuucuauuuuaaaa

SEQ ID NO: 752766 - RNA, 12 nt, Leptospira interrogans serovar lai str. 56601
caauagaaauac

SEQ ID NO: 752767 - RNA, 22 nt, Leptospira interrogans serovar lai str. 56601
caauagaauuguguuaguuccc

SEQ ID NO: 752768 - RNA, 23 nt, Leptospira interrogans serovar lai str. 56601
caauagaguuguugaaaaauuuc

SEQ ID NO: 752769 - RNA, 17 nt, Leptospira interrogans serovar lai str. 56601
caauagcuucuuuaaaa

SEQ ID NO: 752770 - RNA, 20 nt, Leptospira interrogans serovar lai str. 56601
caauagcuucuuuaaaaacu

SEQ ID NO: 752771 - RNA, 14 nt, Leptospira interrogans serovar lai str. 56601
caauaggaaaggga

SEQ ID NO: 752772 - RNA, 17 nt, Leptospira interrogans serovar lai str. 56601
caauaguucuauuuuau

SEQ ID NO: 752773 - RNA, 15 nt, Leptospira interrogans serovar lai str. 56601
caaugcaacagaaac

SEQ ID NO: 752774 - RNA, 15 nt, Leptospira interrogans serovar lai str. 56601
caaugcgaaauagau

SEQ ID NO: 752775 - RNA, 12 nt, Leptospira interrogans serovar lai str. 56601
caaugaaaauuc

SEQ ID NO: 752776 - RNA, 22 nt, Leptospira interrogans serovar lai str. 56601
caaugaucauauccgaaagaua

SEQ ID NO: 752777 - RNA, 13 nt, Leptospira interrogans serovar lai str. 56601
caaugauucuaac

SEQ ID NO: 752778 - RNA, 14 nt, Leptospira interrogans serovar lai str. 56601
caaugcaaaaaauu

SEQ ID NO: 752779 - RNA, 17 nt, Leptospira interrogans serovar lai str. 56601
caauauuuaaaaauucu

SEQ ID NO: 752780 - RNA, 17 nt, Leptospira interrogans serovar lai str. 56601
caaucaugaauauuuuc

SEQ ID NO: 752781 - RNA, 15 nt, Leptospira interrogans serovar lai str. 56601
caaucuccauuauag

SEQ ID NO: 752782 - RNA, 18 nt, Leptospira interrogans serovar lai str. 56601
caaucuccauuauaguuu

SEQ ID NO: 752783 - RNA, 20 nt, Leptospira interrogans serovar lai str. 56601
caaucuccccaaaaucuuua

SEQ ID NO: 752784 - RNA, 17 nt, Leptospira interrogans serovar lai str. 56601
caaucggguaaaaaaua

SEQ ID NO: 752785 - RNA, 21 nt, Leptospira interrogans serovar lai str. 56601
caaucguaggcacguggaaaa

SEQ ID NO: 752786 - RNA, 18 nt, Leptospira interrogans serovar lai str. 56601
caauccgcggauguuuga

SEQ ID NO: 752787 - RNA, 22 nt, Leptospira interrogans serovar lai str. 56601
caagggaagguuuuguaaaaau

SEQ ID NO: 752788 - RNA, 22 nt, Leptospira interrogans serovar lai str. 56601
caagggcggcuuuuuuuacuuc

SEQ ID NO: 752789 - RNA, 21 nt, Leptospira interrogans serovar lai str. 56601
caagguuucacuuuuuuaaag

SEQ ID NO: 752790 - RNA, 20 nt, Leptospira interrogans serovar lai str. 56601
caaggcuuuguaauaaaaau

SEQ ID NO: 752791 - RNA, 23 nt, Leptospira interrogans serovar lai str. 56601
caaggcggcucgcgaccuaaaac

SEQ ID NO: 752792 - RNA, 22 nt, Leptospira interrogans serovar lai str. 56601
caagauuucguucggaaaaaau

SEQ ID NO: 752793 - RNA, 23 nt, Leptospira interrogans serovar lai str. 56601
caagauuucguucggaaaaaaua

SEQ ID NO: 752794 - RNA, 17 nt, Leptospira interrogans serovar lai str. 56601
caagauugucuuuauuc

SEQ ID NO: 752795 - RNA, 17 nt, Leptospira interrogans serovar lai str. 56601
caagauuuuucguucua

SEQ ID NO: 752796 - RNA, 20 nt, Leptospira interrogans serovar lai str. 56601
caagcacauccgcauucuca

SEQ ID NO: 752797 - RNA, 19 nt, Leptospira interrogans serovar lai str. 56601
caagauucauuucguaaaa

SEQ ID NO: 752798 - RNA, 21 nt, Leptospira interrogans serovar lai str. 56601
caagauucauuucguaaaauc

SEQ ID NO: 752799 - RNA, 22 nt, Leptospira interrogans serovar lai str. 56601
caagauucauuucguaaaaucc

SEQ ID NO: 752800 - RNA, 16 nt, Leptospira interrogans serovar lai str. 56601
caagagugguuuucaa

SEQ ID NO: 752801 - RNA, 18 nt, Leptospira interrogans serovar lai str. 56601
caagagugguuuucaaau

SEQ ID NO: 752802 - RNA, 15 nt, Leptospira interrogans serovar lai str. 56601
caagaagaaaagaau

SEQ ID NO: 752803 - RNA, 18 nt, Leptospira interrogans serovar lai str. 56601
caagaacuggauucaaaa

SEQ ID NO: 752804 - RNA, 19 nt, Leptospira interrogans serovar lai str. 56601
caagaacuggauucaaaau

SEQ ID NO: 752805 - RNA, 18 nt, Leptospira interrogans serovar lai str. 56601
caacuuuuugaagaaaca

SEQ ID NO: 752806 - RNA, 19 nt, Leptospira interrogans serovar lai str. 56601
caacuuuuugaagaaacaa

SEQ ID NO: 752807 - RNA, 15 nt, Leptospira interrogans serovar lai str. 56601
caacuuuuuuaauuu

SEQ ID NO: 752808 - RNA, 17 nt, Leptospira interrogans serovar lai str. 56601
caacuuuuucagaaaaa

SEQ ID NO: 752809 - RNA, 15 nt, Leptospira interrogans serovar lai str. 56601
caacuuuugaaacua

SEQ ID NO: 752810 - RNA, 13 nt, Leptospira interrogans serovar lai str. 56601
caacuuuccuuuu

SEQ ID NO: 752811 - RNA, 20 nt, Leptospira interrogans serovar lai str. 56601
caacuuucgcauuuguugua

SEQ ID NO: 752812 - RNA, 21 nt, Leptospira interrogans serovar lai str. 56601
caacuuggaaucuuaaaaaga

SEQ ID NO: 752813 - RNA, 15 nt, Leptospira interrogans serovar lai str. 56601
caacuuuagaaaaau

SEQ ID NO: 752814 - RNA, 16 nt, Leptospira interrogans serovar lai str. 56601
caacuaaauccuucuu

SEQ ID NO: 752815 - RNA, 20 nt, Leptospira interrogans serovar lai str. 56601
caacuaaauccuucuuuucu

SEQ ID NO: 752816 - RNA, 12 nt, Leptospira interrogans serovar lai str. 56601
caacuaaaagac

SEQ ID NO: 752817 - RNA, 13 nt, Leptospira interrogans serovar lai str. 56601
caacuuaaaacug

SEQ ID NO: 752818 - RNA, 18 nt, Leptospira interrogans serovar lai str. 56601
caacugugggaacuacua

SEQ ID NO: 752819 - RNA, 17 nt, Leptospira interrogans serovar lai str. 56601
caacauaaugcugcaau

SEQ ID NO: 752820 - RNA, 18 nt, Leptospira interrogans serovar lai str. 56601
caaccccacaaguuaaua

SEQ ID NO: 752821 - RNA, 18 nt, Leptospira interrogans serovar lai str. 56601
caacccccguuauuaaaa

SEQ ID NO: 752822 - RNA, 21 nt, Leptospira interrogans serovar lai str. 56601
caaccagagccguaaauauuu

SEQ ID NO: 752823 - RNA, 14 nt, Leptospira interrogans serovar lai str. 56601
caacaagaaugaaa

SEQ ID NO: 752824 - RNA, 13 nt, Leptospira interrogans serovar lai str. 56601
caacaacucuaau

SEQ ID NO: 752825 - RNA, 21 nt, Leptospira interrogans serovar lai str. 56601
caacaacucuaauacaaaaaa

SEQ ID NO: 752826 - RNA, 19 nt, Leptospira interrogans serovar lai str. 56601
caacaacucuaauauaaaa

SEQ ID NO: 752827 - RNA, 21 nt, Leptospira interrogans serovar lai str. 56601
caacaacucuaauauaaaauc

SEQ ID NO: 752828 - RNA, 17 nt, Leptospira interrogans serovar lai str. 56601
caacaacucuauuuuau

SEQ ID NO: 752829 - RNA, 19 nt, Leptospira interrogans serovar lai str. 56601
caacacugagucaacaaau

SEQ ID NO: 752830 - RNA, 23 nt, Leptospira interrogans serovar lai str. 56601
caacacugagucaacaaauauuc

SEQ ID NO: 752831 - RNA, 20 nt, Leptospira interrogans serovar lai str. 56601
caacagaacgggcuuucuau

SEQ ID NO: 752832 - RNA, 20 nt, Leptospira interrogans serovar lai str. 56601
caacagaucgcguuuuauaa

SEQ ID NO: 752833 - RNA, 12 nt, Leptospira interrogans serovar lai str. 56601
caacagagaaag

SEQ ID NO: 752834 - RNA, 13 nt, Leptospira interrogans serovar lai str. 56601
caacagagaaagu

SEQ ID NO: 752835 - RNA, 18 nt, Leptospira interrogans serovar lai str. 56601
caaauugauaauuuuugu

SEQ ID NO: 752836 - RNA, 18 nt, Leptospira interrogans serovar lai str. 56601
caaauugcaacuuugguu

SEQ ID NO: 752837 - RNA, 21 nt, Leptospira interrogans serovar lai str. 56601
caaauugaauuugcaguaaaa

SEQ ID NO: 752838 - RNA, 22 nt, Leptospira interrogans serovar lai str. 56601
caaauuuuacauuguuuuucga

SEQ ID NO: 752839 - RNA, 22 nt, Leptospira interrogans serovar lai str. 56601
caaauuugcgaaaaaaauaacg

SEQ ID NO: 752840 - RNA, 19 nt, Leptospira interrogans serovar lai str. 56601
caaauuuuugcauaaaauc

SEQ ID NO: 752841 - RNA, 20 nt, Leptospira interrogans serovar lai str. 56601
caaauuuuugcauaaaaucg

SEQ ID NO: 752842 - RNA, 20 nt, Leptospira interrogans serovar lai str. 56601
caaauuuuuuucuaaaauau

SEQ ID NO: 752843 - RNA, 13 nt, Leptospira interrogans serovar lai str. 56601
caacaaaaaauau

SEQ ID NO: 752844 - RNA, 18 nt, Leptospira interrogans serovar lai str. 56601
caaauuaauuacuuagau

SEQ ID NO: 752845 - RNA, 21 nt, Leptospira interrogans serovar lai str. 56601
caaauuaauuacuuagaugaa

SEQ ID NO: 752846 - RNA, 23 nt, Leptospira interrogans serovar lai str. 56601
caaaugcugaauugcucaaagaa

SEQ ID NO: 752847 - RNA, 20 nt, Leptospira interrogans serovar lai str. 56601
caaauuaggucacauuugau

SEQ ID NO: 752848 - RNA, 20 nt, Leptospira interrogans serovar lai str. 56601
caaauuagguuguguuugau

SEQ ID NO: 752849 - RNA, 18 nt, Leptospira interrogans serovar lai str. 56601
caaacccaaugauucuaa

SEQ ID NO: 752850 - RNA, 19 nt, Leptospira interrogans serovar lai str. 56601
caaacccugccaaaauccc

SEQ ID NO: 752851 - RNA, 19 nt, Leptospira interrogans serovar lai str. 56601
caaacacgggaauaaaaac

SEQ ID NO: 752852 - RNA, 20 nt, Leptospira interrogans serovar lai str. 56601
caaacacgggaauaaaaaca

SEQ ID NO: 752853 - RNA, 18 nt, Leptospira interrogans serovar lai str. 56601
caaacacuaauaaaaaug

SEQ ID NO: 752854 - RNA, 13 nt, Leptospira interrogans serovar lai str. 56601
caaacaccacaau

SEQ ID NO: 752855 - RNA, 14 nt, Leptospira interrogans serovar lai str. 56601
caaaauuucuaaag

SEQ ID NO: 752856 - RNA, 15 nt, Leptospira interrogans serovar lai str. 56601
caaaauuucuuuuuu

SEQ ID NO: 752857 - RNA, 13 nt, Leptospira interrogans serovar lai str. 56601
caaacacaugagc

SEQ ID NO: 752858 - RNA, 15 nt, Leptospira interrogans serovar lai str. 56601
caaaauuuagaauug

SEQ ID NO: 752859 - RNA, 14 nt, Leptospira interrogans serovar lai str. 56601
caaaauuuaaaaau

SEQ ID NO: 752860 - RNA, 20 nt, Leptospira interrogans serovar lai str. 56601
caaaauuuaagauuacucua

SEQ ID NO: 752861 - RNA, 18 nt, Leptospira interrogans serovar lai str. 56601
caaaauuuaucuguaaaa

SEQ ID NO: 752862 - RNA, 20 nt, Leptospira interrogans serovar lai str. 56601
caaaauuuaucuguaaaauu

SEQ ID NO: 752863 - RNA, 18 nt, Leptospira interrogans serovar lai str. 56601
caaaauuucagauauuuu

SEQ ID NO: 752864 - RNA, 12 nt, Leptospira interrogans serovar lai str. 56601
caaaauugagaa

SEQ ID NO: 752865 - RNA, 23 nt, Leptospira interrogans serovar lai str. 56601
caaaauugagcuuguuuuuaaau

SEQ ID NO: 752866 - RNA, 18 nt, Leptospira interrogans serovar lai str. 56601
caaaauucuuaaaaaaua

SEQ ID NO: 752867 - RNA, 23 nt, Leptospira interrogans serovar lai str. 56601
caaaauuguuggccuuuuugaag

SEQ ID NO: 752868 - RNA, 20 nt, Leptospira interrogans serovar lai str. 56601
caaaaugaguuauaguaaaa

SEQ ID NO: 752869 - RNA, 13 nt, Leptospira interrogans serovar lai str. 56601
caaaaugaacuca

SEQ ID NO: 752870 - RNA, 15 nt, Leptospira interrogans serovar lai str. 56601
caaaaugaacucaac

SEQ ID NO: 752871 - RNA, 16 nt, Leptospira interrogans serovar lai str. 56601
caaaaugaacucaaca

SEQ ID NO: 752872 - RNA, 16 nt, Leptospira interrogans serovar lai str. 56601
caaaaugaauuguaaa

SEQ ID NO: 752873 - RNA, 19 nt, Leptospira interrogans serovar lai str. 56601
caaaaugaauuguaaaaaa

SEQ ID NO: 752874 - RNA, 16 nt, Leptospira interrogans serovar lai str. 56601
caaaaccgaaucugga

SEQ ID NO: 752875 - RNA, 15 nt, Leptospira interrogans serovar lai str. 56601
caaaaguuuauaaac

SEQ ID NO: 752876 - RNA, 16 nt, Leptospira interrogans serovar lai str. 56601
caaaaguuuauaaacu

SEQ ID NO: 752877 - RNA, 21 nt, Leptospira interrogans serovar lai str. 56601
caaaaguuuucaaaaauguau

SEQ ID NO: 752878 - RNA, 15 nt, Leptospira interrogans serovar lai str. 56601
caaaauaagaaaaua

SEQ ID NO: 752879 - RNA, 19 nt, Leptospira interrogans serovar lai str. 56601
caaaauaagaaaauaaagg

SEQ ID NO: 752880 - RNA, 16 nt, Leptospira interrogans serovar lai str. 56601
caaaauaagaauuuuc

SEQ ID NO: 752881 - RNA, 13 nt, Leptospira interrogans serovar lai str. 56601
caaaaucaaagag

SEQ ID NO: 752882 - RNA, 13 nt, Leptospira interrogans serovar lai str. 56601
caaauaaaaggag

SEQ ID NO: 752883 - RNA, 22 nt, Leptospira interrogans serovar lai str. 56601
caaauaaagaaaaggaaggagu

SEQ ID NO: 752884 - RNA, 14 nt, Leptospira interrogans serovar lai str. 56601
caaauaaaacuucu

SEQ ID NO: 752885 - RNA, 20 nt, Leptospira interrogans serovar lai str. 56601
caaaguuauuucgauuggaa

SEQ ID NO: 752886 - RNA, 16 nt, Leptospira interrogans serovar lai str. 56601
caaaguaaguucaaau

SEQ ID NO: 752887 - RNA, 17 nt, Leptospira interrogans serovar lai str. 56601
caaaguaaguucaaauu

SEQ ID NO: 752888 - RNA, 15 nt, Leptospira interrogans serovar lai str. 56601
caaauaauaaaacuu

SEQ ID NO: 752889 - RNA, 18 nt, Leptospira interrogans serovar lai str. 56601
caaauaacgauuccauuu

SEQ ID NO: 752890 - RNA, 21 nt, Leptospira interrogans serovar lai str. 56601
caaauaacgauuccauuuuuu

SEQ ID NO: 752891 - RNA, 22 nt, Leptospira interrogans serovar lai str. 56601
caaauaacgauuccauuuuuua

SEQ ID NO: 752892 - RNA, 17 nt, Leptospira interrogans serovar lai str. 56601
caaauaaaguuuuauac

SEQ ID NO: 752893 - RNA, 15 nt, Leptospira interrogans serovar lai str. 56601
caaauacagugucuu

SEQ ID NO: 752894 - RNA, 20 nt, Leptospira interrogans serovar lai str. 56601
caaauacagugucuugaaau

SEQ ID NO: 752895 - RNA, 22 nt, Leptospira interrogans serovar lai str. 56601
caaauacagugucuugaaauuc

SEQ ID NO: 752896 - RNA, 19 nt, Leptospira interrogans serovar lai str. 56601
caaauacaaaauuuuuucc

SEQ ID NO: 752897 - RNA, 15 nt, Leptospira interrogans serovar lai str. 56601
caaauacaauuugau

SEQ ID NO: 752898 - RNA, 16 nt, Leptospira interrogans serovar lai str. 56601
caaauacuuagaauuu

SEQ ID NO: 752899 - RNA, 14 nt, Leptospira interrogans serovar lai str. 56601
caaauagaaauaac

SEQ ID NO: 752900 - RNA, 17 nt, Leptospira interrogans serovar lai str. 56601
caaagcacuuuuuuccu

SEQ ID NO: 752901 - RNA, 20 nt, Leptospira interrogans serovar lai str. 56601
caaagcacuuuuuuccucga

SEQ ID NO: 752902 - RNA, 20 nt, Leptospira interrogans serovar lai str. 56601
caaagauauuucaauauaaa

SEQ ID NO: 752903 - RNA, 13 nt, Leptospira interrogans serovar lai str. 56601
caaagcucagauu

SEQ ID NO: 752904 - RNA, 17 nt, Leptospira interrogans serovar lai str. 56601
caaagcuuguuucaaaa

SEQ ID NO: 752905 - RNA, 15 nt, Leptospira interrogans serovar lai str. 56601
caaagauaaaaaaga

SEQ ID NO: 752906 - RNA, 16 nt, Leptospira interrogans serovar lai str. 56601
caaagauaaaaaagaa

SEQ ID NO: 752907 - RNA, 17 nt, Leptospira interrogans serovar lai str. 56601
caaagauaaaaaagaaa

SEQ ID NO: 752908 - RNA, 16 nt, Leptospira interrogans serovar lai str. 56601
caaagauaaaauauag

SEQ ID NO: 752909 - RNA, 16 nt, Leptospira interrogans serovar lai str. 56601
caaagaguuguuuauc

SEQ ID NO: 752910 - RNA, 16 nt, Leptospira interrogans serovar lai str. 56601
caaagaguuuaaaaaa

SEQ ID NO: 752911 - RNA, 17 nt, Leptospira interrogans serovar lai str. 56601
caaagaguuuaaaaaau

SEQ ID NO: 752912 - RNA, 18 nt, Leptospira interrogans serovar lai str. 56601
caaagaguuuaaaaaauc

SEQ ID NO: 752913 - RNA, 20 nt, Leptospira interrogans serovar lai str. 56601
caaagaguuuaaaaaauccg

SEQ ID NO: 752914 - RNA, 20 nt, Leptospira interrogans serovar lai str. 56601
caaagagccgcuuaaacuuc

SEQ ID NO: 752915 - RNA, 18 nt, Leptospira interrogans serovar lai str. 56601
caaacucuuuauuuuuaa

SEQ ID NO: 752916 - RNA, 14 nt, Leptospira interrogans serovar lai str. 56601
caaacucuuuuucu

SEQ ID NO: 752917 - RNA, 16 nt, Leptospira interrogans serovar lai str. 56601
caaacucuuuuucuuc

SEQ ID NO: 752918 - RNA, 21 nt, Leptospira interrogans serovar lai str. 56601
caaacuaggucgcauuuagca

SEQ ID NO: 752919 - RNA, 13 nt, Leptospira interrogans serovar lai str. 56601
aaaaucuuuagaa

SEQ ID NO: 752920 - RNA, 15 nt, Leptospira interrogans serovar lai str. 56601
aaaaucuuuagaauu

SEQ ID NO: 752921 - RNA, 19 nt, Leptospira interrogans serovar lai str. 56601
cagauuuugcacaaaaccu

SEQ ID NO: 752922 - RNA, 16 nt, Leptospira interrogans serovar lai str. 56601
cagauuuuauuuugau

SEQ ID NO: 752923 - RNA, 23 nt, Leptospira interrogans serovar lai str. 56601
cagauuuuauuuugauuccaaag

SEQ ID NO: 752924 - RNA, 23 nt, Leptospira interrogans serovar lai str. 56601
cagauuuucucaaaaaaaguaau

SEQ ID NO: 752925 - RNA, 16 nt, Leptospira interrogans serovar lai str. 56601
aaaaugaaaucuacaa

SEQ ID NO: 752926 - RNA, 19 nt, Leptospira interrogans serovar lai str. 56601
aaaaugaaaucuacaaaac

SEQ ID NO: 752927 - RNA, 20 nt, Leptospira interrogans serovar lai str. 56601
aaaaugaaagguaauuuuga

SEQ ID NO: 752928 - RNA, 19 nt, Leptospira interrogans serovar lai str. 56601
aaaaugaaaaaaaacaaag

SEQ ID NO: 752929 - RNA, 15 nt, Leptospira interrogans serovar lai str. 56601
aaaaugaaaaaacuu

SEQ ID NO: 752930 - RNA, 11 nt, Leptospira interrogans serovar lai str. 56601
aaaaugaaaac

SEQ ID NO: 752931 - RNA, 13 nt, Leptospira interrogans serovar lai str. 56601
aaaaugaaaauua

SEQ ID NO: 752932 - RNA, 16 nt, Leptospira interrogans serovar lai str. 56601
aaaaugaagaaacacu

SEQ ID NO: 752933 - RNA, 20 nt, Leptospira interrogans serovar lai str. 56601
aaaaugaaucaugaauuccu

SEQ ID NO: 752934 - RNA, 23 nt, Leptospira interrogans serovar lai str. 56601
cagauuucagcuccaaaaaaaua

SEQ ID NO: 752935 - RNA, 14 nt, Leptospira interrogans serovar lai str. 56601
cagauuuauuuuag

SEQ ID NO: 752936 - RNA, 17 nt, Leptospira interrogans serovar lai str. 56601
cagauuuaauuuuucug

SEQ ID NO: 752937 - RNA, 19 nt, Leptospira interrogans serovar lai str. 56601
cagauuuaauuuuucugau

SEQ ID NO: 752938 - RNA, 21 nt, Leptospira interrogans serovar lai str. 56601
cagauuugauguaaagaaaac

SEQ ID NO: 752939 - RNA, 20 nt, Leptospira interrogans serovar lai str. 56601
cagauuuccgguaaguaaua

SEQ ID NO: 752940 - RNA, 12 nt, Leptospira interrogans serovar lai str. 56601
cagauuuguccg

SEQ ID NO: 752941 - RNA, 13 nt, Leptospira interrogans serovar lai str. 56601
cagauuaaaaaau

SEQ ID NO: 752942 - RNA, 14 nt, Leptospira interrogans serovar lai str. 56601
cagauguuuuaaaa

SEQ ID NO: 752943 - RNA, 19 nt, Leptospira interrogans serovar lai str. 56601
cagauggagaauugauuuu

SEQ ID NO: 752944 - RNA, 12 nt, Leptospira interrogans serovar lai str. 56601
cagaugaaacua

SEQ ID NO: 752945 - RNA, 23 nt, Leptospira interrogans serovar lai str. 56601
cagcacaaguuucuuaaauuugu

SEQ ID NO: 752946 - RNA, 16 nt, Leptospira interrogans serovar lai str. 56601
cagcaaggagcaacau

SEQ ID NO: 752947 - RNA, 14 nt, Leptospira interrogans serovar lai str. 56601
aaaaugcuguaacu

SEQ ID NO: 752948 - RNA, 14 nt, Leptospira interrogans serovar lai str. 56601
aaaaugaaugauag

SEQ ID NO: 752949 - RNA, 22 nt, Leptospira interrogans serovar lai str. 56601
aaaaugaauguuuaaaauuuau

SEQ ID NO: 752950 - RNA, 16 nt, Leptospira interrogans serovar lai str. 56601
aaaaugaauuguaaaa

SEQ ID NO: 752951 - RNA, 18 nt, Leptospira interrogans serovar lai str. 56601
aaaaugaauuguaaaaaa

SEQ ID NO: 752952 - RNA, 12 nt, Leptospira interrogans serovar lai str. 56601
cagcaaaaccuu

SEQ ID NO: 752953 - RNA, 15 nt, Leptospira interrogans serovar lai str. 56601
aaaauggauuuauaa

SEQ ID NO: 752954 - RNA, 14 nt, Leptospira interrogans serovar lai str. 56601
aaaauggaaaaaag

SEQ ID NO: 752955 - RNA, 18 nt, Leptospira interrogans serovar lai str. 56601
aaaauggauacuuauuau

SEQ ID NO: 752956 - RNA, 14 nt, Leptospira interrogans serovar lai str. 56601
aaaauggagaacuu

SEQ ID NO: 752957 - RNA, 22 nt, Leptospira interrogans serovar lai str. 56601
cagcaagcacauccgcauucuc

SEQ ID NO: 752958 - RNA, 23 nt, Leptospira interrogans serovar lai str. 56601
cagcaagcacauccgcauucuca

SEQ ID NO: 752959 - RNA, 12 nt, Leptospira interrogans serovar lai str. 56601
aaaaucaaauau

SEQ ID NO: 752960 - RNA, 14 nt, Leptospira interrogans serovar lai str. 56601
aaaaucaugucuca

SEQ ID NO: 752961 - RNA, 15 nt, Leptospira interrogans serovar lai str. 56601
aaaauccagaauaau

SEQ ID NO: 752962 - RNA, 18 nt, Leptospira interrogans serovar lai str. 56601
aaaauccagaauaauaau

SEQ ID NO: 752963 - RNA, 18 nt, Leptospira interrogans serovar lai str. 56601
aaaaucaggcuuuauaaa

SEQ ID NO: 752964 - RNA, 19 nt, Leptospira interrogans serovar lai str. 56601
aaaaucaggcuuuauaaaa

SEQ ID NO: 752965 - RNA, 21 nt, Leptospira interrogans serovar lai str. 56601
aaaaucagggccggagaaaau

SEQ ID NO: 752966 - RNA, 13 nt, Leptospira interrogans serovar lai str. 56601
aaaaucauaucca

SEQ ID NO: 752967 - RNA, 23 nt, Leptospira interrogans serovar lai str. 56601
aaaaucauauccaauuucaauuu

SEQ ID NO: 752968 - RNA, 17 nt, Leptospira interrogans serovar lai str. 56601
aaaaucauacuuuuaaa

SEQ ID NO: 752969 - RNA, 18 nt, Leptospira interrogans serovar lai str. 56601
aaaaucauacuuuuaaaa

SEQ ID NO: 752970 - RNA, 20 nt, Leptospira interrogans serovar lai str. 56601
aaaaucauacuuuuaaaaaa

SEQ ID NO: 752971 - RNA, 18 nt, Leptospira interrogans serovar lai str. 56601
aaaaucagguuuuauaaa

SEQ ID NO: 752972 - RNA, 18 nt, Leptospira interrogans serovar lai str. 56601
aaaaucagucauaaaaaa

SEQ ID NO: 752973 - RNA, 14 nt, Leptospira interrogans serovar lai str. 56601
aaaaucaguuaaua

SEQ ID NO: 752974 - RNA, 23 nt, Leptospira interrogans serovar lai str. 56601
aaaaucaguuaauacaaaacuua

SEQ ID NO: 752975 - RNA, 14 nt, Leptospira interrogans serovar lai str. 56601
aaaaucauaaaaca

SEQ ID NO: 752976 - RNA, 17 nt, Leptospira interrogans serovar lai str. 56601
cagagcauauaauuaaa

SEQ ID NO: 752977 - RNA, 18 nt, Leptospira interrogans serovar lai str. 56601
cagagcaucauacaguaa

SEQ ID NO: 752978 - RNA, 17 nt, Leptospira interrogans serovar lai str. 56601
cagagcuuuacaauaaa

SEQ ID NO: 752979 - RNA, 15 nt, Leptospira interrogans serovar lai str. 56601
cagaauuucuuucuc

SEQ ID NO: 752980 - RNA, 18 nt, Leptospira interrogans serovar lai str. 56601
cagaauuuaggcaauuuu

SEQ ID NO: 752981 - RNA, 12 nt, Leptospira interrogans serovar lai str. 56601
cagaacaaaacg

SEQ ID NO: 752982 - RNA, 23 nt, Leptospira interrogans serovar lai str. 56601
cagaauuagauuaaauuuuuaua

SEQ ID NO: 752983 - RNA, 18 nt, Leptospira interrogans serovar lai str. 56601
cagaauguuuucuacaaa

SEQ ID NO: 752984 - RNA, 22 nt, Leptospira interrogans serovar lai str. 56601
cagaauguuuucuacaaauaaa

SEQ ID NO: 752985 - RNA, 13 nt, Leptospira interrogans serovar lai str. 56601
cagaauuaaaaau

SEQ ID NO: 752986 - RNA, 16 nt, Leptospira interrogans serovar lai str. 56601
cagaauuaaaaauuaa

SEQ ID NO: 752987 - RNA, 17 nt, Leptospira interrogans serovar lai str. 56601
cacuuuccuuaaaccca

SEQ ID NO: 752988 - RNA, 15 nt, Leptospira interrogans serovar lai str. 56601
cagaaacccucuccu

SEQ ID NO: 752989 - RNA, 14 nt, Leptospira interrogans serovar lai str. 56601
cagaaacauuggaa

SEQ ID NO: 752990 - RNA, 23 nt, Leptospira interrogans serovar lai str. 56601
cagaaacauuggaacuuuuuauc

SEQ ID NO: 752991 - RNA, 13 nt, Leptospira interrogans serovar lai str. 56601
cagaaaccauaaa

SEQ ID NO: 752992 - RNA, 16 nt, Leptospira interrogans serovar lai str. 56601
cagaaaccauaaaaua

SEQ ID NO: 752993 - RNA, 22 nt, Leptospira interrogans serovar lai str. 56601
cagaaaccauaaaauaaaaaac

SEQ ID NO: 752994 - RNA, 14 nt, Leptospira interrogans serovar lai str. 56601
cagaaaaaaaaaga

SEQ ID NO: 752995 - RNA, 16 nt, Leptospira interrogans serovar lai str. 56601
cagaaaaaaaaagaau

SEQ ID NO: 752996 - RNA, 13 nt, Leptospira interrogans serovar lai str. 56601
cacuuuuuuaaag

SEQ ID NO: 752997 - RNA, 13 nt, Leptospira interrogans serovar lai str. 56601
cagaaaaaaaauc

SEQ ID NO: 752998 - RNA, 14 nt, Leptospira interrogans serovar lai str. 56601
cagaaaaaaccucc

SEQ ID NO: 752999 - RNA, 15 nt, Leptospira interrogans serovar lai str. 56601
cagaaaaacaaaaaa

SEQ ID NO: 753000 - RNA, 22 nt, Leptospira interrogans serovar lai str. 56601
cagccugauaaauuccguaaaa

SEQ ID NO: 753001 - RNA, 20 nt, Leptospira interrogans serovar lai str. 56601
cagcauaaguauuauuuuua

SEQ ID NO: 753002 - RNA, 23 nt, Leptospira interrogans serovar lai str. 56601
cagcauugaguuuaagaaacuca

SEQ ID NO: 753003 - RNA, 20 nt, Leptospira interrogans serovar lai str. 56601
caguaguuccuacaaauuaa

SEQ ID NO: 753004 - RNA, 14 nt, Leptospira interrogans serovar lai str. 56601
caguaggcuauuuu

SEQ ID NO: 753005 - RNA, 20 nt, Leptospira interrogans serovar lai str. 56601
caguacuauauuuuugugaa

SEQ ID NO: 753006 - RNA, 15 nt, Leptospira interrogans serovar lai str. 56601
caguacgaucaaauc

SEQ ID NO: 753007 - RNA, 19 nt, Leptospira interrogans serovar lai str. 56601
cagucaccucuauaaaauc

SEQ ID NO: 753008 - RNA, 15 nt, Leptospira interrogans serovar lai str. 56601
cagucaaguaaagaa

SEQ ID NO: 753009 - RNA, 14 nt, Leptospira interrogans serovar lai str. 56601
caguauuuguaaaa

SEQ ID NO: 753010 - RNA, 19 nt, Leptospira interrogans serovar lai str. 56601
caguauuuguaaaaaugag

SEQ ID NO: 753011 - RNA, 15 nt, Leptospira interrogans serovar lai str. 56601
caguauucuagaaua

SEQ ID NO: 753012 - RNA, 16 nt, Leptospira interrogans serovar lai str. 56601
caguauguuuuuuuga

SEQ ID NO: 753013 - RNA, 14 nt, Leptospira interrogans serovar lai str. 56601
cagucauaaaaaac

SEQ ID NO: 753014 - RNA, 22 nt, Leptospira interrogans serovar lai str. 56601
cagucgcacccccgucuacuuu

SEQ ID NO: 753015 - RNA, 15 nt, Leptospira interrogans serovar lai str. 56601
cagugauaagaaaaa

SEQ ID NO: 753016 - RNA, 20 nt, Leptospira interrogans serovar lai str. 56601
cagugaauaaaauaaaaaaa

SEQ ID NO: 753017 - RNA, 22 nt, Leptospira interrogans serovar lai str. 56601
cagugaauaaaauaaaaaaaua

SEQ ID NO: 753018 - RNA, 19 nt, Leptospira interrogans serovar lai str. 56601
caguaauaaucuaaacuug

SEQ ID NO: 753019 - RNA, 14 nt, Leptospira interrogans serovar lai str. 56601
caguaagaagaaaa

SEQ ID NO: 753020 - RNA, 16 nt, Leptospira interrogans serovar lai str. 56601
caguaaggauucuuuu

SEQ ID NO: 753021 - RNA, 19 nt, Leptospira interrogans serovar lai str. 56601
caguaaaacuuugagaugu

SEQ ID NO: 753022 - RNA, 17 nt, Leptospira interrogans serovar lai str. 56601
caguaaaacgcucucua

SEQ ID NO: 753023 - RNA, 13 nt, Leptospira interrogans serovar lai str. 56601
caguaaaaucuuu

SEQ ID NO: 753024 - RNA, 17 nt, Leptospira interrogans serovar lai str. 56601
cagguugguauuuaaaa

SEQ ID NO: 753025 - RNA, 20 nt, Leptospira interrogans serovar lai str. 56601
aaacaaauccgaaaauguag

SEQ ID NO: 753026 - RNA, 19 nt, Leptospira interrogans serovar lai str. 56601
aaacaaaguauaacccaaa

SEQ ID NO: 753027 - RNA, 12 nt, Leptospira interrogans serovar lai str. 56601
aaacaaauuaag

SEQ ID NO: 753028 - RNA, 19 nt, Leptospira interrogans serovar lai str. 56601
aaacaaauuaaguuuaaaa

SEQ ID NO: 753029 - RNA, 22 nt, Leptospira interrogans serovar lai str. 56601
aaacaaauuaaguuuaaaaaca

SEQ ID NO: 753030 - RNA, 15 nt, Leptospira interrogans serovar lai str. 56601
aaacaacaguacaag

SEQ ID NO: 753031 - RNA, 16 nt, Leptospira interrogans serovar lai str. 56601
cagguuuuauaaagug

SEQ ID NO: 753032 - RNA, 14 nt, Leptospira interrogans serovar lai str. 56601
caguaaaaaagcga

SEQ ID NO: 753033 - RNA, 20 nt, Leptospira interrogans serovar lai str. 56601
caggggcuuugauuggauuc

SEQ ID NO: 753034 - RNA, 20 nt, Leptospira interrogans serovar lai str. 56601
caggucccaaacuuucuuuu

SEQ ID NO: 753035 - RNA, 16 nt, Leptospira interrogans serovar lai str. 56601
caggcuuaaaucucau

SEQ ID NO: 753036 - RNA, 16 nt, Leptospira interrogans serovar lai str. 56601
aaaauuuuucucccuu

SEQ ID NO: 753037 - RNA, 11 nt, Leptospira interrogans serovar lai str. 56601
aaaauuuuuau

SEQ ID NO: 753038 - RNA, 22 nt, Leptospira interrogans serovar lai str. 56601
aaaauuuuuaucgcaaagcucu

SEQ ID NO: 753039 - RNA, 16 nt, Leptospira interrogans serovar lai str. 56601
aaaauuuuuaaaaaau

SEQ ID NO: 753040 - RNA, 21 nt, Leptospira interrogans serovar lai str. 56601
aaaauuuuccgaaccuuacca

SEQ ID NO: 753041 - RNA, 20 nt, Leptospira interrogans serovar lai str. 56601
aaaauuuuccggacuuucca

SEQ ID NO: 753042 - RNA, 21 nt, Leptospira interrogans serovar lai str. 56601
aaaauuuuccguuaauaaauc

SEQ ID NO: 753043 - RNA, 18 nt, Leptospira interrogans serovar lai str. 56601
aaaauuuucuguuuauuu

SEQ ID NO: 753044 - RNA, 19 nt, Leptospira interrogans serovar lai str. 56601
aaaauuuguaggaacucau

SEQ ID NO: 753045 - RNA, 14 nt, Leptospira interrogans serovar lai str. 56601
aaaauuuuauaaaa

SEQ ID NO: 753046 - RNA, 15 nt, Leptospira interrogans serovar lai str. 56601
aaaauuuuauaaaaa

SEQ ID NO: 753047 - RNA, 16 nt, Leptospira interrogans serovar lai str. 56601
aaaauuuuauaaaaau

SEQ ID NO: 753048 - RNA, 15 nt, Leptospira interrogans serovar lai str. 56601
aaaauuuuauaauag

SEQ ID NO: 753049 - RNA, 12 nt, Leptospira interrogans serovar lai str. 56601
aaaauuugaaaa

SEQ ID NO: 753050 - RNA, 15 nt, Leptospira interrogans serovar lai str. 56601
aaaauuugaaaagaa

SEQ ID NO: 753051 - RNA, 21 nt, Leptospira interrogans serovar lai str. 56601
aaaauuugaaaagaaaccaau

SEQ ID NO: 753052 - RNA, 13 nt, Leptospira interrogans serovar lai str. 56601
aaaauuuggauuu

SEQ ID NO: 753053 - RNA, 11 nt, Leptospira interrogans serovar lai str. 56601
aaaauuugauu

SEQ ID NO: 753054 - RNA, 16 nt, Leptospira interrogans serovar lai str. 56601
aaaauuucuuaaaaga

SEQ ID NO: 753055 - RNA, 18 nt, Leptospira interrogans serovar lai str. 56601
aaaauuucuaaagaauua

SEQ ID NO: 753056 - RNA, 13 nt, Leptospira interrogans serovar lai str. 56601
aaaauuuuccgaa

SEQ ID NO: 753057 - RNA, 17 nt, Leptospira interrogans serovar lai str. 56601
caggacggauguaacag

SEQ ID NO: 753058 - RNA, 22 nt, Leptospira interrogans serovar lai str. 56601
caggacggauguaacaguaaga

SEQ ID NO: 753059 - RNA, 20 nt, Leptospira interrogans serovar lai str. 56601
cagcuuuuuuaaauuuuuau

SEQ ID NO: 753060 - RNA, 15 nt, Leptospira interrogans serovar lai str. 56601
cagcuagaaaaggaa

SEQ ID NO: 753061 - RNA, 15 nt, Leptospira interrogans serovar lai str. 56601
aaaauuggaaagaac

SEQ ID NO: 753062 - RNA, 23 nt, Leptospira interrogans serovar lai str. 56601
aaaauugugggaacuauuauaaa

SEQ ID NO: 753063 - RNA, 17 nt, Leptospira interrogans serovar lai str. 56601
aaaauuguugaagaauu

SEQ ID NO: 753064 - RNA, 12 nt, Leptospira interrogans serovar lai str. 56601
aaaauuuaaaaa

SEQ ID NO: 753065 - RNA, 13 nt, Leptospira interrogans serovar lai str. 56601
aaaauuuaaaaau

SEQ ID NO: 753066 - RNA, 14 nt, Leptospira interrogans serovar lai str. 56601
aaaauuuagaaaua

SEQ ID NO: 753067 - RNA, 13 nt, Leptospira interrogans serovar lai str. 56601
aaaauuuagaauu

SEQ ID NO: 753068 - RNA, 14 nt, Leptospira interrogans serovar lai str. 56601
aaaauuuagaauug

SEQ ID NO: 753069 - RNA, 20 nt, Leptospira interrogans serovar lai str. 56601
aaaauuuaacgauauuagaa

SEQ ID NO: 753070 - RNA, 14 nt, Leptospira interrogans serovar lai str. 56601
aaaauuuaaaauac

SEQ ID NO: 753071 - RNA, 16 nt, Leptospira interrogans serovar lai str. 56601
aaaauuuaacaacauu

SEQ ID NO: 753072 - RNA, 13 nt, Leptospira interrogans serovar lai str. 56601
aaaauuuaaacaa

SEQ ID NO: 753073 - RNA, 15 nt, Leptospira interrogans serovar lai str. 56601
aaaauuuaaacaaca

SEQ ID NO: 753074 - RNA, 21 nt, Leptospira interrogans serovar lai str. 56601
aaaauuuaucuguaaaauuug

SEQ ID NO: 753075 - RNA, 17 nt, Leptospira interrogans serovar lai str. 56601
cagcuccaaaaaaauaa

SEQ ID NO: 753076 - RNA, 19 nt, Leptospira interrogans serovar lai str. 56601
cagcuccaaaaaaauaaau

SEQ ID NO: 753077 - RNA, 16 nt, Leptospira interrogans serovar lai str. 56601
ccagcccauucuuucc

SEQ ID NO: 753078 - RNA, 14 nt, Leptospira interrogans serovar lai str. 56601
ccagcccucagcua

SEQ ID NO: 753079 - RNA, 17 nt, Leptospira interrogans serovar lai str. 56601
ccagauuuaauuuuucu

SEQ ID NO: 753080 - RNA, 21 nt, Leptospira interrogans serovar lai str. 56601
ccagagccguaaauauuuuuu

SEQ ID NO: 753081 - RNA, 13 nt, Leptospira interrogans serovar lai str. 56601
ccagaucaauucu

SEQ ID NO: 753082 - RNA, 16 nt, Leptospira interrogans serovar lai str. 56601
ccagaaaccauaaaau

SEQ ID NO: 753083 - RNA, 18 nt, Leptospira interrogans serovar lai str. 56601
ccagaacgcgauccauag

SEQ ID NO: 753084 - RNA, 19 nt, Leptospira interrogans serovar lai str. 56601
ccagaacggcgauccauag

SEQ ID NO: 753085 - RNA, 20 nt, Leptospira interrogans serovar lai str. 56601
ccagaauuuugaacauuuuc

SEQ ID NO: 753086 - RNA, 14 nt, Leptospira interrogans serovar lai str. 56601
ccagaagauugaaa

SEQ ID NO: 753087 - RNA, 14 nt, Leptospira interrogans serovar lai str. 56601
ccacuucucacaaa

SEQ ID NO: 753088 - RNA, 15 nt, Leptospira interrogans serovar lai str. 56601
ccacuucucacaaau

SEQ ID NO: 753089 - RNA, 17 nt, Leptospira interrogans serovar lai str. 56601
ccacuucucacaaauca

SEQ ID NO: 753090 - RNA, 15 nt, Leptospira interrogans serovar lai str. 56601
ccacuugaauagaac

SEQ ID NO: 753091 - RNA, 20 nt, Leptospira interrogans serovar lai str. 56601
ccacuguaaaaguuuuugaa

SEQ ID NO: 753092 - RNA, 12 nt, Leptospira interrogans serovar lai str. 56601
ccaccuauacua

SEQ ID NO: 753093 - RNA, 23 nt, Leptospira interrogans serovar lai str. 56601
ccaccuaaaaugaaaaaaaacaa

SEQ ID NO: 753094 - RNA, 23 nt, Leptospira interrogans serovar lai str. 56601
ccaccuuuuuuuaugaaaaaauu

SEQ ID NO: 753095 - RNA, 14 nt, Leptospira interrogans serovar lai str. 56601
ccaccuuuacauaa

SEQ ID NO: 753096 - RNA, 16 nt, Leptospira interrogans serovar lai str. 56601
ccaccuuggaaagaaa

SEQ ID NO: 753097 - RNA, 13 nt, Leptospira interrogans serovar lai str. 56601
ccaccaaaguaug

SEQ ID NO: 753098 - RNA, 17 nt, Leptospira interrogans serovar lai str. 56601
ccacaaguguuguaucu

SEQ ID NO: 753099 - RNA, 17 nt, Leptospira interrogans serovar lai str. 56601
ccacagguuuuaaacua

SEQ ID NO: 753100 - RNA, 21 nt, Leptospira interrogans serovar lai str. 56601
ccacaguaggcuauuuuacug

SEQ ID NO: 753101 - RNA, 14 nt, Leptospira interrogans serovar lai str. 56601
ccacauuuuuaaaa

SEQ ID NO: 753102 - RNA, 18 nt, Leptospira interrogans serovar lai str. 56601
ccacauuuuaaagguuga

SEQ ID NO: 753103 - RNA, 17 nt, Leptospira interrogans serovar lai str. 56601
ccacauuuucaaaaucu

SEQ ID NO: 753104 - RNA, 16 nt, Leptospira interrogans serovar lai str. 56601
ccacauuuauuuuuac

SEQ ID NO: 753105 - RNA, 16 nt, Leptospira interrogans serovar lai str. 56601
ccacauuuauuuuuua

SEQ ID NO: 753106 - RNA, 22 nt, Leptospira interrogans serovar lai str. 56601
ccacauuucaaaguuuugcugu

SEQ ID NO: 753107 - RNA, 18 nt, Leptospira interrogans serovar lai str. 56601
ccacaucgaaaaaacaaa

SEQ ID NO: 753108 - RNA, 16 nt, Leptospira interrogans serovar lai str. 56601
ccacaucuuauuuuua

SEQ ID NO: 753109 - RNA, 22 nt, Leptospira interrogans serovar lai str. 56601
ccacaucuuauuuuuacagaaa

SEQ ID NO: 753110 - RNA, 20 nt, Leptospira interrogans serovar lai str. 56601
ccaaugaugaucgcguaaua

SEQ ID NO: 753111 - RNA, 15 nt, Leptospira interrogans serovar lai str. 56601
ccaaguauucuauuu

SEQ ID NO: 753112 - RNA, 20 nt, Leptospira interrogans serovar lai str. 56601
ccacaaguucgccuacacug

SEQ ID NO: 753113 - RNA, 13 nt, Leptospira interrogans serovar lai str. 56601
ccacaaguugaau

SEQ ID NO: 753114 - RNA, 20 nt, Leptospira interrogans serovar lai str. 56601
ccaauuauaaaauuuuucuc

SEQ ID NO: 753115 - RNA, 19 nt, Leptospira interrogans serovar lai str. 56601
ccaauuaacaaaacugcuu

SEQ ID NO: 753116 - RNA, 12 nt, Leptospira interrogans serovar lai str. 56601
ccaauuccaaac

SEQ ID NO: 753117 - RNA, 13 nt, Leptospira interrogans serovar lai str. 56601
ccaauuccaaacg

SEQ ID NO: 753118 - RNA, 18 nt, Leptospira interrogans serovar lai str. 56601
ccaauuccaccuuggaaa

SEQ ID NO: 753119 - RNA, 23 nt, Leptospira interrogans serovar lai str. 56601
ccaauuccauuucuguaacaucc

SEQ ID NO: 753120 - RNA, 22 nt, Leptospira interrogans serovar lai str. 56601
ccaauucgguugacuccaaaaa

SEQ ID NO: 753121 - RNA, 13 nt, Leptospira interrogans serovar lai str. 56601
ccaauucuaaaau

SEQ ID NO: 753122 - RNA, 23 nt, Leptospira interrogans serovar lai str. 56601
ccaaauacuuagaauuuuuucgu

SEQ ID NO: 753123 - RNA, 15 nt, Leptospira interrogans serovar lai str. 56601
ccaaauaauaaaacu

SEQ ID NO: 753124 - RNA, 22 nt, Leptospira interrogans serovar lai str. 56601
ccaaccccacaaguguuguauc

SEQ ID NO: 753125 - RNA, 19 nt, Leptospira interrogans serovar lai str. 56601
ccaaccagagccguaaaua

SEQ ID NO: 753126 - RNA, 18 nt, Leptospira interrogans serovar lai str. 56601
ccaaauuguuuucuaaag

SEQ ID NO: 753127 - RNA, 15 nt, Leptospira interrogans serovar lai str. 56601
ccaaauugccaaaug

SEQ ID NO: 753128 - RNA, 17 nt, Leptospira interrogans serovar lai str. 56601
ccaaacucaaugcugcu

SEQ ID NO: 753129 - RNA, 18 nt, Leptospira interrogans serovar lai str. 56601
ccaaacucaaugcugcuc

SEQ ID NO: 753130 - RNA, 16 nt, Leptospira interrogans serovar lai str. 56601
ccaaaccgauuuuugu

SEQ ID NO: 753131 - RNA, 13 nt, Leptospira interrogans serovar lai str. 56601
ccaaaauuuagaa

SEQ ID NO: 753132 - RNA, 17 nt, Leptospira interrogans serovar lai str. 56601
ccaaacaauuuuuugaa

SEQ ID NO: 753133 - RNA, 19 nt, Leptospira interrogans serovar lai str. 56601
ccaaacacgaauuccucaa

SEQ ID NO: 753134 - RNA, 19 nt, Leptospira interrogans serovar lai str. 56601
ccaaacagccaaagaaaua

SEQ ID NO: 753135 - RNA, 21 nt, Leptospira interrogans serovar lai str. 56601
ccaaaaagaaaaacagguaaa

SEQ ID NO: 753136 - RNA, 19 nt, Leptospira interrogans serovar lai str. 56601
ccaaaaacguaagcuugau

SEQ ID NO: 753137 - RNA, 21 nt, Leptospira interrogans serovar lai str. 56601
ccaaaaauagggaaaacucaa

SEQ ID NO: 753138 - RNA, 21 nt, Leptospira interrogans serovar lai str. 56601
ccaaaaauagggaaaacucau

SEQ ID NO: 753139 - RNA, 22 nt, Leptospira interrogans serovar lai str. 56601
ccaaaaaugcaaaaguuuucaa

SEQ ID NO: 753140 - RNA, 12 nt, Leptospira interrogans serovar lai str. 56601
ccaaaaauucag

SEQ ID NO: 753141 - RNA, 11 nt, Leptospira interrogans serovar lai str. 56601
ccaaaaucuua

SEQ ID NO: 753142 - RNA, 21 nt, Leptospira interrogans serovar lai str. 56601
ccaaaaucuuuagaauuuuuc

SEQ ID NO: 753143 - RNA, 17 nt, Leptospira interrogans serovar lai str. 56601
ccaaaaugaauuguaaa

SEQ ID NO: 753144 - RNA, 13 nt, Leptospira interrogans serovar lai str. 56601
ccaaaaucccaga

SEQ ID NO: 753145 - RNA, 17 nt, Leptospira interrogans serovar lai str. 56601
ccaaaaucccagaaagg

SEQ ID NO: 753146 - RNA, 21 nt, Leptospira interrogans serovar lai str. 56601
ccaaaacgcgauccguaaaaa

SEQ ID NO: 753147 - RNA, 21 nt, Leptospira interrogans serovar lai str. 56601
ccaaaaccucaaaaaauuuua

SEQ ID NO: 753148 - RNA, 19 nt, Leptospira interrogans serovar lai str. 56601
ccaaaaggcacauuuuuca

SEQ ID NO: 753149 - RNA, 15 nt, Leptospira interrogans serovar lai str. 56601
ccaaaagaacuuuga

SEQ ID NO: 753150 - RNA, 20 nt, Leptospira interrogans serovar lai str. 56601
ccaaaaguccaauuuuaaaa

SEQ ID NO: 753151 - RNA, 22 nt, Leptospira interrogans serovar lai str. 56601
ccaaaaaaagucucaaaaccug

SEQ ID NO: 753152 - RNA, 21 nt, Leptospira interrogans serovar lai str. 56601
cauuuuuuucgaauugaguuu

SEQ ID NO: 753153 - RNA, 19 nt, Leptospira interrogans serovar lai str. 56601
cauuuuuugggcuucugaa

SEQ ID NO: 753154 - RNA, 14 nt, Leptospira interrogans serovar lai str. 56601
cauuuuucuuaaaa

SEQ ID NO: 753155 - RNA, 15 nt, Leptospira interrogans serovar lai str. 56601
cauuuuucuuaaaaa

SEQ ID NO: 753156 - RNA, 17 nt, Leptospira interrogans serovar lai str. 56601
cauuuuucuuaaaaaaa

SEQ ID NO: 753157 - RNA, 12 nt, Leptospira interrogans serovar lai str. 56601
cauuuuuuaaau

SEQ ID NO: 753158 - RNA, 16 nt, Leptospira interrogans serovar lai str. 56601
cauuuuugugaaacuu

SEQ ID NO: 753159 - RNA, 11 nt, Leptospira interrogans serovar lai str. 56601
cauuuuuaaaa

SEQ ID NO: 753160 - RNA, 22 nt, Leptospira interrogans serovar lai str. 56601
cauuuuguugcguuuaaaaaca

SEQ ID NO: 753161 - RNA, 20 nt, Leptospira interrogans serovar lai str. 56601
cauuuuuaaaaauuagaacu

SEQ ID NO: 753162 - RNA, 23 nt, Leptospira interrogans serovar lai str. 56601
cauuuuuagaauuuguuuuuaaa

SEQ ID NO: 753163 - RNA, 16 nt, Leptospira interrogans serovar lai str. 56601
cauuuuucaaauaaag

SEQ ID NO: 753164 - RNA, 18 nt, Leptospira interrogans serovar lai str. 56601
cauuuuucaaauaaagaa

SEQ ID NO: 753165 - RNA, 17 nt, Leptospira interrogans serovar lai str. 56601
cauuuuuccauaaaaaa

SEQ ID NO: 753166 - RNA, 12 nt, Leptospira interrogans serovar lai str. 56601
cauuuuucaagu

SEQ ID NO: 753167 - RNA, 20 nt, Leptospira interrogans serovar lai str. 56601
cauuuugaguagccaauuga

SEQ ID NO: 753168 - RNA, 21 nt, Leptospira interrogans serovar lai str. 56601
cauuuugcccuauugcuuuau

SEQ ID NO: 753169 - RNA, 15 nt, Leptospira interrogans serovar lai str. 56601
cauugaagaaaaaaa

SEQ ID NO: 753170 - RNA, 14 nt, Leptospira interrogans serovar lai str. 56601
cauucuuauaaaga

SEQ ID NO: 753171 - RNA, 19 nt, Leptospira interrogans serovar lai str. 56601
cauucuuuuugccaauuca

SEQ ID NO: 753172 - RNA, 15 nt, Leptospira interrogans serovar lai str. 56601
cauugaaaucagagu

SEQ ID NO: 753173 - RNA, 17 nt, Leptospira interrogans serovar lai str. 56601
cauucuuuaaaauagaa

SEQ ID NO: 753174 - RNA, 19 nt, Leptospira interrogans serovar lai str. 56601
cauucuuuccuauaaaagu

SEQ ID NO: 753175 - RNA, 17 nt, Leptospira interrogans serovar lai str. 56601
cauucuuuagaaauuuu

SEQ ID NO: 753176 - RNA, 18 nt, Leptospira interrogans serovar lai str. 56601
cauucuuuagaaauuuuu

SEQ ID NO: 753177 - RNA, 22 nt, Leptospira interrogans serovar lai str. 56601
cauucuuuagaaauuuuuaauc

SEQ ID NO: 753178 - RNA, 16 nt, Leptospira interrogans serovar lai str. 56601
cauuccauaggcaauu

SEQ ID NO: 753179 - RNA, 19 nt, Leptospira interrogans serovar lai str. 56601
cauucccauccgaaauccc

SEQ ID NO: 753180 - RNA, 15 nt, Leptospira interrogans serovar lai str. 56601
cauucuaguuuguuu

SEQ ID NO: 753181 - RNA, 19 nt, Leptospira interrogans serovar lai str. 56601
cauucuaguuuguuuaucc

SEQ ID NO: 753182 - RNA, 15 nt, Leptospira interrogans serovar lai str. 56601
cauucugaaacuuuu

SEQ ID NO: 753183 - RNA, 20 nt, Leptospira interrogans serovar lai str. 56601
cauucugaaacuuuucaaaa

SEQ ID NO: 753184 - RNA, 14 nt, Leptospira interrogans serovar lai str. 56601
cauuacaaaacacu

SEQ ID NO: 753185 - RNA, 16 nt, Leptospira interrogans serovar lai str. 56601
cauuaauuacagaauu

SEQ ID NO: 753186 - RNA, 17 nt, Leptospira interrogans serovar lai str. 56601
cauuaugaauuuuuaaa

SEQ ID NO: 753187 - RNA, 18 nt, Leptospira interrogans serovar lai str. 56601
cauuaugcgcaaucucaa

SEQ ID NO: 753188 - RNA, 14 nt, Leptospira interrogans serovar lai str. 56601
cauuauuagaguug

SEQ ID NO: 753189 - RNA, 15 nt, Leptospira interrogans serovar lai str. 56601
cauucauuuuuucua

SEQ ID NO: 753190 - RNA, 11 nt, Leptospira interrogans serovar lai str. 56601
cauuaaaaagc

SEQ ID NO: 753191 - RNA, 15 nt, Leptospira interrogans serovar lai str. 56601
cauuaaaaaagauaa

SEQ ID NO: 753192 - RNA, 17 nt, Leptospira interrogans serovar lai str. 56601
cauuaaaauuuucaucu

SEQ ID NO: 753193 - RNA, 17 nt, Leptospira interrogans serovar lai str. 56601
cauuaaacaauuuuuca

SEQ ID NO: 753194 - RNA, 14 nt, Leptospira interrogans serovar lai str. 56601
cauuaaauucuagc

SEQ ID NO: 753195 - RNA, 17 nt, Leptospira interrogans serovar lai str. 56601
cauguuuuaaugaaaaa

SEQ ID NO: 753196 - RNA, 13 nt, Leptospira interrogans serovar lai str. 56601
cauguuuuuaaaa

SEQ ID NO: 753197 - RNA, 22 nt, Leptospira interrogans serovar lai str. 56601
cauguauauaaauuuauauuuu

SEQ ID NO: 753198 - RNA, 20 nt, Leptospira interrogans serovar lai str. 56601
cauguaaaacuuagaucuca

SEQ ID NO: 753199 - RNA, 19 nt, Leptospira interrogans serovar lai str. 56601
cauggccuucuggaaaaau

SEQ ID NO: 753200 - RNA, 16 nt, Leptospira interrogans serovar lai str. 56601
caugauucauuuaaaa

SEQ ID NO: 753201 - RNA, 20 nt, Leptospira interrogans serovar lai str. 56601
caugauucauuuuucuaaaa

SEQ ID NO: 753202 - RNA, 22 nt, Leptospira interrogans serovar lai str. 56601
caugauucauuuuucuaaaaaa

SEQ ID NO: 753203 - RNA, 20 nt, Leptospira interrogans serovar lai str. 56601
caugauucauuuuuugaaaa

SEQ ID NO: 753204 - RNA, 13 nt, Leptospira interrogans serovar lai str. 56601
caugauucugaaa

SEQ ID NO: 753205 - RNA, 18 nt, Leptospira interrogans serovar lai str. 56601
caugauucugaaaagaau

SEQ ID NO: 753206 - RNA, 14 nt, Leptospira interrogans serovar lai str. 56601
caugauuuguaaua

SEQ ID NO: 753207 - RNA, 15 nt, Leptospira interrogans serovar lai str. 56601
caugcaaaaauuuaa

SEQ ID NO: 753208 - RNA, 17 nt, Leptospira interrogans serovar lai str. 56601
caugauuuuuuaaucug

SEQ ID NO: 753209 - RNA, 20 nt, Leptospira interrogans serovar lai str. 56601
caugauuuuuuaaucuggaa

SEQ ID NO: 753210 - RNA, 23 nt, Leptospira interrogans serovar lai str. 56601
caugauuuuuuaaucuggaaacg

SEQ ID NO: 753211 - RNA, 19 nt, Leptospira interrogans serovar lai str. 56601
caucguuaccagcaagcac

SEQ ID NO: 753212 - RNA, 13 nt, Leptospira interrogans serovar lai str. 56601
caucguuccaaac

SEQ ID NO: 753213 - RNA, 15 nt, Leptospira interrogans serovar lai str. 56601
caucuugaaacccca

SEQ ID NO: 753214 - RNA, 16 nt, Leptospira interrogans serovar lai str. 56601
caucuuuuaaaaucaa

SEQ ID NO: 753215 - RNA, 20 nt, Leptospira interrogans serovar lai str. 56601
caucuuuuaaaaucaagagc

SEQ ID NO: 753216 - RNA, 21 nt, Leptospira interrogans serovar lai str. 56601
caucuuuuaaaaucaagagcu

SEQ ID NO: 753217 - RNA, 21 nt, Leptospira interrogans serovar lai str. 56601
caugaacgaauuuuucaacaa

SEQ ID NO: 753218 - RNA, 18 nt, Leptospira interrogans serovar lai str. 56601
caugaaauuuucuuagaa

SEQ ID NO: 753219 - RNA, 21 nt, Leptospira interrogans serovar lai str. 56601
caugaauaaacaauaaaauaa

SEQ ID NO: 753220 - RNA, 22 nt, Leptospira interrogans serovar lai str. 56601
caugaauaaacaauaaaauaac

SEQ ID NO: 753221 - RNA, 16 nt, Leptospira interrogans serovar lai str. 56601
caugagcuugucccaa

SEQ ID NO: 753222 - RNA, 13 nt, Leptospira interrogans serovar lai str. 56601
caugauaaaaauu

SEQ ID NO: 753223 - RNA, 15 nt, Leptospira interrogans serovar lai str. 56601
caugauaaaaauugu

SEQ ID NO: 753224 - RNA, 21 nt, Leptospira interrogans serovar lai str. 56601
caugauaaaaauuguuaucgc

SEQ ID NO: 753225 - RNA, 14 nt, Leptospira interrogans serovar lai str. 56601
caugagacuauaaa

SEQ ID NO: 753226 - RNA, 23 nt, Leptospira interrogans serovar lai str. 56601
caugagauuauuaucuuguguuu

SEQ ID NO: 753227 - RNA, 17 nt, Leptospira interrogans serovar lai str. 56601
caugacuacagaauaaa

SEQ ID NO: 753228 - RNA, 13 nt, Leptospira interrogans serovar lai str. 56601
cauccgcauucuc

SEQ ID NO: 753229 - RNA, 20 nt, Leptospira interrogans serovar lai str. 56601
cauccauacaacuuucagau

SEQ ID NO: 753230 - RNA, 16 nt, Leptospira interrogans serovar lai str. 56601
caucccagaacaaaac

SEQ ID NO: 753231 - RNA, 16 nt, Leptospira interrogans serovar lai str. 56601
caucccgcccaaagua

SEQ ID NO: 753232 - RNA, 21 nt, Leptospira interrogans serovar lai str. 56601
cauccaaacucuuaaucugcu

SEQ ID NO: 753233 - RNA, 21 nt, Leptospira interrogans serovar lai str. 56601
cauccaauuauaaaauuuuuc

SEQ ID NO: 753234 - RNA, 12 nt, Leptospira interrogans serovar lai str. 56601
caucaauuauuu

SEQ ID NO: 753235 - RNA, 18 nt, Leptospira interrogans serovar lai str. 56601
caucacaacgcucuuuau

SEQ ID NO: 753236 - RNA, 13 nt, Leptospira interrogans serovar lai str. 56601
caucaaauuugcu

SEQ ID NO: 753237 - RNA, 19 nt, Leptospira interrogans serovar lai str. 56601
caucaaauuugcuucaaca

SEQ ID NO: 753238 - RNA, 15 nt, Leptospira interrogans serovar lai str. 56601
cauauuuucaaaaaa

SEQ ID NO: 753239 - RNA, 16 nt, Leptospira interrogans serovar lai str. 56601
cauauuuucaaaaaau

SEQ ID NO: 753240 - RNA, 17 nt, Leptospira interrogans serovar lai str. 56601
cauauuuucaaaaaaua

SEQ ID NO: 753241 - RNA, 16 nt, Leptospira interrogans serovar lai str. 56601
caucaaaaaaaugaua

SEQ ID NO: 753242 - RNA, 21 nt, Leptospira interrogans serovar lai str. 56601
cauaggaaauaauuccuccau

SEQ ID NO: 753243 - RNA, 22 nt, Leptospira interrogans serovar lai str. 56601
cauaggaaauaauuccuccaug

SEQ ID NO: 753244 - RNA, 16 nt, Leptospira interrogans serovar lai str. 56601
cauaggaaauucuuuu

SEQ ID NO: 753245 - RNA, 17 nt, Leptospira interrogans serovar lai str. 56601
cauaggaaauucuuuuc

SEQ ID NO: 753246 - RNA, 16 nt, Leptospira interrogans serovar lai str. 56601
cauaggauacaaaacu

SEQ ID NO: 753247 - RNA, 20 nt, Leptospira interrogans serovar lai str. 56601
cauaggcgcggaaaaauuau

SEQ ID NO: 753248 - RNA, 14 nt, Leptospira interrogans serovar lai str. 56601
cauaggugauuaaa

SEQ ID NO: 753249 - RNA, 17 nt, Leptospira interrogans serovar lai str. 56601
cauauauaauuuauucu

SEQ ID NO: 753250 - RNA, 18 nt, Leptospira interrogans serovar lai str. 56601
cauagauacauaaacugu

SEQ ID NO: 753251 - RNA, 22 nt, Leptospira interrogans serovar lai str. 56601
cauagaggcuuuacauuuuuaa

SEQ ID NO: 753252 - RNA, 22 nt, Leptospira interrogans serovar lai str. 56601
cauagagauagaaccuauaucu

SEQ ID NO: 753253 - RNA, 12 nt, Leptospira interrogans serovar lai str. 56601
cauagaagugaa

SEQ ID NO: 753254 - RNA, 15 nt, Leptospira interrogans serovar lai str. 56601
cauacuucuaaaaaa

SEQ ID NO: 753255 - RNA, 19 nt, Leptospira interrogans serovar lai str. 56601
cauacuuuuugcaaguaaa

SEQ ID NO: 753256 - RNA, 13 nt, Leptospira interrogans serovar lai str. 56601
cauacuuuuaaaa

SEQ ID NO: 753257 - RNA, 16 nt, Leptospira interrogans serovar lai str. 56601
cauacuuuuaaaaaau

SEQ ID NO: 753258 - RNA, 17 nt, Leptospira interrogans serovar lai str. 56601
cauacuuuuaaaaaauu

SEQ ID NO: 753259 - RNA, 18 nt, Leptospira interrogans serovar lai str. 56601
cauacuuuuagaagauuu

SEQ ID NO: 753260 - RNA, 17 nt, Leptospira interrogans serovar lai str. 56601
cgacaaucguaggcacg

SEQ ID NO: 753261 - RNA, 14 nt, Leptospira interrogans serovar lai str. 56601
cgacaagaaugagu

SEQ ID NO: 753262 - RNA, 20 nt, Leptospira interrogans serovar lai str. 56601
cgacaacuuauaauuuucuu

SEQ ID NO: 753263 - RNA, 14 nt, Leptospira interrogans serovar lai str. 56601
cgaauuguuuuuaa

SEQ ID NO: 753264 - RNA, 19 nt, Leptospira interrogans serovar lai str. 56601
cgaauuguuuuuaaauacu

SEQ ID NO: 753265 - RNA, 18 nt, Leptospira interrogans serovar lai str. 56601
cgaauucauuuaccuaaa

SEQ ID NO: 753266 - RNA, 14 nt, Leptospira interrogans serovar lai str. 56601
cgaauuucagauag

SEQ ID NO: 753267 - RNA, 17 nt, Leptospira interrogans serovar lai str. 56601
cgaauuuccauuucuga

SEQ ID NO: 753268 - RNA, 20 nt, Leptospira interrogans serovar lai str. 56601
cgaauuuuuuuuauuuuuag

SEQ ID NO: 753269 - RNA, 19 nt, Leptospira interrogans serovar lai str. 56601
cgacaaaaggauuccauuu

SEQ ID NO: 753270 - RNA, 20 nt, Leptospira interrogans serovar lai str. 56601
cgacaaaaggauuccauuuc

SEQ ID NO: 753271 - RNA, 19 nt, Leptospira interrogans serovar lai str. 56601
cgacagauucaauuuuuau

SEQ ID NO: 753272 - RNA, 20 nt, Leptospira interrogans serovar lai str. 56601
cgaauggaaaucuuuuaaaa

SEQ ID NO: 753273 - RNA, 21 nt, Leptospira interrogans serovar lai str. 56601
cgaauaguaccgucacaaacu

SEQ ID NO: 753274 - RNA, 19 nt, Leptospira interrogans serovar lai str. 56601
cgaaucauauuuaacugua

SEQ ID NO: 753275 - RNA, 12 nt, Leptospira interrogans serovar lai str. 56601
cgaauaaaaaac

SEQ ID NO: 753276 - RNA, 15 nt, Leptospira interrogans serovar lai str. 56601
cgaauaaaaaacuca

SEQ ID NO: 753277 - RNA, 22 nt, Leptospira interrogans serovar lai str. 56601
cgaagaauaucugcaaaauaac

SEQ ID NO: 753278 - RNA, 16 nt, Leptospira interrogans serovar lai str. 56601
cgaagaauuauuuacu

SEQ ID NO: 753279 - RNA, 17 nt, Leptospira interrogans serovar lai str. 56601
cgaacuucguuggaaag

SEQ ID NO: 753280 - RNA, 16 nt, Leptospira interrogans serovar lai str. 56601
cgaacgaauucuaaaa

SEQ ID NO: 753281 - RNA, 20 nt, Leptospira interrogans serovar lai str. 56601
cgaacgaauucuaaaauuug

SEQ ID NO: 753282 - RNA, 12 nt, Leptospira interrogans serovar lai str. 56601
cgaacucacaag

SEQ ID NO: 753283 - RNA, 19 nt, Leptospira interrogans serovar lai str. 56601
cgaacucacaaguugaaug

SEQ ID NO: 753284 - RNA, 14 nt, Leptospira interrogans serovar lai str. 56601
cgaacuacccaaaa

SEQ ID NO: 753285 - RNA, 20 nt, Leptospira interrogans serovar lai str. 56601
cgacguaaagaauucauuuu

SEQ ID NO: 753286 - RNA, 17 nt, Leptospira interrogans serovar lai str. 56601
cgaccuuucuaaaaauu

SEQ ID NO: 753287 - RNA, 15 nt, Leptospira interrogans serovar lai str. 56601
cgaccuguagagaag

SEQ ID NO: 753288 - RNA, 13 nt, Leptospira interrogans serovar lai str. 56601
cgaccuuaaauaa

SEQ ID NO: 753289 - RNA, 15 nt, Leptospira interrogans serovar lai str. 56601
cgaccuuaaauaaua

SEQ ID NO: 753290 - RNA, 18 nt, Leptospira interrogans serovar lai str. 56601
cgacccagaaaaaaccuc

SEQ ID NO: 753291 - RNA, 16 nt, Leptospira interrogans serovar lai str. 56601
cgaccccgucauuuac

SEQ ID NO: 753292 - RNA, 15 nt, Leptospira interrogans serovar lai str. 56601
cgacccuagaagccu

SEQ ID NO: 753293 - RNA, 21 nt, Leptospira interrogans serovar lai str. 56601
cgaccguuuccaugaaauaga

SEQ ID NO: 753294 - RNA, 23 nt, Leptospira interrogans serovar lai str. 56601
ccuuucaucuacauaaaaaagga

SEQ ID NO: 753295 - RNA, 13 nt, Leptospira interrogans serovar lai str. 56601
ccuuucaucucua

SEQ ID NO: 753296 - RNA, 22 nt, Leptospira interrogans serovar lai str. 56601
ccuuucauguuauaucgaauuc

SEQ ID NO: 753297 - RNA, 15 nt, Leptospira interrogans serovar lai str. 56601
ccuuucuaaaaauuu

SEQ ID NO: 753298 - RNA, 17 nt, Leptospira interrogans serovar lai str. 56601
ccuuuccuugaaaaaaa

SEQ ID NO: 753299 - RNA, 19 nt, Leptospira interrogans serovar lai str. 56601
ccuuuggcauacaucucua

SEQ ID NO: 753300 - RNA, 23 nt, Leptospira interrogans serovar lai str. 56601
ccuuuggacgaaucgaaugguac

SEQ ID NO: 753301 - RNA, 13 nt, Leptospira interrogans serovar lai str. 56601
ccuuuugaaucua

SEQ ID NO: 753302 - RNA, 22 nt, Leptospira interrogans serovar lai str. 56601
ccuuuugaaguaguaacacuca

SEQ ID NO: 753303 - RNA, 16 nt, Leptospira interrogans serovar lai str. 56601
ccuuuaguuuuuuagc

SEQ ID NO: 753304 - RNA, 16 nt, Leptospira interrogans serovar lai str. 56601
ccuuucacaucuccac

SEQ ID NO: 753305 - RNA, 16 nt, Leptospira interrogans serovar lai str. 56601
ccuuuauuuaaaaacc

SEQ ID NO: 753306 - RNA, 14 nt, Leptospira interrogans serovar lai str. 56601
ccuuuaauuacagu

SEQ ID NO: 753307 - RNA, 22 nt, Leptospira interrogans serovar lai str. 56601
ccuuuacauaauaauacagaau

SEQ ID NO: 753308 - RNA, 17 nt, Leptospira interrogans serovar lai str. 56601
ccuuuaauauuuucaga

SEQ ID NO: 753309 - RNA, 12 nt, Leptospira interrogans serovar lai str. 56601
ccuuuaaacuua

SEQ ID NO: 753310 - RNA, 21 nt, Leptospira interrogans serovar lai str. 56601
ccuuuaaauugaauucuuccu

SEQ ID NO: 753311 - RNA, 17 nt, Leptospira interrogans serovar lai str. 56601
ccuuguucauaaaaacg

SEQ ID NO: 753312 - RNA, 21 nt, Leptospira interrogans serovar lai str. 56601
ccuucggaauuucugcuacaa

SEQ ID NO: 753313 - RNA, 19 nt, Leptospira interrogans serovar lai str. 56601
ccuucuuuacaguuuuuaa

SEQ ID NO: 753314 - RNA, 14 nt, Leptospira interrogans serovar lai str. 56601
ccuucuuuucuucu

SEQ ID NO: 753315 - RNA, 14 nt, Leptospira interrogans serovar lai str. 56601
ccuucuuuuuucua

SEQ ID NO: 753316 - RNA, 23 nt, Leptospira interrogans serovar lai str. 56601
ccuucaaaacuaggaucuccuug

SEQ ID NO: 753317 - RNA, 19 nt, Leptospira interrogans serovar lai str. 56601
ccuuaccgccuucacccac

SEQ ID NO: 753318 - RNA, 17 nt, Leptospira interrogans serovar lai str. 56601
ccuuaccuccuuuuuca

SEQ ID NO: 753319 - RNA, 18 nt, Leptospira interrogans serovar lai str. 56601
ccuuaccuccuuuuucaa

SEQ ID NO: 753320 - RNA, 18 nt, Leptospira interrogans serovar lai str. 56601
ccuuacgaucuaaaagga

SEQ ID NO: 753321 - RNA, 19 nt, Leptospira interrogans serovar lai str. 56601
ccuuacgaucuaaaaggac

SEQ ID NO: 753322 - RNA, 14 nt, Leptospira interrogans serovar lai str. 56601
ccuuacauuuuuuu

SEQ ID NO: 753323 - RNA, 18 nt, Leptospira interrogans serovar lai str. 56601
ccuuacaaacuccgugaa

SEQ ID NO: 753324 - RNA, 16 nt, Leptospira interrogans serovar lai str. 56601
ccugggaaguuguauc

SEQ ID NO: 753325 - RNA, 17 nt, Leptospira interrogans serovar lai str. 56601
ccuggcucucagcucug

SEQ ID NO: 753326 - RNA, 23 nt, Leptospira interrogans serovar lai str. 56601
ccuggauuuguaauaguucccac

SEQ ID NO: 753327 - RNA, 14 nt, Leptospira interrogans serovar lai str. 56601
ccuggaaaagaauc

SEQ ID NO: 753328 - RNA, 21 nt, Leptospira interrogans serovar lai str. 56601
ccgggauuuuaaaaauuuuga

SEQ ID NO: 753329 - RNA, 22 nt, Leptospira interrogans serovar lai str. 56601
aaaccgucccaaaaucuuaaaa

SEQ ID NO: 753330 - RNA, 18 nt, Leptospira interrogans serovar lai str. 56601
ccggaccgggcucuucag

SEQ ID NO: 753331 - RNA, 14 nt, Leptospira interrogans serovar lai str. 56601
ccgcuguaugaaaa

SEQ ID NO: 753332 - RNA, 20 nt, Leptospira interrogans serovar lai str. 56601
ccggauuuguugauuuuuga

SEQ ID NO: 753333 - RNA, 13 nt, Leptospira interrogans serovar lai str. 56601
ccuccuugaguuu

SEQ ID NO: 753334 - RNA, 22 nt, Leptospira interrogans serovar lai str. 56601
ccuauuguauuugauuuuaccu

SEQ ID NO: 753335 - RNA, 19 nt, Leptospira interrogans serovar lai str. 56601
ccuauuuuuuuaaaaaauu

SEQ ID NO: 753336 - RNA, 18 nt, Leptospira interrogans serovar lai str. 56601
ccuauauuuuaaauucaa

SEQ ID NO: 753337 - RNA, 17 nt, Leptospira interrogans serovar lai str. 56601
ccuauauuuugauaaag

SEQ ID NO: 753338 - RNA, 22 nt, Leptospira interrogans serovar lai str. 56601
ccuaguuuaugugaguucccau

SEQ ID NO: 753339 - RNA, 17 nt, Leptospira interrogans serovar lai str. 56601
ccuacauucauuuuuau

SEQ ID NO: 753340 - RNA, 17 nt, Leptospira interrogans serovar lai str. 56601
ccuacauuuauuuuuac

SEQ ID NO: 753341 - RNA, 21 nt, Leptospira interrogans serovar lai str. 56601
ccuacauuuuauuuuuuauga

SEQ ID NO: 753342 - RNA, 13 nt, Leptospira interrogans serovar lai str. 56601
ccuacauuuuuua

SEQ ID NO: 753343 - RNA, 17 nt, Leptospira interrogans serovar lai str. 56601
ccuacauuuuuuaucaa

SEQ ID NO: 753344 - RNA, 17 nt, Leptospira interrogans serovar lai str. 56601
ccuacaucauuuguaga

SEQ ID NO: 753345 - RNA, 14 nt, Leptospira interrogans serovar lai str. 56601
ccuaauuuuagaga

SEQ ID NO: 753346 - RNA, 22 nt, Leptospira interrogans serovar lai str. 56601
ccuaauaccgugguaucuacau

SEQ ID NO: 753347 - RNA, 17 nt, Leptospira interrogans serovar lai str. 56601
ccuaauccaauaaaauu

SEQ ID NO: 753348 - RNA, 16 nt, Leptospira interrogans serovar lai str. 56601
ccuaaugaaaaagaaa

SEQ ID NO: 753349 - RNA, 21 nt, Leptospira interrogans serovar lai str. 56601
ccuacuuauuucuauaaaauu

SEQ ID NO: 753350 - RNA, 23 nt, Leptospira interrogans serovar lai str. 56601
ccuacgcuucaaucucuuucuca

SEQ ID NO: 753351 - RNA, 18 nt, Leptospira interrogans serovar lai str. 56601
aaacgaucagaaaaacaa

SEQ ID NO: 753352 - RNA, 20 nt, Leptospira interrogans serovar lai str. 56601
aaacgaucagaaaaacaaaa

SEQ ID NO: 753353 - RNA, 22 nt, Leptospira interrogans serovar lai str. 56601
aaacgaucagaaaaacaaaaaa

SEQ ID NO: 753354 - RNA, 19 nt, Leptospira interrogans serovar lai str. 56601
aaacgaucauacuuuagaa

SEQ ID NO: 753355 - RNA, 22 nt, Leptospira interrogans serovar lai str. 56601
aaacgaucggaaggauuagcau

SEQ ID NO: 753356 - RNA, 16 nt, Leptospira interrogans serovar lai str. 56601
aaacgaucuacuuugc

SEQ ID NO: 753357 - RNA, 12 nt, Leptospira interrogans serovar lai str. 56601
ccguuauuaaaa

SEQ ID NO: 753358 - RNA, 13 nt, Leptospira interrogans serovar lai str. 56601
ccguuauuuuuuu

SEQ ID NO: 753359 - RNA, 12 nt, Leptospira interrogans serovar lai str. 56601
ccguuuuuaaau

SEQ ID NO: 753360 - RNA, 11 nt, Leptospira interrogans serovar lai str. 56601
ccuaaacccug

SEQ ID NO: 753361 - RNA, 18 nt, Leptospira interrogans serovar lai str. 56601
ccuaaaaugugggaacuc

SEQ ID NO: 753362 - RNA, 13 nt, Leptospira interrogans serovar lai str. 56601
ccuaaaauuuuaa

SEQ ID NO: 753363 - RNA, 12 nt, Leptospira interrogans serovar lai str. 56601
ccuaaaaugaaa

SEQ ID NO: 753364 - RNA, 19 nt, Leptospira interrogans serovar lai str. 56601
ccuaaaauggauuuauaau

SEQ ID NO: 753365 - RNA, 17 nt, Leptospira interrogans serovar lai str. 56601
ccuaaaaauuguugaag

SEQ ID NO: 753366 - RNA, 17 nt, Leptospira interrogans serovar lai str. 56601
ccuaaaaaauuuuuaga

SEQ ID NO: 753367 - RNA, 15 nt, Leptospira interrogans serovar lai str. 56601
ccuaauauaucagau

SEQ ID NO: 753368 - RNA, 15 nt, Leptospira interrogans serovar lai str. 56601
ccuaauaacuuguuc

SEQ ID NO: 753369 - RNA, 19 nt, Leptospira interrogans serovar lai str. 56601
ccuaaggauccaauacaaa

SEQ ID NO: 753370 - RNA, 16 nt, Leptospira interrogans serovar lai str. 56601
ccuaagaaucaaaucu

SEQ ID NO: 753371 - RNA, 15 nt, Leptospira interrogans serovar lai str. 56601
ccuaacccugcaaag

SEQ ID NO: 753372 - RNA, 20 nt, Leptospira interrogans serovar lai str. 56601
ccgcaaaacgguaauuuuau

SEQ ID NO: 753373 - RNA, 12 nt, Leptospira interrogans serovar lai str. 56601
ccgcauuuuuau

SEQ ID NO: 753374 - RNA, 15 nt, Leptospira interrogans serovar lai str. 56601
aaaccagcaaaacac

SEQ ID NO: 753375 - RNA, 18 nt, Leptospira interrogans serovar lai str. 56601
aaaccagcaaaacacuuu

SEQ ID NO: 753376 - RNA, 14 nt, Leptospira interrogans serovar lai str. 56601
aaaccauaaaauaa

SEQ ID NO: 753377 - RNA, 19 nt, Leptospira interrogans serovar lai str. 56601
aaaccaucgauuuacuuua

SEQ ID NO: 753378 - RNA, 16 nt, Leptospira interrogans serovar lai str. 56601
aaaccaucucaaaaac

SEQ ID NO: 753379 - RNA, 17 nt, Leptospira interrogans serovar lai str. 56601
aaaccaucucaaaaaca

SEQ ID NO: 753380 - RNA, 22 nt, Leptospira interrogans serovar lai str. 56601
ccgccaguuuuuugagaaacaa

SEQ ID NO: 753381 - RNA, 19 nt, Leptospira interrogans serovar lai str. 56601
aaacccaucguaaacaaaa

SEQ ID NO: 753382 - RNA, 16 nt, Leptospira interrogans serovar lai str. 56601
aaacccaauaccaaac

SEQ ID NO: 753383 - RNA, 16 nt, Leptospira interrogans serovar lai str. 56601
aaacccaaaaauguag

SEQ ID NO: 753384 - RNA, 23 nt, Leptospira interrogans serovar lai str. 56601
ccgacuugagauuccuuuuaaga

SEQ ID NO: 753385 - RNA, 22 nt, Leptospira interrogans serovar lai str. 56601
aaacauucaaauuucugaaaca

SEQ ID NO: 753386 - RNA, 14 nt, Leptospira interrogans serovar lai str. 56601
aaacauuccaauuu

SEQ ID NO: 753387 - RNA, 15 nt, Leptospira interrogans serovar lai str. 56601
ccgacagauuuauau

SEQ ID NO: 753388 - RNA, 19 nt, Leptospira interrogans serovar lai str. 56601
ccgacauaugcugccuaug

SEQ ID NO: 753389 - RNA, 21 nt, Leptospira interrogans serovar lai str. 56601
aaacauccaauuauaaaauuu

SEQ ID NO: 753390 - RNA, 20 nt, Leptospira interrogans serovar lai str. 56601
ccgaagaauccgaaaaaccu

SEQ ID NO: 753391 - RNA, 14 nt, Leptospira interrogans serovar lai str. 56601
ccgaagaauuauuu

SEQ ID NO: 753392 - RNA, 18 nt, Leptospira interrogans serovar lai str. 56601
ccgaaucuggaagccaaa

SEQ ID NO: 753393 - RNA, 23 nt, Leptospira interrogans serovar lai str. 56601
ccgaaucuggaagccaaaaccaa

SEQ ID NO: 753394 - RNA, 20 nt, Leptospira interrogans serovar lai str. 56601
aaacauuagaguuguugaaa

SEQ ID NO: 753395 - RNA, 16 nt, Leptospira interrogans serovar lai str. 56601
aaacaucacuuccauu

SEQ ID NO: 753396 - RNA, 20 nt, Leptospira interrogans serovar lai str. 56601
ccgaacucacaaguugaaug

SEQ ID NO: 753397 - RNA, 21 nt, Leptospira interrogans serovar lai str. 56601
ccgaaagcguuucguucuuuu

SEQ ID NO: 753398 - RNA, 20 nt, Leptospira interrogans serovar lai str. 56601
aaacauaauacgauaauauu

SEQ ID NO: 753399 - RNA, 23 nt, Leptospira interrogans serovar lai str. 56601
aaacauacuuuuugcaaguaaaa

SEQ ID NO: 753400 - RNA, 18 nt, Leptospira interrogans serovar lai str. 56601
ccgaaaccucaaaaaauu

SEQ ID NO: 753401 - RNA, 12 nt, Leptospira interrogans serovar lai str. 56601
ccgaaaauguag

SEQ ID NO: 753402 - RNA, 15 nt, Leptospira interrogans serovar lai str. 56601
cccuuaaucauuuuu

SEQ ID NO: 753403 - RNA, 17 nt, Leptospira interrogans serovar lai str. 56601
aaacaggaaaauuuaaa

SEQ ID NO: 753404 - RNA, 15 nt, Leptospira interrogans serovar lai str. 56601
aaacagguaaaccug

SEQ ID NO: 753405 - RNA, 15 nt, Leptospira interrogans serovar lai str. 56601
cccuaguuuauguga

SEQ ID NO: 753406 - RNA, 22 nt, Leptospira interrogans serovar lai str. 56601
cccuaguuuaugugaguuccca

SEQ ID NO: 753407 - RNA, 21 nt, Leptospira interrogans serovar lai str. 56601
cccuagaagccugaguuugag

SEQ ID NO: 753408 - RNA, 21 nt, Leptospira interrogans serovar lai str. 56601
cccucugggaucggaaccaaa

SEQ ID NO: 753409 - RNA, 21 nt, Leptospira interrogans serovar lai str. 56601
cccugcaaaggcgggaauaaa

SEQ ID NO: 753410 - RNA, 18 nt, Leptospira interrogans serovar lai str. 56601
cccucgaaaucugaccuc

SEQ ID NO: 753411 - RNA, 17 nt, Leptospira interrogans serovar lai str. 56601
cccuauuguauuugauu

SEQ ID NO: 753412 - RNA, 13 nt, Leptospira interrogans serovar lai str. 56601
cccucccguuauu

SEQ ID NO: 753413 - RNA, 17 nt, Leptospira interrogans serovar lai str. 56601
cccucccguuauuuuuu

SEQ ID NO: 753414 - RNA, 23 nt, Leptospira interrogans serovar lai str. 56601
cccucccguuauuuuuuuuacau

SEQ ID NO: 753415 - RNA, 20 nt, Leptospira interrogans serovar lai str. 56601
cccaugauagaguucugaaa

SEQ ID NO: 753416 - RNA, 16 nt, Leptospira interrogans serovar lai str. 56601
ccccaccuaaaaugaa

SEQ ID NO: 753417 - RNA, 16 nt, Leptospira interrogans serovar lai str. 56601
ccccaucucuucgucu

SEQ ID NO: 753418 - RNA, 20 nt, Leptospira interrogans serovar lai str. 56601
cccaguauuuugcacugaaa

SEQ ID NO: 753419 - RNA, 14 nt, Leptospira interrogans serovar lai str. 56601
aaacaauucuuccu

SEQ ID NO: 753420 - RNA, 16 nt, Leptospira interrogans serovar lai str. 56601
aaacaauugauugcuu

SEQ ID NO: 753421 - RNA, 12 nt, Leptospira interrogans serovar lai str. 56601
aaacaauuuuuc

SEQ ID NO: 753422 - RNA, 15 nt, Leptospira interrogans serovar lai str. 56601
aaacaauuuuucaag

SEQ ID NO: 753423 - RNA, 16 nt, Leptospira interrogans serovar lai str. 56601
aaacaauuuuuugaaa

SEQ ID NO: 753424 - RNA, 17 nt, Leptospira interrogans serovar lai str. 56601
aaacaauuuuuugaaaa

SEQ ID NO: 753425 - RNA, 23 nt, Leptospira interrogans serovar lai str. 56601
aaacaauuuuuugaaaaagaaua

SEQ ID NO: 753426 - RNA, 15 nt, Leptospira interrogans serovar lai str. 56601
aaacacaugagcauu

SEQ ID NO: 753427 - RNA, 18 nt, Leptospira interrogans serovar lai str. 56601
aaacaccacaauuuacaa

SEQ ID NO: 753428 - RNA, 15 nt, Leptospira interrogans serovar lai str. 56601
cccauauaauuuuau

SEQ ID NO: 753429 - RNA, 17 nt, Leptospira interrogans serovar lai str. 56601
cccauccgaaaucccaa

SEQ ID NO: 753430 - RNA, 19 nt, Leptospira interrogans serovar lai str. 56601
cccauccgaaaucccaaaa

SEQ ID NO: 753431 - RNA, 18 nt, Leptospira interrogans serovar lai str. 56601
cccaucgcacgucccaca

SEQ ID NO: 753432 - RNA, 21 nt, Leptospira interrogans serovar lai str. 56601
cccaucgcacgucccacaaau

SEQ ID NO: 753433 - RNA, 16 nt, Leptospira interrogans serovar lai str. 56601
cccagaacaaaacguu

SEQ ID NO: 753434 - RNA, 12 nt, Leptospira interrogans serovar lai str. 56601
cccagaaaaaac

SEQ ID NO: 753435 - RNA, 15 nt, Leptospira interrogans serovar lai str. 56601
ccaugguuuuuucaa

SEQ ID NO: 753436 - RNA, 11 nt, Leptospira interrogans serovar lai str. 56601
ccauuaacuau

SEQ ID NO: 753437 - RNA, 13 nt, Leptospira interrogans serovar lai str. 56601
ccauguuuuuaaa

SEQ ID NO: 753438 - RNA, 14 nt, Leptospira interrogans serovar lai str. 56601
ccauucuaaaaucu

SEQ ID NO: 753439 - RNA, 19 nt, Leptospira interrogans serovar lai str. 56601
ccauucuaaaaucuggauu

SEQ ID NO: 753440 - RNA, 17 nt, Leptospira interrogans serovar lai str. 56601
ccauuucuguaacaucc

SEQ ID NO: 753441 - RNA, 21 nt, Leptospira interrogans serovar lai str. 56601
ccauuuuagcauaaguucguc

SEQ ID NO: 753442 - RNA, 21 nt, Leptospira interrogans serovar lai str. 56601
ccauuuuccuucggugauacu

SEQ ID NO: 753443 - RNA, 12 nt, Leptospira interrogans serovar lai str. 56601
ccauuuuucuuc

SEQ ID NO: 753444 - RNA, 12 nt, Leptospira interrogans serovar lai str. 56601
ccauuuuuuaga

SEQ ID NO: 753445 - RNA, 23 nt, Leptospira interrogans serovar lai str. 56601
ccauuuuguugcguuuaaaaaca

SEQ ID NO: 753446 - RNA, 19 nt, Leptospira interrogans serovar lai str. 56601
ccauuuuuagucauuuccu

SEQ ID NO: 753447 - RNA, 23 nt, Leptospira interrogans serovar lai str. 56601
ccauuuuuuucuccuuuuuuacu

SEQ ID NO: 753448 - RNA, 23 nt, Leptospira interrogans serovar lai str. 56601
cccaacgguaacgagcaucuuua

SEQ ID NO: 753449 - RNA, 16 nt, Leptospira interrogans serovar lai str. 56601
ccauccacaaaggcac

SEQ ID NO: 753450 - RNA, 16 nt, Leptospira interrogans serovar lai str. 56601
aaacaaucuuagaaug

SEQ ID NO: 753451 - RNA, 18 nt, Leptospira interrogans serovar lai str. 56601
ccaucuuugauauuugga

SEQ ID NO: 753452 - RNA, 23 nt, Leptospira interrogans serovar lai str. 56601
ccauggaggcugccgcucuuucu

SEQ ID NO: 753453 - RNA, 22 nt, Leptospira interrogans serovar lai str. 56601
ccaguauuuuacgcuuaaauag

SEQ ID NO: 753454 - RNA, 18 nt, Leptospira interrogans serovar lai str. 56601
ccauaggcgcggaaaaau

SEQ ID NO: 753455 - RNA, 17 nt, Leptospira interrogans serovar lai str. 56601
ccauacaaaauuuaaaa

SEQ ID NO: 753456 - RNA, 18 nt, Leptospira interrogans serovar lai str. 56601
ccauacaaaauuuaaaaa

SEQ ID NO: 753457 - RNA, 16 nt, Leptospira interrogans serovar lai str. 56601
ccauaaaauagaaaca

SEQ ID NO: 753458 - RNA, 15 nt, Leptospira interrogans serovar lai str. 56601
ccauaaaauaaaaaa

SEQ ID NO: 753459 - RNA, 14 nt, Leptospira interrogans serovar lai str. 56601
ccauaaaaaaugaa

SEQ ID NO: 753460 - RNA, 11 nt, Leptospira interrogans serovar lai str. 56601
ccauaaaaacg

SEQ ID NO: 753461 - RNA, 21 nt, Leptospira interrogans serovar lai str. 56601
cgcauaaaacucuaaauucag

SEQ ID NO: 753462 - RNA, 18 nt, Leptospira interrogans serovar lai str. 56601
cgcauaaaagaaauuuaa

SEQ ID NO: 753463 - RNA, 22 nt, Leptospira interrogans serovar lai str. 56601
cgcauaaaagaaauuuaauaca

SEQ ID NO: 753464 - RNA, 17 nt, Leptospira interrogans serovar lai str. 56601
aaacggugcauuuaaaa

SEQ ID NO: 753465 - RNA, 13 nt, Leptospira interrogans serovar lai str. 56601
aaacgguuuuagu

SEQ ID NO: 753466 - RNA, 18 nt, Leptospira interrogans serovar lai str. 56601
aaacgguuuucuaauuua

SEQ ID NO: 753467 - RNA, 14 nt, Leptospira interrogans serovar lai str. 56601
cgcagacucuucuc

SEQ ID NO: 753468 - RNA, 22 nt, Leptospira interrogans serovar lai str. 56601
cgcagaggaaacguauuuuuac

SEQ ID NO: 753469 - RNA, 24 nt, Leptospira interrogans serovar lai str. 56601
cgauuucauccaugucuucuaaau

SEQ ID NO: 753470 - RNA, 19 nt, Leptospira interrogans serovar lai str. 56601
cgauuucuacaauggagga

SEQ ID NO: 753471 - RNA, 21 nt, Leptospira interrogans serovar lai str. 56601
cgauuucuauccauucuagaa

SEQ ID NO: 753472 - RNA, 19 nt, Leptospira interrogans serovar lai str. 56601
cgcaaguucgguagaaaga

SEQ ID NO: 753473 - RNA, 15 nt, Leptospira interrogans serovar lai str. 56601
cgcaaugaaaauucc

SEQ ID NO: 753474 - RNA, 15 nt, Leptospira interrogans serovar lai str. 56601
cgauuuaaaaacuau

SEQ ID NO: 753475 - RNA, 12 nt, Leptospira interrogans serovar lai str. 56601
cgauucaauucg

SEQ ID NO: 753476 - RNA, 16 nt, Leptospira interrogans serovar lai str. 56601
cgauucacuuccauug

SEQ ID NO: 753477 - RNA, 18 nt, Leptospira interrogans serovar lai str. 56601
cgauuauguaauauacaa

SEQ ID NO: 753478 - RNA, 15 nt, Leptospira interrogans serovar lai str. 56601
cgauuaaauuuugaa

SEQ ID NO: 753479 - RNA, 19 nt, Leptospira interrogans serovar lai str. 56601
cgaucuuguagacaaauca

SEQ ID NO: 753480 - RNA, 13 nt, Leptospira interrogans serovar lai str. 56601
cgaucuaaaagga

SEQ ID NO: 753481 - RNA, 18 nt, Leptospira interrogans serovar lai str. 56601
cgaucuguaaaauucaga

SEQ ID NO: 753482 - RNA, 13 nt, Leptospira interrogans serovar lai str. 56601
cgaucauucuuua

SEQ ID NO: 753483 - RNA, 14 nt, Leptospira interrogans serovar lai str. 56601
cgauccgaugcauu

SEQ ID NO: 753484 - RNA, 15 nt, Leptospira interrogans serovar lai str. 56601
cgauccguaaaaaac

SEQ ID NO: 753485 - RNA, 15 nt, Leptospira interrogans serovar lai str. 56601
cgaucgcgggcaauu

SEQ ID NO: 753486 - RNA, 19 nt, Leptospira interrogans serovar lai str. 56601
cgauagaagcgagagacgc

SEQ ID NO: 753487 - RNA, 17 nt, Leptospira interrogans serovar lai str. 56601
cgauauaauaaaauccc

SEQ ID NO: 753488 - RNA, 24 nt, Leptospira interrogans serovar lai str. 56601
cgaucacgucgcuuacaaagugau

SEQ ID NO: 753489 - RNA, 23 nt, Leptospira interrogans serovar lai str. 56601
cgauaacggucuccuuagaaagc

SEQ ID NO: 753490 - RNA, 13 nt, Leptospira interrogans serovar lai str. 56601
cgcccaaacccca

SEQ ID NO: 753491 - RNA, 16 nt, Leptospira interrogans serovar lai str. 56601
cgccauguuuuuaaaa

SEQ ID NO: 753492 - RNA, 14 nt, Leptospira interrogans serovar lai str. 56601
cgcuucacagagua

SEQ ID NO: 753493 - RNA, 18 nt, Leptospira interrogans serovar lai str. 56601
cgcuucacagaguacaua

SEQ ID NO: 753494 - RNA, 23 nt, Leptospira interrogans serovar lai str. 56601
cgcuguuuuguggucaacaucuc

SEQ ID NO: 753495 - RNA, 12 nt, Leptospira interrogans serovar lai str. 56601
cgcugauaaauu

SEQ ID NO: 753496 - RNA, 16 nt, Leptospira interrogans serovar lai str. 56601
cgcuggaaauaucaau

SEQ ID NO: 753497 - RNA, 20 nt, Leptospira interrogans serovar lai str. 56601
cgcucaaaauucuuaaaaaa

SEQ ID NO: 753498 - RNA, 21 nt, Leptospira interrogans serovar lai str. 56601
cgcuagaaguuauaaugauaa

SEQ ID NO: 753499 - RNA, 23 nt, Leptospira interrogans serovar lai str. 56601
cgcucauuagaauuguugaaaaa

SEQ ID NO: 753500 - RNA, 13 nt, Leptospira interrogans serovar lai str. 56601
cggcauuaauaua

SEQ ID NO: 753501 - RNA, 12 nt, Leptospira interrogans serovar lai str. 56601
uuuuuguuugaa

SEQ ID NO: 753502 - RNA, 20 nt, Leptospira interrogans serovar lai str. 56601
uuuuuguuuuggcucuugcu

SEQ ID NO: 753503 - RNA, 12 nt, Leptospira interrogans serovar lai str. 56601
uuuuuguagaau

SEQ ID NO: 753504 - RNA, 16 nt, Leptospira interrogans serovar lai str. 56601
uuuuuguaugaguucc

SEQ ID NO: 753505 - RNA, 18 nt, Leptospira interrogans serovar lai str. 56601
uuuuuguaugaguuccua

SEQ ID NO: 753506 - RNA, 17 nt, Leptospira interrogans serovar lai str. 56601
uuuuuuagaaaucaauu

SEQ ID NO: 753507 - RNA, 23 nt, Leptospira interrogans serovar lai str. 56601
uuuuuuacgaaaaaauugacuua

SEQ ID NO: 753508 - RNA, 15 nt, Leptospira interrogans serovar lai str. 56601
uuuuuuaaaaaauuc

SEQ ID NO: 753509 - RNA, 16 nt, Leptospira interrogans serovar lai str. 56601
uuuuuuaaaaaauuuc

SEQ ID NO: 753510 - RNA, 13 nt, Leptospira interrogans serovar lai str. 56601
uuuuuuaacaacu

SEQ ID NO: 753511 - RNA, 17 nt, Leptospira interrogans serovar lai str. 56601
uuuuuuaacauuuguuu

SEQ ID NO: 753512 - RNA, 11 nt, Leptospira interrogans serovar lai str. 56601
uuuuuuuucaa

SEQ ID NO: 753513 - RNA, 12 nt, Leptospira interrogans serovar lai str. 56601
uuuuuuauuucu

SEQ ID NO: 753514 - RNA, 13 nt, Leptospira interrogans serovar lai str. 56601
uuuuuuauuuuau

SEQ ID NO: 753515 - RNA, 18 nt, Leptospira interrogans serovar lai str. 56601
uuuuucgaacuauuuuuu

SEQ ID NO: 753516 - RNA, 16 nt, Leptospira interrogans serovar lai str. 56601
uuuuucgaagauauaa

SEQ ID NO: 753517 - RNA, 12 nt, Leptospira interrogans serovar lai str. 56601
uuuuucgaauug

SEQ ID NO: 753518 - RNA, 13 nt, Leptospira interrogans serovar lai str. 56601
uuuuuccguaaau

SEQ ID NO: 753519 - RNA, 14 nt, Leptospira interrogans serovar lai str. 56601
uuuuucuacaauua

SEQ ID NO: 753520 - RNA, 18 nt, Leptospira interrogans serovar lai str. 56601
uuuuucuaguaguuccca

SEQ ID NO: 753521 - RNA, 21 nt, Leptospira interrogans serovar lai str. 56601
uuuuucgugauaacaaacuuu

SEQ ID NO: 753522 - RNA, 17 nt, Leptospira interrogans serovar lai str. 56601
uuuugauccguuuuaaa

SEQ ID NO: 753523 - RNA, 16 nt, Leptospira interrogans serovar lai str. 56601
uuuugaucuaauaaua

SEQ ID NO: 753524 - RNA, 19 nt, Leptospira interrogans serovar lai str. 56601
uuuugauucauucaggauu

SEQ ID NO: 753525 - RNA, 16 nt, Leptospira interrogans serovar lai str. 56601
uuuugauuuguuucuu

SEQ ID NO: 753526 - RNA, 14 nt, Leptospira interrogans serovar lai str. 56601
uuuuuccauaaaaa

SEQ ID NO: 753527 - RNA, 23 nt, Leptospira interrogans serovar lai str. 56601
uuuuuggccuaaggauccaauac

SEQ ID NO: 753528 - RNA, 14 nt, Leptospira interrogans serovar lai str. 56601
uuuuuguaaaaaaa

SEQ ID NO: 753529 - RNA, 15 nt, Leptospira interrogans serovar lai str. 56601
uuuuuguaaaaucca

SEQ ID NO: 753530 - RNA, 20 nt, Leptospira interrogans serovar lai str. 56601
uuuuuguaaaggaagauaaa

SEQ ID NO: 753531 - RNA, 15 nt, Leptospira interrogans serovar lai str. 56601
uuuuugaguaauucc

SEQ ID NO: 753532 - RNA, 16 nt, Leptospira interrogans serovar lai str. 56601
uuuuugauaaaauaua

SEQ ID NO: 753533 - RNA, 13 nt, Leptospira interrogans serovar lai str. 56601
uuuuugcaaaaaa

SEQ ID NO: 753534 - RNA, 12 nt, Leptospira interrogans serovar lai str. 56601
uuuuucuucuuu

SEQ ID NO: 753535 - RNA, 20 nt, Leptospira interrogans serovar lai str. 56601
uuuuucuuagaccgaacuca

SEQ ID NO: 753536 - RNA, 13 nt, Leptospira interrogans serovar lai str. 56601
uuuuugaaaugca

SEQ ID NO: 753537 - RNA, 13 nt, Leptospira interrogans serovar lai str. 56601
uuuuucuucuuca

SEQ ID NO: 753538 - RNA, 14 nt, Leptospira interrogans serovar lai str. 56601
uuuuugaaacauuu

SEQ ID NO: 753539 - RNA, 21 nt, Leptospira interrogans serovar lai str. 56601
uuuuugaaacauuucuaaaau

SEQ ID NO: 753540 - RNA, 23 nt, Leptospira interrogans serovar lai str. 56601
uuuuaguaguuccacauuuauuu

SEQ ID NO: 753541 - RNA, 14 nt, Leptospira interrogans serovar lai str. 56601
uuuuaguucaaaaa

SEQ ID NO: 753542 - RNA, 15 nt, Leptospira interrogans serovar lai str. 56601
uuuuaguucucuauu

SEQ ID NO: 753543 - RNA, 16 nt, Leptospira interrogans serovar lai str. 56601
uuuuaguaaaauuuaa

SEQ ID NO: 753544 - RNA, 14 nt, Leptospira interrogans serovar lai str. 56601
uuuuaguaaacuac

SEQ ID NO: 753545 - RNA, 19 nt, Leptospira interrogans serovar lai str. 56601
uuuuaguaaacuacuaaau

SEQ ID NO: 753546 - RNA, 14 nt, Leptospira interrogans serovar lai str. 56601
uuuuauaaaaauac

SEQ ID NO: 753547 - RNA, 16 nt, Leptospira interrogans serovar lai str. 56601
uuuuauaaaaaucuag

SEQ ID NO: 753548 - RNA, 11 nt, Leptospira interrogans serovar lai str. 56601
uuuuauaaaac

SEQ ID NO: 753549 - RNA, 20 nt, Leptospira interrogans serovar lai str. 56601
uuuuaguuucuuuuuuagau

SEQ ID NO: 753550 - RNA, 16 nt, Leptospira interrogans serovar lai str. 56601
uuuuaguuguacaaaa

SEQ ID NO: 753551 - RNA, 11 nt, Leptospira interrogans serovar lai str. 56601
uuuuauaaaau

SEQ ID NO: 753552 - RNA, 14 nt, Leptospira interrogans serovar lai str. 56601
uuuuauaaacuucu

SEQ ID NO: 753553 - RNA, 17 nt, Leptospira interrogans serovar lai str. 56601
uuuuauaaagauaaauc

SEQ ID NO: 753554 - RNA, 18 nt, Leptospira interrogans serovar lai str. 56601
uuuuauaaauuauuuuuu

SEQ ID NO: 753555 - RNA, 19 nt, Leptospira interrogans serovar lai str. 56601
uuuuauaaauuauuuuuug

SEQ ID NO: 753556 - RNA, 13 nt, Leptospira interrogans serovar lai str. 56601
uuuuauaauuuag

SEQ ID NO: 753557 - RNA, 21 nt, Leptospira interrogans serovar lai str. 56601
uuuuauacuuuaauaauauaa

SEQ ID NO: 753558 - RNA, 16 nt, Leptospira interrogans serovar lai str. 56601
uuuuauaguauauaau

SEQ ID NO: 753559 - RNA, 19 nt, Leptospira interrogans serovar lai str. 56601
uuuuaucgaauaagaaauu

SEQ ID NO: 753560 - RNA, 21 nt, Leptospira interrogans serovar lai str. 56601
uuuuaugccuuugguauuuua

SEQ ID NO: 753561 - RNA, 18 nt, Leptospira interrogans serovar lai str. 56601
uuuuaucaaauaaaguuu

SEQ ID NO: 753562 - RNA, 23 nt, Leptospira interrogans serovar lai str. 56601
uuuuauaucuuaauuaaaaaauc

SEQ ID NO: 753563 - RNA, 17 nt, Leptospira interrogans serovar lai str. 56601
uuuuauauaauuuacuu

SEQ ID NO: 753564 - RNA, 11 nt, Leptospira interrogans serovar lai str. 56601
uuuuauauaga

SEQ ID NO: 753565 - RNA, 16 nt, Leptospira interrogans serovar lai str. 56601
uuuuauccauaaauuc

SEQ ID NO: 753566 - RNA, 17 nt, Leptospira interrogans serovar lai str. 56601
uuuuaucauaaaacacu

SEQ ID NO: 753567 - RNA, 17 nt, Leptospira interrogans serovar lai str. 56601
uuuuaucauguuuuaua

SEQ ID NO: 753568 - RNA, 18 nt, Leptospira interrogans serovar lai str. 56601
uuuuaucauguuuuauau

SEQ ID NO: 753569 - RNA, 13 nt, Leptospira interrogans serovar lai str. 56601
uuuuacaguaaaa

SEQ ID NO: 753570 - RNA, 15 nt, Leptospira interrogans serovar lai str. 56601
uuuuacaauuaaacu

SEQ ID NO: 753571 - RNA, 16 nt, Leptospira interrogans serovar lai str. 56601
uuuuacagaaaaauca

SEQ ID NO: 753572 - RNA, 16 nt, Leptospira interrogans serovar lai str. 56601
uuuuacagaagauuuu

SEQ ID NO: 753573 - RNA, 18 nt, Leptospira interrogans serovar lai str. 56601
uuuuacagaauauuaaau

SEQ ID NO: 753574 - RNA, 12 nt, Leptospira interrogans serovar lai str. 56601
uuuuacagauuu

SEQ ID NO: 753575 - RNA, 20 nt, Leptospira interrogans serovar lai str. 56601
uuuuacaaacaaauucuaaa

SEQ ID NO: 753576 - RNA, 22 nt, Leptospira interrogans serovar lai str. 56601
uuuuacaaacaaauucuaaaau

SEQ ID NO: 753577 - RNA, 23 nt, Leptospira interrogans serovar lai str. 56601
uuuuacaaacaaauucuaaaauu

SEQ ID NO: 753578 - RNA, 20 nt, Leptospira interrogans serovar lai str. 56601
uuuuacaaagacucggaaau

SEQ ID NO: 753579 - RNA, 20 nt, Leptospira interrogans serovar lai str. 56601
uuuuacccugguuucaaaaa

SEQ ID NO: 753580 - RNA, 21 nt, Leptospira interrogans serovar lai str. 56601
uuuuacccugguuucaaaaaa

SEQ ID NO: 753581 - RNA, 21 nt, Leptospira interrogans serovar lai str. 56601
uuuuaauuucgggauauucuu

SEQ ID NO: 753582 - RNA, 14 nt, Leptospira interrogans serovar lai str. 56601
uuuuaauuuguuuu

SEQ ID NO: 753583 - RNA, 19 nt, Leptospira interrogans serovar lai str. 56601
uuuuaauuuucuaauauaa

SEQ ID NO: 753584 - RNA, 15 nt, Leptospira interrogans serovar lai str. 56601
uuuuaaucaaaugca

SEQ ID NO: 753585 - RNA, 16 nt, Leptospira interrogans serovar lai str. 56601
uuuuaaucaaaugcag

SEQ ID NO: 753586 - RNA, 23 nt, Leptospira interrogans serovar lai str. 56601
uuuuaaucaugugaauucagaaa

SEQ ID NO: 753587 - RNA, 18 nt, Leptospira interrogans serovar lai str. 56601
uuuuaaucgcucugaagu

SEQ ID NO: 753588 - RNA, 15 nt, Leptospira interrogans serovar lai str. 56601
uuuuaauguuacaua

SEQ ID NO: 753589 - RNA, 23 nt, Leptospira interrogans serovar lai str. 56601
uuuuacuauaaacauauuauuuu

SEQ ID NO: 753590 - RNA, 12 nt, Leptospira interrogans serovar lai str. 56601
uuuuacuaaaaa

SEQ ID NO: 753591 - RNA, 16 nt, Leptospira interrogans serovar lai str. 56601
uuuuacuaaaaaacau

SEQ ID NO: 753592 - RNA, 15 nt, Leptospira interrogans serovar lai str. 56601
uuuuacguuauaauu

SEQ ID NO: 753593 - RNA, 17 nt, Leptospira interrogans serovar lai str. 56601
uuuuacggaucaaaauu

SEQ ID NO: 753594 - RNA, 17 nt, Leptospira interrogans serovar lai str. 56601
uuuuacggaucaauucu

SEQ ID NO: 753595 - RNA, 22 nt, Leptospira interrogans serovar lai str. 56601
uuuuaccugccuuauaaugaag

SEQ ID NO: 753596 - RNA, 21 nt, Leptospira interrogans serovar lai str. 56601
uuuuaccgauaagucuagaaa

SEQ ID NO: 753597 - RNA, 15 nt, Leptospira interrogans serovar lai str. 56601
uuuuaccguuuuuaa

SEQ ID NO: 753598 - RNA, 14 nt, Leptospira interrogans serovar lai str. 56601
uuuuacgaaaaaau

SEQ ID NO: 753599 - RNA, 17 nt, Leptospira interrogans serovar lai str. 56601
uuuuacgaacaaauucu

SEQ ID NO: 753600 - RNA, 20 nt, Leptospira interrogans serovar lai str. 56601
uuuuacgaacacauucuaaa

SEQ ID NO: 753601 - RNA, 20 nt, Leptospira interrogans serovar lai str. 56601
uuuuacgaaccaauucuaaa

SEQ ID NO: 753602 - RNA, 23 nt, Leptospira interrogans serovar lai str. 56601
uuuuacgaacgaauucuaaaauu

SEQ ID NO: 753603 - RNA, 17 nt, Leptospira interrogans serovar lai str. 56601
uuuuacgauuaaauuuu

SEQ ID NO: 753604 - RNA, 15 nt, Leptospira interrogans serovar lai str. 56601
uuuuacgcaaucauu

SEQ ID NO: 753605 - RNA, 20 nt, Leptospira interrogans serovar lai str. 56601
uuuuacgacuuuauucaaaa

SEQ ID NO: 753606 - RNA, 14 nt, Leptospira interrogans serovar lai str. 56601
uuuuagaaaauuag

SEQ ID NO: 753607 - RNA, 14 nt, Leptospira interrogans serovar lai str. 56601
uuuuagaaaauuuu

SEQ ID NO: 753608 - RNA, 17 nt, Leptospira interrogans serovar lai str. 56601
uuuuagaaacuaaaaaa

SEQ ID NO: 753609 - RNA, 21 nt, Leptospira interrogans serovar lai str. 56601
uuuuagaaaucaauucuucuu

SEQ ID NO: 753610 - RNA, 16 nt, Leptospira interrogans serovar lai str. 56601
uuuuagaagauuuuua

SEQ ID NO: 753611 - RNA, 19 nt, Leptospira interrogans serovar lai str. 56601
uuuuagaagauuuuuacuc

SEQ ID NO: 753612 - RNA, 14 nt, Leptospira interrogans serovar lai str. 56601
uuuuagaauaucuu

SEQ ID NO: 753613 - RNA, 14 nt, Leptospira interrogans serovar lai str. 56601
uuuuagaauauuau

SEQ ID NO: 753614 - RNA, 17 nt, Leptospira interrogans serovar lai str. 56601
uuuuacuugcaaaaagu

SEQ ID NO: 753615 - RNA, 19 nt, Leptospira interrogans serovar lai str. 56601
uuuuacuugcaaaaaguau

SEQ ID NO: 753616 - RNA, 20 nt, Leptospira interrogans serovar lai str. 56601
uuuuacucgugcacaaguuu

SEQ ID NO: 753617 - RNA, 20 nt, Leptospira interrogans serovar lai str. 56601
uuuuacuguuguuaaauuuu

SEQ ID NO: 753618 - RNA, 21 nt, Leptospira interrogans serovar lai str. 56601
uuuuacuucauauacaagacu

SEQ ID NO: 753619 - RNA, 22 nt, Leptospira interrogans serovar lai str. 56601
uuuuacuucguuauaauuuuca

SEQ ID NO: 753620 - RNA, 12 nt, Leptospira interrogans serovar lai str. 56601
uuuuagaaugag

SEQ ID NO: 753621 - RNA, 22 nt, Leptospira interrogans serovar lai str. 56601
uuuuagaguucguuaagaauaa

SEQ ID NO: 753622 - RNA, 14 nt, Leptospira interrogans serovar lai str. 56601
uuuuagaauuuguu

SEQ ID NO: 753623 - RNA, 20 nt, Leptospira interrogans serovar lai str. 56601
uuuuagaauuuguuuguaaa

SEQ ID NO: 753624 - RNA, 19 nt, Leptospira interrogans serovar lai str. 56601
uuuuagagaaacuuuaaau

SEQ ID NO: 753625 - RNA, 15 nt, Leptospira interrogans serovar lai str. 56601
uuuuauuaaauaaag

SEQ ID NO: 753626 - RNA, 13 nt, Leptospira interrogans serovar lai str. 56601
uuuuauuauaaaa

SEQ ID NO: 753627 - RNA, 13 nt, Leptospira interrogans serovar lai str. 56601
uuuuauuauauaa

SEQ ID NO: 753628 - RNA, 18 nt, Leptospira interrogans serovar lai str. 56601
uuuuauuauauaauuuuu

SEQ ID NO: 753629 - RNA, 18 nt, Leptospira interrogans serovar lai str. 56601
uuuuauguuauauauuuu

SEQ ID NO: 753630 - RNA, 15 nt, Leptospira interrogans serovar lai str. 56601
uuuuauguaagaaaa

SEQ ID NO: 753631 - RNA, 19 nt, Leptospira interrogans serovar lai str. 56601
uuuuauguaauauuucuuu

SEQ ID NO: 753632 - RNA, 16 nt, Leptospira interrogans serovar lai str. 56601
uuuuauguauuuuaaa

SEQ ID NO: 753633 - RNA, 18 nt, Leptospira interrogans serovar lai str. 56601
uuuuauggaaaaaugaaa

SEQ ID NO: 753634 - RNA, 19 nt, Leptospira interrogans serovar lai str. 56601
uuuuauuucuuuuuuguuu

SEQ ID NO: 753635 - RNA, 18 nt, Leptospira interrogans serovar lai str. 56601
uuuuauuugauuagaaaa

SEQ ID NO: 753636 - RNA, 14 nt, Leptospira interrogans serovar lai str. 56601
uuuuauuucuaagu

SEQ ID NO: 753637 - RNA, 13 nt, Leptospira interrogans serovar lai str. 56601
uuuucauuuugcu

SEQ ID NO: 753638 - RNA, 16 nt, Leptospira interrogans serovar lai str. 56601
uuuucauuuuuacaau

SEQ ID NO: 753639 - RNA, 10 nt, Leptospira interrogans serovar lai str. 56601
uuuucauuug

SEQ ID NO: 753640 - RNA, 15 nt, Leptospira interrogans serovar lai str. 56601
uuuuccaaaaacuuu

SEQ ID NO: 753641 - RNA, 18 nt, Leptospira interrogans serovar lai str. 56601
uuuuccaaaaauuuaaaa

SEQ ID NO: 753642 - RNA, 15 nt, Leptospira interrogans serovar lai str. 56601
uuuucauucuuucca

SEQ ID NO: 753643 - RNA, 23 nt, Leptospira interrogans serovar lai str. 56601
uuuuccagaucauuuuguaaguc

SEQ ID NO: 753644 - RNA, 14 nt, Leptospira interrogans serovar lai str. 56601
uuuucaaaaacucu

SEQ ID NO: 753645 - RNA, 18 nt, Leptospira interrogans serovar lai str. 56601
uuuucaauaauucuauuu

SEQ ID NO: 753646 - RNA, 16 nt, Leptospira interrogans serovar lai str. 56601
uuuucaaucuaaccca

SEQ ID NO: 753647 - RNA, 14 nt, Leptospira interrogans serovar lai str. 56601
uuuucaauuauuuu

SEQ ID NO: 753648 - RNA, 13 nt, Leptospira interrogans serovar lai str. 56601
uuuucuauuuaac

SEQ ID NO: 753649 - RNA, 12 nt, Leptospira interrogans serovar lai str. 56601
uuuucuauaaaa

SEQ ID NO: 753650 - RNA, 15 nt, Leptospira interrogans serovar lai str. 56601
uuuucuauaaccaca

SEQ ID NO: 753651 - RNA, 18 nt, Leptospira interrogans serovar lai str. 56601
uuuucuauaaucugaaau

SEQ ID NO: 753652 - RNA, 15 nt, Leptospira interrogans serovar lai str. 56601
uuuucuaaaaaaaau

SEQ ID NO: 753653 - RNA, 18 nt, Leptospira interrogans serovar lai str. 56601
uuuucuaaaaaaaaugga

SEQ ID NO: 753654 - RNA, 15 nt, Leptospira interrogans serovar lai str. 56601
uuuucuaaaaaaacg

SEQ ID NO: 753655 - RNA, 20 nt, Leptospira interrogans serovar lai str. 56601
uuuucuaaaaguaaaaguau

SEQ ID NO: 753656 - RNA, 15 nt, Leptospira interrogans serovar lai str. 56601
uuuucuaaaauauag

SEQ ID NO: 753657 - RNA, 21 nt, Leptospira interrogans serovar lai str. 56601
uuuucuaauagagaaaaauuu

SEQ ID NO: 753658 - RNA, 19 nt, Leptospira interrogans serovar lai str. 56601
uuuucuaaguggagaggaa

SEQ ID NO: 753659 - RNA, 20 nt, Leptospira interrogans serovar lai str. 56601
uuuucuaaauuaauauuuau

SEQ ID NO: 753660 - RNA, 14 nt, Leptospira interrogans serovar lai str. 56601
uuuucuaaauuuua

SEQ ID NO: 753661 - RNA, 13 nt, Leptospira interrogans serovar lai str. 56601
uuuucuaagaauc

SEQ ID NO: 753662 - RNA, 22 nt, Leptospira interrogans serovar lai str. 56601
uuuucccaaacaggaaaauuua

SEQ ID NO: 753663 - RNA, 16 nt, Leptospira interrogans serovar lai str. 56601
uuuucccgaaagaacu

SEQ ID NO: 753664 - RNA, 18 nt, Leptospira interrogans serovar lai str. 56601
uuuucgugauaacaaacu

SEQ ID NO: 753665 - RNA, 21 nt, Leptospira interrogans serovar lai str. 56601
uuuucgguucgggauuuuuuu

SEQ ID NO: 753666 - RNA, 23 nt, Leptospira interrogans serovar lai str. 56601
uuuucgguaaaaucauucuuuug

SEQ ID NO: 753667 - RNA, 16 nt, Leptospira interrogans serovar lai str. 56601
uuuucccgcuaaaagu

SEQ ID NO: 753668 - RNA, 15 nt, Leptospira interrogans serovar lai str. 56601
uuuuccgaaccuuac

SEQ ID NO: 753669 - RNA, 18 nt, Leptospira interrogans serovar lai str. 56601
uuuuccgaaccuuaccac

SEQ ID NO: 753670 - RNA, 12 nt, Leptospira interrogans serovar lai str. 56601
uuuugauaaaau

SEQ ID NO: 753671 - RNA, 15 nt, Leptospira interrogans serovar lai str. 56601
uuuugauaaaauaua

SEQ ID NO: 753672 - RNA, 16 nt, Leptospira interrogans serovar lai str. 56601
uuuugauaaaauauag

SEQ ID NO: 753673 - RNA, 13 nt, Leptospira interrogans serovar lai str. 56601
uuuugaauauuau

SEQ ID NO: 753674 - RNA, 19 nt, Leptospira interrogans serovar lai str. 56601
uuuugaaguaguuccuaca

SEQ ID NO: 753675 - RNA, 18 nt, Leptospira interrogans serovar lai str. 56601
uuuugaacuacagaauuu

SEQ ID NO: 753676 - RNA, 22 nt, Leptospira interrogans serovar lai str. 56601
uuuugaacuacagaauuuuuua

SEQ ID NO: 753677 - RNA, 21 nt, Leptospira interrogans serovar lai str. 56601
uuuugaagaaacaauucuucc

SEQ ID NO: 753678 - RNA, 22 nt, Leptospira interrogans serovar lai str. 56601
uuuugaaaauuuacgauucuaa

SEQ ID NO: 753679 - RNA, 18 nt, Leptospira interrogans serovar lai str. 56601
uuuugaaacauuucuaaa

SEQ ID NO: 753680 - RNA, 19 nt, Leptospira interrogans serovar lai str. 56601
uuuugaaacuauccaaaag

SEQ ID NO: 753681 - RNA, 21 nt, Leptospira interrogans serovar lai str. 56601
uuuugaaauagauucuaauuu

SEQ ID NO: 753682 - RNA, 11 nt, Leptospira interrogans serovar lai str. 56601
uuuucuuaggu

SEQ ID NO: 753683 - RNA, 19 nt, Leptospira interrogans serovar lai str. 56601
uuuucucagccaaaaguuu

SEQ ID NO: 753684 - RNA, 22 nt, Leptospira interrogans serovar lai str. 56601
uuuucucagccaaaaguuuuug

SEQ ID NO: 753685 - RNA, 16 nt, Leptospira interrogans serovar lai str. 56601
uuuucucaaaaaaagu

SEQ ID NO: 753686 - RNA, 17 nt, Leptospira interrogans serovar lai str. 56601
uuuucuuaguuuuguac

SEQ ID NO: 753687 - RNA, 17 nt, Leptospira interrogans serovar lai str. 56601
uuuucuuaauaaacuuu

SEQ ID NO: 753688 - RNA, 20 nt, Leptospira interrogans serovar lai str. 56601
uuuucuucccagauucccuu

SEQ ID NO: 753689 - RNA, 14 nt, Leptospira interrogans serovar lai str. 56601
uuuucuucuggaau

SEQ ID NO: 753690 - RNA, 15 nt, Leptospira interrogans serovar lai str. 56601
uuuguauucaagagc

SEQ ID NO: 753691 - RNA, 22 nt, Leptospira interrogans serovar lai str. 56601
uuuguacaucuuaaaaaauaca

SEQ ID NO: 753692 - RNA, 13 nt, Leptospira interrogans serovar lai str. 56601
uuuguaugaguuc

SEQ ID NO: 753693 - RNA, 17 nt, Leptospira interrogans serovar lai str. 56601
uuuguaguaacuccuac

SEQ ID NO: 753694 - RNA, 19 nt, Leptospira interrogans serovar lai str. 56601
uuuguaaguuuuccauucu

SEQ ID NO: 753695 - RNA, 16 nt, Leptospira interrogans serovar lai str. 56601
uuuguaacuuuuacug

SEQ ID NO: 753696 - RNA, 16 nt, Leptospira interrogans serovar lai str. 56601
uuuguaauaguuccca

SEQ ID NO: 753697 - RNA, 18 nt, Leptospira interrogans serovar lai str. 56601
uuuguaauaguucccaca

SEQ ID NO: 753698 - RNA, 22 nt, Leptospira interrogans serovar lai str. 56601
uuuguaauaguucccacaguuu

SEQ ID NO: 753699 - RNA, 17 nt, Leptospira interrogans serovar lai str. 56601
uuuguaaauugugggaa

SEQ ID NO: 753700 - RNA, 19 nt, Leptospira interrogans serovar lai str. 56601
uuuguaaccuuuguuuccu

SEQ ID NO: 753701 - RNA, 16 nt, Leptospira interrogans serovar lai str. 56601
uuuguaaaaauucucc

SEQ ID NO: 753702 - RNA, 14 nt, Leptospira interrogans serovar lai str. 56601
uuugguuuguaaua

SEQ ID NO: 753703 - RNA, 13 nt, Leptospira interrogans serovar lai str. 56601
uuuguaaauaaac

SEQ ID NO: 753704 - RNA, 22 nt, Leptospira interrogans serovar lai str. 56601
uuuguaaauauguuuuuuuuca

SEQ ID NO: 753705 - RNA, 12 nt, Leptospira interrogans serovar lai str. 56601
uuuguaaaucua

SEQ ID NO: 753706 - RNA, 19 nt, Leptospira interrogans serovar lai str. 56601
uuuggcucuugcuaaaauu

SEQ ID NO: 753707 - RNA, 19 nt, Leptospira interrogans serovar lai str. 56601
uuugggacaaacuuuaauu

SEQ ID NO: 753708 - RNA, 17 nt, Leptospira interrogans serovar lai str. 56601
uuugggcgaauaaaaaa

SEQ ID NO: 753709 - RNA, 17 nt, Leptospira interrogans serovar lai str. 56601
uuuggugauuuaaaaau

SEQ ID NO: 753710 - RNA, 20 nt, Leptospira interrogans serovar lai str. 56601
uuuggguuuggaguauuuuu

SEQ ID NO: 753711 - RNA, 14 nt, Leptospira interrogans serovar lai str. 56601
uuugguaauuugug

SEQ ID NO: 753712 - RNA, 20 nt, Leptospira interrogans serovar lai str. 56601
uuugguuaucauaaaaauaa

SEQ ID NO: 753713 - RNA, 19 nt, Leptospira interrogans serovar lai str. 56601
uuuggacgaauccugcuaa

SEQ ID NO: 753714 - RNA, 19 nt, Leptospira interrogans serovar lai str. 56601
uuuggaaucugcaucuuuu

SEQ ID NO: 753715 - RNA, 22 nt, Leptospira interrogans serovar lai str. 56601
uuuggcauacaucucuaacauc

SEQ ID NO: 753716 - RNA, 13 nt, Leptospira interrogans serovar lai str. 56601
uuuggauuuugau

SEQ ID NO: 753717 - RNA, 18 nt, Leptospira interrogans serovar lai str. 56601
uuugcuuugucauuucag

SEQ ID NO: 753718 - RNA, 13 nt, Leptospira interrogans serovar lai str. 56601
uuugcuuuucuau

SEQ ID NO: 753719 - RNA, 23 nt, Leptospira interrogans serovar lai str. 56601
uuuggaaagaauacgauuuaauc

SEQ ID NO: 753720 - RNA, 17 nt, Leptospira interrogans serovar lai str. 56601
uuugcuguaaaauuuag

SEQ ID NO: 753721 - RNA, 11 nt, Leptospira interrogans serovar lai str. 56601
uuugcuuccau

SEQ ID NO: 753722 - RNA, 13 nt, Leptospira interrogans serovar lai str. 56601
uuugcuucuuuua

SEQ ID NO: 753723 - RNA, 19 nt, Leptospira interrogans serovar lai str. 56601
uuugcuuaaagcauuaaaa

SEQ ID NO: 753724 - RNA, 15 nt, Leptospira interrogans serovar lai str. 56601
uuugcggaucguuuu

SEQ ID NO: 753725 - RNA, 18 nt, Leptospira interrogans serovar lai str. 56601
uuugcggaaucaauuuua

SEQ ID NO: 753726 - RNA, 19 nt, Leptospira interrogans serovar lai str. 56601
uuugcgggaacucccacaa

SEQ ID NO: 753727 - RNA, 21 nt, Leptospira interrogans serovar lai str. 56601
uuugcucacuaccuuauaaaa

SEQ ID NO: 753728 - RNA, 20 nt, Leptospira interrogans serovar lai str. 56601
uuuguuuugugucuggaacg

SEQ ID NO: 753729 - RNA, 15 nt, Leptospira interrogans serovar lai str. 56601
uuuguuuucuuuucu

SEQ ID NO: 753730 - RNA, 21 nt, Leptospira interrogans serovar lai str. 56601
uuuguuuugaaacaguacuuu

SEQ ID NO: 753731 - RNA, 12 nt, Leptospira interrogans serovar lai str. 56601
uuuguuuccuuc

SEQ ID NO: 753732 - RNA, 21 nt, Leptospira interrogans serovar lai str. 56601
uuuguuuuaaaauuuaugauc

SEQ ID NO: 753733 - RNA, 20 nt, Leptospira interrogans serovar lai str. 56601
uuuguugcguuuaaaaacag

SEQ ID NO: 753734 - RNA, 16 nt, Leptospira interrogans serovar lai str. 56601
uuuguuccaaaaccuc

SEQ ID NO: 753735 - RNA, 22 nt, Leptospira interrogans serovar lai str. 56601
uuuguuccaaaaccucaaaaaa

SEQ ID NO: 753736 - RNA, 16 nt, Leptospira interrogans serovar lai str. 56601
uuuguuagauucuauu

SEQ ID NO: 753737 - RNA, 14 nt, Leptospira interrogans serovar lai str. 56601
uuuguuauaagaau

SEQ ID NO: 753738 - RNA, 15 nt, Leptospira interrogans serovar lai str. 56601
uuuguuaaccaaaaa

SEQ ID NO: 753739 - RNA, 13 nt, Leptospira interrogans serovar lai str. 56601
uuuguguuguaug

SEQ ID NO: 753740 - RNA, 20 nt, Leptospira interrogans serovar lai str. 56601
uuugugacuaucacaaaaau

SEQ ID NO: 753741 - RNA, 15 nt, Leptospira interrogans serovar lai str. 56601
uuugugaaacuuaau

SEQ ID NO: 753742 - RNA, 14 nt, Leptospira interrogans serovar lai str. 56601
uuugugaacuuuua

SEQ ID NO: 753743 - RNA, 14 nt, Leptospira interrogans serovar lai str. 56601
uuugucuuuaaaau

SEQ ID NO: 753744 - RNA, 21 nt, Leptospira interrogans serovar lai str. 56601
uuugugagaguuccacauuuu

SEQ ID NO: 753745 - RNA, 21 nt, Leptospira interrogans serovar lai str. 56601
uuugugagaguucccacauuu

SEQ ID NO: 753746 - RNA, 16 nt, Leptospira interrogans serovar lai str. 56601
uuuguggaaacuauua

SEQ ID NO: 753747 - RNA, 21 nt, Leptospira interrogans serovar lai str. 56601
uuugugggaguucccacauuu

SEQ ID NO: 753748 - RNA, 20 nt, Leptospira interrogans serovar lai str. 56601
uuugugcuauauucaaaaaa

SEQ ID NO: 753749 - RNA, 21 nt, Leptospira interrogans serovar lai str. 56601
uuugugcuauauucaaaaaag

SEQ ID NO: 753750 - RNA, 22 nt, Leptospira interrogans serovar lai str. 56601
uuugucccaaaaccucaaaaaa

SEQ ID NO: 753751 - RNA, 22 nt, Leptospira interrogans serovar lai str. 56601
uuugucuccugucaauuuucca

SEQ ID NO: 753752 - RNA, 18 nt, Leptospira interrogans serovar lai str. 56601
uuugucucaaaacuuaaa

SEQ ID NO: 753753 - RNA, 13 nt, Leptospira interrogans serovar lai str. 56601
uuugucucaaaau

SEQ ID NO: 753754 - RNA, 14 nt, Leptospira interrogans serovar lai str. 56601
uuugucguaauucc

SEQ ID NO: 753755 - RNA, 15 nt, Leptospira interrogans serovar lai str. 56601
uuugucggaaucuuu

SEQ ID NO: 753756 - RNA, 13 nt, Leptospira interrogans serovar lai str. 56601
uuuuaaaauguag

SEQ ID NO: 753757 - RNA, 13 nt, Leptospira interrogans serovar lai str. 56601
uuuuaaaaucuuc

SEQ ID NO: 753758 - RNA, 23 nt, Leptospira interrogans serovar lai str. 56601
uuuuaaaaguuuuggaagauucu

SEQ ID NO: 753759 - RNA, 19 nt, Leptospira interrogans serovar lai str. 56601
uuuuaaaagaucugaguuu

SEQ ID NO: 753760 - RNA, 13 nt, Leptospira interrogans serovar lai str. 56601
uuuuaaaaauuuu

SEQ ID NO: 753761 - RNA, 20 nt, Leptospira interrogans serovar lai str. 56601
uuuuaaaaauuuuauuaaau

SEQ ID NO: 753762 - RNA, 18 nt, Leptospira interrogans serovar lai str. 56601
uuuuaaaaccaaaaugcu

SEQ ID NO: 753763 - RNA, 14 nt, Leptospira interrogans serovar lai str. 56601
uuuuaaaaauauaa

SEQ ID NO: 753764 - RNA, 14 nt, Leptospira interrogans serovar lai str. 56601
uuuuaaaaauauag

SEQ ID NO: 753765 - RNA, 16 nt, Leptospira interrogans serovar lai str. 56601
uuuuaaaaaauuucuu

SEQ ID NO: 753766 - RNA, 21 nt, Leptospira interrogans serovar lai str. 56601
uuuuaaaacggaauuuuguuu

SEQ ID NO: 753767 - RNA, 13 nt, Leptospira interrogans serovar lai str. 56601
uuuuaaaaaauag

SEQ ID NO: 753768 - RNA, 12 nt, Leptospira interrogans serovar lai str. 56601
uuuuaaaaaagg

SEQ ID NO: 753769 - RNA, 14 nt, Leptospira interrogans serovar lai str. 56601
uuuuaaaaaaugug

SEQ ID NO: 753770 - RNA, 18 nt, Leptospira interrogans serovar lai str. 56601
uuuuaaaaaaugugaacu

SEQ ID NO: 753771 - RNA, 13 nt, Leptospira interrogans serovar lai str. 56601
uuuuaaaaaauuu

SEQ ID NO: 753772 - RNA, 22 nt, Leptospira interrogans serovar lai str. 56601
uuuguuuuuggaaauguuuuuu

SEQ ID NO: 753773 - RNA, 20 nt, Leptospira interrogans serovar lai str. 56601
uuuuaaaaagaauuguucgu

SEQ ID NO: 753774 - RNA, 13 nt, Leptospira interrogans serovar lai str. 56601
uuuuaaaaaguuc

SEQ ID NO: 753775 - RNA, 14 nt, Leptospira interrogans serovar lai str. 56601
uuuuaaaaaguucu

SEQ ID NO: 753776 - RNA, 13 nt, Leptospira interrogans serovar lai str. 56601
uuuuaaaaauguc

SEQ ID NO: 753777 - RNA, 13 nt, Leptospira interrogans serovar lai str. 56601
uuuuaaaaauuag

SEQ ID NO: 753778 - RNA, 13 nt, Leptospira interrogans serovar lai str. 56601
uuuuaaaaauuca

SEQ ID NO: 753779 - RNA, 17 nt, Leptospira interrogans serovar lai str. 56601
uuuuaaaaauucaacua

SEQ ID NO: 753780 - RNA, 12 nt, Leptospira interrogans serovar lai str. 56601
uuuuaaauacuc

SEQ ID NO: 753781 - RNA, 20 nt, Leptospira interrogans serovar lai str. 56601
uuuuaaauacucuaauuuuu

SEQ ID NO: 753782 - RNA, 21 nt, Leptospira interrogans serovar lai str. 56601
uuuuaaaguuuugaaauagcu

SEQ ID NO: 753783 - RNA, 22 nt, Leptospira interrogans serovar lai str. 56601
uuuuaaagaaacucauaaaaua

SEQ ID NO: 753784 - RNA, 18 nt, Leptospira interrogans serovar lai str. 56601
uuuuaaaccaguuuguuu

SEQ ID NO: 753785 - RNA, 12 nt, Leptospira interrogans serovar lai str. 56601
uuuuaaaauugc

SEQ ID NO: 753786 - RNA, 13 nt, Leptospira interrogans serovar lai str. 56601
uuuuaaaauugug

SEQ ID NO: 753787 - RNA, 13 nt, Leptospira interrogans serovar lai str. 56601
uuuuaaaauuuau

SEQ ID NO: 753788 - RNA, 13 nt, Leptospira interrogans serovar lai str. 56601
uuuuaaauuuuua

SEQ ID NO: 753789 - RNA, 19 nt, Leptospira interrogans serovar lai str. 56601
uuuuaaauccaacuuaaaa

SEQ ID NO: 753790 - RNA, 22 nt, Leptospira interrogans serovar lai str. 56601
uuuuaaauccaacuuaaaacug

SEQ ID NO: 753791 - RNA, 16 nt, Leptospira interrogans serovar lai str. 56601
uuuuaaaugugggaac

SEQ ID NO: 753792 - RNA, 23 nt, Leptospira interrogans serovar lai str. 56601
uuuuaaauguaagaguuccuaca

SEQ ID NO: 753793 - RNA, 15 nt, Leptospira interrogans serovar lai str. 56601
uuuuaaauuguucgu

SEQ ID NO: 753794 - RNA, 18 nt, Leptospira interrogans serovar lai str. 56601
uuuuaaguaauauuucuc

SEQ ID NO: 753795 - RNA, 14 nt, Leptospira interrogans serovar lai str. 56601
uuuuaaguucaaaa

SEQ ID NO: 753796 - RNA, 20 nt, Leptospira interrogans serovar lai str. 56601
uuuuaaguucagauucaauu

SEQ ID NO: 753797 - RNA, 14 nt, Leptospira interrogans serovar lai str. 56601
uuuuaauaaaauac

SEQ ID NO: 753798 - RNA, 14 nt, Leptospira interrogans serovar lai str. 56601
uuuuaauaaaaugc

SEQ ID NO: 753799 - RNA, 17 nt, Leptospira interrogans serovar lai str. 56601
uuuuaauauacugcaau

SEQ ID NO: 753800 - RNA, 15 nt, Leptospira interrogans serovar lai str. 56601
uuuuaauauuacauu

SEQ ID NO: 753801 - RNA, 20 nt, Leptospira interrogans serovar lai str. 56601
uuuuaauauuauuaaauuuu

SEQ ID NO: 753802 - RNA, 22 nt, Leptospira interrogans serovar lai str. 56601
uuuuaagaacaauuuaaaauaa

SEQ ID NO: 753803 - RNA, 21 nt, Leptospira interrogans serovar lai str. 56601
uuuuaagaauuuguuugucuu

SEQ ID NO: 753804 - RNA, 23 nt, Leptospira interrogans serovar lai str. 56601
uuuuaagacaaacuuuuagauaa

SEQ ID NO: 753805 - RNA, 13 nt, Leptospira interrogans serovar lai str. 56601
uucuaaaauugua

SEQ ID NO: 753806 - RNA, 22 nt, Leptospira interrogans serovar lai str. 56601
uucuaaaauuguagaaacuuau

SEQ ID NO: 753807 - RNA, 14 nt, Leptospira interrogans serovar lai str. 56601
uucuaaaauuugua

SEQ ID NO: 753808 - RNA, 12 nt, Leptospira interrogans serovar lai str. 56601
uucuaaaauaua

SEQ ID NO: 753809 - RNA, 20 nt, Leptospira interrogans serovar lai str. 56601
uucuaaaauauccguaaaac

SEQ ID NO: 753810 - RNA, 13 nt, Leptospira interrogans serovar lai str. 56601
uucuaaaagaaga

SEQ ID NO: 753811 - RNA, 15 nt, Leptospira interrogans serovar lai str. 56601
uucuaaaaguaaaag

SEQ ID NO: 753812 - RNA, 14 nt, Leptospira interrogans serovar lai str. 56601
uucuaauucauuga

SEQ ID NO: 753813 - RNA, 20 nt, Leptospira interrogans serovar lai str. 56601
uucuaauuuucuuguuuaaa

SEQ ID NO: 753814 - RNA, 13 nt, Leptospira interrogans serovar lai str. 56601
uucuaaacacaga

SEQ ID NO: 753815 - RNA, 12 nt, Leptospira interrogans serovar lai str. 56601
uucuaaaggaaa

SEQ ID NO: 753816 - RNA, 17 nt, Leptospira interrogans serovar lai str. 56601
uucuacaccuucuaaau

SEQ ID NO: 753817 - RNA, 22 nt, Leptospira interrogans serovar lai str. 56601
uucuacaauggaggauccuuuc

SEQ ID NO: 753818 - RNA, 14 nt, Leptospira interrogans serovar lai str. 56601
uucuacaauccucg

SEQ ID NO: 753819 - RNA, 19 nt, Leptospira interrogans serovar lai str. 56601
uucuaauuuuuuauugaau

SEQ ID NO: 753820 - RNA, 16 nt, Leptospira interrogans serovar lai str. 56601
uucuacaaaauuuaga

SEQ ID NO: 753821 - RNA, 13 nt, Leptospira interrogans serovar lai str. 56601
uucuacaaauaaa

SEQ ID NO: 753822 - RNA, 13 nt, Leptospira interrogans serovar lai str. 56601
uucuacaaauucu

SEQ ID NO: 753823 - RNA, 14 nt, Leptospira interrogans serovar lai str. 56601
uucuacauucugaa

SEQ ID NO: 753824 - RNA, 19 nt, Leptospira interrogans serovar lai str. 56601
uucuacauuuuugugaaac

SEQ ID NO: 753825 - RNA, 21 nt, Leptospira interrogans serovar lai str. 56601
uucuaugaaacgaaauauauu

SEQ ID NO: 753826 - RNA, 22 nt, Leptospira interrogans serovar lai str. 56601
uucuaugaaacgaaauauauua

SEQ ID NO: 753827 - RNA, 12 nt, Leptospira interrogans serovar lai str. 56601
uucuaucaaaaa

SEQ ID NO: 753828 - RNA, 19 nt, Leptospira interrogans serovar lai str. 56601
uucuauauauugaaauauu

SEQ ID NO: 753829 - RNA, 22 nt, Leptospira interrogans serovar lai str. 56601
uucuauaguaaagauuagaaaa

SEQ ID NO: 753830 - RNA, 16 nt, Leptospira interrogans serovar lai str. 56601
uucuacgauugcaaga

SEQ ID NO: 753831 - RNA, 14 nt, Leptospira interrogans serovar lai str. 56601
uucuauuuuaaaag

SEQ ID NO: 753832 - RNA, 21 nt, Leptospira interrogans serovar lai str. 56601
uucuauuuucuuugaaaaaau

SEQ ID NO: 753833 - RNA, 13 nt, Leptospira interrogans serovar lai str. 56601
uucucaaaaucuu

SEQ ID NO: 753834 - RNA, 19 nt, Leptospira interrogans serovar lai str. 56601
uucucaaaaucuuaauaaa

SEQ ID NO: 753835 - RNA, 12 nt, Leptospira interrogans serovar lai str. 56601
uucguuuuacuu

SEQ ID NO: 753836 - RNA, 16 nt, Leptospira interrogans serovar lai str. 56601
uucguuuuaguuccca

SEQ ID NO: 753837 - RNA, 17 nt, Leptospira interrogans serovar lai str. 56601
uucguuuuuuaaaaugu

SEQ ID NO: 753838 - RNA, 16 nt, Leptospira interrogans serovar lai str. 56601
uucguuuuuuuaauau

SEQ ID NO: 753839 - RNA, 12 nt, Leptospira interrogans serovar lai str. 56601
uucuaaaaaaag

SEQ ID NO: 753840 - RNA, 19 nt, Leptospira interrogans serovar lai str. 56601
uucuaaaaaaaguuuuaca

SEQ ID NO: 753841 - RNA, 15 nt, Leptospira interrogans serovar lai str. 56601
uucuaaaaaaauacg

SEQ ID NO: 753842 - RNA, 13 nt, Leptospira interrogans serovar lai str. 56601
uucuaaaaauaag

SEQ ID NO: 753843 - RNA, 14 nt, Leptospira interrogans serovar lai str. 56601
uucuaaaaaugaaa

SEQ ID NO: 753844 - RNA, 11 nt, Leptospira interrogans serovar lai str. 56601
uucuaaaaauu

SEQ ID NO: 753845 - RNA, 12 nt, Leptospira interrogans serovar lai str. 56601
uucuaaaaauuu

SEQ ID NO: 753846 - RNA, 20 nt, Leptospira interrogans serovar lai str. 56601
uucuaaaaauuuuuuuaaac

SEQ ID NO: 753847 - RNA, 13 nt, Leptospira interrogans serovar lai str. 56601
uucguuucaacuu

SEQ ID NO: 753848 - RNA, 14 nt, Leptospira interrogans serovar lai str. 56601
uucguuguauggaa

SEQ ID NO: 753849 - RNA, 14 nt, Leptospira interrogans serovar lai str. 56601
uucguuugaacucg

SEQ ID NO: 753850 - RNA, 17 nt, Leptospira interrogans serovar lai str. 56601
uucguuggaaaguuuuu

SEQ ID NO: 753851 - RNA, 17 nt, Leptospira interrogans serovar lai str. 56601
uucguaucuaaagacua

SEQ ID NO: 753852 - RNA, 16 nt, Leptospira interrogans serovar lai str. 56601
uucguaugaguuccca

SEQ ID NO: 753853 - RNA, 14 nt, Leptospira interrogans serovar lai str. 56601
uucgggaaacaaca

SEQ ID NO: 753854 - RNA, 15 nt, Leptospira interrogans serovar lai str. 56601
uuaucagaaaaacau

SEQ ID NO: 753855 - RNA, 16 nt, Leptospira interrogans serovar lai str. 56601
uucggcgcaaaauauc

SEQ ID NO: 753856 - RNA, 22 nt, Leptospira interrogans serovar lai str. 56601
uucugcauauacggauuucuau

SEQ ID NO: 753857 - RNA, 21 nt, Leptospira interrogans serovar lai str. 56601
uucugaaaaguuuaugaauuu

SEQ ID NO: 753858 - RNA, 22 nt, Leptospira interrogans serovar lai str. 56601
uucucuuuucgaaaauucugcu

SEQ ID NO: 753859 - RNA, 19 nt, Leptospira interrogans serovar lai str. 56601
uucucuuuuuagacaaaaa

SEQ ID NO: 753860 - RNA, 14 nt, Leptospira interrogans serovar lai str. 56601
uucugaaaaaaauu

SEQ ID NO: 753861 - RNA, 19 nt, Leptospira interrogans serovar lai str. 56601
uucugaaaaaaguugaaau

SEQ ID NO: 753862 - RNA, 20 nt, Leptospira interrogans serovar lai str. 56601
uucugaaaaaaguuggaauu

SEQ ID NO: 753863 - RNA, 23 nt, Leptospira interrogans serovar lai str. 56601
uucugaaaaaguuggaaucuaaa

SEQ ID NO: 753864 - RNA, 19 nt, Leptospira interrogans serovar lai str. 56601
uucucuucuaauucaguuu

SEQ ID NO: 753865 - RNA, 21 nt, Leptospira interrogans serovar lai str. 56601
uucucucaaauucuucagggc

SEQ ID NO: 753866 - RNA, 15 nt, Leptospira interrogans serovar lai str. 56601
uucucucgaaaugag

SEQ ID NO: 753867 - RNA, 22 nt, Leptospira interrogans serovar lai str. 56601
uucucucgacaaucaaaacuuu

SEQ ID NO: 753868 - RNA, 21 nt, Leptospira interrogans serovar lai str. 56601
uucucccccaacugaaaauga

SEQ ID NO: 753869 - RNA, 22 nt, Leptospira interrogans serovar lai str. 56601
uucucuagaaauuuauaauauu

SEQ ID NO: 753870 - RNA, 16 nt, Leptospira interrogans serovar lai str. 56601
uucucuagaaacugca

SEQ ID NO: 753871 - RNA, 18 nt, Leptospira interrogans serovar lai str. 56601
uucucacagaaauauauu

SEQ ID NO: 753872 - RNA, 14 nt, Leptospira interrogans serovar lai str. 56601
uucuccaucuguuu

SEQ ID NO: 753873 - RNA, 13 nt, Leptospira interrogans serovar lai str. 56601
uucuccauccuau

SEQ ID NO: 753874 - RNA, 12 nt, Leptospira interrogans serovar lai str. 56601
uucuuauauaaa

SEQ ID NO: 753875 - RNA, 16 nt, Leptospira interrogans serovar lai str. 56601
uucuuaugagauuuuu

SEQ ID NO: 753876 - RNA, 17 nt, Leptospira interrogans serovar lai str. 56601
uucuuauguggaugaua

SEQ ID NO: 753877 - RNA, 16 nt, Leptospira interrogans serovar lai str. 56601
uucuuauuaauucuua

SEQ ID NO: 753878 - RNA, 15 nt, Leptospira interrogans serovar lai str. 56601
uucuuaauaaacuuu

SEQ ID NO: 753879 - RNA, 15 nt, Leptospira interrogans serovar lai str. 56601
uucuucuaaugaagu

SEQ ID NO: 753880 - RNA, 16 nt, Leptospira interrogans serovar lai str. 56601
uucuucuagauuuuaa

SEQ ID NO: 753881 - RNA, 17 nt, Leptospira interrogans serovar lai str. 56601
uucuucugcaauucgca

SEQ ID NO: 753882 - RNA, 17 nt, Leptospira interrogans serovar lai str. 56601
uucuucguuauuuuuau

SEQ ID NO: 753883 - RNA, 14 nt, Leptospira interrogans serovar lai str. 56601
uucugcuaaguuca

SEQ ID NO: 753884 - RNA, 21 nt, Leptospira interrogans serovar lai str. 56601
uucuguugaguucauucugau

SEQ ID NO: 753885 - RNA, 15 nt, Leptospira interrogans serovar lai str. 56601
uucuguucauucuuu

SEQ ID NO: 753886 - RNA, 19 nt, Leptospira interrogans serovar lai str. 56601
uucuuaaaaugugggaauu

SEQ ID NO: 753887 - RNA, 11 nt, Leptospira interrogans serovar lai str. 56601
uucuuaaaaaa

SEQ ID NO: 753888 - RNA, 14 nt, Leptospira interrogans serovar lai str. 56601
uucuuaaaaaauau

SEQ ID NO: 753889 - RNA, 19 nt, Leptospira interrogans serovar lai str. 56601
uucuuaaaucuuagauuca

SEQ ID NO: 753890 - RNA, 13 nt, Leptospira interrogans serovar lai str. 56601
uugauccauuaau

SEQ ID NO: 753891 - RNA, 17 nt, Leptospira interrogans serovar lai str. 56601
uugauccguuuuaaaau

SEQ ID NO: 753892 - RNA, 18 nt, Leptospira interrogans serovar lai str. 56601
uugauuaaacaggacaau

SEQ ID NO: 753893 - RNA, 13 nt, Leptospira interrogans serovar lai str. 56601
uugauuagaaaaa

SEQ ID NO: 753894 - RNA, 19 nt, Leptospira interrogans serovar lai str. 56601
uugauuagaguuaaauuga

SEQ ID NO: 753895 - RNA, 12 nt, Leptospira interrogans serovar lai str. 56601
uugauucaaaaa

SEQ ID NO: 753896 - RNA, 16 nt, Leptospira interrogans serovar lai str. 56601
uugauucaaaaacuaa

SEQ ID NO: 753897 - RNA, 12 nt, Leptospira interrogans serovar lai str. 56601
uugcaaagaaga

SEQ ID NO: 753898 - RNA, 20 nt, Leptospira interrogans serovar lai str. 56601
uugcaacuuugguuaucaua

SEQ ID NO: 753899 - RNA, 11 nt, Leptospira interrogans serovar lai str. 56601
uugcacaaaac

SEQ ID NO: 753900 - RNA, 14 nt, Leptospira interrogans serovar lai str. 56601
uugcacauaaaaga

SEQ ID NO: 753901 - RNA, 23 nt, Leptospira interrogans serovar lai str. 56601
uugauagaacucuuuuaccuuac

SEQ ID NO: 753902 - RNA, 21 nt, Leptospira interrogans serovar lai str. 56601
uugauaccgggauuuuaaaaa

SEQ ID NO: 753903 - RNA, 14 nt, Leptospira interrogans serovar lai str. 56601
uugauacugcauca

SEQ ID NO: 753904 - RNA, 18 nt, Leptospira interrogans serovar lai str. 56601
uugauagaaaaaaucacg

SEQ ID NO: 753905 - RNA, 17 nt, Leptospira interrogans serovar lai str. 56601
uugauagaaaaacucug

SEQ ID NO: 753906 - RNA, 16 nt, Leptospira interrogans serovar lai str. 56601
uugagggguuuuuccu

SEQ ID NO: 753907 - RNA, 20 nt, Leptospira interrogans serovar lai str. 56601
uugagggguuuuuccuuuua

SEQ ID NO: 753908 - RNA, 19 nt, Leptospira interrogans serovar lai str. 56601
uugagguauuuuagagaaa

SEQ ID NO: 753909 - RNA, 22 nt, Leptospira interrogans serovar lai str. 56601
uugauaauucgugaacuuuaga

SEQ ID NO: 753910 - RNA, 22 nt, Leptospira interrogans serovar lai str. 56601
uugauaauuuuuguuuguaaaa

SEQ ID NO: 753911 - RNA, 15 nt, Leptospira interrogans serovar lai str. 56601
uugagauuacaaaaa

SEQ ID NO: 753912 - RNA, 21 nt, Leptospira interrogans serovar lai str. 56601
uugagcacaauauauucagua

SEQ ID NO: 753913 - RNA, 12 nt, Leptospira interrogans serovar lai str. 56601
uugagagccuuu

SEQ ID NO: 753914 - RNA, 20 nt, Leptospira interrogans serovar lai str. 56601
uugagagccuuuuuauuucu

SEQ ID NO: 753915 - RNA, 16 nt, Leptospira interrogans serovar lai str. 56601
uugagacaagaagaaa

SEQ ID NO: 753916 - RNA, 21 nt, Leptospira interrogans serovar lai str. 56601
uugagacagguucugauauaa

SEQ ID NO: 753917 - RNA, 20 nt, Leptospira interrogans serovar lai str. 56601
uugaaugaaaagauuucaaa

SEQ ID NO: 753918 - RNA, 17 nt, Leptospira interrogans serovar lai str. 56601
uugaaugaaaucuaaau

SEQ ID NO: 753919 - RNA, 22 nt, Leptospira interrogans serovar lai str. 56601
uugaaugaaaucuaaauuuguu

SEQ ID NO: 753920 - RNA, 23 nt, Leptospira interrogans serovar lai str. 56601
uugaaugaaaucuaaauuuguug

SEQ ID NO: 753921 - RNA, 17 nt, Leptospira interrogans serovar lai str. 56601
uugaauccgaauacaaa

SEQ ID NO: 753922 - RNA, 15 nt, Leptospira interrogans serovar lai str. 56601
uugacaauuugugaa

SEQ ID NO: 753923 - RNA, 15 nt, Leptospira interrogans serovar lai str. 56601
uugaauaucuaauau

SEQ ID NO: 753924 - RNA, 15 nt, Leptospira interrogans serovar lai str. 56601
uugaauauaauaaaa

SEQ ID NO: 753925 - RNA, 11 nt, Leptospira interrogans serovar lai str. 56601
uugaauauuuu

SEQ ID NO: 753926 - RNA, 12 nt, Leptospira interrogans serovar lai str. 56601
uugaccagagcu

SEQ ID NO: 753927 - RNA, 15 nt, Leptospira interrogans serovar lai str. 56601
uugaauagaauuugg

SEQ ID NO: 753928 - RNA, 22 nt, Leptospira interrogans serovar lai str. 56601
uugaauacgacagguuuaauug

SEQ ID NO: 753929 - RNA, 14 nt, Leptospira interrogans serovar lai str. 56601
uugaaguaguuccu

SEQ ID NO: 753930 - RNA, 22 nt, Leptospira interrogans serovar lai str. 56601
uugaaguguagagaaacuuagc

SEQ ID NO: 753931 - RNA, 15 nt, Leptospira interrogans serovar lai str. 56601
uugaaguuaagaaga

SEQ ID NO: 753932 - RNA, 17 nt, Leptospira interrogans serovar lai str. 56601
uugaaggguaacucagc

SEQ ID NO: 753933 - RNA, 17 nt, Leptospira interrogans serovar lai str. 56601
uugaaggaguuuuguua

SEQ ID NO: 753934 - RNA, 23 nt, Leptospira interrogans serovar lai str. 56601
uugaacagaaagaucaugaauca

SEQ ID NO: 753935 - RNA, 16 nt, Leptospira interrogans serovar lai str. 56601
uugaagcguuuucuua

SEQ ID NO: 753936 - RNA, 23 nt, Leptospira interrogans serovar lai str. 56601
uugaagcguuuucuuaauuguug

SEQ ID NO: 753937 - RNA, 22 nt, Leptospira interrogans serovar lai str. 56601
uugaaauauuauaaauuuaaaa

SEQ ID NO: 753938 - RNA, 14 nt, Leptospira interrogans serovar lai str. 56601
uugaaaauaaaaau

SEQ ID NO: 753939 - RNA, 18 nt, Leptospira interrogans serovar lai str. 56601
uugaaaauaaaaaucaua

SEQ ID NO: 753940 - RNA, 13 nt, Leptospira interrogans serovar lai str. 56601
uugaaaaauucca

SEQ ID NO: 753941 - RNA, 22 nt, Leptospira interrogans serovar lai str. 56601
uugaaaaauuucauaguucaau

SEQ ID NO: 753942 - RNA, 13 nt, Leptospira interrogans serovar lai str. 56601
uugaaaaauuucc

SEQ ID NO: 753943 - RNA, 23 nt, Leptospira interrogans serovar lai str. 56601
uucuuuuguaaaacgauucugca

SEQ ID NO: 753944 - RNA, 14 nt, Leptospira interrogans serovar lai str. 56601
uucuuuuuaaauac

SEQ ID NO: 753945 - RNA, 15 nt, Leptospira interrogans serovar lai str. 56601
uucuuuuuaaauaca

SEQ ID NO: 753946 - RNA, 12 nt, Leptospira interrogans serovar lai str. 56601
uucuuuuuauuu

SEQ ID NO: 753947 - RNA, 14 nt, Leptospira interrogans serovar lai str. 56601
uugaaaaaugaauu

SEQ ID NO: 753948 - RNA, 12 nt, Leptospira interrogans serovar lai str. 56601
uucuuucuaaau

SEQ ID NO: 753949 - RNA, 14 nt, Leptospira interrogans serovar lai str. 56601
uucuuuuagaaaau

SEQ ID NO: 753950 - RNA, 15 nt, Leptospira interrogans serovar lai str. 56601
uucuuucuauuuuuu

SEQ ID NO: 753951 - RNA, 12 nt, Leptospira interrogans serovar lai str. 56601
uucuuuaaaauu

SEQ ID NO: 753952 - RNA, 18 nt, Leptospira interrogans serovar lai str. 56601
uucuugugucaagcccuc

SEQ ID NO: 753953 - RNA, 12 nt, Leptospira interrogans serovar lai str. 56601
uucuuuaaaaac

SEQ ID NO: 753954 - RNA, 11 nt, Leptospira interrogans serovar lai str. 56601
uucuucuuccu

SEQ ID NO: 753955 - RNA, 12 nt, Leptospira interrogans serovar lai str. 56601
uucuucugcugc

SEQ ID NO: 753956 - RNA, 19 nt, Leptospira interrogans serovar lai str. 56601
uugucuacgauuucuccaa

SEQ ID NO: 753957 - RNA, 14 nt, Leptospira interrogans serovar lai str. 56601
uuguccauuuccau

SEQ ID NO: 753958 - RNA, 11 nt, Leptospira interrogans serovar lai str. 56601
uugucccaaaa

SEQ ID NO: 753959 - RNA, 13 nt, Leptospira interrogans serovar lai str. 56601
uugugcaauaauu

SEQ ID NO: 753960 - RNA, 14 nt, Leptospira interrogans serovar lai str. 56601
uuguucauaaaauc

SEQ ID NO: 753961 - RNA, 16 nt, Leptospira interrogans serovar lai str. 56601
uuguuaaaaaauuaau

SEQ ID NO: 753962 - RNA, 12 nt, Leptospira interrogans serovar lai str. 56601
uuguuaaauuuu

SEQ ID NO: 753963 - RNA, 16 nt, Leptospira interrogans serovar lai str. 56601
uuguuaagauaaauuu

SEQ ID NO: 753964 - RNA, 20 nt, Leptospira interrogans serovar lai str. 56601
uuguaaugacacuuaucaaa

SEQ ID NO: 753965 - RNA, 21 nt, Leptospira interrogans serovar lai str. 56601
uuguaaugacacuuaucaaau

SEQ ID NO: 753966 - RNA, 16 nt, Leptospira interrogans serovar lai str. 56601
uuguaauaguucccac

SEQ ID NO: 753967 - RNA, 19 nt, Leptospira interrogans serovar lai str. 56601
uuguaauaguucccacagu

SEQ ID NO: 753968 - RNA, 12 nt, Leptospira interrogans serovar lai str. 56601
uuguaaguuuuc

SEQ ID NO: 753969 - RNA, 12 nt, Leptospira interrogans serovar lai str. 56601
uuguaaguuuuu

SEQ ID NO: 753970 - RNA, 18 nt, Leptospira interrogans serovar lai str. 56601
uuguaaggauuccuuucc

SEQ ID NO: 753971 - RNA, 22 nt, Leptospira interrogans serovar lai str. 56601
uuguaagggaaaguuauuucuu

SEQ ID NO: 753972 - RNA, 12 nt, Leptospira interrogans serovar lai str. 56601
uuguaauaaugu

SEQ ID NO: 753973 - RNA, 16 nt, Leptospira interrogans serovar lai str. 56601
uugguuaucauaaaaa

SEQ ID NO: 753974 - RNA, 20 nt, Leptospira interrogans serovar lai str. 56601
uugguucaaaguuuucacaa

SEQ ID NO: 753975 - RNA, 17 nt, Leptospira interrogans serovar lai str. 56601
uuguacucugcaaaauu

SEQ ID NO: 753976 - RNA, 14 nt, Leptospira interrogans serovar lai str. 56601
uuguagaauuuauu

SEQ ID NO: 753977 - RNA, 16 nt, Leptospira interrogans serovar lai str. 56601
uuguauagaaaccgau

SEQ ID NO: 753978 - RNA, 17 nt, Leptospira interrogans serovar lai str. 56601
uuguauagaaaccgauu

SEQ ID NO: 753979 - RNA, 18 nt, Leptospira interrogans serovar lai str. 56601
uuguauacaggaaacauu

SEQ ID NO: 753980 - RNA, 19 nt, Leptospira interrogans serovar lai str. 56601
uuguaucagauguuuuaaa

SEQ ID NO: 753981 - RNA, 14 nt, Leptospira interrogans serovar lai str. 56601
uuguaucauuguuu

SEQ ID NO: 753982 - RNA, 20 nt, Leptospira interrogans serovar lai str. 56601
uuguauaaaaauuagaaaug

SEQ ID NO: 753983 - RNA, 15 nt, Leptospira interrogans serovar lai str. 56601
uuguaugaguuccca

SEQ ID NO: 753984 - RNA, 18 nt, Leptospira interrogans serovar lai str. 56601
uuguaugcaggaaacaua

SEQ ID NO: 753985 - RNA, 18 nt, Leptospira interrogans serovar lai str. 56601
uuguauccgaaaaauucc

SEQ ID NO: 753986 - RNA, 15 nt, Leptospira interrogans serovar lai str. 56601
uuguucuccaacuua

SEQ ID NO: 753987 - RNA, 12 nt, Leptospira interrogans serovar lai str. 56601
uuguuuucuaaa

SEQ ID NO: 753988 - RNA, 18 nt, Leptospira interrogans serovar lai str. 56601
uuguuuuuuagaaaauuc

SEQ ID NO: 753989 - RNA, 16 nt, Leptospira interrogans serovar lai str. 56601
uuguuuuucuuuaggu

SEQ ID NO: 753990 - RNA, 12 nt, Leptospira interrogans serovar lai str. 56601
uuguuuuuaaau

SEQ ID NO: 753991 - RNA, 16 nt, Leptospira interrogans serovar lai str. 56601
uuguuuuuauaaauaa

SEQ ID NO: 753992 - RNA, 10 nt, Leptospira interrogans serovar lai str. 56601
uuuaaauaca

SEQ ID NO: 753993 - RNA, 17 nt, Leptospira interrogans serovar lai str. 56601
uuuaaauagauucaaaa

SEQ ID NO: 753994 - RNA, 12 nt, Leptospira interrogans serovar lai str. 56601
uuuaaauauuaa

SEQ ID NO: 753995 - RNA, 16 nt, Leptospira interrogans serovar lai str. 56601
uuuaaauccaacuuaa

SEQ ID NO: 753996 - RNA, 22 nt, Leptospira interrogans serovar lai str. 56601
uuuaaauccaacuuaaaacugu

SEQ ID NO: 753997 - RNA, 21 nt, Leptospira interrogans serovar lai str. 56601
uuuaaauaagcuaagcauaaa

SEQ ID NO: 753998 - RNA, 21 nt, Leptospira interrogans serovar lai str. 56601
uuuaaaaucacaaaaaagaua

SEQ ID NO: 753999 - RNA, 18 nt, Leptospira interrogans serovar lai str. 56601
uuuaaaaguuugauuuca

SEQ ID NO: 754000 - RNA, 11 nt, Leptospira interrogans serovar lai str. 56601
uuuaaaaguuu

SEQ ID NO: 754001 - RNA, 13 nt, Leptospira interrogans serovar lai str. 56601
uuuaaaacuuguc

SEQ ID NO: 754002 - RNA, 21 nt, Leptospira interrogans serovar lai str. 56601
uuuaaaacuugucccaaaauu

SEQ ID NO: 754003 - RNA, 20 nt, Leptospira interrogans serovar lai str. 56601
uuuaaaucuuaugguuuuuu

SEQ ID NO: 754004 - RNA, 15 nt, Leptospira interrogans serovar lai str. 56601
uuuaacaacucuaau

SEQ ID NO: 754005 - RNA, 21 nt, Leptospira interrogans serovar lai str. 56601
uuuaaaugcagcuauuuuuuu

SEQ ID NO: 754006 - RNA, 11 nt, Leptospira interrogans serovar lai str. 56601
uuuaaaugaaa

SEQ ID NO: 754007 - RNA, 16 nt, Leptospira interrogans serovar lai str. 56601
uuuaaaugaaaugugg

SEQ ID NO: 754008 - RNA, 22 nt, Leptospira interrogans serovar lai str. 56601
uuuaacauuuguuuuuuauaau

SEQ ID NO: 754009 - RNA, 20 nt, Leptospira interrogans serovar lai str. 56601
uuuaauuuguaggaauuccu

SEQ ID NO: 754010 - RNA, 18 nt, Leptospira interrogans serovar lai str. 56601
uuuaauuuguuauuguuu

SEQ ID NO: 754011 - RNA, 18 nt, Leptospira interrogans serovar lai str. 56601
uuuacacaacauuaugaa

SEQ ID NO: 754012 - RNA, 18 nt, Leptospira interrogans serovar lai str. 56601
uuuaauuuucuaauauaa

SEQ ID NO: 754013 - RNA, 20 nt, Leptospira interrogans serovar lai str. 56601
uuuaauugcgguaguuccca

SEQ ID NO: 754014 - RNA, 22 nt, Leptospira interrogans serovar lai str. 56601
uuuaauugcgguaguucccaca

SEQ ID NO: 754015 - RNA, 23 nt, Leptospira interrogans serovar lai str. 56601
uuuaauugcgguaguucccacau

SEQ ID NO: 754016 - RNA, 13 nt, Leptospira interrogans serovar lai str. 56601
uuuaauaauauaa

SEQ ID NO: 754017 - RNA, 14 nt, Leptospira interrogans serovar lai str. 56601
uuuaauacgaauuu

SEQ ID NO: 754018 - RNA, 16 nt, Leptospira interrogans serovar lai str. 56601
uuuaauuacaguuaau

SEQ ID NO: 754019 - RNA, 19 nt, Leptospira interrogans serovar lai str. 56601
uuuaauuauguuugccauu

SEQ ID NO: 754020 - RNA, 15 nt, Leptospira interrogans serovar lai str. 56601
uuuaauuauuuauuu

SEQ ID NO: 754021 - RNA, 12 nt, Leptospira interrogans serovar lai str. 56601
uuuaauaaagau

SEQ ID NO: 754022 - RNA, 17 nt, Leptospira interrogans serovar lai str. 56601
uuuaauaaaauuuuuaa

SEQ ID NO: 754023 - RNA, 20 nt, Leptospira interrogans serovar lai str. 56601
uuuaauaaaauuuuuaaaaa

SEQ ID NO: 754024 - RNA, 12 nt, Leptospira interrogans serovar lai str. 56601
uuuaaguuugug

SEQ ID NO: 754025 - RNA, 13 nt, Leptospira interrogans serovar lai str. 56601
uuuaaguuuguga

SEQ ID NO: 754026 - RNA, 16 nt, Leptospira interrogans serovar lai str. 56601
uuuaaguuugugagag

SEQ ID NO: 754027 - RNA, 13 nt, Leptospira interrogans serovar lai str. 56601
uuuaaguuuucuu

SEQ ID NO: 754028 - RNA, 14 nt, Leptospira interrogans serovar lai str. 56601
uuuaaguuuucuuu

SEQ ID NO: 754029 - RNA, 21 nt, Leptospira interrogans serovar lai str. 56601
uuuaaguuuucuuuuuuauca

SEQ ID NO: 754030 - RNA, 19 nt, Leptospira interrogans serovar lai str. 56601
uuuaaguuuuucuuaaaaa

SEQ ID NO: 754031 - RNA, 14 nt, Leptospira interrogans serovar lai str. 56601
uuuaauaaaauaca

SEQ ID NO: 754032 - RNA, 18 nt, Leptospira interrogans serovar lai str. 56601
uuuaacucguuagagaaa

SEQ ID NO: 754033 - RNA, 19 nt, Leptospira interrogans serovar lai str. 56601
uuuaacucguuagagaaaa

SEQ ID NO: 754034 - RNA, 14 nt, Leptospira interrogans serovar lai str. 56601
uuuaaccuuuacca

SEQ ID NO: 754035 - RNA, 17 nt, Leptospira interrogans serovar lai str. 56601
uuuaacgcaaaauacug

SEQ ID NO: 754036 - RNA, 16 nt, Leptospira interrogans serovar lai str. 56601
uugguguuguguuagu

SEQ ID NO: 754037 - RNA, 22 nt, Leptospira interrogans serovar lai str. 56601
uugguauuuuagguauuucuaa

SEQ ID NO: 754038 - RNA, 15 nt, Leptospira interrogans serovar lai str. 56601
uugguaauuugugaa

SEQ ID NO: 754039 - RNA, 18 nt, Leptospira interrogans serovar lai str. 56601
uuggcucaacuuuuccag

SEQ ID NO: 754040 - RNA, 14 nt, Leptospira interrogans serovar lai str. 56601
uuggcucagauuuc

SEQ ID NO: 754041 - RNA, 22 nt, Leptospira interrogans serovar lai str. 56601
uuggaauguacuaaaauuuuau

SEQ ID NO: 754042 - RNA, 18 nt, Leptospira interrogans serovar lai str. 56601
uuggcagaugaaacuaau

SEQ ID NO: 754043 - RNA, 21 nt, Leptospira interrogans serovar lai str. 56601
uuggagggcaaucgauuugag

SEQ ID NO: 754044 - RNA, 22 nt, Leptospira interrogans serovar lai str. 56601
uuggaggaaaagucgaaagaau

SEQ ID NO: 754045 - RNA, 19 nt, Leptospira interrogans serovar lai str. 56601
uugcugucauaaaccgauu

SEQ ID NO: 754046 - RNA, 21 nt, Leptospira interrogans serovar lai str. 56601
uugcucagagaauaucugaau

SEQ ID NO: 754047 - RNA, 22 nt, Leptospira interrogans serovar lai str. 56601
uugcucagagaauaucugaauu

SEQ ID NO: 754048 - RNA, 20 nt, Leptospira interrogans serovar lai str. 56601
uugcgugaaaaccaauuccg

SEQ ID NO: 754049 - RNA, 18 nt, Leptospira interrogans serovar lai str. 56601
uugcuaaaauuuuuuuaa

SEQ ID NO: 754050 - RNA, 20 nt, Leptospira interrogans serovar lai str. 56601
uugccggagccaaauuguaa

SEQ ID NO: 754051 - RNA, 20 nt, Leptospira interrogans serovar lai str. 56601
uugcauauuccuugagaaaa

SEQ ID NO: 754052 - RNA, 16 nt, Leptospira interrogans serovar lai str. 56601
uugcacguaaacauuc

SEQ ID NO: 754053 - RNA, 17 nt, Leptospira interrogans serovar lai str. 56601
uugcacugaaauagaau

SEQ ID NO: 754054 - RNA, 18 nt, Leptospira interrogans serovar lai str. 56601
uugcacugaaauagaauu

SEQ ID NO: 754055 - RNA, 12 nt, Leptospira interrogans serovar lai str. 56601
uuuauuaagaac

SEQ ID NO: 754056 - RNA, 21 nt, Leptospira interrogans serovar lai str. 56601
uuuauuaagaacuuucucgaa

SEQ ID NO: 754057 - RNA, 13 nt, Leptospira interrogans serovar lai str. 56601
uuuauuaaauaaa

SEQ ID NO: 754058 - RNA, 15 nt, Leptospira interrogans serovar lai str. 56601
uuuaugaauaaaaaa

SEQ ID NO: 754059 - RNA, 16 nt, Leptospira interrogans serovar lai str. 56601
uuuaucuuuauaaaaa

SEQ ID NO: 754060 - RNA, 16 nt, Leptospira interrogans serovar lai str. 56601
uuuaugaaaaaauuca

SEQ ID NO: 754061 - RNA, 19 nt, Leptospira interrogans serovar lai str. 56601
uuuaugaccuaauuuauuu

SEQ ID NO: 754062 - RNA, 20 nt, Leptospira interrogans serovar lai str. 56601
uuuaucgcaaaacauuauuu

SEQ ID NO: 754063 - RNA, 14 nt, Leptospira interrogans serovar lai str. 56601
uuuauccauaaauc

SEQ ID NO: 754064 - RNA, 14 nt, Leptospira interrogans serovar lai str. 56601
uuuauccauaaauu

SEQ ID NO: 754065 - RNA, 22 nt, Leptospira interrogans serovar lai str. 56601
uuuauccauccauacaacuuuc

SEQ ID NO: 754066 - RNA, 16 nt, Leptospira interrogans serovar lai str. 56601
uuuaucuguaaaauuu

SEQ ID NO: 754067 - RNA, 19 nt, Leptospira interrogans serovar lai str. 56601
uuuaucggcguucuacaaa

SEQ ID NO: 754068 - RNA, 21 nt, Leptospira interrogans serovar lai str. 56601
uuuauaauucguuuuuuaaaa

SEQ ID NO: 754069 - RNA, 15 nt, Leptospira interrogans serovar lai str. 56601
uuuauaauucugaau

SEQ ID NO: 754070 - RNA, 20 nt, Leptospira interrogans serovar lai str. 56601
uuuauaauauucuuuuauau

SEQ ID NO: 754071 - RNA, 22 nt, Leptospira interrogans serovar lai str. 56601
uuuauacgcccgaguaauaaga

SEQ ID NO: 754072 - RNA, 19 nt, Leptospira interrogans serovar lai str. 56601
uuuauacauucguuuuaau

SEQ ID NO: 754073 - RNA, 13 nt, Leptospira interrogans serovar lai str. 56601
uuuauaauuuuua

SEQ ID NO: 754074 - RNA, 15 nt, Leptospira interrogans serovar lai str. 56601
uuuauagaaaauuuu

SEQ ID NO: 754075 - RNA, 22 nt, Leptospira interrogans serovar lai str. 56601
uuuauacuuaucacgaaaauua

SEQ ID NO: 754076 - RNA, 13 nt, Leptospira interrogans serovar lai str. 56601
uuuauaaagauuu

SEQ ID NO: 754077 - RNA, 14 nt, Leptospira interrogans serovar lai str. 56601
uuuauaaagcaaaa

SEQ ID NO: 754078 - RNA, 12 nt, Leptospira interrogans serovar lai str. 56601
uuuauaaaugua

SEQ ID NO: 754079 - RNA, 11 nt, Leptospira interrogans serovar lai str. 56601
uuuauaaaauu

SEQ ID NO: 754080 - RNA, 12 nt, Leptospira interrogans serovar lai str. 56601
uuuauaaaauua

SEQ ID NO: 754081 - RNA, 21 nt, Leptospira interrogans serovar lai str. 56601
uuuauaaaaccugauuuuucu

SEQ ID NO: 754082 - RNA, 12 nt, Leptospira interrogans serovar lai str. 56601
uuuauaaaagua

SEQ ID NO: 754083 - RNA, 21 nt, Leptospira interrogans serovar lai str. 56601
uuuauaaaaguauaauauuua

SEQ ID NO: 754084 - RNA, 15 nt, Leptospira interrogans serovar lai str. 56601
uuuauaaaauaaaaa

SEQ ID NO: 754085 - RNA, 21 nt, Leptospira interrogans serovar lai str. 56601
uuuauaacgggaauuauaaau

SEQ ID NO: 754086 - RNA, 14 nt, Leptospira interrogans serovar lai str. 56601
uuuauauuuuaauu

SEQ ID NO: 754087 - RNA, 18 nt, Leptospira interrogans serovar lai str. 56601
uuuauauuucauugaaau

SEQ ID NO: 754088 - RNA, 20 nt, Leptospira interrogans serovar lai str. 56601
uuuauaucuuaauuaaaaaa

SEQ ID NO: 754089 - RNA, 20 nt, Leptospira interrogans serovar lai str. 56601
uuuauaguuuuuaacuguuu

SEQ ID NO: 754090 - RNA, 15 nt, Leptospira interrogans serovar lai str. 56601
uuuauauaaaauuug

SEQ ID NO: 754091 - RNA, 20 nt, Leptospira interrogans serovar lai str. 56601
uuuauauauauucacaaaaa

SEQ ID NO: 754092 - RNA, 13 nt, Leptospira interrogans serovar lai str. 56601
uuuauauauauuu

SEQ ID NO: 754093 - RNA, 17 nt, Leptospira interrogans serovar lai str. 56601
uuuauauagaaccaucu

SEQ ID NO: 754094 - RNA, 14 nt, Leptospira interrogans serovar lai str. 56601
uuuaucagaugugu

SEQ ID NO: 754095 - RNA, 13 nt, Leptospira interrogans serovar lai str. 56601
uuuaucaaauaaa

SEQ ID NO: 754096 - RNA, 17 nt, Leptospira interrogans serovar lai str. 56601
uuuaucaaauaaaguuu

SEQ ID NO: 754097 - RNA, 12 nt, Leptospira interrogans serovar lai str. 56601
uuuacucaaaga

SEQ ID NO: 754098 - RNA, 16 nt, Leptospira interrogans serovar lai str. 56601
uuuacuaaaaaacaua

SEQ ID NO: 754099 - RNA, 22 nt, Leptospira interrogans serovar lai str. 56601
uuuacuacccgacguauaaaaa

SEQ ID NO: 754100 - RNA, 22 nt, Leptospira interrogans serovar lai str. 56601
uuuacuauaaacauauuauuuu

SEQ ID NO: 754101 - RNA, 19 nt, Leptospira interrogans serovar lai str. 56601
uuuacuacgucuucuaaau

SEQ ID NO: 754102 - RNA, 16 nt, Leptospira interrogans serovar lai str. 56601
uuuacugaguuucaaa

SEQ ID NO: 754103 - RNA, 17 nt, Leptospira interrogans serovar lai str. 56601
uuuacucgauaauucuu

SEQ ID NO: 754104 - RNA, 15 nt, Leptospira interrogans serovar lai str. 56601
uuuacucuuauaaaa

SEQ ID NO: 754105 - RNA, 18 nt, Leptospira interrogans serovar lai str. 56601
uuuacucuuauaaaauuu

SEQ ID NO: 754106 - RNA, 15 nt, Leptospira interrogans serovar lai str. 56601
uuuacucuuauuuau

SEQ ID NO: 754107 - RNA, 21 nt, Leptospira interrogans serovar lai str. 56601
uuuacucuauccauauacgua

SEQ ID NO: 754108 - RNA, 15 nt, Leptospira interrogans serovar lai str. 56601
uuuacuuuaaaauuu

SEQ ID NO: 754109 - RNA, 16 nt, Leptospira interrogans serovar lai str. 56601
uuuacuuuaaaauuug

SEQ ID NO: 754110 - RNA, 13 nt, Leptospira interrogans serovar lai str. 56601
uuuacuuuuucca

SEQ ID NO: 754111 - RNA, 11 nt, Leptospira interrogans serovar lai str. 56601
uuuagaaaaag

SEQ ID NO: 754112 - RNA, 15 nt, Leptospira interrogans serovar lai str. 56601
uuuagaaaaaauuuu

SEQ ID NO: 754113 - RNA, 14 nt, Leptospira interrogans serovar lai str. 56601
uuuagaaaaagcac

SEQ ID NO: 754114 - RNA, 15 nt, Leptospira interrogans serovar lai str. 56601
uuuacuugaaaauaa

SEQ ID NO: 754115 - RNA, 13 nt, Leptospira interrogans serovar lai str. 56601
uuuacuugcaaaa

SEQ ID NO: 754116 - RNA, 22 nt, Leptospira interrogans serovar lai str. 56601
uuuacuucauccgggcuuuucu

SEQ ID NO: 754117 - RNA, 20 nt, Leptospira interrogans serovar lai str. 56601
uuuacugcuugacaucuuuu

SEQ ID NO: 754118 - RNA, 12 nt, Leptospira interrogans serovar lai str. 56601
uuuacguaaauu

SEQ ID NO: 754119 - RNA, 16 nt, Leptospira interrogans serovar lai str. 56601
uuuacgugauaauucu

SEQ ID NO: 754120 - RNA, 14 nt, Leptospira interrogans serovar lai str. 56601
uuuacgauuaaauu

SEQ ID NO: 754121 - RNA, 14 nt, Leptospira interrogans serovar lai str. 56601
uuuacgauucaauu

SEQ ID NO: 754122 - RNA, 13 nt, Leptospira interrogans serovar lai str. 56601
uuuacgauucuaa

SEQ ID NO: 754123 - RNA, 16 nt, Leptospira interrogans serovar lai str. 56601
uuuacauaagaccaua

SEQ ID NO: 754124 - RNA, 16 nt, Leptospira interrogans serovar lai str. 56601
uuuacauaauaauaca

SEQ ID NO: 754125 - RNA, 22 nt, Leptospira interrogans serovar lai str. 56601
uuuacgaacacauucuaaaauu

SEQ ID NO: 754126 - RNA, 20 nt, Leptospira interrogans serovar lai str. 56601
uuuacgaacgaauucuaaaa

SEQ ID NO: 754127 - RNA, 16 nt, Leptospira interrogans serovar lai str. 56601
uuuacaucaaaaacaa

SEQ ID NO: 754128 - RNA, 21 nt, Leptospira interrogans serovar lai str. 56601
uuuacaucaacucuguaaauu

SEQ ID NO: 754129 - RNA, 23 nt, Leptospira interrogans serovar lai str. 56601
uuuacaucaacucuguaaauuca

SEQ ID NO: 754130 - RNA, 20 nt, Leptospira interrogans serovar lai str. 56601
uuuacacgauaauuuucuuu

SEQ ID NO: 754131 - RNA, 23 nt, Leptospira interrogans serovar lai str. 56601
uuuacacgaucauucuuuagaaa

SEQ ID NO: 754132 - RNA, 15 nt, Leptospira interrogans serovar lai str. 56601
uuuacagauuuauuu

SEQ ID NO: 754133 - RNA, 13 nt, Leptospira interrogans serovar lai str. 56601
uuuacagaaaaau

SEQ ID NO: 754134 - RNA, 15 nt, Leptospira interrogans serovar lai str. 56601
uuuacagaaaaauca

SEQ ID NO: 754135 - RNA, 16 nt, Leptospira interrogans serovar lai str. 56601
uuuacagaaaaaucag

SEQ ID NO: 754136 - RNA, 12 nt, Leptospira interrogans serovar lai str. 56601
uuuacaguaaaa

SEQ ID NO: 754137 - RNA, 17 nt, Leptospira interrogans serovar lai str. 56601
uuuacaguaaaaucuaa

SEQ ID NO: 754138 - RNA, 22 nt, Leptospira interrogans serovar lai str. 56601
uuuacaguaaaaucuaaauuug

SEQ ID NO: 754139 - RNA, 23 nt, Leptospira interrogans serovar lai str. 56601
uuuacagccaccaucaaaauuua

SEQ ID NO: 754140 - RNA, 13 nt, Leptospira interrogans serovar lai str. 56601
uuuagcguaaauu

SEQ ID NO: 754141 - RNA, 15 nt, Leptospira interrogans serovar lai str. 56601
uuuaggauuuuauga

SEQ ID NO: 754142 - RNA, 19 nt, Leptospira interrogans serovar lai str. 56601
uuuaggauuuuuggaauaa

SEQ ID NO: 754143 - RNA, 14 nt, Leptospira interrogans serovar lai str. 56601
uuuaggaguucuaa

SEQ ID NO: 754144 - RNA, 14 nt, Leptospira interrogans serovar lai str. 56601
uuuaguaaaauuua

SEQ ID NO: 754145 - RNA, 15 nt, Leptospira interrogans serovar lai str. 56601
uuuaguaaaauuuaa

SEQ ID NO: 754146 - RNA, 17 nt, Leptospira interrogans serovar lai str. 56601
uuuagguaauagaaaac

SEQ ID NO: 754147 - RNA, 15 nt, Leptospira interrogans serovar lai str. 56601
uuuagguauuucuaa

SEQ ID NO: 754148 - RNA, 17 nt, Leptospira interrogans serovar lai str. 56601
uuuaguaaacuacuaaa

SEQ ID NO: 754149 - RNA, 22 nt, Leptospira interrogans serovar lai str. 56601
uuuaguauaaucaaauacaaaa

SEQ ID NO: 754150 - RNA, 13 nt, Leptospira interrogans serovar lai str. 56601
uuuaguuguuccu

SEQ ID NO: 754151 - RNA, 22 nt, Leptospira interrogans serovar lai str. 56601
uuuauaaaaaccugauuuuucc

SEQ ID NO: 754152 - RNA, 14 nt, Leptospira interrogans serovar lai str. 56601
uuuauaaaaaguuu

SEQ ID NO: 754153 - RNA, 15 nt, Leptospira interrogans serovar lai str. 56601
uuuauaaaacaaucu

SEQ ID NO: 754154 - RNA, 15 nt, Leptospira interrogans serovar lai str. 56601
uuuaguuguacaaaa

SEQ ID NO: 754155 - RNA, 16 nt, Leptospira interrogans serovar lai str. 56601
uuuaguucaaaaacau

SEQ ID NO: 754156 - RNA, 21 nt, Leptospira interrogans serovar lai str. 56601
uuuagaacagaaugucuuaga

SEQ ID NO: 754157 - RNA, 17 nt, Leptospira interrogans serovar lai str. 56601
uuuagaagaaggucuca

SEQ ID NO: 754158 - RNA, 16 nt, Leptospira interrogans serovar lai str. 56601
uuuagaauaaaauuug

SEQ ID NO: 754159 - RNA, 20 nt, Leptospira interrogans serovar lai str. 56601
uuuagaauaucuuaauauaa

SEQ ID NO: 754160 - RNA, 13 nt, Leptospira interrogans serovar lai str. 56601
uuuagaaaauuuu

SEQ ID NO: 754161 - RNA, 21 nt, Leptospira interrogans serovar lai str. 56601
uuuagaaaagacuuuuuaugg

SEQ ID NO: 754162 - RNA, 20 nt, Leptospira interrogans serovar lai str. 56601
uuuagaaaauaauaauauuu

SEQ ID NO: 754163 - RNA, 20 nt, Leptospira interrogans serovar lai str. 56601
uuuagaaaucaauucuucuu

SEQ ID NO: 754164 - RNA, 22 nt, Leptospira interrogans serovar lai str. 56601
uuuagaaaucaauucuucuuuc

SEQ ID NO: 754165 - RNA, 13 nt, Leptospira interrogans serovar lai str. 56601
uuuagaaauuucu

SEQ ID NO: 754166 - RNA, 15 nt, Leptospira interrogans serovar lai str. 56601
uuuagaaauuucuaa

SEQ ID NO: 754167 - RNA, 20 nt, Leptospira interrogans serovar lai str. 56601
uuuagaaauuucuaauaaaa

SEQ ID NO: 754168 - RNA, 15 nt, Leptospira interrogans serovar lai str. 56601
uuuagaaauuuuuaa

SEQ ID NO: 754169 - RNA, 17 nt, Leptospira interrogans serovar lai str. 56601
uuuagaauuuuucgaaa

SEQ ID NO: 754170 - RNA, 22 nt, Leptospira interrogans serovar lai str. 56601
uuuagaauuuuucgaaacaaaa

SEQ ID NO: 754171 - RNA, 16 nt, Leptospira interrogans serovar lai str. 56601
uuuagacaaaaauacu

SEQ ID NO: 754172 - RNA, 14 nt, Leptospira interrogans serovar lai str. 56601
uuuagagugaauuu

SEQ ID NO: 754173 - RNA, 15 nt, Leptospira interrogans serovar lai str. 56601
uuuagaguuaagaga

SEQ ID NO: 754174 - RNA, 19 nt, Leptospira interrogans serovar lai str. 56601
uuuagaguucguuaagaau

SEQ ID NO: 754175 - RNA, 20 nt, Leptospira interrogans serovar lai str. 56601
uuuagagcaguucaauuuuu

SEQ ID NO: 754176 - RNA, 22 nt, Leptospira interrogans serovar lai str. 56601
uuuagauaagagacaaauauuu

SEQ ID NO: 754177 - RNA, 14 nt, Leptospira interrogans serovar lai str. 56601
uuuagauuucgaaa

SEQ ID NO: 754178 - RNA, 13 nt, Leptospira interrogans serovar lai str. 56601
uuuagauucuaaa

SEQ ID NO: 754179 - RNA, 15 nt, Leptospira interrogans serovar lai str. 56601
uuuagauucuaaaaa

SEQ ID NO: 754180 - RNA, 16 nt, Leptospira interrogans serovar lai str. 56601
uuuagauucuaaaaaa

SEQ ID NO: 754181 - RNA, 18 nt, Leptospira interrogans serovar lai str. 56601
uuuagauaauuauucuca

SEQ ID NO: 754182 - RNA, 15 nt, Leptospira interrogans serovar lai str. 56601
uuuagaucuaaauuu

SEQ ID NO: 754183 - RNA, 14 nt, Leptospira interrogans serovar lai str. 56601
uuuagcaauuugug

SEQ ID NO: 754184 - RNA, 23 nt, Leptospira interrogans serovar lai str. 56601
uuucaucaggaccaaaucuuuca

SEQ ID NO: 754185 - RNA, 20 nt, Leptospira interrogans serovar lai str. 56601
uuucauccaugucuucuaaa

SEQ ID NO: 754186 - RNA, 21 nt, Leptospira interrogans serovar lai str. 56601
uuucauccaugucuucuaaau

SEQ ID NO: 754187 - RNA, 22 nt, Leptospira interrogans serovar lai str. 56601
uuucauccaugucuucuaaauc

SEQ ID NO: 754188 - RNA, 15 nt, Leptospira interrogans serovar lai str. 56601
uuucauaucuaaaau

SEQ ID NO: 754189 - RNA, 15 nt, Leptospira interrogans serovar lai str. 56601
uuucaugaaauagug

SEQ ID NO: 754190 - RNA, 16 nt, Leptospira interrogans serovar lai str. 56601
uuucaugaacgaauuu

SEQ ID NO: 754191 - RNA, 23 nt, Leptospira interrogans serovar lai str. 56601
uuucaucuguggagaaaauuccu

SEQ ID NO: 754192 - RNA, 16 nt, Leptospira interrogans serovar lai str. 56601
uuucaugcaaaaauuu

SEQ ID NO: 754193 - RNA, 20 nt, Leptospira interrogans serovar lai str. 56601
uuucaugcaaaaauuuaauu

SEQ ID NO: 754194 - RNA, 21 nt, Leptospira interrogans serovar lai str. 56601
uuucaugaauuaaagaagagc

SEQ ID NO: 754195 - RNA, 20 nt, Leptospira interrogans serovar lai str. 56601
uuuccaccggaguaaggcaa

SEQ ID NO: 754196 - RNA, 23 nt, Leptospira interrogans serovar lai str. 56601
uuuccaccggaguaaggcaaacu

SEQ ID NO: 754197 - RNA, 21 nt, Leptospira interrogans serovar lai str. 56601
uuuccaaacucaaugcugcuc

SEQ ID NO: 754198 - RNA, 13 nt, Leptospira interrogans serovar lai str. 56601
uuuccaaaaauuu

SEQ ID NO: 754199 - RNA, 13 nt, Leptospira interrogans serovar lai str. 56601
uuucauuuuguuu

SEQ ID NO: 754200 - RNA, 21 nt, Leptospira interrogans serovar lai str. 56601
uuucauucaaaauaaauaaua

SEQ ID NO: 754201 - RNA, 13 nt, Leptospira interrogans serovar lai str. 56601
uuucauugaguuu

SEQ ID NO: 754202 - RNA, 20 nt, Leptospira interrogans serovar lai str. 56601
uuucagacugacugaaaaaa

SEQ ID NO: 754203 - RNA, 13 nt, Leptospira interrogans serovar lai str. 56601
uuucagauuuuau

SEQ ID NO: 754204 - RNA, 16 nt, Leptospira interrogans serovar lai str. 56601
uuucagcuccaaaaaa

SEQ ID NO: 754205 - RNA, 22 nt, Leptospira interrogans serovar lai str. 56601
uuucauaguucaauuaacaaaa

SEQ ID NO: 754206 - RNA, 23 nt, Leptospira interrogans serovar lai str. 56601
uuucauaauaaauuuuucuggaa

SEQ ID NO: 754207 - RNA, 17 nt, Leptospira interrogans serovar lai str. 56601
uuucauaaauacaaagu

SEQ ID NO: 754208 - RNA, 18 nt, Leptospira interrogans serovar lai str. 56601
uuucauaaauacaaagua

SEQ ID NO: 754209 - RNA, 18 nt, Leptospira interrogans serovar lai str. 56601
uuucagugaauaaaauaa

SEQ ID NO: 754210 - RNA, 14 nt, Leptospira interrogans serovar lai str. 56601
uuucaguucugaga

SEQ ID NO: 754211 - RNA, 16 nt, Leptospira interrogans serovar lai str. 56601
uuuauuucaaaauuua

SEQ ID NO: 754212 - RNA, 22 nt, Leptospira interrogans serovar lai str. 56601
uuuauuucggaucgaaaaugca

SEQ ID NO: 754213 - RNA, 14 nt, Leptospira interrogans serovar lai str. 56601
uuuauuuaauaaaa

SEQ ID NO: 754214 - RNA, 20 nt, Leptospira interrogans serovar lai str. 56601
uuuauugaagauauuuuccu

SEQ ID NO: 754215 - RNA, 17 nt, Leptospira interrogans serovar lai str. 56601
uuuauugaaaaauagaa

SEQ ID NO: 754216 - RNA, 20 nt, Leptospira interrogans serovar lai str. 56601
uuuauucacugaaaauuuaa

SEQ ID NO: 754217 - RNA, 16 nt, Leptospira interrogans serovar lai str. 56601
uuuauucuaaacaaaa

SEQ ID NO: 754218 - RNA, 15 nt, Leptospira interrogans serovar lai str. 56601
uuuauuauaaauuua

SEQ ID NO: 754219 - RNA, 12 nt, Leptospira interrogans serovar lai str. 56601
uuucaaacguuc

SEQ ID NO: 754220 - RNA, 22 nt, Leptospira interrogans serovar lai str. 56601
uuucaaacugagauuugucuca

SEQ ID NO: 754221 - RNA, 21 nt, Leptospira interrogans serovar lai str. 56601
uuucaaagaauauaaaaucuu

SEQ ID NO: 754222 - RNA, 22 nt, Leptospira interrogans serovar lai str. 56601
uuucaaaaucggaauuuuaauu

SEQ ID NO: 754223 - RNA, 17 nt, Leptospira interrogans serovar lai str. 56601
uuucaaaaguuagaaua

SEQ ID NO: 754224 - RNA, 17 nt, Leptospira interrogans serovar lai str. 56601
uuucaaaauaagaauuu

SEQ ID NO: 754225 - RNA, 19 nt, Leptospira interrogans serovar lai str. 56601
uuucaaaauaagaauuuuc

SEQ ID NO: 754226 - RNA, 17 nt, Leptospira interrogans serovar lai str. 56601
uuucaaagcuauaguuu

SEQ ID NO: 754227 - RNA, 12 nt, Leptospira interrogans serovar lai str. 56601
uuucaaaaauuu

SEQ ID NO: 754228 - RNA, 13 nt, Leptospira interrogans serovar lai str. 56601
uuucaaaaaugua

SEQ ID NO: 754229 - RNA, 20 nt, Leptospira interrogans serovar lai str. 56601
uuucaaaaauuccaauaaca

SEQ ID NO: 754230 - RNA, 13 nt, Leptospira interrogans serovar lai str. 56601
uuuauuuuucuaa

SEQ ID NO: 754231 - RNA, 14 nt, Leptospira interrogans serovar lai str. 56601
uuuauuuuucuaaa

SEQ ID NO: 754232 - RNA, 12 nt, Leptospira interrogans serovar lai str. 56601
uuucaaaaaacu

SEQ ID NO: 754233 - RNA, 20 nt, Leptospira interrogans serovar lai str. 56601
uuucaaaaaacuuucuuaaa

SEQ ID NO: 754234 - RNA, 22 nt, Leptospira interrogans serovar lai str. 56601
uuuauuuuaaaaaaauuuuuau

SEQ ID NO: 754235 - RNA, 17 nt, Leptospira interrogans serovar lai str. 56601
uuuauuucugagaguaa

SEQ ID NO: 754236 - RNA, 13 nt, Leptospira interrogans serovar lai str. 56601
uuucaagauuguc

SEQ ID NO: 754237 - RNA, 15 nt, Leptospira interrogans serovar lai str. 56601
uuucaagauugucuu

SEQ ID NO: 754238 - RNA, 16 nt, Leptospira interrogans serovar lai str. 56601
uuucaagaauuuauuu

SEQ ID NO: 754239 - RNA, 22 nt, Leptospira interrogans serovar lai str. 56601
uuucaagacaacagaacaaaau

SEQ ID NO: 754240 - RNA, 12 nt, Leptospira interrogans serovar lai str. 56601
uuucaacuuuuu

SEQ ID NO: 754241 - RNA, 20 nt, Leptospira interrogans serovar lai str. 56601
uuucaacuuuuuucagaaaa

SEQ ID NO: 754242 - RNA, 17 nt, Leptospira interrogans serovar lai str. 56601
uuucaaguguucuacgg

SEQ ID NO: 754243 - RNA, 14 nt, Leptospira interrogans serovar lai str. 56601
uuucaaguuuucuu

SEQ ID NO: 754244 - RNA, 18 nt, Leptospira interrogans serovar lai str. 56601
uuucaaucuauuaacuuu

SEQ ID NO: 754245 - RNA, 17 nt, Leptospira interrogans serovar lai str. 56601
uuucaaugcaaaaaauu

SEQ ID NO: 754246 - RNA, 21 nt, Leptospira interrogans serovar lai str. 56601
uuucaaucgaagaaauacacg

SEQ ID NO: 754247 - RNA, 22 nt, Leptospira interrogans serovar lai str. 56601
uuucacgaacacaaauucuaaa

SEQ ID NO: 754248 - RNA, 17 nt, Leptospira interrogans serovar lai str. 56601
uuucaauuuucucaaaa

SEQ ID NO: 754249 - RNA, 19 nt, Leptospira interrogans serovar lai str. 56601
uuucaauuuucucaaaaaa

SEQ ID NO: 754250 - RNA, 13 nt, Leptospira interrogans serovar lai str. 56601
uuucaauuuuuau

SEQ ID NO: 754251 - RNA, 18 nt, Leptospira interrogans serovar lai str. 56601
uuucacagaaacccucuc

SEQ ID NO: 754252 - RNA, 14 nt, Leptospira interrogans serovar lai str. 56601
uuugccauuuuuuu

SEQ ID NO: 754253 - RNA, 22 nt, Leptospira interrogans serovar lai str. 56601
uuugccauuuuuuucuccuuuu

SEQ ID NO: 754254 - RNA, 18 nt, Leptospira interrogans serovar lai str. 56601
uuugcccagaguuuguug

SEQ ID NO: 754255 - RNA, 17 nt, Leptospira interrogans serovar lai str. 56601
uuugccuuguucauaaa

SEQ ID NO: 754256 - RNA, 14 nt, Leptospira interrogans serovar lai str. 56601
uuugcgaaaaaaau

SEQ ID NO: 754257 - RNA, 21 nt, Leptospira interrogans serovar lai str. 56601
uuugcacguaaacauucaagg

SEQ ID NO: 754258 - RNA, 14 nt, Leptospira interrogans serovar lai str. 56601
uuugcacugaaaua

SEQ ID NO: 754259 - RNA, 18 nt, Leptospira interrogans serovar lai str. 56601
uuugcagaaguauuccau

SEQ ID NO: 754260 - RNA, 20 nt, Leptospira interrogans serovar lai str. 56601
uuugcaaguaaaaagacuca

SEQ ID NO: 754261 - RNA, 18 nt, Leptospira interrogans serovar lai str. 56601
uuugcaauuaaaacgaua

SEQ ID NO: 754262 - RNA, 17 nt, Leptospira interrogans serovar lai str. 56601
uuugauccguuuuaaaa

SEQ ID NO: 754263 - RNA, 13 nt, Leptospira interrogans serovar lai str. 56601
uuugauuaaaaau

SEQ ID NO: 754264 - RNA, 12 nt, Leptospira interrogans serovar lai str. 56601
uuugcaaaaaaa

SEQ ID NO: 754265 - RNA, 13 nt, Leptospira interrogans serovar lai str. 56601
uuugcaaaaaaaa

SEQ ID NO: 754266 - RNA, 17 nt, Leptospira interrogans serovar lai str. 56601
uuugcaaaaaaaauacg

SEQ ID NO: 754267 - RNA, 15 nt, Leptospira interrogans serovar lai str. 56601
uuugcaaaaaaauaa

SEQ ID NO: 754268 - RNA, 13 nt, Leptospira interrogans serovar lai str. 56601
uuugauuagaaaa

SEQ ID NO: 754269 - RNA, 17 nt, Leptospira interrogans serovar lai str. 56601
uuugauuccaagauuuu

SEQ ID NO: 754270 - RNA, 20 nt, Leptospira interrogans serovar lai str. 56601
uuugauuccuuuuucuaauc

SEQ ID NO: 754271 - RNA, 22 nt, Leptospira interrogans serovar lai str. 56601
uuugauucggauuucugaaaaa

SEQ ID NO: 754272 - RNA, 21 nt, Leptospira interrogans serovar lai str. 56601
uuugauuacaaagcacuguuu

SEQ ID NO: 754273 - RNA, 12 nt, Leptospira interrogans serovar lai str. 56601
uuugauugaauu

SEQ ID NO: 754274 - RNA, 14 nt, Leptospira interrogans serovar lai str. 56601
uuugauaaaauaua

SEQ ID NO: 754275 - RNA, 20 nt, Leptospira interrogans serovar lai str. 56601
uuugaguagaagccaaugug

SEQ ID NO: 754276 - RNA, 17 nt, Leptospira interrogans serovar lai str. 56601
uuugaggucccacaauc

SEQ ID NO: 754277 - RNA, 13 nt, Leptospira interrogans serovar lai str. 56601
uuugauaaagaau

SEQ ID NO: 754278 - RNA, 21 nt, Leptospira interrogans serovar lai str. 56601
uuugauauaaucuuaauauuu

SEQ ID NO: 754279 - RNA, 23 nt, Leptospira interrogans serovar lai str. 56601
uuugauauacugguuuuggagac

SEQ ID NO: 754280 - RNA, 21 nt, Leptospira interrogans serovar lai str. 56601
uuugauauauuagaauauaca

SEQ ID NO: 754281 - RNA, 15 nt, Leptospira interrogans serovar lai str. 56601
uuugagaugugggaa

SEQ ID NO: 754282 - RNA, 22 nt, Leptospira interrogans serovar lai str. 56601
uuugagaugugggaacuaccac

SEQ ID NO: 754283 - RNA, 20 nt, Leptospira interrogans serovar lai str. 56601
uuugagagagcguucugcua

SEQ ID NO: 754284 - RNA, 14 nt, Leptospira interrogans serovar lai str. 56601
uuugagacaagaag

SEQ ID NO: 754285 - RNA, 22 nt, Leptospira interrogans serovar lai str. 56601
uuugagacaagaagaaaagaau

SEQ ID NO: 754286 - RNA, 19 nt, Leptospira interrogans serovar lai str. 56601
uuugagacagguucugaua

SEQ ID NO: 754287 - RNA, 21 nt, Leptospira interrogans serovar lai str. 56601
uuugagaagcggguuuuucuu

SEQ ID NO: 754288 - RNA, 18 nt, Leptospira interrogans serovar lai str. 56601
uuugagaaucuucauuuu

SEQ ID NO: 754289 - RNA, 14 nt, Leptospira interrogans serovar lai str. 56601
uuugagaaacuucg

SEQ ID NO: 754290 - RNA, 23 nt, Leptospira interrogans serovar lai str. 56601
uuugagaaaagagauuucugaga

SEQ ID NO: 754291 - RNA, 14 nt, Leptospira interrogans serovar lai str. 56601
uuugagaaaaucca

SEQ ID NO: 754292 - RNA, 17 nt, Leptospira interrogans serovar lai str. 56601
uuugagaaaauccaguc

SEQ ID NO: 754293 - RNA, 21 nt, Leptospira interrogans serovar lai str. 56601
uuugagaaaccuuuucuagac

SEQ ID NO: 754294 - RNA, 17 nt, Leptospira interrogans serovar lai str. 56601
uuugagcaguaaaaaag

SEQ ID NO: 754295 - RNA, 23 nt, Leptospira interrogans serovar lai str. 56601
uuugagagccuuuuuauuucuaa

SEQ ID NO: 754296 - RNA, 19 nt, Leptospira interrogans serovar lai str. 56601
uuucuugaacucaauguug

SEQ ID NO: 754297 - RNA, 20 nt, Leptospira interrogans serovar lai str. 56601
uuucuugagggguuuuuccu

SEQ ID NO: 754298 - RNA, 22 nt, Leptospira interrogans serovar lai str. 56601
uuucuugagggguuuuuccuuu

SEQ ID NO: 754299 - RNA, 14 nt, Leptospira interrogans serovar lai str. 56601
uuucuugugucaag

SEQ ID NO: 754300 - RNA, 13 nt, Leptospira interrogans serovar lai str. 56601
uuucuuuaaaauc

SEQ ID NO: 754301 - RNA, 13 nt, Leptospira interrogans serovar lai str. 56601
uuucuuccggaug

SEQ ID NO: 754302 - RNA, 14 nt, Leptospira interrogans serovar lai str. 56601
uuucuucauaaaau

SEQ ID NO: 754303 - RNA, 20 nt, Leptospira interrogans serovar lai str. 56601
uuucuucggauucacaaacg

SEQ ID NO: 754304 - RNA, 15 nt, Leptospira interrogans serovar lai str. 56601
uuucuucuauuucuu

SEQ ID NO: 754305 - RNA, 12 nt, Leptospira interrogans serovar lai str. 56601
uuucuucugcug

SEQ ID NO: 754306 - RNA, 13 nt, Leptospira interrogans serovar lai str. 56601
uuucuucugcugc

SEQ ID NO: 754307 - RNA, 22 nt, Leptospira interrogans serovar lai str. 56601
uuucuucugguugaaagaaucu

SEQ ID NO: 754308 - RNA, 13 nt, Leptospira interrogans serovar lai str. 56601
uuucuuaaaucuu

SEQ ID NO: 754309 - RNA, 16 nt, Leptospira interrogans serovar lai str. 56601
uuucuuaaauucuaaa

SEQ ID NO: 754310 - RNA, 19 nt, Leptospira interrogans serovar lai str. 56601
uuucuuaaauucuaaaaaa

SEQ ID NO: 754311 - RNA, 12 nt, Leptospira interrogans serovar lai str. 56601
uuucuuaaaaag

SEQ ID NO: 754312 - RNA, 12 nt, Leptospira interrogans serovar lai str. 56601
uuucuuaaaaga

SEQ ID NO: 754313 - RNA, 13 nt, Leptospira interrogans serovar lai str. 56601
uuucuuaauuucu

SEQ ID NO: 754314 - RNA, 18 nt, Leptospira interrogans serovar lai str. 56601
uuucuuacaccgaauuca

SEQ ID NO: 754315 - RNA, 20 nt, Leptospira interrogans serovar lai str. 56601
uuucuuauaaccuaucacaa

SEQ ID NO: 754316 - RNA, 17 nt, Leptospira interrogans serovar lai str. 56601
uuucuguuucaugaaau

SEQ ID NO: 754317 - RNA, 22 nt, Leptospira interrogans serovar lai str. 56601
uuucuguucauucuuuaaaaua

SEQ ID NO: 754318 - RNA, 13 nt, Leptospira interrogans serovar lai str. 56601
uuucuguauuuuu

SEQ ID NO: 754319 - RNA, 12 nt, Leptospira interrogans serovar lai str. 56601
uuucuguauuuu

SEQ ID NO: 754320 - RNA, 20 nt, Leptospira interrogans serovar lai str. 56601
uuugaccugccuuucuuauu

SEQ ID NO: 754321 - RNA, 17 nt, Leptospira interrogans serovar lai str. 56601
uuugaauuuuuaagaau

SEQ ID NO: 754322 - RNA, 13 nt, Leptospira interrogans serovar lai str. 56601
uuugaauuucuuu

SEQ ID NO: 754323 - RNA, 19 nt, Leptospira interrogans serovar lai str. 56601
uuugaauuuuacuaaaaau

SEQ ID NO: 754324 - RNA, 17 nt, Leptospira interrogans serovar lai str. 56601
uuugacaauuugugaac

SEQ ID NO: 754325 - RNA, 23 nt, Leptospira interrogans serovar lai str. 56601
uuugaauuuaggaaauuuucaau

SEQ ID NO: 754326 - RNA, 17 nt, Leptospira interrogans serovar lai str. 56601
uuugaaugacacaaaaa

SEQ ID NO: 754327 - RNA, 20 nt, Leptospira interrogans serovar lai str. 56601
uuugaaugacacaaaaaacu

SEQ ID NO: 754328 - RNA, 22 nt, Leptospira interrogans serovar lai str. 56601
uuugaauaaaaccgcugaaaaa

SEQ ID NO: 754329 - RNA, 14 nt, Leptospira interrogans serovar lai str. 56601
uuugaauccaaaag

SEQ ID NO: 754330 - RNA, 19 nt, Leptospira interrogans serovar lai str. 56601
uuugaaaugcaguuucuuc

SEQ ID NO: 754331 - RNA, 18 nt, Leptospira interrogans serovar lai str. 56601
uuugaacaaguucuaaau

SEQ ID NO: 754332 - RNA, 18 nt, Leptospira interrogans serovar lai str. 56601
uuugaaacuauccaaaag

SEQ ID NO: 754333 - RNA, 18 nt, Leptospira interrogans serovar lai str. 56601
uuugaaaguaaaaaagag

SEQ ID NO: 754334 - RNA, 16 nt, Leptospira interrogans serovar lai str. 56601
uuugaaaguucccaaa

SEQ ID NO: 754335 - RNA, 17 nt, Leptospira interrogans serovar lai str. 56601
uuugaaaguucccaaau

SEQ ID NO: 754336 - RNA, 21 nt, Leptospira interrogans serovar lai str. 56601
uuugaaaauccauaugaguuc

SEQ ID NO: 754337 - RNA, 13 nt, Leptospira interrogans serovar lai str. 56601
uuucuuugaaaaa

SEQ ID NO: 754338 - RNA, 20 nt, Leptospira interrogans serovar lai str. 56601
uuucuuugaaggaucuuaga

SEQ ID NO: 754339 - RNA, 17 nt, Leptospira interrogans serovar lai str. 56601
uuugaaaauugugggaa

SEQ ID NO: 754340 - RNA, 21 nt, Leptospira interrogans serovar lai str. 56601
uuugaaacaucacuuccauuu

SEQ ID NO: 754341 - RNA, 12 nt, Leptospira interrogans serovar lai str. 56601
uuucuuuuuaaa

SEQ ID NO: 754342 - RNA, 13 nt, Leptospira interrogans serovar lai str. 56601
uuugaaaaagaau

SEQ ID NO: 754343 - RNA, 14 nt, Leptospira interrogans serovar lai str. 56601
uuuccagaucauuu

SEQ ID NO: 754344 - RNA, 18 nt, Leptospira interrogans serovar lai str. 56601
uuuccacuacaaucacuu

SEQ ID NO: 754345 - RNA, 15 nt, Leptospira interrogans serovar lai str. 56601
uuuccacucuuugac

SEQ ID NO: 754346 - RNA, 14 nt, Leptospira interrogans serovar lai str. 56601
uuuccagaaaccau

SEQ ID NO: 754347 - RNA, 17 nt, Leptospira interrogans serovar lai str. 56601
uuuccagaaaccauaaa

SEQ ID NO: 754348 - RNA, 20 nt, Leptospira interrogans serovar lai str. 56601
uuuccagaaaccauaaaaua

SEQ ID NO: 754349 - RNA, 21 nt, Leptospira interrogans serovar lai str. 56601
uuuccagaaaccauaaaauaa

SEQ ID NO: 754350 - RNA, 18 nt, Leptospira interrogans serovar lai str. 56601
uuuccaucuuuauaucuu

SEQ ID NO: 754351 - RNA, 13 nt, Leptospira interrogans serovar lai str. 56601
uuuccaugaaaua

SEQ ID NO: 754352 - RNA, 14 nt, Leptospira interrogans serovar lai str. 56601
uuuccaugaaauag

SEQ ID NO: 754353 - RNA, 16 nt, Leptospira interrogans serovar lai str. 56601
uuuccauaaaaaacau

SEQ ID NO: 754354 - RNA, 15 nt, Leptospira interrogans serovar lai str. 56601
uuuccauaaaauaga

SEQ ID NO: 754355 - RNA, 18 nt, Leptospira interrogans serovar lai str. 56601
uuuccccguuuuacgauc

SEQ ID NO: 754356 - RNA, 13 nt, Leptospira interrogans serovar lai str. 56601
uuucccaaaauuu

SEQ ID NO: 754357 - RNA, 21 nt, Leptospira interrogans serovar lai str. 56601
uuucccaaacaggaaaauuua

SEQ ID NO: 754358 - RNA, 19 nt, Leptospira interrogans serovar lai str. 56601
uuucccaguucuuaaauaa

SEQ ID NO: 754359 - RNA, 19 nt, Leptospira interrogans serovar lai str. 56601
uuuccccaagacgucuaca

SEQ ID NO: 754360 - RNA, 16 nt, Leptospira interrogans serovar lai str. 56601
uuuccccccacccaaa

SEQ ID NO: 754361 - RNA, 16 nt, Leptospira interrogans serovar lai str. 56601
uuuccggaauacuuuu

SEQ ID NO: 754362 - RNA, 14 nt, Leptospira interrogans serovar lai str. 56601
uuuccggaauccga

SEQ ID NO: 754363 - RNA, 13 nt, Leptospira interrogans serovar lai str. 56601
uuuccggacuuuc

SEQ ID NO: 754364 - RNA, 17 nt, Leptospira interrogans serovar lai str. 56601
uuuccggacuuuccaga

SEQ ID NO: 754365 - RNA, 17 nt, Leptospira interrogans serovar lai str. 56601
uuuccgauuucuuucaa

SEQ ID NO: 754366 - RNA, 18 nt, Leptospira interrogans serovar lai str. 56601
uuuccgaaccuuaccacc

SEQ ID NO: 754367 - RNA, 20 nt, Leptospira interrogans serovar lai str. 56601
uuuccgaaccuuaccacccc

SEQ ID NO: 754368 - RNA, 15 nt, Leptospira interrogans serovar lai str. 56601
uuuccgauaaagaaa

SEQ ID NO: 754369 - RNA, 12 nt, Leptospira interrogans serovar lai str. 56601
uuuccuaaaauu

SEQ ID NO: 754370 - RNA, 21 nt, Leptospira interrogans serovar lai str. 56601
uuuccuaaaauugugggaacu

SEQ ID NO: 754371 - RNA, 21 nt, Leptospira interrogans serovar lai str. 56601
uuuccuaaaauuuugcaguaa

SEQ ID NO: 754372 - RNA, 19 nt, Leptospira interrogans serovar lai str. 56601
uuuccuaauauaucagauu

SEQ ID NO: 754373 - RNA, 21 nt, Leptospira interrogans serovar lai str. 56601
uuuccuaauauaucagauuga

SEQ ID NO: 754374 - RNA, 14 nt, Leptospira interrogans serovar lai str. 56601
uuuccguaccccaa

SEQ ID NO: 754375 - RNA, 18 nt, Leptospira interrogans serovar lai str. 56601
uuuccguagaucuuuuau

SEQ ID NO: 754376 - RNA, 17 nt, Leptospira interrogans serovar lai str. 56601
uuucgagugguucuaau

SEQ ID NO: 754377 - RNA, 23 nt, Leptospira interrogans serovar lai str. 56601
uuucgcauuuguuguaucgaacu

SEQ ID NO: 754378 - RNA, 22 nt, Leptospira interrogans serovar lai str. 56601
uuuccuuaagacccuaaaaaau

SEQ ID NO: 754379 - RNA, 15 nt, Leptospira interrogans serovar lai str. 56601
uuuccuucuuuacag

SEQ ID NO: 754380 - RNA, 21 nt, Leptospira interrogans serovar lai str. 56601
uuuccuucuuucugaaauaaa

SEQ ID NO: 754381 - RNA, 21 nt, Leptospira interrogans serovar lai str. 56601
uuuccuuuucgacuauuucuu

SEQ ID NO: 754382 - RNA, 13 nt, Leptospira interrogans serovar lai str. 56601
uuucgaaaacgau

SEQ ID NO: 754383 - RNA, 12 nt, Leptospira interrogans serovar lai str. 56601
uuucgaaaacuu

SEQ ID NO: 754384 - RNA, 13 nt, Leptospira interrogans serovar lai str. 56601
uuucgaaacaaaa

SEQ ID NO: 754385 - RNA, 16 nt, Leptospira interrogans serovar lai str. 56601
uuucgaauucuuucua

SEQ ID NO: 754386 - RNA, 14 nt, Leptospira interrogans serovar lai str. 56601
uuuccuuuccuuga

SEQ ID NO: 754387 - RNA, 15 nt, Leptospira interrogans serovar lai str. 56601
uuucuagauauuuca

SEQ ID NO: 754388 - RNA, 21 nt, Leptospira interrogans serovar lai str. 56601
uuucuagacuuucuuugaacu

SEQ ID NO: 754389 - RNA, 23 nt, Leptospira interrogans serovar lai str. 56601
uuucuagugucuaaacuaaaaaa

SEQ ID NO: 754390 - RNA, 17 nt, Leptospira interrogans serovar lai str. 56601
uuucuaggauuuuauau

SEQ ID NO: 754391 - RNA, 23 nt, Leptospira interrogans serovar lai str. 56601
uuucuacaauggaggauccuuuc

SEQ ID NO: 754392 - RNA, 14 nt, Leptospira interrogans serovar lai str. 56601
uuucuacaauuaua

SEQ ID NO: 754393 - RNA, 21 nt, Leptospira interrogans serovar lai str. 56601
uuucuaauaaaauaugaguuu

SEQ ID NO: 754394 - RNA, 17 nt, Leptospira interrogans serovar lai str. 56601
uuucuaaguccuuuucu

SEQ ID NO: 754395 - RNA, 22 nt, Leptospira interrogans serovar lai str. 56601
uuucuaauagagaaaaauuuuc

SEQ ID NO: 754396 - RNA, 17 nt, Leptospira interrogans serovar lai str. 56601
uuucuaauaguugaaau

SEQ ID NO: 754397 - RNA, 16 nt, Leptospira interrogans serovar lai str. 56601
uuucuaauauuaaaaa

SEQ ID NO: 754398 - RNA, 13 nt, Leptospira interrogans serovar lai str. 56601
uuucuaaaauaua

SEQ ID NO: 754399 - RNA, 15 nt, Leptospira interrogans serovar lai str. 56601
uuucuaaaugaguuu

SEQ ID NO: 754400 - RNA, 21 nt, Leptospira interrogans serovar lai str. 56601
uuucuaaaugaguuuuagaau

SEQ ID NO: 754401 - RNA, 18 nt, Leptospira interrogans serovar lai str. 56601
uuucuaaauugagaauuu

SEQ ID NO: 754402 - RNA, 13 nt, Leptospira interrogans serovar lai str. 56601
uuucuaaauugug

SEQ ID NO: 754403 - RNA, 21 nt, Leptospira interrogans serovar lai str. 56601
uuucuaaauugugagaacuac

SEQ ID NO: 754404 - RNA, 11 nt, Leptospira interrogans serovar lai str. 56601
uuucuaaaaug

SEQ ID NO: 754405 - RNA, 16 nt, Leptospira interrogans serovar lai str. 56601
uuucuaaaaaaaaugg

SEQ ID NO: 754406 - RNA, 17 nt, Leptospira interrogans serovar lai str. 56601
uuucuaaaaaaaaugua

SEQ ID NO: 754407 - RNA, 11 nt, Leptospira interrogans serovar lai str. 56601
uuucuaaaaua

SEQ ID NO: 754408 - RNA, 14 nt, Leptospira interrogans serovar lai str. 56601
uuucuaaaaauuuc

SEQ ID NO: 754409 - RNA, 15 nt, Leptospira interrogans serovar lai str. 56601
uuucuaaaaauuucc

SEQ ID NO: 754410 - RNA, 22 nt, Leptospira interrogans serovar lai str. 56601
uuucggcccggauauuuucuca

SEQ ID NO: 754411 - RNA, 22 nt, Leptospira interrogans serovar lai str. 56601
uuucggcuugauaccuaaugcu

SEQ ID NO: 754412 - RNA, 13 nt, Leptospira interrogans serovar lai str. 56601
uuucguucggaaa

SEQ ID NO: 754413 - RNA, 19 nt, Leptospira interrogans serovar lai str. 56601
uuucguucggaaaaaguau

SEQ ID NO: 754414 - RNA, 21 nt, Leptospira interrogans serovar lai str. 56601
uuucguucggaaaaaguauaa

SEQ ID NO: 754415 - RNA, 17 nt, Leptospira interrogans serovar lai str. 56601
uuucguuucccucuucu

SEQ ID NO: 754416 - RNA, 17 nt, Leptospira interrogans serovar lai str. 56601
uuucguuucgaaaauuu

SEQ ID NO: 754417 - RNA, 15 nt, Leptospira interrogans serovar lai str. 56601
uuucguuucugagga

SEQ ID NO: 754418 - RNA, 16 nt, Leptospira interrogans serovar lai str. 56601
uuucgugauaacaaac

SEQ ID NO: 754419 - RNA, 20 nt, Leptospira interrogans serovar lai str. 56601
uuucuauggaucgccguucu

SEQ ID NO: 754420 - RNA, 14 nt, Leptospira interrogans serovar lai str. 56601
uuucuaucaaaaaa

SEQ ID NO: 754421 - RNA, 19 nt, Leptospira interrogans serovar lai str. 56601
uuucuaucaaaaaauugca

SEQ ID NO: 754422 - RNA, 19 nt, Leptospira interrogans serovar lai str. 56601
uuucuaguuuuccuucuag

SEQ ID NO: 754423 - RNA, 16 nt, Leptospira interrogans serovar lai str. 56601
uuucuauaaaacaaaa

SEQ ID NO: 754424 - RNA, 14 nt, Leptospira interrogans serovar lai str. 56601
uuucuauaaaauug

SEQ ID NO: 754425 - RNA, 18 nt, Leptospira interrogans serovar lai str. 56601
uuucuauagggaucagug

SEQ ID NO: 754426 - RNA, 13 nt, Leptospira interrogans serovar lai str. 56601
uuucuauuuuaau

SEQ ID NO: 754427 - RNA, 19 nt, Leptospira interrogans serovar lai str. 56601
uuucucaucaaaaaaauga

SEQ ID NO: 754428 - RNA, 19 nt, Leptospira interrogans serovar lai str. 56601
uuucuccggcgaccuuucu

SEQ ID NO: 754429 - RNA, 22 nt, Leptospira interrogans serovar lai str. 56601
uuucuccggcgaccuuucuaaa

SEQ ID NO: 754430 - RNA, 20 nt, Leptospira interrogans serovar lai str. 56601
uuucucccuuaccuccuuuu

SEQ ID NO: 754431 - RNA, 13 nt, Leptospira interrogans serovar lai str. 56601
uuucucuucuaau

SEQ ID NO: 754432 - RNA, 12 nt, Leptospira interrogans serovar lai str. 56601
uuucugaaauaa

SEQ ID NO: 754433 - RNA, 20 nt, Leptospira interrogans serovar lai str. 56601
uuucugaaaaaaguuggaau

SEQ ID NO: 754434 - RNA, 14 nt, Leptospira interrogans serovar lai str. 56601
uuucugaaaaaguu

SEQ ID NO: 754435 - RNA, 14 nt, Leptospira interrogans serovar lai str. 56601
uuucugaaaaguuu

SEQ ID NO: 754436 - RNA, 21 nt, Leptospira interrogans serovar lai str. 56601
uuucugauaaagaaaaccuuu

SEQ ID NO: 754437 - RNA, 17 nt, Leptospira interrogans serovar lai str. 56601
uuucugagaauuucucu

SEQ ID NO: 754438 - RNA, 13 nt, Leptospira interrogans serovar lai str. 56601
uuucugauuuuua

SEQ ID NO: 754439 - RNA, 18 nt, Leptospira interrogans serovar lai str. 56601
uuucugauuuuuauaauu

SEQ ID NO: 754440 - RNA, 16 nt, Leptospira interrogans serovar lai str. 56601
uuucuggauucugcug

SEQ ID NO: 754441 - RNA, 18 nt, Leptospira interrogans serovar lai str. 56601
uuucugccauuuuuaguc

SEQ ID NO: 754442 - RNA, 18 nt, Leptospira interrogans serovar lai str. 56601
ucauuaaugcgaaaauuu

SEQ ID NO: 754443 - RNA, 20 nt, Leptospira interrogans serovar lai str. 56601
ucauuaaugcgaaaauuuaa

SEQ ID NO: 754444 - RNA, 14 nt, Leptospira interrogans serovar lai str. 56601
ucauuaauuuuuga

SEQ ID NO: 754445 - RNA, 20 nt, Leptospira interrogans serovar lai str. 56601
ucauuaccaauugauaauuu

SEQ ID NO: 754446 - RNA, 18 nt, Leptospira interrogans serovar lai str. 56601
ucauuaaacaauuuuuca

SEQ ID NO: 754447 - RNA, 14 nt, Leptospira interrogans serovar lai str. 56601
ucauggccuucugg

SEQ ID NO: 754448 - RNA, 14 nt, Leptospira interrogans serovar lai str. 56601
ucauggagaauaaa

SEQ ID NO: 754449 - RNA, 20 nt, Leptospira interrogans serovar lai str. 56601
ucaugucucaguucaaaaua

SEQ ID NO: 754450 - RNA, 17 nt, Leptospira interrogans serovar lai str. 56601
ucaugugaauucagaaa

SEQ ID NO: 754451 - RNA, 13 nt, Leptospira interrogans serovar lai str. 56601
ucauguaaaauuu

SEQ ID NO: 754452 - RNA, 15 nt, Leptospira interrogans serovar lai str. 56601
ucauguaaaauuuuu

SEQ ID NO: 754453 - RNA, 18 nt, Leptospira interrogans serovar lai str. 56601
ucauguaauauaaguuaa

SEQ ID NO: 754454 - RNA, 19 nt, Leptospira interrogans serovar lai str. 56601
ucauuagaauuguugaaaa

SEQ ID NO: 754455 - RNA, 21 nt, Leptospira interrogans serovar lai str. 56601
ucauuagaauuguugaaaaau

SEQ ID NO: 754456 - RNA, 19 nt, Leptospira interrogans serovar lai str. 56601
ucauuagaguuauugaaaa

SEQ ID NO: 754457 - RNA, 12 nt, Leptospira interrogans serovar lai str. 56601
ucauucaggauu

SEQ ID NO: 754458 - RNA, 13 nt, Leptospira interrogans serovar lai str. 56601
ucauuauuugaaa

SEQ ID NO: 754459 - RNA, 21 nt, Leptospira interrogans serovar lai str. 56601
ucauucggagacuugauuuga

SEQ ID NO: 754460 - RNA, 20 nt, Leptospira interrogans serovar lai str. 56601
ucauucuauuuggauuuuau

SEQ ID NO: 754461 - RNA, 16 nt, Leptospira interrogans serovar lai str. 56601
ucauuccuauaaauaa

SEQ ID NO: 754462 - RNA, 16 nt, Leptospira interrogans serovar lai str. 56601
ucauucuuuugugacu

SEQ ID NO: 754463 - RNA, 14 nt, Leptospira interrogans serovar lai str. 56601
ucauucugauucua

SEQ ID NO: 754464 - RNA, 14 nt, Leptospira interrogans serovar lai str. 56601
ucauucugaaaaaa

SEQ ID NO: 754465 - RNA, 13 nt, Leptospira interrogans serovar lai str. 56601
ucauucuuuaaaa

SEQ ID NO: 754466 - RNA, 17 nt, Leptospira interrogans serovar lai str. 56601
ucauucuuuaaaauaga

SEQ ID NO: 754467 - RNA, 13 nt, Leptospira interrogans serovar lai str. 56601
ucauucuuuagaa

SEQ ID NO: 754468 - RNA, 21 nt, Leptospira interrogans serovar lai str. 56601
ucauuuuacagaauauuaaau

SEQ ID NO: 754469 - RNA, 14 nt, Leptospira interrogans serovar lai str. 56601
ucauuuuauuuuua

SEQ ID NO: 754470 - RNA, 20 nt, Leptospira interrogans serovar lai str. 56601
ucauuuuguaaguccaauga

SEQ ID NO: 754471 - RNA, 14 nt, Leptospira interrogans serovar lai str. 56601
ucauuuugauaauu

SEQ ID NO: 754472 - RNA, 13 nt, Leptospira interrogans serovar lai str. 56601
ucauuugaauuua

SEQ ID NO: 754473 - RNA, 16 nt, Leptospira interrogans serovar lai str. 56601
ucauuugaaguauuuu

SEQ ID NO: 754474 - RNA, 23 nt, Leptospira interrogans serovar lai str. 56601
ucauuucuaugauauggaauucc

SEQ ID NO: 754475 - RNA, 15 nt, Leptospira interrogans serovar lai str. 56601
ucauuucgaaaacga

SEQ ID NO: 754476 - RNA, 23 nt, Leptospira interrogans serovar lai str. 56601
ucauuucgaaaacgauuuuucaa

SEQ ID NO: 754477 - RNA, 14 nt, Leptospira interrogans serovar lai str. 56601
ucauuuccuccaaa

SEQ ID NO: 754478 - RNA, 15 nt, Leptospira interrogans serovar lai str. 56601
ucauuuaccuaaaau

SEQ ID NO: 754479 - RNA, 16 nt, Leptospira interrogans serovar lai str. 56601
ucauuuaccuaaaauu

SEQ ID NO: 754480 - RNA, 14 nt, Leptospira interrogans serovar lai str. 56601
ucauuuacucaaau

SEQ ID NO: 754481 - RNA, 16 nt, Leptospira interrogans serovar lai str. 56601
ucauuuacucaaauua

SEQ ID NO: 754482 - RNA, 20 nt, Leptospira interrogans serovar lai str. 56601
ucauugugaauguauauuuu

SEQ ID NO: 754483 - RNA, 23 nt, Leptospira interrogans serovar lai str. 56601
ucauugugaauguauauuuuuuu

SEQ ID NO: 754484 - RNA, 18 nt, Leptospira interrogans serovar lai str. 56601
ucauuggaguuuuuuaaa

SEQ ID NO: 754485 - RNA, 20 nt, Leptospira interrogans serovar lai str. 56601
uccaaacccaaugauucuaa

SEQ ID NO: 754486 - RNA, 19 nt, Leptospira interrogans serovar lai str. 56601
uccaaacccugccaaaauc

SEQ ID NO: 754487 - RNA, 19 nt, Leptospira interrogans serovar lai str. 56601
uccaaacucaaugcugcuc

SEQ ID NO: 754488 - RNA, 16 nt, Leptospira interrogans serovar lai str. 56601
uccaaagauuuuaaaa

SEQ ID NO: 754489 - RNA, 19 nt, Leptospira interrogans serovar lai str. 56601
uccaaagauuuuaaaaauu

SEQ ID NO: 754490 - RNA, 24 nt, Leptospira interrogans serovar lai str. 56601
uccaaagauuuuaaaaauucaacu

SEQ ID NO: 754491 - RNA, 15 nt, Leptospira interrogans serovar lai str. 56601
uccaaagauaaaaaa

SEQ ID NO: 754492 - RNA, 17 nt, Leptospira interrogans serovar lai str. 56601
uccaaagauaaaaaaga

SEQ ID NO: 754493 - RNA, 18 nt, Leptospira interrogans serovar lai str. 56601
uccaaagauaaaaaagaa

SEQ ID NO: 754494 - RNA, 16 nt, Leptospira interrogans serovar lai str. 56601
uccaaaaguuuugcgg

SEQ ID NO: 754495 - RNA, 11 nt, Leptospira interrogans serovar lai str. 56601
uccaaaaccuc

SEQ ID NO: 754496 - RNA, 18 nt, Leptospira interrogans serovar lai str. 56601
uccaaaaccucaaaaaau

SEQ ID NO: 754497 - RNA, 21 nt, Leptospira interrogans serovar lai str. 56601
uccaaaaggcacauuuuucaa

SEQ ID NO: 754498 - RNA, 16 nt, Leptospira interrogans serovar lai str. 56601
uccaaaaauuuaaaaa

SEQ ID NO: 754499 - RNA, 14 nt, Leptospira interrogans serovar lai str. 56601
uccaaaaagaaaaa

SEQ ID NO: 754500 - RNA, 15 nt, Leptospira interrogans serovar lai str. 56601
uccaaaaagaaaaac

SEQ ID NO: 754501 - RNA, 16 nt, Leptospira interrogans serovar lai str. 56601
ucauuuuuugaaaaag

SEQ ID NO: 754502 - RNA, 15 nt, Leptospira interrogans serovar lai str. 56601
ucauuuuuucuaaau

SEQ ID NO: 754503 - RNA, 17 nt, Leptospira interrogans serovar lai str. 56601
ucauuuuuucuaaauua

SEQ ID NO: 754504 - RNA, 15 nt, Leptospira interrogans serovar lai str. 56601
ucauuuuucugaaaa

SEQ ID NO: 754505 - RNA, 17 nt, Leptospira interrogans serovar lai str. 56601
ucauuuuucugaaaaag

SEQ ID NO: 754506 - RNA, 14 nt, Leptospira interrogans serovar lai str. 56601
ucauuuuucuuaaa

SEQ ID NO: 754507 - RNA, 17 nt, Leptospira interrogans serovar lai str. 56601
ucauuuuucuuaaaaaa

SEQ ID NO: 754508 - RNA, 18 nt, Leptospira interrogans serovar lai str. 56601
ucauuuuucuuaaaaaaa

SEQ ID NO: 754509 - RNA, 13 nt, Leptospira interrogans serovar lai str. 56601
ucauuuuucuaaa

SEQ ID NO: 754510 - RNA, 15 nt, Leptospira interrogans serovar lai str. 56601
ucauuuuucuaaaaa

SEQ ID NO: 754511 - RNA, 16 nt, Leptospira interrogans serovar lai str. 56601
ucauuuuucuaaaaaa

SEQ ID NO: 754512 - RNA, 14 nt, Leptospira interrogans serovar lai str. 56601
ucauuuuucuacaa

SEQ ID NO: 754513 - RNA, 15 nt, Leptospira interrogans serovar lai str. 56601
ucauuuuucuacaau

SEQ ID NO: 754514 - RNA, 22 nt, Leptospira interrogans serovar lai str. 56601
uccaaaguucccgccaaaugcu

SEQ ID NO: 754515 - RNA, 16 nt, Leptospira interrogans serovar lai str. 56601
uccaaauccccaaaag

SEQ ID NO: 754516 - RNA, 18 nt, Leptospira interrogans serovar lai str. 56601
uccaaaucugaaucucuu

SEQ ID NO: 754517 - RNA, 16 nt, Leptospira interrogans serovar lai str. 56601
uccaacaaauugaaau

SEQ ID NO: 754518 - RNA, 16 nt, Leptospira interrogans serovar lai str. 56601
uccaacccaaacacau

SEQ ID NO: 754519 - RNA, 15 nt, Leptospira interrogans serovar lai str. 56601
uccaaccagagcaua

SEQ ID NO: 754520 - RNA, 21 nt, Leptospira interrogans serovar lai str. 56601
ucaugauucauuuuucugaaa

SEQ ID NO: 754521 - RNA, 14 nt, Leptospira interrogans serovar lai str. 56601
ucaugauucugaaa

SEQ ID NO: 754522 - RNA, 19 nt, Leptospira interrogans serovar lai str. 56601
ucaucuuugcgauuuuucc

SEQ ID NO: 754523 - RNA, 20 nt, Leptospira interrogans serovar lai str. 56601
ucaucuuugcgauuuuuccg

SEQ ID NO: 754524 - RNA, 15 nt, Leptospira interrogans serovar lai str. 56601
ucaugaauuaaagaa

SEQ ID NO: 754525 - RNA, 13 nt, Leptospira interrogans serovar lai str. 56601
ucaugaauauuuu

SEQ ID NO: 754526 - RNA, 20 nt, Leptospira interrogans serovar lai str. 56601
ucaugaauauuuuccaaaaa

SEQ ID NO: 754527 - RNA, 21 nt, Leptospira interrogans serovar lai str. 56601
ucaugaaccauggauuuuuac

SEQ ID NO: 754528 - RNA, 16 nt, Leptospira interrogans serovar lai str. 56601
ucaugaacgaauuuuu

SEQ ID NO: 754529 - RNA, 14 nt, Leptospira interrogans serovar lai str. 56601
ucaugaucaaauuc

SEQ ID NO: 754530 - RNA, 18 nt, Leptospira interrogans serovar lai str. 56601
ucaugacuacagaauaaa

SEQ ID NO: 754531 - RNA, 22 nt, Leptospira interrogans serovar lai str. 56601
ucaucucccgaaugaauuuuca

SEQ ID NO: 754532 - RNA, 18 nt, Leptospira interrogans serovar lai str. 56601
ucaucugaacuaugaaau

SEQ ID NO: 754533 - RNA, 17 nt, Leptospira interrogans serovar lai str. 56601
ucaucuguggagaaaau

SEQ ID NO: 754534 - RNA, 12 nt, Leptospira interrogans serovar lai str. 56601
ucaucuaaaaaa

SEQ ID NO: 754535 - RNA, 14 nt, Leptospira interrogans serovar lai str. 56601
ucaucgucuaauca

SEQ ID NO: 754536 - RNA, 16 nt, Leptospira interrogans serovar lai str. 56601
ucaucguuccaaaccc

SEQ ID NO: 754537 - RNA, 17 nt, Leptospira interrogans serovar lai str. 56601
ucaucgcuuuuaaauug

SEQ ID NO: 754538 - RNA, 18 nt, Leptospira interrogans serovar lai str. 56601
ucauccuggauauauaga

SEQ ID NO: 754539 - RNA, 17 nt, Leptospira interrogans serovar lai str. 56601
ucauccaugucuucuaa

SEQ ID NO: 754540 - RNA, 20 nt, Leptospira interrogans serovar lai str. 56601
ucauccgggcuuuucuuucg

SEQ ID NO: 754541 - RNA, 13 nt, Leptospira interrogans serovar lai str. 56601
ucaucauucugaa

SEQ ID NO: 754542 - RNA, 18 nt, Leptospira interrogans serovar lai str. 56601
ucaucauucugaaaaaag

SEQ ID NO: 754543 - RNA, 21 nt, Leptospira interrogans serovar lai str. 56601
ucaucaccaaccccacaaguu

SEQ ID NO: 754544 - RNA, 13 nt, Leptospira interrogans serovar lai str. 56601
ucauaucaaauuc

SEQ ID NO: 754545 - RNA, 17 nt, Leptospira interrogans serovar lai str. 56601
ucauaucaaaaauugua

SEQ ID NO: 754546 - RNA, 13 nt, Leptospira interrogans serovar lai str. 56601
ucauauccaaaac

SEQ ID NO: 754547 - RNA, 16 nt, Leptospira interrogans serovar lai str. 56601
ucauauccaauuucaa

SEQ ID NO: 754548 - RNA, 19 nt, Leptospira interrogans serovar lai str. 56601
ucauauaauaaaaauagcc

SEQ ID NO: 754549 - RNA, 11 nt, Leptospira interrogans serovar lai str. 56601
ucauauaaaag

SEQ ID NO: 754550 - RNA, 17 nt, Leptospira interrogans serovar lai str. 56601
ucauauaaaagugaaca

SEQ ID NO: 754551 - RNA, 21 nt, Leptospira interrogans serovar lai str. 56601
ucauauuauuuguaguuucaa

SEQ ID NO: 754552 - RNA, 14 nt, Leptospira interrogans serovar lai str. 56601
ucauaucuaaaaug

SEQ ID NO: 754553 - RNA, 23 nt, Leptospira interrogans serovar lai str. 56601
ucauaucuaaaauggacugcaaa

SEQ ID NO: 754554 - RNA, 17 nt, Leptospira interrogans serovar lai str. 56601
ucaucaaugguuuuucu

SEQ ID NO: 754555 - RNA, 18 nt, Leptospira interrogans serovar lai str. 56601
ucaucaaugguuuuucuu

SEQ ID NO: 754556 - RNA, 16 nt, Leptospira interrogans serovar lai str. 56601
ucaucaaaacuuaaau

SEQ ID NO: 754557 - RNA, 14 nt, Leptospira interrogans serovar lai str. 56601
ucauauuuucaaaa

SEQ ID NO: 754558 - RNA, 16 nt, Leptospira interrogans serovar lai str. 56601
ucauauuuucaaaaaa

SEQ ID NO: 754559 - RNA, 17 nt, Leptospira interrogans serovar lai str. 56601
ucauauuuucaaaaaau

SEQ ID NO: 754560 - RNA, 22 nt, Leptospira interrogans serovar lai str. 56601
ucauauugaaaucugaacauaa

SEQ ID NO: 754561 - RNA, 17 nt, Leptospira interrogans serovar lai str. 56601
ucauauuuaacuguaau

SEQ ID NO: 754562 - RNA, 19 nt, Leptospira interrogans serovar lai str. 56601
ucauauugagauaaaaagu

SEQ ID NO: 754563 - RNA, 12 nt, Leptospira interrogans serovar lai str. 56601
ucauacauuuuu

SEQ ID NO: 754564 - RNA, 14 nt, Leptospira interrogans serovar lai str. 56601
ucauacaguaaaac

SEQ ID NO: 754565 - RNA, 16 nt, Leptospira interrogans serovar lai str. 56601
ucauaaucaauuaacc

SEQ ID NO: 754566 - RNA, 17 nt, Leptospira interrogans serovar lai str. 56601
ucauaaguguaugaaaa

SEQ ID NO: 754567 - RNA, 14 nt, Leptospira interrogans serovar lai str. 56601
ucauaguucaauua

SEQ ID NO: 754568 - RNA, 20 nt, Leptospira interrogans serovar lai str. 56601
ucauaguucagaugaauuga

SEQ ID NO: 754569 - RNA, 14 nt, Leptospira interrogans serovar lai str. 56601
ucauaguucccaca

SEQ ID NO: 754570 - RNA, 21 nt, Leptospira interrogans serovar lai str. 56601
ucauagaauaaucggaaauac

SEQ ID NO: 754571 - RNA, 16 nt, Leptospira interrogans serovar lai str. 56601
ucauagaccaauuuuu

SEQ ID NO: 754572 - RNA, 17 nt, Leptospira interrogans serovar lai str. 56601
ucauacuucuaaaaaau

SEQ ID NO: 754573 - RNA, 22 nt, Leptospira interrogans serovar lai str. 56601
ucauacuuuagaaauuucuaau

SEQ ID NO: 754574 - RNA, 16 nt, Leptospira interrogans serovar lai str. 56601
ucauacuuuuaaaaaa

SEQ ID NO: 754575 - RNA, 17 nt, Leptospira interrogans serovar lai str. 56601
ucauacuuuuaaaaaau

SEQ ID NO: 754576 - RNA, 18 nt, Leptospira interrogans serovar lai str. 56601
ucaguaguuauauuaaua

SEQ ID NO: 754577 - RNA, 19 nt, Leptospira interrogans serovar lai str. 56601
ucagguuuuaucaaauaaa

SEQ ID NO: 754578 - RNA, 22 nt, Leptospira interrogans serovar lai str. 56601
ucaguaaauuauggacuauuuu

SEQ ID NO: 754579 - RNA, 16 nt, Leptospira interrogans serovar lai str. 56601
ucagugauaagaaaaa

SEQ ID NO: 754580 - RNA, 15 nt, Leptospira interrogans serovar lai str. 56601
ucagugaauaaaaua

SEQ ID NO: 754581 - RNA, 16 nt, Leptospira interrogans serovar lai str. 56601
ucagugaauaaaauaa

SEQ ID NO: 754582 - RNA, 16 nt, Leptospira interrogans serovar lai str. 56601
ucagucucauuucaaa

SEQ ID NO: 754583 - RNA, 22 nt, Leptospira interrogans serovar lai str. 56601
ucaguauguuguucuccaacuu

SEQ ID NO: 754584 - RNA, 13 nt, Leptospira interrogans serovar lai str. 56601
ucaguucugagac

SEQ ID NO: 754585 - RNA, 22 nt, Leptospira interrogans serovar lai str. 56601
ucaguucuuauagaaacuaaug

SEQ ID NO: 754586 - RNA, 21 nt, Leptospira interrogans serovar lai str. 56601
ucaguguuuugugauaaaauu

SEQ ID NO: 754587 - RNA, 13 nt, Leptospira interrogans serovar lai str. 56601
ucaguuauaagua

SEQ ID NO: 754588 - RNA, 19 nt, Leptospira interrogans serovar lai str. 56601
ucauaacaaauaaaaggag

SEQ ID NO: 754589 - RNA, 19 nt, Leptospira interrogans serovar lai str. 56601
ucauaaaccgauuuuccca

SEQ ID NO: 754590 - RNA, 21 nt, Leptospira interrogans serovar lai str. 56601
ucauaaaggugcaugaaaaua

SEQ ID NO: 754591 - RNA, 12 nt, Leptospira interrogans serovar lai str. 56601
ucauaaaauucu

SEQ ID NO: 754592 - RNA, 15 nt, Leptospira interrogans serovar lai str. 56601
ucauaaaaaaaucaa

SEQ ID NO: 754593 - RNA, 13 nt, Leptospira interrogans serovar lai str. 56601
ucaguuuuuucgu

SEQ ID NO: 754594 - RNA, 22 nt, Leptospira interrogans serovar lai str. 56601
ucaguuuuuucguaaaaaauag

SEQ ID NO: 754595 - RNA, 12 nt, Leptospira interrogans serovar lai str. 56601
ucaguuuuucgg

SEQ ID NO: 754596 - RNA, 20 nt, Leptospira interrogans serovar lai str. 56601
ucaguuuuacuguaaaauuu

SEQ ID NO: 754597 - RNA, 15 nt, Leptospira interrogans serovar lai str. 56601
ucagggcucaaaguc

SEQ ID NO: 754598 - RNA, 15 nt, Leptospira interrogans serovar lai str. 56601
ucaggcuuuauaaaa

SEQ ID NO: 754599 - RNA, 14 nt, Leptospira interrogans serovar lai str. 56601
ucaggauaaccuaa

SEQ ID NO: 754600 - RNA, 19 nt, Leptospira interrogans serovar lai str. 56601
ucagcuucagucaaguuau

SEQ ID NO: 754601 - RNA, 15 nt, Leptospira interrogans serovar lai str. 56601
ucagcucuggucaau

SEQ ID NO: 754602 - RNA, 20 nt, Leptospira interrogans serovar lai str. 56601
ucagcucugguuaauaaauu

SEQ ID NO: 754603 - RNA, 18 nt, Leptospira interrogans serovar lai str. 56601
ucagcuccaaaaaaauaa

SEQ ID NO: 754604 - RNA, 20 nt, Leptospira interrogans serovar lai str. 56601
ucagcuacaaucaauaaauu

SEQ ID NO: 754605 - RNA, 15 nt, Leptospira interrogans serovar lai str. 56601
ucagcuagaaaagga

SEQ ID NO: 754606 - RNA, 15 nt, Leptospira interrogans serovar lai str. 56601
ucagcuauaaaauag

SEQ ID NO: 754607 - RNA, 16 nt, Leptospira interrogans serovar lai str. 56601
ucagcuauaaaauagg

SEQ ID NO: 754608 - RNA, 23 nt, Leptospira interrogans serovar lai str. 56601
ucagcguaagguguuuauaaaaa

SEQ ID NO: 754609 - RNA, 15 nt, Leptospira interrogans serovar lai str. 56601
ucagcgcauuuagaa

SEQ ID NO: 754610 - RNA, 13 nt, Leptospira interrogans serovar lai str. 56601
uccaauuuugcuu

SEQ ID NO: 754611 - RNA, 15 nt, Leptospira interrogans serovar lai str. 56601
uccaauuuccuggau

SEQ ID NO: 754612 - RNA, 16 nt, Leptospira interrogans serovar lai str. 56601
uccaauuuuaaaacca

SEQ ID NO: 754613 - RNA, 15 nt, Leptospira interrogans serovar lai str. 56601
uccaauugaauauaa

SEQ ID NO: 754614 - RNA, 18 nt, Leptospira interrogans serovar lai str. 56601
uccaauugaauauaaaau

SEQ ID NO: 754615 - RNA, 20 nt, Leptospira interrogans serovar lai str. 56601
uccaauuguuccacuguauu

SEQ ID NO: 754616 - RNA, 22 nt, Leptospira interrogans serovar lai str. 56601
uccaauuguuccgaauuaaaaa

SEQ ID NO: 754617 - RNA, 14 nt, Leptospira interrogans serovar lai str. 56601
uccaaugaaaacua

SEQ ID NO: 754618 - RNA, 18 nt, Leptospira interrogans serovar lai str. 56601
uccaauuaacaaaacugc

SEQ ID NO: 754619 - RNA, 12 nt, Leptospira interrogans serovar lai str. 56601
uccaauuauaaa

SEQ ID NO: 754620 - RNA, 20 nt, Leptospira interrogans serovar lai str. 56601
uccaauuauaaaauuuuucu

SEQ ID NO: 754621 - RNA, 21 nt, Leptospira interrogans serovar lai str. 56601
uccaauuauaaaauuuuucuc

SEQ ID NO: 754622 - RNA, 19 nt, Leptospira interrogans serovar lai str. 56601
uccaaguagagagugaaaa

SEQ ID NO: 754623 - RNA, 21 nt, Leptospira interrogans serovar lai str. 56601
uccaauacuuacacuccucaa

SEQ ID NO: 754624 - RNA, 17 nt, Leptospira interrogans serovar lai str. 56601
uccaagcaauucuaaga

SEQ ID NO: 754625 - RNA, 20 nt, Leptospira interrogans serovar lai str. 56601
uccaacuuuuucagaaaaau

SEQ ID NO: 754626 - RNA, 18 nt, Leptospira interrogans serovar lai str. 56601
uccacauuccgucaaauc

SEQ ID NO: 754627 - RNA, 19 nt, Leptospira interrogans serovar lai str. 56601
uccacauuuauuuuuacgg

SEQ ID NO: 754628 - RNA, 15 nt, Leptospira interrogans serovar lai str. 56601
uccacauuuuaaagg

SEQ ID NO: 754629 - RNA, 19 nt, Leptospira interrogans serovar lai str. 56601
uccaccggaguaaggcaaa

SEQ ID NO: 754630 - RNA, 13 nt, Leptospira interrogans serovar lai str. 56601
uccacccaaaccg

SEQ ID NO: 754631 - RNA, 13 nt, Leptospira interrogans serovar lai str. 56601
uccacuuuaaaaa

SEQ ID NO: 754632 - RNA, 16 nt, Leptospira interrogans serovar lai str. 56601
uccacuuuaaaaauga

SEQ ID NO: 754633 - RNA, 19 nt, Leptospira interrogans serovar lai str. 56601
uccacuuuaaaaaugaucu

SEQ ID NO: 754634 - RNA, 16 nt, Leptospira interrogans serovar lai str. 56601
uccacuucucacaaau

SEQ ID NO: 754635 - RNA, 10 nt, Leptospira interrogans serovar lai str. 56601
uccacuucaa

SEQ ID NO: 754636 - RNA, 15 nt, Leptospira interrogans serovar lai str. 56601
uccacuucaaaaaga

SEQ ID NO: 754637 - RNA, 18 nt, Leptospira interrogans serovar lai str. 56601
uccacuuaaaaaguuuuu

SEQ ID NO: 754638 - RNA, 21 nt, Leptospira interrogans serovar lai str. 56601
uccacuaugaaaguuuuucaa

SEQ ID NO: 754639 - RNA, 16 nt, Leptospira interrogans serovar lai str. 56601
uccaccuuggaaagaa

SEQ ID NO: 754640 - RNA, 14 nt, Leptospira interrogans serovar lai str. 56601
uccagaaccucaaa

SEQ ID NO: 754641 - RNA, 20 nt, Leptospira interrogans serovar lai str. 56601
uccagaaccucaaagaaauu

SEQ ID NO: 754642 - RNA, 20 nt, Leptospira interrogans serovar lai str. 56601
uccagcugaaacuaauaugu

SEQ ID NO: 754643 - RNA, 21 nt, Leptospira interrogans serovar lai str. 56601
uccagcuuuuuuaaauuuuua

SEQ ID NO: 754644 - RNA, 19 nt, Leptospira interrogans serovar lai str. 56601
uccagcgaucgugauaaga

SEQ ID NO: 754645 - RNA, 17 nt, Leptospira interrogans serovar lai str. 56601
uccaguuuacuacccga

SEQ ID NO: 754646 - RNA, 19 nt, Leptospira interrogans serovar lai str. 56601
uccauagcaacaauuaaca

SEQ ID NO: 754647 - RNA, 12 nt, Leptospira interrogans serovar lai str. 56601
uccauagagaac

SEQ ID NO: 754648 - RNA, 14 nt, Leptospira interrogans serovar lai str. 56601
uccauaaugaagau

SEQ ID NO: 754649 - RNA, 23 nt, Leptospira interrogans serovar lai str. 56601
uccauaacagaauuuaggcaauu

SEQ ID NO: 754650 - RNA, 13 nt, Leptospira interrogans serovar lai str. 56601
uccauaaaauaga

SEQ ID NO: 754651 - RNA, 14 nt, Leptospira interrogans serovar lai str. 56601
uccauaaaauagaa

SEQ ID NO: 754652 - RNA, 17 nt, Leptospira interrogans serovar lai str. 56601
uccauaucuacaaaaga

SEQ ID NO: 754653 - RNA, 23 nt, Leptospira interrogans serovar lai str. 56601
uccauaucuacgacuaacaaaau

SEQ ID NO: 754654 - RNA, 22 nt, Leptospira interrogans serovar lai str. 56601
uccauauacguaaaaauaauau

SEQ ID NO: 754655 - RNA, 19 nt, Leptospira interrogans serovar lai str. 56601
uccauauagagaauuugug

SEQ ID NO: 754656 - RNA, 16 nt, Leptospira interrogans serovar lai str. 56601
uccauaugaguuccca

SEQ ID NO: 754657 - RNA, 15 nt, Leptospira interrogans serovar lai str. 56601
ucccacaauuuugag

SEQ ID NO: 754658 - RNA, 19 nt, Leptospira interrogans serovar lai str. 56601
ucccacaguuugaaagucu

SEQ ID NO: 754659 - RNA, 16 nt, Leptospira interrogans serovar lai str. 56601
ucccaccuuuuuuuau

SEQ ID NO: 754660 - RNA, 23 nt, Leptospira interrogans serovar lai str. 56601
ucccaccuuuuuuuaugaaaaaa

SEQ ID NO: 754661 - RNA, 21 nt, Leptospira interrogans serovar lai str. 56601
ucccacaguuccacuuuaaaa

SEQ ID NO: 754662 - RNA, 23 nt, Leptospira interrogans serovar lai str. 56601
ucccacauuuuuaaaaguuauua

SEQ ID NO: 754663 - RNA, 16 nt, Leptospira interrogans serovar lai str. 56601
ucccacguuuuaaagg

SEQ ID NO: 754664 - RNA, 23 nt, Leptospira interrogans serovar lai str. 56601
uccauuggauucugcucuucuaa

SEQ ID NO: 754665 - RNA, 18 nt, Leptospira interrogans serovar lai str. 56601
uccauuucuauaaauuga

SEQ ID NO: 754666 - RNA, 14 nt, Leptospira interrogans serovar lai str. 56601
uccauuuucauaau

SEQ ID NO: 754667 - RNA, 12 nt, Leptospira interrogans serovar lai str. 56601
uccauuuuuccg

SEQ ID NO: 754668 - RNA, 12 nt, Leptospira interrogans serovar lai str. 56601
uccauuucauug

SEQ ID NO: 754669 - RNA, 15 nt, Leptospira interrogans serovar lai str. 56601
uccauuuuucugaaa

SEQ ID NO: 754670 - RNA, 14 nt, Leptospira interrogans serovar lai str. 56601
uccauuuuuuagaa

SEQ ID NO: 754671 - RNA, 16 nt, Leptospira interrogans serovar lai str. 56601
ucccaaaauuucuaaa

SEQ ID NO: 754672 - RNA, 20 nt, Leptospira interrogans serovar lai str. 56601
ucccaaacaggaaaauuuaa

SEQ ID NO: 754673 - RNA, 14 nt, Leptospira interrogans serovar lai str. 56601
ucccaaaaacucaa

SEQ ID NO: 754674 - RNA, 21 nt, Leptospira interrogans serovar lai str. 56601
ucccaaaaacucaaagaaauu

SEQ ID NO: 754675 - RNA, 15 nt, Leptospira interrogans serovar lai str. 56601
ucccaauaaggagca

SEQ ID NO: 754676 - RNA, 14 nt, Leptospira interrogans serovar lai str. 56601
ucccaaacuuucuu

SEQ ID NO: 754677 - RNA, 14 nt, Leptospira interrogans serovar lai str. 56601
uccaugucuucuaa

SEQ ID NO: 754678 - RNA, 15 nt, Leptospira interrogans serovar lai str. 56601
uccaugucuucuaaa

SEQ ID NO: 754679 - RNA, 19 nt, Leptospira interrogans serovar lai str. 56601
uccaugucuucuaaaucua

SEQ ID NO: 754680 - RNA, 14 nt, Leptospira interrogans serovar lai str. 56601
uccauugauuuuca

SEQ ID NO: 754681 - RNA, 14 nt, Leptospira interrogans serovar lai str. 56601
uccauucuucaaau

SEQ ID NO: 754682 - RNA, 21 nt, Leptospira interrogans serovar lai str. 56601
uccauucuucaaauaacauuu

SEQ ID NO: 754683 - RNA, 12 nt, Leptospira interrogans serovar lai str. 56601
uccauucuaaga

SEQ ID NO: 754684 - RNA, 18 nt, Leptospira interrogans serovar lai str. 56601
uccauuauaguuuuuuca

SEQ ID NO: 754685 - RNA, 21 nt, Leptospira interrogans serovar lai str. 56601
uccaugauucauuuuucuaaa

SEQ ID NO: 754686 - RNA, 20 nt, Leptospira interrogans serovar lai str. 56601
uccaugauucugaaaaaagu

SEQ ID NO: 754687 - RNA, 20 nt, Leptospira interrogans serovar lai str. 56601
uccaucuuuuuuuucuaaaa

SEQ ID NO: 754688 - RNA, 16 nt, Leptospira interrogans serovar lai str. 56601
uccaucuuuauaucuu

SEQ ID NO: 754689 - RNA, 16 nt, Leptospira interrogans serovar lai str. 56601
uccaucuguuucuauu

SEQ ID NO: 754690 - RNA, 13 nt, Leptospira interrogans serovar lai str. 56601
uccaugaaauaga

SEQ ID NO: 754691 - RNA, 16 nt, Leptospira interrogans serovar lai str. 56601
uccaucguuuauuuuu

SEQ ID NO: 754692 - RNA, 19 nt, Leptospira interrogans serovar lai str. 56601
uccaucguaucuuucaaaa

SEQ ID NO: 754693 - RNA, 17 nt, Leptospira interrogans serovar lai str. 56601
ucccauccgaaauccca

SEQ ID NO: 754694 - RNA, 18 nt, Leptospira interrogans serovar lai str. 56601
ucccauccgaaaucccaa

SEQ ID NO: 754695 - RNA, 22 nt, Leptospira interrogans serovar lai str. 56601
ucccauccgaaaucccaaaacc

SEQ ID NO: 754696 - RNA, 13 nt, Leptospira interrogans serovar lai str. 56601
ucccauauaauuu

SEQ ID NO: 754697 - RNA, 17 nt, Leptospira interrogans serovar lai str. 56601
ucccauauaauuuuauc

SEQ ID NO: 754698 - RNA, 21 nt, Leptospira interrogans serovar lai str. 56601
ucccaugauagaguucugaaa

SEQ ID NO: 754699 - RNA, 18 nt, Leptospira interrogans serovar lai str. 56601
uccccaaguaaaauuaaa

SEQ ID NO: 754700 - RNA, 21 nt, Leptospira interrogans serovar lai str. 56601
uccccaaaaugaauuguaaaa

SEQ ID NO: 754701 - RNA, 21 nt, Leptospira interrogans serovar lai str. 56601
ucccaguucuuaaauaaaauu

SEQ ID NO: 754702 - RNA, 15 nt, Leptospira interrogans serovar lai str. 56601
ucccagauucccuuu

SEQ ID NO: 754703 - RNA, 19 nt, Leptospira interrogans serovar lai str. 56601
ucccagacguaucaaaaua

SEQ ID NO: 754704 - RNA, 16 nt, Leptospira interrogans serovar lai str. 56601
ucccccaacugaaaau

SEQ ID NO: 754705 - RNA, 21 nt, Leptospira interrogans serovar lai str. 56601
ucccccaacugaaaaugacca

SEQ ID NO: 754706 - RNA, 15 nt, Leptospira interrogans serovar lai str. 56601
uccccauaaacaaac

SEQ ID NO: 754707 - RNA, 13 nt, Leptospira interrogans serovar lai str. 56601
uccccgaacuaua

SEQ ID NO: 754708 - RNA, 17 nt, Leptospira interrogans serovar lai str. 56601
uccgauacgaguaaaaa

SEQ ID NO: 754709 - RNA, 19 nt, Leptospira interrogans serovar lai str. 56601
uccgauacgaguaaaaauu

SEQ ID NO: 754710 - RNA, 15 nt, Leptospira interrogans serovar lai str. 56601
uccgauuuuuguuuu

SEQ ID NO: 754711 - RNA, 15 nt, Leptospira interrogans serovar lai str. 56601
uccgcaaaaauuccu

SEQ ID NO: 754712 - RNA, 19 nt, Leptospira interrogans serovar lai str. 56601
uccgcaaaaauuccuuuuu

SEQ ID NO: 754713 - RNA, 14 nt, Leptospira interrogans serovar lai str. 56601
uccgauuucuuuca

SEQ ID NO: 754714 - RNA, 19 nt, Leptospira interrogans serovar lai str. 56601
uccgaugcauugaguucag

SEQ ID NO: 754715 - RNA, 21 nt, Leptospira interrogans serovar lai str. 56601
uccgaaauuuuuuuaaaaaug

SEQ ID NO: 754716 - RNA, 13 nt, Leptospira interrogans serovar lai str. 56601
uccgaaaaaccuu

SEQ ID NO: 754717 - RNA, 21 nt, Leptospira interrogans serovar lai str. 56601
uccgaaaaauuccacuucuca

SEQ ID NO: 754718 - RNA, 15 nt, Leptospira interrogans serovar lai str. 56601
uccgaauaggaucag

SEQ ID NO: 754719 - RNA, 15 nt, Leptospira interrogans serovar lai str. 56601
uccgaauuaaaaauu

SEQ ID NO: 754720 - RNA, 16 nt, Leptospira interrogans serovar lai str. 56601
uccgacaagaaugagu

SEQ ID NO: 754721 - RNA, 17 nt, Leptospira interrogans serovar lai str. 56601
uccgaauugaucucaua

SEQ ID NO: 754722 - RNA, 16 nt, Leptospira interrogans serovar lai str. 56601
ucccuuaccuccuuuu

SEQ ID NO: 754723 - RNA, 17 nt, Leptospira interrogans serovar lai str. 56601
ucccuauuuuugggugg

SEQ ID NO: 754724 - RNA, 18 nt, Leptospira interrogans serovar lai str. 56601
ucccguuauuuuuuuuac

SEQ ID NO: 754725 - RNA, 23 nt, Leptospira interrogans serovar lai str. 56601
ucccguauaaaaguguaucccuu

SEQ ID NO: 754726 - RNA, 12 nt, Leptospira interrogans serovar lai str. 56601
ucccgcuaaaag

SEQ ID NO: 754727 - RNA, 15 nt, Leptospira interrogans serovar lai str. 56601
ucccgccaaaugcug

SEQ ID NO: 754728 - RNA, 14 nt, Leptospira interrogans serovar lai str. 56601
uccccuuuuuuaau

SEQ ID NO: 754729 - RNA, 14 nt, Leptospira interrogans serovar lai str. 56601
ucccgaaugaauuu

SEQ ID NO: 754730 - RNA, 18 nt, Leptospira interrogans serovar lai str. 56601
ucccgaaugaauuuucaa

SEQ ID NO: 754731 - RNA, 13 nt, Leptospira interrogans serovar lai str. 56601
uccccuugauucc

SEQ ID NO: 754732 - RNA, 17 nt, Leptospira interrogans serovar lai str. 56601
uccuaaaaaauaaaugu

SEQ ID NO: 754733 - RNA, 22 nt, Leptospira interrogans serovar lai str. 56601
uccuaaaaugugggaacucuua

SEQ ID NO: 754734 - RNA, 23 nt, Leptospira interrogans serovar lai str. 56601
uccuaaaauugugggaacuuuau

SEQ ID NO: 754735 - RNA, 19 nt, Leptospira interrogans serovar lai str. 56601
uccuaaaaccucaaaaaau

SEQ ID NO: 754736 - RNA, 15 nt, Leptospira interrogans serovar lai str. 56601
uccuaauauaucaga

SEQ ID NO: 754737 - RNA, 18 nt, Leptospira interrogans serovar lai str. 56601
uccuaaugaaaaagaaac

SEQ ID NO: 754738 - RNA, 16 nt, Leptospira interrogans serovar lai str. 56601
uccuaagaaucaaauc

SEQ ID NO: 754739 - RNA, 16 nt, Leptospira interrogans serovar lai str. 56601
uccuacuuauuucuau

SEQ ID NO: 754740 - RNA, 22 nt, Leptospira interrogans serovar lai str. 56601
uccuacaaauuaagucccauuu

SEQ ID NO: 754741 - RNA, 11 nt, Leptospira interrogans serovar lai str. 56601
uccuacauuuu

SEQ ID NO: 754742 - RNA, 12 nt, Leptospira interrogans serovar lai str. 56601
uccuacauuuua

SEQ ID NO: 754743 - RNA, 18 nt, Leptospira interrogans serovar lai str. 56601
uccuacauuuuaaaaauu

SEQ ID NO: 754744 - RNA, 16 nt, Leptospira interrogans serovar lai str. 56601
uccuacauuuuuuaaa

SEQ ID NO: 754745 - RNA, 20 nt, Leptospira interrogans serovar lai str. 56601
uccuacauuuuuuaaauuua

SEQ ID NO: 754746 - RNA, 15 nt, Leptospira interrogans serovar lai str. 56601
uccuacauuuuuuau

SEQ ID NO: 754747 - RNA, 18 nt, Leptospira interrogans serovar lai str. 56601
uccgugaacuucuuucau

SEQ ID NO: 754748 - RNA, 14 nt, Leptospira interrogans serovar lai str. 56601
uccgucuuuuguaa

SEQ ID NO: 754749 - RNA, 19 nt, Leptospira interrogans serovar lai str. 56601
uccuccgauucugaauauu

SEQ ID NO: 754750 - RNA, 21 nt, Leptospira interrogans serovar lai str. 56601
uccuccuugaguuugagaaau

SEQ ID NO: 754751 - RNA, 13 nt, Leptospira interrogans serovar lai str. 56601
uccuccugaaaau

SEQ ID NO: 754752 - RNA, 21 nt, Leptospira interrogans serovar lai str. 56601
uccuccaaacaauuuuuugaa

SEQ ID NO: 754753 - RNA, 12 nt, Leptospira interrogans serovar lai str. 56601
uccuauaaauuc

SEQ ID NO: 754754 - RNA, 15 nt, Leptospira interrogans serovar lai str. 56601
uccuauaucaacaau

SEQ ID NO: 754755 - RNA, 16 nt, Leptospira interrogans serovar lai str. 56601
uccuauaucaacaauc

SEQ ID NO: 754756 - RNA, 16 nt, Leptospira interrogans serovar lai str. 56601
uccuauucaacuugug

SEQ ID NO: 754757 - RNA, 18 nt, Leptospira interrogans serovar lai str. 56601
uccuauauuuuaaauuca

SEQ ID NO: 754758 - RNA, 11 nt, Leptospira interrogans serovar lai str. 56601
uccucaauuag

SEQ ID NO: 754759 - RNA, 15 nt, Leptospira interrogans serovar lai str. 56601
uccuauuuucgaaaa

SEQ ID NO: 754760 - RNA, 20 nt, Leptospira interrogans serovar lai str. 56601
uccucaacggguucuucauu

SEQ ID NO: 754761 - RNA, 15 nt, Leptospira interrogans serovar lai str. 56601
uccugacugcccguu

SEQ ID NO: 754762 - RNA, 16 nt, Leptospira interrogans serovar lai str. 56601
uccuguaaauucaaaa

SEQ ID NO: 754763 - RNA, 19 nt, Leptospira interrogans serovar lai str. 56601
uccugccuucucucgacaa

SEQ ID NO: 754764 - RNA, 22 nt, Leptospira interrogans serovar lai str. 56601
uccucuucuuugucuuugagaa

SEQ ID NO: 754765 - RNA, 14 nt, Leptospira interrogans serovar lai str. 56601
uccucuuccggaag

SEQ ID NO: 754766 - RNA, 13 nt, Leptospira interrogans serovar lai str. 56601
uccucugauaaaa

SEQ ID NO: 754767 - RNA, 16 nt, Leptospira interrogans serovar lai str. 56601
uccucugauaaaauca

SEQ ID NO: 754768 - RNA, 15 nt, Leptospira interrogans serovar lai str. 56601
uccucugaacuucau

SEQ ID NO: 754769 - RNA, 16 nt, Leptospira interrogans serovar lai str. 56601
uccugaaaauuuuccu

SEQ ID NO: 754770 - RNA, 17 nt, Leptospira interrogans serovar lai str. 56601
uccugaaaauuuuccuu

SEQ ID NO: 754771 - RNA, 16 nt, Leptospira interrogans serovar lai str. 56601
uccucgcuuuuaauaa

SEQ ID NO: 754772 - RNA, 14 nt, Leptospira interrogans serovar lai str. 56601
uccgcauucucaca

SEQ ID NO: 754773 - RNA, 17 nt, Leptospira interrogans serovar lai str. 56601
uccgcaauaucccaaau

SEQ ID NO: 754774 - RNA, 15 nt, Leptospira interrogans serovar lai str. 56601
uccgccccacccaaa

SEQ ID NO: 754775 - RNA, 22 nt, Leptospira interrogans serovar lai str. 56601
uccgccccacccaaaaauaggg

SEQ ID NO: 754776 - RNA, 22 nt, Leptospira interrogans serovar lai str. 56601
uccgcgguuaugauauaauaua

SEQ ID NO: 754777 - RNA, 19 nt, Leptospira interrogans serovar lai str. 56601
uccgcuguaguaucucuug

SEQ ID NO: 754778 - RNA, 21 nt, Leptospira interrogans serovar lai str. 56601
uccguauacuuuaaaaaauau

SEQ ID NO: 754779 - RNA, 13 nt, Leptospira interrogans serovar lai str. 56601
uccguagaacgaa

SEQ ID NO: 754780 - RNA, 14 nt, Leptospira interrogans serovar lai str. 56601
uccguaaaauucaa

SEQ ID NO: 754781 - RNA, 13 nt, Leptospira interrogans serovar lai str. 56601
uccguaaacucaa

SEQ ID NO: 754782 - RNA, 16 nt, Leptospira interrogans serovar lai str. 56601
uccgguucgaaucauu

SEQ ID NO: 754783 - RNA, 22 nt, Leptospira interrogans serovar lai str. 56601
uccgggaauauucguaagaaaa

SEQ ID NO: 754784 - RNA, 14 nt, Leptospira interrogans serovar lai str. 56601
uccgggcuuuucuu

SEQ ID NO: 754785 - RNA, 22 nt, Leptospira interrogans serovar lai str. 56601
uccggcuaaaaaacugauuaaa

SEQ ID NO: 754786 - RNA, 18 nt, Leptospira interrogans serovar lai str. 56601
uccggauuaaaaagguuu

SEQ ID NO: 754787 - RNA, 21 nt, Leptospira interrogans serovar lai str. 56601
ucgauagccaugguaagaaga

SEQ ID NO: 754788 - RNA, 22 nt, Leptospira interrogans serovar lai str. 56601
ucgauagccaugguaagaagaa

SEQ ID NO: 754789 - RNA, 13 nt, Leptospira interrogans serovar lai str. 56601
ucgauaauucuuu

SEQ ID NO: 754790 - RNA, 16 nt, Leptospira interrogans serovar lai str. 56601
ucgaugcaaaaugcuc

SEQ ID NO: 754791 - RNA, 23 nt, Leptospira interrogans serovar lai str. 56601
ucgauucagagugguuucuuaug

SEQ ID NO: 754792 - RNA, 14 nt, Leptospira interrogans serovar lai str. 56601
ucgauuccuaaaau

SEQ ID NO: 754793 - RNA, 16 nt, Leptospira interrogans serovar lai str. 56601
ucgcauuuuccuuuuu

SEQ ID NO: 754794 - RNA, 19 nt, Leptospira interrogans serovar lai str. 56601
ucgccaaaaacgcaaaaag

SEQ ID NO: 754795 - RNA, 22 nt, Leptospira interrogans serovar lai str. 56601
ucgccaaaauauucagaaacug

SEQ ID NO: 754796 - RNA, 23 nt, Leptospira interrogans serovar lai str. 56601
ucgcauuguuuaaauagauucaa

SEQ ID NO: 754797 - RNA, 19 nt, Leptospira interrogans serovar lai str. 56601
ucgcauugaucuuuuagau

SEQ ID NO: 754798 - RNA, 20 nt, Leptospira interrogans serovar lai str. 56601
ucgcauuaugccgaauucac

SEQ ID NO: 754799 - RNA, 21 nt, Leptospira interrogans serovar lai str. 56601
ucgcauuaugccgaauucacg

SEQ ID NO: 754800 - RNA, 21 nt, Leptospira interrogans serovar lai str. 56601
ucgcauuaaaauuuucaucuu

SEQ ID NO: 754801 - RNA, 20 nt, Leptospira interrogans serovar lai str. 56601
ucgauuuuggguuuggagua

SEQ ID NO: 754802 - RNA, 13 nt, Leptospira interrogans serovar lai str. 56601
ucgcaaaaaaaau

SEQ ID NO: 754803 - RNA, 23 nt, Leptospira interrogans serovar lai str. 56601
ucgacuuuugaaaauccauauga

SEQ ID NO: 754804 - RNA, 12 nt, Leptospira interrogans serovar lai str. 56601
ucgacuucuuuu

SEQ ID NO: 754805 - RNA, 14 nt, Leptospira interrogans serovar lai str. 56601
ucgacguaaaaaua

SEQ ID NO: 754806 - RNA, 16 nt, Leptospira interrogans serovar lai str. 56601
ucgacguaagaauauu

SEQ ID NO: 754807 - RNA, 18 nt, Leptospira interrogans serovar lai str. 56601
ucgacguaagaauauuug

SEQ ID NO: 754808 - RNA, 17 nt, Leptospira interrogans serovar lai str. 56601
ucgaauuuuuuuuauuu

SEQ ID NO: 754809 - RNA, 17 nt, Leptospira interrogans serovar lai str. 56601
ucgaaugcucuaaaagc

SEQ ID NO: 754810 - RNA, 19 nt, Leptospira interrogans serovar lai str. 56601
ucgaauuguauccgaaaaa

SEQ ID NO: 754811 - RNA, 13 nt, Leptospira interrogans serovar lai str. 56601
ucgaauuuccauu

SEQ ID NO: 754812 - RNA, 21 nt, Leptospira interrogans serovar lai str. 56601
ucgaauuuccauuucugacau

SEQ ID NO: 754813 - RNA, 13 nt, Leptospira interrogans serovar lai str. 56601
ucgaauucuuucu

SEQ ID NO: 754814 - RNA, 23 nt, Leptospira interrogans serovar lai str. 56601
ucgaaugguacgaccaaaacaua

SEQ ID NO: 754815 - RNA, 15 nt, Leptospira interrogans serovar lai str. 56601
ucgaagauaccaaau

SEQ ID NO: 754816 - RNA, 15 nt, Leptospira interrogans serovar lai str. 56601
uccuuaaauauaucu

SEQ ID NO: 754817 - RNA, 20 nt, Leptospira interrogans serovar lai str. 56601
uccuuaagacccuaaaaaau

SEQ ID NO: 754818 - RNA, 15 nt, Leptospira interrogans serovar lai str. 56601
ucgccucuugaagcc

SEQ ID NO: 754819 - RNA, 15 nt, Leptospira interrogans serovar lai str. 56601
ucgccuacacugugu

SEQ ID NO: 754820 - RNA, 17 nt, Leptospira interrogans serovar lai str. 56601
ucgccuauuuuuuuaaa

SEQ ID NO: 754821 - RNA, 16 nt, Leptospira interrogans serovar lai str. 56601
ucgcuuacaaagugau

SEQ ID NO: 754822 - RNA, 19 nt, Leptospira interrogans serovar lai str. 56601
ucgcuuaucaauucacucu

SEQ ID NO: 754823 - RNA, 15 nt, Leptospira interrogans serovar lai str. 56601
ucggaaaauugaaua

SEQ ID NO: 754824 - RNA, 13 nt, Leptospira interrogans serovar lai str. 56601
ucggaaaaaauau

SEQ ID NO: 754825 - RNA, 23 nt, Leptospira interrogans serovar lai str. 56601
ucggaaaaaauaugauuuaaaau

SEQ ID NO: 754826 - RNA, 16 nt, Leptospira interrogans serovar lai str. 56601
ucggaaauuugaauuu

SEQ ID NO: 754827 - RNA, 22 nt, Leptospira interrogans serovar lai str. 56601
ucggaaauaccgcuggaaauau

SEQ ID NO: 754828 - RNA, 18 nt, Leptospira interrogans serovar lai str. 56601
ucggaacaauuacagaag

SEQ ID NO: 754829 - RNA, 18 nt, Leptospira interrogans serovar lai str. 56601
ucggaacacuugaaaaau

SEQ ID NO: 754830 - RNA, 21 nt, Leptospira interrogans serovar lai str. 56601
ucggaacuagggaauuuuuca

SEQ ID NO: 754831 - RNA, 22 nt, Leptospira interrogans serovar lai str. 56601
ucggaaggauuagcaugaaauu

SEQ ID NO: 754832 - RNA, 19 nt, Leptospira interrogans serovar lai str. 56601
ucggacuuuccgaauagga

SEQ ID NO: 754833 - RNA, 14 nt, Leptospira interrogans serovar lai str. 56601
ucggagaauuuaag

SEQ ID NO: 754834 - RNA, 17 nt, Leptospira interrogans serovar lai str. 56601
ucgcucaaucaaauuuu

SEQ ID NO: 754835 - RNA, 13 nt, Leptospira interrogans serovar lai str. 56601
ucgcucaaauuuu

SEQ ID NO: 754836 - RNA, 19 nt, Leptospira interrogans serovar lai str. 56601
ucgcguuugaaacucagua

SEQ ID NO: 754837 - RNA, 23 nt, Leptospira interrogans serovar lai str. 56601
ucgcuaaacuaucuauuagaaca

SEQ ID NO: 754838 - RNA, 19 nt, Leptospira interrogans serovar lai str. 56601
ucgcguuaauauaauaaga

SEQ ID NO: 754839 - RNA, 15 nt, Leptospira interrogans serovar lai str. 56601
ucgcguagauaauga

SEQ ID NO: 754840 - RNA, 15 nt, Leptospira interrogans serovar lai str. 56601
ucucacuuccuaugg

SEQ ID NO: 754841 - RNA, 20 nt, Leptospira interrogans serovar lai str. 56601
ucucacaaaucagguuuuua

SEQ ID NO: 754842 - RNA, 13 nt, Leptospira interrogans serovar lai str. 56601
ucucacaaaucau

SEQ ID NO: 754843 - RNA, 14 nt, Leptospira interrogans serovar lai str. 56601
ucucacaaaucaug

SEQ ID NO: 754844 - RNA, 15 nt, Leptospira interrogans serovar lai str. 56601
ucucaaucaaaauuu

SEQ ID NO: 754845 - RNA, 23 nt, Leptospira interrogans serovar lai str. 56601
ucucaagugaugaaguuuuacua

SEQ ID NO: 754846 - RNA, 13 nt, Leptospira interrogans serovar lai str. 56601
ucucaaaaccuau

SEQ ID NO: 754847 - RNA, 21 nt, Leptospira interrogans serovar lai str. 56601
ucucaaaaccuguaaaugaau

SEQ ID NO: 754848 - RNA, 15 nt, Leptospira interrogans serovar lai str. 56601
ucucaaaaaaugcau

SEQ ID NO: 754849 - RNA, 19 nt, Leptospira interrogans serovar lai str. 56601
ucucaaaaucuuaauaaaa

SEQ ID NO: 754850 - RNA, 20 nt, Leptospira interrogans serovar lai str. 56601
ucucaaaaucuuaauaaaau

SEQ ID NO: 754851 - RNA, 14 nt, Leptospira interrogans serovar lai str. 56601
ucucaaaaauacuu

SEQ ID NO: 754852 - RNA, 12 nt, Leptospira interrogans serovar lai str. 56601
ucucaaaaauau

SEQ ID NO: 754853 - RNA, 12 nt, Leptospira interrogans serovar lai str. 56601
ucucaaaaaaag

SEQ ID NO: 754854 - RNA, 19 nt, Leptospira interrogans serovar lai str. 56601
ucuauuuucuuugaaaaaa

SEQ ID NO: 754855 - RNA, 18 nt, Leptospira interrogans serovar lai str. 56601
ucuauuuuauguaaaucg

SEQ ID NO: 754856 - RNA, 18 nt, Leptospira interrogans serovar lai str. 56601
ucuauuuuauugauucua

SEQ ID NO: 754857 - RNA, 13 nt, Leptospira interrogans serovar lai str. 56601
ucuauuuuauuuu

SEQ ID NO: 754858 - RNA, 17 nt, Leptospira interrogans serovar lai str. 56601
ucucaacaacucuaaua

SEQ ID NO: 754859 - RNA, 19 nt, Leptospira interrogans serovar lai str. 56601
ucucaacaacucuaauaua

SEQ ID NO: 754860 - RNA, 15 nt, Leptospira interrogans serovar lai str. 56601
ucuauuuuaauauau

SEQ ID NO: 754861 - RNA, 16 nt, Leptospira interrogans serovar lai str. 56601
ucuauuuuaauauauu

SEQ ID NO: 754862 - RNA, 21 nt, Leptospira interrogans serovar lai str. 56601
ucuauuuuauacuucuauaau

SEQ ID NO: 754863 - RNA, 14 nt, Leptospira interrogans serovar lai str. 56601
ucuauuuuaucaga

SEQ ID NO: 754864 - RNA, 13 nt, Leptospira interrogans serovar lai str. 56601
ucuauuucccaaa

SEQ ID NO: 754865 - RNA, 14 nt, Leptospira interrogans serovar lai str. 56601
ucuauuucccaaaa

SEQ ID NO: 754866 - RNA, 20 nt, Leptospira interrogans serovar lai str. 56601
ucuauuuccguuauauuaaa

SEQ ID NO: 754867 - RNA, 19 nt, Leptospira interrogans serovar lai str. 56601
ucuauugucucaaaauuaa

SEQ ID NO: 754868 - RNA, 16 nt, Leptospira interrogans serovar lai str. 56601
ucuauuggguuugauu

SEQ ID NO: 754869 - RNA, 14 nt, Leptospira interrogans serovar lai str. 56601
ucuauuguaauaaa

SEQ ID NO: 754870 - RNA, 15 nt, Leptospira interrogans serovar lai str. 56601
ucuauuguaauaaau

SEQ ID NO: 754871 - RNA, 17 nt, Leptospira interrogans serovar lai str. 56601
ucuauuguaauaaaucg

SEQ ID NO: 754872 - RNA, 13 nt, Leptospira interrogans serovar lai str. 56601
ucucaguucaaaa

SEQ ID NO: 754873 - RNA, 18 nt, Leptospira interrogans serovar lai str. 56601
ucucauacuuaauuucaa

SEQ ID NO: 754874 - RNA, 22 nt, Leptospira interrogans serovar lai str. 56601
ucucagcuucagucaaguuauu

SEQ ID NO: 754875 - RNA, 15 nt, Leptospira interrogans serovar lai str. 56601
ucucagccaaaaguu

SEQ ID NO: 754876 - RNA, 13 nt, Leptospira interrogans serovar lai str. 56601
ucuccuauguuuc

SEQ ID NO: 754877 - RNA, 23 nt, Leptospira interrogans serovar lai str. 56601
ucuccuuagaaagcgugacuaaa

SEQ ID NO: 754878 - RNA, 12 nt, Leptospira interrogans serovar lai str. 56601
ucuccuaaaaua

SEQ ID NO: 754879 - RNA, 18 nt, Leptospira interrogans serovar lai str. 56601
ucuccaucuguuucuauu

SEQ ID NO: 754880 - RNA, 21 nt, Leptospira interrogans serovar lai str. 56601
ucuccaucuuuuuuuucuaaa

SEQ ID NO: 754881 - RNA, 22 nt, Leptospira interrogans serovar lai str. 56601
ucuccaucuuuuuuuucuaaaa

SEQ ID NO: 754882 - RNA, 16 nt, Leptospira interrogans serovar lai str. 56601
ucuauaaucugaaaua

SEQ ID NO: 754883 - RNA, 14 nt, Leptospira interrogans serovar lai str. 56601
ucuauaauguuaau

SEQ ID NO: 754884 - RNA, 16 nt, Leptospira interrogans serovar lai str. 56601
ucuauaauguuaauuu

SEQ ID NO: 754885 - RNA, 20 nt, Leptospira interrogans serovar lai str. 56601
ucuauaaaugaauuuuaaau

SEQ ID NO: 754886 - RNA, 20 nt, Leptospira interrogans serovar lai str. 56601
ucuauaaauucaucuaaaaa

SEQ ID NO: 754887 - RNA, 23 nt, Leptospira interrogans serovar lai str. 56601
ucuauaaauucaucuaaaaaaaa

SEQ ID NO: 754888 - RNA, 12 nt, Leptospira interrogans serovar lai str. 56601
ucuauaaauugc

SEQ ID NO: 754889 - RNA, 16 nt, Leptospira interrogans serovar lai str. 56601
ucuaguuuuugaauag

SEQ ID NO: 754890 - RNA, 11 nt, Leptospira interrogans serovar lai str. 56601
ucuauaaaauc

SEQ ID NO: 754891 - RNA, 16 nt, Leptospira interrogans serovar lai str. 56601
ucuauaaaaucuaaaa

SEQ ID NO: 754892 - RNA, 20 nt, Leptospira interrogans serovar lai str. 56601
ucuauaaaaucuaaaaaaac

SEQ ID NO: 754893 - RNA, 21 nt, Leptospira interrogans serovar lai str. 56601
ucuauaaaaucuaaaaagaau

SEQ ID NO: 754894 - RNA, 21 nt, Leptospira interrogans serovar lai str. 56601
ucuauaaaauggguuuucauu

SEQ ID NO: 754895 - RNA, 14 nt, Leptospira interrogans serovar lai str. 56601
ucuauaaaauuaaa

SEQ ID NO: 754896 - RNA, 13 nt, Leptospira interrogans serovar lai str. 56601
ucuauaaaauuca

SEQ ID NO: 754897 - RNA, 14 nt, Leptospira interrogans serovar lai str. 56601
ucuaguucaacgua

SEQ ID NO: 754898 - RNA, 14 nt, Leptospira interrogans serovar lai str. 56601
ucuaguuugaauuu

SEQ ID NO: 754899 - RNA, 17 nt, Leptospira interrogans serovar lai str. 56601
ucuaguuugaauuuagg

SEQ ID NO: 754900 - RNA, 15 nt, Leptospira interrogans serovar lai str. 56601
ucuaguuuuccuucu

SEQ ID NO: 754901 - RNA, 13 nt, Leptospira interrogans serovar lai str. 56601
ucuaguaaaaaug

SEQ ID NO: 754902 - RNA, 23 nt, Leptospira interrogans serovar lai str. 56601
ucuaguauuauuuuccuuuaaua

SEQ ID NO: 754903 - RNA, 14 nt, Leptospira interrogans serovar lai str. 56601
ucuagucaauuaaa

SEQ ID NO: 754904 - RNA, 14 nt, Leptospira interrogans serovar lai str. 56601
ucuaguccucuuuu

SEQ ID NO: 754905 - RNA, 18 nt, Leptospira interrogans serovar lai str. 56601
ucuaggaacugcuuccaa

SEQ ID NO: 754906 - RNA, 20 nt, Leptospira interrogans serovar lai str. 56601
ucuaggaacugcuuccaaaa

SEQ ID NO: 754907 - RNA, 21 nt, Leptospira interrogans serovar lai str. 56601
ucuacuuuuaaaacuuuuaau

SEQ ID NO: 754908 - RNA, 16 nt, Leptospira interrogans serovar lai str. 56601
ucuacuuuauuaaaaa

SEQ ID NO: 754909 - RNA, 18 nt, Leptospira interrogans serovar lai str. 56601
ucuacuuuauuaaaaagu

SEQ ID NO: 754910 - RNA, 23 nt, Leptospira interrogans serovar lai str. 56601
ucuacuugucuuuagaacuuguc

SEQ ID NO: 754911 - RNA, 17 nt, Leptospira interrogans serovar lai str. 56601
ucuagaaagaauuuaau

SEQ ID NO: 754912 - RNA, 23 nt, Leptospira interrogans serovar lai str. 56601
ucuagaaauaugaauuacuacaa

SEQ ID NO: 754913 - RNA, 13 nt, Leptospira interrogans serovar lai str. 56601
ucuagaaacugca

SEQ ID NO: 754914 - RNA, 21 nt, Leptospira interrogans serovar lai str. 56601
ucuagaaauuuauaauauucu

SEQ ID NO: 754915 - RNA, 17 nt, Leptospira interrogans serovar lai str. 56601
ucuagacuuucuuugaa

SEQ ID NO: 754916 - RNA, 22 nt, Leptospira interrogans serovar lai str. 56601
ucuagauuuuacgauuaaauuu

SEQ ID NO: 754917 - RNA, 14 nt, Leptospira interrogans serovar lai str. 56601
ucuauccacuaaaa

SEQ ID NO: 754918 - RNA, 19 nt, Leptospira interrogans serovar lai str. 56601
ucuauccacuaaaauacuu

SEQ ID NO: 754919 - RNA, 16 nt, Leptospira interrogans serovar lai str. 56601
ucuauccauucuagaa

SEQ ID NO: 754920 - RNA, 24 nt, Leptospira interrogans serovar lai str. 56601
ucuauagcuuuugagcaguaaaaa

SEQ ID NO: 754921 - RNA, 13 nt, Leptospira interrogans serovar lai str. 56601
ucuauauucaaaa

SEQ ID NO: 754922 - RNA, 23 nt, Leptospira interrogans serovar lai str. 56601
ucuauaucgugaaacuuuccacu

SEQ ID NO: 754923 - RNA, 12 nt, Leptospira interrogans serovar lai str. 56601
ucuaucucaaaa

SEQ ID NO: 754924 - RNA, 21 nt, Leptospira interrogans serovar lai str. 56601
ucuaucguuagguuauaauuu

SEQ ID NO: 754925 - RNA, 15 nt, Leptospira interrogans serovar lai str. 56601
ucuaugauuaaagcc

SEQ ID NO: 754926 - RNA, 19 nt, Leptospira interrogans serovar lai str. 56601
ucuaugauucugaaaaaaa

SEQ ID NO: 754927 - RNA, 16 nt, Leptospira interrogans serovar lai str. 56601
ucuaucuuuucaaaag

SEQ ID NO: 754928 - RNA, 16 nt, Leptospira interrogans serovar lai str. 56601
ucuaucuuuuuuaaaa

SEQ ID NO: 754929 - RNA, 18 nt, Leptospira interrogans serovar lai str. 56601
ucuaucuuuuuuaaaaca

SEQ ID NO: 754930 - RNA, 13 nt, Leptospira interrogans serovar lai str. 56601
ucuauuagaacau

SEQ ID NO: 754931 - RNA, 19 nt, Leptospira interrogans serovar lai str. 56601
ucuauuaugauucuauaau

SEQ ID NO: 754932 - RNA, 20 nt, Leptospira interrogans serovar lai str. 56601
ucuauuccuaaaauguggga

SEQ ID NO: 754933 - RNA, 18 nt, Leptospira interrogans serovar lai str. 56601
ucuauucauaaaugauaa

SEQ ID NO: 754934 - RNA, 14 nt, Leptospira interrogans serovar lai str. 56601
ucuauuccaaugua

SEQ ID NO: 754935 - RNA, 20 nt, Leptospira interrogans serovar lai str. 56601
ucuauucguauuuuauagaa

SEQ ID NO: 754936 - RNA, 20 nt, Leptospira interrogans serovar lai str. 56601
ucuauucuuaaaauguagga

SEQ ID NO: 754937 - RNA, 15 nt, Leptospira interrogans serovar lai str. 56601
ucuauguaagaaaau

SEQ ID NO: 754938 - RNA, 21 nt, Leptospira interrogans serovar lai str. 56601
ucuaugggaauuuuuguaaaa

SEQ ID NO: 754939 - RNA, 20 nt, Leptospira interrogans serovar lai str. 56601
ucuauuaacuuuacaucaau

SEQ ID NO: 754940 - RNA, 16 nt, Leptospira interrogans serovar lai str. 56601
ucuauuacaaaacuua

SEQ ID NO: 754941 - RNA, 16 nt, Leptospira interrogans serovar lai str. 56601
ucuaaucgaaacuaua

SEQ ID NO: 754942 - RNA, 18 nt, Leptospira interrogans serovar lai str. 56601
ucuaaucacgaaaaauga

SEQ ID NO: 754943 - RNA, 20 nt, Leptospira interrogans serovar lai str. 56601
ucuaacccauucaacaucau

SEQ ID NO: 754944 - RNA, 18 nt, Leptospira interrogans serovar lai str. 56601
ucuaaucucguuaaauuu

SEQ ID NO: 754945 - RNA, 13 nt, Leptospira interrogans serovar lai str. 56601
ucuaauauuaaaa

SEQ ID NO: 754946 - RNA, 18 nt, Leptospira interrogans serovar lai str. 56601
ucuaauauuuuaaagaaa

SEQ ID NO: 754947 - RNA, 14 nt, Leptospira interrogans serovar lai str. 56601
ucuaauauaaaaac

SEQ ID NO: 754948 - RNA, 22 nt, Leptospira interrogans serovar lai str. 56601
ucuaauauaaaaaccacaaaaa

SEQ ID NO: 754949 - RNA, 21 nt, Leptospira interrogans serovar lai str. 56601
ucuaauagucucauacuuaau

SEQ ID NO: 754950 - RNA, 22 nt, Leptospira interrogans serovar lai str. 56601
ucuaauagucucauacuuaauu

SEQ ID NO: 754951 - RNA, 20 nt, Leptospira interrogans serovar lai str. 56601
ucuaauaguugaaauucacc

SEQ ID NO: 754952 - RNA, 19 nt, Leptospira interrogans serovar lai str. 56601
ucuaauagagaaaaauuuu

SEQ ID NO: 754953 - RNA, 16 nt, Leptospira interrogans serovar lai str. 56601
ucuaauagauuuauga

SEQ ID NO: 754954 - RNA, 16 nt, Leptospira interrogans serovar lai str. 56601
ucuaauucuaaaaauu

SEQ ID NO: 754955 - RNA, 22 nt, Leptospira interrogans serovar lai str. 56601
ucuaauucuaaaaauuuuuuua

SEQ ID NO: 754956 - RNA, 20 nt, Leptospira interrogans serovar lai str. 56601
ucuaauucuucuaaugaagu

SEQ ID NO: 754957 - RNA, 17 nt, Leptospira interrogans serovar lai str. 56601
ucuacaaguucauaaga

SEQ ID NO: 754958 - RNA, 15 nt, Leptospira interrogans serovar lai str. 56601
ucuacaauaaaggaa

SEQ ID NO: 754959 - RNA, 17 nt, Leptospira interrogans serovar lai str. 56601
ucuacaauuauauuaaa

SEQ ID NO: 754960 - RNA, 23 nt, Leptospira interrogans serovar lai str. 56601
ucuaauucauuuggaucuguaau

SEQ ID NO: 754961 - RNA, 18 nt, Leptospira interrogans serovar lai str. 56601
ucuaauguacaacauccu

SEQ ID NO: 754962 - RNA, 18 nt, Leptospira interrogans serovar lai str. 56601
ucuacccacucuuugacu

SEQ ID NO: 754963 - RNA, 22 nt, Leptospira interrogans serovar lai str. 56601
ucuacaccaguauucaauucca

SEQ ID NO: 754964 - RNA, 16 nt, Leptospira interrogans serovar lai str. 56601
ucuacagauaaaaaua

SEQ ID NO: 754965 - RNA, 23 nt, Leptospira interrogans serovar lai str. 56601
ucuacgacuaacaaaaugauuuu

SEQ ID NO: 754966 - RNA, 13 nt, Leptospira interrogans serovar lai str. 56601
ucuacuaaaucag

SEQ ID NO: 754967 - RNA, 17 nt, Leptospira interrogans serovar lai str. 56601
ucuacuaagauuucuug

SEQ ID NO: 754968 - RNA, 14 nt, Leptospira interrogans serovar lai str. 56601
ucuaccccaucucu

SEQ ID NO: 754969 - RNA, 12 nt, Leptospira interrogans serovar lai str. 56601
ucguuuuaaaaa

SEQ ID NO: 754970 - RNA, 15 nt, Leptospira interrogans serovar lai str. 56601
ucguuugcuuuucua

SEQ ID NO: 754971 - RNA, 13 nt, Leptospira interrogans serovar lai str. 56601
ucguuuguaaaau

SEQ ID NO: 754972 - RNA, 22 nt, Leptospira interrogans serovar lai str. 56601
ucguuuuacugaccucuauaau

SEQ ID NO: 754973 - RNA, 15 nt, Leptospira interrogans serovar lai str. 56601
ucguuuuaucuuaga

SEQ ID NO: 754974 - RNA, 19 nt, Leptospira interrogans serovar lai str. 56601
ucguuucuuaauuuuacua

SEQ ID NO: 754975 - RNA, 19 nt, Leptospira interrogans serovar lai str. 56601
ucguucuuuuuuccuucuu

SEQ ID NO: 754976 - RNA, 13 nt, Leptospira interrogans serovar lai str. 56601
ucguguucuaaau

SEQ ID NO: 754977 - RNA, 16 nt, Leptospira interrogans serovar lai str. 56601
ucguguuguauggaaa

SEQ ID NO: 754978 - RNA, 15 nt, Leptospira interrogans serovar lai str. 56601
ucuaacauuuuauua

SEQ ID NO: 754979 - RNA, 20 nt, Leptospira interrogans serovar lai str. 56601
ucuaacauuuuauuauaaau

SEQ ID NO: 754980 - RNA, 17 nt, Leptospira interrogans serovar lai str. 56601
ucuaacaguaaaacuuu

SEQ ID NO: 754981 - RNA, 12 nt, Leptospira interrogans serovar lai str. 56601
ucuaaauuuguu

SEQ ID NO: 754982 - RNA, 22 nt, Leptospira interrogans serovar lai str. 56601
ucuaacaaaaaguguuuauaau

SEQ ID NO: 754983 - RNA, 16 nt, Leptospira interrogans serovar lai str. 56601
ucuaaauuuuacaauu

SEQ ID NO: 754984 - RNA, 16 nt, Leptospira interrogans serovar lai str. 56601
ucuaaauuuuauaaaa

SEQ ID NO: 754985 - RNA, 17 nt, Leptospira interrogans serovar lai str. 56601
ucuaaauuuuauaaaau

SEQ ID NO: 754986 - RNA, 14 nt, Leptospira interrogans serovar lai str. 56601
ucuaaauuuucuuu

SEQ ID NO: 754987 - RNA, 16 nt, Leptospira interrogans serovar lai str. 56601
ucuaaagaauuaucau

SEQ ID NO: 754988 - RNA, 15 nt, Leptospira interrogans serovar lai str. 56601
ucuaaagacuaaaaa

SEQ ID NO: 754989 - RNA, 13 nt, Leptospira interrogans serovar lai str. 56601
ucuaaaaguaaaa

SEQ ID NO: 754990 - RNA, 21 nt, Leptospira interrogans serovar lai str. 56601
ucuaaaaccuggauuugucuc

SEQ ID NO: 754991 - RNA, 16 nt, Leptospira interrogans serovar lai str. 56601
ucguuuuuaguuucaa

SEQ ID NO: 754992 - RNA, 20 nt, Leptospira interrogans serovar lai str. 56601
ucuaaaacacaucuuaaaaa

SEQ ID NO: 754993 - RNA, 20 nt, Leptospira interrogans serovar lai str. 56601
ucuaaaauacuuuugaaaua

SEQ ID NO: 754994 - RNA, 15 nt, Leptospira interrogans serovar lai str. 56601
ucuaaaauucuuccg

SEQ ID NO: 754995 - RNA, 12 nt, Leptospira interrogans serovar lai str. 56601
ucuaaaauugua

SEQ ID NO: 754996 - RNA, 20 nt, Leptospira interrogans serovar lai str. 56601
ucuaaaauuguaggaacuac

SEQ ID NO: 754997 - RNA, 15 nt, Leptospira interrogans serovar lai str. 56601
ucuaaaauuucauuu

SEQ ID NO: 754998 - RNA, 20 nt, Leptospira interrogans serovar lai str. 56601
ucuaaaauuuguaggaacuc

SEQ ID NO: 754999 - RNA, 16 nt, Leptospira interrogans serovar lai str. 56601
ucuaaacuaaaaaaaa

SEQ ID NO: 755000 - RNA, 16 nt, Leptospira interrogans serovar lai str. 56601
ucuaaacauuuaacuu

SEQ ID NO: 755001 - RNA, 19 nt, Leptospira interrogans serovar lai str. 56601
ucuaaacauuuaacuuuua

SEQ ID NO: 755002 - RNA, 20 nt, Leptospira interrogans serovar lai str. 56601
ucuaaacauuuaacuuuuau

SEQ ID NO: 755003 - RNA, 17 nt, Leptospira interrogans serovar lai str. 56601
ucuaaacaauuuuauuu

SEQ ID NO: 755004 - RNA, 20 nt, Leptospira interrogans serovar lai str. 56601
ucguggagaaauucguuuua

SEQ ID NO: 755005 - RNA, 14 nt, Leptospira interrogans serovar lai str. 56601
ucgucuucuuuuuu

SEQ ID NO: 755006 - RNA, 13 nt, Leptospira interrogans serovar lai str. 56601
ucgucuuuauaaa

SEQ ID NO: 755007 - RNA, 14 nt, Leptospira interrogans serovar lai str. 56601
ucgucuuuauaaag

SEQ ID NO: 755008 - RNA, 15 nt, Leptospira interrogans serovar lai str. 56601
ucgguuuaaaacuag

SEQ ID NO: 755009 - RNA, 14 nt, Leptospira interrogans serovar lai str. 56601
ucgguucuauaaaa

SEQ ID NO: 755010 - RNA, 21 nt, Leptospira interrogans serovar lai str. 56601
ucguaguagucccacauuuuu

SEQ ID NO: 755011 - RNA, 16 nt, Leptospira interrogans serovar lai str. 56601
ucugccauuuuuaguc

SEQ ID NO: 755012 - RNA, 18 nt, Leptospira interrogans serovar lai str. 56601
ucugccccaaaauuuaga

SEQ ID NO: 755013 - RNA, 18 nt, Leptospira interrogans serovar lai str. 56601
ucugaauuuuuauaaguu

SEQ ID NO: 755014 - RNA, 15 nt, Leptospira interrogans serovar lai str. 56601
ucugauagagaaaaa

SEQ ID NO: 755015 - RNA, 15 nt, Leptospira interrogans serovar lai str. 56601
ucugauaauuuuuua

SEQ ID NO: 755016 - RNA, 17 nt, Leptospira interrogans serovar lai str. 56601
ucugauaacuauauaac

SEQ ID NO: 755017 - RNA, 16 nt, Leptospira interrogans serovar lai str. 56601
ucugauaaagaaaacc

SEQ ID NO: 755018 - RNA, 13 nt, Leptospira interrogans serovar lai str. 56601
ucugaguagaaag

SEQ ID NO: 755019 - RNA, 18 nt, Leptospira interrogans serovar lai str. 56601
ucucgaaaaucucagaaa

SEQ ID NO: 755020 - RNA, 21 nt, Leptospira interrogans serovar lai str. 56601
ucucgaaauaucguucuagaa

SEQ ID NO: 755021 - RNA, 15 nt, Leptospira interrogans serovar lai str. 56601
ucucgcauuuuccuu

SEQ ID NO: 755022 - RNA, 21 nt, Leptospira interrogans serovar lai str. 56601
ucucgcauuuuccuuuuuccg

SEQ ID NO: 755023 - RNA, 14 nt, Leptospira interrogans serovar lai str. 56601
ucugaacuaugaaa

SEQ ID NO: 755024 - RNA, 18 nt, Leptospira interrogans serovar lai str. 56601
ucugaacuaugaaauuuu

SEQ ID NO: 755025 - RNA, 10 nt, Leptospira interrogans serovar lai str. 56601
ucugaaccug

SEQ ID NO: 755026 - RNA, 18 nt, Leptospira interrogans serovar lai str. 56601
ucugaaauuguuuuaaaa

SEQ ID NO: 755027 - RNA, 12 nt, Leptospira interrogans serovar lai str. 56601
ucugaaaucuua

SEQ ID NO: 755028 - RNA, 23 nt, Leptospira interrogans serovar lai str. 56601
ucugaaagugaaaguaaucuuuu

SEQ ID NO: 755029 - RNA, 12 nt, Leptospira interrogans serovar lai str. 56601
ucugaaauaaaa

SEQ ID NO: 755030 - RNA, 15 nt, Leptospira interrogans serovar lai str. 56601
ucugaaauagaauuu

SEQ ID NO: 755031 - RNA, 17 nt, Leptospira interrogans serovar lai str. 56601
ucugaaauagaauuuuu

SEQ ID NO: 755032 - RNA, 14 nt, Leptospira interrogans serovar lai str. 56601
ucuuaaauucuaau

SEQ ID NO: 755033 - RNA, 18 nt, Leptospira interrogans serovar lai str. 56601
ucuuaaauuuuuuuucag

SEQ ID NO: 755034 - RNA, 20 nt, Leptospira interrogans serovar lai str. 56601
ucuuaaauaucgaauuucuu

SEQ ID NO: 755035 - RNA, 21 nt, Leptospira interrogans serovar lai str. 56601
ucuuaaaaugauuuugccguu

SEQ ID NO: 755036 - RNA, 21 nt, Leptospira interrogans serovar lai str. 56601
ucuuaaaauuccgaauucuaa

SEQ ID NO: 755037 - RNA, 22 nt, Leptospira interrogans serovar lai str. 56601
ucuuaaaauuccgaauucuaaa

SEQ ID NO: 755038 - RNA, 14 nt, Leptospira interrogans serovar lai str. 56601
ucuuaaaauuguga

SEQ ID NO: 755039 - RNA, 12 nt, Leptospira interrogans serovar lai str. 56601
ucuuaaaauuua

SEQ ID NO: 755040 - RNA, 15 nt, Leptospira interrogans serovar lai str. 56601
ucuuaaaauuuagaa

SEQ ID NO: 755041 - RNA, 18 nt, Leptospira interrogans serovar lai str. 56601
ucuuaaaauuuagaaaua

SEQ ID NO: 755042 - RNA, 23 nt, Leptospira interrogans serovar lai str. 56601
ucuguuuuuagcguaaauucacu

SEQ ID NO: 755043 - RNA, 12 nt, Leptospira interrogans serovar lai str. 56601
ucuguuuuguuu

SEQ ID NO: 755044 - RNA, 14 nt, Leptospira interrogans serovar lai str. 56601
ucuuaaaaaauaca

SEQ ID NO: 755045 - RNA, 15 nt, Leptospira interrogans serovar lai str. 56601
ucuuaaaaaauauuu

SEQ ID NO: 755046 - RNA, 16 nt, Leptospira interrogans serovar lai str. 56601
ucuuaaaaacuugaau

SEQ ID NO: 755047 - RNA, 14 nt, Leptospira interrogans serovar lai str. 56601
ucuuaaaaagagua

SEQ ID NO: 755048 - RNA, 19 nt, Leptospira interrogans serovar lai str. 56601
ucuuaaaaagaguauuauc

SEQ ID NO: 755049 - RNA, 13 nt, Leptospira interrogans serovar lai str. 56601
ucuuaaaaauuua

SEQ ID NO: 755050 - RNA, 15 nt, Leptospira interrogans serovar lai str. 56601
ucuguuuuauagaau

SEQ ID NO: 755051 - RNA, 15 nt, Leptospira interrogans serovar lai str. 56601
ucuguuuauuuugaa

SEQ ID NO: 755052 - RNA, 22 nt, Leptospira interrogans serovar lai str. 56601
ucuguucgucguuuagaggaag

SEQ ID NO: 755053 - RNA, 15 nt, Leptospira interrogans serovar lai str. 56601
ucuguggacuuauga

SEQ ID NO: 755054 - RNA, 16 nt, Leptospira interrogans serovar lai str. 56601
ucuguggacuuaugag

SEQ ID NO: 755055 - RNA, 15 nt, Leptospira interrogans serovar lai str. 56601
ucuguauuuuuaagu

SEQ ID NO: 755056 - RNA, 19 nt, Leptospira interrogans serovar lai str. 56601
ucugucucuuuauauaaaa

SEQ ID NO: 755057 - RNA, 19 nt, Leptospira interrogans serovar lai str. 56601
ucuguagaaauucuauuuu

SEQ ID NO: 755058 - RNA, 13 nt, Leptospira interrogans serovar lai str. 56601
ucugcuuuuuuaa

SEQ ID NO: 755059 - RNA, 13 nt, Leptospira interrogans serovar lai str. 56601
ucugggaaccggc

SEQ ID NO: 755060 - RNA, 21 nt, Leptospira interrogans serovar lai str. 56601
ucuugcaaaaauagaauuuuu

SEQ ID NO: 755061 - RNA, 22 nt, Leptospira interrogans serovar lai str. 56601
ucuugcaaaaauagaauuuuug

SEQ ID NO: 755062 - RNA, 14 nt, Leptospira interrogans serovar lai str. 56601
ucuuuaaaauugug

SEQ ID NO: 755063 - RNA, 13 nt, Leptospira interrogans serovar lai str. 56601
ucuuuaaaauuuu

SEQ ID NO: 755064 - RNA, 22 nt, Leptospira interrogans serovar lai str. 56601
ucuuuaaaauuuuuaauaaaau

SEQ ID NO: 755065 - RNA, 23 nt, Leptospira interrogans serovar lai str. 56601
ucuuuaaaaauaggaauucgaaa

SEQ ID NO: 755066 - RNA, 22 nt, Leptospira interrogans serovar lai str. 56601
ucuuuaaaagagcgaaaugcag

SEQ ID NO: 755067 - RNA, 12 nt, Leptospira interrogans serovar lai str. 56601
ucuuuaaaauac

SEQ ID NO: 755068 - RNA, 16 nt, Leptospira interrogans serovar lai str. 56601
ucuuuaaaugugggaa

SEQ ID NO: 755069 - RNA, 15 nt, Leptospira interrogans serovar lai str. 56601
ucuuuauaaaaauga

SEQ ID NO: 755070 - RNA, 17 nt, Leptospira interrogans serovar lai str. 56601
ucuuuauaaaaaugaua

SEQ ID NO: 755071 - RNA, 13 nt, Leptospira interrogans serovar lai str. 56601
ucuuuagaaauuu

SEQ ID NO: 755072 - RNA, 14 nt, Leptospira interrogans serovar lai str. 56601
ucuuuagaaauuuu

SEQ ID NO: 755073 - RNA, 19 nt, Leptospira interrogans serovar lai str. 56601
ucuuuagaaauuuuuaauc

SEQ ID NO: 755074 - RNA, 15 nt, Leptospira interrogans serovar lai str. 56601
ucuuuagaacuuguc

SEQ ID NO: 755075 - RNA, 16 nt, Leptospira interrogans serovar lai str. 56601
ucuuuagaauuuuucg

SEQ ID NO: 755076 - RNA, 12 nt, Leptospira interrogans serovar lai str. 56601
ucuugaaauucu

SEQ ID NO: 755077 - RNA, 13 nt, Leptospira interrogans serovar lai str. 56601
ucuucuuuuucca

SEQ ID NO: 755078 - RNA, 21 nt, Leptospira interrogans serovar lai str. 56601
ucuucuuuuguuuuuauaaau

SEQ ID NO: 755079 - RNA, 17 nt, Leptospira interrogans serovar lai str. 56601
ucuugagggguuuuucc

SEQ ID NO: 755080 - RNA, 18 nt, Leptospira interrogans serovar lai str. 56601
ucuugagggguuuuuccu

SEQ ID NO: 755081 - RNA, 19 nt, Leptospira interrogans serovar lai str. 56601
ucuugagggguuuuuccuu

SEQ ID NO: 755082 - RNA, 11 nt, Leptospira interrogans serovar lai str. 56601
ucuucuuguaa

SEQ ID NO: 755083 - RNA, 13 nt, Leptospira interrogans serovar lai str. 56601
ucuucuucuagau

SEQ ID NO: 755084 - RNA, 15 nt, Leptospira interrogans serovar lai str. 56601
ucuucuguaaaacuu

SEQ ID NO: 755085 - RNA, 15 nt, Leptospira interrogans serovar lai str. 56601
ucuucuagcaaucuu

SEQ ID NO: 755086 - RNA, 12 nt, Leptospira interrogans serovar lai str. 56601
ucuucuaaauuu

SEQ ID NO: 755087 - RNA, 20 nt, Leptospira interrogans serovar lai str. 56601
ucuucggcguugaguuuuug

SEQ ID NO: 755088 - RNA, 24 nt, Leptospira interrogans serovar lai str. 56601
ucuucguuauuuuuauaaagauaa

SEQ ID NO: 755089 - RNA, 21 nt, Leptospira interrogans serovar lai str. 56601
ucuuccuuuuuaaaaccaaaa

SEQ ID NO: 755090 - RNA, 13 nt, Leptospira interrogans serovar lai str. 56601
ucuuccuucuuga

SEQ ID NO: 755091 - RNA, 14 nt, Leptospira interrogans serovar lai str. 56601
ucuuccuucuugaa

SEQ ID NO: 755092 - RNA, 23 nt, Leptospira interrogans serovar lai str. 56601
ucuuaauggaucaaaagaguuuu

SEQ ID NO: 755093 - RNA, 21 nt, Leptospira interrogans serovar lai str. 56601
ucuuaauuuguaagaguucca

SEQ ID NO: 755094 - RNA, 14 nt, Leptospira interrogans serovar lai str. 56601
ucuuaauuuuacua

SEQ ID NO: 755095 - RNA, 14 nt, Leptospira interrogans serovar lai str. 56601
ucuuaauuaaaaaa

SEQ ID NO: 755096 - RNA, 23 nt, Leptospira interrogans serovar lai str. 56601
ucuuaaguugaguucuucugcaa

SEQ ID NO: 755097 - RNA, 22 nt, Leptospira interrogans serovar lai str. 56601
ucuuaauauacuuaagcucuaa

SEQ ID NO: 755098 - RNA, 20 nt, Leptospira interrogans serovar lai str. 56601
ucuuaaaucuuagauucacu

SEQ ID NO: 755099 - RNA, 22 nt, Leptospira interrogans serovar lai str. 56601
ucuuaaaucuuagauucacuuu

SEQ ID NO: 755100 - RNA, 15 nt, Leptospira interrogans serovar lai str. 56601
ucuuaacuuuaagca

SEQ ID NO: 755101 - RNA, 19 nt, Leptospira interrogans serovar lai str. 56601
ucuuaacuuuaagcaaaga

SEQ ID NO: 755102 - RNA, 13 nt, Leptospira interrogans serovar lai str. 56601
ucuucauaucaaa

SEQ ID NO: 755103 - RNA, 22 nt, Leptospira interrogans serovar lai str. 56601
ucuucauuaaacaauuuuucaa

SEQ ID NO: 755104 - RNA, 22 nt, Leptospira interrogans serovar lai str. 56601
ucuucauuuugggauuuuauug

SEQ ID NO: 755105 - RNA, 22 nt, Leptospira interrogans serovar lai str. 56601
ucuuccgguggauuuuuuuauc

SEQ ID NO: 755106 - RNA, 22 nt, Leptospira interrogans serovar lai str. 56601
ucuuccgggaggaauuuuuaaa

SEQ ID NO: 755107 - RNA, 20 nt, Leptospira interrogans serovar lai str. 56601
uguaaaucgguucuauaaaa

SEQ ID NO: 755108 - RNA, 22 nt, Leptospira interrogans serovar lai str. 56601
uguaaauccguauacuuuaaaa

SEQ ID NO: 755109 - RNA, 11 nt, Leptospira interrogans serovar lai str. 56601
uguaacuuuua

SEQ ID NO: 755110 - RNA, 16 nt, Leptospira interrogans serovar lai str. 56601
uguaacucauauagaa

SEQ ID NO: 755111 - RNA, 15 nt, Leptospira interrogans serovar lai str. 56601
uguaauaaaaauuua

SEQ ID NO: 755112 - RNA, 23 nt, Leptospira interrogans serovar lai str. 56601
uguaauaaaaauuuaaaauacuc

SEQ ID NO: 755113 - RNA, 19 nt, Leptospira interrogans serovar lai str. 56601
uguaauaaaaauuuacaga

SEQ ID NO: 755114 - RNA, 17 nt, Leptospira interrogans serovar lai str. 56601
uguaaauauguuuuuuu

SEQ ID NO: 755115 - RNA, 19 nt, Leptospira interrogans serovar lai str. 56601
uguaaaguuuagauuuuaa

SEQ ID NO: 755116 - RNA, 15 nt, Leptospira interrogans serovar lai str. 56601
uguaaaguucuuuuc

SEQ ID NO: 755117 - RNA, 18 nt, Leptospira interrogans serovar lai str. 56601
uguaaaguucuuuucuua

SEQ ID NO: 755118 - RNA, 20 nt, Leptospira interrogans serovar lai str. 56601
uguaaaagaaaaauuaaaug

SEQ ID NO: 755119 - RNA, 18 nt, Leptospira interrogans serovar lai str. 56601
uguaaaauuuaaauuugu

SEQ ID NO: 755120 - RNA, 12 nt, Leptospira interrogans serovar lai str. 56601
uguaaaauuuag

SEQ ID NO: 755121 - RNA, 12 nt, Leptospira interrogans serovar lai str. 56601
uguaaaaugaug

SEQ ID NO: 755122 - RNA, 12 nt, Leptospira interrogans serovar lai str. 56601
uguaaacuucug

SEQ ID NO: 755123 - RNA, 20 nt, Leptospira interrogans serovar lai str. 56601
uguaaaauucagauuucagc

SEQ ID NO: 755124 - RNA, 13 nt, Leptospira interrogans serovar lai str. 56601
uguaaaaaugagu

SEQ ID NO: 755125 - RNA, 21 nt, Leptospira interrogans serovar lai str. 56601
uguaaaacccaucguaaacaa

SEQ ID NO: 755126 - RNA, 22 nt, Leptospira interrogans serovar lai str. 56601
ugguuaucauaaaaauaaagaa

SEQ ID NO: 755127 - RNA, 21 nt, Leptospira interrogans serovar lai str. 56601
uguaauauacaauaaauagaa

SEQ ID NO: 755128 - RNA, 19 nt, Leptospira interrogans serovar lai str. 56601
uguaauaguucccacaaau

SEQ ID NO: 755129 - RNA, 14 nt, Leptospira interrogans serovar lai str. 56601
uguacaucuuaaaa

SEQ ID NO: 755130 - RNA, 15 nt, Leptospira interrogans serovar lai str. 56601
uguacaucuuaaaaa

SEQ ID NO: 755131 - RNA, 12 nt, Leptospira interrogans serovar lai str. 56601
uguacaauagag

SEQ ID NO: 755132 - RNA, 14 nt, Leptospira interrogans serovar lai str. 56601
uguacguaaaaaug

SEQ ID NO: 755133 - RNA, 14 nt, Leptospira interrogans serovar lai str. 56601
uguaccauuuugau

SEQ ID NO: 755134 - RNA, 14 nt, Leptospira interrogans serovar lai str. 56601
uguacuaaaauuuu

SEQ ID NO: 755135 - RNA, 17 nt, Leptospira interrogans serovar lai str. 56601
uguacuaaaauuuuaua

SEQ ID NO: 755136 - RNA, 21 nt, Leptospira interrogans serovar lai str. 56601
uguacuaaaauuuuauaaaaa

SEQ ID NO: 755137 - RNA, 13 nt, Leptospira interrogans serovar lai str. 56601
uguacuuaaauuu

SEQ ID NO: 755138 - RNA, 16 nt, Leptospira interrogans serovar lai str. 56601
uguacuuaaauuuuau

SEQ ID NO: 755139 - RNA, 12 nt, Leptospira interrogans serovar lai str. 56601
uguauuaaaaaa

SEQ ID NO: 755140 - RNA, 20 nt, Leptospira interrogans serovar lai str. 56601
uguauggcucauuuuucuua

SEQ ID NO: 755141 - RNA, 18 nt, Leptospira interrogans serovar lai str. 56601
uguauuuuauuuuuggau

SEQ ID NO: 755142 - RNA, 14 nt, Leptospira interrogans serovar lai str. 56601
uguauuuuaaacaa

SEQ ID NO: 755143 - RNA, 15 nt, Leptospira interrogans serovar lai str. 56601
uguauuuauucaaaa

SEQ ID NO: 755144 - RNA, 14 nt, Leptospira interrogans serovar lai str. 56601
ugucacagacuucu

SEQ ID NO: 755145 - RNA, 16 nt, Leptospira interrogans serovar lai str. 56601
uguauauaaacgagua

SEQ ID NO: 755146 - RNA, 13 nt, Leptospira interrogans serovar lai str. 56601
uguauacaggaaa

SEQ ID NO: 755147 - RNA, 19 nt, Leptospira interrogans serovar lai str. 56601
uguauacaggaaacauuau

SEQ ID NO: 755148 - RNA, 18 nt, Leptospira interrogans serovar lai str. 56601
uguagagauugauauuca

SEQ ID NO: 755149 - RNA, 16 nt, Leptospira interrogans serovar lai str. 56601
uguagaaccuggauuu

SEQ ID NO: 755150 - RNA, 13 nt, Leptospira interrogans serovar lai str. 56601
uguagaauaggau

SEQ ID NO: 755151 - RNA, 13 nt, Leptospira interrogans serovar lai str. 56601
uguagaucaaauc

SEQ ID NO: 755152 - RNA, 20 nt, Leptospira interrogans serovar lai str. 56601
uguaggaauuacuacauuug

SEQ ID NO: 755153 - RNA, 13 nt, Leptospira interrogans serovar lai str. 56601
uguaggaacuacu

SEQ ID NO: 755154 - RNA, 20 nt, Leptospira interrogans serovar lai str. 56601
uguaggaacuacuaauuuau

SEQ ID NO: 755155 - RNA, 13 nt, Leptospira interrogans serovar lai str. 56601
uguaggaacucau

SEQ ID NO: 755156 - RNA, 23 nt, Leptospira interrogans serovar lai str. 56601
uguaguuuauuuuucuuuuaaaa

SEQ ID NO: 755157 - RNA, 13 nt, Leptospira interrogans serovar lai str. 56601
uguaguuucaauu

SEQ ID NO: 755158 - RNA, 18 nt, Leptospira interrogans serovar lai str. 56601
uguaguuucaauuuauua

SEQ ID NO: 755159 - RNA, 16 nt, Leptospira interrogans serovar lai str. 56601
uguauaaaguauagaa

SEQ ID NO: 755160 - RNA, 17 nt, Leptospira interrogans serovar lai str. 56601
uguauaaaagaaacaua

SEQ ID NO: 755161 - RNA, 21 nt, Leptospira interrogans serovar lai str. 56601
uguauaaaagaaacauaauac

SEQ ID NO: 755162 - RNA, 13 nt, Leptospira interrogans serovar lai str. 56601
uguaguaacuccu

SEQ ID NO: 755163 - RNA, 17 nt, Leptospira interrogans serovar lai str. 56601
uguaguaucucuuguca

SEQ ID NO: 755164 - RNA, 13 nt, Leptospira interrogans serovar lai str. 56601
uguaguauuucca

SEQ ID NO: 755165 - RNA, 13 nt, Leptospira interrogans serovar lai str. 56601
uguaguaacuacu

SEQ ID NO: 755166 - RNA, 17 nt, Leptospira interrogans serovar lai str. 56601
uggguuguuaugcaaau

SEQ ID NO: 755167 - RNA, 16 nt, Leptospira interrogans serovar lai str. 56601
uggguuucuuaaaucu

SEQ ID NO: 755168 - RNA, 13 nt, Leptospira interrogans serovar lai str. 56601
ugguaaaaauauc

SEQ ID NO: 755169 - RNA, 17 nt, Leptospira interrogans serovar lai str. 56601
uggguuuuacuaaaaaa

SEQ ID NO: 755170 - RNA, 19 nt, Leptospira interrogans serovar lai str. 56601
uggguuuuacuaaaaaaca

SEQ ID NO: 755171 - RNA, 21 nt, Leptospira interrogans serovar lai str. 56601
uggguuuuacuaaaaaacaua

SEQ ID NO: 755172 - RNA, 12 nt, Leptospira interrogans serovar lai str. 56601
ugguaguuccca

SEQ ID NO: 755173 - RNA, 23 nt, Leptospira interrogans serovar lai str. 56601
uggucgaucguuuuuugaucgua

SEQ ID NO: 755174 - RNA, 15 nt, Leptospira interrogans serovar lai str. 56601
uggucuauuacaaaa

SEQ ID NO: 755175 - RNA, 13 nt, Leptospira interrogans serovar lai str. 56601
uggguaucuaaau

SEQ ID NO: 755176 - RNA, 18 nt, Leptospira interrogans serovar lai str. 56601
ugggaucugaauuuuaua

SEQ ID NO: 755177 - RNA, 19 nt, Leptospira interrogans serovar lai str. 56601
ugggauuugaauuuaaaac

SEQ ID NO: 755178 - RNA, 17 nt, Leptospira interrogans serovar lai str. 56601
ugggcauaggaaauaau

SEQ ID NO: 755179 - RNA, 15 nt, Leptospira interrogans serovar lai str. 56601
uggcgacaaaaggau

SEQ ID NO: 755180 - RNA, 15 nt, Leptospira interrogans serovar lai str. 56601
uggccuucuggaaaa

SEQ ID NO: 755181 - RNA, 21 nt, Leptospira interrogans serovar lai str. 56601
uggccucgaaaguuuacacaa

SEQ ID NO: 755182 - RNA, 21 nt, Leptospira interrogans serovar lai str. 56601
uggcauccaggauuuucacag

SEQ ID NO: 755183 - RNA, 19 nt, Leptospira interrogans serovar lai str. 56601
uggcaggaucaaaauccgu

SEQ ID NO: 755184 - RNA, 14 nt, Leptospira interrogans serovar lai str. 56601
uggauuugauuuuu

SEQ ID NO: 755185 - RNA, 19 nt, Leptospira interrogans serovar lai str. 56601
uggauuuuuauguaauauu

SEQ ID NO: 755186 - RNA, 21 nt, Leptospira interrogans serovar lai str. 56601
uggauugccacgguuaaaugg

SEQ ID NO: 755187 - RNA, 21 nt, Leptospira interrogans serovar lai str. 56601
uggauucugcucuucuaauug

SEQ ID NO: 755188 - RNA, 23 nt, Leptospira interrogans serovar lai str. 56601
uggauugguguuguguuaguucc

SEQ ID NO: 755189 - RNA, 13 nt, Leptospira interrogans serovar lai str. 56601
uggauucaaaauu

SEQ ID NO: 755190 - RNA, 16 nt, Leptospira interrogans serovar lai str. 56601
uggaucuguaauugga

SEQ ID NO: 755191 - RNA, 12 nt, Leptospira interrogans serovar lai str. 56601
uggaugauaaaa

SEQ ID NO: 755192 - RNA, 20 nt, Leptospira interrogans serovar lai str. 56601
uggaugauauuucauucuua

SEQ ID NO: 755193 - RNA, 18 nt, Leptospira interrogans serovar lai str. 56601
uggaucauccuuuggaug

SEQ ID NO: 755194 - RNA, 16 nt, Leptospira interrogans serovar lai str. 56601
uggaucuacuaagauu

SEQ ID NO: 755195 - RNA, 17 nt, Leptospira interrogans serovar lai str. 56601
uggaucuacuaagauuu

SEQ ID NO: 755196 - RNA, 16 nt, Leptospira interrogans serovar lai str. 56601
uggaucgguuuuagaa

SEQ ID NO: 755197 - RNA, 18 nt, Leptospira interrogans serovar lai str. 56601
uggaguggagauuuugca

SEQ ID NO: 755198 - RNA, 19 nt, Leptospira interrogans serovar lai str. 56601
uggaucaaaaccauuuuug

SEQ ID NO: 755199 - RNA, 15 nt, Leptospira interrogans serovar lai str. 56601
uggaucaaaagaguu

SEQ ID NO: 755200 - RNA, 15 nt, Leptospira interrogans serovar lai str. 56601
uggacuauuuuauua

SEQ ID NO: 755201 - RNA, 19 nt, Leptospira interrogans serovar lai str. 56601
uggacucauaacgugacaa

SEQ ID NO: 755202 - RNA, 14 nt, Leptospira interrogans serovar lai str. 56601
uggagaaaacgaga

SEQ ID NO: 755203 - RNA, 17 nt, Leptospira interrogans serovar lai str. 56601
uggagaaaucuguuuua

SEQ ID NO: 755204 - RNA, 17 nt, Leptospira interrogans serovar lai str. 56601
uggagaauuaauuuuuc

SEQ ID NO: 755205 - RNA, 21 nt, Leptospira interrogans serovar lai str. 56601
uggagaauuaauuuuuuaaaa

SEQ ID NO: 755206 - RNA, 15 nt, Leptospira interrogans serovar lai str. 56601
uggagaauucauuuu

SEQ ID NO: 755207 - RNA, 17 nt, Leptospira interrogans serovar lai str. 56601
uggagcguucaacagau

SEQ ID NO: 755208 - RNA, 17 nt, Leptospira interrogans serovar lai str. 56601
uggaguauuuuuuccug

SEQ ID NO: 755209 - RNA, 14 nt, Leptospira interrogans serovar lai str. 56601
uguuuuaguucaaa

SEQ ID NO: 755210 - RNA, 20 nt, Leptospira interrogans serovar lai str. 56601
uguuuuaguucaaaaacauc

SEQ ID NO: 755211 - RNA, 11 nt, Leptospira interrogans serovar lai str. 56601
uguuuuaaaac

SEQ ID NO: 755212 - RNA, 19 nt, Leptospira interrogans serovar lai str. 56601
uguuuuaaugaaaaauuuc

SEQ ID NO: 755213 - RNA, 16 nt, Leptospira interrogans serovar lai str. 56601
uguuugucuuuuucua

SEQ ID NO: 755214 - RNA, 13 nt, Leptospira interrogans serovar lai str. 56601
uguuuguaaaauu

SEQ ID NO: 755215 - RNA, 14 nt, Leptospira interrogans serovar lai str. 56601
uguuuucuacaaau

SEQ ID NO: 755216 - RNA, 23 nt, Leptospira interrogans serovar lai str. 56601
uguuuucuacaaauaaaacuucu

SEQ ID NO: 755217 - RNA, 16 nt, Leptospira interrogans serovar lai str. 56601
uguuuugcucuaaaau

SEQ ID NO: 755218 - RNA, 20 nt, Leptospira interrogans serovar lai str. 56601
uguuuugcucuaaaauaauu

SEQ ID NO: 755219 - RNA, 14 nt, Leptospira interrogans serovar lai str. 56601
uguuuuauucuaaa

SEQ ID NO: 755220 - RNA, 23 nt, Leptospira interrogans serovar lai str. 56601
uguuuuauucuaaacaaaauguc

SEQ ID NO: 755221 - RNA, 14 nt, Leptospira interrogans serovar lai str. 56601
uguuucuguuugau

SEQ ID NO: 755222 - RNA, 20 nt, Leptospira interrogans serovar lai str. 56601
uguuucuugugucaagcccu

SEQ ID NO: 755223 - RNA, 15 nt, Leptospira interrogans serovar lai str. 56601
uguuucuauuuuaug

SEQ ID NO: 755224 - RNA, 19 nt, Leptospira interrogans serovar lai str. 56601
uguuucuauuuuauguaaa

SEQ ID NO: 755225 - RNA, 18 nt, Leptospira interrogans serovar lai str. 56601
uguuucgacguaaaaaua

SEQ ID NO: 755226 - RNA, 12 nt, Leptospira interrogans serovar lai str. 56601
uguuucuaaaac

SEQ ID NO: 755227 - RNA, 13 nt, Leptospira interrogans serovar lai str. 56601
uguuugaauuuuu

SEQ ID NO: 755228 - RNA, 23 nt, Leptospira interrogans serovar lai str. 56601
uguuugaauuuuuaagaauaauu

SEQ ID NO: 755229 - RNA, 14 nt, Leptospira interrogans serovar lai str. 56601
uguuuauaauuuuu

SEQ ID NO: 755230 - RNA, 19 nt, Leptospira interrogans serovar lai str. 56601
uguuuaggaauuuuuuaaa

SEQ ID NO: 755231 - RNA, 19 nt, Leptospira interrogans serovar lai str. 56601
uguuuacccgauauuaaaa

SEQ ID NO: 755232 - RNA, 18 nt, Leptospira interrogans serovar lai str. 56601
uguuuagaauauuuucuc

SEQ ID NO: 755233 - RNA, 18 nt, Leptospira interrogans serovar lai str. 56601
uguuuaaauagauucaaa

SEQ ID NO: 755234 - RNA, 17 nt, Leptospira interrogans serovar lai str. 56601
uguuuaauaccuaauuc

SEQ ID NO: 755235 - RNA, 15 nt, Leptospira interrogans serovar lai str. 56601
uguuuaauuucuuca

SEQ ID NO: 755236 - RNA, 15 nt, Leptospira interrogans serovar lai str. 56601
uguuuaauuuuaaag

SEQ ID NO: 755237 - RNA, 14 nt, Leptospira interrogans serovar lai str. 56601
uguuuauuuugaau

SEQ ID NO: 755238 - RNA, 22 nt, Leptospira interrogans serovar lai str. 56601
uguuucaagacaacagaacaaa

SEQ ID NO: 755239 - RNA, 17 nt, Leptospira interrogans serovar lai str. 56601
uguuucgcuaaagugug

SEQ ID NO: 755240 - RNA, 20 nt, Leptospira interrogans serovar lai str. 56601
uguuuccuucuuucugaaau

SEQ ID NO: 755241 - RNA, 20 nt, Leptospira interrogans serovar lai str. 56601
uguuuccucuugaagauuua

SEQ ID NO: 755242 - RNA, 19 nt, Leptospira interrogans serovar lai str. 56601
uguuucccaguucuuaaau

SEQ ID NO: 755243 - RNA, 21 nt, Leptospira interrogans serovar lai str. 56601
uguuucccaguucuuaaauaa

SEQ ID NO: 755244 - RNA, 18 nt, Leptospira interrogans serovar lai str. 56601
uguuucaguauucuagaa

SEQ ID NO: 755245 - RNA, 14 nt, Leptospira interrogans serovar lai str. 56601
uuaaacuuugaaaa

SEQ ID NO: 755246 - RNA, 16 nt, Leptospira interrogans serovar lai str. 56601
uuaaacuucaaaaaau

SEQ ID NO: 755247 - RNA, 15 nt, Leptospira interrogans serovar lai str. 56601
uuaaacucauucuag

SEQ ID NO: 755248 - RNA, 22 nt, Leptospira interrogans serovar lai str. 56601
uuaaaauuucccgauucucaaa

SEQ ID NO: 755249 - RNA, 18 nt, Leptospira interrogans serovar lai str. 56601
uuaaacguuuauuucaaa

SEQ ID NO: 755250 - RNA, 22 nt, Leptospira interrogans serovar lai str. 56601
uuaaacguuuauuucaaaauuu

SEQ ID NO: 755251 - RNA, 14 nt, Leptospira interrogans serovar lai str. 56601
uuaaauaaaaagaa

SEQ ID NO: 755252 - RNA, 18 nt, Leptospira interrogans serovar lai str. 56601
uuaaaguuuacaucaaaa

SEQ ID NO: 755253 - RNA, 15 nt, Leptospira interrogans serovar lai str. 56601
uuaaagcauuaaaaa

SEQ ID NO: 755254 - RNA, 16 nt, Leptospira interrogans serovar lai str. 56601
uuaaagauuugcucuu

SEQ ID NO: 755255 - RNA, 18 nt, Leptospira interrogans serovar lai str. 56601
uuaaaagccauuucaaaa

SEQ ID NO: 755256 - RNA, 20 nt, Leptospira interrogans serovar lai str. 56601
uuaaaagagcgaaaugcaga

SEQ ID NO: 755257 - RNA, 18 nt, Leptospira interrogans serovar lai str. 56601
uuaaaagaaacuuaauaa

SEQ ID NO: 755258 - RNA, 19 nt, Leptospira interrogans serovar lai str. 56601
uuaaaagaaacuuaauaaa

SEQ ID NO: 755259 - RNA, 20 nt, Leptospira interrogans serovar lai str. 56601
uuaaaagaauauuucuaaaa

SEQ ID NO: 755260 - RNA, 15 nt, Leptospira interrogans serovar lai str. 56601
uuaaaaggguuuuua

SEQ ID NO: 755261 - RNA, 18 nt, Leptospira interrogans serovar lai str. 56601
uuaaaaggguuuuuacaa

SEQ ID NO: 755262 - RNA, 22 nt, Leptospira interrogans serovar lai str. 56601
uuaaaaguagaaucaucucaaa

SEQ ID NO: 755263 - RNA, 20 nt, Leptospira interrogans serovar lai str. 56601
uuaaaaucuaucucaaaaau

SEQ ID NO: 755264 - RNA, 13 nt, Leptospira interrogans serovar lai str. 56601
uuaaaaucacaaa

SEQ ID NO: 755265 - RNA, 21 nt, Leptospira interrogans serovar lai str. 56601
uuaaaaucacaaaaaagauaa

SEQ ID NO: 755266 - RNA, 19 nt, Leptospira interrogans serovar lai str. 56601
uuaaaaucguaaaaaagau

SEQ ID NO: 755267 - RNA, 20 nt, Leptospira interrogans serovar lai str. 56601
uuaaaaucguaaaaaagaua

SEQ ID NO: 755268 - RNA, 21 nt, Leptospira interrogans serovar lai str. 56601
uuaaaaucguaaaaaagauaa

SEQ ID NO: 755269 - RNA, 23 nt, Leptospira interrogans serovar lai str. 56601
uuaaaaucguaaaaaagauaaaa

SEQ ID NO: 755270 - RNA, 14 nt, Leptospira interrogans serovar lai str. 56601
uuaaaauuuagaaa

SEQ ID NO: 755271 - RNA, 12 nt, Leptospira interrogans serovar lai str. 56601
uuaaaauuuaug

SEQ ID NO: 755272 - RNA, 14 nt, Leptospira interrogans serovar lai str. 56601
uuaaacguauaaaa

SEQ ID NO: 755273 - RNA, 21 nt, Leptospira interrogans serovar lai str. 56601
uuaaaauuagauuuauugaaa

SEQ ID NO: 755274 - RNA, 12 nt, Leptospira interrogans serovar lai str. 56601
uuaaaauguagg

SEQ ID NO: 755275 - RNA, 18 nt, Leptospira interrogans serovar lai str. 56601
uuaaaauuaaugaauaac

SEQ ID NO: 755276 - RNA, 15 nt, Leptospira interrogans serovar lai str. 56601
uuaaaaauuuaauuu

SEQ ID NO: 755277 - RNA, 22 nt, Leptospira interrogans serovar lai str. 56601
uuaaaaauucaacuaaauccuu

SEQ ID NO: 755278 - RNA, 16 nt, Leptospira interrogans serovar lai str. 56601
uuaaaaauucuuaaua

SEQ ID NO: 755279 - RNA, 18 nt, Leptospira interrogans serovar lai str. 56601
uuaaaaauaguauuuugu

SEQ ID NO: 755280 - RNA, 12 nt, Leptospira interrogans serovar lai str. 56601
uuaaaaauaccg

SEQ ID NO: 755281 - RNA, 13 nt, Leptospira interrogans serovar lai str. 56601
uuaaaacauuucg

SEQ ID NO: 755282 - RNA, 11 nt, Leptospira interrogans serovar lai str. 56601
uuaaaacucac

SEQ ID NO: 755283 - RNA, 19 nt, Leptospira interrogans serovar lai str. 56601
uuaaaacucacaucucuuu

SEQ ID NO: 755284 - RNA, 17 nt, Leptospira interrogans serovar lai str. 56601
uuaaaacgaauugauaa

SEQ ID NO: 755285 - RNA, 10 nt, Leptospira interrogans serovar lai str. 56601
uuaaaaagaa

SEQ ID NO: 755286 - RNA, 18 nt, Leptospira interrogans serovar lai str. 56601
uuaaaaagcucaucucau

SEQ ID NO: 755287 - RNA, 21 nt, Leptospira interrogans serovar lai str. 56601
uuaaaaaccgucccaaaacaa

SEQ ID NO: 755288 - RNA, 21 nt, Leptospira interrogans serovar lai str. 56601
uuaaaaaccuaguguuuaauu

SEQ ID NO: 755289 - RNA, 21 nt, Leptospira interrogans serovar lai str. 56601
uuaaaaacucuaccuuuauuu

SEQ ID NO: 755290 - RNA, 19 nt, Leptospira interrogans serovar lai str. 56601
uuaaaaaaugaauuuuuca

SEQ ID NO: 755291 - RNA, 20 nt, Leptospira interrogans serovar lai str. 56601
uuaaaaaaugaauuuuucau

SEQ ID NO: 755292 - RNA, 13 nt, Leptospira interrogans serovar lai str. 56601
uuaaaaaauuaau

SEQ ID NO: 755293 - RNA, 14 nt, Leptospira interrogans serovar lai str. 56601
uuaaaaaauuuaua

SEQ ID NO: 755294 - RNA, 13 nt, Leptospira interrogans serovar lai str. 56601
uguuuuuuccagc

SEQ ID NO: 755295 - RNA, 23 nt, Leptospira interrogans serovar lai str. 56601
uguuuuuuccgguaauuauaauu

SEQ ID NO: 755296 - RNA, 13 nt, Leptospira interrogans serovar lai str. 56601
uguuuuuuuggau

SEQ ID NO: 755297 - RNA, 14 nt, Leptospira interrogans serovar lai str. 56601
uguuuuuuuggaua

SEQ ID NO: 755298 - RNA, 20 nt, Leptospira interrogans serovar lai str. 56601
uguuuuuuagaaaauucaaa

SEQ ID NO: 755299 - RNA, 14 nt, Leptospira interrogans serovar lai str. 56601
uguuuuuuauauaa

SEQ ID NO: 755300 - RNA, 14 nt, Leptospira interrogans serovar lai str. 56601
uguuuuuuauggaa

SEQ ID NO: 755301 - RNA, 15 nt, Leptospira interrogans serovar lai str. 56601
uguuuuuuauggaaa

SEQ ID NO: 755302 - RNA, 14 nt, Leptospira interrogans serovar lai str. 56601
uguuuuuuauuuaa

SEQ ID NO: 755303 - RNA, 20 nt, Leptospira interrogans serovar lai str. 56601
uuaaaaaagagaaagaaaaa

SEQ ID NO: 755304 - RNA, 21 nt, Leptospira interrogans serovar lai str. 56601
uuaaaaaagagaaagaaaaag

SEQ ID NO: 755305 - RNA, 12 nt, Leptospira interrogans serovar lai str. 56601
uuaaaaaacuau

SEQ ID NO: 755306 - RNA, 17 nt, Leptospira interrogans serovar lai str. 56601
uuaaaaaaaugauuucc

SEQ ID NO: 755307 - RNA, 21 nt, Leptospira interrogans serovar lai str. 56601
uguuuuucuugcuaacauccc

SEQ ID NO: 755308 - RNA, 21 nt, Leptospira interrogans serovar lai str. 56601
uguuuuucacaaguuaaauug

SEQ ID NO: 755309 - RNA, 16 nt, Leptospira interrogans serovar lai str. 56601
uguuuuguuuccuucu

SEQ ID NO: 755310 - RNA, 22 nt, Leptospira interrogans serovar lai str. 56601
uguuuuggcucuugcuaaaauu

SEQ ID NO: 755311 - RNA, 18 nt, Leptospira interrogans serovar lai str. 56601
uguuuuguagagucaaaa

SEQ ID NO: 755312 - RNA, 19 nt, Leptospira interrogans serovar lai str. 56601
uguuuuuauaaauaaaaga

SEQ ID NO: 755313 - RNA, 22 nt, Leptospira interrogans serovar lai str. 56601
uguuuuuauaucuuaauuaaaa

SEQ ID NO: 755314 - RNA, 17 nt, Leptospira interrogans serovar lai str. 56601
uguuuugugauaaaauu

SEQ ID NO: 755315 - RNA, 15 nt, Leptospira interrogans serovar lai str. 56601
uguuuuuaaaauugu

SEQ ID NO: 755316 - RNA, 18 nt, Leptospira interrogans serovar lai str. 56601
uguuuuuaaauuaauauu

SEQ ID NO: 755317 - RNA, 15 nt, Leptospira interrogans serovar lai str. 56601
uguuguuauggaauu

SEQ ID NO: 755318 - RNA, 13 nt, Leptospira interrogans serovar lai str. 56601
uguuguuuaaaau

SEQ ID NO: 755319 - RNA, 19 nt, Leptospira interrogans serovar lai str. 56601
uguucuccaacuuacauua

SEQ ID NO: 755320 - RNA, 17 nt, Leptospira interrogans serovar lai str. 56601
uguugcuccuugcuguc

SEQ ID NO: 755321 - RNA, 16 nt, Leptospira interrogans serovar lai str. 56601
uguugcaauacauucu

SEQ ID NO: 755322 - RNA, 18 nt, Leptospira interrogans serovar lai str. 56601
uguucgugaaauugugau

SEQ ID NO: 755323 - RNA, 14 nt, Leptospira interrogans serovar lai str. 56601
uguucguucccaca

SEQ ID NO: 755324 - RNA, 11 nt, Leptospira interrogans serovar lai str. 56601
uguucuaaauu

SEQ ID NO: 755325 - RNA, 14 nt, Leptospira interrogans serovar lai str. 56601
uguucuaaauugaa

SEQ ID NO: 755326 - RNA, 21 nt, Leptospira interrogans serovar lai str. 56601
uguuccgcuguaguaucucuu

SEQ ID NO: 755327 - RNA, 16 nt, Leptospira interrogans serovar lai str. 56601
uguuccuauaaaugug

SEQ ID NO: 755328 - RNA, 19 nt, Leptospira interrogans serovar lai str. 56601
uguuccuauaaauguggua

SEQ ID NO: 755329 - RNA, 12 nt, Leptospira interrogans serovar lai str. 56601
uguuaugcaaau

SEQ ID NO: 755330 - RNA, 15 nt, Leptospira interrogans serovar lai str. 56601
uguuaugcaaauaca

SEQ ID NO: 755331 - RNA, 21 nt, Leptospira interrogans serovar lai str. 56601
uguuauggcaggaucaaaauc

SEQ ID NO: 755332 - RNA, 13 nt, Leptospira interrogans serovar lai str. 56601
uguguuucuaauu

SEQ ID NO: 755333 - RNA, 16 nt, Leptospira interrogans serovar lai str. 56601
ugugguaguucccaca

SEQ ID NO: 755334 - RNA, 16 nt, Leptospira interrogans serovar lai str. 56601
ugugguaguuccuacg

SEQ ID NO: 755335 - RNA, 15 nt, Leptospira interrogans serovar lai str. 56601
uguguuuuuuaacau

SEQ ID NO: 755336 - RNA, 21 nt, Leptospira interrogans serovar lai str. 56601
uguuaaaagauuuguuuuaua

SEQ ID NO: 755337 - RNA, 20 nt, Leptospira interrogans serovar lai str. 56601
uguuaaaauaaaaaaauuga

SEQ ID NO: 755338 - RNA, 22 nt, Leptospira interrogans serovar lai str. 56601
uguuaaacuagauuauugaucu

SEQ ID NO: 755339 - RNA, 17 nt, Leptospira interrogans serovar lai str. 56601
uguuaaccaaaaauuca

SEQ ID NO: 755340 - RNA, 16 nt, Leptospira interrogans serovar lai str. 56601
ugugcuauauucaaaa

SEQ ID NO: 755341 - RNA, 23 nt, Leptospira interrogans serovar lai str. 56601
uguggggcgggaacuaaguuuua

SEQ ID NO: 755342 - RNA, 15 nt, Leptospira interrogans serovar lai str. 56601
ugugggaacuaccac

SEQ ID NO: 755343 - RNA, 20 nt, Leptospira interrogans serovar lai str. 56601
ugugggaacuaccacaaaac

SEQ ID NO: 755344 - RNA, 19 nt, Leptospira interrogans serovar lai str. 56601
ugugggaacuauaauaaca

SEQ ID NO: 755345 - RNA, 22 nt, Leptospira interrogans serovar lai str. 56601
ugugggaacuaucacaaaucua

SEQ ID NO: 755346 - RNA, 15 nt, Leptospira interrogans serovar lai str. 56601
ugugggaacuauuac

SEQ ID NO: 755347 - RNA, 14 nt, Leptospira interrogans serovar lai str. 56601
ugugggaacucaca

SEQ ID NO: 755348 - RNA, 23 nt, Leptospira interrogans serovar lai str. 56601
ugugggaacucccacuuuuaaag

SEQ ID NO: 755349 - RNA, 17 nt, Leptospira interrogans serovar lai str. 56601
ugugggaacucucacaa

SEQ ID NO: 755350 - RNA, 21 nt, Leptospira interrogans serovar lai str. 56601
ugugggaacucucacaaauca

SEQ ID NO: 755351 - RNA, 20 nt, Leptospira interrogans serovar lai str. 56601
ugugggaacucuuacauuuu

SEQ ID NO: 755352 - RNA, 16 nt, Leptospira interrogans serovar lai str. 56601
ugugacuuuaauuuua

SEQ ID NO: 755353 - RNA, 19 nt, Leptospira interrogans serovar lai str. 56601
ugucaccguuuauucucca

SEQ ID NO: 755354 - RNA, 16 nt, Leptospira interrogans serovar lai str. 56601
ugugccuucguuuaaa

SEQ ID NO: 755355 - RNA, 21 nt, Leptospira interrogans serovar lai str. 56601
ugugccuucguuuaaaaaacg

SEQ ID NO: 755356 - RNA, 12 nt, Leptospira interrogans serovar lai str. 56601
uuaaaucucauu

SEQ ID NO: 755357 - RNA, 14 nt, Leptospira interrogans serovar lai str. 56601
uuaaaucuuuaaaa

SEQ ID NO: 755358 - RNA, 21 nt, Leptospira interrogans serovar lai str. 56601
uuaaauccaacuuaaaacugu

SEQ ID NO: 755359 - RNA, 18 nt, Leptospira interrogans serovar lai str. 56601
uuaacucguuagagaaaa

SEQ ID NO: 755360 - RNA, 15 nt, Leptospira interrogans serovar lai str. 56601
uuaacucuuaaauuu

SEQ ID NO: 755361 - RNA, 17 nt, Leptospira interrogans serovar lai str. 56601
uuaacucuuaaauuucg

SEQ ID NO: 755362 - RNA, 22 nt, Leptospira interrogans serovar lai str. 56601
uuaacuguaauuagaggauaaa

SEQ ID NO: 755363 - RNA, 19 nt, Leptospira interrogans serovar lai str. 56601
uuaagaacaauuuaaaaua

SEQ ID NO: 755364 - RNA, 20 nt, Leptospira interrogans serovar lai str. 56601
uuaagaacaauuuaaaauaa

SEQ ID NO: 755365 - RNA, 21 nt, Leptospira interrogans serovar lai str. 56601
uuaagagaugugaguuuuaaa

SEQ ID NO: 755366 - RNA, 15 nt, Leptospira interrogans serovar lai str. 56601
uuaagacccuaaaaa

SEQ ID NO: 755367 - RNA, 16 nt, Leptospira interrogans serovar lai str. 56601
uuaagacccuaaaaaa

SEQ ID NO: 755368 - RNA, 20 nt, Leptospira interrogans serovar lai str. 56601
uuaagacccuaaaaaauuuu

SEQ ID NO: 755369 - RNA, 17 nt, Leptospira interrogans serovar lai str. 56601
uuaagacaaacuuuuag

SEQ ID NO: 755370 - RNA, 21 nt, Leptospira interrogans serovar lai str. 56601
uuaagacaaacuuuuagauaa

SEQ ID NO: 755371 - RNA, 13 nt, Leptospira interrogans serovar lai str. 56601
uuaagaauacugg

SEQ ID NO: 755372 - RNA, 13 nt, Leptospira interrogans serovar lai str. 56601
uuaagaauaaaua

SEQ ID NO: 755373 - RNA, 21 nt, Leptospira interrogans serovar lai str. 56601
uuaagaauaaauaaugaaaac

SEQ ID NO: 755374 - RNA, 19 nt, Leptospira interrogans serovar lai str. 56601
uuaaguauuguuaagauaa

SEQ ID NO: 755375 - RNA, 22 nt, Leptospira interrogans serovar lai str. 56601
uuaaguauuguuaagauaaauu

SEQ ID NO: 755376 - RNA, 22 nt, Leptospira interrogans serovar lai str. 56601
uuaagucguuguauuuuaaaca

SEQ ID NO: 755377 - RNA, 15 nt, Leptospira interrogans serovar lai str. 56601
uuaaguacuuaauuu

SEQ ID NO: 755378 - RNA, 18 nt, Leptospira interrogans serovar lai str. 56601
uuaauauaaaaaauaaua

SEQ ID NO: 755379 - RNA, 21 nt, Leptospira interrogans serovar lai str. 56601
uuaauauaaaaaauaauauua

SEQ ID NO: 755380 - RNA, 21 nt, Leptospira interrogans serovar lai str. 56601
uuaauaguuuauacuuuaaua

SEQ ID NO: 755381 - RNA, 22 nt, Leptospira interrogans serovar lai str. 56601
uuaauaguuuauacuuuaauaa

SEQ ID NO: 755382 - RNA, 22 nt, Leptospira interrogans serovar lai str. 56601
uuaauaggauuuuagaaugaga

SEQ ID NO: 755383 - RNA, 13 nt, Leptospira interrogans serovar lai str. 56601
uuaauacaaaaaa

SEQ ID NO: 755384 - RNA, 14 nt, Leptospira interrogans serovar lai str. 56601
uuaauacaaaaaac

SEQ ID NO: 755385 - RNA, 15 nt, Leptospira interrogans serovar lai str. 56601
uuaauaauucaaaau

SEQ ID NO: 755386 - RNA, 19 nt, Leptospira interrogans serovar lai str. 56601
uuaauacaguauuucgucu

SEQ ID NO: 755387 - RNA, 10 nt, Leptospira interrogans serovar lai str. 56601
uuaaucaaau

SEQ ID NO: 755388 - RNA, 21 nt, Leptospira interrogans serovar lai str. 56601
uuaauauuuucagaagucuuu

SEQ ID NO: 755389 - RNA, 17 nt, Leptospira interrogans serovar lai str. 56601
uuaauauucaacuuuuu

SEQ ID NO: 755390 - RNA, 17 nt, Leptospira interrogans serovar lai str. 56601
uuaauauuuauaaaaca

SEQ ID NO: 755391 - RNA, 15 nt, Leptospira interrogans serovar lai str. 56601
uuaauauuuauaaua

SEQ ID NO: 755392 - RNA, 19 nt, Leptospira interrogans serovar lai str. 56601
uuaauauuacauucaauaa

SEQ ID NO: 755393 - RNA, 17 nt, Leptospira interrogans serovar lai str. 56601
uuaaucaugugaauuca

SEQ ID NO: 755394 - RNA, 21 nt, Leptospira interrogans serovar lai str. 56601
uuaaucaugugaauucagaaa

SEQ ID NO: 755395 - RNA, 23 nt, Leptospira interrogans serovar lai str. 56601
uuaaucaugugaauucagaaaaa

SEQ ID NO: 755396 - RNA, 14 nt, Leptospira interrogans serovar lai str. 56601
uuaauuucuucaua

SEQ ID NO: 755397 - RNA, 13 nt, Leptospira interrogans serovar lai str. 56601
uuaauuuuaaaga

SEQ ID NO: 755398 - RNA, 14 nt, Leptospira interrogans serovar lai str. 56601
uuaauuuuaaagaa

SEQ ID NO: 755399 - RNA, 14 nt, Leptospira interrogans serovar lai str. 56601
uuaauuuuaguaaa

SEQ ID NO: 755400 - RNA, 19 nt, Leptospira interrogans serovar lai str. 56601
uuaauuuguaagaguucca

SEQ ID NO: 755401 - RNA, 23 nt, Leptospira interrogans serovar lai str. 56601
uuaauuucuaaacaauuuuauuu

SEQ ID NO: 755402 - RNA, 16 nt, Leptospira interrogans serovar lai str. 56601
uuaauuucucuuauua

SEQ ID NO: 755403 - RNA, 18 nt, Leptospira interrogans serovar lai str. 56601
uuaauuuuccuauuuucg

SEQ ID NO: 755404 - RNA, 19 nt, Leptospira interrogans serovar lai str. 56601
uuaauuuucgauuuaauau

SEQ ID NO: 755405 - RNA, 22 nt, Leptospira interrogans serovar lai str. 56601
uuaauuuucgauuuaauauauu

SEQ ID NO: 755406 - RNA, 12 nt, Leptospira interrogans serovar lai str. 56601
uuaauuuuauuu

SEQ ID NO: 755407 - RNA, 17 nt, Leptospira interrogans serovar lai str. 56601
uuaauuuuucaacaauu

SEQ ID NO: 755408 - RNA, 23 nt, Leptospira interrogans serovar lai str. 56601
uuaauuuuucaacaauucuauua

SEQ ID NO: 755409 - RNA, 19 nt, Leptospira interrogans serovar lai str. 56601
uuacaaaaaaugaauuuag

SEQ ID NO: 755410 - RNA, 17 nt, Leptospira interrogans serovar lai str. 56601
uuaauuuuuuaaaaauu

SEQ ID NO: 755411 - RNA, 15 nt, Leptospira interrogans serovar lai str. 56601
uuaauuuuuagaaga

SEQ ID NO: 755412 - RNA, 12 nt, Leptospira interrogans serovar lai str. 56601
uuaauucuccau

SEQ ID NO: 755413 - RNA, 17 nt, Leptospira interrogans serovar lai str. 56601
uuaauucuccauuuguu

SEQ ID NO: 755414 - RNA, 13 nt, Leptospira interrogans serovar lai str. 56601
uuaauucuaaauc

SEQ ID NO: 755415 - RNA, 17 nt, Leptospira interrogans serovar lai str. 56601
uuaauuacaguuaauaa

SEQ ID NO: 755416 - RNA, 17 nt, Leptospira interrogans serovar lai str. 56601
uuaaucuaagauccaaa

SEQ ID NO: 755417 - RNA, 22 nt, Leptospira interrogans serovar lai str. 56601
uuaccagaccucucuuuuaauu

SEQ ID NO: 755418 - RNA, 23 nt, Leptospira interrogans serovar lai str. 56601
uuaccacagugaaagauuaaaga

SEQ ID NO: 755419 - RNA, 23 nt, Leptospira interrogans serovar lai str. 56601
uuacauaaguucgguguaaaaaa

SEQ ID NO: 755420 - RNA, 23 nt, Leptospira interrogans serovar lai str. 56601
uuacaguaaaaucuaaauuugua

SEQ ID NO: 755421 - RNA, 18 nt, Leptospira interrogans serovar lai str. 56601
uuacaauggaaaguguua

SEQ ID NO: 755422 - RNA, 20 nt, Leptospira interrogans serovar lai str. 56601
uuacaauggaaaguguuagu

SEQ ID NO: 755423 - RNA, 14 nt, Leptospira interrogans serovar lai str. 56601
uuacaauuuauuau

SEQ ID NO: 755424 - RNA, 15 nt, Leptospira interrogans serovar lai str. 56601
uuaccggguuccauu

SEQ ID NO: 755425 - RNA, 14 nt, Leptospira interrogans serovar lai str. 56601
uuaccuaaaauuca

SEQ ID NO: 755426 - RNA, 19 nt, Leptospira interrogans serovar lai str. 56601
uuacccugguuucaaaaaa

SEQ ID NO: 755427 - RNA, 16 nt, Leptospira interrogans serovar lai str. 56601
uuaccgauaagucuag

SEQ ID NO: 755428 - RNA, 20 nt, Leptospira interrogans serovar lai str. 56601
uuagcaaauuuacuucaauu

SEQ ID NO: 755429 - RNA, 20 nt, Leptospira interrogans serovar lai str. 56601
uuagcaauuugugaacuuuc

SEQ ID NO: 755430 - RNA, 14 nt, Leptospira interrogans serovar lai str. 56601
uuagcaccuuuuuu

SEQ ID NO: 755431 - RNA, 21 nt, Leptospira interrogans serovar lai str. 56601
uuagcauuuuuaagauuacau

SEQ ID NO: 755432 - RNA, 23 nt, Leptospira interrogans serovar lai str. 56601
uuaggcccgaauuuuaaauauua

SEQ ID NO: 755433 - RNA, 19 nt, Leptospira interrogans serovar lai str. 56601
uuaggauuuuaugaaaguu

SEQ ID NO: 755434 - RNA, 22 nt, Leptospira interrogans serovar lai str. 56601
uuaggcaauauuauuuuaacuu

SEQ ID NO: 755435 - RNA, 17 nt, Leptospira interrogans serovar lai str. 56601
uuaggaacuuuuauaau

SEQ ID NO: 755436 - RNA, 14 nt, Leptospira interrogans serovar lai str. 56601
uuaggaagaaacaa

SEQ ID NO: 755437 - RNA, 19 nt, Leptospira interrogans serovar lai str. 56601
uuagcugaaauuaauuccu

SEQ ID NO: 755438 - RNA, 19 nt, Leptospira interrogans serovar lai str. 56601
uuagcguguaugguaaaaa

SEQ ID NO: 755439 - RNA, 20 nt, Leptospira interrogans serovar lai str. 56601
uuagcuaagucuuuaaaaau

SEQ ID NO: 755440 - RNA, 23 nt, Leptospira interrogans serovar lai str. 56601
uuagccuuuaaacuuucuuccaa

SEQ ID NO: 755441 - RNA, 15 nt, Leptospira interrogans serovar lai str. 56601
uuagauaauuauucu

SEQ ID NO: 755442 - RNA, 22 nt, Leptospira interrogans serovar lai str. 56601
uuagauacguuuuauuauauaa

SEQ ID NO: 755443 - RNA, 16 nt, Leptospira interrogans serovar lai str. 56601
uuagauuuguguuagu

SEQ ID NO: 755444 - RNA, 14 nt, Leptospira interrogans serovar lai str. 56601
uuagauuuuaacuu

SEQ ID NO: 755445 - RNA, 19 nt, Leptospira interrogans serovar lai str. 56601
uuagacguaggaaaugaaa

SEQ ID NO: 755446 - RNA, 17 nt, Leptospira interrogans serovar lai str. 56601
uuagacguuugaaaauc

SEQ ID NO: 755447 - RNA, 21 nt, Leptospira interrogans serovar lai str. 56601
uuagacgccauguuuuuaaaa

SEQ ID NO: 755448 - RNA, 23 nt, Leptospira interrogans serovar lai str. 56601
uuagacgccauguuuuuaaaauc

SEQ ID NO: 755449 - RNA, 16 nt, Leptospira interrogans serovar lai str. 56601
uuagaccgaacucaca

SEQ ID NO: 755450 - RNA, 17 nt, Leptospira interrogans serovar lai str. 56601
uuagaagaauuguauuu

SEQ ID NO: 755451 - RNA, 19 nt, Leptospira interrogans serovar lai str. 56601
uuagaacuguguuucuaau

SEQ ID NO: 755452 - RNA, 17 nt, Leptospira interrogans serovar lai str. 56601
uuagaacuguugaaaaa

SEQ ID NO: 755453 - RNA, 12 nt, Leptospira interrogans serovar lai str. 56601
uuagaacucacg

SEQ ID NO: 755454 - RNA, 14 nt, Leptospira interrogans serovar lai str. 56601
uuagacaaaaauac

SEQ ID NO: 755455 - RNA, 16 nt, Leptospira interrogans serovar lai str. 56601
uuagacaaaaauacua

SEQ ID NO: 755456 - RNA, 13 nt, Leptospira interrogans serovar lai str. 56601
uuagaauuguuga

SEQ ID NO: 755457 - RNA, 17 nt, Leptospira interrogans serovar lai str. 56601
uuagaauuguugaaaaa

SEQ ID NO: 755458 - RNA, 23 nt, Leptospira interrogans serovar lai str. 56601
uuagaauuguugaaaaauuuauu

SEQ ID NO: 755459 - RNA, 18 nt, Leptospira interrogans serovar lai str. 56601
uuagaauuugaacuuuac

SEQ ID NO: 755460 - RNA, 19 nt, Leptospira interrogans serovar lai str. 56601
uuagaauuuguucuuaaaa

SEQ ID NO: 755461 - RNA, 12 nt, Leptospira interrogans serovar lai str. 56601
uuagaauuuucu

SEQ ID NO: 755462 - RNA, 19 nt, Leptospira interrogans serovar lai str. 56601
uuagaauuuuucgaaacaa

SEQ ID NO: 755463 - RNA, 20 nt, Leptospira interrogans serovar lai str. 56601
uuagacaaaaaauucuuuuu

SEQ ID NO: 755464 - RNA, 21 nt, Leptospira interrogans serovar lai str. 56601
uuagaaaucgauuuguaaaau

SEQ ID NO: 755465 - RNA, 21 nt, Leptospira interrogans serovar lai str. 56601
uuagaaagugcauucgcugag

SEQ ID NO: 755466 - RNA, 11 nt, Leptospira interrogans serovar lai str. 56601
uuagaacauca

SEQ ID NO: 755467 - RNA, 21 nt, Leptospira interrogans serovar lai str. 56601
uuagaaagaaucuuuuuaaaa

SEQ ID NO: 755468 - RNA, 15 nt, Leptospira interrogans serovar lai str. 56601
uuagaacagacucug

SEQ ID NO: 755469 - RNA, 19 nt, Leptospira interrogans serovar lai str. 56601
uuagaaauuuauacuauaa

SEQ ID NO: 755470 - RNA, 19 nt, Leptospira interrogans serovar lai str. 56601
uuagaaauuuuuaauaaaa

SEQ ID NO: 755471 - RNA, 20 nt, Leptospira interrogans serovar lai str. 56601
uuagaaauuuuuaaucaaau

SEQ ID NO: 755472 - RNA, 17 nt, Leptospira interrogans serovar lai str. 56601
uuagaaaugauuuuuua

SEQ ID NO: 755473 - RNA, 22 nt, Leptospira interrogans serovar lai str. 56601
uuagaaaugauuuuuuaaaaua

SEQ ID NO: 755474 - RNA, 16 nt, Leptospira interrogans serovar lai str. 56601
uuacuugcaaaaagua

SEQ ID NO: 755475 - RNA, 15 nt, Leptospira interrogans serovar lai str. 56601
uuacuucuguaaucu

SEQ ID NO: 755476 - RNA, 20 nt, Leptospira interrogans serovar lai str. 56601
uuacuucguuauaauuuuca

SEQ ID NO: 755477 - RNA, 14 nt, Leptospira interrogans serovar lai str. 56601
uuacuuauuuuuga

SEQ ID NO: 755478 - RNA, 22 nt, Leptospira interrogans serovar lai str. 56601
uuacgaacaaauucuaaaauug

SEQ ID NO: 755479 - RNA, 17 nt, Leptospira interrogans serovar lai str. 56601
uuaccuugaaacuuuua

SEQ ID NO: 755480 - RNA, 22 nt, Leptospira interrogans serovar lai str. 56601
uuaccuugaaacuuuuaauaaa

SEQ ID NO: 755481 - RNA, 19 nt, Leptospira interrogans serovar lai str. 56601
uuacuuaccucuauaaaau

SEQ ID NO: 755482 - RNA, 18 nt, Leptospira interrogans serovar lai str. 56601
uuacgaaucuaauuuaua

SEQ ID NO: 755483 - RNA, 13 nt, Leptospira interrogans serovar lai str. 56601
uuacgacauuuua

SEQ ID NO: 755484 - RNA, 23 nt, Leptospira interrogans serovar lai str. 56601
uuauacgcccgaguaauaagaau

SEQ ID NO: 755485 - RNA, 23 nt, Leptospira interrogans serovar lai str. 56601
uuauaccaaguucgauuaaaaua

SEQ ID NO: 755486 - RNA, 17 nt, Leptospira interrogans serovar lai str. 56601
uuauaaauugccaaaua

SEQ ID NO: 755487 - RNA, 13 nt, Leptospira interrogans serovar lai str. 56601
uuauaaauuuaua

SEQ ID NO: 755488 - RNA, 20 nt, Leptospira interrogans serovar lai str. 56601
uuauaaaucuguacuuaaau

SEQ ID NO: 755489 - RNA, 16 nt, Leptospira interrogans serovar lai str. 56601
uuauaaccuaucacaa

SEQ ID NO: 755490 - RNA, 15 nt, Leptospira interrogans serovar lai str. 56601
uuauaacguuauaaa

SEQ ID NO: 755491 - RNA, 14 nt, Leptospira interrogans serovar lai str. 56601
uuauaaauguagga

SEQ ID NO: 755492 - RNA, 15 nt, Leptospira interrogans serovar lai str. 56601
uuauaguaaaagaaa

SEQ ID NO: 755493 - RNA, 17 nt, Leptospira interrogans serovar lai str. 56601
uuauaguaaaagaaaau

SEQ ID NO: 755494 - RNA, 18 nt, Leptospira interrogans serovar lai str. 56601
uuauacuuuauagaaaau

SEQ ID NO: 755495 - RNA, 15 nt, Leptospira interrogans serovar lai str. 56601
uuauacuauaaguuu

SEQ ID NO: 755496 - RNA, 17 nt, Leptospira interrogans serovar lai str. 56601
uuauauuucauugaaau

SEQ ID NO: 755497 - RNA, 16 nt, Leptospira interrogans serovar lai str. 56601
uuauauuucuaaaaga

SEQ ID NO: 755498 - RNA, 15 nt, Leptospira interrogans serovar lai str. 56601
uuaucacgaaaauua

SEQ ID NO: 755499 - RNA, 15 nt, Leptospira interrogans serovar lai str. 56601
uuauauuuuuaaaaa

SEQ ID NO: 755500 - RNA, 15 nt, Leptospira interrogans serovar lai str. 56601
uuauauuagaguuuu

SEQ ID NO: 755501 - RNA, 17 nt, Leptospira interrogans serovar lai str. 56601
uuauauuauaauucucu

SEQ ID NO: 755502 - RNA, 13 nt, Leptospira interrogans serovar lai str. 56601
uuauauuauauaa

SEQ ID NO: 755503 - RNA, 15 nt, Leptospira interrogans serovar lai str. 56601
uuauauguauuuauu

SEQ ID NO: 755504 - RNA, 20 nt, Leptospira interrogans serovar lai str. 56601
uuauauguauuuauucaaaa

SEQ ID NO: 755505 - RNA, 22 nt, Leptospira interrogans serovar lai str. 56601
uuauauguauuuauucaaaaua

SEQ ID NO: 755506 - RNA, 13 nt, Leptospira interrogans serovar lai str. 56601
uuauauuaaaaug

SEQ ID NO: 755507 - RNA, 16 nt, Leptospira interrogans serovar lai str. 56601
uuauauaaguauuaua

SEQ ID NO: 755508 - RNA, 13 nt, Leptospira interrogans serovar lai str. 56601
uuaguuuuaauau

SEQ ID NO: 755509 - RNA, 16 nt, Leptospira interrogans serovar lai str. 56601
uuaguuguacaaaaau

SEQ ID NO: 755510 - RNA, 13 nt, Leptospira interrogans serovar lai str. 56601
uuaguuuaaaaac

SEQ ID NO: 755511 - RNA, 14 nt, Leptospira interrogans serovar lai str. 56601
uuaguuacuuauuu

SEQ ID NO: 755512 - RNA, 18 nt, Leptospira interrogans serovar lai str. 56601
uuaguuagcugaaauuaa

SEQ ID NO: 755513 - RNA, 18 nt, Leptospira interrogans serovar lai str. 56601
uuaguucccacaaauuaa

SEQ ID NO: 755514 - RNA, 15 nt, Leptospira interrogans serovar lai str. 56601
uuaguucccacauuu

SEQ ID NO: 755515 - RNA, 12 nt, Leptospira interrogans serovar lai str. 56601
uuaguucuccua

SEQ ID NO: 755516 - RNA, 16 nt, Leptospira interrogans serovar lai str. 56601
uuaguuuuuaugccuu

SEQ ID NO: 755517 - RNA, 14 nt, Leptospira interrogans serovar lai str. 56601
uuaguuuuuguaug

SEQ ID NO: 755518 - RNA, 20 nt, Leptospira interrogans serovar lai str. 56601
uuauaaauauuaauuuaaaa

SEQ ID NO: 755519 - RNA, 14 nt, Leptospira interrogans serovar lai str. 56601
uuaguauuuuauua

SEQ ID NO: 755520 - RNA, 18 nt, Leptospira interrogans serovar lai str. 56601
uuaguauuuuucuuaauu

SEQ ID NO: 755521 - RNA, 15 nt, Leptospira interrogans serovar lai str. 56601
uuagguaauagaaaa

SEQ ID NO: 755522 - RNA, 15 nt, Leptospira interrogans serovar lai str. 56601
uuagguauuucuaau

SEQ ID NO: 755523 - RNA, 17 nt, Leptospira interrogans serovar lai str. 56601
uuagguccauagagaac

SEQ ID NO: 755524 - RNA, 15 nt, Leptospira interrogans serovar lai str. 56601
uuagggaucgaucug

SEQ ID NO: 755525 - RNA, 13 nt, Leptospira interrogans serovar lai str. 56601
uuaguaauuuaau

SEQ ID NO: 755526 - RNA, 14 nt, Leptospira interrogans serovar lai str. 56601
uuaguaguaaauaa

SEQ ID NO: 755527 - RNA, 18 nt, Leptospira interrogans serovar lai str. 56601
uuaguaguauuuaagaau

SEQ ID NO: 755528 - RNA, 15 nt, Leptospira interrogans serovar lai str. 56601
uggaauauaaaagaa

SEQ ID NO: 755529 - RNA, 18 nt, Leptospira interrogans serovar lai str. 56601
uggaauauaaaagaauca

SEQ ID NO: 755530 - RNA, 16 nt, Leptospira interrogans serovar lai str. 56601
uggaauucuuuuuuua

SEQ ID NO: 755531 - RNA, 13 nt, Leptospira interrogans serovar lai str. 56601
uggaauuuuucaa

SEQ ID NO: 755532 - RNA, 22 nt, Leptospira interrogans serovar lai str. 56601
uggaauuccgacccagaaaaaa

SEQ ID NO: 755533 - RNA, 21 nt, Leptospira interrogans serovar lai str. 56601
uggaaugacugaccguaaaag

SEQ ID NO: 755534 - RNA, 20 nt, Leptospira interrogans serovar lai str. 56601
uggaaucugaauuuuacaga

SEQ ID NO: 755535 - RNA, 20 nt, Leptospira interrogans serovar lai str. 56601
uggaaucugcaucuuuucua

SEQ ID NO: 755536 - RNA, 15 nt, Leptospira interrogans serovar lai str. 56601
uggaaucuaaacucu

SEQ ID NO: 755537 - RNA, 19 nt, Leptospira interrogans serovar lai str. 56601
uggacagaauccuuccaaa

SEQ ID NO: 755538 - RNA, 20 nt, Leptospira interrogans serovar lai str. 56601
uggacagaauccuuccaaau

SEQ ID NO: 755539 - RNA, 12 nt, Leptospira interrogans serovar lai str. 56601
uggaauuuuuua

SEQ ID NO: 755540 - RNA, 21 nt, Leptospira interrogans serovar lai str. 56601
uggaaacggccgauugaagcg

SEQ ID NO: 755541 - RNA, 15 nt, Leptospira interrogans serovar lai str. 56601
uggaaacuauuacaa

SEQ ID NO: 755542 - RNA, 15 nt, Leptospira interrogans serovar lai str. 56601
ugcuuuuuaaaagau

SEQ ID NO: 755543 - RNA, 18 nt, Leptospira interrogans serovar lai str. 56601
uggaaauaucuaaucuuu

SEQ ID NO: 755544 - RNA, 14 nt, Leptospira interrogans serovar lai str. 56601
uggaaaucgaaaac

SEQ ID NO: 755545 - RNA, 19 nt, Leptospira interrogans serovar lai str. 56601
uggaaagccccagaacaaa

SEQ ID NO: 755546 - RNA, 17 nt, Leptospira interrogans serovar lai str. 56601
uggaaaguguuaguucc

SEQ ID NO: 755547 - RNA, 20 nt, Leptospira interrogans serovar lai str. 56601
uggaaaucuuuuaaaaaagg

SEQ ID NO: 755548 - RNA, 16 nt, Leptospira interrogans serovar lai str. 56601
uggaacuuuaauuauu

SEQ ID NO: 755549 - RNA, 23 nt, Leptospira interrogans serovar lai str. 56601
uggaacuuuaccggguuccauuc

SEQ ID NO: 755550 - RNA, 20 nt, Leptospira interrogans serovar lai str. 56601
uggaaauuuuuaauaaaaua

SEQ ID NO: 755551 - RNA, 15 nt, Leptospira interrogans serovar lai str. 56601
uggaaauuuuuaauc

SEQ ID NO: 755552 - RNA, 20 nt, Leptospira interrogans serovar lai str. 56601
uggaaauuuuuaaucaagug

SEQ ID NO: 755553 - RNA, 14 nt, Leptospira interrogans serovar lai str. 56601
ugcugaauuuaccu

SEQ ID NO: 755554 - RNA, 15 nt, Leptospira interrogans serovar lai str. 56601
ugcuuucucuuuuua

SEQ ID NO: 755555 - RNA, 18 nt, Leptospira interrogans serovar lai str. 56601
ugcuuucucuuuuuagac

SEQ ID NO: 755556 - RNA, 15 nt, Leptospira interrogans serovar lai str. 56601
ugcuuaaagcauuaa

SEQ ID NO: 755557 - RNA, 21 nt, Leptospira interrogans serovar lai str. 56601
ugcgcugaguaguaaguuuuu

SEQ ID NO: 755558 - RNA, 16 nt, Leptospira interrogans serovar lai str. 56601
ugcgguaguucccaca

SEQ ID NO: 755559 - RNA, 13 nt, Leptospira interrogans serovar lai str. 56601
ugcuccauaaaag

SEQ ID NO: 755560 - RNA, 19 nt, Leptospira interrogans serovar lai str. 56601
ugcucacuaccuuauaaaa

SEQ ID NO: 755561 - RNA, 20 nt, Leptospira interrogans serovar lai str. 56601
ugcucacuaccuuauaaaaa

SEQ ID NO: 755562 - RNA, 16 nt, Leptospira interrogans serovar lai str. 56601
ugcucucgcaaugaaa

SEQ ID NO: 755563 - RNA, 20 nt, Leptospira interrogans serovar lai str. 56601
ugcucucgcaaugaaaauuc

SEQ ID NO: 755564 - RNA, 17 nt, Leptospira interrogans serovar lai str. 56601
ugcucuaagagacucua

SEQ ID NO: 755565 - RNA, 15 nt, Leptospira interrogans serovar lai str. 56601
ugcucggcuucuuca

SEQ ID NO: 755566 - RNA, 16 nt, Leptospira interrogans serovar lai str. 56601
ugcucggcuucuucaa

SEQ ID NO: 755567 - RNA, 12 nt, Leptospira interrogans serovar lai str. 56601
ugcuaaaauuuu

SEQ ID NO: 755568 - RNA, 17 nt, Leptospira interrogans serovar lai str. 56601
ugcuaacugauuauaaa

SEQ ID NO: 755569 - RNA, 18 nt, Leptospira interrogans serovar lai str. 56601
ugcuaacugauuauaaaa

SEQ ID NO: 755570 - RNA, 18 nt, Leptospira interrogans serovar lai str. 56601
ugcuaagaaaaaagcagc

SEQ ID NO: 755571 - RNA, 17 nt, Leptospira interrogans serovar lai str. 56601
ugcucaaaaauuauaaa

SEQ ID NO: 755572 - RNA, 21 nt, Leptospira interrogans serovar lai str. 56601
ugcuauugaauccuuccucca

SEQ ID NO: 755573 - RNA, 12 nt, Leptospira interrogans serovar lai str. 56601
ugcuauaaaaag

SEQ ID NO: 755574 - RNA, 21 nt, Leptospira interrogans serovar lai str. 56601
ugcgacagcaaggagcaacau

SEQ ID NO: 755575 - RNA, 15 nt, Leptospira interrogans serovar lai str. 56601
ugccuuucuuauuaa

SEQ ID NO: 755576 - RNA, 21 nt, Leptospira interrogans serovar lai str. 56601
ugccuucacauaaccaacccc

SEQ ID NO: 755577 - RNA, 19 nt, Leptospira interrogans serovar lai str. 56601
ugccuaugccccauucuuu

SEQ ID NO: 755578 - RNA, 19 nt, Leptospira interrogans serovar lai str. 56601
ugcccagaguuuguuggug

SEQ ID NO: 755579 - RNA, 22 nt, Leptospira interrogans serovar lai str. 56601
ugcccagaguuuguuggugagu

SEQ ID NO: 755580 - RNA, 13 nt, Leptospira interrogans serovar lai str. 56601
ugccccaaaauuu

SEQ ID NO: 755581 - RNA, 21 nt, Leptospira interrogans serovar lai str. 56601
ugccauuuuucuucuuuguaa

SEQ ID NO: 755582 - RNA, 18 nt, Leptospira interrogans serovar lai str. 56601
ugccauuuuuuucuccuu

SEQ ID NO: 755583 - RNA, 14 nt, Leptospira interrogans serovar lai str. 56601
ugcccaacgguaac

SEQ ID NO: 755584 - RNA, 18 nt, Leptospira interrogans serovar lai str. 56601
ugccaauaauucuacgaa

SEQ ID NO: 755585 - RNA, 18 nt, Leptospira interrogans serovar lai str. 56601
ugcaguaguuccuacaaa

SEQ ID NO: 755586 - RNA, 22 nt, Leptospira interrogans serovar lai str. 56601
ugcaguaguuccuauaaauuca

SEQ ID NO: 755587 - RNA, 14 nt, Leptospira interrogans serovar lai str. 56601
ugcagcuucuucca

SEQ ID NO: 755588 - RNA, 15 nt, Leptospira interrogans serovar lai str. 56601
ugcagauaaguaagu

SEQ ID NO: 755589 - RNA, 14 nt, Leptospira interrogans serovar lai str. 56601
ugcagauuaaaaaa

SEQ ID NO: 755590 - RNA, 13 nt, Leptospira interrogans serovar lai str. 56601
ugcacuguagagc

SEQ ID NO: 755591 - RNA, 17 nt, Leptospira interrogans serovar lai str. 56601
ugcaaucguccaaucuc

SEQ ID NO: 755592 - RNA, 16 nt, Leptospira interrogans serovar lai str. 56601
ugcaauuuuacuuaua

SEQ ID NO: 755593 - RNA, 19 nt, Leptospira interrogans serovar lai str. 56601
ugcaauuuuacuuauacaa

SEQ ID NO: 755594 - RNA, 17 nt, Leptospira interrogans serovar lai str. 56601
ugcaaagaagaaauaag

SEQ ID NO: 755595 - RNA, 19 nt, Leptospira interrogans serovar lai str. 56601
ugcaaguucuggguaaaaa

SEQ ID NO: 755596 - RNA, 15 nt, Leptospira interrogans serovar lai str. 56601
ugauucaaaaacuaa

SEQ ID NO: 755597 - RNA, 19 nt, Leptospira interrogans serovar lai str. 56601
ugauucaaaaacuaaaaua

SEQ ID NO: 755598 - RNA, 23 nt, Leptospira interrogans serovar lai str. 56601
ugauuccgguaaauuuuuuagaa

SEQ ID NO: 755599 - RNA, 16 nt, Leptospira interrogans serovar lai str. 56601
ugauuaugauccaaac

SEQ ID NO: 755600 - RNA, 22 nt, Leptospira interrogans serovar lai str. 56601
ugauguagaguaaauuuugaaa

SEQ ID NO: 755601 - RNA, 20 nt, Leptospira interrogans serovar lai str. 56601
ugcaaaaaagaaagcagcaa

SEQ ID NO: 755602 - RNA, 16 nt, Leptospira interrogans serovar lai str. 56601
ugcaaaaaaauaaaau

SEQ ID NO: 755603 - RNA, 15 nt, Leptospira interrogans serovar lai str. 56601
ugauuuuuuaaaugu

SEQ ID NO: 755604 - RNA, 14 nt, Leptospira interrogans serovar lai str. 56601
ugauuuuuccauaa

SEQ ID NO: 755605 - RNA, 18 nt, Leptospira interrogans serovar lai str. 56601
ugauuuuucuguaaaaau

SEQ ID NO: 755606 - RNA, 12 nt, Leptospira interrogans serovar lai str. 56601
ugauuuuucuuu

SEQ ID NO: 755607 - RNA, 13 nt, Leptospira interrogans serovar lai str. 56601
ugauuuuucuuua

SEQ ID NO: 755608 - RNA, 14 nt, Leptospira interrogans serovar lai str. 56601
ugauuuuauaccuu

SEQ ID NO: 755609 - RNA, 20 nt, Leptospira interrogans serovar lai str. 56601
ugauuuuaccguuuuuaaau

SEQ ID NO: 755610 - RNA, 22 nt, Leptospira interrogans serovar lai str. 56601
ugauuuuaccguuuuuaaaugu

SEQ ID NO: 755611 - RNA, 23 nt, Leptospira interrogans serovar lai str. 56601
ugauuuuaccguuuuuaaaugug

SEQ ID NO: 755612 - RNA, 21 nt, Leptospira interrogans serovar lai str. 56601
ugauuuuacgaaccaauucua

SEQ ID NO: 755613 - RNA, 23 nt, Leptospira interrogans serovar lai str. 56601
ugauuuuacgaaccaauucuaaa

SEQ ID NO: 755614 - RNA, 19 nt, Leptospira interrogans serovar lai str. 56601
ugauuugugggaguuuuca

SEQ ID NO: 755615 - RNA, 12 nt, Leptospira interrogans serovar lai str. 56601
ugauuuguuucu

SEQ ID NO: 755616 - RNA, 15 nt, Leptospira interrogans serovar lai str. 56601
ugauuuguaauaguu

SEQ ID NO: 755617 - RNA, 21 nt, Leptospira interrogans serovar lai str. 56601
ugauuuggaucgguuuuagaa

SEQ ID NO: 755618 - RNA, 22 nt, Leptospira interrogans serovar lai str. 56601
ugauuuggaucgguuuuagaau

SEQ ID NO: 755619 - RNA, 23 nt, Leptospira interrogans serovar lai str. 56601
ugauuuaaaaaccgucccaaaac

SEQ ID NO: 755620 - RNA, 13 nt, Leptospira interrogans serovar lai str. 56601
ugauuuaaaaaua

SEQ ID NO: 755621 - RNA, 22 nt, Leptospira interrogans serovar lai str. 56601
ugauuuaaaaauaguauuuugu

SEQ ID NO: 755622 - RNA, 22 nt, Leptospira interrogans serovar lai str. 56601
ugauuuaaaaucacaaaaaaga

SEQ ID NO: 755623 - RNA, 13 nt, Leptospira interrogans serovar lai str. 56601
ugauuuaauuauu

SEQ ID NO: 755624 - RNA, 22 nt, Leptospira interrogans serovar lai str. 56601
ugauuucuugagggguuuuucc

SEQ ID NO: 755625 - RNA, 16 nt, Leptospira interrogans serovar lai str. 56601
ugauuucuauaaaauu

SEQ ID NO: 755626 - RNA, 19 nt, Leptospira interrogans serovar lai str. 56601
ugauuucuauaaaauugaa

SEQ ID NO: 755627 - RNA, 18 nt, Leptospira interrogans serovar lai str. 56601
ugauucgaaauuuucagc

SEQ ID NO: 755628 - RNA, 19 nt, Leptospira interrogans serovar lai str. 56601
ugauuguggcaagaggaac

SEQ ID NO: 755629 - RNA, 15 nt, Leptospira interrogans serovar lai str. 56601
ugauucugaaaagaa

SEQ ID NO: 755630 - RNA, 14 nt, Leptospira interrogans serovar lai str. 56601
ugauucuauauauu

SEQ ID NO: 755631 - RNA, 17 nt, Leptospira interrogans serovar lai str. 56601
ugauucuauauauugaa

SEQ ID NO: 755632 - RNA, 18 nt, Leptospira interrogans serovar lai str. 56601
ugauucuauccaauugaa

SEQ ID NO: 755633 - RNA, 16 nt, Leptospira interrogans serovar lai str. 56601
ugaugaauucugggaa

SEQ ID NO: 755634 - RNA, 21 nt, Leptospira interrogans serovar lai str. 56601
ugaucgaauaccguucuuaca

SEQ ID NO: 755635 - RNA, 18 nt, Leptospira interrogans serovar lai str. 56601
ugaucgcguaauauuuca

SEQ ID NO: 755636 - RNA, 15 nt, Leptospira interrogans serovar lai str. 56601
ugaugcauuucugcc

SEQ ID NO: 755637 - RNA, 15 nt, Leptospira interrogans serovar lai str. 56601
ugauauuucauucuu

SEQ ID NO: 755638 - RNA, 15 nt, Leptospira interrogans serovar lai str. 56601
ugauauuucuggaaa

SEQ ID NO: 755639 - RNA, 16 nt, Leptospira interrogans serovar lai str. 56601
ugauauaaucuuaaua

SEQ ID NO: 755640 - RNA, 20 nt, Leptospira interrogans serovar lai str. 56601
ugauauaccaguuaaauuca

SEQ ID NO: 755641 - RNA, 21 nt, Leptospira interrogans serovar lai str. 56601
ugauauaccaguuaaauucau

SEQ ID NO: 755642 - RNA, 16 nt, Leptospira interrogans serovar lai str. 56601
ugagugccuaaauuuu

SEQ ID NO: 755643 - RNA, 18 nt, Leptospira interrogans serovar lai str. 56601
ugaguggugaauuuugcu

SEQ ID NO: 755644 - RNA, 13 nt, Leptospira interrogans serovar lai str. 56601
ugauauuuuaaau

SEQ ID NO: 755645 - RNA, 13 nt, Leptospira interrogans serovar lai str. 56601
ugaguaguaaaau

SEQ ID NO: 755646 - RNA, 18 nt, Leptospira interrogans serovar lai str. 56601
ugaguaguagaaaaugug

SEQ ID NO: 755647 - RNA, 21 nt, Leptospira interrogans serovar lai str. 56601
ugaguaccuaucaauguugug

SEQ ID NO: 755648 - RNA, 15 nt, Leptospira interrogans serovar lai str. 56601
ugaguaauuccacuc

SEQ ID NO: 755649 - RNA, 20 nt, Leptospira interrogans serovar lai str. 56601
ugagguuuuggaaaggucug

SEQ ID NO: 755650 - RNA, 14 nt, Leptospira interrogans serovar lai str. 56601
ugagguuuuaaaag

SEQ ID NO: 755651 - RNA, 15 nt, Leptospira interrogans serovar lai str. 56601
ugagguuuuaaaagu

SEQ ID NO: 755652 - RNA, 18 nt, Leptospira interrogans serovar lai str. 56601
ugagcuaauucuuaaaaa

SEQ ID NO: 755653 - RNA, 19 nt, Leptospira interrogans serovar lai str. 56601
ugagcuaauucuuaaaaau

SEQ ID NO: 755654 - RNA, 23 nt, Leptospira interrogans serovar lai str. 56601
ugagcuaauucuuaaaaauuuau

SEQ ID NO: 755655 - RNA, 23 nt, Leptospira interrogans serovar lai str. 56601
ugagcuagauuuagauucuaaaa

SEQ ID NO: 755656 - RNA, 15 nt, Leptospira interrogans serovar lai str. 56601
ugagcuugucccaaa

SEQ ID NO: 755657 - RNA, 20 nt, Leptospira interrogans serovar lai str. 56601
ugaggaguuuuuauaaaauc

SEQ ID NO: 755658 - RNA, 14 nt, Leptospira interrogans serovar lai str. 56601
ugagauuaaaaaga

SEQ ID NO: 755659 - RNA, 17 nt, Leptospira interrogans serovar lai str. 56601
ugagauuaaaacugcuc

SEQ ID NO: 755660 - RNA, 22 nt, Leptospira interrogans serovar lai str. 56601
ugagauuuagagccaaauuuuu

SEQ ID NO: 755661 - RNA, 18 nt, Leptospira interrogans serovar lai str. 56601
ugagauuugucucaaaau

SEQ ID NO: 755662 - RNA, 22 nt, Leptospira interrogans serovar lai str. 56601
ugagauuugucucaaaauuuaa

SEQ ID NO: 755663 - RNA, 23 nt, Leptospira interrogans serovar lai str. 56601
ugagauuugucucaaaauuuaag

SEQ ID NO: 755664 - RNA, 19 nt, Leptospira interrogans serovar lai str. 56601
ugagaagcggguuuuucuu

SEQ ID NO: 755665 - RNA, 14 nt, Leptospira interrogans serovar lai str. 56601
ugagauagguuuug

SEQ ID NO: 755666 - RNA, 20 nt, Leptospira interrogans serovar lai str. 56601
ugagauaucacaaauuuuaa

SEQ ID NO: 755667 - RNA, 22 nt, Leptospira interrogans serovar lai str. 56601
ugagauaucacaaauuuuaaag

SEQ ID NO: 755668 - RNA, 15 nt, Leptospira interrogans serovar lai str. 56601
ugagaugugggaacu

SEQ ID NO: 755669 - RNA, 13 nt, Leptospira interrogans serovar lai str. 56601
ugagcaaaauuug

SEQ ID NO: 755670 - RNA, 15 nt, Leptospira interrogans serovar lai str. 56601
ugagaaaauaaaaaa

SEQ ID NO: 755671 - RNA, 16 nt, Leptospira interrogans serovar lai str. 56601
ugagaacuacuuuuau

SEQ ID NO: 755672 - RNA, 22 nt, Leptospira interrogans serovar lai str. 56601
ugacuuucuguauuuuuaaguu

SEQ ID NO: 755673 - RNA, 16 nt, Leptospira interrogans serovar lai str. 56601
ugacuugcauuuaaua

SEQ ID NO: 755674 - RNA, 15 nt, Leptospira interrogans serovar lai str. 56601
ugacuuuaauuuuag

SEQ ID NO: 755675 - RNA, 18 nt, Leptospira interrogans serovar lai str. 56601
ugacucuaagcuuuagaa

SEQ ID NO: 755676 - RNA, 22 nt, Leptospira interrogans serovar lai str. 56601
ugacugcccguuucaauuuuug

SEQ ID NO: 755677 - RNA, 20 nt, Leptospira interrogans serovar lai str. 56601
ugaccauggaugaauugauu

SEQ ID NO: 755678 - RNA, 12 nt, Leptospira interrogans serovar lai str. 56601
ugaccaucaaug

SEQ ID NO: 755679 - RNA, 18 nt, Leptospira interrogans serovar lai str. 56601
ugaccguugugagaaaua

SEQ ID NO: 755680 - RNA, 16 nt, Leptospira interrogans serovar lai str. 56601
ugacacugaaaacauu

SEQ ID NO: 755681 - RNA, 17 nt, Leptospira interrogans serovar lai str. 56601
ugacacugaaaacauuu

SEQ ID NO: 755682 - RNA, 12 nt, Leptospira interrogans serovar lai str. 56601
ugaccaccuaua

SEQ ID NO: 755683 - RNA, 19 nt, Leptospira interrogans serovar lai str. 56601
ugaauaucuaauauuuuuc

SEQ ID NO: 755684 - RNA, 19 nt, Leptospira interrogans serovar lai str. 56601
ugaaucuaggauauuugau

SEQ ID NO: 755685 - RNA, 23 nt, Leptospira interrogans serovar lai str. 56601
ugaaucuaggauauuugauauaa

SEQ ID NO: 755686 - RNA, 24 nt, Leptospira interrogans serovar lai str. 56601
ugaaucuaggauauuugauauaau

SEQ ID NO: 755687 - RNA, 16 nt, Leptospira interrogans serovar lai str. 56601
ugaaucuauuguaaua

SEQ ID NO: 755688 - RNA, 20 nt, Leptospira interrogans serovar lai str. 56601
ugaaucuauuuuugauuuua

SEQ ID NO: 755689 - RNA, 23 nt, Leptospira interrogans serovar lai str. 56601
ucuuucaaaaccgcuuuuaguuu

SEQ ID NO: 755690 - RNA, 13 nt, Leptospira interrogans serovar lai str. 56601
ucuuuauaaaguu

SEQ ID NO: 755691 - RNA, 12 nt, Leptospira interrogans serovar lai str. 56601
ugaauucuuccu

SEQ ID NO: 755692 - RNA, 16 nt, Leptospira interrogans serovar lai str. 56601
ugaauucagaaaaaaa

SEQ ID NO: 755693 - RNA, 14 nt, Leptospira interrogans serovar lai str. 56601
ugaauuguaaaaaa

SEQ ID NO: 755694 - RNA, 18 nt, Leptospira interrogans serovar lai str. 56601
ugaauuguaaaaaaccgu

SEQ ID NO: 755695 - RNA, 21 nt, Leptospira interrogans serovar lai str. 56601
ugaauuguggguuguauagaa

SEQ ID NO: 755696 - RNA, 14 nt, Leptospira interrogans serovar lai str. 56601
ugaauugaauuuuu

SEQ ID NO: 755697 - RNA, 15 nt, Leptospira interrogans serovar lai str. 56601
ugaauugcuaaaaaa

SEQ ID NO: 755698 - RNA, 13 nt, Leptospira interrogans serovar lai str. 56601
ugaauuuaaaagu

SEQ ID NO: 755699 - RNA, 22 nt, Leptospira interrogans serovar lai str. 56601
ugaauuuagaaaauuagaaaga

SEQ ID NO: 755700 - RNA, 13 nt, Leptospira interrogans serovar lai str. 56601
ugaauuuuuauaa

SEQ ID NO: 755701 - RNA, 12 nt, Leptospira interrogans serovar lai str. 56601
ugaauuuuucau

SEQ ID NO: 755702 - RNA, 14 nt, Leptospira interrogans serovar lai str. 56601
ugaauuuuuuaaau

SEQ ID NO: 755703 - RNA, 16 nt, Leptospira interrogans serovar lai str. 56601
ugaauuuuuuaaaugc

SEQ ID NO: 755704 - RNA, 18 nt, Leptospira interrogans serovar lai str. 56601
ugaauuuuuuauuaagaa

SEQ ID NO: 755705 - RNA, 13 nt, Leptospira interrogans serovar lai str. 56601
ugaauuuuuucgu

SEQ ID NO: 755706 - RNA, 19 nt, Leptospira interrogans serovar lai str. 56601
ugacaacagucauucugua

SEQ ID NO: 755707 - RNA, 15 nt, Leptospira interrogans serovar lai str. 56601
ugacaaacuaaauuu

SEQ ID NO: 755708 - RNA, 19 nt, Leptospira interrogans serovar lai str. 56601
ugaauuuaggaaauuuuca

SEQ ID NO: 755709 - RNA, 22 nt, Leptospira interrogans serovar lai str. 56601
ugacaagcucuuuaagagucau

SEQ ID NO: 755710 - RNA, 21 nt, Leptospira interrogans serovar lai str. 56601
ugacaauaaucuaagacgaaa

SEQ ID NO: 755711 - RNA, 22 nt, Leptospira interrogans serovar lai str. 56601
gacaguucccacauuuuagaaa

SEQ ID NO: 755712 - RNA, 23 nt, Leptospira interrogans serovar lai str. 56601
gacauagucaagcagauuugucc

SEQ ID NO: 755713 - RNA, 15 nt, Leptospira interrogans serovar lai str. 56601
gacauuguuuuacuc

SEQ ID NO: 755714 - RNA, 14 nt, Leptospira interrogans serovar lai str. 56601
gacauuagaacuac

SEQ ID NO: 755715 - RNA, 21 nt, Leptospira interrogans serovar lai str. 56601
gacauuagaacuacucacaaa

SEQ ID NO: 755716 - RNA, 14 nt, Leptospira interrogans serovar lai str. 56601
gacaucuuuuaaaa

SEQ ID NO: 755717 - RNA, 19 nt, Leptospira interrogans serovar lai str. 56601
gacaugauucauuuuucug

SEQ ID NO: 755718 - RNA, 22 nt, Leptospira interrogans serovar lai str. 56601
gaccaaaucuuucacuuuaaaa

SEQ ID NO: 755719 - RNA, 19 nt, Leptospira interrogans serovar lai str. 56601
gaccaauuuuuuuguaaaa

SEQ ID NO: 755720 - RNA, 18 nt, Leptospira interrogans serovar lai str. 56601
gaccagcguuuugcugag

SEQ ID NO: 755721 - RNA, 19 nt, Leptospira interrogans serovar lai str. 56601
gaccagcguuuugcugagu

SEQ ID NO: 755722 - RNA, 20 nt, Leptospira interrogans serovar lai str. 56601
gaccagcguuuugcugaguu

SEQ ID NO: 755723 - RNA, 22 nt, Leptospira interrogans serovar lai str. 56601
gacaaaaugaguuauaguaaaa

SEQ ID NO: 755724 - RNA, 12 nt, Leptospira interrogans serovar lai str. 56601
gacaaacuuuua

SEQ ID NO: 755725 - RNA, 22 nt, Leptospira interrogans serovar lai str. 56601
gacaaagaguuguuuaucuucu

SEQ ID NO: 755726 - RNA, 17 nt, Leptospira interrogans serovar lai str. 56601
gacaaaguauuuucuag

SEQ ID NO: 755727 - RNA, 18 nt, Leptospira interrogans serovar lai str. 56601
gacaaaucuucuguaaaa

SEQ ID NO: 755728 - RNA, 20 nt, Leptospira interrogans serovar lai str. 56601
cuuuggucgaucguuuuuug

SEQ ID NO: 755729 - RNA, 18 nt, Leptospira interrogans serovar lai str. 56601
cuuugguuaucauaaaaa

SEQ ID NO: 755730 - RNA, 20 nt, Leptospira interrogans serovar lai str. 56601
cuuugguuaucauaaaaaua

SEQ ID NO: 755731 - RNA, 22 nt, Leptospira interrogans serovar lai str. 56601
cuuuguaaaucuauucuuaaaa

SEQ ID NO: 755732 - RNA, 19 nt, Leptospira interrogans serovar lai str. 56601
gaauuuuacuaaaaauuca

SEQ ID NO: 755733 - RNA, 16 nt, Leptospira interrogans serovar lai str. 56601
gaauuuuaugauuuuc

SEQ ID NO: 755734 - RNA, 13 nt, Leptospira interrogans serovar lai str. 56601
gaauuuucaaaau

SEQ ID NO: 755735 - RNA, 19 nt, Leptospira interrogans serovar lai str. 56601
gaauuuuaauuguaaaagg

SEQ ID NO: 755736 - RNA, 20 nt, Leptospira interrogans serovar lai str. 56601
gaauuuuacagauugauucu

SEQ ID NO: 755737 - RNA, 22 nt, Leptospira interrogans serovar lai str. 56601
gaauuuuaccaaauuguuuucu

SEQ ID NO: 755738 - RNA, 18 nt, Leptospira interrogans serovar lai str. 56601
gaauuuuacgugauaauu

SEQ ID NO: 755739 - RNA, 20 nt, Leptospira interrogans serovar lai str. 56601
gaauuuuacgugauaauucu

SEQ ID NO: 755740 - RNA, 17 nt, Leptospira interrogans serovar lai str. 56601
gaauuuguuuuaaaauu

SEQ ID NO: 755741 - RNA, 15 nt, Leptospira interrogans serovar lai str. 56601
gaauuuuaaauauua

SEQ ID NO: 755742 - RNA, 18 nt, Leptospira interrogans serovar lai str. 56601
cuuuguaaccuuuguuuc

SEQ ID NO: 755743 - RNA, 18 nt, Leptospira interrogans serovar lai str. 56601
gaauuuuucgaaacaaaa

SEQ ID NO: 755744 - RNA, 16 nt, Leptospira interrogans serovar lai str. 56601
gaauuuucuaaugcau

SEQ ID NO: 755745 - RNA, 18 nt, Leptospira interrogans serovar lai str. 56601
gaauuuuuauaaguuuaa

SEQ ID NO: 755746 - RNA, 15 nt, Leptospira interrogans serovar lai str. 56601
gaauuuuuaagaaua

SEQ ID NO: 755747 - RNA, 16 nt, Leptospira interrogans serovar lai str. 56601
gaauuuuuacacacuc

SEQ ID NO: 755748 - RNA, 18 nt, Leptospira interrogans serovar lai str. 56601
gaauuuuuuuguauauaa

SEQ ID NO: 755749 - RNA, 19 nt, Leptospira interrogans serovar lai str. 56601
gaauuuuuuuguauauaaa

SEQ ID NO: 755750 - RNA, 20 nt, Leptospira interrogans serovar lai str. 56601
gaauuuuuuuguauauaaau

SEQ ID NO: 755751 - RNA, 19 nt, Leptospira interrogans serovar lai str. 56601
gaauuuuuucguuccuuug

SEQ ID NO: 755752 - RNA, 15 nt, Leptospira interrogans serovar lai str. 56601
gacaaaaauacuaaa

SEQ ID NO: 755753 - RNA, 16 nt, Leptospira interrogans serovar lai str. 56601
gacaaaaauacuaaau

SEQ ID NO: 755754 - RNA, 17 nt, Leptospira interrogans serovar lai str. 56601
gacaacguuacuuuuaa

SEQ ID NO: 755755 - RNA, 15 nt, Leptospira interrogans serovar lai str. 56601
gacaagaaugagucu

SEQ ID NO: 755756 - RNA, 17 nt, Leptospira interrogans serovar lai str. 56601
gacaagaaugagucuuu

SEQ ID NO: 755757 - RNA, 18 nt, Leptospira interrogans serovar lai str. 56601
gacaaucucugauaauuu

SEQ ID NO: 755758 - RNA, 14 nt, Leptospira interrogans serovar lai str. 56601
gacagauuuauauu

SEQ ID NO: 755759 - RNA, 16 nt, Leptospira interrogans serovar lai str. 56601
gacagcuugaagauua

SEQ ID NO: 755760 - RNA, 13 nt, Leptospira interrogans serovar lai str. 56601
gacaauuuuucuc

SEQ ID NO: 755761 - RNA, 17 nt, Leptospira interrogans serovar lai str. 56601
gacgcugaguuugaaag

SEQ ID NO: 755762 - RNA, 19 nt, Leptospira interrogans serovar lai str. 56601
gacgauaccuaaaauggau

SEQ ID NO: 755763 - RNA, 20 nt, Leptospira interrogans serovar lai str. 56601
gacgauccuuuuuuguaaag

SEQ ID NO: 755764 - RNA, 16 nt, Leptospira interrogans serovar lai str. 56601
gacgauugaucagacu

SEQ ID NO: 755765 - RNA, 17 nt, Leptospira interrogans serovar lai str. 56601
gacgauguuguuuaaaa

SEQ ID NO: 755766 - RNA, 13 nt, Leptospira interrogans serovar lai str. 56601
gacgaaaaacuca

SEQ ID NO: 755767 - RNA, 17 nt, Leptospira interrogans serovar lai str. 56601
gacgaauuuuuuagaaa

SEQ ID NO: 755768 - RNA, 21 nt, Leptospira interrogans serovar lai str. 56601
gacgaauugcaccaguuaaau

SEQ ID NO: 755769 - RNA, 14 nt, Leptospira interrogans serovar lai str. 56601
gacgaauccugcua

SEQ ID NO: 755770 - RNA, 18 nt, Leptospira interrogans serovar lai str. 56601
gaccaucaucaaaacuua

SEQ ID NO: 755771 - RNA, 16 nt, Leptospira interrogans serovar lai str. 56601
gacccagaaaaaaccu

SEQ ID NO: 755772 - RNA, 14 nt, Leptospira interrogans serovar lai str. 56601
gaccgaacucacaa

SEQ ID NO: 755773 - RNA, 17 nt, Leptospira interrogans serovar lai str. 56601
gacccuaaaaaauuuuu

SEQ ID NO: 755774 - RNA, 13 nt, Leptospira interrogans serovar lai str. 56601
gaccuaaacccug

SEQ ID NO: 755775 - RNA, 15 nt, Leptospira interrogans serovar lai str. 56601
gaccuuaacucuuaa

SEQ ID NO: 755776 - RNA, 17 nt, Leptospira interrogans serovar lai str. 56601
gagacucuaguaaagaa

SEQ ID NO: 755777 - RNA, 19 nt, Leptospira interrogans serovar lai str. 56601
gagacucuaguaaagaaac

SEQ ID NO: 755778 - RNA, 21 nt, Leptospira interrogans serovar lai str. 56601
gagacgcuuucguuuagagaa

SEQ ID NO: 755779 - RNA, 15 nt, Leptospira interrogans serovar lai str. 56601
gagacgaaaaacuca

SEQ ID NO: 755780 - RNA, 20 nt, Leptospira interrogans serovar lai str. 56601
gagagcguucugcugaguuc

SEQ ID NO: 755781 - RNA, 23 nt, Leptospira interrogans serovar lai str. 56601
gagagaguucuacugaguuucaa

SEQ ID NO: 755782 - RNA, 21 nt, Leptospira interrogans serovar lai str. 56601
gagaauaucugaauuuuuaua

SEQ ID NO: 755783 - RNA, 21 nt, Leptospira interrogans serovar lai str. 56601
gagaauuaauuuuuuaaaaau

SEQ ID NO: 755784 - RNA, 13 nt, Leptospira interrogans serovar lai str. 56601
gagaauucaauuu

SEQ ID NO: 755785 - RNA, 13 nt, Leptospira interrogans serovar lai str. 56601
gagacaagaagaa

SEQ ID NO: 755786 - RNA, 20 nt, Leptospira interrogans serovar lai str. 56601
gagacauugaagaaaaaaag

SEQ ID NO: 755787 - RNA, 13 nt, Leptospira interrogans serovar lai str. 56601
gagacauaaaaaa

SEQ ID NO: 755788 - RNA, 18 nt, Leptospira interrogans serovar lai str. 56601
gagaagcggguuuuucuu

SEQ ID NO: 755789 - RNA, 19 nt, Leptospira interrogans serovar lai str. 56601
gagaagggugaauuuuuuc

SEQ ID NO: 755790 - RNA, 21 nt, Leptospira interrogans serovar lai str. 56601
gagaagggugaauuuuuuccc

SEQ ID NO: 755791 - RNA, 18 nt, Leptospira interrogans serovar lai str. 56601
gagaacuacagcaaauca

SEQ ID NO: 755792 - RNA, 20 nt, Leptospira interrogans serovar lai str. 56601
gagaacucucucaaagcaag

SEQ ID NO: 755793 - RNA, 16 nt, Leptospira interrogans serovar lai str. 56601
gagaacucauucaagu

SEQ ID NO: 755794 - RNA, 19 nt, Leptospira interrogans serovar lai str. 56601
gagaacgcgaacuuuuuua

SEQ ID NO: 755795 - RNA, 19 nt, Leptospira interrogans serovar lai str. 56601
gagaacgaugcuugagcuc

SEQ ID NO: 755796 - RNA, 13 nt, Leptospira interrogans serovar lai str. 56601
gacuuuaguucuc

SEQ ID NO: 755797 - RNA, 22 nt, Leptospira interrogans serovar lai str. 56601
gagaaaaacuuuucuaaaagua

SEQ ID NO: 755798 - RNA, 11 nt, Leptospira interrogans serovar lai str. 56601
gacuuuuccua

SEQ ID NO: 755799 - RNA, 12 nt, Leptospira interrogans serovar lai str. 56601
gacuuuuccuaa

SEQ ID NO: 755800 - RNA, 16 nt, Leptospira interrogans serovar lai str. 56601
gacuuucuguauuuuu

SEQ ID NO: 755801 - RNA, 16 nt, Leptospira interrogans serovar lai str. 56601
gacuuuauucaaaaua

SEQ ID NO: 755802 - RNA, 16 nt, Leptospira interrogans serovar lai str. 56601
gagaaacaaaguagag

SEQ ID NO: 755803 - RNA, 15 nt, Leptospira interrogans serovar lai str. 56601
gagaaacgauacaaa

SEQ ID NO: 755804 - RNA, 11 nt, Leptospira interrogans serovar lai str. 56601
gagaaaauucg

SEQ ID NO: 755805 - RNA, 13 nt, Leptospira interrogans serovar lai str. 56601
gagaaaauccagu

SEQ ID NO: 755806 - RNA, 18 nt, Leptospira interrogans serovar lai str. 56601
gagaaaauccagucaagu

SEQ ID NO: 755807 - RNA, 12 nt, Leptospira interrogans serovar lai str. 56601
gagaaaauccag

SEQ ID NO: 755808 - RNA, 12 nt, Leptospira interrogans serovar lai str. 56601
gagaaaaguguu

SEQ ID NO: 755809 - RNA, 11 nt, Leptospira interrogans serovar lai str. 56601
gagaaauccaa

SEQ ID NO: 755810 - RNA, 22 nt, Leptospira interrogans serovar lai str. 56601
gagaaccucuauaaaaucuaaa

SEQ ID NO: 755811 - RNA, 23 nt, Leptospira interrogans serovar lai str. 56601
gagaaccucuauaaaaucuaaaa

SEQ ID NO: 755812 - RNA, 21 nt, Leptospira interrogans serovar lai str. 56601
gacuuaaaagaagauuuuucu

SEQ ID NO: 755813 - RNA, 19 nt, Leptospira interrogans serovar lai str. 56601
gacuuaugagaguucccac

SEQ ID NO: 755814 - RNA, 15 nt, Leptospira interrogans serovar lai str. 56601
gacuucuauacucuu

SEQ ID NO: 755815 - RNA, 14 nt, Leptospira interrogans serovar lai str. 56601
gacuucucauucuu

SEQ ID NO: 755816 - RNA, 15 nt, Leptospira interrogans serovar lai str. 56601
gacuucuuuuuugua

SEQ ID NO: 755817 - RNA, 13 nt, Leptospira interrogans serovar lai str. 56601
gacuugaaaaagc

SEQ ID NO: 755818 - RNA, 17 nt, Leptospira interrogans serovar lai str. 56601
gacugacugaaaaaaac

SEQ ID NO: 755819 - RNA, 19 nt, Leptospira interrogans serovar lai str. 56601
gacugacugaaaaaaacgu

SEQ ID NO: 755820 - RNA, 23 nt, Leptospira interrogans serovar lai str. 56601
gacugcccguuucaauuuuugaa

SEQ ID NO: 755821 - RNA, 17 nt, Leptospira interrogans serovar lai str. 56601
gacuacagaauaaagua

SEQ ID NO: 755822 - RNA, 16 nt, Leptospira interrogans serovar lai str. 56601
gacuaucaacaagaau

SEQ ID NO: 755823 - RNA, 15 nt, Leptospira interrogans serovar lai str. 56601
gacuaucacaaaaau

SEQ ID NO: 755824 - RNA, 17 nt, Leptospira interrogans serovar lai str. 56601
gacuauuuuauuacaau

SEQ ID NO: 755825 - RNA, 21 nt, Leptospira interrogans serovar lai str. 56601
gacuauuuuauuacaauuuua

SEQ ID NO: 755826 - RNA, 16 nt, Leptospira interrogans serovar lai str. 56601
gacucacaccuucuuu

SEQ ID NO: 755827 - RNA, 23 nt, Leptospira interrogans serovar lai str. 56601
gacucacaccuucuuuuuugcau

SEQ ID NO: 755828 - RNA, 18 nt, Leptospira interrogans serovar lai str. 56601
gacucauauuuuuagaaa

SEQ ID NO: 755829 - RNA, 22 nt, Leptospira interrogans serovar lai str. 56601
gacucauauuuuuagaaaauuu

SEQ ID NO: 755830 - RNA, 20 nt, Leptospira interrogans serovar lai str. 56601
gacucaguauguuguucucc

SEQ ID NO: 755831 - RNA, 22 nt, Leptospira interrogans serovar lai str. 56601
gacucggaaauucucaaaaaau

SEQ ID NO: 755832 - RNA, 13 nt, Leptospira interrogans serovar lai str. 56601
gacguaaaaaaau

SEQ ID NO: 755833 - RNA, 12 nt, Leptospira interrogans serovar lai str. 56601
gacguuuugacc

SEQ ID NO: 755834 - RNA, 19 nt, Leptospira interrogans serovar lai str. 56601
gacuaaaauugacaaagag

SEQ ID NO: 755835 - RNA, 15 nt, Leptospira interrogans serovar lai str. 56601
gacguccuuauaucc

SEQ ID NO: 755836 - RNA, 17 nt, Leptospira interrogans serovar lai str. 56601
gaggaguccaugauucu

SEQ ID NO: 755837 - RNA, 21 nt, Leptospira interrogans serovar lai str. 56601
gaggaguccaugauucugaaa

SEQ ID NO: 755838 - RNA, 17 nt, Leptospira interrogans serovar lai str. 56601
gaggcaacggaauuuuu

SEQ ID NO: 755839 - RNA, 17 nt, Leptospira interrogans serovar lai str. 56601
gaggaacaauuuguaau

SEQ ID NO: 755840 - RNA, 18 nt, Leptospira interrogans serovar lai str. 56601
gagcuguucuuagucuaa

SEQ ID NO: 755841 - RNA, 23 nt, Leptospira interrogans serovar lai str. 56601
gagcucaucauucugaaaaaagu

SEQ ID NO: 755842 - RNA, 17 nt, Leptospira interrogans serovar lai str. 56601
gagcuaauucuuaaaaa

SEQ ID NO: 755843 - RNA, 19 nt, Leptospira interrogans serovar lai str. 56601
gagcucuauguaagaaaau

SEQ ID NO: 755844 - RNA, 20 nt, Leptospira interrogans serovar lai str. 56601
gagcgucuuugaauucgcuu

SEQ ID NO: 755845 - RNA, 20 nt, Leptospira interrogans serovar lai str. 56601
gagcguccauagaagugaag

SEQ ID NO: 755846 - RNA, 18 nt, Leptospira interrogans serovar lai str. 56601
gagcauacccguuuauac

SEQ ID NO: 755847 - RNA, 14 nt, Leptospira interrogans serovar lai str. 56601
gagcaucuuuagaa

SEQ ID NO: 755848 - RNA, 23 nt, Leptospira interrogans serovar lai str. 56601
gagccauaaauggcguauaagaa

SEQ ID NO: 755849 - RNA, 19 nt, Leptospira interrogans serovar lai str. 56601
gagauuuugcacguaaaca

SEQ ID NO: 755850 - RNA, 23 nt, Leptospira interrogans serovar lai str. 56601
gagauuuggugauuuaaaaauag

SEQ ID NO: 755851 - RNA, 15 nt, Leptospira interrogans serovar lai str. 56601
gagauaaaaaaggau

SEQ ID NO: 755852 - RNA, 17 nt, Leptospira interrogans serovar lai str. 56601
gagaguucuacugaguu

SEQ ID NO: 755853 - RNA, 12 nt, Leptospira interrogans serovar lai str. 56601
gagagugaaaaa

SEQ ID NO: 755854 - RNA, 21 nt, Leptospira interrogans serovar lai str. 56601
gagaucaccgcacaaaugaua

SEQ ID NO: 755855 - RNA, 14 nt, Leptospira interrogans serovar lai str. 56601
gagauuaaaacugc

SEQ ID NO: 755856 - RNA, 17 nt, Leptospira interrogans serovar lai str. 56601
gagugauacgcugaguu

SEQ ID NO: 755857 - RNA, 21 nt, Leptospira interrogans serovar lai str. 56601
gaguggauugccauccacaaa

SEQ ID NO: 755858 - RNA, 20 nt, Leptospira interrogans serovar lai str. 56601
gaguguuguguugaguuuca

SEQ ID NO: 755859 - RNA, 16 nt, Leptospira interrogans serovar lai str. 56601
gaguugcuuugaauga

SEQ ID NO: 755860 - RNA, 16 nt, Leptospira interrogans serovar lai str. 56601
gaguuugaguuucuuu

SEQ ID NO: 755861 - RNA, 22 nt, Leptospira interrogans serovar lai str. 56601
gaguuucuugaacucaauguug

SEQ ID NO: 755862 - RNA, 15 nt, Leptospira interrogans serovar lai str. 56601
gaguuguauaacaga

SEQ ID NO: 755863 - RNA, 16 nt, Leptospira interrogans serovar lai str. 56601
gaguuuaagaaacuca

SEQ ID NO: 755864 - RNA, 15 nt, Leptospira interrogans serovar lai str. 56601
gaguuuaaggaagug

SEQ ID NO: 755865 - RNA, 22 nt, Leptospira interrogans serovar lai str. 56601
gaguuuaguauaaucaaauaca

SEQ ID NO: 755866 - RNA, 18 nt, Leptospira interrogans serovar lai str. 56601
gaguuguccuaaaaccuc

SEQ ID NO: 755867 - RNA, 15 nt, Leptospira interrogans serovar lai str. 56601
gaguuguuaaaagug

SEQ ID NO: 755868 - RNA, 22 nt, Leptospira interrogans serovar lai str. 56601
gagucuuuuuacuugcaaaaag

SEQ ID NO: 755869 - RNA, 16 nt, Leptospira interrogans serovar lai str. 56601
gauaaauuuuagaaua

SEQ ID NO: 755870 - RNA, 13 nt, Leptospira interrogans serovar lai str. 56601
gauaaauuuagua

SEQ ID NO: 755871 - RNA, 13 nt, Leptospira interrogans serovar lai str. 56601
gauaagaaaaauu

SEQ ID NO: 755872 - RNA, 19 nt, Leptospira interrogans serovar lai str. 56601
gauaaacauuagaguuguu

SEQ ID NO: 755873 - RNA, 17 nt, Leptospira interrogans serovar lai str. 56601
gaguuuggucaugagau

SEQ ID NO: 755874 - RNA, 22 nt, Leptospira interrogans serovar lai str. 56601
gaguuuguuccaaaaacucaaa

SEQ ID NO: 755875 - RNA, 22 nt, Leptospira interrogans serovar lai str. 56601
gaguuuguucuaaaaacucaaa

SEQ ID NO: 755876 - RNA, 12 nt, Leptospira interrogans serovar lai str. 56601
gaguuuuuccua

SEQ ID NO: 755877 - RNA, 14 nt, Leptospira interrogans serovar lai str. 56601
gaguuuuugaaaaa

SEQ ID NO: 755878 - RNA, 18 nt, Leptospira interrogans serovar lai str. 56601
gauaaauuagaaaauuau

SEQ ID NO: 755879 - RNA, 13 nt, Leptospira interrogans serovar lai str. 56601
gauaaagaaaacc

SEQ ID NO: 755880 - RNA, 15 nt, Leptospira interrogans serovar lai str. 56601
gauaaagaaaaccac

SEQ ID NO: 755881 - RNA, 20 nt, Leptospira interrogans serovar lai str. 56601
gauaaagaaaaccuuucccc

SEQ ID NO: 755882 - RNA, 19 nt, Leptospira interrogans serovar lai str. 56601
gauaaagaaaguaauuuug

SEQ ID NO: 755883 - RNA, 21 nt, Leptospira interrogans serovar lai str. 56601
gauaaacuguaaacuugauua

SEQ ID NO: 755884 - RNA, 21 nt, Leptospira interrogans serovar lai str. 56601
gauaaauagggaauauuccau

SEQ ID NO: 755885 - RNA, 19 nt, Leptospira interrogans serovar lai str. 56601
gaggugaaauuuccacuuc

SEQ ID NO: 755886 - RNA, 20 nt, Leptospira interrogans serovar lai str. 56601
gaggugaaauuuccacuuca

SEQ ID NO: 755887 - RNA, 19 nt, Leptospira interrogans serovar lai str. 56601
gaggucgucucaaaaauau

SEQ ID NO: 755888 - RNA, 22 nt, Leptospira interrogans serovar lai str. 56601
gaggucuaugaugcauuucugc

SEQ ID NO: 755889 - RNA, 17 nt, Leptospira interrogans serovar lai str. 56601
gaguaccauaaauuuua

SEQ ID NO: 755890 - RNA, 17 nt, Leptospira interrogans serovar lai str. 56601
gagggguuuuuccuuuu

SEQ ID NO: 755891 - RNA, 16 nt, Leptospira interrogans serovar lai str. 56601
gaggcugccgcucuuu

SEQ ID NO: 755892 - RNA, 20 nt, Leptospira interrogans serovar lai str. 56601
gauaccgggauuuuaaaaau

SEQ ID NO: 755893 - RNA, 17 nt, Leptospira interrogans serovar lai str. 56601
gauacucauaaaauuug

SEQ ID NO: 755894 - RNA, 13 nt, Leptospira interrogans serovar lai str. 56601
gauagaaagguau

SEQ ID NO: 755895 - RNA, 13 nt, Leptospira interrogans serovar lai str. 56601
gauagagaaaaau

SEQ ID NO: 755896 - RNA, 14 nt, Leptospira interrogans serovar lai str. 56601
gauagagaaaaauu

SEQ ID NO: 755897 - RNA, 21 nt, Leptospira interrogans serovar lai str. 56601
gauagccaugguaagaagaag

SEQ ID NO: 755898 - RNA, 11 nt, Leptospira interrogans serovar lai str. 56601
gauauaauaua

SEQ ID NO: 755899 - RNA, 20 nt, Leptospira interrogans serovar lai str. 56601
gauauaaucuuaauauuucu

SEQ ID NO: 755900 - RNA, 14 nt, Leptospira interrogans serovar lai str. 56601
gauauacugguuuu

SEQ ID NO: 755901 - RNA, 22 nt, Leptospira interrogans serovar lai str. 56601
gauaguuuggguuauaagccaa

SEQ ID NO: 755902 - RNA, 18 nt, Leptospira interrogans serovar lai str. 56601
gauaggaauguuucccag

SEQ ID NO: 755903 - RNA, 15 nt, Leptospira interrogans serovar lai str. 56601
gauaggauuccauug

SEQ ID NO: 755904 - RNA, 17 nt, Leptospira interrogans serovar lai str. 56601
gauagguucuuagaacu

SEQ ID NO: 755905 - RNA, 17 nt, Leptospira interrogans serovar lai str. 56601
gauagguuuuguaagaa

SEQ ID NO: 755906 - RNA, 22 nt, Leptospira interrogans serovar lai str. 56601
gauagcguaauacgaugauaaa

SEQ ID NO: 755907 - RNA, 14 nt, Leptospira interrogans serovar lai str. 56601
gauccaggaucaga

SEQ ID NO: 755908 - RNA, 15 nt, Leptospira interrogans serovar lai str. 56601
gaucauacuuuagaa

SEQ ID NO: 755909 - RNA, 16 nt, Leptospira interrogans serovar lai str. 56601
gaucacguaaaacuuc

SEQ ID NO: 755910 - RNA, 14 nt, Leptospira interrogans serovar lai str. 56601
gauauuucauucuu

SEQ ID NO: 755911 - RNA, 18 nt, Leptospira interrogans serovar lai str. 56601
gauauugagcaagaccuu

SEQ ID NO: 755912 - RNA, 14 nt, Leptospira interrogans serovar lai str. 56601
gauauucugaaagu

SEQ ID NO: 755913 - RNA, 20 nt, Leptospira interrogans serovar lai str. 56601
gauauaguuuugagauuaca

SEQ ID NO: 755914 - RNA, 13 nt, Leptospira interrogans serovar lai str. 56601
gaucaaauacuug

SEQ ID NO: 755915 - RNA, 17 nt, Leptospira interrogans serovar lai str. 56601
gaucaaagcgggaauuc

SEQ ID NO: 755916 - RNA, 16 nt, Leptospira interrogans serovar lai str. 56601
gaucaauucuuuaaau

SEQ ID NO: 755917 - RNA, 13 nt, Leptospira interrogans serovar lai str. 56601
gaugauuuuucua

SEQ ID NO: 755918 - RNA, 19 nt, Leptospira interrogans serovar lai str. 56601
gaugauaaaaaacgaauca

SEQ ID NO: 755919 - RNA, 17 nt, Leptospira interrogans serovar lai str. 56601
gaugagcuuacuuuaau

SEQ ID NO: 755920 - RNA, 17 nt, Leptospira interrogans serovar lai str. 56601
gaugagcuuuuuuagaa

SEQ ID NO: 755921 - RNA, 20 nt, Leptospira interrogans serovar lai str. 56601
gaugagcuuuuuuagaaaaa

SEQ ID NO: 755922 - RNA, 21 nt, Leptospira interrogans serovar lai str. 56601
gaugagcuuuuuuagaaaaag

SEQ ID NO: 755923 - RNA, 21 nt, Leptospira interrogans serovar lai str. 56601
gaucugcuuuuuuaaaccuuc

SEQ ID NO: 755924 - RNA, 14 nt, Leptospira interrogans serovar lai str. 56601
gaucuguaaaaugu

SEQ ID NO: 755925 - RNA, 13 nt, Leptospira interrogans serovar lai str. 56601
gaucuguaaaguu

SEQ ID NO: 755926 - RNA, 15 nt, Leptospira interrogans serovar lai str. 56601
gaugaaauuuuaaaa

SEQ ID NO: 755927 - RNA, 19 nt, Leptospira interrogans serovar lai str. 56601
gaugaaauuuuaaaacccg

SEQ ID NO: 755928 - RNA, 16 nt, Leptospira interrogans serovar lai str. 56601
gaugaaaguuugggau

SEQ ID NO: 755929 - RNA, 14 nt, Leptospira interrogans serovar lai str. 56601
gaucuuguauaaga

SEQ ID NO: 755930 - RNA, 15 nt, Leptospira interrogans serovar lai str. 56601
gaucuuuaaaagagc

SEQ ID NO: 755931 - RNA, 19 nt, Leptospira interrogans serovar lai str. 56601
gaucuuuuuuaauuauguu

SEQ ID NO: 755932 - RNA, 13 nt, Leptospira interrogans serovar lai str. 56601
gaucuuuuauaau

SEQ ID NO: 755933 - RNA, 17 nt, Leptospira interrogans serovar lai str. 56601
gaucugauauuuuaaau

SEQ ID NO: 755934 - RNA, 18 nt, Leptospira interrogans serovar lai str. 56601
gaucuccuaaaauaaaau

SEQ ID NO: 755935 - RNA, 13 nt, Leptospira interrogans serovar lai str. 56601
gaucuaagaaauc

SEQ ID NO: 755936 - RNA, 18 nt, Leptospira interrogans serovar lai str. 56601
gaucuacuaaaucagaau

SEQ ID NO: 755937 - RNA, 15 nt, Leptospira interrogans serovar lai str. 56601
gaucucaauauaaac

SEQ ID NO: 755938 - RNA, 18 nt, Leptospira interrogans serovar lai str. 56601
gaucuauuccuaaaaugu

SEQ ID NO: 755939 - RNA, 20 nt, Leptospira interrogans serovar lai str. 56601
gaucuccacuuaauuuuucu

SEQ ID NO: 755940 - RNA, 21 nt, Leptospira interrogans serovar lai str. 56601
gaucguuggccucgaaaguuu

SEQ ID NO: 755941 - RNA, 20 nt, Leptospira interrogans serovar lai str. 56601
gaucguuucauucccuucuc

SEQ ID NO: 755942 - RNA, 21 nt, Leptospira interrogans serovar lai str. 56601
gaucuaaaaggacgggaaaau

SEQ ID NO: 755943 - RNA, 21 nt, Leptospira interrogans serovar lai str. 56601
gauuucuuacaccgaauucaa

SEQ ID NO: 755944 - RNA, 19 nt, Leptospira interrogans serovar lai str. 56601
gauuucuaguuuaaacguu

SEQ ID NO: 755945 - RNA, 13 nt, Leptospira interrogans serovar lai str. 56601
gauuucuauaaaa

SEQ ID NO: 755946 - RNA, 15 nt, Leptospira interrogans serovar lai str. 56601
gauuucuauaaaauu

SEQ ID NO: 755947 - RNA, 15 nt, Leptospira interrogans serovar lai str. 56601
gauuucuaaauugug

SEQ ID NO: 755948 - RNA, 20 nt, Leptospira interrogans serovar lai str. 56601
gauuucguucggaaaaagua

SEQ ID NO: 755949 - RNA, 21 nt, Leptospira interrogans serovar lai str. 56601
gauuucguucggaaaaaguau

SEQ ID NO: 755950 - RNA, 14 nt, Leptospira interrogans serovar lai str. 56601
gauuuguaaaauug

SEQ ID NO: 755951 - RNA, 14 nt, Leptospira interrogans serovar lai str. 56601
gauuuguaauaguu

SEQ ID NO: 755952 - RNA, 16 nt, Leptospira interrogans serovar lai str. 56601
gauuuguaauaguucc

SEQ ID NO: 755953 - RNA, 19 nt, Leptospira interrogans serovar lai str. 56601
gauuuguaauaguucccac

SEQ ID NO: 755954 - RNA, 21 nt, Leptospira interrogans serovar lai str. 56601
gauuuggaucgggacaaauca

SEQ ID NO: 755955 - RNA, 17 nt, Leptospira interrogans serovar lai str. 56601
gauuuguccgaauccaa

SEQ ID NO: 755956 - RNA, 16 nt, Leptospira interrogans serovar lai str. 56601
gauuugucgaaugcuc

SEQ ID NO: 755957 - RNA, 19 nt, Leptospira interrogans serovar lai str. 56601
gauuugugcaaaaauuuuu

SEQ ID NO: 755958 - RNA, 19 nt, Leptospira interrogans serovar lai str. 56601
gauuuguuuaggaauuuuu

SEQ ID NO: 755959 - RNA, 15 nt, Leptospira interrogans serovar lai str. 56601
gauuuguuuuauaaa

SEQ ID NO: 755960 - RNA, 12 nt, Leptospira interrogans serovar lai str. 56601
gauuuuuguuuu

SEQ ID NO: 755961 - RNA, 13 nt, Leptospira interrogans serovar lai str. 56601
gcaaaaaaaauac

SEQ ID NO: 755962 - RNA, 13 nt, Leptospira interrogans serovar lai str. 56601
gcaaaaauuuaau

SEQ ID NO: 755963 - RNA, 13 nt, Leptospira interrogans serovar lai str. 56601
gcaaaaaagaaag

SEQ ID NO: 755964 - RNA, 13 nt, Leptospira interrogans serovar lai str. 56601
gauuuuaaaaauu

SEQ ID NO: 755965 - RNA, 15 nt, Leptospira interrogans serovar lai str. 56601
gauuuuaaaaauuuu

SEQ ID NO: 755966 - RNA, 16 nt, Leptospira interrogans serovar lai str. 56601
gauuuuaaaaauuuug

SEQ ID NO: 755967 - RNA, 16 nt, Leptospira interrogans serovar lai str. 56601
gauuuucauuuugcua

SEQ ID NO: 755968 - RNA, 17 nt, Leptospira interrogans serovar lai str. 56601
gauuuucauuuugcuaa

SEQ ID NO: 755969 - RNA, 15 nt, Leptospira interrogans serovar lai str. 56601
gauuuugaucuuuuu

SEQ ID NO: 755970 - RNA, 17 nt, Leptospira interrogans serovar lai str. 56601
gauuuucucaaaaaaag

SEQ ID NO: 755971 - RNA, 20 nt, Leptospira interrogans serovar lai str. 56601
gauuuacuacgucuucuaaa

SEQ ID NO: 755972 - RNA, 14 nt, Leptospira interrogans serovar lai str. 56601
gauuuacuuuaaaa

SEQ ID NO: 755973 - RNA, 16 nt, Leptospira interrogans serovar lai str. 56601
gauuuacuuuaaaauu

SEQ ID NO: 755974 - RNA, 20 nt, Leptospira interrogans serovar lai str. 56601
gauuuauguucguucccaca

SEQ ID NO: 755975 - RNA, 23 nt, Leptospira interrogans serovar lai str. 56601
gauuguaaaaaaacaugaagaag

SEQ ID NO: 755976 - RNA, 21 nt, Leptospira interrogans serovar lai str. 56601
gauugguguuguguuaguucc

SEQ ID NO: 755977 - RNA, 14 nt, Leptospira interrogans serovar lai str. 56601
gauucuauuuugag

SEQ ID NO: 755978 - RNA, 14 nt, Leptospira interrogans serovar lai str. 56601
gauucucaaaaugg

SEQ ID NO: 755979 - RNA, 17 nt, Leptospira interrogans serovar lai str. 56601
gauugauucuaagguuu

SEQ ID NO: 755980 - RNA, 16 nt, Leptospira interrogans serovar lai str. 56601
gauugauucuuuaaau

SEQ ID NO: 755981 - RNA, 13 nt, Leptospira interrogans serovar lai str. 56601
gauugauugaagc

SEQ ID NO: 755982 - RNA, 18 nt, Leptospira interrogans serovar lai str. 56601
gauucuaacugguuuuuc

SEQ ID NO: 755983 - RNA, 13 nt, Leptospira interrogans serovar lai str. 56601
gauucuaauuuuu

SEQ ID NO: 755984 - RNA, 17 nt, Leptospira interrogans serovar lai str. 56601
gauucuaggaaacucaa

SEQ ID NO: 755985 - RNA, 18 nt, Leptospira interrogans serovar lai str. 56601
gauucuaggaaacucaag

SEQ ID NO: 755986 - RNA, 19 nt, Leptospira interrogans serovar lai str. 56601
gauucuauauauugaaaua

SEQ ID NO: 755987 - RNA, 23 nt, Leptospira interrogans serovar lai str. 56601
gauucuauauauugaaauauuau

SEQ ID NO: 755988 - RNA, 14 nt, Leptospira interrogans serovar lai str. 56601
gauucuaaaaaaag

SEQ ID NO: 755989 - RNA, 16 nt, Leptospira interrogans serovar lai str. 56601
gauucuaaaaaaaguu

SEQ ID NO: 755990 - RNA, 17 nt, Leptospira interrogans serovar lai str. 56601
gauucgcucaaauuuuc

SEQ ID NO: 755991 - RNA, 17 nt, Leptospira interrogans serovar lai str. 56601
gauucaauucuacgaau

SEQ ID NO: 755992 - RNA, 21 nt, Leptospira interrogans serovar lai str. 56601
gauucaauuuuuauaaacuuc

SEQ ID NO: 755993 - RNA, 13 nt, Leptospira interrogans serovar lai str. 56601
gauucauaaagag

SEQ ID NO: 755994 - RNA, 22 nt, Leptospira interrogans serovar lai str. 56601
gauucaguuuuacuguaaaauu

SEQ ID NO: 755995 - RNA, 19 nt, Leptospira interrogans serovar lai str. 56601
gauucaaaaacuaaaauac

SEQ ID NO: 755996 - RNA, 15 nt, Leptospira interrogans serovar lai str. 56601
gauuauuuuuuaaaa

SEQ ID NO: 755997 - RNA, 16 nt, Leptospira interrogans serovar lai str. 56601
gauuauuuuuuaaaaa

SEQ ID NO: 755998 - RNA, 19 nt, Leptospira interrogans serovar lai str. 56601
gauucaaagauaaaauaua

SEQ ID NO: 755999 - RNA, 15 nt, Leptospira interrogans serovar lai str. 56601
gauuagcaugaaauu

SEQ ID NO: 756000 - RNA, 18 nt, Leptospira interrogans serovar lai str. 56601
gauuauaaaaacaaguuu

SEQ ID NO: 756001 - RNA, 20 nt, Leptospira interrogans serovar lai str. 56601
gauuauaaaaacaaguuuaa

SEQ ID NO: 756002 - RNA, 17 nt, Leptospira interrogans serovar lai str. 56601
gauuauaaccugcaaca

SEQ ID NO: 756003 - RNA, 21 nt, Leptospira interrogans serovar lai str. 56601
gauucauucaggauuacuaau

SEQ ID NO: 756004 - RNA, 18 nt, Leptospira interrogans serovar lai str. 56601
gauucaucgcuuuuaaau

SEQ ID NO: 756005 - RNA, 22 nt, Leptospira interrogans serovar lai str. 56601
gauucauuuuucugaaaaaguu

SEQ ID NO: 756006 - RNA, 15 nt, Leptospira interrogans serovar lai str. 56601
gauuccaagauuuuu

SEQ ID NO: 756007 - RNA, 12 nt, Leptospira interrogans serovar lai str. 56601
gauuccauucuu

SEQ ID NO: 756008 - RNA, 14 nt, Leptospira interrogans serovar lai str. 56601
gauuccauugauuu

SEQ ID NO: 756009 - RNA, 17 nt, Leptospira interrogans serovar lai str. 56601
gauucccaguaaaucca

SEQ ID NO: 756010 - RNA, 13 nt, Leptospira interrogans serovar lai str. 56601
gauuccuacuuau

SEQ ID NO: 756011 - RNA, 20 nt, Leptospira interrogans serovar lai str. 56601
gauucgaacuuuuuuuagaa

SEQ ID NO: 756012 - RNA, 21 nt, Leptospira interrogans serovar lai str. 56601
gauucgaacuuuuuuuagaau

SEQ ID NO: 756013 - RNA, 15 nt, Leptospira interrogans serovar lai str. 56601
gauuccuaaaaauug

SEQ ID NO: 756014 - RNA, 16 nt, Leptospira interrogans serovar lai str. 56601
gauuccgauucuccca

SEQ ID NO: 756015 - RNA, 17 nt, Leptospira interrogans serovar lai str. 56601
gauuccauuuuuuagaa

SEQ ID NO: 756016 - RNA, 18 nt, Leptospira interrogans serovar lai str. 56601
gaugugaauucucuagaa

SEQ ID NO: 756017 - RNA, 22 nt, Leptospira interrogans serovar lai str. 56601
gaugugaguuuuaaaacucaca

SEQ ID NO: 756018 - RNA, 23 nt, Leptospira interrogans serovar lai str. 56601
gauguggaaguuuucaaaaaaug

SEQ ID NO: 756019 - RNA, 21 nt, Leptospira interrogans serovar lai str. 56601
gaugucuaaauccuucaaaac

SEQ ID NO: 756020 - RNA, 24 nt, Leptospira interrogans serovar lai str. 56601
gauuacaaaaaaugaauuuagcau

SEQ ID NO: 756021 - RNA, 21 nt, Leptospira interrogans serovar lai str. 56601
gauuaauucccaaugaugaau

SEQ ID NO: 756022 - RNA, 15 nt, Leptospira interrogans serovar lai str. 56601
gauuaaucuguaaau

SEQ ID NO: 756023 - RNA, 14 nt, Leptospira interrogans serovar lai str. 56601
gauuagaaaaaaag

SEQ ID NO: 756024 - RNA, 21 nt, Leptospira interrogans serovar lai str. 56601
gauuagaaaaaaaguauauau

SEQ ID NO: 756025 - RNA, 20 nt, Leptospira interrogans serovar lai str. 56601
gauguguuaugaguucauuc

SEQ ID NO: 756026 - RNA, 14 nt, Leptospira interrogans serovar lai str. 56601
gcaguacaauucaa

SEQ ID NO: 756027 - RNA, 15 nt, Leptospira interrogans serovar lai str. 56601
gcauaagcaaaaaua

SEQ ID NO: 756028 - RNA, 16 nt, Leptospira interrogans serovar lai str. 56601
gcauaagcaaaaauaa

SEQ ID NO: 756029 - RNA, 23 nt, Leptospira interrogans serovar lai str. 56601
gcaguucuacuuuauuaaaaagu

SEQ ID NO: 756030 - RNA, 22 nt, Leptospira interrogans serovar lai str. 56601
gcaguugugaucagugauucga

SEQ ID NO: 756031 - RNA, 18 nt, Leptospira interrogans serovar lai str. 56601
gcaggcuuguuugaauuu

SEQ ID NO: 756032 - RNA, 14 nt, Leptospira interrogans serovar lai str. 56601
gcagaauguuuucu

SEQ ID NO: 756033 - RNA, 18 nt, Leptospira interrogans serovar lai str. 56601
gcagaagcuuuauuaaau

SEQ ID NO: 756034 - RNA, 12 nt, Leptospira interrogans serovar lai str. 56601
gcacaaaccaaa

SEQ ID NO: 756035 - RNA, 14 nt, Leptospira interrogans serovar lai str. 56601
gcaauacauuagaa

SEQ ID NO: 756036 - RNA, 18 nt, Leptospira interrogans serovar lai str. 56601
gcaauacauucuuauaaa

SEQ ID NO: 756037 - RNA, 20 nt, Leptospira interrogans serovar lai str. 56601
gcaauacauucuuauaaaga

SEQ ID NO: 756038 - RNA, 17 nt, Leptospira interrogans serovar lai str. 56601
gcaaucgaucuguaaaa

SEQ ID NO: 756039 - RNA, 17 nt, Leptospira interrogans serovar lai str. 56601
gcaacacauuuucauuc

SEQ ID NO: 756040 - RNA, 20 nt, Leptospira interrogans serovar lai str. 56601
gcaacacacacuuuauaaaa

SEQ ID NO: 756041 - RNA, 23 nt, Leptospira interrogans serovar lai str. 56601
gcaacacacacuuuauaaaagua

SEQ ID NO: 756042 - RNA, 17 nt, Leptospira interrogans serovar lai str. 56601
gcaacggauuccuccag

SEQ ID NO: 756043 - RNA, 13 nt, Leptospira interrogans serovar lai str. 56601
gcgggauuuugau

SEQ ID NO: 756044 - RNA, 22 nt, Leptospira interrogans serovar lai str. 56601
gcguaaggcucgaauuuuuuuc

SEQ ID NO: 756045 - RNA, 21 nt, Leptospira interrogans serovar lai str. 56601
gcucaauccaauauuuaugcu

SEQ ID NO: 756046 - RNA, 16 nt, Leptospira interrogans serovar lai str. 56601
gcucaauauuuaaaaa

SEQ ID NO: 756047 - RNA, 17 nt, Leptospira interrogans serovar lai str. 56601
gcucaaucaaauuuuug

SEQ ID NO: 756048 - RNA, 19 nt, Leptospira interrogans serovar lai str. 56601
gcuacugcaagagagugac

SEQ ID NO: 756049 - RNA, 17 nt, Leptospira interrogans serovar lai str. 56601
gcuacucgaauuuauau

SEQ ID NO: 756050 - RNA, 15 nt, Leptospira interrogans serovar lai str. 56601
gcucagauuccaacu

SEQ ID NO: 756051 - RNA, 17 nt, Leptospira interrogans serovar lai str. 56601
gcucagauuuccuuucu

SEQ ID NO: 756052 - RNA, 18 nt, Leptospira interrogans serovar lai str. 56601
gcucaucauucugaaaaa

SEQ ID NO: 756053 - RNA, 22 nt, Leptospira interrogans serovar lai str. 56601
gcucauaaaaaaaucaagagcc

SEQ ID NO: 756054 - RNA, 19 nt, Leptospira interrogans serovar lai str. 56601
gcucauacauuuuuagaau

SEQ ID NO: 756055 - RNA, 13 nt, Leptospira interrogans serovar lai str. 56601
gcuccaaaaaaau

SEQ ID NO: 756056 - RNA, 17 nt, Leptospira interrogans serovar lai str. 56601
gcuccaaaaaaauaaau

SEQ ID NO: 756057 - RNA, 14 nt, Leptospira interrogans serovar lai str. 56601
gcucgcgaccgcgc

SEQ ID NO: 756058 - RNA, 13 nt, Leptospira interrogans serovar lai str. 56601
gcuaaaauugaau

SEQ ID NO: 756059 - RNA, 20 nt, Leptospira interrogans serovar lai str. 56601
gcuaaaauuuuuuuaagaau

SEQ ID NO: 756060 - RNA, 18 nt, Leptospira interrogans serovar lai str. 56601
gcuaacugauuauaaaaa

SEQ ID NO: 756061 - RNA, 22 nt, Leptospira interrogans serovar lai str. 56601
gcuaauucaaccgcaaauuuuu

SEQ ID NO: 756062 - RNA, 22 nt, Leptospira interrogans serovar lai str. 56601
gcuaauuuccaaacuacaaauu

SEQ ID NO: 756063 - RNA, 19 nt, Leptospira interrogans serovar lai str. 56601
gcuacaauucccauuaaag

SEQ ID NO: 756064 - RNA, 14 nt, Leptospira interrogans serovar lai str. 56601
gcguauaagaaugu

SEQ ID NO: 756065 - RNA, 18 nt, Leptospira interrogans serovar lai str. 56601
gcguuuuauaauaaauug

SEQ ID NO: 756066 - RNA, 23 nt, Leptospira interrogans serovar lai str. 56601
gcguuucguucuuuuuuccuucu

SEQ ID NO: 756067 - RNA, 18 nt, Leptospira interrogans serovar lai str. 56601
gcguguaugguaaaaaua

SEQ ID NO: 756068 - RNA, 15 nt, Leptospira interrogans serovar lai str. 56601
gcgacgauagaagcg

SEQ ID NO: 756069 - RNA, 22 nt, Leptospira interrogans serovar lai str. 56601
gcgcaaucucaagugaugaagu

SEQ ID NO: 756070 - RNA, 15 nt, Leptospira interrogans serovar lai str. 56601
gcgcagcucuuguga

SEQ ID NO: 756071 - RNA, 21 nt, Leptospira interrogans serovar lai str. 56601
gcgauugcgaaagugauccaa

SEQ ID NO: 756072 - RNA, 18 nt, Leptospira interrogans serovar lai str. 56601
gccuuucaccagaauuua

SEQ ID NO: 756073 - RNA, 15 nt, Leptospira interrogans serovar lai str. 56601
gccuuugguauuuua

SEQ ID NO: 756074 - RNA, 16 nt, Leptospira interrogans serovar lai str. 56601
gccuuucuuauuaauu

SEQ ID NO: 756075 - RNA, 15 nt, Leptospira interrogans serovar lai str. 56601
gccuuuuuauuucua

SEQ ID NO: 756076 - RNA, 15 nt, Leptospira interrogans serovar lai str. 56601
gcgacccuagaagcc

SEQ ID NO: 756077 - RNA, 18 nt, Leptospira interrogans serovar lai str. 56601
gcgacaaaaggauuccau

SEQ ID NO: 756078 - RNA, 17 nt, Leptospira interrogans serovar lai str. 56601
gcgaacuuuuuuauaaa

SEQ ID NO: 756079 - RNA, 20 nt, Leptospira interrogans serovar lai str. 56601
gccuucuuuuuucuaaauaa

SEQ ID NO: 756080 - RNA, 16 nt, Leptospira interrogans serovar lai str. 56601
gccuucuuuucaaaag

SEQ ID NO: 756081 - RNA, 14 nt, Leptospira interrogans serovar lai str. 56601
gccuucguuuaaaa

SEQ ID NO: 756082 - RNA, 16 nt, Leptospira interrogans serovar lai str. 56601
gccuucguuuaaaaaa

SEQ ID NO: 756083 - RNA, 23 nt, Leptospira interrogans serovar lai str. 56601
gccuuguguucaucguuccaaac

SEQ ID NO: 756084 - RNA, 12 nt, Leptospira interrogans serovar lai str. 56601
gccuucaauuau

SEQ ID NO: 756085 - RNA, 23 nt, Leptospira interrogans serovar lai str. 56601
gccugccaaaagaacuuugagau

SEQ ID NO: 756086 - RNA, 14 nt, Leptospira interrogans serovar lai str. 56601
gccucauuucuugg

SEQ ID NO: 756087 - RNA, 17 nt, Leptospira interrogans serovar lai str. 56601
gccuauuuuuuuaaaaa

SEQ ID NO: 756088 - RNA, 18 nt, Leptospira interrogans serovar lai str. 56601
gccuaaauuuuuaucaca

SEQ ID NO: 756089 - RNA, 14 nt, Leptospira interrogans serovar lai str. 56601
gccuaaauuccuuc
